US007629444B1

(12) United States Patent
Goldman et al.

(10) Patent No.: US 7,629,444 B1
(45) Date of Patent: Dec. 8, 2009

(54) **NUCLEOTIDE AND AMINO ACID SEQUENCES FROM *XENORHABDUS BOVIENII* STRAIN XS85831 AND USES THEREOF**

(75) Inventors: Barry S. Goldman, St. Louis, MO (US); Karina Krasomil-Osterfeld, Ellisville, MO (US); Wei Wu, St. Louis, MO (US)

(73) Assignee: Monsanto Technology LLC, St. Louis, MO (US)

( * ) Notice: Subject to any disclaimer, the term of this patent is extended or adjusted under 35 U.S.C. 154(b) by 0 days.

(21) Appl. No.: 11/150,804

(22) Filed: Jun. 10, 2005

Related U.S. Application Data

(60) Provisional application No. 60/579,902, filed on Jun. 15, 2004.

(51) Int. Cl.
*C07H 21/02* (2006.01)
*C07H 21/04* (2006.01)
(52) U.S. Cl. .................... 536/23.1; 536/23.7
(58) Field of Classification Search .............. None
See application file for complete search history.

(56) References Cited

U.S. PATENT DOCUMENTS 7,285,632 B2    10/2007    Apel-Birkhold et al.

OTHER PUBLICATIONS

Ngo et al., in The Protein Folding Problem and Tertiary Structure Prediction, 1994, Merz et al. (ed.), Birkhauser, Boston, MA, pp. 433 and 492-495.*
Branden et al. (Introduction to Protein Structure, Garland Publishing Inc., New York, p. 247).*
Witkowski et al., Biochemistry, 38, 11643-11650, 1999.*
Wishart et al., Journal of Biological Chemistry, vol. 270, No. 45, pp. 26782-26785, 1995.*
Kisselev, Structure, vol. 10, pp. 8-9, 2002.*
NCBI Website, BLASTP Accession No. AAC38625 dated Jun. 30, 1998.
NCBI Website, BLASTP Accession No. NP928295 dated May 1, 2009.
NCBI Website, BLASTP Accession No. AAL18483 dated Jul. 17, 2003.
NCBI Website, BLASTP Accession No. ABG33866 dated Oct. 21, 2008.
NCBI Website, BLASTP Accession No. AAL18451 dated Oct. 25, 2001.
NCBI Website, BLASTP Accession No. ABB43160 dated Nov. 5, 2005.
NCBI Website, BLASTP Accession No. NP927868 dated May 1, 2009.
NCBI Website, BLASTP Accession No. CAE12810 dated Apr. 17, 2005.
NCBI Website, BLASTP Accession No. CAE13256 dated Apr. 17, 2005.
NCBI Website, BLASTP Accession No. YP002026051 dated Aug. 5, 2008.
NCBI Website, BLASTP Accession No. YP335902 dated Apr. 30, 2009.
NCBI Website, BLASTP Accession No. ABA52036 dated Sep. 30, 2005.
NCBI Website, BLASTP Accession No. EDO95309 dated Oct. 9, 2007.

\* cited by examiner

*Primary Examiner*—Suzanne M. Noakes
*Assistant Examiner*—Jae W Lee
(74) *Attorney, Agent, or Firm*—Timothy K. Ball; Arnold & Porter LLP

(57) ABSTRACT

The present invention relates to nucleic acid sequences from *Xenorhabdus*, and, in particular, to genomic DNA sequences, and to nucleotide sequences that encode insecticidal proteins from *Xenorhabdus bovienii*, strain Xs85831. The invention encompasses nucleic acid molecules present in non-coding regions as well as nucleic acid molecules that encode proteins, fragments of proteins, tRNA's, fragments of tRNA's, rRNA's, and fragments of rRNA's. In addition, proteins and fragments thereof and antibodies capable of binding specifically to the proteins are encompassed by the present invention. The invention also relates to methods of using the disclosed nucleic acid molecules, proteins, protein fragments, RNA's, and antibodies, for example, for gene identification and analysis, preparation of constructs, and protecting plants from insect infestations.

6 Claims, No Drawings

US 7,629,444 B1

NUCLEOTIDE AND AMINO ACID SEQUENCES FROM *XENORHABDUS BOVIENII* STRAIN XS85831 AND USES THEREOF

CROSS REFERENCE TO RELATED APPLICATIONS

This application claims the benefit of priority to U.S. Provisional Application Ser. No. 60/579,902, filed Jun. 15, 2004, which is incorporated herein by reference in its entirety.

BACKGROUND OF THE INVENTION

1. Field of the Invention

The present invention discloses nucleic acid sequences from *Xenorhabdus bovienii*, methods of using the disclosed nucleic acid sequences to encode proteins and fragments of proteins, antibodies exhibiting binding specificity for the encoded proteins, transformation of cells such as bacterial cells and plant cells with the nucleic acid sequences or derivatives thereof to produce useful *Xenorhabdus* proteins or fragments thereof, including but not limited to insecticidal, bactericidal, fungicidal, nematicidal, antibiotic resistance, and polyketide proteins, and the like.

2. Background of the Invention

*Xenorhabdus* species are Gram-negative bacteria, members of the family Enterobacteriaceae, and symbiotically associated with nematodes species of the genus *Steinernema*. The nematode-bacterial complex can be characterized as an obligate parasitic relationship, specializing in parasitizing and proliferating in soil insect larvae. Infective, non-feeding stages of these nematodes live in soil and carry in their gut the nematode-genus-specific symbiotic strain of *Xenorhabdus* bacteria. It is believed that the nematodes actively search for the appropriate insect host, invade the insect larvae through natural openings or lesions in the cuticle and, once inside the hemolymph, release their symbiotic bacteria. The nematode-bacterial complex secretes a variety of highly efficient extracellular metabolites and proteins exhibiting insecticidal, bactericidal, fungicidal and nematocidal properties that secures the larval mass as a source of nutrition. An array of extracellular enzymes such as lipases, phospholipases, proteases, and nucleases as well as several broad spectrum antibiotics, and antifungal and nematocidal compositions are also secreted (Boemare & Akhurst, J. Gen. Microbiol. 134: 751-761, 1988; Li et al., Can. J. Microbiol. 43(8):770-773, 1997; McInerney et al., J. Nat. Prod. 54(3):774-84, 1991; McInerney et al., J. Nat. Prod. 54(3):785-95, 1991; Sundar and Chang, J. Gen. Microbiol. 139 (Pt 12):3139-48, 1993). It has been discovered that some compounds secreted by *Xenorhabdus* exhibit anti-neoplastic (U.S. Pat. No. 5,827,872), acaricidal, anti-inflammatory and anti-ulcerogenic properties (U.S. Pat. No. 4,837,222). U.S. Pat. No. 6,048,838 describes insect inhibitory proteins that exhibit a molecular weight of greater than 100 kDa produced by *Xenorhabdus* sp., which are active against a variety of insect species including the orders, Lepidoptera, Coleoptera, Diptera, and Acarina, when provided in an insect diet.

*Xenorhabdus* strains have been shown to produce an array of extracellular proteins and small molecules or secondary metabolites exhibiting specialized functions (Li et al., Can. J. Microbiol. 43(8):770-773, 1997; McInerney et al., J. Nat. Prod. 54(3):774-84, 1991; U.S. Pat. No. 6,048,838), as well as proteins and small molecules that are more commercially interesting because they exhibit antibiotic properties or insect inhibitory activity. A small number of insect inhibitory proteins have previously been identified from these bacteria, symbionts of insect-parasitic nematodes (Morgan et al., Appl. Environ. Microbiol., 67(5):2062-2069, 2001; U.S. Pat. No. 6,048,838). Such proteins and compositions are used as biologically safe and effective pest control agents. Unlike chemical pesticide compositions, these proteins appear to have no effect upon the environment in general, can be targeted to direct their effect primarily upon target insect species, and have no effect on non-target species. A resistance management strategy that takes advantage of insect inhibitory proteins derived from distinct microbial sources other than *B. thuringiensis* would be desirable. Insect inhibitory proteins isolated from *Xenorhabdus* bacteria exhibit all the prerequisites for the delivery of novel genes for transgenic expression of insect pest inhibitory proteins in plants to provide pest resistance, expressed either alone or in combination with other insecticidal proteins such as Cry proteins from *Bacillus thuringiensis.*

Therefore, there is a great deal of interest in identifying genes that encode new insect inhibiting proteins, as well as other types of proteins produced by *Xenorhabdus* bacteria, such as proteins involved in the synthesis of novel antibiotics, polyketide synthases, lipases, proteases, nucleases, chitinases, restriction endonucleases, transposons, transposases, excisases, endonucleases, as well as other useful proteins and the like. Isolation and sequencing of the entire genome of *Xenorhabdus* has allowed for the dissection and analysis of the genome into discrete genes encoding proteins exhibiting beneficial properties as described herein.

SUMMARY OF THE INVENTION

The present invention provides an isolated *Xenorhabdus bovienii* strain Xs85831 deposited on Jun. 28, 2000 with the Agriculture Research Culture Collection (NRRL) International Depository Authority at 1815 North University Street, in Peoria, Ill. 61604 U.S.A., according to the Budapest Treaty on the International Recognition of the Deposit of Microorganisms for the Purpose of Patent Procedures and was designated as NRRL-30311. The present disclosure illustrates that this strain exhibits insecticidal activity against commercially important insect species including, e.g., those in the orders Coleoptera [e.g., western corn rootworm WCR, southern corn rootworm SCR, northern corn rootworm NCR, Mexican corn rootworm MCR, brazilian corn rootworm BCR (i.e., *Diabrotica* species) and Lepidoptera [e.g., tobacco budworm (TBW, *Heliothis virescens* Fabricius), cotton bollworm (CBW, *Heliothis zea* Boddie), corn earworm (CEW, *Helicoverpa zea* Boddie), beet armyworm (BAW, *Spodotera exigua* Hübner) and black cutworm (BCW, *Agrotis ipsylon* Hufnagel)]. The strain may also exhibit insecticidal activity against other insects including, e.g., Dipteran, Hemipteran and Hymenopteran insects, or sucking and piercing insects. This strain may be used as a source for DNA sequences encoding insecticidal proteins, and when formulated into a composition of matter as a spray, powder or emulsion, for the treatment of plants or animals to inhibit insect infestation.

The present invention provides isolated and purified nucleic acid molecules isolated from *X. bovienii*, strain Xs85831, selected from the group consisting of SEQ ID NO: 1 through SEQ ID NO:5313 and the complements thereof. These nucleic acid molecules are predicted to encode the polypeptides and amino acid sequences selected from the group consisting of SEQ ID NO:5314 to SEQ ID NO:10626. For clarity, the open reading frame (ORF) set forth in SEQ ID NO:1 encodes an amino acid sequence as set forth in SEQ ID NO:5314; the ORF set forth in SEQ ID NO:2 encodes an amino acid sequence as set forth in SEQ ID NO:5315; and this iteration is continuous with respect to the SEQ ID NO's 1-5313, each respective SEQ ID NO representing a separate and distinct ORF corresponding to the next sequential predicted amino acid sequence as set forth in SEQ ID NO:5314-10626, wherein the ORF as set forth in SEQ ID NO:5313 corresponds to the amino acid sequence as set forth in SEQ ID NO:10626.

The invention further provides a method for isolating a nucleic acid molecule comprising a nucleotide sequence encoding a polypeptide or protein the amino acid sequence of which is at least about 70%, 71, 72, 73, 74, 75, 76, 77, 78, 7, 80, 81, 82, 83, 84, 85, 86, 87, 88, 89, 90, 91, 92, 93, 94, 95, 96, 97, 98, 99, or even about 100% identical to a polypeptide selected from the group consisting of SEQ ID NO:5314 to SEQ ID NO:10626. The method comprises obtaining a nucleic acid encoding all or a substantial portion of an amino acid sequence of a *Xenorhabdus* protein homologue comprising: (a) probing a library with a hybridization probe comprising a nucleotide sequence selected from the group consisting of SEQ ID NO:1 through SEQ ID NO:5313; (b) identifying a DNA segment that hybridizes to the probe; (c) isolating the DNA segment identified in step (b); and (d) sequencing the DNA segment isolated in step (c) wherein the sequenced DNA segment encodes all or a substantial portion of a *Xenorhabdus* protein homologue.

The present invention also provides a substantially purified polypeptide or protein comprising an amino acid sequence selected from the group consisting of SEQ ID NO:5314 to SEQ ID NO:10626. In a preferred embodiment, the amino acid sequence is at least about 70% 70%, 71, 72, 73, 74, 75, 76, 77, 78, 7, 80, 81, 82, 83, 84, 85, 86, 87, 88, 89, 90, 91, 92, 93, 94, 95, 96, 97, 98, 99, or even about 100% identical to a polypeptide selected from the group consisting of SEQ ID NO:5314 to SEQ ID NO:10626.

The present invention also provides in the sequence listing a selected group of sequences that exhibit properties of bacterial promoter sequences (SEQ ID NO:10627-SEQ ID NO:13014), sequences that exhibit properties of bacterial termination sequences (SEQ ID NO:13015-SEQ ID NO:14450), and sequences that exhibit homology or identity to bacterial tRNA coding sequences (SEQ ID NO:14451-14541). Contiguous sequences have been assembled from overlapping sequences that contain any or all of the above mentioned SEQ ID NO's and are set forth herein as contigs in the sequence listing form SEQ ID NO:14542 through SEQ ID NO:14985.

The present invention also provides for recombinant expression constructs comprising: (1) a promoter, which functions in a host cell to cause the production of a mRNA molecule; which is operably linked to (2) a structural nucleotide sequence encoding an insecticidal protein selected from the group consisting of SEQ ID NO: 7316, 9584, 9585, 9639 and 9679; which is operably linked to (3) a 3' sequence that functions in said cell to cause termination of transcription.

The present invention also provides a recombinant construct comprising: (1) a promoter, which functions in a host cell to cause the production of a mRNA molecule; which is operably linked to (2) a structural nucleotide sequence selected from the group consisting of SEQ ID NO:1 to SEQ ID NO:5313; which is operably linked to (3) a 3' non-translated sequence that functions in said cell to cause termination of transcription.

The present invention provides a recombinant construct comprising: (1) a promoter, which functions in a host cell to cause the production of a mRNA molecule; which is operably linked to (2) a structural nucleotide sequence encoding a polypeptide selected from the group consisting of SEQ ID NO:5314 through SEQ ID NO:10626; which is operably linked to (3) a 3' non-translated sequence that functions in said cell to cause termination of transcription.

A transformed cell is provided that expresses a chimeric or heterologous nucleic acid molecule which comprises: (1) a promoter, which functions in said cell to cause the production of a mRNA molecule; which is operably linked to (2) a structural nucleic acid molecule selected from the group consisting of SEQ ID NO: 2003, 4271, 4272, 4326 and 4366; which is operably linked to (3) a 3' sequence that functions in said cell to cause termination of transcription. The structural nucleic acid molecule encodes an insecticidal protein.

A plant cell, a mammalian cell, a bacterial cell, an algal cell, an insect cell and a fungal cell transformed with an isolated nucleic acid molecule of the present invention is provided, wherein the nucleic acid molecule is selected from the group consisting of SEQ ID NO:1 through SEQ ID NO:5313, or SEQ ID NO:14451 through SEQ ID NO:14541, or the complement thereof.

Isolated nucleic acid molecules are provided comprising nucleotide sequences encoding polypeptides or proteins exhibiting insect inhibitory activity, wherein the activity is manifested by inhibiting the growth or development of, or contributing substantially to, or causing the death of a Coleopteran, a Dipteran, a Lepidopteran, a Hemipteran, a Hymenopteran, or a sucking and piercing insect or insect larvae thereof. Also provided are nucleotide sequences encoding novel proteins comprising polypeptides which augment the activity of polypeptides exhibiting insect inhibitory activity when fed to Coleopteran, Dipteran, Lepidopteran, Hemipteran, Hymenopteran, or sucking and piercing insects or insect larvae thereof.

A method for using an insect inhibitory protein isolated from *X. bovienii*, strain Xs85831, is provided. The protein is useful for controlling target insect pests in a plant, wherein the insect inhibitory protein comprises a polypeptide sequence that is selected from the group consisting of SEQ ID NO's: 7316, 9584, 9585, 9639 and 9679. The method comprises the steps of: a) introducing into the genome of the plant an exogenous nucleic acid, wherein the exogenous nucleic acid comprises in the 5' to 3' direction i) a promoter that functions in the cells of said plant, said promoter operably linked to; ii) a structural nucleotide sequence encoding a polypeptide or protein the amino acid sequence of which is substantially identical to a sequence selected from the group consisting of SEQ ID NO's: 7316, 9584, 9585, 9639 and 9679, said structural nucleic acid sequence operably linked to; iii) a 3' non-translated nucleic acid sequence that functions in said cells of said plant to cause transcriptional termination; b) obtaining transformed plant cells containing the nucleic acid sequence of step (a); and c) regenerating from said transformed plant cells a transformed plant in which said polypeptide or protein is overexpressed.

A computer readable medium is provided having recorded thereon one or more of the nucleotide sequences depicted in SEQ ID NO:1 through SEQ ID NO:14985 or with respect to the nucleotide sequences therein, the complements thereof, useful at least as a library of information that can be searched for sequences that are or are substantially identical to the sequences within the library with reference to a query sequence. The computer readable medium can also be used to select sequences for use as probes or primers for identifying and/or detecting in a biological sample the presence of a probe or primer sequence or sequence between primer pairs.

BRIEF DESCRIPTION OF THE SEQUENCES

The sequences disclosed herein have been provided under 37 CFR §1.821-1.825 on CD-ROM diskette. A copy of the Sequence Listing referred to herein is submitted in computer readable form (CRF) on CD-ROM diskette in accordance with the requirements of 37 CFR §1.821(e) and 37CFR §1.52(e) and on two additional diskettes labeled as Copy 1 and Copy 2 respectively. The Sequence Listing in CRF is incorporated herein by reference in its entirety. The contents of the Sequence Listing (CRF) and the two additional CD-ROM diskettes labeled Copy 1 and Copy 2 are the same, and each contains a single 25.023 megabyte text file labeled as Xeno53444_seqListing.txt created with PatentIn version 3.0 software or the equivalent thereof on Jun. 8, 2005, the content of which passed the scrutiny of the USPTO PatentIn Checker software version 1.0.0.1.

Nucleotide sequences from SEQ ID NO:1 to SEQ ID NO:5313 as set forth in the Sequence Listing represent predicted open reading frames encoding peptides that are set forth at SEQ ID NO:5314 to SEQ ID NO:10616. SEQ ID NO:1 represents a predicted ORF, the amino acid sequence translation of which corresponds to the peptide sequence as set forth at SEQ ID NO:5314. Each sequential SEQ ID NO, 2 through 5313, represents a separate predicted ORF, the amino acid sequence of which is set forth at SEQ ID NO:5315-SEQ ID NO:10616. The peptide sequence corresponding to any given nucleotide sequence set forth at SEQ ID NO:1-SEQ ID NO:5313 can be quickly identified by adding 5313 to the number of the SEQ ID NO. For example, the peptide sequence corresponding to the nucleotide sequence ORF as set froth at SEQ ID NO: 201 can be quickly identified by adding 5313 to 201 to arrive at SEQ ID NO:5514. Most SEQ ID NO's corresponding to nucleotide sequences are also identified herein as being present in a contiguous nucleotide sequence representing a large segment of the *Xenorhabdus* genome. The contiguous sequences, individually referred to herein as a CONTIG, or collectively as CONTIGS, are set forth herein as SEQ ID NO:14542-SEQ ID NO:14985. Each nucleotide sequence in the Sequence Listing that corresponds to a position or segment within any CONTIG sequence is associated with that CONTIG by reference to the CONTIG in one or more feature fields <220> and <223> within the SEQ ID NO reference fields. For example, SEQ ID NO:1 contains feature field information that indicates that the coding sequence or nucleotide sequence as set forth in SEQ ID NO:1 is also referred to as "Xb4151_4152.C1.gene1.dna". "Xb4151_4152.C1.gene1.dna" refers in part to the CONTIG, identified as "Xb4151_4152.C1", or SEQ ID NO:14542. SEQ ID NO:1 is descriptive of an ORF from nucleotide position 32-556 as set forth in SEQ ID NO:14542. The ORF as set forth in SEQ ID NO:1 corresponds to the reverse complement of the specified nucleotide segment within SEQ ID NO:14542. Each CONTIG contains multiple coding sequences and multiple genes. The sense or antisense direction of an ORF or other coding sequence is identified in a Feature Field by either a "+" or a "−" illustrating whether the nucleotide sequence specified by a given SEQ ID NO exhibits the same sequence ("+") as that illustrated in the CONTIG sequence or the reverse complement sequence ("−") thereof.

Amino acid sequences predicted to be encoded from the ORF nucleotide sequences contain feature fields that are populated with comments describing the results of BLASTP searches that yielded specific information about the identity or similarity of the predicted amino acid sequence with reference to known amino acid sequences. This information is often referred to as the annotation information for a given amino acid sequence. For many of the amino acid sequences as set forth from SEQ ID NO:5314-SEQ ID NO:10626, similar amino acid sequences or "hits" were readily identifiable using one or more BLASTP search algorithm specified hereinbelow. For those amino acid sequences for which hits were identified, information is provided with respect to the gene classification, the predictive function of the protein, the functional class of the protein family if any that the predicted protein may belong to, the portion of the query sequence (the predicted amino acid sequence as set forth in the SEQ ID NO) that resulted in the identification of the hit, the portion of the hit sequence that resulted in the closest match being established, the BLASTP score, the relative percent identity or similarity, if any, and the database sequence identifier for the hit sequence whether from SWISSPROT, GENBANK, or otherwise, as well as any other information that may be believed to be relevant to identification and classification of the amino acid sequence presented within each SEQ ID NO.

*Xenorhabdus* Xs85831 nucleotide sequences corresponding to predicted bacterial consensus promoter sequences upstream from various ORF's or other genes identified in the instant invention are set forth in the Sequence Listing from SEQ ID NO:10627 through SEQ ID NO:13014. The position of these predicted promoter sequences within any given CONTIG is also specified as indicated above, along with any information about orientation of the promoter with respect to the CONTIG sequence.

Translational termination sequences are relatively simple sequences in bacterial systems, and *Xenorhabdus* Xs85831 termination sequences appear to fall within these consensus identification rules. Such termination sequences are set forth in the Sequence Listing from SEQ ID NO:13015 through SEQ ID NO:14450

Nucleotide sequences corresponding to predicted genes encoding various tRNA homologs from *Xenorhabdus* Xs85831 and their annotations are set forth in the Sequence Listing from SEQ ID NO:14451 through SEQ ID NO:14541.

In summary, the following list is a brief description of the blocks of sequences as set out in the Sequence Listing.

SEQ ID NO:1 through SEQ ID NO:5313 represent predicted open reading frames that have been isolated and characterized from the genome of *X. bovienii*, strain Xs85831.

SEQ ID NO:5314 through SEQ ID NO:10626 represent the predicted amino acid sequence translation of each of the above specified open reading frames.

SEQ ID NO:10627 through SEQ ID NO:13014 represent predicted promoter nucleotide sequences isolated and characterized from the genome of *X. bovienii*, strain Xs85831.

SEQ ID NO:13015 through SEQ ID NO:14450 represent predicted translational termination sequences isolated and characterized from the genome of *X. bovienii*, strain Xs85831.

SEQ ID NO:14451 through SEQ ID NO:14541 represent nucleotide sequences predicted to encode various tRNA and rRNA isolated and characterized from the genome of *X. bovienii*, strain Xs85831.

SEQ ID NO:14542 through SEQ ID NO:14985 represent contiguous sequences of the genome of *X. bovienii*, strain Xs85831 specified herein as CONTIG sequences assembled as a result of overlapping individual nucleotide sequences using bioinformatic methods.

DETAILED DESCRIPTION OF THE INVENTION

In accordance with the present invention, novel nucleic acid molecules have been isolated from a bacterium *Xhenorhabdus. bovienii*, strain Xs85831. Polypeptides or proteins, tRNA and rRNA encoded from the novel nucleotide sequences are also provided. Isolated nucleic acid molecules comprising regulatory elements that include promoter and translational termination sequences are also provided. The present invention provides isolated nucleic acid molecules that encode a class of proteins that exhibit insect inhibitory activity, wherein the activity is manifested by inhibiting the growth or development of, or contributing substantially to, or causing the death of an insect, such as a Coleopteran, a Dipteran, a Lepidopteran, a Hemipteran, a Hymenopteran, or a sucking and piercing insect. Those skilled in the art will find utility of these insecticidal proteins in protecting plants from insect infestations, and in formulations for preventing insect infestations.

In another embodiment, the present invention provides isolated nucleic acid molecules that encode a class of proteins or polypeptides that are useful in providing compositions comprising, e.g., insect inhibitory proteins, microbial inhibitory proteins including bactericidal and fungistatic proteins, nematocidal and protein homologs of chitinases, histones and restriction enzymes, proteases, proteins capable of conferring resistance to heavy metals or other toxic compositions, polyketide synthases, antibiotic, cellular functions, restriction endonucleases, proteases, chitinases, lipases, cellulases, metabolic functions, catabolic functions, anabolic functions, regulatory proteins, transcription and translation proteins, and transposases, among others.

In still another embodiment, the present invention relates to methods of obtaining the disclosed nucleic acid molecules and proteins and of using the disclosed nucleic acid molecules, proteins, fragments of proteins, and antibodies, for example, for gene identification and analysis, preparation of constructs, transformation of cells with nucleotide compositions disclosed herein to produce *Xenorhabdus* proteins or fragments thereof, in particular novel insect inhibitory, bactericidal, fungicidal and nematocidal proteins.

The inventors have identified a strain of *Xenorhabdus* bacteria that exhibits novel insecticidal properties, and based on this observation, have identified the nucleotide sequence of the genomic DNA of the bacterial strain in order to more fully understand the basis of the novel insecticidal properties exhibited by the organism. In identifying the nucleotide sequence of the genome of the bacterium, the inventors identified numerous sequences that overlap at least partially with numerous other sequences, enabling the construction of very large contiguous sequences representing the organizational and structural topology of the genome of the organism, which is then used to compare to other large genomes that have been previously sequenced. In addition, the nucleotide sequences were searched for the presence of various elements, including but not limited to open reading frames (ORF's) encoding proteins, promoter sequences, sequences encoding tRNA and rRNA sequences identified based either on their identity or similarity to other related sequences from other organisms already known in the art, and the like. Such sequences have provided information about how the *Xenorhabdus bovienii* organism of the present invention is able to function in its symbiotic relationship with its commensurate *Steinernema* nematode host, how it is able to fully encompass the biosphere of a target organism in order to establish a pristine environment for the growth and proliferation of its commensurate *Steinernema* nematode host, and information about biological properties that may be useful in medicinal, pharmaceutical, veterinary, and even general household use, as well as enzymes and other molecules that may be useful in diagnostics and research investigations. The following description characterizes a number of the features identified by analysis and characterization of the individual coding sequences of the genome of *Xenorhabdus bovienii* strain Xs85831.

The term "an isolated nucleic acid" refers to a nucleic acid that is no longer accompanied by some of materials with which it is associated in its natural state or to a nucleic acid the structure of which is not identical to that of any of naturally occurring nucleic acid. Examples of an isolated nucleic acid include: (1) DNAs which have the sequence of part of a naturally occurring genomic DNA molecules, but are not flanked by two coding sequences that flank that part of the molecule in the genome of the organism in which it naturally occurs; (2) a nucleic acid incorporated into a vector or into the genomic DNA of a prokaryote or eukaryote in a manner such that the resulting molecule is not identical to any naturally occurring vector or genomic DNA; (3) a separate molecule such as a cDNA, a genomic fragment, a fragment produced by polymerase chain reaction (PCR), or a restriction fragment; (4) recombinant DNAs; and (5) synthetic DNAs. An isolated nucleic acid may also be comprised of one or more segments of cDNA, genomic DNA or synthetic DNA.

Stringent conditions are sequence dependent and will be different in different circumstances. Generally, stringent conditions are selected to be about 5° C. lower than the thermal melting point (Tm) for the specific sequence at a defined ionic strength and pH. The Tm is the temperature (under defined ionic strength and pH) at which 50% of the target sequence hybridizes to a perfectly matched probe. Appropriate stringent conditions are known to those skilled in the art or can be found in *Current Protocols in Molecular Biology*, John Wiley & Sons, N.Y. 6.3.1-6.3.6 (1989). For the purposes of this disclosure, stringent conditions include at least one wash (usually 2) in 0.2×SSC at a temperature of at least about 50° C., usually about 55° C., for 20 minutes, or equivalent conditions.

The hybridizing portion of two different but at least partly complementary nucleic acids is at least about 20 nucleotides in length, or about 50 nucleotides in length, or least about 75 nucleotides in length, or even at least about 100 nucleotides or longer. As used herein, the hybridizing portion a given nucleic acid sequence or segment exhibits at least from about 70% to about 100% identity to a portion of a sequence as set forth in SEQ ID NO:1 to SEQ ID NO:5313, or any sequence as set forth in SEQ ID NO:10617 to SEQ ID NO:14985.

As used herein, an "open reading frame" (ORF) is a segment of a nucleotide sequence that encodes a polypeptide. Open reading frames in genomic sequences can be screened for the presence of protein homologues utilizing one or a number of different search algorithms that have been developed, one example of which are the suite of programs referred to as BLAST programs. Nucleic acids derived from *Xenorhabdus* species of bacteria commonly symbiotically associated with insect pathogenic *Steinernema* nematodes are surprisingly useful in providing compositions comprising insect inhibitory proteins, microbial inhibitory proteins including bactericidal, bacteriostatic, fungicidal, and fungistatic proteins, protein homologs of chitinases, histones and restriction enzymes, proteases, proteins capable of conferring resistance to heavy metals or other toxic compositions, proteins and compositions capable of conferring pharmaceutical advantages such as antineoplastic, acaricidal, anti-inflammatory and anti-ulcerogenic properties, polyketide synthases, transposons and mobile genetic elements and their corresponding transposases, excisases, integrases, and invertases, phage and phage particle proteins, other useful proteins homologous to proteins derived from *Xenorhabdus, Photorhabdus, Serratia, Yersinia, Salmonella, E. coli,* and *Erwinia* sp. among others. In addition, antibodies directed to the above-mentioned proteins and fragments thereof have been discovered to be of particular utility in the present invention.

The present invention provides an isolated protein having an amino acid sequence that is substantially identical to a member selected from group consisting of SEQ ID NO:5314 through SEQ ID NO:10626. By "substantially identical" or "substantial identity" as used in reference to two amino acid sequences, it is meant that one amino acid sequence is identical to the other amino acid sequence or exhibits at least about 50% sequence identity, at least about 70% sequence identity, at least about 80%, at least about 90%, or at least about 95% identity or greater, or any range in between, when compared to another amino acid sequence as a reference sequence using the programs described herein, preferably BLASTP using standard parameters, as described below. "Sequence identity" is determined by comparing two optimally aligned sequences over a comparison window, wherein the portion of the polynucleotide sequence in the comparison window may comprise additions or deletions (i.e., gaps) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison and multiplying the result by 100 to yield the percentage of sequence identity.

Polypeptides that are substantially similar share sequences in which residue positions are not identical and may differ by conservative amino acid changes. Conservative amino acid substitutions refer to the interchangeability of residues having similar side chains. "Conservative amino acid substitutions" refer to substitutions of one or more amino acids in a native amino acid sequence with another amino acid(s) having similar side chains, resulting in a silent change. Conserved substitutes for an amino acid within a native amino acid sequence can be selected from other members of the group to which the naturally occurring amino acid belongs.

Optimal alignment of sequences for comparison can use any means to analyze sequence identity (homology) known in the art, e.g., by the BLAST algorithm (Altschul et al, J. Mol. Biol. 215: 403-410, 1990) that is suitable for determining sequence similarity; by the progressive alignment method of termed "PILEUP" (Morrison, Mol. Biol. Evol. 14:428-441, 1997); and by the local homology algorithm of Smith & Waterman (Adv. Appl. Math. 2: 482, 1981). Software for performing BLAST analyses is publicly available through the National Center for Biotechnology Information (NCBI). One measure of similarity provided by the BLAST algorithm is the smallest sum probability (P(N)), which provides an indication of the probability by which a match between two nucleotide or amino acid sequences would occur by chance. For example, a nucleic acid is considered similar to a reference sequence if the smallest sum probability in a comparison of the test nucleic acid to the reference nucleic acid is less than about 0.1, more preferably less than about 0.01, and most preferably less than about 0.001.

One skilled in the art will recognize that a value of sequence identity can be appropriately adjusted to determine corresponding sequence identity of two nucleotide sequences encoding the proteins of the present invention by taking into account codon degeneracy, conservative amino acid substitutions, reading frame positioning and the like. Substantial identity of nucleotide sequences for these purposes normally means sequence identity between at least two different sequences exhibiting at least about 50%, at least about 60%, at least about 70%, at least about 80%, at least about 90%, or at least about 95% or greater or any range inbetween to a reference sequence or to each other.

The isolated nucleic acid molecule of the present invention can encode an insect inhibitory protein. In particular, the amino acid sequences as set forth at SEQ ID NO:7316, SEQ ID NO:9584, SEQ ID NO:9585, SEQ ID NO:9639 and SEQ ID NO:9679 each respectively encoded by the nucleotide sequences as set forth at SEQ ID NO:2003, SEQ ID NO:4271, SEQ ID NO:4272, SEQ ID NO:4326 and SEQ ID NO:4366 encode insecticidal proteins. The term "insecticidal" or "insect inhibitory protein" refers to any polypeptide or protein or portion thereof that exhibits insect inhibitory activity when provided in the diet of a target insect. The activity may be manifested by an observation that the presence of the insecticidal agent inhibits the growth or development of, or the contributes substantially to, or causes the death of a Coleopteran, a Dipteran, a Lepidopteran, a Hemipteran, a Hymenopteran, or a sucking and piercing insect, or any combination thereof, and includes any polypeptide or protein derived from the above mentioned sequences, whether the sequence has been mutated, truncated, contains an insertion or deletion, or otherwise, so long as the agent maintains at least the insect inhibitory activity associated with the native composition. Accordingly, the isolated nucleic acids encoding those polypeptide or protein with such modification are also within the scope of the present invention.

The insect inhibitory proteins of the present invention have been shown by BLAST analysis to exhibit homology to other previously identified *Xenorhabdus* or *Photorhabdus* insecticidal proteins. For instance, the polypeptide sequence as set forth in SEQ ID NO:7316 exhibits about 60% amino acid sequence homology to an insecticidal toxin complex protein TcaC from *Photorhabdus luminescens laumondii*. The polypeptide sequence as set forth in SEQ ID NO:9584 exhibits 81% amino acid sequence homology to an insecticidal toxin A2 from *Xenorhabdus nematophila*. The polypeptide sequence as set forth in SEQ ID NO:9585 exhibits 57% amino acid sequence homology to an insecticidal toxin complex protein TcaC from *Photorhabdus luminescens*. The polypeptide sequence as set forth in SEQ ID NO:9639 exhibits 69% amino acid sequence homology to an insecticidal toxin complex protein TcdB1 from *Photorhabdus luminescens laumondii*. The polypeptide sequence as set forth in SEQ ID NO:9679 exhibits 69% amino acid sequence homology to an insecticidal toxin complex protein TccC from *Photorhabdus luminescens*.

There is growing interest within the medical sciences in the potential utility of purified mammalian antibodies in the diagnosis and treatment of disease. For example, tagged antibodies directed against tumor cell surface antigens provide a highly sensitive and specific means for detecting and classifying various cancers. One therapeutic application using antibodies involves the administration of purified tumor-specific antibodies that are chemically coupled to cytotoxic agents. A class of cytotoxins that holds particular promise in the treatment of cancers consists of protein toxins from plants. However, progress in the treatment of cancers using chemically coupled antibodies and cytotoxins has been impeded by the lack of a cost effective means for producing these molecules in a pharmaceutically acceptable grade and in commercially acceptable quantities. Cytotoxin homologs may be overexpressed in plants and large quantities of the cytotoxin proteins may be produced, isolated and purified from the plants. These purified plant toxins may be used as a therapeutic agents. Cytotoxin protein homologues have been identified from sequences present in the genome of the Xenorhabdus strain Xs85831. Cytotoxin protein homologues are represented by the amino acid sequences as set forth in the following sequences: SEQ ID NO:5524, SEQ ID NO:5845, SEQ ID NO:5846, SEQ ID NO:5901, SEQ ID NO:5932, SEQ ID NO:5975, SEQ ID NO:6700, SEQ ID NO:7023, SEQ ID NO:7373, SEQ ID NO:7374, SEQ ID NO:7375, SEQ ID NO:7377, SEQ ID NO:7563, SEQ ID NO:7877, SEQ ID NO:8566, SEQ ID NO:8624, SEQ ID NO:8632, SEQ ID NO:8721, SEQ ID NO:8735, SEQ ID NO:9429, SEQ ID NO:9628, SEQ ID NO:9704, SEQ ID NO:9738, SEQ ID NO:9774, SEQ ID NO:9777, SEQ ID NO:9779, SEQ ID NO:9833, SEQ ID NO:10005, SEQ ID NO:10322, SEQ ID NO:10368, SEQ ID NO:10598 and SEQ ID NO:10605.

Polyketides are small bioactive molecules that are a class of small compounds linked by their biosynthetic pathways. The pathways and their products are particularly abundant in soil microorganisms. A large number of major pharmaceutical and agricultural products have been derived from these complex natural products including insecticides, fungicides, antibacterials, anti-inflammatory, cancer-fighting agents, and cholesterol-lowering agents. Examples of polyketides include Rifamycins (Rifampin), Adriamycin (Doxorubicin), Erythromycin, Mevacor (Lovastatin), Ascomycin (Immunomycin), and Spinosad. Polyketides are produced by large proteins referred to as polyketide synthases (or synthetases). There are an extraordinary number of polyketides synthase genes in the genome of Xenorhabdus bovienii strain Xs85831. In addition to polyketide synthases Xenorhabdus also contains an extraordinary number of related proteins referred to as non-ribosomal peptide synthases (NRP synthase). These proteins also generate small molecules with a variety of biochemical functions. It is possible that any of these genes can be placed into the genome of a plant to produce a substance (polyketide or non-ribosomal peptide) that can protect a plant against damage from insects, fungi, or bacteria. In addition, these genes can be placed in plants to generate polyketides or non-ribosomal peptides for other uses including pharmaceuticals. Polyketide synthase protein homologues have been identified in the genome of the present invention and are set forth at SEQ ID NO:6034, SEQ ID NO:6035, SEQ ID NO:6037, SEQ ID NO:6038, SEQ ID NO:6040, SEQ ID NO:6041, SEQ ID NO:6042, SEQ ID NO:6817, SEQ ID NO:7170, SEQ ID NO:7360, SEQ ID NO:7361, SEQ ID NO:7362, SEQ ID NO:7363, SEQ ID NO:7550, SEQ ID NO:8093, SEQ ID NO:8094, SEQ ID NO:8095, SEQ ID NO:8186, SEQ ID NO:8686, SEQ ID NO:8687, SEQ ID NO:9049, SEQ ID NO:9100, SEQ ID NO:9101, SEQ ID NO:9104, SEQ ID NO:9108, SEQ ID NO:9322, SEQ ID NO:9324, SEQ ID NO:10039, SEQ ID NO:10228, SEQ ID NO:10229, SEQ ID NO:10257 and SEQ ID NO:10258.

Proteases play very important roles in an organism's metabolism and proteins synthesis and several types of proteases have been reported. A processing protease is a protease that cleaves a propeptide to generate a mature biochemically active polypeptide (Enderlin and Ogrydziak, Yeast 10:67-79, 1994). Serine protease is required for intramitochondrial proteolysis and maintenance of respiratory function. Ubiquitin-specific protease (ubiquitin C-terminal hydrolase) of the 26S proteasome complex is involved in vacuole biogenesis and osmoregulation. Inner membrane protease of mitochondria acts in complex with IMP1P but has different substrate specificity for removal of signal peptidase serine protease of the subtilisin family with broad proteolytic specificity (U.S. Pat. No. 6,723,837). A number of protease homologues were identified as being encoded from various genes in the genome of Xenorhabdus bovienii strain Xs85831 as set forth in the sequence listing at SEQ ID NO:5589, SEQ ID NO:5625, SEQ ID NO:5958, SEQ ID NO:5959, SEQ ID NO:6156, SEQ ID NO:6298, SEQ ID NO:6300, SEQ ID NO:6404, SEQ ID NO:6530, SEQ ID NO:6602, SEQ ID NO:6839, SEQ ID NO:7599, SEQ ID NO:7682, SEQ ID NO:7706, SEQ ID NO:7735, SEQ ID NO:7737, SEQ ID NO:7941, SEQ ID NO:7999, SEQ ID NO:8072, SEQ ID NO:8137, SEQ ID NO:8267, SEQ ID NO:8568, SEQ ID NO:9284, SEQ ID NO:9336, SEQ ID NO:9368, SEQ ID NO:9729, SEQ ID NO:9921, SEQ ID NO:9984, SEQ ID NO:10021, SEQ ID NO:10022, SEQ ID NO:10143, SEQ ID NO:10201, SEQ ID NO:10263, SEQ ID NO:10327, SEQ ID NO:10371, SEQ ID NO:10372, SEQ ID NO:10411, SEQ ID NO:10412, SEQ ID NO:10413, SEQ ID NO:10430, SEQ ID NO:10580 and SEQ ID NO:10582.

A chitinase is one of several classes of antifungal proteins that include chitinases, defensins, cysteine-rich chitin-binding proteins, β-1,3-glucanases, permatins (including zeamatins), thionins, ribosome-inactivating proteins, and non-specific lipid transfer proteins (U.S. Pat. No. 6,573,361). A number of chitinase or related homologues were identified as being encoded from various genes in the genome of Xenorhabdus bovienii strain Xs85831 as set forth in the sequence listing at SEQ ID NO:6895, SEQ ID NO:8218, SEQ ID NO:8222, SEQ ID NO:10427 and SEQ ID NO:10583.

"Restriction enzyme" refers to an enzyme that recognizes a specific palindromic or other sequence of nucleotides in double stranded DNA and cleaves both strands. Nucleotide sequences encoding unique restriction enzymes and their corresponding modification methylase homologues are useful in the biological arts. A number of restriction enzymes and modification methylases and proteins homologous to such enzymes were identified as being encoded from various genes in the genome of Xenorhabdus bovienii strain Xs85831 as set forth in the sequence listing at SEQ ID NO:6835, SEQ ID NO:7488, SEQ ID NO:8128, SEQ ID NO:8129, SEQ ID NO:8132, SEQ ID NO:8901, SEQ ID NO:8902, SEQ ID NO:8903 and SEQ ID NO:9854.

Histones are abundant and required for DNA organization in all eukaryotes. Genes with homology to histones and proteins that affect histones, such histone deacetylases may affect histones in insects, disrupting normal cellular processes. Histones have not previously been found in bacteria. Surprisingly, various genes capable of encoding histone and histone deacetylase homologous proteins were found to be present in the genome of Xenorhabdus bovienii strain Xs85831 as set forth in the sequence listing at SEQ ID NO:5672, SEQ ID NO:5923, SEQ ID NO:6188, SEQ ID NO:7790, SEQ ID NO:7816, SEQ ID NO:7835, SEQ ID NO:8060, SEQ ID NO:9246, SEQ ID NO:9672, SEQ ID NO:9907, SEQ ID NO:9916, SEQ ID NO:10115, SEQ ID NO:10199, SEQ ID NO:10517 and SEQ ID NO:10540.

Ferritin homologuous proteins are encoded by various open reading frames within the genome of Xenorhabdus bovienii strain Xs85831 as set forth in the sequence listing at SEQ ID NO:5769, SEQ ID NO:5770, SEQ ID NO:6289 and SEQ ID NO:7552. These proteins may be used for overexpression in plants, resulting in an increase in resistance to abiotic and biotic oxidative stresses. Overexpression of ferritin promotes cellular productivity during limited water conditions to prevent formation of oxygen radicals (US Pat. Appl. Pub. No. 20030233670).

Biopolymer transport protein homologues were identified as being expressible from the genome of *Xenorhabdus bovienii* strain Xs85831 as set forth at SEQ ID NO:5799, SEQ ID NO:5801, SEQ ID NO:5802, SEQ ID NO:10481 and SEQ ID NO:10482.

Protein homologues capable of conferring resistance to heavy metals were identified from translation of open reading frames in *Xenorhabdus bovienii* strain Xs85831 as set forth in SEQ ID NO:6291, SEQ ID NO:6521, SEQ ID NO:7064, SEQ ID NO:7069, SEQ ID NO:7726, SEQ ID NO:7727, SEQ ID NO:7729, SEQ ID NO:7962, SEQ ID NO:8108, SEQ ID NO:8284, SEQ ID NO:10189, SEQ ID NO:10190, SEQ ID NO:10326 and SEQ ID NO:10406. Such proteins may be introduced into crop plants to provide for resistance to heavy metals (U.S. Pat. No. 6,426,447).

Helicases are proteins involved in unwinding DNA. HrpA hlicase is associated with the plant pathogenic bacteria *Pseudomonas syringae*. Hrp-like helicase homologues were identified from translation of *Xenorhabdus bovienii* strain Xs85831 coding sequences. SEQ ID NO:8465 and SEQ ID NO:10227 may represent HrpA helicases of *Xenorhabdus* that could be useful in plant DNA metabolism for improving plant transformation or as a herbicide to affect DNA metabolism or gene regulation in plants.

Coding sequences encoding an *Anopheles* mosquito species homologous protein were identified from the genome of *Xenorhabdus bovienii* strain Xs85831 as set forth in SEQ ID NO:9502 and SEQ ID NO:9512. Bacteria do not normally have genes encoding proteins that exhibit high homology to insect proteins, so it is possible that these proteins may be associated with pathogenesis of mosquitos. These and other proteins such as histones and histone deacetylases may be acting during pathogenesis and/or infection of an insect by the *Steinernema/Xenorhabdus* complex to destroy or redirect insect regulatory pathways.

As used herein, the term "promoter" or "promoter sequence" refers to a nucleotide sequence that, when located in cis to a structural nucleotide sequence encoding a polypeptide, protein, RNA or otherwise, functions in a way that directs expression of one or more mRNA or other RNA molecules that encodes the polypeptide or protein or that folds into a structure that is used for structural or functional purposes such as a tRNA or a rRNA. Such promoter regions are typically found upstream of the trinucleotide, ATG, at the start site of a polypeptide-coding region. Promoter molecules can also include DNA sequences from which transcription of tRNA or rRNA sequences are initiated. Promoter sequences or regulatory elements identified from the genome of *Xenorhabdus bovienii* strain Xs85831 are set forth at SEQ ID NO:10627 through SEQ ID NO:13014.

The term "terminator sequence" refers to a nucleotide sequence that is required for the termination reaction of the transcription process. Termination involves recognition of the point at which no further bases should be added to a growing RNA chain. To terminate transcription, the formation of phosphodiester bonds must cease and the transcription complex must come apart. When the last base is added to the RNA chain, the RNA-DNA hybrid is disrupted, the DNA reforms into a duplex state, and the RNA polymerase enzyme and RNA molecule are both released from the DNA. Terminator sequences identified from the genome of *Xenorhabdus bovienii* strain Xs85831 are set forth at SEQ ID NO:13015 through SEQ ID NO:14450.

Sequences encoding ribosomal RNA (rRNA) and transfer RNA (tRNA) molecule homologous sequences were identified from an examination of *Xenorhabdus bovienii* strain Xs85831 genome sequences and are set forth at SEQ ID NO:14451 through SEQ ID NO:14541.

A "substantial portion" of a nucleotide sequence comprises enough of the sequence to afford specific identification and/or isolation of a nucleic acid fragment comprising the sequence. In general, gene specific oligonucleotide probes comprising 20-30 contiguous nucleotides may be used in sequence-dependent methods of gene identification (e.g., Southern hybridization) and isolation (e.g., in situ hybridization of bacterial colonies or bacteriophage plaques). In addition, short oligonucleotides of 12-15 bases may be used as amplification primers in PCR in order to obtain a particular nucleic acid fragment comprising the primers. The skilled artisan, having the benefit of the sequences as reported herein, may now use all or a substantial portion of the disclosed sequences for purposes known to him or her in this art. Accordingly, the present invention comprises the complete sequences as reported in the accompanying Sequence Listing, as well as substantial portions of those sequences as defined above.

The nucleic acids of the present invention may be used to isolate nucleic acids encoding homologous proteins from the same or other species, such as *Photorhabdus, Serratia, Yersinia, Salmonella, E. coli, Bacillus*, and *Erwinia* species. Examples of sequence-dependent protocols include, but are not limited to, methods of nucleic acid hybridization, and methods of DNA and RNA amplification as exemplified by various uses of nucleic acid amplification technologies (e.g., polymerase chain reaction, ligase chain reaction).

Genes encoding homologous proteins, either as cDNAs or genomic DNAs, could be isolated directly by using all or a portion of the nucleic acids of the present invention as DNA hybridization probes to screen cDNA or genomic libraries from any desired organism employing methodology well known to those skilled in the art. Methods for forming such libraries are well known in the art (Sambrook et al., ibid). Specific oligonucleotide probes based upon the nucleic acids of the present invention can be designed and synthesized by methods known in the art. Moreover, the entire sequences of the nucleic acids can be used directly to synthesize DNA probes by methods known to the skilled artisan such as random primer DNA labeling, nick translation, or end-labeling techniques, or RNA probes using available in vitro transcription systems. In addition, specific primers can be designed and used to amplify a part or all of the sequences. The resulting amplification products can be labeled directly during amplification reactions or labeled after amplification reactions, and used as probes to isolate full-length cDNA or genomic DNAs under conditions of appropriate stringency.

In addition, two short segments of the nucleic acids of the present invention may be used in polymerase chain reaction protocols, for example, the RACE protocol (Frohman et al., Proc. Natl. Acad. Sci. USA 85:8998, 1988), to amplify longer nucleic acids encoding homologous genes from DNA or RNA from other sources.

Nucleic acids of interest may also be synthesized, either completely or in part, especially where it is desirable to provide a sequence that is functional in a plant cell, by well-known techniques as described in the technical literature. See, e.g., Carruthers et al. (Cold Spring Harbor Symp. Quant. Biol. 47:411-418, 1982) and Adams et al. (J. Am. Chem. Soc. 105:661, 1983).

Availability of the nucleotide sequences encoding *Xenorhabdus* proteins facilitates immunological screening of DNA expression libraries. Synthetic polypeptides representing portions of the amino acid sequences of *Xenorhabdus* proteins may be synthesized. These polypeptides can be used to immunize animals to produce polyclonal or monoclonal antibodies with specificity for polypeptides or proteins comprising the amino acid sequences. These antibodies can be then be used to screen expression libraries to isolate genes of interest.

The present invention provides substantially purified proteins or polypeptide molecules comprising an amino acid sequence that (1) is encoded by a nucleotide sequence that is at least about 50% identical to a coding sequence as set forth in any of SEQ ID NO:1 through SEQ ID NO:5313; or (2) is substantially identical to an amino acid sequence selected from the group consisting of SEQ ID NO:5314 to SEQ ID NO:10626.

The term "substantially purified protein or polypeptide molecule" refers to a protein or polypeptide molecule separated from substantially all other molecules normally associated with it in its native state. More preferably a substantially purified protein or polypeptide molecule is the predominant species present in a preparation. A substantially purified molecule may be greater than about 60%, or at least about 75%, or at least about 80%, at least about 90%, or at least about 95% free from the other molecules (exclusive of solvent) present as found in its natural environment.

Proteins or polypeptides may undergo modifications, including post-translational modifications, such as, but not limited to, disulfide bond formation, glycosylation, phosphorylation, or oligomerization. Thus, as used herein, the term "protein molecule" or "polypeptide molecule" includes any protein molecule that is modified by any biological or non-biological process. The terms "amino acid" and "amino acids" refer to all naturally occurring amino acids. This definition is meant to include norleucine, ornithine, homocysteine, and homoserine.

The polypeptides or proteins of the present invention may be produced via chemical synthesis, or more preferably, by expression in a suitable bacterial or eukaryotic host. Suitable methods for expression of the polypeptides or proteins are described by Sambrook et al. (ibid). The polypeptides or protein molecules of the present invention may also include fusion protein or polypeptide molecules. A protein or polypeptide molecule that comprises one or more additional polypeptide regions not derived from that protein molecule is a "fusion" protein or polypeptide molecule. Such molecules may be derivatized to contain carbohydrate or other moieties (such as keyhole limpet hemocyanin, etc.). Fusion protein or polypeptide molecules of the present invention are preferably produced via recombinant means.

Antibodies may be used to quantitatively or qualitatively detect the protein or polypeptide molecules of the present invention. As used herein, an antibody or polypeptide is said to "specifically bind" to a protein or polypeptide molecule of the present invention if such binding is not competitively inhibited by the presence of non-related molecules.

Nucleic acid molecules that encode all or part of the protein or polypeptide of the present invention can be expressed, via recombinant means, to yield protein or polypeptides that can in turn be used to elicit antibodies that are capable of binding the expressed protein or polypeptide. Such antibodies may be used in immunoassays for that protein or polypeptide. Such protein or polypeptide-encoding molecules, or their fragments may be "fusion" molecules (i.e., a part of a larger nucleic acid molecule) such that, upon expression, a fusion protein is produced. It may be desirable to derivatize the obtained antibodies, for example, with a ligand group (such as biotin) or a detectable marker group (such as a fluorescent group, a radioisotope or an enzyme). Such antibodies may be used in immunoassays for that protein or may be used to screen DNA expression libraries to isolate clones containing full-length insert of genes.

Antibodies elicited in response to challenge with amino acid sequences selected from the group consisting of SEQ ID NO:7316, SEQ ID NO:9584, SEQ ID NO:9585, SEQ ID NO:9639 and SEQ ID NO:9679 can be used to specifically bind to one or more of these insect inhibitory polypeptides or proteins and to detect homologous sequences produced by other organisms, including but not limited to other *Xenorhabdus* species, and to detect the presence of such insect inhibitory polypeptides or proteins in a sample.

The present invention also provides a method for detecting an insect inhibitory polypeptide or protein in a biological sample, the method comprising: (1) obtaining a biological sample; (2) contacting the sample with an antibody that specifically binds to the polypeptide or protein comprising any or all or any combination of SEQ ID NO:7316, SEQ ID NO:9584, SEQ ID NO:9585, SEQ ID NO:9639 and SEQ ID NO:9679, under conditions effective to allow the formation of immune complexes; and (3) detecting the complexes so formed.

A recombinant vector or construct for use in transformation of a plant cell is provided comprising a structural nucleotide sequence encoding a *Xenorhabdus* protein or polypeptide selected from the group consisting of SEQ ID NO:5313 through SEQ ID NO:10626. In a preferred embodiment, a plant recombinant vector or construct of the present invention comprises a structural nucleotide sequence encoding an insect inhibitory protein or polypeptide of the present invention comprising an amino acid sequence that is selected from the group consisting of SEQ ID NO:7316, SEQ ID NO:9584, SEQ ID NO:9585, SEQ ID NO:9639 and SEQ ID NO:9679. The present invention also relates to a transformed plant cell or plant comprising in its genome an exogenous nucleic acid encoding one or more *Xenorhabdus* proteins or polypeptides of the present invention. The present invention also relates to methods for creating a transgenic plant in which one or more *Xenorhabdus* proteins or polypeptides of the present invention are overexpressed.

As used herein, "structural nucleotide sequence" refers to a nucleotide sequence that is expressed to produce a polypeptide. The term "genome" as it applies to plant cells encompasses not only chromosomal DNA found within the nucleus, but organelle DNA found within subcellular components of the cell. DNA of the present invention introduced into plant cells can therefore be either chromosomally integrated or organelle-localized. The term "genome" as it applies to bacteria encompasses both the chromosome and plasmids within a bacterial host cell. DNA of the present invention introduced into bacterial host cells can therefore be either chromosomally integrated or plasmid-localized.

Methods that are well known to those skilled in the art may be used to construct the plant recombinant construct or vector of the present invention. These methods include in vitro recombinant DNA techniques, synthetic techniques, and in vivo genetic recombination. Such techniques are described in part at least in Sambrook et al. (ibid); and Ausubel et al. (Current Protocols in Mol. Biol., John, Wiley & Sons, New York, N.Y., 1989).

A plant recombinant construct or vector of the present invention contains a structural nucleotide sequence encoding one or more *Xenorhabdus* proteins or polypeptides of the present invention as set forth in SEQ ID NO:5313 through SEQ ID NO:10626 and operably linked regulatory sequences or control elements.

The term "operably linked", as used in reference to a regulatory sequence and a structural nucleotide sequence, means that the regulatory sequence causes regulated expression of the operably linked structural nucleotide sequence. "Regulatory sequences" or "control elements" refer to nucleotide sequences located upstream (5' noncoding sequences), within, or downstream (3' non-translated sequences) of a structural nucleotide sequence, and which influence the transcription, RNA processing or stability, or translation of the associated structural nucleotide sequence. Regulatory sequences may include promoters, translation leader sequences, introns, and polyadenylation recognition sequences.

It is understood that different promoters may direct the expression of a gene in different tissues or cell types, or at different stages of development, or in response to different environmental conditions. For example, promoters that may be used in the present invention include, but are not limited to, constitutive promoters [e.g., the nopaline synthase (NOS) promoters (Ellis et al., EMBO Journal 6:11-16, 1987); the cauliflower mosaic virus (CaMV) 35S (Fraley et al., U.S. Pat. No. 5,858,742); and actin promoters, such as the *Arabidopsis* actin gene promoter (see, e.g., Huang, Plant Mol. Biol. 33:125-139, 1997)], inducible promoter [e.g., the drought-inducible promoter of maize (Busk, Plant J. 11:1285-1295, 1997; the cold, drought, and high salt inducible promoter from potato (Kirch, Plant Mol. Biol. 33:897-909, 1997; and salicylic acid inducible promoter (Uknes et al., Plant Cell 5:159-169, 1993)] and tissue-specific promoters [e.g., leaf-specific promoters [e.g., Matsuoka, Plant J. 6:311-319, 1994; Shiina, Plant Physiol. 115-477-483, 1997); root-specific promoters (e.g., Samac et al., *Plant Mol. Biol.* 25: 587-596, 1994; Yamamoto, Plant Cell 3:371-382, 1991), tuber-specific promoters (Hannapel, *Plant Physiol.* 101: 703-704, 1993; Bevan et al., *EMBO J.* 8: 1899-1906, 1986), seed-specific promoters (e.g., Sheridan, Genetics 142:1009-1020, 1996; Abler, Plant Mol. Biol. 22:10131-1038, 1993) and pollen-specific promoter (e.g., Guerrero, Mol. Gen. Genet. 224:161-168, 1990; Wakeley, Plant Mol. Biol. 37:187-192, 1992).

It is recognized that additional promoters that may be utilized are described, for example, in U.S. Pat. Nos. 5,378,619, 5,391,725, 5,428,147, 5,447,858, 5,608,144, 5,608,144, 5,614,399, 5,633,441, 5,633,435, and 4,633,436. In addition, a tissue specific enhancer may be used (Fromm et al., *The Plant Cell* 1:977-984, 1989). It is further recognized that since in most cases the exact boundaries of regulatory sequences have not been completely defined, DNA fragments of different lengths may have identical promoter activity.

"Translation leader sequence" refers to a DNA sequence located between the promoter sequence of a gene and the coding sequence. The translation leader sequence is present in the fully processed mRNA upstream of the translation start sequence. The translation leader sequence may affect processing of the primary transcript to mRNA, mRNA stability or translation efficiency. Examples of translation leader sequences include maize and petunia heat shock protein leaders (U.S. Pat. No. 5,362,865), plant virus coat protein leaders, and plant rubisco leaders, among others (Turner and Foster, Molecular Biotechnology 3:225, 1995).

The 3' non-translated sequence or 3' transcription termination region means a DNA molecule linked to and located downstream of a structural polynucleotide molecule and includes polynucleotides that provide polyadenylation signal and other regulatory signals capable of affecting transcription, mRNA processing or gene expression. The polyadenylation signal functions in plants to cause the addition of polyadenylate nucleotides to the 3' end of the mRNA precursor. The polyadenylation sequence can be derived from the natural gene, from a variety of plant genes, or from T-DNA genes. An example of a 3' transcription termination region is the nopaline synthase 3' region (nos 3'; Fraley et al., Proc. Natl. Acad. Sci. USA, 80: 4803-4807, 1983). The use of different 3' nontranslated regions is exemplified by Ingelbrecht et al. (Plant Cell 1:671-680, 1989).

A recombinant vector or construct of the present invention will typically comprise a selectable marker that confers a selectable phenotype on plant cells. Selectable markers may also be used to select for plants or plant cells that contain the exogenous nucleic acids encoding polypeptides or proteins of the present invention. The marker may encode biocide resistance, antibiotic resistance (e.g., kanamycin, G418 bleomycin, hygromycin, etc.), or herbicide resistance (e.g., glyphosate, etc.). Examples of selectable markers include, but are not limited to, a neo gene (Potrykus et al., *Mol. Gen. Genet.* 199:183-188, 1985) which codes for kanamycin resistance and can be selected for using kanamycin, G418, etc.; a mutant EPSP synthase gene (Hinchee et al., *Bio/Technology* 6:915-922, 1988) which encodes glyphosate resistance; and a nitrilase gene which confers resistance to bromoxynil (Stalker et al., *J. Biol. Chem.* 263:6310-6314, 1988).

A recombinant vector or construct of the present invention may also include a screenable marker. Screenable markers may be used to monitor expression. Exemplary screenable markers include a β-glucuronidase or uidA gene (GUS) which encodes an enzyme for which various chromogenic substrates are known (Jefferson, *Plant Mol. Biol, Rep.* 5:387-405, 1987; Jefferson et al., *EMBO J.* 6:3901-3907, 1987); an R-locus gene (Dellaporta et al., Stadler Symposium 11:263-282, 1988); a β-lactamase gene (Sutcliffe et al., *Proc. Natl. Acad. Sci. (U.S.A.)* 75:3737-3741, 1978); and a luciferase gene (Ow et al., *Science* 234:856-859, 1986). Included within the terms "selectable or screenable marker genes" are also genes that encode a secretable marker whose secretion can be detected as a means of identifying or selecting for transformed cells. Examples include markers that encode a secretable antigen that can be identified by antibody interaction, or even secretable enzymes that can be detected catalytically. Secretable proteins fall into a number of classes, including small, diffusible proteins detectable, e.g., by ELISA, small active enzymes detectable in extracellular solution (e.g., α-amylase, β-lactamase, phosphinothricin transferase), or proteins which are inserted or trapped in the cell wall (such as proteins which include a leader sequence such as that found in the expression unit of extension or tobacco PR-S). Other possible selectable and/or screenable marker genes will be apparent to those of skill in the art.

In preparing the DNA constructs of the present invention, the various components of the construct or fragments thereof will normally be inserted into a convenient cloning vector, e.g., a plasmid that is capable of replication in a bacterial host, e.g., *E. coli*. Numerous vectors exist that have been described in the literature, many of which are commercially available. After each cloning, the cloning vector with the desired insert may be isolated and subjected to further manipulation, such as restriction digestion, insertion of new fragments or nucleotides, ligation, deletion, mutation, resection, etc. so as to tailor the components of the desired sequence. Once the construct has been completed, it may then be transferred to an appropriate vector for further manipulation in accordance with the manner of transformation of the host cell.

The present invention also provide a transgenic plant comprising in its genome an isolated nucleic acid which comprises: (1) a 5' non-coding sequence which functions in the cell to cause the production of a mRNA molecule; which is linked to (2) a structural nucleotide sequence, wherein the structural nucleotide sequence encodes a *Xenorhabdus* protein or polypeptide of the present invention that is substantially identical to a member selected from the group consisting of SEQ ID NO:5314 to SEQ ID NO:10626; which is linked to (3) a 3' non-translated sequence that functions in said cell to cause termination of transcription.

The term "transgenic plant" refers to a plant that contains an exogenous nucleic acid, which can be derived from the same plant species or from a different plant species. Transgenic plants of the present invention preferably have incorporated into their genome or transformed into their chloroplast or plastid genomes a selected polynucleotide (or "transgene"), that comprises at least a structural nucleotide sequence that encodes a polypeptide the amino acid sequence of which is selected from the group consisting of SEQ ID NO:5314 to SEQ ID NO:10626 or, in particular, an insect inhibitory polypeptide the amino acid sequence of which is selected from the group consisting of SEQ ID NO:7316, SEQ ID NO:9584, SEQ ID NO:9585, SEQ ID NO:9639 and SEQ ID NO:9679, which are also referred to herein as XIP or Xip proteins (*Xenorhabdus* Insecticidal Proteins), the genes encoding such proteins as xip genes. Transgenic plants are also meant to comprise progeny (decendant, offspring, etc.) of any generation of such a transgenic plant. A seed of any generation of such transgenic insect-resistant plants is also an important aspect of the invention so long as the cells of the seed contain the DNA sequence encoding the *Xenorhabdus* polypeptide.

The DNA constructs of the present invention may be introduced into the genome of a desired plant host by a variety of conventional transformation techniques, which are well known to those skilled in the art. Preferred methods of transformation of plant cells or tissues are the *Agrobacterium* mediated transformation method and the biolistics or particle-gun mediated transformation method. Suitable plant transformation vectors for the purpose of *Agrobacterium* mediated transformation include those derived from a Ti plasmid of *Agrobacterium tumefaciens*, as well as those disclosed, e.g., by Herrera-Estrella et al. (Nature 303:209, 1983); Bevan (Nucleic Acids Res. 12: 8711-8721, 1984); Klee et al. (Bio-Technology 3(7): 637-642, 1985); and EPO publication 120,516. In addition to plant transformation vectors derived from the Ti or root-inducing (Ri) plasmids of *Agrobacterium*, alternative methods can be used to insert the DNA constructs of this invention into plant cells. Such methods may involve, but are not limited to, for example, the use of liposomes, electroporation, chemicals that increase free DNA uptake, free DNA delivery via microprojectile bombardment, and transformation using viruses or pollen.

A plasmid expression vector suitable for the introduction of a nucleic acid encoding a polypeptide or protein of the present invention in monocots using electroporation or particle-gun mediated transformation is composed of the following: a promoter that is constitutive or tissue-specific; an intron that provides a splice site to facilitate expression of the gene, such as the Hsp70 intron (PCT Publication WO93/19189); and a 3' polyadenylation sequence such as the nopaline synthase 3' sequence (NOS 3'; Fraley et al., Proc. Natl. Acad. Sci. USA 80: 4803-4807, 1983). This expression cassette may be assembled on high copy replicons suitable for the production of large quantities of DNA.

When adequate numbers of cells (or protoplasts) containing the exogenous nucleic acid encoding a polypeptide or protein of the present invention are obtained, the cells (or protoplasts) are regenerated into whole plants. Choice of methodology for the regeneration step is not critical, with suitable protocols being available for hosts from Leguminosae (alfalfa, soybean, clover, etc.), Umbelliferae (carrot, celery, parsnip), Cruciferae (cabbage, radish, canola/rapeseed, etc.), Cucurbitaceae (melons and cucumber), Gramineae (wheat, barley, rice, maize, etc.), Solanaceae (potato, tobacco, tomato, peppers), various floral crops, such as sunflower, and nut-bearing trees, such as almonds, cashews, walnuts, and pecans. See, for example, Ammirato et al. (Handbook of Plant Cell Culture—Crop Species. Macmillan Publ. Co., 1984); Shimamoto et al (Nature 338:274-276, 1989); Vasil et al. (Bio/Technology 8:429-434, 1990; Bio/Technology 10:667-674, 1992); Hayashimoto (Plant Physiol. 93:857-863, 1990); and Datta et al. (Bio-technology 8:736-740, 1990). Regeneration can also be obtained from plant callus, explants, organs, or parts thereof. Such regeneration techniques are described generally in Klee et al. (Ann. Rev. Plant Phys. 38:467-486, 1987).

A transgenic plant formed using *Agrobacterium* transformation methods typically contains a single exogenous gene on one chromosome. Such transgenic plants can be referred to as being heterozygous for the added exogenous gene. More preferred is a transgenic plant that is homozygous for the added exogenous gene; i.e., a transgenic plant that contains two added exogenous genes, one gene at the same locus on each chromosome of a chromosome pair. A homozygous transgenic plant can be obtained by sexually mating (selfing) an independent segregant transgenic plant that contains a single exogenous gene, germinating some of the seeds produced and analyzing the resulting plants produced for the exogenous gene of interest.

The development or regeneration of transgenic plants containing the exogenous nucleic acid that encodes a polypeptide or protein of interest is well known in the art. Preferably, the regenerated plants are self-pollinated to provide homozygous transgenic plants, as discussed above. Otherwise, pollen obtained from the regenerated plants is crossed to seed-grown plants of agronomically important lines. Conversely, pollen from plants of these important lines is used to pollinate regenerated plants. A transgenic plant of the present invention containing a desired polypeptide or protein of the present invention is cultivated using methods well known to one skilled in the art.

Transgenic plants, that can be generated by practice of the present invention, include but are not limited to *Acacia*, alfalfa, aneth, apple, apricot, artichoke, arugula, asparagus, avocado, banana, barley, beans, beet, blackberry, blueberry, broccoli, brussels sprouts, cabbage, canola, cantaloupe, carrot, cassaya, cauliflower, celery, cherry, cilantro, citrus, clementines, coffee, corn, cotton, cucumber, Douglas fir, eggplant, endive, escarole, eucalyptus, fennel, figs, gourd, grape, grapefruit, honey dew, jicama, kiwifruit, lettuce, leeks, lemon, lime, pine, mango, melon, mushroom, nut, oat, okra, onion, orange, an ornamental plant, papaya, parsley, pea, peach, peanut, pear, pepper, persimmon, pine, pineapple, plantain, plum, pomegranate, poplar, potato, pumpkin, quince, radiata pine, radicchio, radish, raspberry, rice, rye, sorghum, soybean, spinach, squash, strawberry, sugarbeet, sugarcane, sunflower, sweet potato, sweetgum, tangerine, tea, tobacco, tomato, turf, a vine, watermelon, wheat, yams, and zucchini.

The present invention also provides parts of the transgenic plants of present invention. Plant parts, without limitation, include seed, endosperm, ovule and pollen. In a particularly preferred embodiment of the present invention, the plant part is a seed.

The present invention also further provides method for generating a transgenic plant comprising the steps of: a) introducing into the genome of the plant an exogenous nucleic acid, wherein the exogenous nucleic acid comprises in the 5' to 3' direction i) a promoter that functions in the cells of said plant, said promoter operably linked to; ii) a structural nucleic acid sequence encoding a polypeptide or protein of the present invention that is selected from the group consisting of SEQ ID NO:5314 to SEQ ID NO:10626 or, in particular, an insect inhibitory polypeptide that is selected from the group consisting of SEQ ID NO:7316, SEQ ID NO:9584, SEQ ID NO:9585, SEQ ID NO:9639 and SEQ ID NO:9679, said structural nucleic acid sequence operably linked to; iii) a 3' non-translated nucleic acid sequence that functions in said cells of said plant to cause transcriptional termination; b) obtaining transformed plant cells containing the nucleic acid sequence of step (a); and c) regenerating from said transformed plant cells a transformed plant in which said polypeptide or protein is overexpressed.

Any of the isolated nucleic acid molecules of the present invention may be introduced into a plant cell in a permanent or transient manner in combination with other genetic elements such as vectors, promoters, enhancers etc. Further any of the nucleic acid molecules encoding a *Xenorhabdus* protein or polypeptide of the present invention may be introduced into a plant cell in a manner that allows for over expression of the protein or polypeptide encoded by the nucleic acid molecule.

The nucleotide sequences of the present invention may be introduced into a wide variety of prokaryotic and eukaryotic microorganism hosts to express the *Xenorhabdus* polypeptide or protein of the present invention, particularly the insect inhibitory polypeptides or proteins of the present invention comprising an amino acid sequence that is selected from the group consisting of SEQ ID NO:7316, SEQ ID NO:9584, SEQ ID NO:9585, SEQ ID NO:9639 and SEQ ID NO:9679. The term "microorganism" includes prokaryotic and eukaryotic microbial species such as bacteria and fungi. Illustrative prokaryotes, whether Gram-negative, Gram-positive, or otherwise, include Enterobacteriaceae, such as *Escherichia, Erwinia, Shigella, Salmonella,* and *Proteus*; Bacillaceae; Rhizobiceae, such as *Rhizobium*; Spirillaceae, such as *photobacterium, Zymomonas, Serratia, Aeromonas, Vibrio, Desulfovibrio, Spirillum*; Lactobacillaceae; Pseudomonadaceae, such as *Pseudomonas* and *Acetobacter*; Azotobacteraceae, Actinomycetales, and Nitrobacteraceae. Among eukaryotes are fungi, such as *Phycomycetes* and *Ascomycetes*, which includes yeast, such as *Saccharomyces* and *Schizosaccharomyces*; and *Basidiomycetes* yeast, such as *Rhodotorula, Aureobasidium, Sporobolomyces*, and the like.

For the purpose of plant protection against insects, a large number of microorganisms known to inhabit the phylloplane (the surface of the plant leaves) and/or the rhizosphere (the soil surrounding plant roots) of a wide variety of important crops may also be desirable host cells for manipulation, propagation, storage, delivery and/or mutagenesis of the disclosed recombinant constructs. These microorganisms include bacteria, algae, and fungi. Of particular interest are microorganisms, such as bacteria, e.g., genera *Bacillus* (including the species and subspecies); *Pseudomonas, Erwinia, Serratia, Klebsiella, Zanthomonas, Streptomyces, Rhizobium, Rhodopseudomonas, Methylophilius, Agrobacterium, Acetobacter, Lactobacillus, Arthrobacter, Azotobacter, Leuconostoc,* and *Alcaligenes*; fungi, particularly yeast, e.g., genera *Saccharomyces, Cryptococcus, Kluyveromyces, Sporobolomyces, Rhodotorula,* and *Aureobasidium*.

The present invention also relates to a bacterial or a fungal recombinant construct. The recombinant construct may comprise a structural nucleotide sequence encoding a *Xenorhabdus* protein or polypeptide comprising an amino acid sequence that is selected from the group consisting of SEQ ID NO:5314 to SEQ ID NO:10626. The present invention also relates to methods for obtaining a recombinant bacterial or fungal host cell, comprising introducing into a bacterial or fungal host cell an exogenous nucleic acid molecule that is selected from the group consisting of SEQ ID NO:1 to SEQ ID NO:5313.

The recombinant construct for producing a polypeptide in a bacterium also contains an inducible promoter that is recognized by the host bacterium and is operably linked to the nucleic acid encoding, for example, the nucleic acid molecule encoding the *Xenorhabdus* protein or polypeptide of interest. Inducible promoters suitable for use with bacterial hosts include the β-lactamase, *E. coli* λ phage $P_L$ and $P_R$, and *E. coli* galactose, arabinose, alkaline phosphatase, tryptophan (trp), and lactose operon promoter systems and variations thereof (Chang et al., *Nature* 275:615, 1978; Goeddel et al., *Nature* 281:544, 1979; Guzman et al., *J. Bacteriol.* 174:7716-7728, 1992; Goeddel, *Nucleic Acids Res.* 8:4057, 1980; EP 36,776). Hybrid promoters such as the tac promoter (deBoer et al., *Proc. Natl. Acad. Sci.* (*USA*) 80:21-25, 1983) and other known bacterial inducible promoters are suitable (Siebenlist et al., *Cell* 20:269, 1980) may also be used.

The bacterial recombinant construct or vector may be a linear or a closed circular plasmid. The vector system may be a single vector or plasmid or two or more vectors or plasmids that together contain the total DNA to be introduced into the genome of the bacterial host. In addition, the bacterial vector may be an expression vector. Nucleic acid molecules encoding *Xenorhabdus* proteins or polypeptide can, for example, be suitably inserted into a replicable vector for expression in a bacterium under the control of a suitable promoter for that bacterium. Many vectors are available for this purpose, and selection of the appropriate vector will depend mainly on the size of the nucleic acid to be inserted into the vector and the particular host cell to be transformed with the vector. Each vector contains various components depending on its function (amplification of DNA or expression of DNA) and the particular host cell with which it is compatible. The vector components for bacterial transformation generally include, but are not limited to, one or more of the following: a signal sequence, an origin of replication, one or more selectable marker genes, a promoter allowing the expression of an exogenous nucleotide sequence and a structural nucleotide sequence of the present invention.

In general, plasmid vectors containing replicon and control sequences that are derived from species compatible with the host cell are used in connection with bacterial hosts. The vector ordinarily carries a replication site, as well as marking sequences that are capable of providing phenotypic selection in transformed cells. For example, E. coli is typically transformed using pBR322, a plasmid derived from an *E. coli* species (see, e.g., Bolivar et al., *Gene* 2:95, 1977). The pBR322 plasmid contains genes for ampicillin and tetracycline resistance and thus provides easy means for identifying transformed cells. The pBR322 plasmid, or other microbial plasmid or phage, also generally contains, or is modified to contain, promoters that can be used by the microbial organism for expression of the selectable marker genes. In addition, nucleic acid molecules encoding *Xenorhabdus* proteins or polypeptides may be expressed not only directly, but also as a fusion with another polypeptide, preferably a signal sequence or other polypeptide having a specific cleavage site at the N-terminus of the mature polypeptide. The suitable vectors containing one or more of the above-listed components may be constructed employing standard recombinant DNA techniques. Isolated plasmids or DNA fragments are cleaved, tailored, and re-ligated in the form desired to generate the plasmids required. Examples of available bacterial expression vectors include, but are not limited to, the multifunctional *E. coli* cloning and expression vectors such as Bluescript™ (Stratagene, La Jolla, Calif.), in which, for example, a *Xenorhabdus* protein or polypeptide of the present invention, may be ligated into the vector in frame with sequences for the amino-terminal Met and the subsequent 7 residues of β-galactosidase so that a hybrid protein is produced; pIN vectors (Van Heeke and Schuster *J. Biol. Chem.* 264:5503-5509, 1989); and the like. pGEX vectors (Promega, Madison, Wis.) may also be used to express foreign polypeptides as fusion proteins with glutathione S-transferase (GST). Bacterial cells used to produce the polypeptide of interest for purposes of this invention are cultured in suitable media in which the promoters for the nucleic acid encoding the heterologous polypeptide can be artificially induced as described generally, e.g., in Sambrook et al., ibid). Examples of suitable media are given in U.S. Pat. Nos. 5,304,472 and 5,342,763.

A yeast recombinant construct can typically include one or more of the following: a promoter sequence, a fusion partner sequence, a leader sequence, a transcription termination sequence and a selectable marker. These elements can be combined into an expression cassette, which may be maintained in a replicon, such as an extrachromosomal element (e.g., plasmids) capable of stable maintenance in a host, such as yeast or bacteria. The replicon may have two replication systems, thus allowing it to be maintained, for example, in yeast for expression and in a procaryotic host for cloning and amplification. Examples of such yeast-bacteria shuttle vectors include YEp24 (Botstein et al., Gene, 8:17-24, 1979), pCl/1 (Brake et al., Proc. Natl. Acad. Sci. USA, 81:4642-4646, 1984), and YRp17 (Stinchcomb et al., J. Mol. Biol., 158:157, 1982).

The nucleotide sequence provided in the present invention can be "provided" in a variety of media to facilitate their use, and can be provided as a subset thereof in a form that allows a skilled artisan to examine the sequences.

In one application of this embodiment, a nucleotide sequence of the present invention can be recorded on computer readable media. As used herein, "computer readable media" refers to any medium that can be read and accessed directly by a computer. Such media include, but are not limited to: magnetic storage media, such as floppy discs, hard disc, storage medium, and magnetic tape: optical storage media such as CD-ROM; electrical storage media such as RAM and ROM; internet servers; and hybrids of these categories such as magnetic/optical storage media. The computer readable mediums can be used to create a manufacture comprising one or more computer readable media having recorded thereon one or more of the nucleotide sequences of the present invention.

By providing one or more of nucleotide sequences of the present invention, a skilled artisan can routinely access the sequence information for a variety of purposes. Computer software is publicly available which allows a skilled artisan to access sequence information provided in a computer readable medium. The examples which follow demonstrate how software which implements the BLAST (Altschul et al., *J. Mol. Biol.* 215:403-410, 1990) and BLAZE (Brutlag et al., *Comp. Chem.* 17:203-207, 1993) search algorithms on a Sybase system can be used to identify open reading frames (ORFs) within the genome that contain homology to ORFs or proteins from other organisms. Such ORFs are useful in producing commercially important proteins such as enzymes used in amino acid biosynthesis, metabolism, transcription, translation, RNA processing, nucleic acid and a protein degradation, protein modification, and DNA replication, restriction, modification, recombination, repair, designing sequences for incorporation into plasmids that are useful for modeling and testing prior to actually engaging in a costly procedure that can be very costly in terms of financial expenditures and human capital.

Nucleic acid molecules and fragments thereof of the present invention may be employed to obtain other nucleic acid molecules from the same or closely related species. Such nucleic acid molecules include the nucleic acid molecules that encode the complete coding sequence of a protein and promoters and flanking sequences of such molecules. In addition, such nucleic acid molecules include sequences that encode for other isozymes or gene family members. Such molecules can be readily obtained by using the above-described nucleic acid molecules or fragments thereof to screen genomic libraries obtained from *Xenorhabdus*.

The nucleic acid molecules of the present invention may be used for physical mapping in conjunction with linkage analysis, which can enable the isolation of genes. Physical mapping has been reported to identify the markers closest in terms of genetic recombination to a gene target for cloning. Once a DNA marker is linked to a gene of interest, the chromosome walking technique can be used to find the genes via overlapping clones. For chromosome walking, random molecular markers or established molecular linkage maps are used to conduct a search to localize the gene adjacent to one or more markers. A chromosome walk (Bukanov and Berg, *Mo. Microbiol.* 11:509-523, 1994; Birkenbihl and Vielmetter *Nucleic Acids Res.* 17:5057-5069, 1989; Wenzel and Herrmann, *Nucleic Acids Res.* 16:8323-8336, 1988) is then initiated from the closest linked marker. Starting from the selected clones, labeled probes specific for the ends of the insert DNA are synthesized and used as probes in hybridizations against a representative library. Clones hybridizing with one of the probes are picked and serve as templates for the synthesis of new probes; by subsequent analysis, contigs are produced. The degree of overlap of the hybridizing clones used to produce a contig can be determined by comparative restriction analysis. The most frequently used procedures are, fingerprinting (Coulson et al, *Proc. Natl. Acad. Sci.* (*U.S.A.*) 83:7821-7821, 1986; Knott et al., *Nucleic Acids Res.* 16:2601-2612, 1988; Eiglmeier et al., *Mol. Microbiol.* 7:197-206, 1993), restriction fragment mapping (Smith and Birnstiel, *Nucleic Acids Res.* 3:2387-2398, 1976), or the "landmarking" technique (Charlebois et al. *J. Mol. Biol.* 222:509-524, 1991).

Nucleic acid molecules of the present invention can be used to monitor expression. A microarray-based method for high-throughput monitoring of gene expression may be utilized to measure gene-specific hybridization targets. This 'chip'-based approach involves using microarrays of nucleic acid molecules as gene-specific hybridization targets to quantitatively measure expression of the corresponding genes (Schena et al., *Science* 270:467-470, 1995; Shalon, Ph.D. Thesis, Stanford University, 1996). Every nucleotide in a large sequence can be queried at the same time. Hybridization can be used to efficiently analyze nucleotide sequences. It is understood that one or more of the molecules of the present invention, preferably one or more of the nucleic acid molecules or protein molecules or fragments thereof of the present invention may be utilized in a microarray based method. In a preferred embodiment, the microarray of the present invention comprises at least 10 nucleic acid molecules, more preferably at least 100 nucleic acid molecules, and even more preferably at least 1000 nucleic acid molecules, that specifically hybridize under stringent conditions to at least 10, at least 100, at least 1000, nucleic acid molecules, respectively, encoding Xenorhabdus proteins or polypeptides or fragments thereof set forth in SEQ ID NO:1 through SEQ ID NO:5313 or fragment thereof or complement. In a further embodiment, the microarray of the present invention comprises at least 2,500 nucleic acid molecules that specifically hybridize under stringent conditions to at least 2,500 nucleic acid molecules that encode a Xenorhabdus protein, polypeptide, or fragment thereof.

Nucleic acid molecules of the present invention may be used in site directed mutagenesis. Site-directed mutagenesis may be utilized to modify nucleic acid sequences, particularly as it is a technique that allows one or more of the amino acids encoded by a nucleic acid molecule to be altered (e.g. a threonine to be replaced by a methionine). Any of the nucleic acid molecules of the present invention may either be modified by site-directed mutagenesis or used as, for example, nucleic acid molecules that are used to target other nucleic acid molecules for modification. It is understood that mutants with more than one altered nucleotide can be constructed using techniques that practitioners skilled in the art are familiar with such as isolating restriction fragments and ligating such fragments into an expression vector (see, for example, Sambrook et al., ibid).

Insect inhibitory protein-encoding nucleic acids of the present invention will find particular uses in the plant protection against insects. For instance, insect-resistant transgenic plants can be generated by introducing the exogenous nucleic acids encoding an insect inhibitory polypeptide or protein or insect inhibitory fragment thereof, the amino acid sequence of which is substantially identical to a sequence set forth in SEQ ID NO:7316, SEQ ID NO:9584, SEQ ID NO:9585, SEQ ID NO:9639 and SEQ ID NO:9679. Insect inhibitory protein-encoding nucleic acids of the present invention will also find particular uses in engineering a transgenic microorganism (bacteria or fungi) to express the insect inhibitory polypeptides or proteins of the present invention and then to apply them to the insect food source or allow them to reside in soil surrounding plant roots or on the surface of plant leaves. The transgenic microorganisms of the present invention may be used to produce Xenorhabdus polypeptides or proteins of interest, particularly insect inhibitory polypeptides or proteins. Insect inhibitory polypeptides or proteins or insect inhibitory fragments thereof may be secreted, for example as in bacterial systems, meaning targeted to either the periplasm as for gram negative bacteria or localized to the extracellular space for gram negative or any other type of bacterium, or localized to the intracellular spaces within the cytoplasm.

A principle object of the present invention is to provide a method for identification of any gene or any protein encoded by any structural gene contained within a Xenorhabdus species, particularly those species which are shown to exhibit the production of an insect inhibitory protein or molecule or other similarly active composition, either alone or in combination with proteins or molecules or other similarly active compositions which may be derived from the bacterium in its role as a natural symbiont within an insect pathogenic nematode host. Isolation and identification of a single insect pathogenic nematode species enables the skilled artisan to isolate at least one species of Xenorhabdus endosymbiotic bacteria from the haemolymph of an insect larvae or adult which has been invaded by the isolated and identified host nematode. The isolation and purification of an insect pathogenic nematode Xenorhabdus symbiont bacterium from an insect cadaver provides the basis for obtaining an amount of genomic DNA from which a genomic library can be constructed to represent the entire genome of the bacterial strain. The library can then be manipulated as described herein to produce linear nucleotide sequences, which can then be compared to each other to identify regions of identity with which an overlapping sequence can be generated to produce islands of linear sequence known as contigs because of the contiguous linear sequence assembled from smaller bits of sequence data. The contigs can be assembled into a genomic map from which genes can be identified, and wherein translation of structural genes lead to further identification of proteins having predicted structure and function based on homologies of such predicted protein sequences as translated from open reading frames contained within the genome map, to proteins of known sequence, and perhaps also of known structure and function identified previously from other bacterial, viral, fungal, or other eukaryotic sources.

Xenorhabdus strain Xs85831 and isolatable protein compositions exhibiting insecticidal activity as disclosed herein will find particular utility as insecticides for topical and/or systemic application to field crops, grasses, fruits and vegetables, and ornamental plants. In one embodiment, the bioinsecticide composition comprises an oil flowable suspension of bacterial cells that expresses a novel protein disclosed herein. In another embodiment, the bioinsecticide composition comprises a water dispersible granule. This granule comprises bacterial cells that express a novel insecticidal protein disclosed herein. In a third embodiment, the bioinsecticide composition comprises a wettable powder, dust, pellet, or colloidal concentrate. This powder comprises bacterial cells that express a novel insecticidal protein disclosed herein. Such dry forms of the insecticidal compositions may be formulated to dissolve immediately upon wetting, or alternatively, dissolve in a controlled-release, sustained-release, or other time-dependent manner. In a fourth embodiment, the bioinsecticide composition comprises an aqueous suspension of bacterial cells such as those described above that express the insecticidal protein. Such aqueous suspensions may be provided as a concentrated stock solution which is diluted prior to application, or alternatively, as a diluted solution.

Preferred bacterial cells for fulfilling the above methods may comprise Xenorhabdus Xs85831 cells. However, bacteria such as B. thuringiensis, B. megaterium, B. su, E. coli, Salmonella typhimurium, other Xenorhabdus or Photorhabdus species, or Pseudomonas spp. cells transformed with a DNA segment disclosed herein and expressing the insecticidal protein to are also contemplated to be useful.

Alternatively, the novel Xenorhabdus insecticidal proteins (Xip) of the present invention may be prepared by native or recombinant bacterial expression systems in vitro and isolated for subsequent field application. Such protein may be either in crude cell lysates, suspensions, colloids, etc., or alternatively may be purified, refined, buffered, and/or further processed, before formulating in an active biocidal formulation. Likewise, under certain circumstances, it may be desirable to isolate insecticidal proteins or whole cells from bacterial cultures expressing the insecticidal protein(s) of the present invention and apply solutions, suspensions, or colloidal preparations of such insecticidal proteins or whole cells as the active bioinsecticidal composition.

Regardless of the method of application, the amount of the active component(s) is applied at an insecticidally-effective amount, which will vary depending on such factors as, for example, the specific coleopteran insects to be controlled, or the specific piercing and sucking insect to be controlled, the specific plant or crop to be treated, the environmental conditions, and the method, rate, and quantity of application of the insecticidally-active composition.

The insecticide compositions described herein may be made by formulating either the bacterial cells, insecticidal protein suspensions, or isolated protein components with the desired agriculturally acceptable carrier (U.S. Pat. No. 6,177,615). The compositions may be formulated prior to administration in an appropriate means such as lyophilized, freeze-dried, desiccated, or in an aqueous carrier, medium or suitable diluent, such as saline or other buffer. The formulated compositions may be in the form of a dust or granular material, or a suspension in oil (vegetable or mineral), or water or oil/water emulsions, or as a wettable powder, or in combination with any other carrier material suitable for agricultural application (U.S. Pat. Nos. 5,616,319 and 5,942,658). Suitable agricultural carriers can be solid or liquid and are well known in the art. The insecticidal compositions of this invention are applied to the environment of the target coleopteran or piercing and sucking insect, typically onto the foliage of the plant or crop to be protected, by conventional methods, preferably by spraying (U.S. Pat. No. 6,177,615). The strength and duration of insecticidal application will be set with regard to conditions specific to the particular pest(s), crop(s) to be treated and particular environmental conditions. The proportional ratio of active ingredient to carrier will naturally depend on the chemical nature, solubility, and stability of the insecticidal composition, as well as the particular formulation contemplated.

Other application techniques, e.g., dusting, sprinkling, soaking, soil injection, seed coating, seedling coating, spraying, aerating, misting, atomizing, and the like, are also feasible and may be required under certain circumstances such as e.g., insects that cause root or stalk infestation, or for application to delicate vegetation or ornamental plants. These application procedures are also well known to those of skill in the art.

The insecticidal composition of the invention may be employed in the method of the invention singly or in combination with other compounds, including and not limited to other pesticides. The method of the invention may also be used in conjunction with other treatments such as surfactants, detergents, polymers or time-release formulations. The insecticidal compositions of the present invention may be formulated for either systemic or topical use.

Having now generally described the invention, the same will be more readily understood through reference to the following examples that are provided by way of illustration, and are not intended to be limiting of the present invention, unless specified.

EXAMPLES

Example 1

This example illustrates the isolation and characterization of a *Steinernema* race of nematode that contains a *Xenorhabdus* bacterium, strain Xs8583.

The *Xenorhabdus* bacterium, strain Xs85831, was isolated from entomopathogenic *Steinernema* nematodes according to the following procedure. Entomopathogenic nematodes were isolated from soil samples obtained from various geographic locations and entomopathogenic nematode suspensions were prepared according to the entomopathogenic nematode baiting method as disclosed in the US patent application (application Ser. No. 09/897,516). A variety of fourth instar insect larvae that included corn ear worm, tobacco bud worm, black cut worm, beet army worm, boll weevil, western corn rootworm and *Galleria mellonella* were placed individually in a 24-well plate containing Whatman filters in each well. Approximately ten microliters (µL) of an entomopathogenic nematode suspension were added into each well with one insect. The plates was sealed with Parafilm™ and placed at 25° C. in the dark.

After 48 to 72 hours dead insect larvae were removed from the 24 well plate. The insect larvae were surface sterilized [20 milliliter (mL) $H_2O$, 3 mL 4M NaOH and 1 mL 5% NaOCl] for 5 minutes and air-dried. The insect larvae were cut open with sterile instruments on the lateral side without injuring the gut and the hemolymph was streaked on indicator plates (nitro blue tetrazolium agar plates containing nutrient agar). The agar plates were incubated at 30° C. in the dark for 48 hours.

Characteristic blue colonies were selected from the indicator plates: phase I *Xenorhabdus* bacteria are able to take up bromthymol blue dye from the NBT agar and form the blue colonies. Bacterial characterization was performed according to methods known to the one skilled in the art (Farmer, *Bergey's Manual of Systematic Bacteriology, Vol.* 1: 510-511, 1984; Akhurst & Boemare, *J. Gen. Microbiol., Vol.* 133: 1835-1845, 1988; Boemare et al., *Int. J. Syst. Bacteriol., Vol.* 44: 249-255, 1993).

Single characteristic phase I colonies were picked up by an inoculation loop and suspended into BHI media (Brain Heart Infusion medium (Difco), 32 g/l, 50 mL in a 250 mL baffled flask). The bacteria were grown at 25° C. at 280 rpm on a rotary shaker in the dark. After 24 hours 15% glycerol was added to the bacterial culture, 1.5 mL aliquots for stock cultures were placed into cryovials and stored at −80° C.

The isolated *Xenorhabdus* strain Xs85831 was deposited according to the Budapest Treaty on the International Recognition of the Deposit of Microorganisms for the Purpose of Patent Procedures with the Agriculture Research Culture Collection (NRRL) International Depositary Authority at 1815 North University Street, in Peoria, Ill., ZIP 61604, U.S.A., on Jun. 28, 2000 and designated as NRRL-30311. It is contemplated for use as a source for DNA sequences encoding insecticidal and other types of useful proteins, and when formulated into a composition of matter as a spray, powder or emulsion, for the treatment of plants or animals to inhibit insect infestation and the like.

Example 2

This example illustrates the construction of genomic DNA libraries from *Xenorhabdus* strain Xs85831 genomic DNA.

Genomic DNA from *Xenorhabdus* strain Xs85831 was prepared for constructions of genomic libraries using methods well known in the art. Xs85831 bacterial cells were grown in brain heart infusion broth (Difco) for 42 hours at 25° C. to mid-exponential phase (OD650=~1.0). Cells were poured into ten 1.5 mL-microcentrifuge tubes and spun for 5 minutes at ~10,000 RPM to pellet. The supernatant was removed and the cells were frozen. The frozen pellets were resuspended into 200 µL of TE (10 mM Tris, 1 mM EDTA, pH 8.0). Genomic DNA was prepared from the frozen cell pellets using the Promega Genomic Preparation kit following the instructions of the manufacturer (Madison, Wis.). Ten DNA samples were prepared from the cells above, and two of the samples were resuspended into 50 µL of TE. Sample purity was tested and confirmed by digestion using the restriction enzymes EcoRI, HindIII, NotI, and SalI. The resuspended samples were used for the preparation of a genomic library.

The genomic libraries of *Xenorhabdus* strain Xs85831, for example, LIB4151 and LIB4152, were prepared according to standard procedures well known to those skilled in the art. Genomic DNA was sheared and then polished with T4 polymerase and T4 polynucleotide kinase. LIB4151 was constructed from fragments 1.6-2.5 kb in length, while LIB 4152 was constructed from fragments 2.5-3.5 kb in length. Size fractionated fragments were recovered from an agarose gel. Blunt end ligation was used to clone DNA fractions into the Sma I site of the standard cloning vector pUC18. The resulting ligation reactions were transformed into *E. coli* DH10B. The resulting vector fragment contains an intact beta-lactamase coding sequence enabling selection of transformed cells containing genomic DNA insertions on media containing ampicillin. Several ampicillin resistant transformants were selected and streaked in duplicate onto media containing ampicillin to determine the efficiency of the library construction. 80% of colonies arising from the transformation contained an insert, presumably derived from the genomic sequences. Approximately 150,000 colony-forming units per microliter of ligation mix were obtained. About thirty thousand individual recombinant colonies from each library were selected for DNA sequence analysis of inserted genomic DNA.

Example 3

This example illustrates the generation of contiguous nucleotide sequences from the sequencing information generated from the library clones prepared in Example 2.

About 74,000 genomic nucleotide sequence traces were derived from the double stranded plasmid library as described in Example 2. The two basic methods for the DNA sequencing are the chain termination method of Sanger et al., *Proc. Natl. Acad. Sci.* (*U.S.A.*) 74:5463-5467, 1977) and the chemical degradation method of Maxam and Gilbert, *Proc. Natl. Acad. Sci.* (*U.S.A.*) 74:560-564, 1977). PHRED (phragment editor, Phil Green, University of Washington) was used to call the bases from the sequence trace files and to assign quality scores to the bases. After the base calling is completed, sequence preprocessing is performed by removing 5' and 3' vector and linker sequences, according to standard procedures well known in the art. The preprocessed sequences were then assembled into contigs, or groups of overlapping sequences. Contigs are assembled using PHRAP (phragment assembly program, Phil Green, University of Washington) using default assembly parameters.

A total of 444 contigs were obtained and contig sequences were recognized as those sequences whose designations begin with the letter designation "Xb4151_4152.C". All contig sequences were run through the annotation and gene selection processes as described in Examples 4 and 5 below. The contig sequences are listed in the Sequence Listing file from SEQ ID NO:14542 to SEQ ID NO:14985.

Example 4

This example illustrates the identification of different coding sequences, open reading frames, and the like within the 444 contigs assembled as described in Example 3.

The genes, open reading frames, other predicted expressed sequences, and partial genes embedded in the contiguous (CONTIG) sequences were identified through a series of informatics analyses. Homology-based searches (i.e., BLASTX) were used to detect conserved sequences during comparisons of DNA sequences or hypothetically translated protein sequences to public and/or proprietary DNA and protein databases. Novel genes, i.e., with no known homologs, were predicted with the program GeneMark provided by Borodovsky's Bioinformatics Group at the Georgia Institute of Technology, Atlanta, Ga. The results of the homology and predictive methods were then merged into a single set of predicted coding regions, and their most probable translation.

The homology-based method used to define the *Xenorhabdus* gene set was BLASTX (see Coulson, *Trends in Biotechnology* 12:76-80, 1994; Birren et al., *Genome Analysis*, 1:543-559, 1997). BLASTX takes a nucleotide sequence, translates it in three forward reading frames and three reverse complement reading frames, and then compares the six translations against a protein sequence database (e.g. the non-redundant protein (i.e., nr-aa) database at NCBI). BLASTX is run with the *Xenorhabdus* contigs as queries against the GenBank non-redundant protein data library. To identify genes solely by BLASTX, the maximum BLASTX E value is set at 1E-08.

The method used to define the *Xenorhabdus* gene set was GeneMark. Protein-encoding regions in the *Xenorhabdus* nucleic acid molecules of the present invention were identified and the BLAST results and GeneMark analyses are provided in the Sequence Listing feature fields.

Example 5

This example illustrates the identification of peptides, tRNA, rRNA, promoter sequences, translational termination sequences, and the like from bioinformations analyses of the derived sequences.

The *X. bovienii* genome from strain Xs85831, as assembled from LIB4151 and LIB4152, consisted of $4.5 \times 10^6$ bases from the 444 sequence contigs. The smallest contig sequence had 126 bases and the largest one had 524707 bases, with an average contig size of 10,610 base pairs. The sequence contigs were annotated to identify genes and gene regulation elements. As a result, 5313 protein-coding genes (SEQ ID NO:1 through SEQ ID NO:5313, 2388 promoters (SEQ ID NO:10627 through SEQ ID NO:13014), 1436 terminators (SEQ ID NO:13015 through SEQ ID NO:14450), 19 ribosomal RNA genes (SEQ ID NO:114451 through SEQ ID NO:14469) and 72 transfer RNA genes (SEQ ID NO:14470 through SEQ ID NO:14541) were identified.

The *Xenorhabdus* genome was annotated by searching for homology to genes of known functions. These searches were done using homology to whole protein using BLAST as well as similarity to protein domains using Pfam and Hidden Markov Model algorithms. The annotations were then associated with the ORFs predicted by protein prediction models. The genome annotation was completed with FGENESB (Softberry, Inc., Mount Kisco, N.Y.), a bacterial gene/operon prediction and annotation pipeline developed by Softberry Inc. (Mount Kisco, N.Y., USA). The annotation database and parameters were updated and customized when processing *X. bovienii* genome. These annotations were assembled into a database that could be queried by searching for key words using wildcard text searches.

The analysis was done by performing keyword searches against the annotated genome sequences in the database. The present inventors contemplate that, since *Xenorhabdus* is an insect pathogen of, it may contain potent insecticidal molecules that are similar to the toxin complex (tc) toxins previously shown to be associated with *Photorhabdus*. The present inventors further contemplate that there may be many genes that are associated with virulence and pathogenesis in other eukaryotes. These may include, for example, hemolysins, lipases, and RTX (repeats in toxin) family of cytolytic toxins. All *Xenorhabdus* genes encoding proteins that exhibited homology to those proteins found in *Drosophila* (Fruit Fly) or *Anopheles* (mosquitos) were searched for homology to genes of known functions, as those genes may be those that affect pathogenesis in insects. Homologs of fungicides, nematocides, and other microcides, histone, proteins sequestering iron, polyketides and Non-ribosomal (NRP) peptides and HrpA-helicase were also searched for homology to genes of known functions. In addition, possible nematocides were searched using the prefix "Nema*", where the symbol "*" equals to a wild card. The exemplary key words used to conduct the searches included tc, toxin, RTX, hemolysin, lipase, chitinase, protease, ferritin, iron, chelin, arsenite, toluene, resistance, colicin, restriction, *Anopheles*, insect, *Drosophila*, ketide, NRP, polyketides, non-ribosomal, polymer, nema and nematode. A wild card was used with all searches.

The search results have shown that the *Xenorhabdus* strain Xs85831 has proteins that are homologous to many important known proteins or polypeptides. The search for homologs has also led to some new discoveries. Discovery of histone homologs was new as histones were not previously found in bacteria. These genes might make histones that would affect an insect's growth and development by disrupting its normal cellular processes. Fungicides and nematocides fell into many classes. The first step was done to look for any annotation containing the word "resistance" and put them into first class. Often these homologs referred to resistance to metals (e.g. tellurite resistance) or antibiotics (e.g. tetracycline resistance). Resistance homologs may also came about from small phage-like particles called colicins. These proteins may often be evolved from phage tails. Polyketides and non-ribosomal (NRP) peptides were very large proteins, often greater than 1000 amino acid residues, for example, SEQ ID NO's: 6035, 6037 and 8093). Proteins that affected fungi and insect skeletons included chitinases. Proteins sequestering iron were often a virulence determinant. Homologs identified included chelin and ferritin. HrpA-helicase homologs may be involved in a plant's DNA metabolism and may be used to improve plant transformation.

In summary, the nucleotide sequences are identified herein that encode many useful *Xenorhabdus* polypeptides or proteins, including but not limited to insect inhibitory polypeptides or proteins as set forth in SEQ ID NO's 7316, 9584, 9585, 9639 and 9679; cytotoxin proteins as set forth in SEQ ID NO's 5524, 5845, 5846, 5901, 5932, 5975, 6700, 7023, 7373, 7374, 7375, 7377, 7563, 7877, 8566, 8624, 8632, 8721, 8735, 9429, 9628, 9704, 9738, 9774, 9777, 9779, 9833, 10005, 10322, 10368, 10598 and 10605, which may be used as microbial inhibitory proteins including bactericidal, bacteriostatic, fungicidal, and fungistatic polypeptides or proteins; polyketide synthases as set forth in SEQ ID NO's 6034, 6035, 6037, 6038, 6040, 6041, 6042, 6817, 7170, 7360, 7361, 7362, 7363, 7550, 8093, 8094, 8095, 8186, 8686, 8687, 9049, 9100, 9101, 9104, 9108, 9322, 9324, 10039, 10228, 10229, 10257 and 10258; proteases as set forth in SEQ ID NO's 5589, 5625, 5958, 5959, 6156, 6298, 6300, 6404, 6530, 6602, 6839, 7599, 7682, 7706, 7735, 7737, 7941, 7999, 8072, 8137, 8267, 8568, 9284, 9336, 9368, 9729, 9921, 9984, 10021, 10022, 10143, 10201, 10263, 10327, 10371, 10372, 10411, 10412, 10413, 10430, 10580 and 10582; chitinases as set forth in SEQ ID NO's 6895, 8218, 8222, 10427 and 10583; restriction enzymes as set forth in SEQ ID NO's 6835, 7488, 8128, 8129, 8132, 8901, 8902, 8903 and 9854; histone homologues as set forth in SEQ ID NO's 5672, 5923, 6188, 7790, 7816, 7835, 8060, 9246, 9672, 9907, 9916, 10115, 10199, 10517 and 10540; ferritin homologues as set forth in SEQ ID NO's 5769, 5770, 6289 and 7552; biopolymer transport proteins as set forth in SEQ ID NO's 5799, 5801, 5802, 10481 and 10482; polypeptides or proteins capable of conferring resistance to heavy metals or other toxic compositions as set forth in SEQ ID NO's 6291, 6521, 7064, 7069, 7726, 7727, 7729, 7962, 8108, 8284, 10189, 10190, 10326 and 10406; Hrp-like helicase homologues as set forth in SEQ ID NO:8465 and SEQ ID NO:10227; and protein homologues to proteins from *Anopheles* species as set forth in SEQ ID NO:9502 and SEQ ID NO:9512. These proteins or polypeptides, offered by way of illustration and not by way of limitation, are just some of the exemplary proteins or peptides from the *Xenorhabdus* strain Xs85831 that are homologous to known proteins or polypeptides. Predictive functions and utilities of these exemplary proteins or peptides are described in the feature fields as set forth in the Sequence Listing.

Example 6

This example illustrates the evaluation of insecticidal proteins produced by *Xenorhabdus* strain Xs85831.

Insect inhibitory proteins produced by *Xenorhabdus* strain Xs85831 were evaluated using the following procedure. A 250 mL baffled flask containing 50 mL BHI medium in was inoculated with 1.5 mL bacterial stock culture and incubated at 25° C. and 280 rpm on a rotary shaker in the dark for 48 hours. The culture was frozen at −80° C. for at least 24 hours. The culture broth was then thawed, centrifuged at 2600×g for 30 minutes at 4° C. and decanted from the cell and debris pellet. The broth was then sterile-filtered (0.2 μm) and dialyzed. The culture supernatant was used without an additional concentration step for bioassays to evaluate insect inhibitory, fungicidal and bactericidal properties. Larvae were obtained using insect eggs obtained from commercial sources, hatched and reared using conventional methods.

Insect inhibitory activity was evaluated against members of the insects in the order Coleoptera that included Western corn rootworm (WCR, *Diabrotica virgifera virgifera*), Southern corn rootworm (SCR, *Diabrotica undecempunctata howardi*) and cotton boll weevil (BWV, *Anthomonas grandis grandis*). Insect inhibitory activity against corn rootworm larvae was evaluated as follows. *Xenorhabdus* culture supernatant, control medium (BHI) or Tris buffer, pH 7.0, was applied to the surface (about 0.38 cm$^2$) of a modified artificial diet (Bioserv™; diet product F9757) in 20 μL aliquots. The plates were allowed to air-dry in a drying chamber (16-20° C.; 40-50% RH) and the wells were infested with single non-diapausing neonate WCR hatched from surface disinfested eggs (Pleau, Master of Science Thesis, Saint Louis University, 1999). Plates were sealed, placed in a humidified growth chamber and maintained at 27° C. for the appropriate period (5-7 days). Mortality and stunting (0-3) scores were then assessed and statistically analyzed (SAS institute, user's manual for JMP version 3.2, 1989-1997). Twenty-four insects per treatment were used in all studies. Control mortality was generally less than 10%.

Insect inhibitory activity against the cotton boll weevil was evaluated as follows. *Xenorhabdus* supernatant, control medium (BHI) or Tris, pH 7.0, were applied in 20 μL aliquots to the surface of 200 μL of artificial diet (Bioserv™ Co., Frenchtown, N.J.; diet product F9247) and allowed to air-dry. Boll weevil eggs were then placed into the wells, the wells sealed and the plates held at 27° C., 60% relative humidity (RH) for 6 days. An activity score, based on confounding of frass production, growth and mortality was then assessed and analyzed statistically (SAS institute, ibid). Control mortality ranged between 0% and 25%.

The bacterial culture supernatant exhibited activity against Lepidopteran larvae, such as the tobacco budworm (TBW, *Heliothis virescens*), cotton bollworm (CBW, *Heliothis zea*), corn earworm (CEW, *Helicoverpa zea*), beet armyworm (BAW, *Spodotera exigua*), and black cutworm (BCW, *Agrotis ipsylon*). Activity was also observed against the European corn borer (ECB, *Ostrinia nubilalis*).

Insect inhibitory activity against Lepidopteran larvae was tested as follows. *Xenorhabdus* culture supernatant, control medium (BHI) and Tris buffer, pH 7.0, were applied directly to the surface (about 0.38 cm$^2$) of standard artificial Lepidopteran diet (Southland Products Incorporated, Lake Village, Ark.; Lepidopteran multi-species diet) in 20 µL aliquots. The diet plates were allowed to air-dry in a drying chamber (16-20° C.; 40-50% RH). The test wells were then infested with insect eggs of TBW, CEW or BCW suspended in agar. In the case of ECB, neonates were hand infested into the wells at one neonate per well. Following infestation, diet plates were sealed, placed in a humidity controlled growth chamber and maintained in the dark at 27° C. for the appropriate period of time. Mortality and stunting measurements were scored at day 5 and statistically analyzed (SAS institute, 1989-1997, User's manual for JMP version 3.2). Generally 24 insects per treatment were used in all studies. Control mortality generally ranged from 0-12.5%.

Insect inhibitory activity was also tested against *Lygus* bugs (Western Tarnished Plant Bug (WTPB), *Lygus hesperus* Knight) in the order Hemiptera. The insect inhibitory activity against *Lygus* bug was tested as follows. Feeding domes were made using a dome-making machine manufactured by Analytical Research Systems (Gainesville, Fla.). Briefly, the system used a vacuum to form domes from Parafilm™ sheeting using an aluminum block template shaped in the form of a 96-well microtiter-plate. To each such formed dome was added 40 uL of a 1:10 (v/v) dilution of test solution in diet. The dome-molded Parafilm™ was then heat sealed with a sheet of Mylar. The resulting Parafilm™ dome sheet (96-wells) was placed onto a 96-well flat-bottomed microtiter plate containing one *Lygus* nymph per well. The assay was typically scored after 4 days for mortality and stunting, using a scale of 0 (no mortality or stunting) to 3 (complete mortality).

The bioassay results demonstrated that the culture supernatant containing insecticidal proteins from *Xenorhabdus bovienii* strain Xs85831 exhibited significant insecticidal activity against most of the insect species tested. Specifically, the culture supernatant exhibited very strong insecticidal activity against BCW, CEW, SCR and TBW and exhibited a comparatively weak insecticidal activity against WCR and FAW. However, the bioassays conducted have not yet shown that the culture supernatant exhibited any insecticidal activity against BWV and WTPB.

Example 7

This example illustrates the construction of a plant transformed to express a protein of the present invention.

It is desirable to express a XIP protein such as that set forth in SEQ ID NO:7316 (a *Photorhabdus* species TcaC insecticidal protein homologous sequence) in a cotton plant to protect cotton plants from *lygus* bug infestation. A nucleotide sequence preferred for expression in a cotton plant, or other dicot plant, is constructed according to the method of U.S. Pat. No. 5,500,365 to achieve a sequence that exhibits improved levels of expression of the TcaC homologous amino acid sequence in cotton plants. The synthetic nucleotide sequence encoding the TcaC related amino acid sequence is introduced into a plant expression cassette in a plant expression vector under the control of a plant functional promoter, and the expression cassette is introduced into the cotton cells along with a selectable marker. Cotton plants (transgenic events) are produced after an appropriate period of time that contain the expression cassette with the synthetic XIP expression sequence. Transgenic cotton events are screened for expression of the TcaC homologous protein using antibodies specific for the TcaC homologous protein. Transgenic events exhibiting preferred levels of expression of the TcaC homologous protein are exposed to *lygus* bug infestation and control of *lygus* infestation is scored, and events that exhibit the greatest levels of control become commercially acceptable commercial embodiments.

In summary, the above specification describes preferred embodiments of the present invention. It will be understood by those skilled in the art that, without departing from the scope and spirit of the present invention and without undue experimentation, the present invention can be performed within a wide range of equivalent parameters. While the present invention has been described in connection with specific embodiments thereof, it will be understood that it is capable of further modifications. The present invention is intended to cover any uses, variations, or adaptations of the invention following the principles of the invention in general. Various permutations and combination of the elements provided in all the claims that follow are possible and fall within the scope of this invention.

SEQ ID NO's referred to herein are listed in the Sequence Listing on CD-ROM which accompanies this specification, and are not provided in paper copy due to the large number of pages that would be required for handling of the sequence listing.

All patent publications referred to in this specification are incorporated herein by reference.

SEQUENCE LISTING (14985 sequences)

SEQ ID NO: 1 - DNA, 525 bp, Xenorhabdus bovienii
  unsure (1)..(525): unsure at all n locations
  Coding sequence Name=Xb4151_4152.C1.gene1.dna; Position on contig =32..556bp; Strand=-
atgcgtcaggcggggcgatatttgcctgaatataaagcaacgcggcaggaggcgggagatttcatctcgttatgcaaaaacactgaactggcctgtgaagtgacgctccagcctctgcgtcggtttccgctggatgcagcaattctgttttccgatattttgactattcctgatgcaatggggcttgggctgtatttcgaaactggggaagggccgcgttttcactctccgattctcaatcatacagatgtggaaaaactccctgtacctgatccggagatggagctgggctatgtcatggatgctgttcgtgcgatccgtaaggcactggcaggccaagttcctctgataggtttttcgggtagtccgtggacactggcgacgtatatggtcgaagggggaagcagtaaggcgttcaccaaaataaaatccatgatgtatgcccaacctgctacgttgcatctgttactggataaattggcaaacagcgttattctatatttgaacgcgcaaataannnnnnnn

SEQ ID NO: 2 - DNA, 507 bp, Xenorhabdus bovienii
  Coding sequence Name=Xb4151_4152.C2.gene1.dna; Position on contig =232..738bp; Strand=-
atgaagttgatgatcaaaaaacagtattatgactatttagtccagaaatcaacaaaatcggctgttaaccttaaaatatacgccactaccggtattgctcaattcatcgggtttgaaacaatattcagtcggagggtatacaatcaaaaacaagttatgtttattacgtcttctccaattgctgtttccgacgacttcgatccacccatcattgaggaaacatatcagtcctccactttaacaaggccagatcaacccgattatttccatttcatgatcccgcagaataatcatttacatcccggtgatttcatcatcggatttgtgacggatgatgataaacacatttataaaaaaaacctgatcttcggggaggtagcggttgccgaagatggatattttagatttaaagtgtacatgaccagttcggcttatttattggtatatatcagtcaatcaatatccacagtatcggtaacaaaggaattgaggtctggctgccagtag

SEQ ID NO: 3 - DNA, 147 bp, Xenorhabdus bovienii
  Coding sequence Name=Xb4151_4152.C3.gene1.dna; Position on contig =25..171bp; Strand=-
atgaaacagcggctgaaaagcgcgttagcgttattagatgatgacactatagagcagctggttggccattttctgctggtaaaccagagctcgcgttttgatgccctgttagttttcttgcttaacgccaagaagagggtcatctag

SEQ ID NO: 4 - DNA, 147 bp, Xenorhabdus bovienii
  Coding sequence Name=Xb4151_4152.C3.gene2.dna; Position on contig =171..317bp; Strand=-
atgatggaatgcatcattgatggtgcactattaccgcctgtttcattactgctgttgcagaaaatggccgcaggcgcggcaatcagtgacattcgcttaaccgtagcagaacatgagttccatgctgaggttgaggaggcagaataa

SEQ ID NO: 5 - DNA, 213 bp, Xenorhabdus bovienii
  Coding sequence Name=Xb4151_4152.C3.gene3.dna; Position on contig =671..883bp; Strand=-
gggtacaacagttcatcggaattgggcggtcaaattctgggggatagcatcgagtcagttgcagcagtaactctcgctaagaccatcgaaaatacggtggaggaggggtctcaaggggagacagagcacggaagctattgctcaagtggactcagaagccactctaaagagcaatccctgatggaaaaactggctctatcagcgctcgactga

SEQ ID NO: 6 - DNA, 144 bp, Xenorhabdus bovienii
  Coding sequence Name=Xb4151_4152.C6.gene1.dna; Position on contig =508..651bp; Strand=+
ttggggggttctggggctccccacccccccggggagatgggggttatgggcgccccccaaaaattctatgggggtaaaggggggcggttaaaaaaaaaacctttggaagaaaaagggggggttttctcccgcgtgggagaatag

SEQ ID NO: 7 - DNA, 183 bp, Xenorhabdus bovienii
  unsure (1)..(183): unsure at all n locations
  Coding sequence Name=Xb4151_4152.C11.gene1.dna; Position on contig =289..471bp; Strand=-
ttnnncgggaaaaaattnnncccctnnnaaaaaaaaaaaaaaaaanccncccaaaaaaaaaacaaaanccttnaaatccncccccccnntccctnnnnnccaaannnccccaaaaanaaggaggcccatatcgttaagnnaaggtcggccgctgccaaaaaaaaaaaacnanaaaaaatataa

SEQ ID NO: 8 - DNA, 282 bp, Xenorhabdus bovienii
  unsure (1)..(282): unsure at all n locations
  Coding sequence Name=Xb4151_4152.C20.gene1.dna; Position on contig =389..670bp; Strand=-
ttggggggggtgtttaaaaaaaattttttgtggggggcccggggngngnncncccccaaaaaaaaancccgggggggggggggggggggggggggaaaaattttgggggaaaaaaaaattttttttttcccctttttggggggggagaaaaatttggggaaaaaaaattttggggggggcggggggggcnacaaatttaaaaaaagggggggaaaaaagggggggaaaaaaaaanccccccaaaattttgggttttccaaagggaaanaaggggaattttaa

SEQ ID NO: 9 - DNA, 183 bp, Xenorhabdus bovienii
  unsure (1)..(183): unsure at all n locations
  Coding sequence Name=Xb4151_4152.C25.gene1.dna; Position on contig =193..375bp; Strand=-
atggtgggcctnccggggccggcccaaaacccgggttttttnntcnncccctggttttggnaatgggggnccttncccgttttgggnttctttgggnnaggnatntnngnnncgtnnntcnnnccgttnattgtngnnaaagnncttgnnanacctatntnnnccagtntnttnnnaaagtna

SEQ ID NO: 10 - DNA, 522 bp, Xenorhabdus bovienii
  unsure (1)..(522): unsure at all n locations
  Coding sequence Name=Xb4151_4152.C26.gene1.dna; Position on contig =17..538bp; Strand=-
ttggggggggggggggggggcgggccccccgggggggggggggggggggggggttttttcccccncgcccatttttatgggggggggttttttttaaaaaaaaaccccggggggggggggggggggggggggggggttttggggggggggtttttttttggaaaatggggggggggggaaattttgggggggggggggtttttgggggggggggggtttttggggggggggggggggatcccggggggggcccggggggggggggggtggttttgggggggggggggggttttaaagggggggggggccggggccggggggggggttgggcccgggggggttgggtgggtccgggggggggtcccatttgataggggggggttttcctcgggggtggccggcacgggcggggtcgggtccgggtttagggcctnnnnnntttttgggggnggnggggggggctcccnccccccccccnccnnnnncnccccccccnncnnntttttttttttttttnnnnnn

SEQ ID NO: 11 - DNA, 213 bp, Xenorhabdus bovienii
  unsure (1)..(213): unsure at all n locations
  Coding sequence Name=Xb4151_4152.C26.gene2.dna; Position on contig =442..654bp; Strand=-
ttgggggggggggggggggggggggcanttttgataggaaaattaaannnnnnnnggggggggggggggggccccccntttttttttttcccctcgggcccgggggggttttttttttggggggggggggggggggcgggccccccgggggggggggggggggggggggttttttcccccncgcccatttttatgggggggggttttttttaa

SEQ ID NO: 12 - DNA, 192 bp, Xenorhabdus bovienii
  Coding sequence Name=Xb4151_4152.C38.gene1.dna; Position on contig =384..575bp; Strand=+
gtgggggggggaaaacgggggggggggcaaattttaaaatttttggggggccaaaaaattttagggaaaagaggggggggggaaatggggaaaaattttccaaaaacccccccacaaaaattcccccccttaaaaaaaccggggcccccgtgggggaaaaaaaattttccccccccccgaggggggttttaa

SEQ ID NO: 13 - DNA, 138 bp, Xenorhabdus bovienii
  unsure (1)..(138): unsure at all n locations
  Coding sequence Name=Xb4151_4152.C40.gene1.dna; Position on contig =329..466bp; Strand=+
atgggngaganctggggggaaaccccgcgcccccaaggggggtggggtccttctggaaaaaagggggagaaaaaaatttttttttggggggggggggggaaaaaaaaaaaaaaaaaaatttttgggggacaaaattaa

SEQ ID NO: 14 - DNA, 255 bp, Xenorhabdus bovienii
  unsure (1)..(255): unsure at all n locations
  Coding sequence Name=Xb4151_4152.C40.gene2.dna; Position on contig =450..704bp; Strand=+
ttgggggacaaaattaaagaagggggggggggggggtgttcacaaaacaaaaagggggagaaagggggggcaaaaaccctttttttagaggggggggttaaaaaggagagaaaaaacccgggggggaacaacgccgggtgggaggagggaggggggtttttttggggcggggccccccccacaaaaaaagggnnncggcccggggggataaaaaaaaacggggggcgggggggaggggggnngaaaantttttaa

SEQ ID NO: 15 - DNA, 582 bp, Xenorhabdus bovienii
  unsure (1)..(582): unsure at all n locations
  Coding sequence Name=Xb4151_4152.C43.gene1.dna; Position on contig =176..757bp; Strand=-
ttggggggccccctgggggggggggaaataaaaaaaaaattttttttaaaaaaagggggggggggtttgggggggggggtggggggnnnaaaannnnnnnannaanggggggggggggcccccaacctcggggggggggggnaaaggggggnaatatgggggggggggnggggggaaaaacccctggggggaaagggggcggggggggggaaaattgggggggggggggggttaaanaccccccgcggggtctcttncctcggggggccccccccaatttttntnttttngggtgggggggggttgggnnnnnaaattatttttaaaagggggggnaaatataanncccnaaggnnaaaaagggggggntcccgggggncagggnccngggtggggggggggttggnaaccgncgggggtttctnttnnnnntcnnnggggtnggnnggnncgnttaggggnggnnctcggggggggnnnaaacccgggcnnggggggtttttcccnncncggggggggggcnnnnnnctaaaaattattnaaatnnnnnnnnnnngggggggcggggcncctcctctttaa

SEQ ID NO: 16 - DNA, 474 bp, Xenorhabdus bovienii
  unsure (1)..(474): unsure at all n locations
  Coding sequence Name=Xb4151_4152.C44.gene1.dna; Position on contig =156..629bp; Strand=-
ttgggggggggcacttttttgggggttttttttgnccccgggggggggttttttaaaaaaggggaggggggggaaaaaaacacnnaaatttttggggtttttgggggcgggaaaaagggggggttttttggggttttttgggggggggggtttggnattttttttttttgggggggggncttttttgggttttggttttnncccccaaaagggggggttccncaggggncgggtttnnnnnttgggggggnaaggggnaggnaaaaaattttaanccngggggnanagngnnatcnttnncananantgtttnntttgggggggggggggnaaaaaaaaaacgggggccncnggggggtttttttccccngggggcnnttttttttttttnnnnnnnnnnggtggggncntttttacccncncnaaaaaaataaaggggggaaattttttttctttcnntttttnnnnnnnnnn

SEQ ID NO: 17 - DNA, 414 bp, Xenorhabdus bovienii
  Coding sequence Name=Xb4151_4152.C50.gene1.dna; Position on contig =3..416bp; Strand=+
tacgaattcgagctcggtcccccattgagtgttgtggtcagttcattacagccacaggaagaagatatctatcctctggcgggtgatgaaaaactgctgcaagtccgtggagaatatttaccgctactggaattgtaccggatatttgatatttcgagcggagaaacctcgccaaccaaaggtattgccgtcattgtccagagcgcggggcgccgctatgctttgctggtggataaactggtcggacagcatcaggtggtcgttaaaaatatcgagagcaattaccgtaaagtacctggcatttcggctgccaccattatgggagacggtagtgttgccctgatcattgatattcctgctttgcagaaactcaatcatgaacagttggctacgcgtaaggcggagctggtgtaa

SEQ ID NO: 18 - DNA, 183 bp, Xenorhabdus bovienii
  unsure (1)..(183): unsure at all n locations
  Coding sequence Name=Xb4151_4152.C50.gene2.dna; Position on contig =660..842bp; Strand=+
ttgaggatcaaattctcgcaggaaaacgtcacttataacgacaacaccgtcgtgattgtcctgaacctgcttaatcgtgtggtggngattgtgntcgatggtgtgtccgatgtgctgtctctgaaaggacgatcaatttgtccagcgncgnagtttgcngntaccttgtcactgaatatctga

SEQ ID NO: 19 - DNA, 285 bp, Xenorhabdus bovienii
  unsure (1)..(285): unsure at all n locations
  Coding sequence Name=Xb4151_4152.C52.gene1.dna; Position on contig =40..324bp; Strand=-
gtgttttttctttttnnnnaannnnntgttggggggggggggggggnnnnnnnnnccttttttttttctttcccccccccccccccnaaaanaaaaaaaggggggggggggggggggggggggggggggggggggaaaaaaaacccccccncnnnccgggcgccgnncgcnnccnngnncccgnccctnggccncnncnccnnccnnncnnnctnnnnnctttnnnnnnngtnnnnnnnncctnnnnnaaaaaaaaaaaaaggggaacctnnngagaaaagttaa

SEQ ID NO: 20 - DNA, 297 bp, Xenorhabdus bovienii
  unsure (1)..(297): unsure at all n locations
  Coding sequence Name=Xb4151_4152.C65.gene1.dna; Position on contig =401..697bp; Strand=-
ttggggctttggggttgggaaaaaaagaaaattttggggaaatatttaaaatttaaggggggcaaaggagggggggcccccaaaaaaggggggggggggggcccttggggtgtttccttaaaaaacccggggttttccccttttcccaattttttaattnnnnaatatattaaaaaggggggggcncccaaaaggcccaaaggggcgggaaaggnaaaaaaaanaaaattanctttggggnnnccgggggtttttnnaatnccggttattgggttttttnnaaaaaggttnncctaa

SEQ ID NO: 21 - DNA, 207 bp, Xenorhabdus bovienii
  unsure (1)..(207): unsure at all n locations
  Coding sequence Name=Xb4151_4152.C67.gene1.dna; Position on contig =536..742bp; Strand=-
atgtcnngnannaatgtanacnnnctccncnncntgtgngcggnnncctncttngcncgnnntttnggngctacnncaaannnggagccntcnngnanngaanngnnnnaannngnnngcnnaangggngncnttnnngtnanannnnttgnngnnnantnncnaananancnnctgtnnngagttnnaagnnnnnggnaaagttna

SEQ ID NO: 22 - DNA, 120 bp, Xenorhabdus bovienii
  unsure (1)..(120): unsure at all n locations
  Coding sequence Name=Xb4151_4152.C69.gene1.dna; Position on contig =26..145bp; Strand=-
gtggggcggggggaccgtaccggtctgtacggccgggggagagacggggagcagggcggggggcgtggatgggggggtgttgcctnggtggtngagtggtgggtagggaaannnnnnnnn

SEQ ID NO: 23 - DNA, 474 bp, Xenorhabdus bovienii
  unsure (1)..(474): unsure at all n locations
  Coding sequence Name=Xb4151_4152.C69.gene2.dna; Position on contig =320..793bp; Strand=-
ttntttttttttnaaaaaaaaaaaaaaaaaaccccccnttttttttttttttttttccctcgcgcgggggaggaaaaaaaccccccccccccccgcntggggagggggggtgtgttttttttcccccccccccaccaacaaaaaaaaaaagaaaacgggggggggggtttttttttttttttctccccaggggggggggcccctctttttttttttttttcccccccccccccccaattgtttttgttagaaaaaaaaaaaaaaatattgggggggccacaaaccctttgtttttttttccccccaaaaaagccccgggttccttttggggagaggaaattttgggaaaaactttattgggtttttaaaaggggcttttcccccttgtttttttccccaaactttggacacaaaaaatcccttcaaacttttatttttttgggcttgggcgccctttacaggcttttgggatga

SEQ ID NO: 24 - DNA, 192 bp, Xenorhabdus bovienii
  unsure (1)..(192): unsure at all n locations
  Coding sequence Name=Xb4151_4152.C73.gene1.dna; Position on contig =296..487bp; Strand=+
gtgacaggtcgaaactctagaaggggaattccntntcttgggggaacagggaaaaaacaaaggaagccggtttgtaaaacaaatttcaaacaaatcaaaacctgggggaaagttataacacctctcggtggggaaaccctcaacggtntaaaaaacaaaggccaaacaattctcaaggccaaaaaaaaatag

SEQ ID NO: 25 - DNA, 183 bp, Xenorhabdus bovienii
  unsure (1)..(183): unsure at all n locations
  Coding sequence Name=Xb4151_4152.C89.gene1.dna; Position on contig =143..325bp; Strand=-
ttgaaggtgncggaaattncttcgttancttggaatnccancgncgccattcttttgttaaacatgccgggagaaaatcagannaccggtaaaaccgctcccttacgagtcggnnaagcgggattccggaccnngncgaacttgcgcccacacagtgcgcttagcggttctnctacgatttga

SEQ ID NO: 26 - DNA, 189 bp, Xenorhabdus bovienii
  unsure (1)..(189): unsure at all n locations
  Coding sequence Name=Xb4151_4152.C89.gene2.dna; Position on contig =276..464bp; Strand=+
atggcgncgntggnattccaagntaacgaagnaatttccgncaccttcaaccaaaacacgggtcctggggggtttggaccaattcggtttgggggccccaaaccccggaagaaaaaacccggtttggaagggcctccctggaagggcgggccctgggggaaatcttgggctttgggtttgggggggtaa

SEQ ID NO: 27 - DNA, 204 bp, Xenorhabdus bovienii
  Coding sequence Name=Xb4151_4152.C89.gene3.dna; Position on contig =440..643bp; Strand=+
ttgggctttgggtttgggggggtaaaaaaaccgggggcaaaaaaaaccaagccccggggggggtttaaaaacccccggggggtcttttttttaaaaccaaatttttggaaaaagggtgtggtgaaaaaaccccaggggggggttgggggggtttttaaaaacccgcgggagaaaaaaaaaaaagggggggggaaaaaagtataa

SEQ ID NO: 28 - DNA, 186 bp, Xenorhabdus bovienii
  Coding sequence Name=Xb4151_4152.C98.gene1.dna; Position on contig =286..471bp; Strand=-
atgtttttctcctctggggggggggtaaaatatattttcccccccccccaaaaaacggggggggggcccccccaaaaaaaaaaaaaggggaaaaaaaaccccctcttggtgtggaaaagaggtttttctccttgggggggaaaaaataaaaaaacacccccccccttaagggacccctttttttaa

SEQ ID NO: 29 - DNA, 201 bp, Xenorhabdus bovienii
  Coding sequence Name=Xb4151_4152.C104.gene1.dna; Position on contig =199..399bp; Strand=+
atggcagatcaagcaacatgtttggctgaaccgattcacatgcaggaaaaatattatgtggggcggccaaccttaacggggggggaggctacccttggaaaaagcttcctgggaaaaaacccggggggggaaaaatttgggacccggggcctgaattttgcgtgggtaaccaacgggccctcccccttgaaaagggtataa

SEQ ID NO: 30 - DNA, 132 bp, Xenorhabdus bovienii
  unsure (1)..(132): unsure at all n locations
  Coding sequence Name=Xb4151_4152.C108.gene1.dna; Position on contig =404..535bp; Strand=-
atnnggctcnntnnngaggtcgnnnnnnccttngngggggggnccccccanaacaccgggnngggggggcgtgnntnnnaaaacnccccggggnggctanaaaanatnctcccnctcgntnnnnaaaantaa

SEQ ID NO: 31 - DNA, 165 bp, Xenorhabdus bovienii
  Coding sequence Name=Xb4151_4152.C117.gene1.dna; Position on contig =575..739bp; Strand=-
ttgggggggggtgcacaaaattgggggaaaaaatatggggggggaaaaaaatattgggtaatatatcccccgggggggccccccccacaattgtggggtgtttgggaaaataataaaccccgggggggggtgggtgggtttaaaaaaaaaaaaatttttttttaa

SEQ ID NO: 32 - DNA, 574 bp, Xenorhabdus bovienii
  unsure (1)..(574): unsure at all n locations
  Coding sequence Name=Xb4151_4152.C123.gene1.dna; Position on contig =1..574bp; Strand=-
gtgtcgccgttttcacaaccaaccacacccccacccacacaaaaaaaaaaggggggggggggggcccccccccccgccggggggggggggggcacccccaccacccctctcccaaaaaaaaacccccaaaaaaaccgccccccccccccccacgggggggggggaaaaaacacagggggatttttttccccaaaaaaaacccccncggggggnggcccccccccccccccaacccccttnnnntttaaaaggggtttaaaaacaaaaaaaaaaaaacaccccccccccttttttgggggggggggggttcacaaaaaaaaaccccccggggcccccccccccccaaaannnnaaaaaaaatttttttttttnccgggggttttttttggggttnnnncacctttcccacccaaagcaacaaaaaaaaaagnttttttccccttnccggggcccccccccccccccccccccccaaaaaatttnccaaagccccaacaaaaaaacnnccaaaaaaaaaaaacaaaaaacgggcttttcccnnnnacccccacctccgctganntttacagccgat

SEQ ID NO: 33 - DNA, 396 bp, Xenorhabdus bovienii
  unsure (1)..(396): unsure at all n locations
  Coding sequence Name=Xb4151_4152.C123.gene2.dna; Position on contig =720..1115bp; Strand=-
gttttggttgggggtatagagacaacaggcaaccagccgcaccaacaaaaanaaaaacacaacacaaccggancccaacacaaacctcccccaccgcagcacaaaaaccgcgaccaaacaacaaccaccacaaaccacccgggcaacaaccaaacaccanngaaaaaagaaagaaaagaacaccacacaacgcgccaccccgtcgcgaccaacactaaagaaaaaaaaaacaacaaaaaaaccaaaaagaaaaatctcctttctttatctcttaanaccatcgtgngggaaggaaggggccacccagannacccaacnccaaaacaaacaaacaacaacaaccccaccccccaccacccaacacaacaaaaacagcgncnnncccccnacaaataa

SEQ ID NO: 34 - DNA, 174 bp, Xenorhabdus bovienii
  Coding sequence Name=Xb4151_4152.C130.gene1.dna; Position on contig =43..216bp; Strand=-
ttggggccccccccctctaaaaaaatcccccaggggggggtgggcagctttatttttccccccaacccctttttaaaacaaggggccttccccacgggaaaagcaagggtaagggggctaaaaaatgagatgatcgatacgtgtccagagatcaattctacgtcactcatgtaa

SEQ ID NO: 35 - DNA, 144 bp, Xenorhabdus bovienii
  unsure (1)..(144): unsure at all n locations
  Coding sequence Name=Xb4151_4152.C142.gene1.dna; Position on contig =45..188bp; Strand=-
gtgnttcccnnnctnnnnnnacanncanagttaatccgccggggggcccccgaaacccacaccggaaaanccnngggccnccaaacccccccccaacnnnnnnnnnncnaacaggccgctcctttnnnnnnnaaagagannnnn

SEQ ID NO: 36 - DNA, 456 bp, Xenorhabdus bovienii
  unsure (1)..(456): unsure at all n locations
  Coding sequence Name=Xb4151_4152.C142.gene2.dna; Position on contig =460..915bp; Strand=+
ttgctgcagaggggggggggagaaaacacaaagggggggaaggttgtccgcgggagtgcccccaaccccgggggggaagggtgggggcggggggcggagagggaacaaagcgggggggggggaagatattccccccccccccaaaagtgtgtggtgtgtggtcccccacaaaaaaaccttttttcaaaaccaaaaatttttatagggtataaacgcccccctgcgggnnnnnnnnaacaaccctccctccaaaaaaaaaatataggggggggggggggaggaagcgggggnaaaaaaaaaacccccccccggggggggggggggaggggggggaaggggggcccncccccccgccccccccccccaggggggggggggggcgcggggggccccttttttnnnttntntnataannnnnnccttttttttcgcgggggggggggggggcgaaaataa

SEQ ID NO: 37 - DNA, 546 bp, Xenorhabdus bovienii
  unsure (1)..(546): unsure at all n locations
  Coding sequence Name=Xb4151_4152.C158.gene1.dna; Position on contig =3..548bp; Strand=+
gggaaggnnnnttnngggnggggttnngggggnnnnnnngccctgtctggggggggccttaacaaatttcgggggnggngggcgccggcctctttnttttttttgctngggcggccctctcccccctcctcctcccccccgcggcgggtctccctcgcggcgtggggtgtcttgcgccttctcctcttctctgcccctgcctccccggctnctcctgctctcctgtgtgcgctctcgggcggcgggggcctggcgtcgcgtccggccctctttccttcgtgcccggtggccctgggggtgtctttttgggcgggggggggggggcctcctcttggcccggggggcccgctcgccccgctcctcctctccctctggctgcccccttcccccctctcccctttcccttttctcccctgggggggggccgggggggggggccctcccccccccccgggggaaaaaacccggggggaaaaaaaaaaaaaaagttttttttttttttggggggcnnnnnaaaaaaaanaagnnctntttntttttgcttaa

SEQ ID NO: 38 - DNA, 279 bp, Xenorhabdus bovienii
  unsure (1)..(279): unsure at all n locations
  Coding sequence Name=Xb4151_4152.C158.gene2.dna; Position on contig =733..1011bp; Strand=-
gtnaannnttttnnncnnnnngacnnnntgcannancngnnattnntgnnncnnnttncnngnnnngctanngnnngcttgnnnnncnnnnnnnagngnngnntnctnnngntgntnnnnnnaagccgnnnngnngncnnatgnngtgttnnngtnnnccagttccnnccngtntnnntttnngnttgnncntttnnnttcgncnngnttncttnnnttnngtngncgttgtnnnntnnnctaatnttnnngtgccttaattncgngtgttntgnttna

SEQ ID NO: 39 - DNA, 333 bp, Xenorhabdus bovienii
  unsure (1)..(333): unsure at all n locations
  Coding sequence Name=Xb4151_4152.C162.gene1.dna; Position on contig =520..852bp; Strand=-
ttgntgtgtggggnngtggggggggtgttgtgggtgttggtttgttgnnnnnngtgntttgngtgnggggnggttggggtgtggttgnttngtgggtgtggnnngggttggnnngttttgnggnnttngttnnntttttggttggnttgtngttnnngnnggngtgngngggggggggggggnnnngggnngngngnntnggtgtnntngtggtgnngnnnggnggggggggggnnggnnnggnnnggggggnggnngnggggggttgggggggggggggggggggggnggngggggggngnnttgngggggnggtgggggnnggggggttaa

SEQ ID NO: 40 - DNA, 276 bp, Xenorhabdus bovienii
  unsure (1)..(276): unsure at all n locations
  Coding sequence Name=Xb4151_4152.C165.gene1.dna; Position on contig =345..620bp; Strand=-
gtggtttctttcccnctttcctttnttttttttntttnggggnaaggggcaaaagcggnngggggnngggtttttaannntttttccnntttncnnnnnggggccnggtgggngnaaaagggaaaaaaaacttctcgcggggtctggcttgtgttggtgnnnctctncggggggnnnnccnnnncggngntcgtgctaccccccaaaggggttcctgtcctcgcgggggggggggggggccccccccccccggggtttaaaacagttggtgcttga

SEQ ID NO: 41 - DNA, 249 bp, Xenorhabdus bovienii
  unsure (1)..(249): unsure at all n locations
  Coding sequence Name=Xb4151_4152.C170.gene1.dna; Position on contig =29..277bp; Strand=+
atgtcgtatcgcttcgcgacggtgatatacacgagctttcccctgtggnttggaagtcctgtggtgccaaatgtacaaggcttcccggatgccgggttttccgttagaatgttcgggaaaaaaatcggggcaaaaacccggggagaaggggtaaaatttttggggcttaaagggggaaaaaaaggggggttcccccgttttttcggggggggggggaaaaatctggccaaaaaccccaaaaatttttaa

SEQ ID NO: 42 - DNA, 147 bp, Xenorhabdus bovienii
  Coding sequence Name=Xb4151_4152.C173.gene1.dna; Position on contig =164..310bp; Strand=-
gtggttttgggggggggggggggggttttttttttttttgggggggggggggggcgggaacacggggggggggggggggaaatgggggggggggtttcccccctattttttttgggggggggtacccccccgggaaccccggtttaa

SEQ ID NO: 43 - DNA, 213 bp, Xenorhabdus bovienii
  unsure (1)..(213): unsure at all n locations
  Coding sequence Name=Xb4151_4152.C174.gene1.dna; Position on contig =455..667bp; Strand=-
ttggggncnntgggttgggnancnaaattggtggnnctctntttagtttcnctncncgggggggggttcgcgtcgggnaaggttnnattnctgcnnttccttttnntnnnnaaagcgggncttgggttntttctaaaaattcgcggcttttataaannggggggggggggcnnnnnaaaaaaaacagggaanaggtttgcggggctttattna

SEQ ID NO: 44 - DNA, 159 bp, Xenorhabdus bovienii
  unsure (1)..(159): unsure at all n locations
  Coding sequence Name=Xb4151_4152.C174.gene2.dna; Position on contig =927..1085bp; Strand=-
ttggtgttanattctttttggagaggagggcgggncccctggggggcggtttatttagagaggggtctaaaaagagaagagggggnttttggggtgntcttncctggngggggcgttcttggtggggggattaatgtggggngggggctttttgggtga

SEQ ID NO: 45 - DNA, 373 bp, Xenorhabdus bovienii
  Coding sequence Name=Xb4151_4152.C175.gene1.dna; Position on contig =313..685bp; Strand=+
ttggatttgttcgaaactaagatcgaacagttggcagatgtgattgaaaatatttacagcgtactggaatccctgagtcgagttatcatggaaggcaagcagggggatgaatttgactcagcgctttcaaaccttgccgagcaggaagatatcggctggaaagtccgtctgtgtctgatggatagccagcgcgcgctcaacttcctcgtgcgtcgcgcccgcctgcccgctaatcagcttgaacaggcccgcgaaatcctgcgagatatcgaatctctgttgccgcataacgaatccctgttccagaaagtcaactttctgatgcaggcggctatgggtttcatcaatatcgaacagagccgcattatcaaaa

SEQ ID NO: 46 - DNA, 384 bp, Xenorhabdus bovienii
  unsure (1)..(384): unsure at all n locations
  Coding sequence Name=Xb4151_4152.C176.gene1.dna; Position on contig =148..531bp; Strand=+
ttgcnncccggttatgtcagagttagttggggcggcgggccgcgaagatcaggagacacgtggatcaagcaggtcggccgcacgggggggtnaaagcgagattggcaggtagcggggggagggttcagaccggggggggggcccggcaagggggggaacgggggcgggtgggacctacggggggaaaccggagaggggcgccaggggaaaaaaagaggggcccaaaaagggcccggggggggcaacaatacggagcggcccaaggaaaggggggggggggcgaaacaacggggggggggggggggggagagctcggggggcaaatggggggtctccccaaaagggggggcaaaaaggggaaaaaaggggggcccttttaaataa

SEQ ID NO: 47 - DNA, 189 bp, Xenorhabdus bovienii
  unsure (1)..(189): unsure at all n locations
  Coding sequence Name=Xb4151_4152.C183.gene1.dna; Position on contig =488..676bp; Strand=-
ttgggtggggggggggttaaaatgggtgggggggggggccaattttttttggggaaaaatttggggttttcgggggttgggaaacgggaaaaaacgcgggggaaaaaaggtatttttaccgggggcaaagcacaaggcncanaagtttgggggccggggncaaaacggttcnntctttttnnnccctag

SEQ ID NO: 48 - DNA, 195 bp, Xenorhabdus bovienii
  unsure (1)..(195): unsure at all n locations
  Coding sequence Name=Xb4151_4152.C189.gene1.dna; Position on contig =420..614bp; Strand=+
atgtggggggntatttgggaaaatcccctccggggcaaaaaggggggcctttttgggggcntaataggcccccccttttttccccctaaaaaaaaaggggggggggaatttaattttacccccccccccccgggggggggggaaaaaaaaaaaaatcccgtggtattaaaaaaaaccccctctgtgggaaaataa

SEQ ID NO: 49 - DNA, 186 bp, Xenorhabdus bovienii
  unsure (1)..(186): unsure at all n locations
  Coding sequence Name=Xb4151_4152.C196.gene1.dna; Position on contig =361..546bp; Strand=+
atgcctatctgcgatgtttctatcaaccgcctttcaacgcttgagggtaaggtaaggacccgggcaaaaatttcccccctttgggcctggaaattaaagggggngccccaaatggctctcattgccgccaaaaaaatcccaaaagggggtgaaattggcccccaaaaacccggtccccttttttag

SEQ ID NO: 50 - DNA, 147 bp, Xenorhabdus bovienii
  Coding sequence Name=Xb4151_4152.C200.gene1.dna; Position on contig =480..626bp; Strand=+
atggtcctggaatttcaaggggaaacgcccctggaaaacgggttgggggccttgcccccttcatggggtgggggtataagggggggggagacccttggccaaagtttggtttcccggggggggggggggggcctttttggggggtaa

SEQ ID NO: 51 - DNA, 168 bp, Xenorhabdus bovienii
  unsure (1)..(168): unsure at all n locations
  Coding sequence Name=Xb4151_4152.C207.gene1.dna; Position on contig =517..684bp; Strand=-
ttnnnnnnngnnnnnnnnngnnnngggnngggnnnngggggggnnnnnnnnnngnnnnnnnnnnngggnnnnnnnnnnnggggnnngngngnnnngnngnnngnngngcgcaaaaaaaaaaaatttttttttttttttgttccccccccccctttttttgttttgtga

SEQ ID NO: 52 - DNA, 168 bp, Xenorhabdus bovienii
  unsure (1)..(168): unsure at all n locations
  Coding sequence Name=Xb4151_4152.C220.gene1.dna; Position on contig =175..342bp; Strand=-
atgggnnnngcggggaaaaaaggattttttctgggggggggcccctggggggggggggnnttttttccgggggggnnncnccctcncccgggtttttcaaaaggggggggggggggggaaccctcctctctttnnnnnnnnncccccccccgggaagaggagttttag

SEQ ID NO: 53 - DNA, 477 bp, Xenorhabdus bovienii
  unsure (1)..(477): unsure at all n locations
  Coding sequence Name=Xb4151_4152.C220.gene2.dna; Position on contig =373..849bp; Strand=-
gtgtgggggggggggacgaccgcggggtgtttttttttttttcccccctttggggggggaatatttttggggggtgtttttttaattaattctcccggggtggtgtttttttttttaaaaaaanancccgccgggggggcgggggggggagaaaaaaatttttttttttttttttttttgggnncgcgggggggggggggtgttttttttggggggggggggggttttttttgtgggaaacccccccgcgcgtgggtttttttttttttgagggggngncggggggggggccccctctcttttttcccccgcgggggggccccaaaaatttttttgggggggttttaccggtgttttccccccccaccttttttaaaatttttgtgggggggcccccccaccccccccccncatatttttggggggggtttttttggggaaaaagggggggggggggggggggggcccccggggtan

SEQ ID NO: 54 - DNA, 219 bp, Xenorhabdus bovienii
  Coding sequence Name=Xb4151_4152.C221.gene1.dna; Position on contig =303..521bp; Strand=-
gtgggggaaagaaaagaagaaagcgtcctcctcccccccacccaaacaccaccgcgggggggggggggggtgggggtttttttcccccacaccccgcgggcccccacaaaaaaaaaaaaacacccctccttttatttttggggggggggggcccccacaaagaggcgttttagaggggcaaaaaaaaaacggcccgcccacacccgcgcgggaatataa

SEQ ID NO: 55 - DNA, 552 bp, Xenorhabdus bovienii
  unsure (1)..(552): unsure at all n locations
  Coding sequence Name=Xb4151_4152.C226.gene1.dna; Position on contig =23..574bp; Strand=-
ttgttttggtttagaagaagnaaaaaagnnanaaacaaaaaaaaaaaacanaanntggttaaatgcggcgcgccgcgcgccggctttttttttttttattttctctcccccgcggggggggggggttttttttttttttttgaggggggggggggggagggagggttatatatagaggggggggggaaaaaaaaaaaaaaacaacccccccccccccccctccacaaaaaaaataattataaagaagaaagccccccccccgcgcgcgggggggtatttattttttcctccccccccgcgcggggcgcggccccaagaaaaatatatgtggggcgcccacaaaaaaaaacacaaagagtgtttttccgggggggggccgcggcgcttttttttttcgggggaaaaagcccaaaggcccccggggggggggggggaaaaaggggccccccccaaaaaaaagggggggggatttttttggggagggggttttttcaaggggccaacctcaaaaacaaaataatggtcaaagaacagcttacccctaaggggtaa

SEQ ID NO: 56 - DNA, 171 bp, Xenorhabdus bovienii
  unsure (1)..(171): unsure at all n locations
  Coding sequence Name=Xb4151_4152.C226.gene2.dna; Position on contig =705..875bp; Strand=-
gtntctgctgttngggtgtggcgccccgnccttnnccccacgaannnaagaaatttcgtattnnatatcaatcaaccacccaccgcgncgagaagaggggggggggaggaggtgctctctctctctcccnccaggtggggnngggcgggggnnagaaaaanaaatnaataa

SEQ ID NO: 57 - DNA, 180 bp, Xenorhabdus bovienii
  unsure (1)..(180): unsure at all n locations
  Coding sequence Name=Xb4151_4152.C232.gene1.dna; Position on contig =66..245bp; Strand=-
atnaaatngnaaanaananctntttgggtnnnctggtnggncnagnaatngnnncntnngnncngnctnnaagnnccncgntgngnanctnntgnnannanatnnatnnatnntngnaatggagtatnnncnanctgnngtntnananagnnctgnnancnncgnagtgganctanatan

SEQ ID NO: 58 - DNA, 504 bp, Xenorhabdus bovienii
  unsure (1)..(504): unsure at all n locations
  Coding sequence Name=Xb4151_4152.C232.gene2.dna; Position on contig =458..961bp; Strand=+
gtgggttttttggggaaaaaacacccggggcgggggggggggaaaaggtttttttggggggggaccacaaattttcccttcctcctcccgaaatttttaccgcttttcaaaaaaacccccttttttttaaaaaaaaactttgttttttttttattagggggggggggggggggggggaaattttttttttttanaaaaccccccccccgggtttttttgggggttttttttttttccctcccccccccccgggtgaaaaaaaaaagaggggccccccccctctttttttttttttttttttttgggggggggggcgccccccccccctcaaattattatatnagggttatgggggggggggggggggggagaaataaaaattttattttttcttgggggggggttttttttttctccccccccttctgtgggggggggggggggagcccgccccccccaaaaaaaaaatttatttttttttttttttttttgggaggggaataa

SEQ ID NO: 59 - DNA, 582 bp, Xenorhabdus bovienii
  Coding sequence Name=Xb4151_4152.C236.gene1.dna; Position on contig =57..638bp; Strand=-
atgggctatattcatggattccgagtatctgaattgcgtgggttaaagctttctgatgcggatttggaggggaaaaagctacgtgtacagcgcctgaaaaatggtttttccacaattcatccgatggtgatgcgggaggttcagctgatacgccagtggcttgcccaacgtcagaagtacaaaaacagtgagcagaatgactggttatttttgtcacgtacaggggtaccgatgtcccgtcagcaattttataaaatcatccgacaaacgagtttacaggccaatttagcggtttgcgcgaatccgcacatgctacgacattcctgcggctacgcgctggcggacaatggcgtggacacccgcttgattcaggactatttaggacatcggaatattcgccatactgtacgttataccgcaagtaatgcgggtcgtttcggggctatctggcaggaaagagggaaacgaaaattgtctacaattagtaccaaactgttaacccgtcaattatcctactttttgcaatccgtttattctcatttcatccgaaagaatcaatgtaatagattgattacaatgtag

SEQ ID NO: 60 - DNA, 177 bp, Xenorhabdus bovienii
  unsure (1)..(177): unsure at all n locations
  Coding sequence Name=Xb4151_4152.C246.gene1.dna; Position on contig =441..617bp; Strand=-
atnnaaaagaaaaaaaagngaagagaagagagtggggnnnattttttatttttatnntttnnnnnnnnngnnnaaanaaaaaaaaaaaaaaanaaagaaagagnagataggggngagggggggggnggggggggcggggggggggngnggnnggnnntannagataaaaaaatataa

SEQ ID NO: 61 - DNA, 423 bp, Xenorhabdus bovienii
  unsure (1)..(423): unsure at all n locations
  Coding sequence Name=Xb4151_4152.C246.gene2.dna; Position on contig =458..880bp; Strand=-
ntnnnnntnnggngnnnnnnnnnggggaaaaaanaaaaaaaaaaaagggggggggggggggggnnttattatttttttnnttttttttttnnnnnntttttnnnnnggggggggggcggggnccgccnnnnnnaaaaaaaaaaaaaaaaaaaaaaaaaatnnnnaaaaaaaaaaaaaaaaaaaatnattttttttttttttttttttttttnngggaggggagggggggagaggnagnngagaagaataaagaaaaatagaaaatnnaaaagaaaaaaaagngaagagaagagagtggggnnnattttttatttttatnntttnnnnnnnnngnnnaaanaaaaaaaaaaaaaaanaaagaaagagnagataggggngagggggggggnggggggggcggggggggggngnggnnggnnntan

SEQ ID NO: 62 - DNA, 237 bp, Xenorhabdus bovienii
  unsure (1)..(237): unsure at all n locations
  Coding sequence Name=Xb4151_4152.C251.gene1.dna; Position on contig =153..389bp; Strand=-
gtgtggggagaaaaaaaaaaaacacccccccccccccccaccaaaaaaataggggtgtgggtgttaaaagggggggagnnaaaaaaaaaaaaaccaactccccccgcccccctacccgaggggggggccgccccctcttatttcccccccatatttagaggggtgtggggccaaatctttttgggaaaagggccggatccggtnccggggccttctttcgctataccnnnnnnnnnn

SEQ ID NO: 63 - DNA, 177 bp, Xenorhabdus bovienii
  Coding sequence Name=Xb4151_4152.C255.gene1.dna; Position on contig =596..772bp; Strand=-
ttgggggggggggggccaaaaaaaaaaaatgggggggggggggaaaaattccccccttttggcgggggggggggaaaaaaaaaattttttgggggtggggggggggccccgggggaaaaaaaaggaattcgggggggtttcggggggggggggtttttaaaaaaaaaatttttttaa

SEQ ID NO: 64 - DNA, 162 bp, Xenorhabdus bovienii
  unsure (1)..(162): unsure at all n locations
  Coding sequence Name=Xb4151_4152.C256.gene1.dna; Position on contig =55..216bp; Strand=-
gtnttnaatgggngnncttggngnnaattgnnaaaagnnaagncggtgnncgngnaaagncacgttnccaaaaagttgggtttgnaaaacnncnaccaagggccaagttncgtnacttcgnactncaannccttnccattggngnnggttnggnccccttaa

SEQ ID NO: 65 - DNA, 456 bp, Xenorhabdus bovienii
  unsure (1)..(456): unsure at all n locations
  Coding sequence Name=Xb4151_4152.C256.gene2.dna; Position on contig =379..834bp; Strand=-
ttgtttggggggggggggggggggtttttttttnnntttttttttttcctccccccggcgngggcggcgggggccgctttttttttttttttaaaaaaaaaaattnnnttttttttttttttttgggagaaaaaaaaaaaaaaaaccccccgggggggggggttttttattttttttttaaaaaaaaacccccccagaagggggggccccccaaaaaaccccccaaggaggggggttttttttttaaaaaaaaatttttggggggaaaaaaaaaaaaaaaacacccctcttttttttccccccccaaaaaaacgccgcgggggccgccgggtttttttgtgggaaaaaaaaaaaaggggaaaaaaaaggggaaaaatttttggtttgtggggggggggccccccnnncccccaaagggggnaaaaaatatatggggggcccgggccccccctttaa

SEQ ID NO: 66 - DNA, 252 bp, Xenorhabdus bovienii
  Coding sequence Name=Xb4151_4152.C261.gene1.dna; Position on contig =169..420bp; Strand=+
ttgggcaacccaaaaaaaaacagggggcctttgggtttaacaaaaaaccgcgttttccccccaccatttttaatccgggggggcgcggggggaaaccaaataataaagggggggggccgcgcggggtttttcccacaaaaaaaaaatataaccccccccccccccgccggggggggggggggggggggtggggtaaacccccccgccagtttttgggggggggggggggcgaccgctattttttatttttaa

SEQ ID NO: 67 - DNA, 468 bp, Xenorhabdus bovienii
  Coding sequence Name=Xb4151_4152.C261.gene2.dna; Position on contig =545..1012bp; Strand=+
gtgagtcggttttgcagtcgttggtgctggcggtcttcgtttcgcacggaagcgccttgcgtggcgggggcatactgcggttgttttgaggggggacgggggcatgtatcgagggcagtgagggaggcggttttttgttttctgtggcccttcgctaccctctcggcgcggtggcttcgcggggcggggtggggggtgggcaggtgtcgacgcatggcgatgggtgtcgggtctggtgggttggtgggggattgccgggttatggtgggctgcttctcgcgctctcgtaggtggtgtgggggtgtggttttggggaggacggcggcgcgcggggggggtgtgggtggtgtgggcggggttgggtgtgtgtggggtggggtgtgggcgcgctcttggtttgtatggggcggtcgggggtatgagttcggctcgtccgaaggtgtatactcttctcgtatcgtggggtag

SEQ ID NO: 68 - DNA, 552 bp, Xenorhabdus bovienii
  unsure (1)..(552): unsure at all n locations
  Coding sequence Name=Xb4151_4152.C267.gene1.dna; Position on contig =138..689bp; Strand=-
ttgtgggggggnccccgcncccccccnccctnnnaaaaaatanaaaaaaaaaaagaaaaaaagggggngnnncgcnccnctccccccctctcttttttttttttttttttttttttggnggtattattaaaaaaacagaagggaggggaggagggtttgttgtttttttttttttttttttgggggggggggggggggggaaaaaaaagaaaaagagttttntttttttttttttttttgctttttttaaaaacaagaaaaaaaaaaaaaaataaaagacannnattattgggggggagagaggggttggttttttataaaaccnccaaaaagaagggggggcaaaaaaaactttttttttattttaagggggggggtttttttttttttaaaaaaaataggggggaaaaaaagggccgaagggttttaaaagccaaaattttttttaaaagggaggaaagaaaaccccctttttntnttttctttttaaaaaaaaaaaatttaaaaaactntttttttttttttgtttnntattttattccttcctcatag

SEQ ID NO: 69 - DNA, 228 bp, Xenorhabdus bovienii
  unsure (1)..(228): unsure at all n locations
  Coding sequence Name=Xb4151_4152.C267.gene2.dna; Position on contig =699..926bp; Strand=-
atgagcntnaagaaaagaaatagaataagaaaagcnnnnncggagaaaaaaggaagnaaaagggaatattnttttatttattttttttttttggnnntttgggccggggggcgcgagggaannncnccnnnnnnnncgcgggtggggtggggtgggggagggtntnggttgtttattattataaaannncgcnctaaaaaaaaaataanannnacaaaaaaaatataa

SEQ ID NO: 70 - DNA, 270 bp, Xenorhabdus bovienii
  unsure (1)..(270): unsure at all n locations
  Coding sequence Name=Xb4151_4152.C270.gene1.dna; Position on contig =699..968bp; Strand=+
gtggggggagaaatttccccagaagaggggagaagagaggggggggggggggaaaacaattctttttttttttggggggngggggggggggggagacccccaaaaaaaggggggggggggggggaaaagaggagggagggggtgggagaaaaaaaaaaaaaaaaaaaatttttttttggggggggggggggggggagcacaaaaatatctcacacaaaagggggggggttgggggggggtgggtntnatagaataaataaagttntttag

SEQ ID NO: 71 - DNA, 135 bp, Xenorhabdus bovienii
  unsure (1)..(135): unsure at all n locations
  Coding sequence Name=Xb4151_4152.C271.gene1.dna; Position on contig =398..532bp; Strand=-
atgngagaagaaaaagannncactctcttaaagattctgagaggtgtgtggagatatgtgagcttacgacaaancaaagancactctnnnatcttctctgtcattcttatttgggatgaggggtgtgcctcatan

SEQ ID NO: 72 - DNA, 243 bp, Xenorhabdus bovienii
  unsure (1)..(243): unsure at all n locations
  Coding sequence Name=Xb4151_4152.C271.gene2.dna; Position on contig =502..744bp; Strand=-
ttnnnnnctnnnnnggnnngnnaaananncnaanncgnngncngnggttnnatatnnanannnctgaagnnaangnanangggnnnnnaattcnnnncctttnnncctttaagagnaaaggttnncccgcaannncccttttggnnnccaaggnngnggaaaattggnccaaaaaggttttttggggccccnnnnnnnnnnnataataatatatgngagaagaaaaagannncactctcttaa

SEQ ID NO: 73 - DNA, 180 bp, Xenorhabdus bovienii
  unsure (1)..(180): unsure at all n locations
  Coding sequence Name=Xb4151_4152.C271.gene3.dna; Position on contig =678..857bp; Strand=-
gtgcncncgnnnnncgngnnttnngntnaaaannttnaanaanannccnaaaggnnncgnnnncngnnnncnnaaanggtngnncnannnnncggnngnnnnaaanntnaannttnnnnnctnnnnnggnnngnnaaananncnaanncgnngncngnggttnnatatnnanannnctga

SEQ ID NO: 74 - DNA, 222 bp, Xenorhabdus bovienii
  unsure (1)..(222): unsure at all n locations
  Coding sequence Name=Xb4151_4152.C271.gene4.dna; Position on contig =1103..1324bp; Strand=-
atgttgccaaacacaaaaaaganggttggatataanatttnnnccttctgggggcaaagaaaaagagaaggttttncccnnggtttggcaaaaaaaacaaanagggggcgtgtgttctncanncnaaaannntattctctccgcctgtttctntnttttgaaaatatggcgnaaaacanaaagaggttgtgggcctttgggacantatataatgatttgtaa

SEQ ID NO: 75 - DNA, 663 bp, Xenorhabdus bovienii
  Coding sequence Name=Xb4151_4152.C278.gene1.dna; Position on contig =33..695bp; Strand=-
gaaagcttggccgaggtctatgcgctggtctgcgtgatctatagcggcatgatatggaattttggtttcatcgtcatggcgatgaatcgcctgcacggcgatatggcaagggtcgcggagaccgacgaactcaccgggctcccgaaccgccgccatttcatgaaaaggctggcgagagccgaactcgcattcagtgaagacggggtcgcctataccgtcatgctgatcgatatcgacaatttcaagcattggaacgacacatatggccatgcgctgggcgatcaggcgcttgtgcatttcgccgatgtcggggtcgacatcctcaatcgccgcggtgtgctggcgcgctttggaggcgatgagttctcgattctgctgcctgggatgcaggagcatgaggcgacggaaatcgcccgtgaaatcgtcggcgcagtcaaccatacgccgcttgttttcaacgggcggaaactcatcttgacggtcagcatcggcattgcgagcgaagaaccgggtgatgagaggagtgacctcgatgtttttgcgcgggccgatcttgcgctctacaaggtaaagcaggcaggccggaacggctatgctacccgtacaacgacggtgaacgccccgcgttcttctttctccggaaggtcgctggctgttggatga

SEQ ID NO: 76 - DNA, 337 bp, Xenorhabdus bovienii
  Coding sequence Name=Xb4151_4152.C279.gene1.dna; Position on contig =2..338bp; Strand=-
gccgcaagcttcggtcttgttgcaaccgtcgtggatcaatctgaacgcttgaaccgcttcatcgccaatctccttgatatgactcgcatcgaagccggtgcgatgaagcctaatctctcgcttcattttgttggagacctgatcggggctgcactcaatcgtgcatctcggatactcgcctgccatcaggtcaacgtcgcggttccagtcaatctgccgatggtccaccttgacgccgtcctgtttgagcaggctttattcaatctgttcgacaacgccgcaaaatacgctccggagaattcgcccattacggttaaagacctcggccaagcttccg

SEQ ID NO: 77 - DNA, 351 bp, Xenorhabdus bovienii
  Coding sequence Name=Xb4151_4152.C281.gene1.dna; Position on contig =91..441bp; Strand=-
gagcggccgcaagcttcggtcttccatcacgccttgcgcaaccgcgcccatgatgccgcgcgtgccgccgccataaacaaggcgcagaccgtgttcggcaatggaccggccaagcgcaacgcccgcatcgcgatagatgggattcaggcccgtagacgagccgcaataaacacagatggatcgaatctcagacatgatttcttgtgctcttttggtctttcagcgtcaagcgcctccggtttcattttgcggagaagattagcggcgggcggcggtcgcggttggacatttgtggagattgttatatctcaatcggtatgtgtttcagatcgtgaagtggattggatatga

SEQ ID NO: 78 - DNA, 496 bp, Xenorhabdus bovienii
  Coding sequence Name=Xb4151_4152.C282.gene1.dna; Position on contig =2..497bp; Strand=-
cgagcggccgcaagcttcggtcttaccagcaaggcctatgccgctgaaattcgcagccgtatcgatccttatcgcgccggtgtcagcgaggcgctcaagccagccgaattcaaggaatccaacgagaccacgcattattccattgtggacaaggacggcaatgccgtcgccgtgacctacacgctgaacggttcgttcggcacggccaaggtggccgaaggcaccggcattctgctcaacaacgagatggacgacttcaccatcaagccgggcgtggccaatctctatggtctcatacagggcgaagccaatgccatcgaaccgcgcaagtcgccgctgtcctctatgagccccacaatcgtgtcgaaggatggcaagccgttcatggtcatcggcagccccggcggttcgcgcatcatcacgatcacgctggaggcgatcatgagtgtcatcgaccatggcatggacattcaggaagacctcggccaagcttccg

SEQ ID NO: 79 - DNA, 351 bp, Xenorhabdus bovienii
  Coding sequence Name=Xb4151_4152.C283.gene1.dna; Position on contig =166..516bp; Strand=-
atgccagacaaggcggttcccaggcgtctgctggaagatcacgtcgcaccatacgatcatcccatcgccttcacacgagggcagacggtatccctgaccggaaaggccgaaatctgggacggctaccggtggctgtgggccgtgggagcggatggccgtgcggggtggattcccgataacagcatcacggtcaaggatgatacggtcatcactctgcgcgactactcggcgatggaactgacctgcaacaaagggaccgtcctccacgttatcgaagaaacgcatggatgggcttggtgcagcgcgcccaatggatttttcggttgggtgccggtgaacaaacttgcctga

SEQ ID NO: 80 - DNA, 219 bp, Xenorhabdus bovienii
  Coding sequence Name=Xb4151_4152.C283.gene2.dna; Position on contig =520..738bp; Strand=-
gagcggccgcaagcttcggtcttcaagcgcaacggcagcctgatggggccgccccgccccagtgcgatcaacgttcagggggatgacaaggcgaaaaaggcattcgtgaacgctgctatcgacgcggttgaaaaatgcacgccgctgaaatttgcgccctcgctggcagagggtatcggcgggaatgtcttcaccatgcagtttcattcggcggattga

SEQ ID NO: 81 - DNA, 520 bp, Xenorhabdus bovienii
  Coding sequence Name=Xb4151_4152.C284.gene1.dna; Position on contig =2..521bp; Strand=-
ggaagcttggccgaggtctggttaccgacgatcaaggatatgagccttggtataggcgatgtgctggacacgctggataagcgagtgggcgtcatcgacaagatcgaaatggccgtcaagggtctgatgagcggtttcggttatgggggtgagagtggtactcgccagctgatcaacgatctcggtgatctcctgtttggcaaggcatttgaaggtgacggcacgcaggtcgatcagcgcatgattgatctggccaggctatcgaataatttccgcaagatcgggctcgatcttaaagccttcgccaaggatatcgggtcgggcgatattctcggtgctgccgggaatatctcggaagcgatcagtaagatgtccggggctaccacagtaataagtgcaataggtatagccgctaccggtgcggcaatgatcacactggggcgtggaattgccagattggcattctcgccgtttggtcgaattggcttaattgcagcagaccgaagcttgcggccgctcg

SEQ ID NO: 82 - DNA, 259 bp, Xenorhabdus bovienii
  Coding sequence Name=Xb4151_4152.C285.gene1.dna; Position on contig =3..261bp; Strand=-
cgagcggccgcaagcttcggtcttttcgaacagcagagcgacgcctacaagacggcaaccatcggcgatgcgccggtgaaggtagccattgaagaggaaatctcgcccgcctcccaacgattcatgggcgaaaacggcatcttcatcggcatgaagggcttcggcgcttcgggtgagatcaacgatctctacaagcatttgggcattacggcagaacatgccgccgaagccgcggaaaagaagacctcggccagagctt

SEQ ID NO: 83 - DNA, 661 bp, Xenorhabdus bovienii
  Coding sequence Name=Xb4151_4152.C286.gene1.dna; Position on contig =2..662bp; Strand=+
cggaagcttggccgaggtctgggcggcctcgacaaatacggcctcgactatgagagcctgaaggccatcaatccgcgcctgatctattgctcgatcaccggtttcggccatacaggcccttatgcggaacgcgcaggctatgatttcatgatccagggcatgggcggcatcatggatctgaccggtgaaccggaccgggagccgcagaaaatcggtgtggctttcgccgacattttcaccggcctctacagcgtgattgcaattcagtcggcgctcatcatgcgggagcgcaccggcaccggccagcatatcgatatggcgctgttcgactgcatgtcggcagtgcttgccaatcaggcaatgaactatctggcatccggcatatcgccgaagcgcatgggcaatgcgcatcccaacatcgcgccctatcagacgttgcccgtttccgatggctatttcatcatcgcctgcggcaacgacggacagttcggaaaactgacttcactgctcggtatcggtgatatcgctaccgacgagcgcttcgtcagcaattcggcgcgcgtggccaaccgggctgccctgacggcgtttttggaagaaaagacccgagcgtggaagcgcgacgatcttctggccgagaccgaagcttgcggccgctcga

SEQ ID NO: 84 - DNA, 411 bp, Xenorhabdus bovienii
  Coding sequence Name=Xb4151_4152.C289.gene1.dna; Position on contig =54..464bp; Strand=+
atgtcggccgtcatcgttgttgcagtttcgctctacggcctgcgctttattcacgtctttgacgtgctgtctctcgggcgcgaccccgcgatcaatcttggcgtcgatcaccagcgggtcgtgcgcaaggtcctgttcatggtcacagtgctggtttcggtttccaccgcactggtcgggcccattaccttcttcggcttgctggtggccaacctggcctacatgattgcaggttcggcaaagcaccgaattatcctgccagtgggggccctgcttgcagttttctgcctcgtgggcggacagaccattcttgaacgtgtcttctcgttcaactccgcactcagcgtcattatcgagtttctgggcggccttgtcttcatcatccttctcgtcagggggcacgcgcgttga

SEQ ID NO: 85 - DNA, 424 bp, Xenorhabdus bovienii
  Coding sequence Name=Xb4151_4152.C289.gene2.dna; Position on contig =461..884bp; Strand=+
ttgattgaaatcagccaagtcagcaaatcctacaatggcacactggtcgtcgatgatgtgaccctgaaactgccagcgcgcggcataacctcgatcatcggtccgaacggtgcgggaaaatctacgctactctccatggtgagccgtctcctgcctatggacaaagggcgagttaccgtagacgggctcgacgtttcgacgacatcgggtgacgtgctggcaaaacggctgtcgatactgcggcaggagaacgcaatcaattcccgcctgaccgtgcgtgatcttgtaactttcggccgttatccctattccaagggtcgtcccaataatgaggatcgcaaacatgtcgaacaggccatcggctatctcggccttgacgatttaagcgggcgctttctggatgagacctcggccaagcttccgc

SEQ ID NO: 86 - DNA, 466 bp, Xenorhabdus bovienii
  Coding sequence Name=Xb4151_4152.C290.gene1.dna; Position on contig =1..466bp; Strand=-
gagcggccgcaagcttcggtcttctacttcatcggtggcgtggatagtgaccacaacacccgcgcacgtgtgcgcgggtataaagatgaactggctgcgctgaacttccccgttcactccgacgccataatcacgaatggttatggtcccgatgccgccgcgagaatcatccgcgatatttataaaaaattgaatggattgccagaggcactgttcgtcaactcgacgagcccttttgagggcgtcgtcagttttctcaagacgctgccggttgacgaggtccgggagtgctccatcggatgtttcgactgggaccccttcatcgaagttctccacttcccggttgtgatggtccggcaaaatgttcaggcaatggtcgaacgcgcctttgaacttctggacgagtccgttcaaacgaacaacccacccgaaatgataccgacagagacctcggccaagcttccgc

SEQ ID NO: 87 - DNA, 405 bp, Xenorhabdus bovienii
  Coding sequence Name=Xb4151_4152.C291.gene1.dna; Position on contig =157..561bp; Strand=+
atgtgggatgcgcgtattgtcgctattcgggaaaacggactcgcaagcattctcgacgcgacaatgccgcgctggttcacccctgcctatcggcgtcccgataatccttcctatcgtgcgtattgcaacatgttcgttcggcaaccgctcgaaggctatgcggccacttgcgctgctctccgggatgccgacttaacgcaagtagccaaaaagatttcggtgccgacattgtgtctggtcggcgagcaggacggttccacaccgcccgacattgtgcgcgaattggcacacctcgttcctcaagcagattttgcagagattgccgactgcggccatatcccctgcgtcgaacagcccgatgcctacgtctcgctgttacgcaactttattacaaacagattctag

SEQ ID NO: 88 - DNA, 148 bp, Xenorhabdus bovienii
  Coding sequence Name=Xb4151_4152.C291.gene2.dna; Position on contig =576..723bp; Strand=+
atggctgacaatgccgtgccgtcagaacgttacaagatcggcatgaatgtgcgccgttcggttctgggcgatacgcatgttgatcgtgcttcaaacagcgcgaccgaccttgatgcaccatttcaagagacctcggccaagcttccgc

SEQ ID NO: 89 - DNA, 310 bp, Xenorhabdus bovienii
  Coding sequence Name=Xb4151_4152.C293.gene1.dna; Position on contig =61..370bp; Strand=+
atgacgtatgtcgtgaccgataattgcattcgctgcaaatatacggactgcgtcgaggtctgcccggtcgattgcttctacgaaggcgaaaacatgctcgtcatcaatcccgatgagtgcatcgactgcggcgtatgtgaaccggaatgccctgccgaggcgatcagccccgacaccgagccgggcctcgacaagtggctggaactgaatacggaatatgcggcaaaatggcccaatattaccgcgaagaaggacgcccttcccgaagccaaggagatggatggcgtagaccgaagcttgcggccgctcg

SEQ ID NO: 90 - DNA, 133 bp, Xenorhabdus bovienii
  Coding sequence Name=Xb4151_4152.C294.gene1.dna; Position on contig =1..133bp; Strand=-
atgctcgttgaaaccaaaccttattcgaaccgcaaggtcgtcattcccggtcgtctggaaatccacgcggcggacgatgccgcccgcttcgtcctgcgcatcggtccggcaaagacctcggccaagcttccgc

SEQ ID NO: 91 - DNA, 249 bp, Xenorhabdus bovienii
  Coding sequence Name=Xb4151_4152.C294.gene2.dna; Position on contig =144..392bp; Strand=-
gtgctggaagaaggcgcgcagattgtcgccgacccaaaacagccgttgccgatgaccatgcttggccatgtcacctcgtcctattggagcgagacgctcgggcggtccatcgccatggcgttggtgtcgggcggcaaggctcgcatgggtgaaacgctttatatgccgatgccggatggcagcgtgcatgaggccactgtatcgggcatggtcttctatgaccccgaaggaaagaaactgaacggataa

SEQ ID NO: 92 - DNA, 450 bp, Xenorhabdus bovienii
  Coding sequence Name=Xb4151_4152.C296.gene1.dna; Position on contig =326..775bp; Strand=+
atgcgcatgttcagacgttttcagccggtttccatcgttctgtttgtcattcttctggcgtttctcgtcggcttcgttgcgttcggtgaaaaggtcaccagcatgcagcctccggccattgatgagcctgccgatgcgatcatcgttttgaccggtggccagtccagaattcaggctgcggtcaatcttctgaaagacaagcgcggaaagcggcttctgatcagcggcgttcatccatcgaccaacgaaaaggtgctgcagcgcgcgacacatgccgaccagagcctgttcgactgctgcgtcgatctcgaccggtcggcgctcaacaccatcggcaatgcagcggaaagtgaacgctggattcgtacaaacaattatcgccgggtgatcctggtcaccaataattatcatattccgcgcagcacgctggagagtgtcctatctcagtga

SEQ ID NO: 93 - DNA, 352 bp, Xenorhabdus bovienii
  Coding sequence Name=Xb4151_4152.C298.gene1.dna; Position on contig =43..394bp; Strand=+
atgagccaggcctttaccgggggtggatatgtgcaggcgattgtgacgagcgaggtgaacgaatttctcaatcgctatcgcggcagcgcacaaacacccgtcgaactcaatctgagggcgagattcaatcaggatttgaacaagggttggttcggggcgatcaacaatgtgatttcgtcggtgacgatgctgtctatcattctgacgggcgcagcccttattcgagagcgcgaacacggaaccatagagcatctgctggtgatgccggtaacgcccgtcgaaatcatggtcagcaaaatatggtctatggggctggtcgtgctgattgcttcagacctcggccaagcttccg

SEQ ID NO: 94 - DNA, 190 bp, Xenorhabdus bovienii
  Coding sequence Name=Xb4151_4152.C299.gene1.dna; Position on contig =3..192bp; Strand=+
gagcggccgcaagcttcggtctggaactatgagccggtcaccttcaccaaggcgattgccaacggcaagatcgatctgaaaaccgatagtgaggctgaaatcagcctgccggtcgattggggtcgttaccgtctggaagtcgaaactgccgacgcctcaggcccggctacgagacctcggccaagcttcc

SEQ ID NO: 95 - DNA, 630 bp, Xenorhabdus bovienii
  Coding sequence Name=Xb4151_4152.C303.gene1.dna; Position on contig =1..630bp; Strand=+
tcgagcggccgcaagcttcggtctgtcctgtccactttgatcggcctaccgctgggcgtcgcgctgattgttaccggcccgggccagtttcttgaacgaccggctttcaaccgcatagcaggcgcgatcgtcaatctggttcgatccacgccgtgcatcatcctgatggtggcgatcattcccctgacgcgcctgattgccggaaccacggttggcacctatgcggccatcgttcctctgacagtggcaatcgtacccttatacgcgcgactggcggaaacggcgatgcgtgaagtagaccaaagcctgatcgaggctgcggaaagcatgggtgcgacgcctatccagatcatcttcaaggtgctgctcccagaggcactgccagggattattgccgggcaaacggttacccttgtcagccttgtcggatactcggcgatggcaggaacggtcggcggcggtggcctgggcgatctcgggattcgtttcggatatcaacgcttcatgccggaagtcatgatagccgttgtcatcattctggttgcaatcgtgcaatccattcagattactggcgattatgccgctcgccttgtcaattaccgcgtggcccgcagccgtcgctcgcgctaa

SEQ ID NO: 96 - DNA, 222 bp, Xenorhabdus bovienii
  Coding sequence Name=Xb4151_4152.C304.gene1.dna; Position on contig =33..254bp; Strand=-
atgacagatgtaatcgtccgcgacagcaatggcacccaattgaatgacggcgattccgtcacgctcatcaaggacctgaaggtgaagggaacctccaccacattgaagcggggaacgctggtcaagggcattcgccttaccggaaacccggcggaagtcgattgcagcaccaagcaggtcaagggattggtgttgcggaccgagtttctgaaaaaagcctag

SEQ ID NO: 97 - DNA, 187 bp, Xenorhabdus bovienii
  Coding sequence Name=Xb4151_4152.C304.gene2.dna; Position on contig =451..637bp; Strand=+
atgatcggtcatgcacttgtggttatcgacgtccagaatgatttctgccccggcggttcgctggcggtcgatcgcggcgatgaaatcattccgaccgtcaaccggctgattgaggaaagcgaaaacgtcatcctcacgcaggactggcaccccgccaaccattcaagaccgaagcttgcggccgctc

SEQ ID NO: 98 - DNA, 163 bp, Xenorhabdus bovienii
  Coding sequence Name=Xb4151_4152.C305.gene1.dna; Position on contig =1..163bp; Strand=-
atggcggcaaccgtcgtctatgacgagttcctgatcgaactgaactggccgctcggcgccgccatcgccatcatcgttctggtcgccaatctggtgatcatgatcgcctataaccgtctgctcgaagggcaggccaagaagaagacctcggccaagcttccgc

SEQ ID NO: 99 - DNA, 336 bp, Xenorhabdus bovienii
  Coding sequence Name=Xb4151_4152.C307.gene1.dna; Position on contig =1..336bp; Strand=+
tcgagcggccgcaagcttcggtctgcgttcaacggcgcaaaggccgttttggacgccattgccaagggcgcgtcggccaagcgtgtcggcttgaagcctgaaggccgtcagccggtccgcgctggcgccgatctttttgatgaatccggtcgccagattggcaccgttacttccggtgggtttggcccatcagcaggtttcccggtcgctatgggttatgtagaggcaagcctcgctacccccggcacacgtgtcttcgctgacgttcgcggcaacaaggtgcccgttgacgtttcagcacttccctttactccgcatcgctatcgcaaaggatga

SEQ ID NO: 100 - DNA, 159 bp, Xenorhabdus bovienii
  Coding sequence Name=Xb4151_4152.C314.gene1.dna; Position on contig =97..255bp; Strand=-
ttggggggggtgggtgttttgggggccctggtggtgtttggggggggggaaactttgggggggaaaacccccccggggttggggggggttgggggggttttggaaaaaaatgtggggttcccccactttgggggggaaaaaggggggtggggggtttaa

SEQ ID NO: 101 - DNA, 174 bp, Xenorhabdus bovienii
  Coding sequence Name=Xb4151_4152.C317.gene1.dna; Position on contig =122..295bp; Strand=-
atgtttccctttagcaaacaaatcatcatcccgcccccattgcggtatctacgtttgagcagcccgttgatggtcagtcatgtcagtactacaagggttccagcattttatcggtacaagcgtctcacgctggtccgcattatgggtgagtacgtatccatagcagtaaattaa

SEQ ID NO: 102 - DNA, 342 bp, Xenorhabdus bovienii
  Coding sequence Name=Xb4151_4152.C317.gene2.dna; Position on contig =405..746bp; Strand=-
atgcctaatccgcgtagtagggctcagatcgtagatccttccaacatggcctttatcgccagctgttctatagctcatttaagtcactcctatggcctcagtaccatgccattactgtctcagtctgcactgggctccatccagttccttgtgacccactctagatgttcattatcatatcgacaagtatcgcgcatgggtctgtcaagcgatagctcaggtagttacataagtcagatcatcctgtatagcataaacaccccccttgctcagtttgttggttcatatcagaccgtccaacataagatcttgattgtcggtcgcagatatccagatttatag

SEQ ID NO: 103 - DNA, 180 bp, Xenorhabdus bovienii
  Coding sequence Name=Xb4151_4152.C318.gene1.dna; Position on contig =2..181bp; Strand=+
atgaacatgatcaaacatccgtgtggaaagagcccaattacagattgtgtggaattgagcctggggtacatgaatcacggctggacagctgttgagcggggtatgctgggagcaggccattacaacgccttgcatctggggatgctacaggactttcttatcattagcccgccaacttaa

SEQ ID NO: 104 - DNA, 222 bp, Xenorhabdus bovienii
  Coding sequence Name=Xb4151_4152.C323.gene1.dna; Position on contig =239..460bp; Strand=+
atggcggccgcgttcgcaaagagggattacctggtaatatatcagacccacaattgggggaaggatgatgtccaagggttcagacaggttcgtaagaatgtctggcttacaaattatgacgtggccaaagagatttctggcgcggtcgtgtcagtttattccacgggatatattggtggaggttgtgaagcgttcttatggcaagaacgttctcgtctatga

SEQ ID NO: 105 - DNA, 159 bp, Xenorhabdus bovienii
  Coding sequence Name=Xb4151_4152.C323.gene2.dna; Position on contig =857..1015bp; Strand=-
agcggccgcaagctttcggtcttcaacggtgaggtggtctttgcgacatctcccggcttcaaacggaatgaagcacatgtcaaactctcgagcaaaagcgggaaagacccttctaatcgatggcacccggacaaagaaccttctccgcactcaaattaa

SEQ ID NO: 106 - DNA, 444 bp, Xenorhabdus bovienii
  Coding sequence Name=Xb4151_4152.C324.gene1.dna; Position on contig =44..487bp; Strand=+
gtggatgcagagattgtatttgaacttctcgcaagtcctgtcgggcagcacaaggaagatggcgccccgactggttatatcgatcttaccgatcaaccgtcatggaaccttggcctgcgctttccgggcaaagacaaggcttggttcgctgccactcgaaagcagatcaagggcgaaacccttctgatcgagcgagacaatgcttacgttctgatgaacagcattcgcgtccccgaactcaccgcctctgtagacgccgctatcgcgctggctgagaggttattccccggcacggaatacgaattcaccaatctgtacaacatcgtccgcgtgacaatcgagatgaacggcgagtacggcggctttcacggcgagcatgtcaattcgctgccgattgcgatctgcatcgccctcttgcgcgcaaaggaggccagcaagccatga

SEQ ID NO: 107 - DNA, 213 bp, Xenorhabdus bovienii
  Coding sequence Name=Xb4151_4152.C324.gene2.dna; Position on contig =643..855bp; Strand=+
ttggctaccttaaatgaaggcaccgagggtacgtgggaaaactatcacgcggacgcgcagaaagcgtgttctaccatcctcgccgctctacaggagccaacgcggccaatgtctgaaattggacaaccttatattcgggttggctatgatgcgtgggacgtgtggcgcgccatgctcgccgcctccgcacttggggagcagagcgatggctaa

SEQ ID NO: 108 - DNA, 195 bp, Xenorhabdus bovienii
  Coding sequence Name=Xb4151_4152.C324.gene3.dna; Position on contig =848..1042bp; Strand=+
atggctaaggccgaactgaacgaatatgaccgcaaaatgcttggcattctcaacggagatttgcccaatgaaacgtggggcgcgtggtggacgccgtgcctcgaatttctgtccggtcttggactttgcaccaagggaccaaatttccagatcacggctgagggtcggcatgcacttggggagcagagcgaatga

SEQ ID NO: 109 - DNA, 223 bp, Xenorhabdus bovienii
  Coding sequence Name=Xb4151_4152.C324.gene4.dna; Position on contig =1039..1261bp; Strand=+
atgacgatgtttatcgcaggagttttattcgcaggacttataagaatttcgtttggccgcattgttctaagggagatgggccagtggaaattccagttcagaagatttgatgaggaagatcagcgcgtaaaagacgcatgggaagaaggcttctctatcggtcgccaagccctgaaaggcggtggggaaggaggcatccagaagacctcggccaggcttccgc

SEQ ID NO: 110 - DNA, 330 bp, Xenorhabdus bovienii
  Coding sequence Name=Xb4151_4152.C325.gene1.dna; Position on contig =1..330bp; Strand=+
gcggaagcttggccgaggtctctgactgaggggcatatcgctagcaaggcgaccaacccgttgcattacaattaccggcgattgtgcgaggcgctaagcgacgcatggccgacggttgtgaaagccgcgccgccacttccggactttggcgataacctcttccacgaaggggcgacggtattcatgggcggcaagtcctacgttctcggaaagtaccatcctgaaatcaaagcgtgggatctgcgccacggcggcgagaacgaaatcactctgcgcgcagatatcctgcgcagaaacatcactggcatcaagtttaaggaagcatcatga

SEQ ID NO: 111 - DNA, 216 bp, Xenorhabdus bovienii
  Coding sequence Name=Xb4151_4152.C327.gene1.dna; Position on contig =32..247bp; Strand=+
atgattgcggtaaacatcaaaactgaggtcgaggcagggcattttcgacaggacatttctgctgaattttttgctacatgcttggttgggattgttgtgcaatttgtccgtcatcccattccggcctcagatatacagtcaaacgcagagttgattgcatcggtgctttttcaaggaatgcaaaacgacacaaagtcatttagaaatggcaactaa

SEQ ID NO: 112 - DNA, 433 bp, Xenorhabdus bovienii
  Coding sequence Name=Xb4151_4152.C332.gene1.dna; Position on contig =2..434bp; Strand=-
atgtccatcgccgaacagatgggcgtgacgcttcagaacactgcctattcggtcaatatcaaggagcgtctcgacttctcctgcgctgttttcgatgctgcaggcaatctcgttgcaaatgcccctcatatgccggtgcacctgggctccatggacgcatcggttgccaccgctattcgcgaaaacagtgacatcaagcccggtgatgtattcctcatcaacgccccatataatggcggcactcaccttcccgacctcaccgtctgcacgccggtcttcgacgataacaatcgtgaaatccggttttgggtcgcaagccgcggacatcacgcggatattggcggcatcgcgccgggatccatgtcgccgcttgcggtcaatatcgagcaggaaggcgtctatatcgacaatttcaagacctcggccaagcttc

SEQ ID NO: 113 - DNA, 648 bp, Xenorhabdus bovienii
  Coding sequence Name=Xb4151_4152.C333.gene1.dna; Position on contig =74..721bp; Strand=+
atggttgagatagaatctggcgacgttatgcatatgcgtgacgaatcctttgaaaatttgctcaacgaaatcaattccaaggttgcgcaatcgcgaatgtccaccactttggcttggattttgggcggcgttgggttcgtggcaggtcttgcgctcgggggagggactgcgcttttgttcagcctattggcactccctggatgggcgataggtaagtggcttgattcataccgacgtaccacggtgctttattatgatctcgaaggggaggcggagcggggctataggcgtctaactgagggatttgattctctttgtggttgcgccgccaaatggcacatcgaggctggcggcgcagtgcaagggcttaccgcttggaaacgaaacgcaggtgcgagccatctcgttaacaggaaagcgaccgcactcttatataaactgccttcaattattaacagcaacataactccgcctgcgcttcatgtcggtaggcaggttatgtacttcatgcccgatgtcgttctggttcaagatagaaatcgattcggttccgtacagtatgctgatctgaatttgcgatggcagccttcaaggtttatcgaaaccgaacgtgtaccgagcgatacaacggttgtcggccatacttag

SEQ ID NO: 114 - DNA, 204 bp, Xenorhabdus bovienii
  Coding sequence Name=Xb4151_4152.C334.gene1.dna; Position on contig =28..231bp; Strand=-
cgagcggccgcaagcttcggtctcgtcacggtggttacgaaaccgggtgaaccggaaggcgacattacgctcacggcaccgcaggacgggcgcattttgacccgtcgttcgctgcgctatgtgcgccgtggcgatgatcttctcaaattgctgggggtgaagccttctgccgtcaagaagcgtgccggcgcgcttgaagcatga

SEQ ID NO: 115 - DNA, 301 bp, Xenorhabdus bovienii
  Coding sequence Name=Xb4151_4152.C337.gene1.dna; Position on contig =115..415bp; Strand=+
atgggcttcggtcatcgggtctatcgcgtgcgcgacccgcgtgccgacgccctgaaaggcgccttgaagcgtatagaatcccttgggcatgagcgtggaaaacaccgggttgagttggcggaggcggtggaaaaggcagccatagcaattctcaggcgccacaagccggatcgggctctcgaaaccaatgtcgagttctataccgcccttttgcttgagcaactgggtttccctcgcgaggcattcacctgcgtctttgcaatgggcagaaccatggggtggatagaccgaagcttgcggc

SEQ ID NO: 116 - DNA, 235 bp, Xenorhabdus bovienii
  Coding sequence Name=Xb4151_4152.C338.gene1.dna; Position on contig =101..335bp; Strand=+
atgctgcccggctattcgatggttcctccccatatcgccaattatgttgaggatgcgccaaggctgaaatattccgacgatatgctcgagcgtgaagacaaggccaaggaactgttgaaggaagcaggcgtcgaaccgaatacgctctcggtcgaactgcgttataacacctcggaaaacaacaagaacaccatggctgccatcgccgaccagaccgaagcttgcggccgctcga

SEQ ID NO: 117 - DNA, 414 bp, Xenorhabdus bovienii
  Coding sequence Name=Xb4151_4152.C339.gene1.dna; Position on contig =3..416bp; Strand=+
ggaagcttggccgaggtctttcgcaaggacgaaaatggcgtctatttcttcgttgatcgtctgaaagacatcatccgacggcggggcgaaaatatctcttccttcgctttggaagccgaagtgcttttccacgacagcgtcaaagagtgcgcggctatcgcggtgccaagcgaattgagcgaggatgaagttcttatcgccgtaacccctgtcgaaggccaccaaatcaatgctggagaactgctggagtttctaacaggccgcctgccccgctttatggtgcctcgctatgtacgaattctggattctttgccgaagacgtcaagcggtaaaatccagaaacatatcctacgcagccaaggcattaccggagatacaatcgatcgcgatttcaacgccaagcgcgcaagctga

SEQ ID NO: 118 - DNA, 189 bp, Xenorhabdus bovienii
  Coding sequence Name=Xb4151_4152.C342.gene1.dna; Position on contig =38..226bp; Strand=+
atgccaatccgtgtcgacaagatcgaggatatcgggcgttaccgcatcgtgcgcgcgggcttcgaggggcagaaactggcagtggtggtcggcgaggatgaggatatacccgcagacccccgtgtgaccttcgatccgaaggctatcggcatattcgcggattcctggcgtgtggggatggagggctga

SEQ ID NO: 119 - DNA, 277 bp, Xenorhabdus bovienii
  Coding sequence Name=Xb4151_4152.C344.gene1.dna; Position on contig =50..326bp; Strand=+
atgaacttccggaacgccaaccgggacaagcagatattcatccagcagaagagactgacactcgatcagctcgaagaacggattcggtatttcgtttcgaagaaaggcaaagggctggctgtcattgaccacatgggcctgatcgatcgcaataagtcggaaacgaggctcgcaaactgggaatttggcgaaatcgtaaccggaaaattgaagcagattgcgagagatgtcgacattccgatcatcggctgtgcccagacctcggccaagcttccgc

SEQ ID NO: 120 - DNA, 490 bp, Xenorhabdus bovienii
  Coding sequence Name=Xb4151_4152.C345.gene1.dna; Position on contig =64..553bp; Strand=+
atgcgcctgcgtgatgtgcagactccggtaaacttcattgtccattctttgcgtgaggtgaacacgcggatcaaggaagggcgatatttcttcactgacatccgcaaagaaggtattgtactttacgaacttgatcctgagccgctcgcccaacccggtattctcaatccggaagacgcccatcgtattgctaaggaatatttcgacgaccggctgccgcatgctagtaaattcgctaagggagccgcgttttattgtcaggagggagatttcaaagaggctgccttcttgctccatcaagcgatagaacaggcatattccacctttctattggtaacaacaaattactcgccgtcttcgcacaacctgaaattcctgcgtcggctctctgaagggcaacgcagtgaactggccaaggcatggccgcaagatcaacagcgttacaaagcgtggttcaatatcgtcaatgaagacctcggccaagcttccg

SEQ ID NO: 121 - DNA, 228 bp, Xenorhabdus bovienii
  Coding sequence Name=Xb4151_4152.C346.gene1.dna; Position on contig =501..728bp; Strand=+
gtgaacctacgctttgtcagtgatatgcccattgaacagcagtctttccctgctctgcataacgataagactatagcgcttcctaacaatactgttaataacatttgtcaagccgccaatatagatttacgtattgtaacaacagaattaggacatcattacagacagccactccacctgagatgcccatcagatgaattagtacctcagacagcaccgatctactga

SEQ ID NO: 122 - DNA, 141 bp, Xenorhabdus bovienii
  Coding sequence Name=Xb4151_4152.C348.gene1.dna; Position on contig =274..414bp; Strand=-
atgggggggggggggtttaaaaaaaattttaaaaccccccccgagggagggaaattttcttcccccttttttgggggtttaaaatttcgggaaaaattacccccccaggttttggggaaatcccctttaaaggggggttaa

SEQ ID NO: 123 - DNA, 321 bp, Xenorhabdus bovienii
  Coding sequence Name=Xb4151_4152.C352.gene1.dna; Position on contig =43..363bp; Strand=+
gtgaatgattgggagatgccgaaggaagctgctgccgggtctagccaaggcggcctggtgtatctaaaatataccttcagatgtagagagcattttgacgagccaaacaatgagtggctgaattgtattgaagcgactagtgacgagttgcttggtgcttataaaagggccgaagatgatgccatgactgtagccttcggagagcgaggcaggagaaggctaaacagtgtttttgatgttattggttccgtctacccggattatagctatcccttgcgaaaacaaggaaagaaaaggaaagttcccactttggacatctga

SEQ ID NO: 124 - DNA, 216 bp, Xenorhabdus bovienii
  Coding sequence Name=Xb4151_4152.C353.gene1.dna; Position on contig =526..741bp; Strand=-
ttgttaggcccgagcgtggattgccttgcgttgaaaaatggcgactcttactgggatgcctgcagttatactctctcgatgctgactgccctcgctagcccctgtgtctctctgcggagcggcaaagatatgtggctcttcaccagcgccctcctggggattggacatctcctaggcgcagacctaggccccgatctcactgagctatctgactaa

SEQ ID NO: 125 - DNA, 162 bp, Xenorhabdus bovienii
  Coding sequence Name=Xb4151_4152.C353.gene2.dna; Position on contig =789..950bp; Strand=+
atggttattcgtgtcgcagctcagaatgtccagcatatattgagagtggcgccccgtaaattggtcacagaccagaggcgagtggagagtaatctagtttcagagtattacgactcggtgtacctcatggtagtaggggtgattcgacacaggccttcgtag

SEQ ID NO: 126 - DNA, 661 bp, Xenorhabdus bovienii
  unsure (1)..(661): unsure at all n locations
  Coding sequence Name=Xb4151_4152.C354.gene1.dna; Position on contig =1..661bp; Strand=-
atgcaacgtctgtatctaatctgcgccccgatgctacacagctctcctgtccacaccccatcaccattgtatcaccccttccctcactcctcacaaaagtccccctgggcactctngtcccttcttccccccctaaaaaaacatctcctctcccatcagccggccgaggagaaaaaagcccgccgcgaaaaaaatattccggtttctcttctaagcccaacccccggggcctttttatctataacaggctctgtgtttcagcgcatgtacgctaagctgttcagtaattccgattcagcatctaatggttcgcggatcatttcggcacttagcagtgttatcctagagcatgtactgagtgttccaaagatacattatgttgctttggaccagtttatcaggatgcggcgccagggccattttggcacgtttaattatatagaaatggcaagtcaactttctgaacgctgtttccctgccctaacgctctgtgtcaaagacatgctattctcccaactgcgccagcataatcatgtagtaccttgtcagtattggcagggcagtcccgatcagaatgctctgttatgtctccactgttttacaccgaggcagtatagcgccgggcacttgctattatgccccacgggccgagggacttgta

SEQ ID NO: 127 - DNA, 171 bp, Xenorhabdus bovienii
  unsure (1)..(171): unsure at all n locations
  Coding sequence Name=Xb4151_4152.C354.gene2.dna; Position on contig =674..844bp; Strand=-
atgcggactaggtcaccagacatcaatccgttatttactgaatactcaccatctccgacatcaattcttcatgctactttccgcgcggccggctacgcttctaatacggcggtccgcagtctctctttcgtctcactactccacggncttactcccgttacacatgtttag

SEQ ID NO: 128 - DNA, 210 bp, Xenorhabdus bovienii
  Coding sequence Name=Xb4151_4152.C356.gene1.dna; Position on contig =299..508bp; Strand=+
atgggttccgcactgtataattttcacgatcctctggcaaaacaccgtgaatataatgactctgcctatacgctcgatcatttttataccaagatattgaaaatagaatctggctttcaaacggaaacgggtagacaaatggctcgtgaaaggacagaacgcatggaacactttcttgaggcttttttgaatgaaattcaggtcacataa

SEQ ID NO: 129 - DNA, 174 bp, Xenorhabdus bovienii
  Coding sequence Name=Xb4151_4152.C359.gene1.dna; Position on contig =654..827bp; Strand=+
atgcggtgggcgagaggagcgcacaaatatgctagggaggcacaagggctctgtccgcgggtggggccggggggtggcatcgagtttctgatattcttctcctgtattgcgaggaacgcttcgcaaggactgtgtgcaaatggctccggtgcgtctgagggtgcgtccgcgtag

SEQ ID NO: 130 - DNA, 222 bp, Xenorhabdus bovienii
  Coding sequence Name=Xb4151_4152.C361.gene1.dna; Position on contig =387..608bp; Strand=+
atgtggccgaatcgactcacgacggtcgccattgtaaatgcagcatctactatccatgactttaacgtggggtgttcggggttggcgccgtcttcccggggtggtggacgtgggggcgaggttggctgggtggtggtggcgcgaaaggggggtggggcccgggcgcggtgggttggggtgtggggtggggagggtggcgaacagcggccctacactgtctaa

SEQ ID NO: 131 - DNA, 478 bp, Xenorhabdus bovienii
  Coding sequence Name=Xb4151_4152.C363.gene1.dna; Position on contig =2..479bp; Strand=-
gtgatcgccgtgtcacatgaactaggtgaaatcttcagcacaaagtttggtttttggcccgacattcaaccaaatacagcaaagcgtaccaatgtcagtgttgcaccaaagggccaccgaatgatctgggctggccggttggatgccgacaagacaaaaggtctttatgctctgctcgacatgctcgacagtctgccgaattgggaactagatattgctggcgaagggccagaaatacccaatctcctgaaagcgatttcgggtcaggcgtcccgtcaaggacgtatacgtttactcggctggatagacgatattcaaactcatatgccgaagtatgacattgttgctggcatgggccgggtcattgtggaggcatcgagccttgccattcctagccttctggtcggctatgatgaagtaaagtgcttcatgtcgtcatcgaccgttgacgacgcagaccgaagcttgcggccgctcg

SEQ ID NO: 132 - DNA, 772 bp, Xenorhabdus bovienii
  Coding sequence Name=Xb4151_4152.C364.gene1.dna; Position on contig =2..773bp; Strand=+
cgagcggccgcaagcttcggtcttgttcatgttcatgaatccgtcgaacaggccattgcagcgtttccggatcgtgaagccatcatcaaaaaccttgccgatgcggcgaaaagtctgaaaacagtccagaccagcgcacctgatggttttctcctgctgcatggccacagactggagcgcaagcggcaggaaatcgatgctgccctgatggaagcggcttcgctgttcgagcgtgcttatctggaacagccggtattggcgtcgggggatgagacaaggctcgtcatcgagcatggttccggagcggcagaaatcgcaataatggctgaacctgtcctgcctgaaacctgttctatcgcctgcgagcagcaaacctcggaacgaaaggttttcaccgtctcgctcatggaagacgtggcaccttccccgcttttcgagcctgcatggcggtcgcttggcggtaacgggcaagcctttgtccggctaagggcgcagtttgacgaccatctggcggagtgcggcttcgatctcgaagagccattcgctattgttccccccgcttcactgaagttcgatccgcctgccgtcattatatccggaggggaagaacatttgccggtcaggcttgttgtcgacggcagggctgaccggattgctttcacaccgcaaaacggctggaatataagcctgaacggtcaaagcgccgtgctgcatgggccttccgttccgaaaccgggcctgacaaacctccaagacctcggccaagcttccg

SEQ ID NO: 133 - DNA, 415 bp, Xenorhabdus bovienii
  Coding sequence Name=Xb4151_4152.C366.gene1.dna; Position on contig =1..415bp; Strand=+
gcggccgcaagcttcggtctcaacccgtccggccaaattcccatgctggtgaccgacgagggggaagcgctcttcgatagtccggtgatctgcgagtatttgaacgattttgccaaaggcaagctgatcggtcgcggtgacgaacgctggcgtaacctgcgcgatcaggcgctgggtgactccatgtgcgacgctgcactacaattacgctacgagatcggcctgcgacccagtgaactgcaatggcagcaatggcggaatgcatgggcatcgaaaatcatcgatactctgacgtggctcgaaacgcggcccgagcatctcagtggacgtcatgatataggcgctatttcgatcttcgtgccccttgcttttatcgacaatcgtattccagaattgagacctcggccaagcttcc

SEQ ID NO: 134 - DNA, 150 bp, Xenorhabdus bovienii
  Coding sequence Name=Xb4151_4152.C371.gene1.dna; Position on contig =28..177bp; Strand=+
gtgggatatgtctttctgcttgccatcaacgacaaggacaaacagattgaaacactgcagcagatcatggcgaccatacaggatgctgatgcactcgaccggctgaaagcggcgcgcacgctggaagacgttcaaaccgcgctgcaatga

SEQ ID NO: 135 - DNA, 268 bp, Xenorhabdus bovienii
  Coding sequence Name=Xb4151_4152.C373.gene1.dna; Position on contig =1..268bp; Strand=-
cgagcggccgcaagcttcggtctggcgctggcggtcgatcgcgtcatggcggaaggctcgctctatgaccgtgaactgtcagcccttgccgtgcgccagtcgcgtggcgatctgatcgaagcaatctttctggtgcgcgcctatcgcaccaccttgccgcgtttcggctattcccgtccgatggaaacggcgcaaatgctgatcgagcgccgcatttcggcgacctataaggatctgccgggtggtcagacctcggccaagcttccgc

SEQ ID NO: 136 - DNA, 180 bp, Xenorhabdus bovienii
  Coding sequence Name=Xb4151_4152.C374.gene1.dna; Position on contig =337..516bp; Strand=-
gtgaagcggatgcgatctatctggacgaaatccgcaaggcctggcctctacgatgccatctggcaggctttcgcggttctgctgccggttcagactgtcggcgtgatgggcgatggccgtacctatgaattcgtctgcgcgctgcgcgctgtgacttccgtagacggcatgacccgctga

SEQ ID NO: 137 - DNA, 315 bp, Xenorhabdus bovienii
  Coding sequence Name=Xb4151_4152.C379.gene1.dna; Position on contig =87..401bp; Strand=-
ggaagcttggccgaggtcttgaagggaaaggtcgtcagtatttcaccggatacaattcaggacgaggtcaaaccggaagagttctactatcgtgtcttcataaagaccgaaacagacgcacttttcaacaaaactggcgagcgttttccaatcgtccccggcatggtcgctaccgttgacattcataccggcagcaagactgttatggattaccctcatcaagcctttcaacagagcgcgggaagcactccgggaaagatagttggcttgtattatccgcgtggcgagaatgccatttcccaatgggctcgctga

SEQ ID NO: 138 - DNA, 225 bp, Xenorhabdus bovienii
  Coding sequence Name=Xb4151_4152.C383.gene1.dna; Position on contig =594..818bp; Strand=+
atgcgcacatctgacggcccgagtgatcctactagcacctatcttggagataccaagcatgcttctgttattactgctggtcactttgggctatggcccaagtgttctcagagcccctggattgcccagagggatgtagcaattgtctttgtgatagtgaatattagcttactaaagagcggaatgattaactcagttctatatgaggagttctgggttctctaa

SEQ ID NO: 139 - DNA, 231 bp, Xenorhabdus bovienii
  Coding sequence Name=Xb4151_4152.C387.gene1.dna; Position on contig =9..239bp; Strand=-
atgctgatcgttgttattccggctatcgtaatggcaatcatttttgctctacgttaccgggaagccaataaatctgctacttaccgtccaaactgggcacactcaaataaaattgagcttgtcgtctggactgtgcctattctgattatcatcgtcttggcaactattacatggaaaacgactcaggaactcgatccatataagccattggactataagaaaaaccggtaa

SEQ ID NO: 140 - DNA, 1209 bp, Xenorhabdus bovienii
  Coding sequence Name=Xb4151_4152.C387.gene2.dna; Position on contig =343..1551bp; Strand=-
atgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatgttcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattgtcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatga

SEQ ID NO: 141 - DNA, 156 bp, Xenorhabdus bovienii
  Coding sequence Name=Xb4151_4152.C389.gene1.dna; Position on contig =3..158bp; Strand=+
aaattggaagttgcaaaagtaggtgtaagttcttcatttttaaagggtacgcccctacaggattcgaaccctgtgccctacggcttagagggcccgttgctctatccaaatggagctaaagggcgcatacgagatgagaacccgttaatgcgttga

SEQ ID NO: 142 - DNA, 876 bp, Xenorhabdus bovienii
  Coding sequence Name=Xb4151_4152.C389.gene2.dna; Position on contig =308..1183bp; Strand=+
atgtcagcaaaaattattgatgggaaaacgattgcgcagacaatcagaagcgaagttgcagaaaaagtcaggcaacgaatcgccgctggaagacgtgctccaggtcttgccgttgttttagtcggagaaaatccggcctcccaaatttatgtcgcgagcaaacgccgtgcctgtgaggaagtcggttttacttcccgctcttacgacttgccagacatcaccagcgaagccgaattactttccctaattgataacttgaacgaagatccggagatcgacggcattttagttcaacttcccctacctgccggcattgataatgtcaaagtactggaacgcattcatcctgataaagatgtggatggtttccacccttacaatattggccgcctgtgccagcgtgctccaaagctgcgcccctgcactcctcgcgggatcgtgacgctgcttgagcgctgcaatatcaatacctacgggctgcatgcggtcatcattggggcttccaatatcgttgggcgtccaatgagccttgaactgctgttggctggctgtactacgacggtgacgcatcgttttaccaaaaacttacgccagcatgttgaacaagctgatttactggtcgtagcggtcggtaaaccgaatttcattcccggcgaatggattaaacccggcgctattgtgattgatgtcggcatcaatcgtctggaaaatggtaaagtcattggcgatgtggatttcgatagtgcatccgaacgcgccagttggatttctcctgttccgggcggagttggcccgatgaccgtcgcgacattgattcaaaataccttgcaggcttgcgaggaatatcatgatgtagaaaaaaccaaaggatactga

SEQ ID NO: 143 - DNA, 213 bp, Xenorhabdus bovienii
  Coding sequence Name=Xb4151_4152.C389.gene3.dna; Position on contig =1183..1395bp; Strand=+
atggaaattttttgtttagatggacacccttatgtagagctgtgcgatctactgaaacttcaagggtggtgtgaaagtggtgcagcggcaaaagcgatgattgcagaaggtttggttaaagttgatgaccaagttgaaacccgcaagcgctgcaaaattatcgcgggtaaagcagtggcctttaacggcgaatcggtgcgcgttgaagcataa

SEQ ID NO: 144 - DNA, 801 bp, Xenorhabdus bovienii
  Coding sequence Name=Xb4151_4152.C389.gene4.dna; Position on contig =1854..2654bp; Strand=+
atgataagaataacgcgtacagtagcgcatgaaagcgctcaaagtgagtatctattacgtcactatgatgccctacactctgcgttagttcagcatctaccgataaatttttctacattatttgctaaacctgccaaaagcagtgatggtgccattgaatggtacagtgatttacaaggccaacctgtcccttttgctcagttatctgcgatagaacgcgataagatccagacgcaaattgcccgtcaattggcggtattagctcgcctgcgtgaacagctcagtgaaaaagagggtgtggataacgaattactgacgttactgggaaaaatcagccagtttcctgctgaggaacacatttggagtgtggataaccaacccgttatcctttgggagccgatgaacgaatctgcatctcaaaatattgcaggaaatcccgattttgtcgcatctcagccagaacagaaacgaaagccgcgctggttatggtggttgctgttgttattgttcattttattattgctgtggctgctgcgaggctgcctgccacgcaatcacactcatattgcgataaaacaacctaatccccctgtggcagtaaaacctccgcaggtaaaaccagtagaacagccaataaagcaaccaatagaacaacccgcgccaacagtgccggaggtaaaacctgaagccgtggtgctctccccgcctgcggatgtcagaaaactatgtccgtcccagcgaaagcggaatcaggctccagaggttgtggtggttaatgagatggtccccaccaccctgtga

SEQ ID NO: 145 - DNA, 457 bp, Xenorhabdus bovienii
  Coding sequence Name=Xb4151_4152.C389.gene5.dna; Position on contig =2696..3152bp; Strand=+
atgcaaaacgttacgcttattggtattgatctcggcaaacattctttccacgttcactgtcaggacaaatcaggaaaggccctgctgcgtaaaaaatttacccgcgccagactgatggagtttttagcgggatcgccatcagcgactgttgtaatggaagcctgcgccggtgctcactttatggctcgccggatcgctgcttttggtcacgaagcgaagctgatttctccacaatttgttcgtccttttgtaaagagcaacaagaacgattttgtggatgctgaagccatatgcgaagctgcatctcgtccctccatgcgatttgtgcaaccacgaacagaggcgcaacaagctatgcgcgccctgcatcgggtcagagaatcactggtcagagacagggttaaaaccactaatcagatgcacgcttttttactggaatttggcatcagtatgccga

SEQ ID NO: 146 - DNA, 783 bp, Xenorhabdus bovienii
  Coding sequence Name=Xb4151_4152.C390.gene1.dna; Position on contig =177..959bp; Strand=+
atgattctgcaagactcttttagcatgtccattatgatcaccctaaaaaacattacggtcgaatttggtagccgcaaggtattaaacaatatcactttcagtcttagacaaggcaagatcctaacgttaatcggcccaaatggtgcgggcaaatcaacactggttcgcgttgttctgggcttgattcaaccaacttctggaactatcgaacacagtcatccactgaaaatcggttacgtcccacaaaaaatcagccttgatcctaccctgcccttaacggttaaacgtttcatgatgctaaggccaaatgttaaatcagcagacatcatgcccgtattaaagcgtgtcaatgctgaacatttattacagcaacccatgcagaaattgtcaggaggagaaacccaacgggttttactcgccagagccttgctcaatcatcctcagcttctggtgcttgatgaaccaacacaaggtgtcgatgtgaatggccaactggcgctttacgatttgatcaatcaaatcagaacagaacttaattgcgccgtgtttatggtatcccatgatttgcacttggtgatggcgaaaacagatgaggttttatgccttaatcaacacatttgctgttctggcacacctgaagtggtgtctatgcatccagaattcatcgcaatgtttggccgccatggtgcagagcaactggcggtctaccgccatcaccacaatcatcaacatgatctgagaggaaaaattattttgaaaaacggtggggagccacgtcgatga

SEQ ID NO: 147 - DNA, 786 bp, Xenorhabdus bovienii
  unsure (1)..(786): unsure at all n locations
  Coding sequence Name=Xb4151_4152.C390.gene2.dna; Position on contig =956..1741bp; Strand=+
atgattgagttattacttccaggctggctggctggcatnttattgaccatcgccgcagggccgctcggctcttttgttgtttggcggagaatgtcttattttggtgatactctggcacacgcttcattgctcggcgtggcattcggttttttactagacgttaatccgttttatgccgttattgctgttacgttgatattggcaatgattttagtctggctggaaaaacgcccacaattagcggtcgatactctgctgggtattatggcgcacagtgcgctatctctgggattggtagtcgtcagctttatgaccaatatccgagtcgatatgatggcatatttatttggtgatctgctgtctgtcacttatgaagatctctggctgattgcagcgggtgttgccattgttgctgggttgctgacatggcaatggcgtgctttgctgtcgatgacggtcagtcaggatttagcatttgttgatggcatcaaaatccagcgcttacgtgtgcttttaatgctggttacagctttgaccattggattggcgatgaaatttgtcggggcattgatcatcacttctctattaattatcccggcggccactgcccgtcgattttcccgtacaccagagcacatggcagtttttgctattgctgttggtatgcttgctgtcacgggaggattaactttatcggcattttataatacccccgccggaccttctgttgtgctctgctcggcagcattgtttgcattaagtttgacgtgtaaggcgaaaaactga

SEQ ID NO: 148 - DNA, 873 bp, Xenorhabdus bovienii
  Coding sequence Name=Xb4151_4152.C390.gene3.dna; Position on contig =2285..3157bp; Strand=-
atgctgatcaacccatctattcgtcttaacaaatacattagcgagagcggcatctgttctcgtcgcgatgccgatcgttacatcgaacaggggaatgtttttattaacggtaagcgagctgctgttggcgatcaggtatttgccggagatatagtgaaagttaacggtcagcttatcgagccgcgtgatgaagaagacctagtgcttattgcgctgaataagcccgttggcatcatcactacgatggaagatagtgagcgggataacatcagtgatttcgttaaccacagcaagcgtgtctttccgatcgggcgtctggataaggattcccagggactgatttttctgactaatcacggcgatctggtcaataagattcttcgtgccggaaataatcacgaaaaagagtacgtggtaacagttaacaaaccggtgaccgatgagtttattcagggcatgagcgcaggtgtgccgatgctgggaacggtgaccaaaaaatgtaaagtgcagaaagaagcttcttttgtgtttcgtatcacgctggtgcaggggcttaaccgccagattcgccgcatgtgtaaacactttggctatgaagttactaggcttgagcgtacgcgcatcatgaacgtcaacttgaaaggactgccacagggcgagtggcgagatttgaccgacgacgaactgatcgagttatttaagctgattgaaaactcatcgtccgaagaaaaatcggcgaaaaaagcgcagactaagcacgttacagctaaaaaaacgggctttaacgagccgaaaaacgccgaaaaatcagacggcaactcggcttcccgtaagcgctttacccagtctgggcgtaagaaaaaggggcgctga

SEQ ID NO: 149 - DNA, 594 bp, Xenorhabdus bovienii
  Coding sequence Name=Xb4151_4152.C390.gene4.dna; Position on contig =3328..3921bp; Strand=-
atggaacgcaatttttacggtttatttaatggggaagaaatgtctcatttttcaaaaatttctgagttacaggatttagtggctgatttagccggatttgagcaaaaacttaagcaatttgaagggcatcttggcttacacttcgaacaatattcagcagaccatatttccctgcgttgtaatgaaagtaaaatagctgatcgttggcgtaagggctttctgcaatgtggtcagttaatatctgaaagtatcattaatggccgtccgatctgcttatttgatctgaaccagccaatagtactacttgactggaaaattgattgcgtggaattgccttatcccagccaaaaacactatgtccaccaaggttgggaacatgtcgaactggtgctgtctgtaccaccagagcaacttatttgtgaagctaaaaagttattacctcaacctttaccagataattttcggatgaaggaaagtcatccgaaaggaaaaaatgaacggttgccaaacccgactttggctgttactgatggtgaaatcacgatcaaatatcatcctttctgtatcagagaaattgtcaaaagtgaggtatag

SEQ ID NO: 150 - DNA, 1731 bp, Xenorhabdus bovienii
  Coding sequence Name=Xb4151_4152.C390.gene5.dna; Position on contig =4176..5906bp; Strand=+
gtgaatatacaggttattctttcagaaaaaatcagcaatgcgctgattgaagctggcgctccaaccgacagtgaagctcacgtccgtcaatctgcaaaagcacaatttggtgactatcaagcgaatggtgtgatggcagctgctaaaaaggtgggaatgcctcctcgacaattggcagaaaaagtcatcagccaactggatctgcaaggaattgccagcaaaattgaaattgcaggcccgggttttatcaatatttttcttgataaagcgtggattgcagcaaatatagaaactgccctgaaagatgaaaagctcggtatcacccctgtggaaccgcaaaccatcgttatcgattattctgctcccaatgtcgccaaacagatgcatgttgggcacctgcgttcaaccatcattggtgatgctgcggcacgtacccttgaatttcttgggcataaagtcattcgagccaaccacgttggtgattggggaacccagttcgggatgctaatcgcctatctggaaaagatccagaacgaagatgccaatgacatggcattagcagatttagaagctttctatcgcgaagcaaagaaacattacgatgaagatgaagagtttgctatccgcgctcgtaactacgtcgtcaaactgcaaggcggtgatgaatattgccgtgaaatgtggcgtaagctggtagatatcaccatgtcccagaatcagcaaacttataaccgcctgaatgtcacattgacagaaaaagacgttatgggtgaaagcctgtataacgatatgctaccgggtatcgttgcagatctgaaacaacgtgggatcgccgttaagagtgatggtgcgacagtggtttaccttgatgaattcaagaataaagaaggcgaacccatgggcgttatcatccagaaaaaagatggtggctatctttacaccacgacggatatagcctgtgccaaataccgtcatgaaaccctgaatgccagccgtgtgctttactacaccgactcacgtcagcaccagcacctgatgcaagcttgggcaattatacggaaaacgggttatattccagcatctatgttactcgaacaccacatgttcggcatgatgctgggcaaagatggtaaaccattcaaaacccgtgccggtggtacagtaagactgtccgacttgctggatgaagcgattgagcgtgcagataccctcattcgtgagaaaaacccagatatgccagaagatgaactgaaaaaaatcgtggaagcggtagggattggcgcggtgaaatatgcagatctttccaagagccgtactacagactatgttttcgactgggataatatgctggcctttgaaggcaacacggcaccttatatgcaatatgcctatacacgtgtgtcatctatctttaaacgtgcagatatcgatgaaaacaacctgacactgccggtgatgctgaatgaagaacgcgagcaggcattggcaacccgcctgttgcagtttgaagaaacgatcactactgtcgcccgtgaaggtacgccacatgttatgtgtgcatacctgtacgatctcgccggtctgttttctggtttctatgagcactgccctatcctgaatgccgatagcgaagagctgcgccagagccgcctgaagttagctctgctgacagcgaaaactttgaagcaaggtctggatactctgggtatccagactgtagaacggatgtaa

SEQ ID NO: 151 - DNA, 1185 bp, Xenorhabdus bovienii
  Coding sequence Name=Xb4151_4152.C391.gene1.dna; Position on contig =432..1616bp; Strand=+
atgtctaaagaaaagtttgaacgtaaaaaaccgcacgttaacgttggtactatcggccacgttgaccacggtaaaactaccctgactgcagcaatcactactgttctggcgaaaacttacggcggtagcgctcgtgcattcgatcagatcgataatgcaccagaagaaaaagcgcgtggtatcaccatttctacttctcacgtagaatacgataccccaactcgccactatgcgcacgttgactgcccaggccacgccgactatgttaaaaacatgatcacgggtgctgctcagatggatggcgcagttctggttgttgctgcaactgatggcccaatgccacagactcgtgagcacatcctgctgggtcgtcaggtaggcgttccatacatcatcgtgttcctgaacaaatgtgacatggttgatgatgaagagctgctggaactggttgaaatggaagtccgtgagctgctgtctcagtacgatttcccaggcgatgatacgccaatcatccgtggttctgctctgaaagcgctggaaggtgaagcagagtgggaagcgaaaatcatcgaactggcagatgcactggattcctacatcccagagccagagcgtgacattgacaagccattcctgctgccaatcgaagacgtattctccatctctggccgtggtactgtagttactggtcgtgttgagcgtggtatcgttaaagtgggtgacgaagtttcaatcgttggtatcacagatacggtgaaaacaacttgtactggcgttgaaatgttccgcaaattgctggacgaaggccgtgctggtgagaacgtaggtgttctgctgcgtggtactaagcgtgacgaaatccaacgtggtcaggtactggctaaaccaggttcaatccagccgcacactcaattcgaatcagaagtttatattctgagcaaagatgaaggtggccgtcatactccattcttcaaaggttaccgtcctcagttctacttccgtacaactgatgtaaccggaactatcgaactgccagaaggcgttgagatggtaatgccaggtgacaacatcaacatgatcgttaccctgattgctccaatcgcaatggacgaaggtctgcgtttcgcaatccgtgaaggtggccgtactgtaggtgctggtgttgttgctaaagtgattgcttag

SEQ ID NO: 152 - DNA, 1005 bp, Xenorhabdus bovienii
  Coding sequence Name=Xb4151_4152.C391.gene2.dna; Position on contig =1764..2768bp; Strand=+
atgcaaaacgttacgcttattggtattgatctcggcaaacattctttccacgttcactgtcaggacaaatcaggaaaggccctgctgcgtaaaaaatttacccgcgccagactgatggagtttttagcgggatcgccatcagcgactgttgtaatggaagcctgcgccggtgctcactttatggctcgccggatcgctgcttttggtcacgaagcgaagctgatttctccacaatttgttcgtccttttgtaaagagcaacaagaacgattttgtggatgctgaagccatatgcgaagctgcatctcgtccctccatgcgatttgtgcaaccacgaacagaggcgcaacaagctatgcgcgccctgcatcgggtcagagaatcactggtcagagacagggttaaaaccactaatcagatgcacgcttttttactggaatttggcatcagtatgccgatcggaaccgccgtgataaaaagactttcaaccgtcttggcagagaacgaacttcctccctatctggcacagttgctgatgcgcttacatgcccattatctttatcttgtcgaacagctcaccgagcttgagacggcactggagcaggagctgagacgtgatgaaacaggacagcgtcttcagacaataccgggcgtgggtccgataactgccagcgtcttatcatcgcagctgggcgatggtaagcagtatggctgtagccgggattttgctgcttcaaccggtctggtaccacgccagtacagcacgggtggcaaaaatacgcttttagggataagtaaacgcggagacaaaaatctgcgacggttacttgtccagtgcgccagagtctttatccagagaatcgattatcagtcaggaaggctggctgaatgggtaaaggctcagcttgagcgaaaacactcaaatgttgtggcctgtgcgctggccaacaaattagcccggatagcctgggcaatcacaacacggcaaactgtgttcgaaaggtaa

SEQ ID NO: 153 - DNA, 192 bp, Xenorhabdus bovienii
  Coding sequence Name=Xb4151_4152.C391.gene3.dna; Position on contig =3805..3996bp; Strand=+
atgtctggcagtgccctactctcacatggggagaccccacactaccatcggcgctacggcgtttcactgctgagttcggcatgggatcaggtgggaccaccgcgctatggccgccagacaaattctgtgttcaatcccgaacaagctgctgtttttcatttgaaactgcgtctctctctctcaccaaaacac

SEQ ID NO: 154 - DNA, 276 bp, Xenorhabdus bovienii
  Coding sequence Name=Xb4151_4152.C392.gene1.dna; Position on contig =194..469bp; Strand=+
atggccaaagttgatgtctattgccgttattgccacaaatcagaacaggtcaaaggacatgggaaaggaaatggcggacatcctcgttatcgctgttatagctgctgtaaggtctttcagttggcgtatacctatcaggcctgcaaacccggcgttaaagaacagattgtcgatatcgcgatgaataacgggggaattcgtgacaccgctcggatcctgaaagtcgccaccgccaccgtcatgaaaacattaaaaacctcagaccccgaaacgtaa

SEQ ID NO: 155 - DNA, 291 bp, Xenorhabdus bovienii
  Coding sequence Name=Xb4151_4152.C392.gene2.dna; Position on contig =598..888bp; Strand=+
gtggctcatgtttttggcgatcgcagtcgaaaaacgttagacaagctgcttaccctcttatcttcctttactattcggttttactgcacggatgactatgttgtttatgacccacttcccgaggaagagcacttgactggaaaggcgtttactcagcgtatagagagaacgaatttaacgcatcgtacccgaatcaaaaggctgaatagaaaaaccattgggtattcaaaatcggaagaaatgcacgataaagtgataggaacctttattgaacgtgaacattatttttaa

SEQ ID NO: 156 - DNA, 534 bp, Xenorhabdus bovienii
  Coding sequence Name=Xb4151_4152.C392.gene3.dna; Position on contig =1180..1713bp; Strand=-
atgaaaaaaaaatcccaaacattatttgctgtatttttgttaagcatcactactgcttgttattcagagagtaacgggagtgaacattttaatgttaaaacaacacaggtggatgaaaaaactcatattgaaataatacatgcattggccaatagtgggcatataggagctcagtatgaattaggtacaatgtattctgaagggaaaggagtcaagcaggactatatcaaagcaaaagattggtatgaaaaagccgctttacagggagatatgaattctcaagtttcattgggcgttatgtattattatgctgaaggaatacctcaagactatataaaagcgaaagaatggcttgaaaaagcggcggcacaagatagcgcaggttctcaggctattttgggtattatgtattatgtaggtgagggagtacaaaaagacgatggaaaagcaaaagaatggtttaaaaaatcctgcgataacggatatcaggtaggatgtgaatcttttgcaaaaatgaacatacatagtaaatag

SEQ ID NO: 157 - DNA, 984 bp, Xenorhabdus bovienii
  Coding sequence Name=Xb4151_4152.C392.gene4.dna; Position on contig =1969..2952bp; Strand=+
atggcctataaacaactgaccgaaacagaaagatatcagattttcagcctgaaagaagccggtttttcacaacgggagatttcaaagtcactcaatcgaaacccatcaacgattagccgggaattgagacgaaatcgggaggcaaagaaatatacgcctgaacaagctcagcttaaggccgtagcgcgccgacagtgtgctacaaaagcagtaaaagtgaaaccagagatagaaatgtggatcaaacagttaatttggcaagatttaagtcctgaacaaacagtcggttatctcaaaagggaaaatataatatctttgcatcatgaaacagtttatcgattgatttataaggataaacttaatgatggtaatttatggcaacatcttaggattgcgaaaaaaccgtatcgtaaacgctatggaagttatgagcgcagaggaaaaattaaaaacagagtcagtattgataagcgccccaaacttgttgataaaaagcagcgtattggtgattgggaaggagatactatcgtgggtaaaaatcataaaagtgcattattgacattagttgaacgaaaatcgttatttactattataattaaacttgaaaataaaacagcagaaggggtcgcaaaagcggcaacaagacatttatcactgataaaacataaaattaaaacaatgacctttgataacggcctcgaatttgccgaacacgaactgatcagtaaaaatttagagacaaaaatttattttgctcacccgtattccccctgggaaagagggataaatgagaacacgaatggattaatcagagattacttcccaaaaggaactgattttaataaggtgtcagagcgggagattaaccttgtggcaaaccgattaaataatcgtcctcgtaaaacacgagattacaaaacaccgaatgagttatttaaaggaataccctctcatttacttcgtccattacggtgttgcgcttaa

SEQ ID NO: 158 - DNA, 378 bp, Xenorhabdus bovienii
  Coding sequence Name=Xb4151_4152.C394.gene1.dna; Position on contig =6..383bp; Strand=+
atgaatattcgtcaactggcattaaccccgaaactgggctttcgcaccaaaacggtaaccgtgactgagtgggataacgccaccgtcaccctgcgtgaaccgtcagctggggcatggatccgctggaatgaagtgacctcgccaacagacaaagaaggaacactctccacggcagaaaaggtgctgcgcaatacccgtgccgatgtcgtgctgtttatcgatgtgctgtgcgatgaacacggtgaaccggtctttactccggacgatatggaggccgtgatggatatctacgcccccgtgcattcccgcctgttacatcaggcactcagtctggtgaccaccggtgatgaagccgaaaaaaagtccgatctccattaa

SEQ ID NO: 159 - DNA, 267 bp, Xenorhabdus bovienii
  Coding sequence Name=Xb4151_4152.C394.gene2.dna; Position on contig =392..658bp; Strand=+
atgctgacgctggccctgcgcctcggtaaaaccctgtccgaattgcagggcgggttaagtgccagcgaactgatgctgtggctggcctacgaccgcgaaaaccccctcagcgaccgtcggggtgacattcaggccgcgcaaattgcctccgcggtttatcagtcacagggtgtcaaagtcgggctgagcgaggcgctgctgcaatggggcaatcccgatgaggaaagcggcgacgacttcgaaaacttctttgctaatctcacatag

SEQ ID NO: 160 - DNA, 3375 bp, Xenorhabdus bovienii
  Coding sequence Name=Xb4151_4152.C394.gene3.dna; Position on contig =667..4041bp; Strand=+
gtggcaaaactgcgtgaactgattatcaaaatctcggccaattccagctcgtatcaggcggaaatcgcccgggctgcccggctgggagaaaattaccaccgggtgatggaaaatggcaaccggggtgcggcggcggcggcgcgtggcagccgtgccgccctgcgtgacctgaacagccagctggtttcagtgaaagactctgccgtcgggatggcgggcgcgtttgccggcatcttcgccaccagtaaactgattgaaaccgccgacaaatggacaaacctcaattcccgcttgaaactggcgacggcgtccagtatcgatttagccaatagccagcggttattgatggagatgagtcaaaaaaccggaacatcattcgaggccaatgccacggtctttgcccgtgcggctgccccgatgcgggcactccaatatgcctcacaagacattgttaatatgacggaagcgctatcgacggggttgagaatatcaggcgcgaatgcttcagaatccagttcggtattggttcagttctcgcaagcgatgtcgtccggtgtcctgcggggtgaagaatttaacgcgatggcggagaacggcagtcgaatcattcaggcactggctgacggtatgggcgtcgccagaacccaattaaaaggcatggcgaacgacggcctgttgacgatggataaagtcattcccgctttactgagccaactggagaaactgaaagcagaaggcctttcaatgggggcgacggttgaaaaatccctgatgcgcgtacaaaacgccttcatggaatggatcggtggggcgaatgaagccacgggtactacccgcgttctcgccggggtactggatgacctgtctaaaaatattaacgacgtcgctgcggcgggcgcagtggcagtcggtctgttcggggcgcgggcgctgggtaacagggtatcagcgattggggcatcaacctctgcgctgatccagaattcccgcgccgaaattaataacgcggatcaagcttaccgtaactctcaggttcaggttgcctcagcgagagccagcgcttatcaggcacaacaaaacgttatcgccgcgcgttcacgcctgcttcagacgacaaacacacagaccttcgccgccgcagaagcgagactgaaccggacactggtcgcagaagcggcagcgcaggccagagtgacgcaaagcatcaatgcaagagccgccgcacaagcgcgactcaatgcggtcacctcgctcggttcaagaatgggcggtgcgctgctcggcgctgtcggtggactgccggggatactgattatggccgccggtgcagcctacctgctgtaccaaaaccaaaagcaggccaaagaagaagcccgggcgcacgcgaaagaggcgacaaaaatcaaggaagaactgagcaagatggatcctgttcaactcagggacaccaagaatcagttaaaagaagatcttgccgtggctaaagaggatgtggaaaagttcaggaaggagatgaataaaaaccaaatcagcctcaatcttttcatgaaggataaaagcaacggtaaaaatactgacatcaagatcaccgagttcagcactaaactttcagaaagccgttcggcgtatgaagctgccctgaaaacggtcggtgaaatcacgtctgccctcacgagtctgggtgaccaacagacaatcaatggggagaaagagaaaaggttcatcacagcgattaacgaaatgcgcaaaaccggcaatgtgacgctggcgctgcaaaatcaaaagctggaactcacggtcgagctactggaacggatcaaaaactcaagcattgatgtatcaggtattcacattcccgtaccggtagtgaaattcgagccaaacgacaaaataaagtcgttactgaaagaccaggaaagggaaattgatctttctaaaagaaagggattagataaagtcaggcgtgaggcgtattacaaagccgttgatggggggttgaatccggatgataggcaacaaaagccctatgtgaatcaggtcattaataacgcggctcaggtataccaaaatgccgaagccctacggaagcaggacgaagccgcccgaaaagctcaaagcgaggcagaaagtgccacacggaaagccgccaaaaccgcagaagattacacgaataaagtggccgaactgaatacgcaactggccaccgaagcgatccgctataaagagggcaatgctgccgccgagctattcgccaattctcaaaataacgtcagtaagtttactcaggaacagaacaaccacctgaaccagcttaacaagcgactggaggaaactaagcagcgttatcaggacttacaggctgctatcgaagcggatccattccgtaatgttgctaaaagaacccaagaagcgacagagcaactggagcggcagaagaacaatggtcaaattgagtcacccgccgaatacacctatcgaaaaggggatatctggaaagacgaggttagaggcaatgcggacgccagacagcagtatgccgtttccgccagagataacttacggggcgaagttgacccaatacaggatctggaaaaccaacttgaacgcaaaaaggcgctttatcagtcctatgctgacgcaactgttatcagtgaacagcgtaagaatgaactgattgcggccgccgaaacggaaaacaacacgaaacgcattgaagcggcgaaacagttatttgctgcccaaagtacctatcacgcaatcgcagtcaacctgtttgatactgtcagcgaacgcatgggcaacatgattacggggctgctaaccggaactaaatcgctcaaagaaggcatttctgaaatgttcgcttcaatggcacagagcgtcgttcagagtttaatgaaaattgctgcgaataaggcatttgaaatgctggcctcttcattcggtggcggtgcggggggggcgttcaacggcttcatgtctacgttcgtcaagaatgccaaaggcggtgtttataattctcccagtctgagtagctacagcggtcagatagtcaatagtccgacattgtttgcatttgcgaaaggggcgggactgatgggtgaagcggggccggaagccatcatgccgctgacccgtagtgccgatggctctctgggtgtacgtgctatttccccaaagggcttgggtgatcaagggggcaccaatatcaatgtctacatcacggacgggaaaactgaaagttcatcatcgaaaggcgataatgacgccttcgggcgtcgttttgctcaggccgtcgctcaggtctactacgctgaacgtgacagggatttgcggcagggtggtgcaatcaacaaagcgataagggcgaaataa

SEQ ID NO: 161 - DNA, 333 bp, Xenorhabdus bovienii
  Coding sequence Name=Xb4151_4152.C394.gene4.dna; Position on contig =4041..4373bp; Strand=+
atggaaatattcacatggctgccgcgcgtgaatgccagttccaatgttgaatttgcgatccgaaaagcgaaattcggtgacggttatgaacaggtctctggtgcggggattaaccccaagtcgatgagatggacattggattttgtcggtaatgaaaaacacattactgagattatcgcctttcttgaccggcatgaagggcataagtcatttatctggacgcccccgctggcgagcaaggggctgtttcggtgcgagagctataagtatcaggccattgattacaaaacctatgccctgtcaactgaattcattgaggcgcacgcgccatag

SEQ ID NO: 162 - DNA, 750 bp, Xenorhabdus bovienii
  Coding sequence Name=Xb4151_4152.C394.gene5.dna; Position on contig =4383..5132bp; Strand=+
atgtttactgctgacgtacaaaagctggacgccggaaataccgtccggctctacgagattgacgggacaaaattcggtgccgatgtgcttcgttttcatgcgtatggtatgcctgtgacgcccgaagaaattgacaccgccgaggagacaggcagtcagccgcagccgaagtccctttggtggcaggggcaggaatataaaccgtggcctgttcagatagagggactggacatgtccacggatggacaggctgcccgccctcgcttatctgttgcgaatattgagggaacggtcaccgcgctatgtctgcaatttgatgacatggtacaagcgaaagtcgctatccatgatacatttgttcattatctggatgcgaaaaatttcccgcagggtaaccctaccgctgatccgcaacaagagcggcagctcatgttttacatcaacagaaaaacatctgaaaccgataagactgtggtttttgaattagccagcccggcgtcactggatggcctgattattcccacccggcaaattcacggcgtatgcacatggtgtgcccgtggctggtaccggacagggaaaggttgcgactacgccggaacaaactattttgatattgacaacaacccgaccgatgatccgagcaaagaccgatgccccggcaccgtcattgcgtgtaagttgcgttacggtgaagataatgagctatcatttggtgggtttccggcctcgtcccttatcaggagatag

SEQ ID NO: 163 - DNA, 705 bp, Xenorhabdus bovienii
  Coding sequence Name=Xb4151_4152.C394.gene6.dna; Position on contig =5135..5839bp; Strand=+
atgaatgataagacattaacggccatatttgaacatactaaacaaatgtatcccaatgaatgttgtggggtaattgcccagaaaagccgcgtagaaaaatactttccctgcaaaaatttagcccctaatcccgccgaacaattccagctagatcccggtgattatttagccgcatcaatctggggaactattaccggtattgttcatagtcacccggacgcaactactatgcccagtgatttagatgaggcacaatgtgattttactgaattgccgtggcacattgtgagctacccagagggtgatttcaggacaatctatccgcgcggtgaattgccgctactcggtcgcccgtttgtgttgggtgtctatgattgctatggtctcattatgagctattaccgccaacaatgcggtattgaactgaatgactatcgggttaattatcattggtgggagcaaggtgaaaacctttacatagagaattttgagaatgccggttttgttgaagtcacaggcgacccgcagacgggcgatgtaatcattatgcaggttcaagcggatgtgcccaatcatgccggtgttttgttagagggtaatttattactccatcacctctacggacagttaagtcagaaagtgccgtatggggggtattggaaagacaggacaataaagatagtacgatatcatttattattataa

SEQ ID NO: 164 - DNA, 639 bp, Xenorhabdus bovienii
  Coding sequence Name=Xb4151_4152.C394.gene7.dna; Position on contig =6373..7011bp; Strand=+
atggcttatatatgtccccctcttcggacaatacgcctacacggcgtccttgctaccaagttcggcgcgacatttgactatgccgtcagagatgccccccatgctatccgggctatgagtaggctggttgcaggttttgaggcattcatgatccatgctcaccagcagggttttactttttcggtcattgtgggtggcagaagttaccacaaagacgaactggacatgaccaagggtaatggtggtatccatatactgcctgtcatcaccggcagtaaacgcggtggattgtttcaaacgattttaggggtagcgctgattgcggttgcatggtggaatccattgggctgggctgcctcgaccgcattgtttgtcggggcgtcaggggcatcaatggcaatgggcggcgtttctcaaatgctggcacctcagccgccgaggttggggatgcgggaatcccccgacaataaacccagttatgctttcggtggtgcagtcaataccatcgcacaagggaaccctgtgcctcttctgtatggttcgcgcgagataggcggggcgattatctcagcgggtgtttacaccgaagaccagtatcagactgagcaaatagaaaaccaacgcaaacacagccgctaa

SEQ ID NO: 165 - DNA, 930 bp, Xenorhabdus bovienii
  Coding sequence Name=Xb4151_4152.C395.gene1.dna; Position on contig =288..1217bp; Strand=+
ttgacgactccatatttacaatttgatcgtgagcattgggcaacattacgtgactcagtgcctttgacactcacagcagaagagattgctgctttaaaggggattaatgaagagatttcaatagaagaagtggttcagatctatcttccattgtcacgtctactcaatttttacattagttccaatttgcggcggcaagccgtccttgaacaatttttagggactggtgggcaaaaaataccttacatcattggcatagcaggtagtgttgctgttggaaagagcacaaccgcgcgtttattacaagcattgttaagccgctggcccgaacatcgccgcgttaaactagtaacgacagacggttttttgcactctaataatgtgttgaatgaacgtggcttaatgaaaaaaaagggtttccctgaatcctacgatatgcgcaacctagtgaaattcgttgctgatataaaatcaggcaccgaaaaagttacagcgccagtatactctcaccttagctacgatattgtccccaatgaacaactgatcatcgagcgtccagatattttgatccttgaaggactaaacgtgctgcaaagtggtatggattatccacatgaaccacatcatgtgtttgtgtctgattttgtcgatttttctatttatgtcgatgcgtcagaagaattgctcgaacagtggtatatcaaccgttttcttaagttccggcaaggggctttttctgatccagactcttatttccacaattattctaagttaactaccgaagcagcgataaaagttgcatcaaatatttggctcgaaattaatggcttaaacttacaacaaaatattttaccaactagagagcgcgctagcctaattatgactaaaggagcgaatcacgctattgaaagtgtcaggttgagaaaataa

SEQ ID NO: 166 - DNA, 960 bp, Xenorhabdus bovienii
  Coding sequence Name=Xb4151_4152.C395.gene2.dna; Position on contig =1250..2209bp; Strand=-
atgaaagatattagtattccattaaaattaattaaagtgttatcagatggcgaagttcattccgggcagcaacttggtcaagaattaggaatgagtcgtgcgggaataaataagcatattcagaccattcgtgaatggggcgtagaaattttaactatcccgggtaagggttatcgtttcccagcatcaatggatctgctggataaagagcttattgcaggttacctgccaaatgatcgtctcgaagttatacctgttatcgattctactaatcagtatttgctggagaaattgtcagaactcgattcaggtgacgcttgtgtcgccgaatatcagtatgccggaaggggacgccgtggcaggcagtggatttctgcttttggtagaaatttatatttatccatgtattggcgcttggagcaagggcctgccgcagcaataggattaagtctggtcgttgggatcgtcattgcggaagtgcttaaccgccagggtgctgaaagagtaaaagtgaaatggccgaatgatctctatttggatgataaaaagctggcaggaatattagttgaattgataggaaaaacgggtgatgcggctcagattgttatcggaataggtatgaatatttcaatgagtagtgaacagcaaaaattgattaaccagcagtggactaatctacagcaagcgggaatagtggttgaacgcaataaattaatttctgaaattattcttgagcttaaaaaagcgttaattcaatttgaaaacgaaggattatctccatttcttttccggtggtcaaaattagataattttatgaatcgttcagtaaagctggttattggaaatcaggaaatttatggaacggcccgtggaattgatcagcaaggagcgttgctgcttgatataaatggtgttattacgccatatattggtggtgaaatttccctcagaggttgttga

SEQ ID NO: 167 - DNA, 1041 bp, Xenorhabdus bovienii
  Coding sequence Name=Xb4151_4152.C395.gene3.dna; Position on contig =2206..3246bp; Strand=-
atgtctgcctgtcaatctatccaattaaaagagttcaacacgtttggtatttcagcctgtgctgatcatatttctactgtaacttcagttgcatcactgttgtccgcatggcaagaagcggaggaaaaagagcatcccattttattacttggtggggggagtaatgttctttttaccgaaaattttaaaggtactgtgatattgaaccgtattcttggtgttgatatacaagaatcggatacagcatggcatatccatgttggcgctggtgaaaactggcatcagctgatcgttcgccttctccatcaacagatctatggcttagaaaatttagcgttgattccaggaagtgtagggtcagcaccaattcaaaatattggtgcatatggaattgaatttaaacatgtctgtgaatatgtcgatctaatagagttgaaaactggcaaactgattcatcttatggcaaatgaatgccaatttgcttatagagatagtatctttaaacatcaatataaagatggttatgctataacagcagttggtttgcagttgagtaaggtttggaagccaatattaacttatggtggcttaacacagttctcaagtgaaagcgtaacaccagaacgcatattcaatgctgtttgtgaaatgcgtcagagtaagttacccgatcctgttattatcgggaatgctggcagtttttttaaaaatccaattgtacttattgaattggcgcaaaagatcaaatttgattatccagagtgtccccaatatcaccataatgaacataatgtaaagatagcggcaggttggctgatagatcaatgtcacttgaaaggttattgtattggtgacgctgcgatacatatgaaacaggcactggtgttaatcaataaaggtaatgcaacgggtcaggatattactgctttggcgacttatgtacgcaaaaaagtagcagaaaaatttaatattttcttagagcctgaagtacgtttcattggtagtgagggtgagatagatgcagtggaatgtatttcatga

SEQ ID NO: 168 - DNA, 186 bp, Xenorhabdus bovienii
  Coding sequence Name=Xb4151_4152.C395.gene4.dna; Position on contig =3704..3889bp; Strand=+
atgtctggcagtgccctactctcacatggggagaccccacactaccatcggcgctacggcgtttcactgctgagttcggcatgggatcaggtgggaccaccgcgctatggccgccagacaaattctgtgttcaatcccgaacaagctgctgtttttcatttgaaactgcgtctctctctcaccaaa

SEQ ID NO: 169 - DNA, 204 bp, Xenorhabdus bovienii
  Coding sequence Name=Xb4151_4152.C396.gene1.dna; Position on contig =52..255bp; Strand=+
atgcgcgacaaaaaggacagttattacgaagagaacaagcgggcgttatccgccattttttatttggcgaatattccgcgtgcacgccacgaaagtgagcttgaacattttaccccagaggaaaaacaggctctgatcaaagcaatgaatcatattaaagttgttgtcagtcagtttcctaagtacttgaagttatctaagtaa

SEQ ID NO: 170 - DNA, 1992 bp, Xenorhabdus bovienii
  Coding sequence Name=Xb4151_4152.C396.gene2.dna; Position on contig =335..2326bp; Strand=+
atgaatagtggttttatcactacggaacataacggtgattatcctattgccaaaggcaggcagtctggcctgtttcagccaagcataccgcagggtgtgtcaatggctgaacgtttattatgggatgtcaacgcggaagatcaccaatggcgccaccaatatatcgggcagatgccggattttctggcgaagtacttcagccgccgttatgttggcatctttaaccattcaggccgccgtgatgcgaacgcctttctgagaagaacagttggacaaaatgtcttgccacggttgcagttggttaaggcaagatattcattcactcatcatatatcgggactaacaccttttccttttattgagcaattggaaaaggtggtgacatgcgatcgcaaacagcttttgaagctcgctcatgaaatatctgtttttattgcgagcaactatgagcactattccttgcagtcttctcaacaatatcaagccgcgcctgtggacagtgaaagtaaattgttcccccgtgtcgctaagttataccaattactggcgaagctgactttacaatgtggcacaaatcctccttattggcagcgttttaatcatgggcgtaaagtaccatctgttgatcaactttgtgcaggtatgttgcggatgatgtctgcccgctggtggtattttcggttaaaacgtctacgtgatatccagtctgaacatatggcaattgcggttgggcaagtacaaaaagccgcatcgccttatgtttcgaaccatgctttgcgtgaatggttggaacagaaacgccgtaaccgtgagtttttcaaacattttgatttggaaaatgagaacggagaacggatttcgctggcggaaacggtggttcatagtaatgcgaatcccgcaatccgacgttgtgaattgatggtcagaatgcgtggtttcgaagatgtcgccgacaaaatgggatgtgttggtgaattttataccatcacggcgccggcaaaataccatgcggttcagcatcagggcgggtttgtcagacagtggaatggtgcgacgcctcgcgatactcaacgctacctgtgtggtatatgggcaaaatcccgtgccgcaatcgcccgtgccggcattaatttatttggtttccgagtggtggaaccgcaccatgacggcactcctcattggcatattctgctgtttatgttgccggagcatcagcggcgggtcagggcgatccttgagcattacgcttgccaggaagagaaagctgaattgcagagcgatgatgccaaaaaagcgcgttttgattacagaatcatagatcctgataaagggagtgcgacaggctatatcgctaagtatatatccaaaaatattgatggttatgcgctggaagatgaaaaagatcatcaaaccggcgcacctttgcgcgatatggcgaaatcggtgactgcatgggcgagtcgctggcgcattcgccaatttcagcaaattgggggagcgcctgtttctgtttggcgggaactacgccgtctcggggaagtgcgtttaatggataacaaagtcaatgcggttttgcaggcagccgatgaaggcaattgggccgcttatattcaggcacagggcgggccgtgggttgcgcgctgtgatttgactattcgtttgtcttataaacatatcccgtttggcagcccttatggggaagatgtttacaccatacaaggggtgacatcaccatttttgtcatgtgtggaatttatctgcacacgtattcatcaatggactcttgtaccgaaatcagaagctgctccgacatcaggacagattgtctataaaagaaacactgaatggccctcttggagttctgtcaataactgtacggatggacaagtggatagggcaatgaaggggtatgtaaattacaggattgatgaggatgataaattaatcaatatggcaaatatttctgcaaaaacagcacgtaataggtattaa

SEQ ID NO: 171 - DNA, 243 bp, Xenorhabdus bovienii
  Coding sequence Name=Xb4151_4152.C396.gene3.dna; Position on contig =2410..2652bp; Strand=+
atggaggcgggtatatcagtggactctcttatggaatcattggtagcgcaacgtattaattttattgccagaatggcaacaagttgcgaatgcaatcatgcggaagacaaagagctggcgttggtctggatagctgaactatctgcgcctcatgaaaaccgacttaacgtccatagaaatgacttagaaaacaatttattgttcgagaaagcattaaaaaattcaggttcaacagacgaataa

SEQ ID NO: 172 - DNA, 237 bp, Xenorhabdus bovienii
  Coding sequence Name=Xb4151_4152.C396.gene4.dna; Position on contig =2671..2907bp; Strand=+
atgaaagtggagatacttttcgataaacgagctaatgtttctgaatcagtgatgtctgcacttgaaagtgaactaaaaaaaagaattttaccgcagtatcccgatacgcattttagaattgcagtcagcagcagtagctccgtaagagtgacaggaaccaaagacagtagtaagcatgaccagatgatggaacttattcaaaacgtctgggaagatgatagctggttgccagattaa

SEQ ID NO: 173 - DNA, 204 bp, Xenorhabdus bovienii
  Coding sequence Name=Xb4151_4152.C396.gene5.dna; Position on contig =3140..3343bp; Strand=+
atgcaagttattgcacaacaaaatgagacagttgatgccctgtgctggcgtcattatggccgaacgctggggatgacggaacgtgtgctgttggccaaccctggtctggctgattttggcgcggtattgcctcatggaacgaaagttgaaatgccgggattcatgcccacgaccactaagccgattatccagctctgggattaa

SEQ ID NO: 174 - DNA, 276 bp, Xenorhabdus bovienii
  Coding sequence Name=Xb4151_4152.C396.gene6.dna; Position on contig =3353..3628bp; Strand=+
atggataaatacagtcacgcaacttatgcctgcgccagtattactgccattttttctggcctttctttatatgagtggagttttcttctcggggtattcgccagcatttccctcggtattctgacttatcagctcaaccgtcgggagcagatgaaacgtaccttgattctgaaaaatatcctgaaaaacatcctggaaaacctggatattgagtctgcgtcgaaatcagccaagatagtcagcgagttgatacatcacgcaccaagagagctgtga

SEQ ID NO: 175 - DNA, 510 bp, Xenorhabdus bovienii
  Coding sequence Name=Xb4151_4152.C396.gene7.dna; Position on contig =3660..4169bp; Strand=+
gtgatcattggccttattattggtggtgctagctcttctgtcattctttctcaatttttggatgagaaagaaggcaaccgactgtctgcctatcgagatggcggcggcatctggacaatatgtcgcggcgtgacgcgcattgatggcaaagcggtatataaaggaatgaagctagcgcctgaacaatgtgatgttttgaaccgaatcgaagccgacagggcgattgattgggtgaaaaagaatgtgcgcgttccgctgactgacccgcaaattgccggtattgccagtttctgtccgtataacatcggccccggaaaatgcttttcctccactttttatcgcaaactcaacgccggcgataaaaaaggtgcgtgtgcagagatcaaacgctgggtctatgatggtgggcgtgactgccgaaaaactcaagggcagccgaatggctgttatggtcaggttctgcggcgtgatcaagaagctgaactggtgtgttgggggctggataaatga

SEQ ID NO: 176 - DNA, 507 bp, Xenorhabdus bovienii
  Coding sequence Name=Xb4151_4152.C396.gene8.dna; Position on contig =4166..4672bp; Strand=+
atgaagaaagtatctttacttgtcagcgtcagcctcgttattgggggatgttttggctggtggggacaccgttcactgtttctcagtgaattgactgatttgaaacagcaacatgctactcaaatcgttgctatcaatcagaaggcgcattcggagacgttagccacaatccaacagatgaaggatgcgcagaacagagttgcgcaattggacgaatactattcaggaaaattaacccatgttaccgaagagaatgctgccttacgtgctgacattgccgctggttatcgtcgggtgcaaatcgccgccgccaaccttgctacctgtcagctcacccaaaaccgagataccagctcccgcagcgtgggcgatgaaacccaagtcgaactcactacaaaagctggacgtgctatttacgatatccgagccggaatcatcagcgatcaggccaaattagattacctgcaacagtatgtacttgaagtcgttcgtcaatgtaaaccgtaa

SEQ ID NO: 177 - DNA, 636 bp, Xenorhabdus bovienii
  Coding sequence Name=Xb4151_4152.C396.gene9.dna; Position on contig =4842..5477bp; Strand=+
atgaacacacaactcactgaactgctgcgcttaatgcgcaacctgatccgaaccggcgtcatcacccaagtggacaccacaaagggtatgtgccgggttgcaacaggcaaccttgaaaccaactggctgaactggttgacatccagggcgggaaactcccgcacttggtgggcgcccagtgtcggtgagcaggttttattactgtccataggcggagaactgaccaccgcctttgtattgcctgcgattttttcagatgagtttccggcgccatcaacatcatcagaagcgacgcatatccagtttcctgatggtgcagtgatggaatatgaaccgcaatcaggcgcattgactgtgatcggcatcaaaaccgcgacagtgactgcttcggattccgtccatattaccgcaccggaaatcacctgtgtcgccagtaccagaatcacactggatacaccggaagtcatctgtacacagctaatgagcacggggaatttgatcgtgcgcaatggcggcaaaatgacgggcaatattgaacacaccggcggcacattcagttccaacggcgtggtcgtggattcccataaacacaccggcgtcaggtcaggcggtgacacatcaggaggccccgtatga

SEQ ID NO: 178 - DNA, 348 bp, Xenorhabdus bovienii
  Coding sequence Name=Xb4151_4152.C396.gene10.dna; Position on contig =5477..5824bp; Strand=+
atgtatctgggaatgaatcggcaaacgggccgagaactgacagatctggctcacgtccggcaatccgtcagtgatattttattaacttccgtgggtagccgcatcgcacgccgtacttacggttcgttgctgccagaactaatcgattggccacagaacccggcgctccggcttcaggtcatggcggccagctataccgccatcagccgttgggagccacgtgtgatgcttatgtcaatcacaatggagacccggcagaacggtgaaatggtggtggatattgcgggaacttatcatcaatccgccaaagaattttcactttctattccggtgagccattcccggtga

SEQ ID NO: 179 - DNA, 909 bp, Xenorhabdus bovienii
  Coding sequence Name=Xb4151_4152.C396.gene11.dna; Position on contig =5833..6741bp; Strand=+
atgccaacaatcgatttaagccagttgccaccaccggatgtggtggaaccactagattatgaacaactgctggaagagcgcaaagaaggattgatctcgctctatccagaagaacagcaggatgcgattgcacgaactctgcaactggaatcagaacctttggtcaaattgctggaagagaacgtttatcgcgaattgctcttgcgtcaacgtgtcaacgaagccgcccgtgcggtgatggtggcctattcgacaggcagagatctggatcaattgggtgtgaacaataacgtagtccgaatggttttgagccctgcggataactccaccgtaccaccgacaccggcggtaatggaatctgacaacgactaccgtgttcgcatcccgcaggcttttgaaggtttgagtgtggctgggccagttggctcctatgaattccatgcccgcagtgcggacggtcgggttgctgatgcttcggctatcagcccgtcaccagccaatgtcaccgtgactattatgtcccgtgaagataaaggcgtggcatcgaaagagctgctggataaagtcgaaaaagcgctgaacgacgaaaacgtgcgtccggtggcggatcgcctgaaagtccaatcggcgagtattgtggaatatgaaattgatgcggtgctgtatatcttcccgacaccggaatcagaaccgatccgcaaagcggctgagcagaaactgaaatactacgttgaagcacaacatcgcttggggcgtgacattcgcttgtcggcaatttatgccgcattgcatgtggaaggcatccagcgtgtggagctgaaagccccgctgaaagatgtggtgctggataaaactcaggtgtcttactgcaccaaaaccacactgatgatgggaggttcagatgaatga

SEQ ID NO: 180 - DNA, 609 bp, Xenorhabdus bovienii
  Coding sequence Name=Xb4151_4152.C396.gene12.dna; Position on contig =6734..7342bp; Strand=+
atgaatgatcgccttctgccgatgggctcaacccagctagaacttgctgcggccaaagcctgtgccgagttgcagaagattaaagtgccgctgcgtgaactgtggaacccagacacctgtccggcaacgttgttgccctatctggcatgggcgtggtcagtggatcgctgggacgaacactggtctgagagcatcaaaagagaagtgatcaaaagctcgctattcctgcataaacataaaggaacgattggtgcaattcggcgggtcgttgaaccgctggggtatctcattcgcgtaaaggagtggtggcagaccaatgatgtaccaggcaccttccggctggatattggtgtactggaaaacggcatcacccatgaaatgttcgaagaactggaaaaactgatttctgatgctaagccagtcagccgtcatttgattgggttagacattaatctggatacgcgcggtgagtattactactcagcagccagttacagcggtgatgagctgacggtttacccctatttcgcagaacaagtaacggtatccggctcagacgttgtgggtatgggcatacatattattgatgacatgaggattagaccatga

SEQ ID NO: 181 - DNA, 1804 bp, Xenorhabdus bovienii
  Coding sequence Name=Xb4151_4152.C396.gene13.dna; Position on contig =7339..9142bp; Strand=+
atgagtaccaaatattttgcgctgctgacgcagctaggcgcagataagttggcgaatgctgcggcattgggtacaaaaattgaaatcacccatatggccgttggtgatggtggtggcagcctgccgacaccagatactaagcaaaccaaactgattaatgaaaagcgtcgtgccgcgatcaatacgttgagcatcgatcccaaaaacactaaccagatcatctctgaacaggttatccctgaaagtgaaggtggctggtggatccgtgaaatcggtctgtttgacaaagatggcattctgattgccgtcgggaactgcgcggaaagctacaaaccacaattacaggaaggttccggtcgtacccagaccatccgcatgattttgattgtcagtagtaccgagtcggtgaccttgaaagttgacccgtctgtggttctggcaactcgcgaatatgttgatgactccattcagaagcattcaaacagccgtaatcatcctgacgcgacgctgaaagagaagggatttgtgatcctgagcagcgcggtggacaacaacagcgaaacccatgcggcaacaccgaaagcggtgaaagcggcgtatgattttgctaatgcggcgaataataatgccaacggtcgcgtgccatctggtcgcaaggtgaatgggaaagcattgtcggaagatatccatcttaaggcttctgatgtagatgcatataacaaaactgaaaccgatgcacgggtgaatgatgccaaagcacaggcgaaagctgcgaatgataatgccgatggccgcgttccagcggggcgtaaggttaatggtaaagctctgaatgcggatattgcgctgaattctggggatgtgggtgcatattccaaaggcgaaacagatactcgggttgatgaagcgaaagcgttggctaatactgcaaaccagaatgcggctaatgcaaataataatgcgaatactcgtctggaaaaaaaccagaatggcgcggatattccgaacaagccgaagtttgtagaaaacctcggtttggcggaaaccaaaaatcaggcccaggacgcagtgcccaattcaaggaaggtgaatgggaagacattgacgggggatgtgaccctgagtgcggaggatgttcagggagagccccgttttaaccagacgatagatctaacgggtttgagtagtgatcggtattatccggtatggtggaaattcccgtttaatgagcgtggagctaattcatggctgacaatacaccgtaattacgccgagaatcgggagaataaaaatccatttgggaaagatgtaactcatttagcagggctagaggtacaaatagaaggaagcgatacactctggggaggagatgctcagtacctgaatataaaacggatcaatcaacgttatcgtaataccgtcaaaaagattcagtatggcatgatgagtattgcaaggtctgttgatggtaagtaccctctatactatgattggaaatctggcgatatcacagaatgccgtgtatatagtggatgttatttacgaggaggattaacctatcatgttactagtaatttcaataacttagattattcccgtaaagaagatgaagtagaaatatggcatggcgtaagtgattctgataagcgggagattaaatggacggttaaatcttatgctattgatgatcctttattaggaaaagattatgatgatacagtaacggcttacggatctgatattacagatatgctatattctgtaggaatagttgtatggtttgctcaaaataaaatccaaatat

SEQ ID NO: 182 - DNA, 1158 bp, Xenorhabdus bovienii
  Coding sequence Name=Xb4151_4152.C397.gene1.dna; Position on contig =17..1174bp; Strand=-
atgtcaatcttccgtagaggaaatacgtggtatgggaactacacgacgccaagcggcaaaagaattaaggagtctcttgggacaacggacaaaaagcaagctcaggagttgcacgaccgaagaaaggccgaattatggcgcatagaaaggttgggtgatttccctgatgtgacctttgatgaggcatgcttgcgatggatcgaggaaaaagctgataagaaatcactggatgatgataaaggccgtatggcgttctggttggaatatttcgaaggagtaagactaaaggatatcaccgaagccaggatttatacggcaatcagcaaaatgagaaaccgcaaatctaagcagcgatgggaaagtcgtgttacagcagcccagaaaaaaggaaaagaagtccctgcatatacagaagtttccgtctcggtagcgaccaaagcaaaacacttatcattgatgaagtctctgctaagggcggctgaacgagattggaaatggttagagaaagcacccgtgatcaaggttccagccgtcagagataaacgtgtcagatggttagagcctcacgaagcccaaagattaattgatgaatgccccgaacctttacagtcaatcgtcaagttcgcactggcaacgggattaaggcgttcaaacattatcaatcttgaatggtctcaaattgatatgcagagacaagtagcatggatacacccagaccaaagtaaatcggctagggctataggggtagccctaaacgaaaccgcttgcagggtgttacgtgcccagataggaaatcataataagtgggtgttcgtccatactaaaccatcaactaatcccgatggaatagtaatgcctaatatcagaaagatgcgtgttgatgataacacggcatggaattccgcattaaagcgagctggaatagaagatttccgatttcatgatctgaggcatacgtgggctagctggttggttcagtcagacgttccactgtcaattttgcaagagatgggcggatgggaatccattgaaatggtaaggcgatatgctcatttagcacctaatcatttgactgaacacgcgcgtcaaattgatgagctttttggaaatctcgtcccaaatccgtcccagtcgggaaaaattgtagttgcaaagtag

SEQ ID NO: 183 - DNA, 402 bp, Xenorhabdus bovienii
  Coding sequence Name=Xb4151_4152.C397.gene2.dna; Position on contig =1030..1431bp; Strand=-
atgagactcatcactgataataatgagatagaaagcataaccttatccagaaaaaaagcagcagcgctcatagggattgatgtggacacattatccctatggtgtcagataggtaaaatagcctacaccaagaagaaccccaccaagccaaactcaccttatttatttacacgcgccgcatgtattgcagcaatcaacaatccgatccaaactgtgattgtgagctcggtagatgcgacagagaaaggagataaacaatgtcaatcttccgtagaggaaatacgtggtatgggaactacacgacgccaagcggcaaaagaattaaggagtctcttgggacaacggacaaaaagcaagctcaggagttgcacgaccgaagaaaggccgaattatggcgcatag

SEQ ID NO: 184 - DNA, 177 bp, Xenorhabdus bovienii
  Coding sequence Name=Xb4151_4152.C397.gene3.dna; Position on contig =1642..1818bp; Strand=-
atgaaagtaactatcgagatgaataacaaagaggttcaggagtatattggtggcgattatctctctccggaatttgaataccaatcattaattcagaatgacgccaaggttattttagaaaactctggatttcagggaatagaaacgggagatatcaccgtaaccatccatgactaa

SEQ ID NO: 185 - DNA, 537 bp, Xenorhabdus bovienii
  Coding sequence Name=Xb4151_4152.C397.gene4.dna; Position on contig =1815..2351bp; Strand=-
atgaaaactgatttcggaggaagtaacactccaaaagaactacgcgacctctggcaaactccacttcctttatttacagcactcaatttagaatttaaattcaaactagatgccgccgctgatgctcaaaataccctgtgcagccactatctcacggaacgagataatgcactggagtgtgattgggaaagttacggctctatattctgtaatccaccctattccaagattacgccgtgggtagagaaagcagccattgaatgcaggaagcaatgccagtctattgtgatgctcgtccccaatgatacctcagtaggctggtttaaattggcaatgcaaacggttgatgaggtcagattaataacgggtggtcgaattcaatttgtgccagtggaacagagaaagaaaaattccaatacaaaaggctccatgcttttaatttggaggccgtttattaccccacgcaaaacaataaccacggtagataaagattatctattcgatatcggtaacgaacatttgaggaaaatagcatga

SEQ ID NO: 186 - DNA, 234 bp, Xenorhabdus bovienii
  Coding sequence Name=Xb4151_4152.C397.gene5.dna; Position on contig =2341..2574bp; Strand=-
atgacaaacaagaatgatgatgtgatgaccgaccgtgaattagtcaatgctgcaattaaattggcaggtaaattttataatattatgggatatcagcatcgggatggttttgaatattggaaatctcctcacccgcaagaacaatcagtttttgagatggctattcaggcatttgaggatatcagaggctctgatgtttgggatgccattgagagtttagaagatgaaaactga

SEQ ID NO: 187 - DNA, 417 bp, Xenorhabdus bovienii
  Coding sequence Name=Xb4151_4152.C397.gene6.dna; Position on contig =2768..3184bp; Strand=-
atgagcaaagatatgattgagcggttacaaaaccgaataaaaaaacaattgactaattttgaaaatattagatttactgaattagaaggtaaagaattattggaattattaaaacgtctcgctgattatgagattattattaatgcgtaccatcaggatgatgcggactggcataaattagctgatataaatggctcaacaacatgtgcattagttgatggaattatcaaactgcaatcgaaattatctgaatatgaaaatatggagcctgtggcgtgggcgcgtaatacaggtatacaacggattctggatttaacagatctaccggaacgcgtattcgaatggagagaatacaatgaatcgcatcctgatattgctgacgaaatattccccctctaccgccaccccaacaaatag

SEQ ID NO: 188 - DNA, 189 bp, Xenorhabdus bovienii
  Coding sequence Name=Xb4151_4152.C397.gene7.dna; Position on contig =3165..3353bp; Strand=-
atgagaaatgacaaaatagaatgcgctaaacgcaaatgtaaacatattcattatgaaaatgatcgaattaaagttccagaccctgaatttccaacatggttaatttctgtttgtccaaaatgtggcgctaatgatttttatataatagagaaacttgaaggagataataatgagcaaagatatgattga

SEQ ID NO: 189 - DNA, 294 bp, Xenorhabdus bovienii
  Coding sequence Name=Xb4151_4152.C397.gene8.dna; Position on contig =3388..3681bp; Strand=-
atgaacaatgatgttatgactaattcagatgtataccaatcaactacaatgaaaaccactagcgacgtatatttttattatgcaaccagaaacggaaatataaataaaataaaaatcaatggctatcattttgataatgaaatgtcagttgagaaatttgctccaataaccattcctgagaaacatatccgaattctgcactgtagatgtggctctaatgattggggggaggatggacgttatattaacgaatattgctgcaacgactgcgggcaatacattactgtttattaa

SEQ ID NO: 190 - DNA, 852 bp, Xenorhabdus bovienii
  Coding sequence Name=Xb4151_4152.C397.gene9.dna; Position on contig =4381..5232bp; Strand=-
atgatcaatgtcgtctcattctctggcggcaggacatcggcgtatctcgtctatctgatggaacagcgccgcaaacaaggtgaggatgtccgctatgtgtttatggatacgggggcggagcatcccatgacctaccgatttgtcagagaagtcgtgaaattctgggatatcccgctgatagtattgcaggctgatatcaatcctcagttgggtgtatcgaatggttatacagtttgggaaccgaaagatatccaaacacggatgccagcattgaagccatttacagatatggttaaaaaatatggcacaccctatatcggtggcgcattctgcactgaccgcctgaaattgcggccattcagagattactgcaatgaccatttcgggcggggtaattatcaaacatggataggcattcgagccgatgagccacggagattaacccgcaaagagggggtgagttatctggctgatatctcggattttgacaaacgagacattctggattggtggaaagatcagccgtttgatttgtcgatcccagagtatcttggcaactgtgtattctgcatcaagaagagtagccaaaaattagggctggcctgtcaagatgagccgggattaaagctggtatttgaacatacgtgcataaccccctcttatgtgagagatggtcatagaaaaaccgatcgtgaaattatgtaccgaggccacatgtcattggatggtatcgccaaaatgtattcggatgtcgattaccaaaacatctatcaggatatgattgcagcccagcgatttgataccggttcctgctccgaatcctgcgaaatatttcagctagacctattttaa

SEQ ID NO: 191 - DNA, 519 bp, Xenorhabdus bovienii
  Coding sequence Name=Xb4151_4152.C397.gene10.dna; Position on contig =5296..5814bp; Strand=-
gtgatcaatggaggggaaacgatggctagccgcggcgtaaataaagttattttagtgggtaatctgggacaggatccggaagttcgctatatgccgaatggcggcgcagttgccaatattactctggcaacatcggaacagtggcgcgataaacaatcgggtgagatgagagagaaaaccgaatggcaccgagtggtgatattcggcaagctggcagaagtcgccggtgaataccttcgcaaaggctctcaggtttatatcgaaggttctttacagactcgcaaatggcaggatcaacagggacaggacagatacacaacagaggtgacggtaaatattggcggaaccatgcagatgctaagtaatagacagggaagtcagcaaggacagcagccccagcagcagtattcaggagtaccgcaacaatctcacggatggggagcgccacagcaaccgaagggacagcaattgcaaccagaacctccaccaatggattttgacgacgacattccattctag

SEQ ID NO: 192 - DNA, 696 bp, Xenorhabdus bovienii
  Coding sequence Name=Xb4151_4152.C397.gene11.dna; Position on contig =5786..6481bp; Strand=-
atggtcagctatgagtcagtcctcaccagagcagggattgatttaagaaatgttgaacaaggatcgtttgactggcacaagttgaggctgggagttattacagcctcggatgctggaaaggtgttatcgaaatcaaaagacggcaaaaaatggacagataccaaggcgacatatttctacacgttactgggtgagatctgcacagggaatgtagttgaagtaaatgcaaagtcactggcatggggcaaggaatacgaagaatcagcgcgggcaacatttgaatttgtgtctggtgtcgatgtaatggaagcccctattttgttcaaggatgattcgctcaggacagcatgctcacccgatggcctgtgtagcgatggcctcggccttgagttgaagtgcccgtttactaccgctgtttttatgagatttcgcttagggggatttgaagccattaaatcggattacatggctcaaattcagtactccatgtgggtcactggaaaagattcatggtatttcgccaactatgacccacgcatgacgcgagagggaatttattatgtcacagtagatagagatgagaaattcatgcagcaattcgatgaattgataccggaatttatagaaaaaatggacgacgccctaaacgaagtgggatttaaattcggtgatcaatggaggggaaacgatggctag

SEQ ID NO: 193 - DNA, 777 bp, Xenorhabdus bovienii
  Coding sequence Name=Xb4151_4152.C397.gene12.dna; Position on contig =6468..7244bp; Strand=-
atgcaagaggttgttactcgtgaacaggattaccatgtcgcggaacccacagggaatgcagcagcagctccaatgcggcttattgagatggctgtatcatcaaatgccgatattgataagttagagcgattactggagctacaaaccaaatgggaagcgggacaggcaagaaaggaatttttggatgctatggcagcatttcaaagcgcactgccgaccattaaaaaattgaaacaagctgattttggagcaggcaaggctaaatataaatatgcatcattggatgatatctcagagcagataaagccatttttgcaaaaatttggattgtcttatcgatttgaacaaaaaatggaaagcggagtaattaccgttaaatgcatagttagccataaatcagggcattatgaatcatgtgaaatgatgtctaccccagatcaatcaggtggaaaaaatagcattcagcaatcagcatctgccatcacgtatttacgccgctacacattaacaggtgcattagggattgcgacagcggatgaagatatagatgggagaataagctcatcaacaccttcgaatggagtaagcgctaaaacaatggaacgcattaacgccatgcttattgggatggataaaacatgggatgatgatttactgccgttgtgctcgaaaatctttaatcgagaaataaattcaccatacgatctatcagaactggaggctaataaagccgaagattttctttccaagaaggtaaaaaacaatggtcagctatga

SEQ ID NO: 194 - DNA, 261 bp, Xenorhabdus bovienii
  Coding sequence Name=Xb4151_4152.C397.gene13.dna; Position on contig =7247..7507bp; Strand=-
gtgagatacgaacgcaacccctatggcgctcaggatgagcaatgggaacaagaggaagaagccgccgcgtacaaagaggcactggaaaccgatctggataaactggcaaatgaccgtcttggtaatttaccggacaacactctatccgatagggttaattctctattagaaagaacgggtgataaacgttctgaactgatggataaataccacgaatggctgtttgatgtatgtcggacagtggaggagcagaggatatga

SEQ ID NO: 195 - DNA, 123 bp, Xenorhabdus bovienii
  Coding sequence Name=Xb4151_4152.C397.gene14.dna; Position on contig =7504..7626bp; Strand=-
atggaagaacgcatgaactcagggcagtggtcgatgaatgagttaacggattatctcattgatagggatttgatgggtagcttcatggaagaactgaaaaaagcgcaacggagggtcgcgtga

SEQ ID NO: 196 - DNA, 429 bp, Xenorhabdus bovienii
  Coding sequence Name=Xb4151_4152.C397.gene15.dna; Position on contig =7908..8336bp; Strand=-
atgctgagtgataaaaaacaggaactcgtttctgaatcatctgggcagctcaatgcactaggtattaatcataccattgatatctgtggaactataacggtacaaacaaaacaaggaaaagttatttactatccaacaaaaaacaaaatccaatataaaggcacggtcaccgcaggtggattaaataacgttaaaaatttggttgattcattagggttatctggcgaaatagccccacaaaagaataaaccggatgagataacattgagggattatttcgcagctcgggctatgggcgcaggtatccggcgttacgatggttcgaaatttggtggcggtcaaaacgcaccggattatgaatatctggccgtcgagtcctatcatatagcggatgcaatgatgaaagcacggcaaaatgattcccgatag

SEQ ID NO: 197 - DNA, 222 bp, Xenorhabdus bovienii
  Coding sequence Name=Xb4151_4152.C397.gene16.dna; Position on contig =8339..8560bp; Strand=-
atggattggattaaatgtagtgagaggttgcctgaaatacgagacgacagtgtaatagtgtatttctcgaatggaagtatggatatggttcatattgaagactgtttcagagatattggcgctggtgtcgatgaaaacggtaatcagctctggactaaatggtatctcagcataggtattacccactggcaaccactcccagaaccaccgacagaagaatga

SEQ ID NO: 198 - DNA, 243 bp, Xenorhabdus bovienii
  Coding sequence Name=Xb4151_4152.C397.gene17.dna; Position on contig =8613..8855bp; Strand=-
atgagtgagaaagttgaaattcgagtagaagcacgcatcacgcgacaatataaccaatgctttgaaataccagaatcagaatacgcgaaaatttgtgaaatagaagattctgatttatccatttatgcacgcgagcgggcaatagaaaaaattttgtttgcaaatggttttgaatacgatgagttttattcagatgaagatgaatccgaagatattgaagtaacattagaagataatgaataa

SEQ ID NO: 199 - DNA, 210 bp, Xenorhabdus bovienii
  Coding sequence Name=Xb4151_4152.C397.gene18.dna; Position on contig =8912..9121bp; Strand=-
atgaatattgaatttattaacgaaattcgggcatcaatgaaacgtgaccgtcagtctgatattcggtacgtaattgaatgtaaaagaaattatctagattttcgtcaatgggctatggatcatgagccacgttctgctagtcgtcgtgcattgaatagattagcttggcaacagcgtaaattctaccgtaagtggatggctctcagttga

SEQ ID NO: 200 - DNA, 231 bp, Xenorhabdus bovienii
  Coding sequence Name=Xb4151_4152.C397.gene19.dna; Position on contig =9135..9365bp; Strand=-
atgtacagaacggcaactcaagtttcgcgggtatcaaatgaattagcgggcggatttatgtatttcgctaatgcacaggatgcgatggatactgggttattttgtcagaaactggtttttgattattggtctggagatgaacgctgcgactttctcgacaagctatttgtcatcaaaaattgggatgagttaactcccgacgaaaaaaatatcgtcaatcaacaacagtaa

SEQ ID NO: 201 - DNA, 309 bp, Xenorhabdus bovienii
  Coding sequence Name=Xb4151_4152.C397.gene20.dna; Position on contig =9400..9708bp; Strand=-
atgacaacagtaaccgttatacggagtgactacgcaactcgtcgttatgagcgtagagctgctttcttggcaaagaaacaggcagcacaaaaccttcaaagccgctcagtggaagaaattatcgactcaattatcaaaccagtagacgaaattgacgtactgacgcaactgatgattgggttgaagaaagatatcaaggacgacaacaacagcggatcttgctgcatgagtgacgtagctctttactcaaccaagcaaagagctggcaatcggatactggagtcaggcggcgttactgctagggggtga

SEQ ID NO: 202 - DNA, 753 bp, Xenorhabdus bovienii
  Coding sequence Name=Xb4151_4152.C397.gene21.dna; Position on contig =10149..10901bp; Strand=-
atgtgctcaactgtgatatcaaatctagggttcgaatgccacccaattggctctgagctactgagaataattagccccttcacatattgtgatgatggcgagcatgttggtgcctttgtcaaagagataaatggtaagtatttagtaagtgacaggtgtgatactttaatgaacatggaagccagaggaatctcacttacaaaaaaaagaatcgaagaaatcagagccttcctaaagaaccaaggctctgaattgaatgaaagaggtgagattattggttgggcgacagaagatactgttggctccgtaacttctggcgttattagagctggaatcatagcatccactttatcacaagattggcaccaaccagtgcaagcagaaaaatttgaaggtcaagttataaactttttatatcatactgaactaaaagatattatttctttacgaggttcagttatgggtatgagtgggcatcaaatagttataccagtgacgattaacacaccaacacctaagtatatcttcacatccagcgtgaaaaaaaacggtagttggaacagtgcctattccttgcttggcaaactaattgatcttaaaaactccaattcagacttgaataatagatatgttgttgttgataacgattcgataggtgatcaaattcaacaattatcattattgtttaatgaaaccagtcatatcttaccatttactaaaagagagacgtgggtgtcacgactggcagcttaa

SEQ ID NO: 203 - DNA, 186 bp, Xenorhabdus bovienii
  Coding sequence Name=Xb4151_4152.C398.gene1.dna; Position on contig =279..464bp; Strand=-
atgcttattctgactcgtcgagttggtgaaacgctcatgataggcgatgaggtaacagtcacagtactgggagttaaaggcaaccaagttcgcattggtgtgaatgcgcccaaggaagtttctgttcaccgtgaagaaatttatcaacggattcaggcagagaaatctcagcctacaactttttaa

SEQ ID NO: 204 - DNA, 2628 bp, Xenorhabdus bovienii
  Coding sequence Name=Xb4151_4152.C398.gene2.dna; Position on contig =711..3338bp; Strand=-
atgagcaaaagcaccgctgagatccgtcaggcgtttcttgacttttttcacactaaagggcaccagatagtaccaagtagttcactggtgccaaataatgatccaaccttgttgttcactaacgcaggaatgaatcagtttaaagatgtttttcttgggttggataaaaggccttattctcgagcaacaacggctcagcgttgtgttcgtgctggcggtaagcataacgatttagaaaatgttggttatacagcccgtcaccatactttcttcgaaatgttgggtaatttcagttttggcgattattttaaacaagatgcgattaaatacgcatgggaactgctgacaggcaaagagtggttcaatctgccaaaagaaaaactgtgggttactgtctatgagacagacgatgaagcctatgatatctggcacaaagaagttggtattccagcagaaagaattattcgaatcggtgataacaaaggcgctccttatgcatcagataacttctggcaaatgggagataccggtccttgtggtccttgtacagaaattttttatgaccacggtgagcatatttggggtgggcctccaggcagcccagaagaagacggtgacaggtatattgaaatctggaacatcgtttttatgcagtttaatcgccacgtggatggcacaatggagccattaccaaaaccttccgttgataccggaatgggtttggaacgtctcaccgcagtgttacagcacgtcaattccaactacgatatcgacttattctgcgatctaattgcttctgtggcagaagtgactggcgcaaccgatcttaccaacaaatctctgcgtgttattgcagaccatatccgctcatgtgccttcttggtttgtgatggggttgtcccgtcgaatgagaaccgtggttatgtgttgcgccgtatcattcgtcgtgcagttcgccatggcaacatgctgggtgcaaaagaaaccttcttctataaactggttgctccactgatcaaaatcatgggctcggcaggcgatgagctaaaacgtcagcagtcattggttgaacaggtattgaaaactgaggaagagcaatttgcccgtacgctggaacgcggtctgcaattgctggatgaagaactggaaaaattgtctggggatacccttgatggcgaaactgcttttcgcctctatgatacctatggtttcccagttgatctgacggcggatgtttgccgtgagcgtaatatcaaagttgatgaagtcggttttgatgttgcgatggaaaaccaacgtcgccgagcacgtgaatccagtggttttggcacagattataacgaacagatcaaagttgacggtcgcagtgatttttctggttacgaacataactcacagcaagcgacggtgatggcgattttccgtcatggtgaagcgattgatcagattcatgcaggtgaagaagcgatcgttatacttgataagacagcgttctatgctgagtctggtggacaggttggtgatacaggtaatctgtccaatggtaacgggatatttgaggttactgatacacaaaaatacggtcaggcaattggtcacattggtaaattgataaatggcactttgaacgttaataatacaattaatgctgagattaatagggtacgccgagattcgattcgtttgaatcactccgcaactcatttgctacatgcggcattacgtcagattctgggggaacatgtttctcagaagggttctttagtaaatgataaatatctgcgttttgacttctctcattttgaagcaatgaagttagaacagatccgtcaggtagaaaatctggtgaatgaagaaatccgcaaaaatttatcaattgttacagaattaatggaattggaagaagcaaaaaccaaaggtgccatggcactgtttggtgagaagtatgatgaacaggtacgtgtattgagcatgggagatttttctactgagttatgtggtggaactcatgctagccgtactggtgatattgggttatttcgtatttccagtgaatcaggtacagctgcagggattcgtcgtatagaagctatcacggggcaaactgcactgaattctgtttatcagcagacggatttactgcaagatattgctcatcttgtgaaaagcgatataagtagcctgaatgagaaagtgaaaacgacactggatagaacaaaacagttggaaaaagagttgcaacacttgaagtctcagcaagcagctcaggaaagctcctctttggcgaatcaaactaaagagattcagggagttcgcctactggtaacacaattgggtgatactgaaccaaaaatgctcagaacgatggttgatgaactgaaaaaccaactgggatcagcaattattgtgctttctactgtgactggtgataaagtcaccctaattgttggtataacgaaggatttgactgctagaataaaagcaggcgatttaatctcttttgttgcccagcaagttggaggtaaaggaggaggacgtcctgatctggcacaggctggcggaactgatgtagcagctcttccttccgcattagctagtgtagaagagtgggtaacattgcggttatag

SEQ ID NO: 205 - DNA, 1140 bp, Xenorhabdus bovienii
  Coding sequence Name=Xb4151_4152.C398.gene3.dna; Position on contig =3656..4795bp; Strand=-
ttggtatcagaaacggtttatcagcagtggggcagccccttcattgcttacgaaggagtaaacatggctaacgatgaaaacaaacaaaaagcactagcagcggcgctgggtcaaattgaaaaacaatttggtaaaggttctatcatgcgtctgggcgaaaaccgctcaatggatgttgaaactatctctactggctccctctcactggatatagctttaggtgcgggtggtttgccaatgggtcgtattgttgaaatatacgggcctgaatcttccggtaaaacaacattgacactgcaagttattgcttctgcccagcgtgaaggcaaaacctgtgcttttattgatgccgaacatgcccttgatccggtttatgccaaaaagttgggcgtagatattgataatctgctgtgctcccagcctgataccggtgaacaggcactggaaatctgtgatgccttgtcacgctctggggcagttgacgtcatcgttgttgactccgttgctgcattaaccccgaaagcggaaatcgaaggtgagatcggcgattcccatatgggattggctgctcgtatgatgagtcaggcaatgcgtaagttggcaggtaacctgaaaaactcgaatactctgctaatctttatcaaccagatccgtatgaaaattggcgtgatgtttggtaacccagaaaccacaacgggtggtaacgcactgaaattctatgcatctgtccgtttggatatccgccgcactggttccgtaaaaaatggcgatgaagttgttggcagtgagactcgtgtgaaagtagtcaagaacaaaattgcggcaccattcaaacaagctgaattccagattttgtatggtgaaggcattaacacctttggcgaattggtcgacttgggcgttaaacacaaaatggtcgaaaaagcaggtgcatggtacagctataacggggataagatcgggcagggtaaagctaatgctactatttacctgaaagagcacccagaaatctctgctgagctggataaaaaactgcgtgaattactgttaaataatgcaggtggattcaatagtgcagtctctgattatgaagctgattatgaagacaacggtgaagaagtgaaaaatgaagagttttaa

SEQ ID NO: 206 - DNA, 507 bp, Xenorhabdus bovienii
  Coding sequence Name=Xb4151_4152.C398.gene4.dna; Position on contig =4838..5344bp; Strand=-
atggatgaaaaaatcctgaatcagcttagtattgaaattggaaagaagctccagcggaagaaattatccttaacctgtgcagaatcctgcacagggggctggattgctaaagtgatcacagatattgcgggaagttcggcctattttaaccgtggtttcgtgacctatggcaatgattctaaaaatgaaatgctgggtgtatcacaggcatctctgatgcagtttggtgcggtgagtgaacaggtcgttaaagaaatggcagtaggggcattaaaagcggccagagcagattttgctgtttctgtcagtggcatcgcaggtccgggtggtggtagtgaagaaaaaaccgacggggaacgggtctgttttgggtttgcctaccgtaatcgtgaggatgtacataccgtgacatatcgccagcattttacgggtgagcgcaatgcagtacggcttcaggccgttattttttctttaaaaacactgctggaagaaatcataaaaaattag

SEQ ID NO: 207 - DNA, 1197 bp, Xenorhabdus bovienii
  Coding sequence Name=Xb4151_4152.C398.gene5.dna; Position on contig =5370..6566bp; Strand=-
atgaatggaactgtagacacacaaccactgttaaataagggaatgaaagcagtattactgtctcaatttctcactgcttttgctgacaatgcgctgttctttgccattttagctcaattgaaggctgaagcttaccctggatggagtctgccagccctgcagattgttttcgtgctgacctatattgtgcttgcccctttcgtaggacaaattgctgatcggttttcgaaaggctgggttatgcttttcgccaatggcatcaaattacttggtgccatcagtatctgtatcgatatgaatcctttcctcggatacacccttgtggggattggcgccgctgcctattcccccgctaaatacggaatattgggtgaattaaccgatggtggtcgtctggtcaaagccaatggtgtgatggaagcttcgacaattgcagccattttgattggttctgtggctggcggtttcctgtctgatatcagtttggcactggcattaggtctttgtgctttgatgtatggtgcggctgtagtagctaatttctatatcccccggcttgctgctgcgcgccagggtaagggatggaatcccaaaaaaatgctggtggattttatggttgtctgttctgcgctttggcgtaatcaggaaacgcgattttcgctagtaggaaccagtctgttctggggtgccggggtaactctgcgcttcctgttagtagcgtgggttcccgtcgtgttggggatagagggtaatacgacacctacgctgatgaacgcaatggttgccgttggcattattgtgggagccgggttggctgcacggtttatcaccttgaaaacagttcgccgttgtatgcccgcaggtattctgatcggcattatggtgattgtttttgctgttcagcaatcaatgtggtcttcctatttgctcctaactgtccttggtgtatttggcggcttctttgtcgttccattgaatgccttattgcaggagcatggaaaacatgagatgggcgcaggtaatgctgtcgctgtgcagaattttggtgaaaacagcgcgatgctggtgatgttgggtctgtatctaatttccatcatgctgggcgcatcggtcgttaccgtcggtattggttttggtatcttgttctcactgacaattgggggagtatggatttgggatctgcttcggaaaaattaa

SEQ ID NO: 208 - DNA, 1440 bp, Xenorhabdus bovienii
  Coding sequence Name=Xb4151_4152.C398.gene6.dna; Position on contig =6571..8010bp; Strand=-
ttgctgaaaaaaatactgggcgtcagccggattttagaacagtttactcaaaaaaatgaacgggttggacttttattacctaatgctacagtgatggccgctgccatatatggtgcttcgctgaaagaacgagtgcctgctttgctgaactacactgcgggaacgagtggtattaaaaatgccatgaaagcagcgacaatcaaaaccatcgtgacatctcgtcaatttttgcaaaaagggcaattaacccacctgccagaacaggtgacggaagccaattgggtatatcttgaagatctgaaagatacgattacgcgggaagataagctttggatattatggcacctgatttttcctgctaaggccattacgccttcccagaagcctgatgatgatgctctgatcctgtttacctctggctctgaaggtgcaccgaaaggtgttgtgcacagtcatgccagcttattggcgaatgttgagcaaattaaaacgattgctgattttactcctcaggatcgttttatgtcctctttaccgctgtttcatgcttttgggctgacagttggtttatttaccccgttgatgacaggtagccgcgtattcctctatccaagcccattgcactatcgtgtcgtgcctgaactggtctatgatcgtaattgtaccgttttgtttgggacttcaacgttcttgggtaattatgcccgttttgcccatccttatgattttgcccgcttgcgctatgtggttgctggggcagaaaaactgtcagaaaacactaaacgtgtttggctagataaattcggcattcgcattctggaaggctacggtgtgacagagtgtgctcctgttgtggcaattaatgtacccatggcagctaaaatgggaactgtcggacggatcttaccgggaatggaagctcgccttcttcctgtacagggtattgagggcggcggtcgtttacaattgcgtgggccgaatgtcatgaaaggatatctgcgtgttgaggcacctgaacatctggaactaccaaccgcagaagatgccgaaggcaatactcagatcggctggtatgatacaggtgatattgtttctattgatgacagaggtttttgtacaatcaaagggcgagtgaagcgttttgcaaaattggcaggcgaaatggtttctctcgaagccgtagaacaaattgcatcgcgagtctctcctgacgcattgcatgcagctacagctaagagtgatcttagcaaaggtgaagcgctggtactctttacaaccgatgctaatttgaatagaaatgcgatgtcgggggttgcccgagaaatgggaatgcctgaactggcggttccacgcgatattcgttatgtgaagcagttaccattgcttggcagtggaaaaccggattttgtcacattaagaaaaatggcagaacaggagtaa

SEQ ID NO: 209 - DNA, 276 bp, Xenorhabdus bovienii; identical to SEQ ID NO: 154
  Coding sequence Name=Xb4151_4152.C398.gene7.dna; Position on contig =8164..8439bp; Strand=+

SEQ ID NO: 210 - DNA, 291 bp, Xenorhabdus bovienii; identical to SEQ ID NO: 155
  Coding sequence Name=Xb4151_4152.C398.gene8.dna; Position on contig =8568..8858bp; Strand=+

SEQ ID NO: 211 - DNA, 1284 bp, Xenorhabdus bovienii
  Coding sequence Name=Xb4151_4152.C398.gene9.dna; Position on contig =8955..10238bp; Strand=-
ttggagaatgtttcaacaagcacattaatcattattcttgtcatcatggtcatcatttctgcctatttttctgcctcagaaactagcatgatgaccataaaccgttatcgattacgccatctggcaaaacaaggtagccgtcctgcacggagggtagaatcactactgcgtcgtcctgacaggctgattagtcttatccttatcggtaataacctcatcaatattctggcctcttcacttgccactattgtggggatgcgtctttatcaagatgcaggtgttgccatcgccactggcatactgacttttgtgattctagtttttgctgaagtaatgcccaaaactatcgctgcactttatccagaaaaagtggcatttcctagcagtttcctactgcgcccactggaaaaaatcatgcttccccttgtgtgggcatttaataaaatcagtttactgctgatgcgctgtctaggcataaagacctttgacattcgcagtgatgctgtcagcaaagatgaattgcgcacaattgtgaatgagtcaaacaccaatctctcacgccgtaatcaagatatgcttatttcaatattagatcttgagaaagtgactgttgccgatatcatggtgccccgtaatgagattgtcggcattgacattaatgatgactggaagtcagtgatgcgacaactaactcattcaccacatggtagaattgtgctttaccgcgattctctcgatgatgccattggcatgctgcgtgtacgtgaagcctatcgcctcatgatggagaaaaaagcgtttacgaaaagaaatctgattaaagccgcagataagatctactttattcctgtcagcatcccgctgaacactcagttgattaatttccaacgcaacaagcaaaaagctggcttaatcgttgacgaatatggcgatattcaggggcttgttactgtcgaagatattttggaagaaattgtcggtgattttactacttctatgtcccctactttagcagaagaagtaatgccacagagtgatggtactgttctagttgatggtacagctaatatccgcgaattaaacaaagtcttcggctgggcattgcctgcagatggaccaagaacaatgaacggcatgattctagaagagttgggtgaaattcccgaattgaacgctcaggtgcagattaataaatataattttgaaattctatcggtacacggtaatgtcatcaaacaggtgagagtgactcctattaatcaagcagaaaaattttctgaataa

SEQ ID NO: 212 - DNA, 447 bp, Xenorhabdus bovienii
  Coding sequence Name=Xb4151_4152.C398.gene10.dna; Position on contig =10293..10739bp; Strand=-
tcagctcggtaccctatcgagttattcattcatattggattagcactccttgggtatgccaccttacttatcgctgcactatatgcactacaactgggctggttggatcatctgcttaaaaagaaaaaattctctttttcttctggcatgccccctctaatgaccattgaacgcaaaatgtttcacattacccaagtcggtgtcattttactcacattgacgttatgtacaggaatcatgtacatggataatattttcggtaaagagaatattcacaaatccgttttatctatcattgcatggtttgtctacgttatcttactctggggtcactatcatgaaggatggcgcggtaaacgtgtcatttggttcaatctgattggcgcgtttattctgacactcgccttttttggcggcaggctattacaggaaattatggtttattaa

SEQ ID NO: 213 - DNA, 3084 bp, Xenorhabdus bovienii
  Coding sequence Name=Xb4151_4152.C399.gene1.dna; Position on contig =451..3534bp; Strand=-
atgaaatatcagttatccgaatgggccatcagaaaacctattcccacgattgttatttttctggcactcactatcgctgggttattttcctttttaaaattgcctatcaatgcaaaccccgttattaattttccggttgtgactgtgactgtcacacaaagtggctcatcaccttccgaattggaaaatgcggttacacaacccatagaacgcgcggtttctggattgccgggcattcggcatattaactcaacaataacggatggcgtatccatcacgattatcgagtttgatataaaaattgatccgaatgttgcgacaaatgatatccgggagcaaattacacagattcgttcggaattacctcaatcaatagatgaaccgctaatcagccgtattgatgtagagggcagcgcgatcctgaattacgcggttcagtcaaaagataagaatttgaccgatttatcttggtttgttgatgacaaattaagtaaaaagttattaatggtgcccggcgttcaaaaaataacgaggctgggtggcacaaataaggaaattttgattgaacctgatccgataaagatggctgccttgaagatcagtgttgcggatattaaccagttattacttcaaaataacgttaatattcctggcggaaaaatggttgtcgcaggacaagatcataccattcgtattttaggtgcaaaaaatgaaatagattatttacaccaattaaaacttcctttagcaaacgataattggataaaattaggcgatattgccacgattagagattcacataaagaaaccatcaccattgcccgcttaaataatgaaattgttgtgggtttcgccgtattccgtgctaaaggttcaagtgatacagaggtagaaaaaggggttgtacgggcattacaaatggctggagaagagtatccggatgtcagtattaaacttgtttcatcaaatgtaaaatatacggtggcaagttataattcgaccatgcagacattaatagaaggtgcaatactaactgttattgtggtgtttttctttctcaaaagctggcgagcgacattgattgcagccattgcactgccattatctatactaccggcattttttatcctgcatttatttggttacaccctgaacagtatcactttattggcattaacattggtgataggtattttagttgatgatgcaatcgtcgaaatagagaatatagagaaatatattgaaagaggtgaaagaccttatattgccgccatcaaagcgtcagatgcaatcggatttgcaatagtcgcgattactattaccattgtcgctgttttcctgcctgtcagttttattggtggttttatcggtaaatattttgttcccttcggcattaccgtatcagcagcagtattatcatcattactggtcgccagattggtaactccgctgatgtccgcctatctcctacagcctaaaaaacatccgaaaacggataaaacagagacacccaaatggataaagaaatatcttactatccttgaaaaaacattaaaattccgcaaaacagcgtcgttgctagccatcgtcttccttttgggatcattagctctggtagcactgttaccctcgggttttatgcctaaagcggatattagtatcaccacaatagaagtagaagccccccccggcacccaagcagcacaaagtgatgaaacgttgcagaagattattaagaaactgcaaggccgcccagaaattatcgatattttctctgttgccggcgttgatggctcctctggtgagattagccagaataggagtaacattattataaatttagtaccgacgggtgaacgtgattggtcacaaaaagaatttgagcaatcattgattcctatcttaaatgagattccagatattcgatataactttggcaatagtagtggcagccgagatatttcgattgttctggccagtgaaaacccagaaattctgtctcagacaatagagcagttacgtaaagagatgatgcagttagagggattgaagaatatcaagctcttgcaacccttgccaagacgggaaattatcataacgcctaatattgatacagcagccagagctggagtaacaaccgatgcgattggctcagtaatcagaacggcaacaataggtgaaatcaattccagagtcgctaagtttaacttaccagacaggcaagttccgatccgcgtcttattatccaaagaagacagggataacctgaccgtattaaatgatctgtacgtaaatagcatatcgggcgtcaatgttccggtaaaatcggtggcaaatatctcttttgcctcaggccctgacaaaatagaacggattgccagacagcggaaagccagtattgatgcagatcttaatggtattgcggtcggaacagcatatatacaaattaatgaattgcccacaatgaaaaaattgccgccagaggtaaaaagagtcgagtatggtgaagttgaatatatgaatgaaatgtttgatcgtttcacgacgaccataacactcagtatcatgatggtactggctattctgattattctgttcaaagattttttacagccaatgacaattttaattgctctgccatttgctatcggtggtgcgattatcgcattacttatttatggcgccgccattgatctgcccgttattatcggcatattaatgttgatgggcatagtctcaaaaaactcaatattattggttgaatttattctcgaaaaatcccgcaccggtatgccacgaaatgaagccattattcaggcaggcagagagcgtgtcagacctattataatgacaacgattgccatgattgccggcatgatcccgctggtcattaccagcggcgcggatgccagtttccgggcgccgatggcaatctcggttattgggggactactcagttcaactttacttagtttactgtttgtaccagttatttacagttatatggatgattttaaaaactttattactccataccttaaaaaattgacctcagtaacgaaagacgatatcgattatcactga

SEQ ID NO: 214 - DNA, 1023 bp, Xenorhabdus bovienii
  Coding sequence Name=Xb4151_4152.C399.gene2.dna; Position on contig =3536..4558bp; Strand=-
atgcatgtctcaaccacaaccatgcaggctgtacagttcactccctctatcaaaatactgggagcaatcgtagcaaaaaatgagattgtgataagcccggcacttcctcagcatatcatcacagaagtgctggttgaagaaggtgactatgtcaaaaaaggtgaagtgttagctacattagaaacactggttcaggatgaaaaagtcaaacaagccaaagcggaactggaaaaagcgctggctttgataaaacagaatgaagcgatgagtaatcaggcacagtctgaacttaagcgtgtaaaaccactggtaaatacaggggtcatttctgccagtgaatttgacaaatacaaaatgcaggcaaattcatcctcatccgccttaaatgcggcaaaagcagaataccggcagttacaggcacaattagaaggggaaaaaacccagcgggcaaaaacaaccatatttgcacccagagaaggcgttatcagtgaacgaactgcgatggcaggtatgataaccgatagcagtcaactgtttaaattgatcgaaaataaccagcacgaattctcggctgaagcctatatttctgctttaaaacaaataaacacaggaatacctgcggctatttctctcacttccggcagcaaaataaccggcaaagtgagatatatctcgccgaaaattaatcccgttacccaaataggaaaaataagaattgcgctcgaaaatgtccccgccgatgtcaaactgggggatttcggccatgctttatttcagcttaaaccagaaaaagtcaatgctattccttatagtgctgtcaatatgggaaataaaaataaacccagtgtctatgttgtcggtaaaaacaatgccgtagagaaaaaagaaattaatacagggcgcatttttgataactggattgagataaagtctggcttatcgccaaaagataaaatcattgtttctgcatctccattcttacaagaaatggatactgttgccattatgccacagggaaaataa

SEQ ID NO: 215 - DNA, 5727 bp, Xenorhabdus bovienii
  Coding sequence Name=Xb4151_4152.C399.gene3.dna; Position on contig =4932..10658bp; Strand=-
atgcttaaaaaacaacgcaagcagtggacaacacaacaacggctcaggcaggtcgcttgggtgaatatctttgcccaggttgcctttccggtggccggcgttttcacgcccgccgtcgccgccgacaaaacccccaggcattcacaggcgacccggccacagacattacagactgaatcttaccgactggccgcgggcgaaagtattaaatccgtcgccaagcgtcatggcctgaccgtgacggaattgaaaaaactcaaccagcttcgtaccttccacaaaccctttacggctctgggcgcaggagatgaaattgacgtgcccaaatctccgtccggtcatttactggctgaaagtctgacacaagccgccgccgccgaatctccggtaagccatactgaaaataataccgaacgctggctggccagtaccgcttcccgcgcggcaggcatgctgaaaggcggtcatgtgctggacagtgccaaaaatcagttacgcggtatggcaatgagtgaagccaatcagaccgtgcaaaactggctgcaacactacggcacggtcaagttacaggccaatgtggatgaccgcgggcgcttagacggcagtcagttcgacatgttgttgccgctctatgacaccgaaaaacagatggcctttacccagttcggcctgcgccatattgacagccgcaccaccgccaacttcgggctgggtcagcgtcacttctttgataccgggatgttgggctataacgctttccttgaccacgacataacccgtgaccatacccgctttggcctcggcgctgaatacgcccgtgattttatgaaattcggggcgaacggctatttccgtgccagcggctggaaagacggcaagaaactgaaagactacgaagaacggccggccagtggttttgacctgcgtgccgaaggttatgtgccttcctatccacagctgggcggcaagttaatttatgaacagtactttggtgatgaagtcggtttgctgagtgaagagcgccggcagaaagatccggccgcctttaccctgggcgccagttataccccgatcccgctggtaacgctgggtctggatcgccggcagagtacctccggcggcggtgaaaccctgtttaatctggggctgaattatgaaatcggtacaccgtggtcaaaacaggttgatccggatgccgtggcctttaaacgcaatctgcaaggcggacgttatgatttggtggagcgtaataatcagattgtactggaataccggaagaaaaatctgatccgcctgatgatggaaaaccggattaacggacgcggcggcgcggtgatcccgctgaatgtcaatgtcagtgcccagcatggcctgaaagagattgtctgggataccgccggtctggtggcgggaggcggcaaactcgacagcgtaaatgcaccggcacgggcagaaaatctggcagcggcgccggttcgcgggggcacccgttacctgctgaccctgccgccgttccatgacaagggtaacaacacctacaccctgtccggcatcgcttatgacactcagggcaatgcctctgagcggatggaaacgctgatacaggtggtttcttctgccgtcaatcccgacggttccggctttgaacccgcggagaaatcgatggtggcggacggtaaaacccaaacggttatccgcctgaaactgaccgacaaagacggcaagcctgtcagcggcgtggcgggtaacctcaaattaaccgacgataaaacgacactgaccggcgacggtaaagatcctgagctgggtacggaagtcagggaagttccggaaggcagcggcatctatgaaatcaccgcgactgccggcaccaagcacggtaaatggaaaatcacgcccacgatcgatggtcatgagctgacaccgactgttattgactttggctcttcattggcggagatgatagataccgatcgcaccgagtttaagccggaaaatggcaacctgaatcaggaaggcgacagtacagacctcgtcctgaacctgaaagacaaggacggcaacccgatcacgggagcggcggataaaatcaccctgaccgatgataaaaatgaactgtacggccagaaccctgctccctcactgggcgcggtaagagaagatccgccgggcagcggtatttataaggccaaggtgacggcaggtcagaaaaaagggacatggaaaatcaccccggcggtggaaggcagaacgctgaaaccggccatcattacctttggccagtcgctgacggacattgtcgataccggcggctcaacgtttacgccggcgacgaatatcctcgcggccaacaatgaagacagtaccgtcatgacgctccatcttaaggacaaatccggcaagcccattcttaacgcgaaggacagtatcacatttgaagacaatggcgataagctgtcgggtgacggccaaaacaaaccgacgattgataaagtctgggaagagccggaaaacagcggtatttataaggtcaaagtgaaagcgggcgacaaaaccggccagtggaaaatcaccacccggatagacggcaagcctctggataccccaacagaaatcaccttcggttcttcgaaagcggagctgattgacccggataaatcggagtttatccccgaaaaaggggaactgccgaatgaaggggataccacggtgattaagctgaacctgaaagacaaggatggcaacccgatcaccggggcggaaaacagcatcaatctgatcccggataaccatgagctgtacggtcaggggcaaatgccgaccaccggaacagcgaaggaaatcccgccgggcagcggcacctatgcaatccctgtcacggcaggcgcgaaaaaaggccaatggaccctcacgccagaggtgttcggtaaaccgctcaaacgcccggccaccctcaccttcgggcaatcactggccgatgtgctggatacccagggctccaccattgaactggcggatggcagtaacacgctggccgcagatggcgtctccaccaaaaccttacgggtggtgctgaaagataaacagggcaaacccgttacaggggcaaaagacagcatcagggtcaatgcggcgggtcaattaccgggagaaggccaagatccacaaatcggtgatgttaaagaagtgtcggacggggtgtatgaagtcgtcgtcaccgccggccagaaaaccggccactggacgctgaccaccaccgtggatggcacggagatgaagaaggagacggtaattgagtttaatgaaaacaaagcgccggccgtgaacaatctgcaactgaatggcattttacatatcaatgaaaccctgtatgcccgctatcagtttgaggacaaaggcggtaataccactgaccgttcgttctatgtctggggagataaaggcactaccgcgaaacaagtgatggcactggcggatgccgccggggtgaaagagccggtactgacgcagaaaaacggcgaaggccgggtaaccgccggcgcggcggataatgaaaaagtgaagtatgttattgcgcgcagcgatgccggtaaggtactggaagtgtccatactggcggctaacggggcgaacctgcgggccaaagcgccggtgaccacggatataaccgacccggcagccaaccagggccttacgggcgggaatggcaaaggcggtgtggcagatccggatgccaaacccggtatcgacaagattgtcctgagtggtgatttggaaatcaatcagccgcttacggccgaatatacctttaacggtaatggcggtgacgccaccgacctctcccagtttgcctggcatgacaaggggactccggcagccgattaccagcccgtaccggacaacggcaagaatgctcaggacaaaacaggcaaggtgaccagaacgctggagcaagcggatgcagggaaaacggtggcgattaccgttaagcccgttaacggaaacaacgaagtcggtgaagccaaaacggtagatattggtatgacggacaccaacatcaaccaaaccacgcccaaaggggcaaaaccgggcaccattcttgaccctaatgccattccttccattaagaatgtagtcttgcacgggtaccgatctgtaaattcaaccctgaaagccacttatgagtttgagcccaataacggttatgtggaagataaaactacctacacctggaggcgggtcgcaacaataggcggcacgccggaagacatcagtaaacagggcgctacaggcactgtcgatggtcaagggggccagatcgaatcttataagctgagtgacgacgatattgataaatttgtggaaattgttttgacgcccaaaaatggcagaagcaaaccaggaactgatattttgaagaacagcggtcagaatgaaggtaatgaacttcagggcggtaatacgatagggcagattattgacccctcccggggccccggcattgcagatctgaaaatccacggtaagttagcggttgatgaggaactgactgcaacgtataaatttgaggctaaaggcggacatgaccaagataactccctctttttatggggtatcaaatatcccgaaggagaccctgattacaataagtcccccgagtttctggtggaacaatttaatagtgatgacaaggatcatattgtcccgccaaataacaccaataccatcccgggataccgtttgaaaccggaagacagtggccgagtcatccaagttgcgatacaagcccgttcgaaactggcgcgtggcaagtcatataacagagatacacggcaggaagctgctgaaggcaataatttagaaggcaacaaggatggtacggtgaaaggcgtggcgagtgacttcacgataacgccggataaacctgagaaggatgcggatggcacgatggcggttaaggttgaaagagataaaaccattacgctcacggtcaaaactgagaacggaggtcaagccgttgggggtatacctgtgacaattaagatgacggcgattaatcgtcaaaagaaagctgacacggtcacagtaaacctggaggcgaaagaaggtgtactggcgggtaaagaggatacttaccgcggccatactgacgaaaaaggttatctggttatcaatgtcactgaccctaacggtattggcacaagaaccaccctgtcggtagaggtgaatggcgaagccaaccagacgttaaccaaaacatgggatgttatttttaccgtactcaccagtccggatacgccgaaggccaattattgggggcatatggaagattacattacacttaacggaataaaatactcgcggcctcaattaaatgctgagttaaatggtgaatctaagctgacaagaaaccgcgaaatttggggaatggcgcagtggattatagtgaaagattactgcaataaattaggagagttacccactagagatcaattaatggatatacataatgcttatcaaaatcggactctttacgacactaatgggtggcctattaattctctcaacggatttggtttaaacatatggtcatctagtttgtggaatccaaatatagatattaatataacagttgtagatataataagtggtaaagaaggaagtgcaggtaacgccggtaatcatggtggtggtgattactctgttatttgtcgcattaaaaactag

SEQ ID NO: 216 - DNA, 669 bp, Xenorhabdus bovienii
  Coding sequence Name=Xb4151_4152.C399.gene4.dna; Position on contig =10998..11666bp; Strand=-
atgttaaaacgtaagtacctgacgcaatctgaaattgaaatgttgctgactgaatcaggcaaacatgctcatgcggcacgcaatatctgcatgatgtttatggggtttattcatgggtttcgggtgtctgaactcctcagtctaaagctgtcagatgtggatttggacagccgcagcctgcgcgtacagcgcctgaaaaatggcttttccaccattcatccaatggtctcccgtgagattcagctgctacgtcagtggctaaagggacgcccgaattatctgccagggacaccacaggccaacagcgaagtctcagactggttattcctgtcccgtagcggccagcggatgtcacgtcagcaagtgtataaaatcatccgccagaccagtttaaaggcaaaattgtcgatttgcgcgaatccgcacatgctcaggcacgcctgcggttatgcactggcagacaatggcgtagacacccggctgattcaggactatttagggcacagaaacatccgtcataccgtgcgctacaccgcgagtaatgcgggtcgcttcgagacggtatgggacgggaaaggaaaacgaaaacagttgacaattagtaccaaactgtcaactaaggggtttttatctgaaaatgaggaaattgcagaaaaacaaacccgctaa

SEQ ID NO: 217 - DNA, 138 bp, Xenorhabdus bovienii
  Coding sequence Name=Xb4151_4152.C399.gene5.dna; Position on contig =11937..12074bp; Strand=+
atgaaactggatcttcgtactgatcgttttagtgggtacggtataactcttgagcaactacgagcctttgtgtatgttactaggtgtttggtcctaacatttgatggattaggatttatctctaaaatagccttttaa

SEQ ID NO: 218 - DNA, 591 bp, Xenorhabdus bovienii
  Coding sequence Name=Xb4151_4152.C399.gene6.dna; Position on contig =12289..12879bp; Strand=-
ttgtcaaaacagacagaaaaacagcgcgctaaacgcaaacaaatcattgatgctgccatctcctgttttatagagaaaggatttcatgcaacatccacagcagaaatctgcaaggcagcaggcatgagcccaggtaatctgtttcactattacccaaccaaaaacgccattattgcagctatcgcagaagaagacagtcatgactatgacaaaatcttgcataccgatgatgatgaaaactcggttatggcaaccatagaaaagatgatgataagcctaatccacctgtataaccaacccgattatgcacgtctcagcatcgaaattatcgctgaagctagccgtaaccctacaattaataaaatatttatcgaaaatgaaaaaaaaatccgggaacgtttagcactattaatccgtaaaggtattgaaacaggggaaattgataaacagattaatgcagaacagacggcatcctggctaatgataactgccgggggtgcgatagggagagagttggtagagccgaattttaagtggcttgatagtatggattcttttacctacataatacgaaaaatttttgcatcataa

SEQ ID NO: 219 - DNA, 180 bp, Xenorhabdus bovienii
  Coding sequence Name=Xb4151_4152.C399.gene7.dna; Position on contig =13087..13266bp; Strand=-
atgccagtttccggcgccggattggcattctcggttattgggggactactcagttcacctttacttagtttactgtttgtaccagtattttacagttatatggatgattttaaaaactttattactccataccttaaaaaattgacctcagtaacgaaagacgatatcgattatcactga

SEQ ID NO: 220 - DNA, 462 bp, Xenorhabdus bovienii
  Coding sequence Name=Xb4151_4152.C400.gene1.dna; Position on contig =324..785bp; Strand=+
atgatcagctttatacaggaacagcttaaggtcattgaatctgccttgtctaaacacattaaaacctatcatcgttccaaactcgatttattatctacagtaaaaggcgttgggcctgccacaatagccactttgatcgctgatgtaccggagttgggtaagttaacacgccgggaaattagtgccttgattggtgttgcaccgtttaatcgagattctggatttttccgggggaaacgaacaatctttggaggaagagcaatggtgcgtcgaatgctatatatggccacgttaacggcaattagatttaaccccgttctctgcgctttctacaagagattgaccgaagcaggcaagccaaacaaagtcgccatcgttgcgtgtatgcgtaaattactggtcattctcaatgcaatgataaaaacaaatagaccgtgggacgaatcattccacacggtgtaa

SEQ ID NO: 221 - DNA, 144 bp, Xenorhabdus bovienii
  Coding sequence Name=Xb4151_4152.C400.gene2.dna; Position on contig =1366..1509bp; Strand=+
atgaaagaaatggtgcgggaggcgagacttgaactcgcacaccttgcggcgccagaacctaaatctggtgcgtctaccaatttcgccactcccgcaaagatggtggctacgacgggaatcgaacctgtgaccccagcattatga

SEQ ID NO: 222 - DNA, 1224 bp, Xenorhabdus bovienii
  Coding sequence Name=Xb4151_4152.C400.gene3.dna; Position on contig =1698..2921bp; Strand=-
atgagtaatcataatgcacagaagcaaatcggtaatattgatctggtcaaacagcttaatggcgccgtggtctatcggctgatagaccaacatgggccaatatcccgcatccagattgcagaagaaagccagcttgctcccgccagcgtaaccaagattactcgtcagttactagaacggggcttgataaaagaagtcgaacagcaggcttccaccggagggcggcgcgcgatctcaatcatcaccgaaactcaccacttccataccatcggagtcaggcttggccgccatgacgccacggtggcgctatttaatatgagcggtaagacgctagtggaacagcactattcagttccagagaatacgcaacaggaagtcgaaaaccggattatctccgccattgaagatttcatcgagaaaaatcagcggcggctccgtgaactgatcgcgatttcagtcattctgcctggcctggttgatcccgatgacggtgtcattcgctatatgcctcacatcaaggtagataactggccactggtcaaaaacctcaacaatcatttcaatatctcttgctttgttggtcatgatattcgcagccttgcactggctgaacattacttcggggcaacccgcaattatgaagattcacttctggtacgtattcatcgtggcacgggagcaggagtcatcatcaataagaatattctgcgcaacaaacgtggcaatctgggtgaaataggccacatccagatcgagccacttggcgaacgctgccattgcggtaattttggctgtctggaaacgatcgtatccaattcagcgatagaaaccagagttcaacatcaattacgacagggttttccaagccagctagccttgaataattgcaatatccatgcgatctgcctcgcagccaatgaaggtgatccactggcagtagaagttatcagacaagtagggcactatcttggcaaagggatctcgattgcgattaacttatttaatcctcagaaaatcgtcattgccggtgatattaccgaagcggaacaggttttactccccgcgattcaaagttgcatcaatacgcaggtgttaaaagcattccgtgaggatcttccggtggtagtttctgagctaaatcactgttctgcgattggtgcattcgccttgacgaaacgtgcgatgctaaacggtgtactgctgcaacatcttcttggcggataa

SEQ ID NO: 223 - DNA, 1164 bp, Xenorhabdus bovienii
  Coding sequence Name=Xb4151_4152.C400.gene4.dna; Position on contig =2934..4097bp; Strand=-
atgtacgctttaactaactgcgttatctataccgggtacgagaggcttgataaccacgcggttatcattgcagacgatttgattcagcacgtttgcccggtaaatgaattaccagaacatattgaaaaacacgatttgcagggcgcaaacctctctccagggtttattgacctacaagtcaatggctgtggtggcgtccaatttaatgagcgactggaagatcttacggaagatacgctgaatatcatgcagaaaaccaatcagcgctacggttgtaccagtttcctgccgacgttgatcaccagtcccgatgaattgatgataacggcaatcgaagtgatgcgttcctatctgacaaagcatcctaatcaggcgctggggctgcatctggaagggccttatattaatcccataaaaaaagggactcacaatccagcctatatacgcaagccaacctccgaaatggtcaactatctgtgcattaatgccgatgtgatcactaaaatcacactcgctcctgaaatagtggaaagtaagtatattcatcagttgaccgaagccggcattattgtttctgctggccattccaacgcaacctatgaagaggctcgtcacggtttccagcatggtatctctttttccacccacttatataacgccatgcccgccatttccggccgccagccagggctaatcagtgccatctatgactcttccgaggtctatgccggcattatctgtgacggaatgcatgtttcatggccgaatatccgcaactccaagcgattaaaaaccgacaaattaatcttagtgacggatgccatcgtccctgctggccttgacccgaaaaccaatacactagaacaatttacctttgccaataaaacaatatactatcgaaatggcttatgtgttgatgagaatggcacactgagcggttcatcaatcacgatgattgagagcgtcaagaatagtgttgaatatgttggtattgctttggatgaaacattgaggatggtgacgctttatccagcccgagcaatcggtgttgataaacgcctcggtacgattgaacccggtaaggtcgcgaatctgactgcatttactcatgatttcaacatctgcaaaaccatcgttaatggaaatgaaatcgaactatcgtga

SEQ ID NO: 224 - DNA, 807 bp, Xenorhabdus bovienii
  Coding sequence Name=Xb4151_4152.C400.gene5.dna; Position on contig =4118..4924bp; Strand=-
atgaggctgatccccctaacaaatgcaagcgatgtcggacgttggtctgctcactatattgttagcaaaatcaataaattcaatccgaccgcagagcatcctttcgtgcttggcctacccactggcagtacgccactgaccacctatagagaacttattgctctgtatcaggcgggaaaagtcagtttcaggcatgtagtgacatttaatatggatgagtacgtcggtattcctgaagatcatccccagagctaccatacgttcatgtaccaaagcttctttagtcatattgatattccaaaagaaaacatcaatctgctcaacggtaatgcagcagatattgatgctgaatgcctgcgttacgaaaataagatcaagtcctacgggaaaatccacctgtttatgggcggggttggtaatgatggtcatattgcgtttaatgaacccgcgtcttccctctcttcacgcactcgtatcaaaacgttaaccattgaaacgcgaaccgcaaactcccgttttttcaataatgatgtggaacaggttccgaaatatgcattaacggtcggtgtaggaactttgatggatgccgaagaagtcatgattctggcaacaggaatgaacaaagcactggccctgcaagctgcaatagaaggcaatatcaaccatatgtggacagtaagctgcctacaaatgcatcctaaatcgattattgtctgtgatgaacccgcaacaatggaattgaaagtgaagacagtgaaatattttcgccagttagaggcggatattctcagtgaattcgctagttag

SEQ ID NO: 225 - DNA, 2034 bp, Xenorhabdus bovienii
  Coding sequence Name=Xb4151_4152.C400.gene6.dna; Position on contig =5257..7290bp; Strand=+
gtgaacattctaagctacttacaacgtattggtcgggcattgatggtgcctgtggcgacattgccggcagcggcaatattggtagggatagggtactggatcgatccgacgggttggggcgctgataatgcgctggcagcactgcttatcacatccggtaatgccatccttaacaatatggggatgttgttcgcaattgggttagcctatggcatgtcgaaggataaagatggcgctgctgcactggcaggtttaatcgggtttatcgtcgtcataaacctgtgtgctcccgcgtctatcgccatgattaaaagtataccgattgatgaagtaccaaaggcattcgggaagatcaataaccagaaccagtttgtcgggattttggttggggtactttctgctgaactgtacaaccgctacagtagcgtcgagttaccacaggcgttgtcattctttagtggtcgccgtttagtacctatcttaaactctttcctgatgattctggtttcttttatcctgatgttcatttggccagtggtttatgactggctggtggcattcggtgaaagtatcactaatcttgggtcaacaggtgcgggtatttacgcattctttaaccgtctgttgattcctgttggtctgcatcatgcgttaaactcggtattctggtttgacgttgccggcatcaatgatattcctaacttcctcggtggtcagaaatcgattgaggctggtacggccattgcgggtatcaccgggcgttatcaggcaggtttcttccccattatgatgtttggattaccgggagccgcattggcgatttaccactgtgcacgtcctgaaaacaaagctaaagttgctggtatcatgatagcgggcgctattgcggctttcttcacgggggtgactgagccacttgaattctctttcatgtttgtcgcacctgtgctttatgttttgcacgccattttaacgggaatttctgtttatatcgcggccacaatggagtggattgcaggtttcggctttagtgccggattcgtcgatatgttgctctcctcgcgcaacccgctggcggttaagtggtacatgctgatcccacaaggtttggtattcttctgcctttactatgttgtattccgtttcaccatcaaaaaattcaacctgatgacaccggggcgtgagttatcagccacggatgaaaccgatggttatgatgttgatacggcaaaacaaggaaggaatggggtaaataacattcaggaagaagcacgtcagtacattgccgcagtggggggatccgataatttgacagggattgattcctgtatcagccgtttacgtttatccgtcaaagactcaggattggtcaataatagactgaccagacatcttggtgcctcgggaattatccgtctgaataaacagaacgcccaaatcatagttggaacccgcgcagagttgattgccagtgccatgaaagaagtattggcaaaaggcccggtagcggcaatcatagaaactcaatactctgagtctgatgttcagacaaaggaagatagccagcaaacaggcattccaatcttgactttaatcgctcctgttacaggggaattggtcaaactggaagatgtccctgatgaagccttttccagcaagttggtaggggatggcattgctattaagccgacgtcggatactgttttttctcctattgccgggactgttgtgaaaattttcgatacaaatcatgcagtatgtattgcggcagataatggtgttgaagtcattgttcatataggtattgataccgtcactcttaatggcagagggtttgagcgtttgattgaagaaggggtgacagttaaagccggtgaaccgttgttgaaactggatcttgagtacttgaatgctcatgctaaatcgatgatcagcccggttattatcagcaatatcgatgattattctggcgtcattataatcgctaaagactctgttattgccagagaatcaaatttatttcaggtgatataa

SEQ ID NO: 226 - DNA, 642 bp, Xenorhabdus bovienii
  Coding sequence Name=Xb4151_4152.C400.gene7.dna; Position on contig =7969..8610bp; Strand=+
atgtctgaatttctttctgaagaaaaaatggagcagtatttaaaaagctgggatgataacggttatatagttatagaatcagcggttagtagagagcaaacacagaaaacagtcgatgctatattctattttttggaaatggataaaaatgatcccgttaatttttataacaccgatatccgttctcgctcaggaattgatgaaatggggcgtattcctttttatcatcatcagaccttgtgggataatcggcaaagtcaaataatttattctgtatatgaaaaaatttttggtataaaagaactattggtgagtattgatagggtcaatatgaatccacctgttaatgatgattggaaatacgaaggttttattcattgggatattgatgtttcaaaacgtccgttagagagtaaaatacaaggcttattgagcctaactgacgatgatggtaattctggtggatttcaatgtgtaccggggtttcataaagtaatttatgaatggctgtcaaaacaaccagaagggtataatagccgattccctgatacgacaggaatgaaaattgtatctatcccattgaaagctggggattatgttatatttcatggcgcgctgcctggtcatgtattaaatggttag

SEQ ID NO: 227 - DNA, 276 bp, Xenorhabdus bovienii; identical to SEQ ID NO: 154
  Coding sequence Name=Xb4151_4152.C400.gene8.dna; Position on contig =8648..8923bp; Strand=+

SEQ ID NO: 228 - DNA, 291 bp, Xenorhabdus bovienii; identical to SEQ ID NO: 155
  Coding sequence Name=Xb4151_4152.C400.gene9.dna; Position on contig =9052..9342bp; Strand=+

SEQ ID NO: 229 - DNA, 990 bp, Xenorhabdus bovienii
  Coding sequence Name=Xb4151_4152.C400.gene10.dna; Position on contig =9355..10344bp; Strand=-
atgactgccgaactaaacaaactcagtgacaaaaaacttaagatcttacatggaagaaaaaatgacaagatcgaattttttgctgatggagcaagcctgagcgctaaggtgtccaaagttggtggtattagctgggtttttacatatcgacttgatggtaaaaaattaaaccgacttaccattgggcgctatcctgatatgagtctcaagcaggctcgagaaatacgaaccaagtgccgtaattggctcgtatcgggtaaagatccaaagctccaatttaacttaacaatgcaggaatcactaaatccagtcacagtaaaaaaagctattgaatactggattgaaaactacggaaaagataacagggtaaatattgataaacacatttctcaattgcagaaacacatatatccttatattggaaatatggcattatccgattgtgaaacccattattggctccaatgttttgatagaattaaacaggcagcccctatgacatctggaattatattccagctatgtaggcaagccatcaaattctgtcgagtaagaaggtatgcaataagtaatgcactggatgatttaactattcttgatgttggaaaaaagcaaaataaaggccaaagatatttgaaagataatgagctcggacaactgtggcagtctctaaatacaaatgtgaatttaccttactatagtaattttttgagagttttaattgtatttggttgtcgctcgcaagaagttagattatctaaattatcagaatgggattttgattctatgttatggacggttccaaaagaaaatagcaaatcaggtgagaaaatcattcgaccaatacctgaatgcttaaaaccgtttttagaaaaactcatttatcaaaatcataaaagtggttatcttctgggggaaattaaaaggtcaggatcagtatcacaatatggtggaaatatatggaaaaaattagggtcatgtattaaatga

SEQ ID NO: 230 - DNA, 717 bp, Xenorhabdus bovienii
  Coding sequence Name=Xb4151_4152.C400.gene11.dna; Position on contig =10508..11224bp; Strand=+
atgaaaaagaaactcacaacagaacaacttgcagatgccaaacgtttgaagcgcatatttgtgttaaggcaaaagcagctcggtatctcttctcaagatgcattcgcggacgaatttggcatgactcaaagcgccgtttcacactatcttaatggtgtaaacgcccttaatttggagagagcggccgatttcgccaataaattgggcgttagcattgcagatttcagtccatcattagatcaacaggcaaggaaactcctgaaagcggtctatggtgatgatcctacttttgccacccatcagcatcctcaaaaacaatatccactgctgaactgggcaaatgcaggtaattggtgtgaagaacctgcaccgctatatcctgaaaacgatattgaacaatggcatgaaacttctattgaatgttcaccccatgctttctggctagaagtcaaaggtgattcaatggcatcatcgaatgaattaaacatacagcaaggtatgatcattttgattgaccctgatgttaagcctatggctaataacttggtggtggcaaaacttgagggagaaaaagagctgacttttaagcaattaattaccgaagggtacgatgcctatttaaaacctctaaatcctcaatacaatatgatacctctcaatgaaaaagtgcatattgttggtgttgtcatagaggccaagatagctaagttgccctaa

SEQ ID NO: 231 - DNA, 951 bp, Xenorhabdus bovienii
  Coding sequence Name=Xb4151_4152.C401.gene1.dna; Position on contig =101..1051bp; Strand=+
atgctgtttctgatgtatgccttaacatccgcttatattagtggcgcgggtgaattactaaccagtagcattaatgaatggacaggttcttcattctcattatcaacgggcgtgattttattcactttaattgccggagccgttgtctgcattggaaccagttccgtagattttatcaaccggatctttttcagcgccaaactgatctttctgatactgatgcttggcctgatgatgccccacattcaccatgtcaatttgttatccctgcccgttgaacaaggccttgtgttatctgcgattcctgtcattttcacctcatttggcttccatggcagcgtacccagcatcgtacgatatatgaaaggagatatccgtaaattacgctggatatttatcatcggtagtgccattccattagcagcttatattttctggcaattgggtactttgggcagcattgctcctacctcatttatgggaatattagccgaaaaatctggtctggatggtttattgagcgccattcgtcatgttgtagcctctccccagacagaattatctgtccggatgtttgctaatctggcactcgtgacatcctttttaggcgttgccttaggcttatttgattttctggctgatctgttcaaacgtcaggataatatagcaggaaggtttcagacagggttgctgacgtttgtccccccattgatttttgcgttgttttatcccaaagggtttatcatggctttaggctatgcagctgctgcactgtcaattttagcgctgttactgccgagtattctggtattcaaagttcgtcagcagcataagcgccaatatcgggtctttggcggaactcccgcattagttgtggttttcctctgtggtatcattctcattgccattcagattggcattgtcgctggaatactacctgaggtagggtaa

SEQ ID NO: 232 - DNA, 543 bp, Xenorhabdus bovienii
  Coding sequence Name=Xb4151_4152.C401.gene2.dna; Position on contig =1164..1706bp; Strand=-
atgaaaagtttcattgctgtcagcatggccagtttgttttttgtgtctggcgtggcaaatgcaatttccatgaatgtacaggctggaaagcattacacaagtacatctgtggggctaggtgataaaagtgcgggattatctttgaatggaaactggactcgcagtgatcataacggtcaaattggtagtttaggcaccgctttcgctctgcctgtaggcccaataacggcaagcgttggtggtaaagtgctttatctgtcgccaaaagaaggaaaagatggtgttgcgttagctgcgggtgccggccttagctgggcggtgttaccttccttgtcactatatggtgaagcttatggagcaccatcagggctgacatcaggcgttgattcttatacagaggcaacaggggggatccgttatactttatttaagccgctgactgtggatgcaggttatcgtgttattgatctgcaaggcaaaaatggtaaccgtaacaataaagtttcagaaggtttttatattggggccggcttcagcttctaa

SEQ ID NO: 233 - DNA, 1425 bp, Xenorhabdus bovienii
  Coding sequence Name=Xb4151_4152.C401.gene3.dna; Position on contig =1834..3258bp; Strand=-
atgtcattagcggaatggacgcaatggccgtggcatcattgggcgatgctctacccagagaagcaggctgtcaggctgcatgaagagacgttatcctggcgacaactagcggaaaaaatcaacgccatcgctgcccattttcaccaacaggggctgtgggaaagtagcagtgtgatcctgagaggaaaaaacagtgccgatctcctgctgtgttatctcagtgcattgcaatgtggtgcaagagtattgccactgaatccgcaactccctgagcctttgttggcagaattgcttcctcatctgaacatgacatttgtcatcgattttaccgatcccccttcatctgctattcaggcgattaaacttgattggcaacctgaattatctgtgataccagagcaatgggtgccgtgggatatccatcgccctgccagtatgattttgacttcgggtacttctggattgcccaaggcagcggttcactctattggggctcaccttgccagtgcgcaggggcttctctcctgcatggattttcagccaaatgacagttggctgttttcgctcccgttgtttcatgtttccggtcagggcattctttggcgttggctgctgaaaggtgcggaattggtgttgcgagatctgaatccattggatcgtgcattatctggttgtacccatgcgtcacttgtaccaacccaactctggcgtttgcttgaacaatcgtttgaacatgcactcactttaaaagcagtgctcttgggtggagccatgataccaacggaattgactcaacaggccgaacaacttggtattcattgctggtgtggctatgggctgacagaaatggcgtcaacggtctgtgcaaaacgggcagatagtttatcaggcgtgggaaatccactaccgggcaaagatattcgcttggtggatgaggatattcagatccgcgctgacagcatcgctctggggtattggcttgatggaaaattgaatccactggcagataccgatggctggttttcgacccgtgacagaggaatatttgaacagggcgaattgcgtattttagggcgcctcgacaatcaatttttcagtgggggagaggggattcagcctgaagatatagagcggattattaaccaacatcctcagattctgcaaaattttgttgtacctattcctgatagtgaatttggacatcgacccgttgtagtgattgaaacccaacatcctgcacttacggaaacacttgctgactggcttactgataagctcgcagcatttcaacgccctgtggtttgttatctgctgcctgtacaattgaaaaatggtgggataaaaatttcacgccagcaggtcaagcaatgggtgctggaaaaatgggttatatctaaagtaatttataaacctgatgatgtataa

SEQ ID NO: 234 - DNA, 996 bp, Xenorhabdus bovienii
  Coding sequence Name=Xb4151_4152.C401.gene4.dna; Position on contig =3249..4244bp; Strand=-
atgcggaaagcgaccttatattcattcagcctgcccatggaggcaggtattattttgcgttatcaacgccttaaaacccgtgatggctttctggtgcacttgcaggaaaatgaacggcacggttggggggaaatctccccgctacccgaattcagtcatgaaactctggaacaggccaaaaatgctgccgtgacatggctgcaacagtggtgtcaaaacgaacagggattaacggtagaacccgaagagagtgaaccgccttccgtggcgtttggtatcagttgtgccctcgctgaactacagggtgaattacccgaagaggctgattatcgcaaagcaccattatgtacgggagatcctgatgacgtgattttgcgtctgggaaatatgactgggcaaaagattgctaaagtgaaagtcgggctgtatgaagcggtgcgggatggtatggtggtggatgtcctgctggaagccgtgcctgatctccagttgcggctagatgcgaatcgcagttggacacgcataaaagccgatgacttcgcaaaatatgtcaatcccgattaccggcaacgaattgcttttcttgaagaaccttgcaaaacctgtgaagaatccctggcatttgcccgtgatacaggaattgccattgcatgggatgaaagcgtgcgtgaagcgggtttcacggtagaagcacaggaaggcgttgcggccattgtcatcaaaccgatgctggttggcagtattgtccgctgtcgtcagttagttgcagacgctcatcaggcagggttggaagcagtaatcagttccagcatcgaaaccagttttggtttgacacagctcgcccgtctcgcacattggctgacacccgatacccttcccgggctggatacgctggatctgattcagtcacaacttatccgtggctggccagaaagtcccattccttgtgtggtgctagatgatctggacaccgtatggagcaatgaatgtcattag

SEQ ID NO: 235 - DNA, 858 bp, Xenorhabdus bovienii
  Coding sequence Name=Xb4151_4152.C401.gene5.dna; Position on contig =4244..5101bp; Strand=-
atgctttatcccaatgaagaaaaattgtacgcgcccattgaatggcaagattgctcccaagggtttaacgatattctctaccataaatctgtagatggcattgccaagattactatcaatcgcccgcaggtgcgtaatgcgttccgtcccctgacagtaaaagagatgattcaggcgctggcagatgcccgttacgatgatgaagttggtacgattatcctgacgggaatgggggaaaaggcattttgtgcagggggtgatcaaaagatccgtggcgattatggtggttatcaagatgataacggcatgcatcatttgaatgtgctggattttcagcgtcaaattcgaacctgtccgaaaccggttgttgctatggtagcgggttattccattggtggcgggcatgtgttgcatttgatgtgtgatctgaccattgcagcagataacgcgatttttggtcagacgggcccgaaagtagggtcatttgacggcggatggggcgcatcttatatggcgcgtatcgttgggcagaaaaaagcccgtgaaatctggttcctctgtcgtcaatatgatgcccggcaagcgttggatatggggctggttaacacggttgtgccttatgcggatttggaaaaagaggccgtgcgctggtgtcgtgaaatgctggaaaacagcccaatggcattgcgttgcctgaaagctgcactgaatgcggattgcgatgggcagtcgggtttgcaggagctggcggggaatgccaccatgttgttctatatgaccgaagaagggcaggaaggacgcaatgcgttcaacgaaaaacgcccccctgatttcagtagattcaagcgtaatccataa

SEQ ID NO: 236 - DNA, 807 bp, Xenorhabdus bovienii
  Coding sequence Name=Xb4151_4152.C401.gene6.dna; Position on contig =5114..5920bp; Strand=-
atgcttgcaagagttacggaaacaggtggctgcattgtgaaactcgccagtcaggtatttcattcggataagccgggaacatggttggtttggctgcatggcttgttgggatgtggtgatgaatggctacccttggtgaatgcttgtagtcagtatgcctcgctggtcattgacctgcccggccacggtcactcgaccgatattactgtggcagggggattcgctgagatgaacgatctcctgaatgaaaccttattcaaacatcagatccatgactattggctgattggctactcactgggtggccgtattgctatgtaccatgcgacttacggcaaacatgaagggttacggggcgtgctggtggaaggcggaaatcccgggctgttttctcaacaggagcgtgatgcgagattgcagcatgatcagtgttgggtgcggcgttttcgtgaggaatcaatggagacggttcttgccgattggtatcaacagcccgtttttgccgatttatcatcggagcagcgtgagcaacttatccattgccgtagccaaaacaggggaagccggattgccgatatgttggaaagtacttcactggggcatcaaccgtggctggttcctgctctgcaacacataaccacacattttgcctacttatgtggggaaaatgatgagaaatttcagaatattgcgaagcaatatacattgccgttaaaaaccatcccacaggttgggcataacgcccataatggcaatcctgcggcgtttgccgccgaagtgaaccattttttatcactttttggttaa

SEQ ID NO: 237 - DNA, 1689 bp, Xenorhabdus bovienii
  Coding sequence Name=Xb4151_4152.C401.gene7.dna; Position on contig =5881..7569bp; Strand=-
atgtcaaacagcgtacttaaccgccgttgggcggaacttctattggaagcactgacccggcatggattgcgtcatgtttgtattgcccctggttcccgatccacgccattgacattatcagccgcagggaacgctaaactgatctgccatactcattttgatgagcggggattagggtatttggcgctgggtctggcgaaggcgagtaaagaaccggttgccgttatcgtgacgtcaggaactgcggttgccaacctctatccctccttgattgaagccggtctgacaggtgagcagctggtatttctcactgccgacaggccaccggaattaattgattgtggtgcgaatcaggctattcgccagatcggtatttttgcctcccatcccactcaggcgctttcactgccgcggccgaccacagaaatttctgccagttggctggtctctgtcgttgataatggcatgtcgaacttaaaacaagggagcctgcatattaattgcccgtttgctgaacctttgtatggcaatgatgtgatcgcgtatcaagattggcaacaaacattgggagaatggtggcagggtaatcaaccgtggcttaggcagtcagaaacttatgttacatctacagtgcgggattggggtttgtggcagaacaagcggggcgttgtactgactggccggatgaatgcagaagaaggcccgctcgttgcacagtggtcaagaaaaatgggctggccactgatcagtgatgtgctgtcccaaactgggcaaccgttgccttgtgctgacttatggctgaatcatccccgtgttcaggaaattctggcacaggcgcaattggtgattcaattcggctccagcctgactggaaaaagactgttgcaatggcaggctgaatgtcagccggaagaattctggattgttgatccgattgtcggcaggcttgacccagctaatcaccaaggacggaaatttacttgttatgtggctgattggcttcgggaacattctgctgactccacgcaagagtctacttcttttggttgggcagatgaattgacttcatggtcagagcaagcacttgaatgtgtcaacgccagattagatggaaaatttggtgaggcggcagtggcgtatcaactgcatcgattactgccagaacaggggcagttgtttgtcggtaatagtttgattgtccgtctgattgatgcattggggcagctccccgcaggttatccggtttacagcaatcgtggtgcaagtggtattgatgggctgatcgcaacagccgcaggagtacaaagggcaacgaacaaaccgacgctggcaattatcggcgatctttcagcactctatgacttaaacagcctgactttgctgcgtgatctttccgcaccgatgatattgattgtcgtcaataacaatggcggtcagattttttcattactgcctacaccagaagaaacgcgtcagcgtttttactgtatgccgcagcatgtcaattttgatcacgctgcggctatgtttggtctgaattatgtgacgccccaaagttggtctgaattaaaacaacgtgttaaacaggcgtgggaacaaaaaacaacgacactgattgaattaaaagtcacagacagcgaaggcgtgagatgcttgcaagagttacggaaacaggtggctgcattgtga

SEQ ID NO: 238 - DNA, 885 bp, Xenorhabdus bovienii
  Coding sequence Name=Xb4151_4152.C401.gene8.dna; Position on contig =7847..8731bp; Strand=-
atgctgattttccgtcaaaattatcgatttttactggcaatatttatcctgctggtgagtttagctgctgatgtttatggcagtgagggaagttgccggattaaagatgaaaggaaacaacaggatttatctgccgtgtttcaaccgaaggtgtttatttccagaaacgatatgcctggagctgtgatttatcgacatccggttatttcaaacccacaagatatattggggattcattgcgataaaccagagaaaatatcatggaaatttattggctatacaccaaccagtagcagaaatgatgatacttatgattcaggcgtgtctgggataggcatacggatgtatggttctaatatagaactgattaagacaaaccccaaaacagggactggcccgattaaaaatgggatgattcaagcttatgtaggttctactattgtgcatacttatcatattcatgatgcactggtcacaactgaaagctgtattttggctaaagagaatattattgtccctatgggatcaatcgggatgtgggaattgtcaggtaatccgcgcactgcgggagcacaagatttcagtattgatctggattgtgacgacaatattcctattacgctaaaatttgagggaaatacagtgtcaaatgacaaccgtattttagcgcttgatcagagagggagtaactctacggccggaggaattggtcttcagattctgtatcaggatcaaccggtaatgataaattctgttttaaaggttggcaccagcccgatgggaatttactcggttcctttcaaagctcactatatacagatagaaaatatgatcaccgcaggtcaagccaacgccaccgcaaaggtatccatcatttataattaa

SEQ ID NO: 239 - DNA, 2550 bp, Xenorhabdus bovienii
  Coding sequence Name=Xb4151_4152.C401.gene9.dna; Position on contig =8753..11302bp; Strand=-
atgtcaaaaaatataaagcataatattgccaagagattatgcgaaggcaagtattatcgattatggctgtctatatttattatgatagggagtttttcttatcattttaaatcttatgctgaaaataatttcaacatccatgcgctgagaataggagataattttcctgatgatattgatctttctatttttaatacttccacgcaacctcctggtaaatattgggtcgatacctatttgaataaagaaagtattgatacgggtaatgttgaatttattttaaatgatggtgaactgcggccaaaactcactgtgcaaaaattgcaggatttaggggtgaaaatcaatgcttttccggtgttgatgaatttaccgtcagaagaggtgattactaatatcagcgagtatattccttcagccagcacgaagtttgattttaatcgacaacggctggatatcagcattcctcaaattgcgctgaatcatcaggtgagaggttatatttcgcctgagtcatgggatcagggaatgacggctttattggttaactaccattatagtgggtcaacaaactggcaggataatcggagaaccaatcagaacaattatttaaatctgcaaaccggcgttaattggcaggcatggcgtttgcgaaattattccacttataccagccagcacaaaaattggcggagtattaaatcttatcttcaacgtgatattcatgctctcaaaggacagttgatcgtcggtgatagtttcacgccttcttatctttttgatgggatagaatttcgcgggattcagcttgcttctgacgaaaatatgctgccggacagtatgaaaggttttgcaccggttgtaagcgggattgctcaaagtcatgctcaggtcacaatcaagcagaatggctatgtgatttatcagacctatgttgcacaggggccatttgtattaaccgatctttatccaaccaccaccagtgggaatttagaaatcattatcaaagaagcggatggccgggaacgtcgttttatacaaccgttttctgctgcacccattatgctgaggaaagatagcctgaaatattcgctgacaatgggacattatcgctcaccctacagccgcagtcgcaaaccttatttctttcaaggtactttgatctacgggcttcacaataatctcaccgcatatggtggtgtcatgttatcccgtgattatcaatctatggtgttaggttcaggaatcgatttgggcaatgtcggctcgctttcttttgatgctacccatgctaatacccaattgccatcagacaaaaaatcccaagggcaggcttaccgactacagtatttgaaagcgctttcactgacaggaacgaatttaactgtggcagggtatcgctattcgactaaaggtttttacgatttcgatgatgccaatcatgctgataacctcaatagcaaccatcggttgtttggccgtatcaataagaaaagcaaactacaagtgcaagttaatcaaatattgggggatttcggcggattgtatgtcacggcattccagcaggattactgggggcagagtagtcatgaacgtggtctcggtgcgggttataacatgagtcaccgtggtatcaattacggcttgaattatacctatagccgcactcccgactctggcaatcatgaccaattattctcattcagtgttcatgtgcctctcgaccgctggctgaaaaatagttgggccagttacagcctgacttcaggtaaaaacagccccgcttcgcaacaggtcagcctgaatggtacggtactggaggataataacctgcactacagcctgcaacagagttataccaatcaaggggatggcgtcagtggaaatatttatgccgggtataagggagcctatggtcggctcaatgccggttataactatcaacaccacggcaggcagatgaattacggtgtcagtgggggaattattgcacacccttacggtctgactttctcccaggaactgggcgaaacggcggtattggttcgagccgaaggcgcaaaaggcgtcaaggtagccaataatacgggcgttactactgacgggaacggctacgccgttgtaccttatgccagcagttaccgaaaaaaccgggtcgcacttgatcctcattcttttgctgatgatgttgatattgatatcaatacgcaatttgttgttccgacaaaaggtgcgcttactctggctaattttcagacacgaattggcagcagggtattgatgtttctttcataccaaggtcagtcagtgccttttggtgccattgctacgttggagaaacagcatgatctcgacaagcccagcagcacaattgtcagtagtgaagggcaagcctatttcacgggaatgccgacccgtggaaagttacaggttaaatggggctctcagaataccaaaacgtgtctagccaattataccttgccggaaaagcaaacattatcaggccatcctctatctggcattaatacaatgaaggtgaattgtgaataa

SEQ ID NO: 240 - DNA, 624 bp, Xenorhabdus bovienii
  Coding sequence Name=Xb4151_4152.C401.gene10.dna; Position on contig =11343..11966bp; Strand=-
atggcgggtggtgtggttattggaggaactcgtgttgtttacttaagtgataagaaagaggtttctgtatctgtcaataacttagagaaagaatctgtttaccttattcagagctggattcaggatgaaaatgagaaaacaaaaactccatttatcgtgacacctcctttatttaagttacccgcaaataacgaaaatattttgcggattattaaagtgagtgatggattgccaatggatagggagtctatattctggctgaatgtgacatctattcctgaaactgtaaaatcaaatgcagatgtcaatcagttacagattgttgttaactcgcgattaaaactattttaccgccctacacaactggaagaaaattcgggggaggcttataagcgtatcaagttcaggaaagaaaatggtgtattaattgcagagaattcgacaccttattttatttctttttcacatctaaaagtggacggaaaagaagtcgaaggggcgggaatggttaaccccttcagccaagcaaattggccattgcctgtcaaaaatgcgaaaagtgtcagctggaaagcaatcaatgattacggtggagtcacacaggaagaattcgcaggtctttag

SEQ ID NO: 241 - DNA, 522 bp, Xenorhabdus bovienii
  Coding sequence Name=Xb4151_4152.C401.gene11.dna; Position on contig =12114..12635bp; Strand=-
atgaaattcaagctgattatttcttctttatttgtatcttctttatttgctacaactgcaaatgcaactattggtacggttaactttaaaggtgaaataacggataaaacgtgtgaaattgatgccgcttctgcaaatcaaacggtgaatatgggtaaagttagtgttaaagaattttctggtgaaaataaagttgcggcagcaacaaaattcagtattaaattaactgaatgcccaaccgaaattaaaaatgcgcttgttaaatttgatggttcttctcatgaaagcaaaggcaaacttttagctctgacaacagacagcaaaaatgccaagggcgttgctatcggtatttatgaagataactcagacaatctggttggtttatataaagattctaaatcatatgcaattgaaaaaggggcagcagagttgccatttattgctaaatacgtagcgacgagtgacaatgtttccgcaggttcggctaatgcggtagcgcgttttactgtagtgtataactaa

SEQ ID NO: 242 - DNA, 279 bp, Xenorhabdus bovienii
  Coding sequence Name=Xb4151_4152.C401.gene12.dna; Position on contig =13514..13792bp; Strand=-
atgactgttacgatagaagtgacttgtcgatattgcgaccaagcagaacctgtacgcaaacacggaacaggtaaggccggcttccctcgctactattgcaaaggttgccaaagaacctttcaactcaactatcgttacaacggccataaaccggatatgaaagaaaaaattgtggatatggcaatgaatggctctggcgtgagagacacaggccgtgtattaggtctcggtatcaatacggtgatgcggacattaaaaaactctcgccaaaacaagtaa

SEQ ID NO: 243 - DNA, 375 bp, Xenorhabdus bovienii
  Coding sequence Name=Xb4151_4152.C401.gene13.dna; Position on contig =13934..14308bp; Strand=-
atgtacgattggtctggagctgttcctgctaaacttgaaaaaggccaacccacagggcttatcctcaaggcgggagatgttatatctattgttgctaagggatgggtgaagtatggccatccagacaactactgggcagcacctcagggtactttacctaaaaaaccgacgctacacgacacactcattgctaaaatcggtaataaaacctacggaatagggaatggtgtgcttcataaaacggttcctgaggatggggagttaatatttgtgttctttgactccccaggtaattacggtgataattctcgtgaattccttgttaatgtaaaaatagagtcacgctattctcctctcgaagaaataaaaaaataa

SEQ ID NO: 244 - DNA, 276 bp, Xenorhabdus bovienii
  Coding sequence Name=Xb4151_4152.C401.gene14.dna; Position on contig =14624..14899bp; Strand=+
atggccaaagttgatgtctattgccgttattgccacaaatcagaacaggtcaaaggacatgggaaaggaaatggcggacatcctcgttatcgctgttatagctgctgtaaggtctttcagttggcgtatacctatcaggcctgcaaacccggcgttaaagaacagattgtcgatatcgcgatgaataacgggggaattcgtgacaccgctcggatcctaaaagtcgccaccgccaccgtcatgaaaacattaaaaacctcagaccccgaaacgtaa

SEQ ID NO: 245 - DNA, 291 bp, Xenorhabdus bovienii; identical to SEQ ID NO: 155
  Coding sequence Name=Xb4151_4152.C401.gene15.dna; Position on contig =15028..15318bp; Strand=+

SEQ ID NO: 246 - DNA, 474 bp, Xenorhabdus bovienii
  Coding sequence Name=Xb4151_4152.C401.gene16.dna; Position on contig =15725..16198bp; Strand=+
atgcaaaacgttacgcttattggtattgatctcggcaaacattctttccacgttcactgtcaggacaaatcaggaaaggccctgctgcgtaaaaaatttacccgcgccagactgatggagtttttagcgggatcgccatcagcgactgttgtaatggaagcctgcgccggtgctcactttatggctcgccggatcgctgcttttggtcacgaagcgaagctgatttctccacaatttgttcgtccttttgtaaagagcaacaagaacgattttgtggatgctgaagccatatgcgaagctgcatctcgtccctccatgcgatttgtgcaaccacgaacagaggcgcaacaagctatgcgcgccctgcatcgggtcagagaatcactggtcagagacagggttaaaaccactaatcagatgcacgcttttttactggaatttggcatcagtatgccgatcggaaccgccgtataa

SEQ ID NO: 247 - DNA, 2583 bp, Xenorhabdus bovienii
  Coding sequence Name=Xb4151_4152.C402.gene1.dna; Position on contig =256..2838bp; Strand=-
atgcgtctggatcgtcttactaataaattccagcttgctctcgctgacgcgcaatctcttgcattagggcgtgataatcaattcatcgaaccgatccacttgatgagcgcattgcttcatcaagaggggggctctgttcgtcccttactaacattggcaggggttgatacgagtagcatcaacaatcaacttaaccaagccttaggtcgattaccgaaagtagagggtaatggtggtgatgtacaggtatccaatgagctggggcgttatttaaacttgtgtgacaaacttgcgcaaaaagcaggtgacaattttatttcttctgaactctttgttctggcggcaatagaagaacgtggaacattaagtgacatacttaaagctgtgggaacaaccaaagataaaatcgctaaggcaatagaacagatgcgtggtggtgagaaagtgagtgatcaaggtgctgaagatcagcgtcaggcactaaaaaaatacacaatcgatctaactgaacgtgccgaacagggcaaattagatcccgtgattgggcgcgatgaagaaattcgccggacaattcaggtattacagcgtagaactaaaaataaccctgttcttattggtgaaccgggtgttgggaaaaccgccatagttgaaggtctggcgcagcgtattattaatgctgaagttccagaggggctgaaaaacaaacgcgttctgtcccttgatatgggagcgctagtggcgggtgcgaaataccgtggtgaatttgaagaacgtttgaaaggtgttttgaacgatctcgccaaacaggaaggctcagtcattctgttcattgatgaattgcatacggtggtaggagcaggtaaggctgatggcgcaatggatgccggtaacatgcttaaacccgccttggctcggggtgaactacactgtgttggtgcgacgacactggatgaatatcgtcagtacattgaaaaagatgctgctttggaacgtcgtttccagaaagtgtatgtggcggagccaactgttgaagataccattgctatcctgcgtgggcttaaagaacgctatgaattgcatcaccatgtacaaattactgatccagcaattgttgctgctgcgactttgtctcatcgctatatttcagatcgtatgttgccagacaaagccatcgatctaattgatgaagcaggagcaagtttgcgtatgcaaatggattctaaaccagaagcactggatcgtttggagcgtcgggttattcagttaaagcttgaacagcaggcactgaaaaaagaatcggacgatggcagtaaaaaacgactcgaaatgttgaatatggagctggtggagaaagaacgcgaatattctgagctggaagaagagtggaaagccgaaaaagcagagctgactggcactcagaacattaaagcagaattagagaatacgcgccttgaattagaaaaagcccgtcgtagtggtgatctagcgaagatgtctgaaatccagtacggaaaaattccagaattggaaaaacgtttggcaacggcagcaacggcagcaacggcagaaagccatcatatgaaactgctgcgtaacaaagtaactgatgccgaaattgccgaaattcttgctcgctggacggggattcctgtatccagaatgttggagagtgaaaaagataaacttctgagcatggagcatgaattacataaacgtgtcatcgggcaaaatgaggctgttgaggctgtatctaatgcaattcgtcgtagccgtgcgggattatccgatccaaatcgtccgattggttcttttatgtttttggggccgacgggggtaggtaaaaccgaattgtgcaaagcgttggccaatttcctattcgacagtgatgatgcgatggtgcgcctagacatgtcggaatttatggaaaaacatactgtttcaagactggtgggggctcctcctggatatgttggatatgaagagggggggtatctgacagaagcggtgcgtcgtcgcccttattcagtgattttactggatgagatagaaaaagctcatcctgatgtcttcaacattctgttacaggtattggatgatggtcgtctgacggatggacagggaagaacggttgattttcgcaatactgttataattatgacctctaatctaggttcagatataattcaggaacgttttggtgcactggattatacgggaatgaaagatatggtgatggaagtagttggtcatcatttcagacctgaatttattaaccgtgtggatgaagtcgtcgtgttccatccattaggaaaagaacatctgacatccattgcgaatatccaattacaacgtttataccatcggttggaagagcgtggctatcaggttacgatgacatcgacagcattagagaaactgagtgatgctggttttgatcctgtatatggtgctcggccattaaaacgagccatccagcaagagatcgaaaaccctttggctcagaagatcctttcaggcaaactaattcccggaaaattggttactttagatctggaaaacgaccacataattgcaaaacaatga

SEQ ID NO: 248 - DNA, 732 bp, Xenorhabdus bovienii
  Coding sequence Name=Xb4151_4152.C402.gene2.dna; Position on contig =2969..3700bp; Strand=-
atgaccccactgatttttcctgattggccacagcttgataatgttggtgcttgcagcacaacccgcttaggtggagtaagcctaccgccttatgacagtttgaatctgggtaaccatgttggtgatgattcgaaatgtgtggagcggaacagaaaactgctggttgaatatgcccagttgccacaacaacctgtctggttggaacaggtacacggaactcgagttatcaatctggatggtcagccagtgaaagataatcaggctgatgctgtttacacgaatatacccgggcaggtttgtgctgtcatgacagcagattgcctgcctgttcttttctgcaccattgcggggaatgaaattgcagcggcgcatgcgggatggcgtgggttatgtacaggggttctagaaaatactgtgactcaatttagcgcaaaacctgaaatgatccgcgcatggttagggccagccattggccctgaaaaatttgaggtgggtcgtgaagttatggatgcgtttgttgtaaccaatcctgagctagaacaagcctttacaccttatggtaataaatttttggcaaatatctatttactggctaaattgaagttgcagtctattggtataaatgaagtttttggaggggctgtttgtactgccactgaggaaagaaactttttctcctatcgccgtgatggtaacactggacgtatggcaactttaatctggctgagataa

SEQ ID NO: 249 - DNA, 978 bp, Xenorhabdus bovienii
  Coding sequence Name=Xb4151_4152.C402.gene3.dna; Position on contig =3705..4682bp; Strand=-
atggcacaaaaaatacgacttaatgcaacagtcgctgaaacacagctcggtcaacgtttagatcaggctttggctgaattgttctctgattattcaagatcccgtataaaagaatggattttggataataaagttcaggttaatggtaaattgatcaataagccaaaagaaaaagtactgggcggtgaagtaatttccattgatgccatcattgaagaagatgcgcgttgggaaccacaagatatcgagttgaatattgtttatgaagatgatgatattctagtgattaacaaaccgcgtgatttggttgtacatcctggagcaggtaatcctgatggtactgtactgaatgccttgttatatcgctatcctgcaattgcagatgtcccccgcgctggtattgtacaccgtctcgataaagatacgactggattgatggttatcgcaaaaaccgttccagcgcaaacccgcttggtggaatccctacaactgcgtgaaattacccgtgaatatgaagcgatcgccttgggatgcatgacagcagggggaatggtagaagaacctatatcccgccatccgacaaaacggacacacatggcagtgcatcctatgggaaaatcggcagttacccattatcgggttatggaacatttccgggcacatactcgtctgcgtctgcgactggaaactggcaggacacatcagatccgtgtccatatggcacatatcaagcatcctctggttggtgatcctttatacggtggccgtcctcgtccgttaaaaggtgcttcagacgaatttcgcgaagtgatgcgcaactttgatcgtcaggcattgcatgccaccatgctacgactttaccatcccatttctggtattgagatggaatggcatgcagaattaccagatgatatggttaaattgattgatgtgatgaaagcggatgctgaaactttcaaagatgagatggactggtag

SEQ ID NO: 250 - DNA, 735 bp, Xenorhabdus bovienii
  Coding sequence Name=Xb4151_4152.C402.gene4.dna; Position on contig =4818..5552bp; Strand=+
gtgatgattcgcatgaaatatctggtggcagcagccacattgagtatggttttatctggatgctccaacaataaggatgctgttcctgatatcccgcaatctcaaatttactcagccgggcaaaaacacctgcaagaaggtaactataaaggggctatcaaacaattggaatcccttgataaccgttatccttttggaccgtactcccaacagactcagcttgatttgatttatgcctattacaaatcagcagaattcccaatggctctcgcatccattgaccgtttcatgcgtctgaacccaacccatccgaatatcgactatgtgatatacttgcgtgctctgatatctcaagccttggatgacaatactctgcaaagcttttttggcatagatcgttcagatcgagatcctgaacatgcccgtgcctcattccgtgatttcaacctgctagtcagccgttatcctaacagtcagtatacgtccgatgctgccaagcgtttagtcttcctcaaagaacgtttggccaaatatgaacttgcggttgtaaaatattacactaaacgcagcgcttatgtggccgttgtcagtcgagttgaacagatgttacgggattatcctgatactcaagcgacccgagaagcacttccttacatggaagcttcctataaggaattgggtctgatggctgaagcagataaagtggcaaaattaattgcggctaacccagtataa

SEQ ID NO: 251 - DNA, 333 bp, Xenorhabdus bovienii
  Coding sequence Name=Xb4151_4152.C402.gene5.dna; Position on contig =5918..6250bp; Strand=+
atgttagtgaacatcaccagcaaacaaatggaaattacccccgcaattcgtagccacatagaagaccgtctaaacaagttgaacaaatggcaagtcaacctaattagtccacatatcgtactcacaaaagaaccacaggggttcttagctgatgccacaataggtataccaaacaatacattagttgctagtgcaaaacatgaggatatgtacgctgccatcaacgaactactaacaaaattagagcgtcaactcaataaagtgcagcataagggagaagcacgccgtgcagatcacagcgttaaagactccaactttgacatagaagtttaa

SEQ ID NO: 252 - DNA, 1155 bp, Xenorhabdus bovienii
  Coding sequence Name=Xb4151_4152.C402.gene6.dna; Position on contig =6556..7710bp; Strand=+
atggaacgaaatttagttaatatacgagaagaaatcagcagtattgatgcagatttactggacctgcttgggaaacgtcggcaattagcctgtgatattgcgcagactaaacttctcgaacatcgccctgttcgagataaagaccgtgagcgagaactacttaatgtgttaattaataaaggcaaaattcatggtctagatgggttctatattacccgcctgtttcaaatgatcattgaagattcagtattaacccagcaagcgttgcttcaacagcatctgaaccagacaccttacgactctgcacgcattacttttctagggccaaaaggttcctattcccacattgcagcccgtcaattttcggcgcgccatttcaatcagttgattgaatgtagttgtcacaaattcccagatattttttcgctggttgagattggtcaagcagattatggcatcctgcctctcgaaaataccagttctggagcaataaatgatgtttatgatttattacagcagacaccattattccttgttggggagataaccctgccaataaatcactgtttattgattggtaccgagactgatacgtcaaaaataaaaacagtttatagccattctcaacctttccagcaatgcaaccaatatctcaatcaatttcctcattggaagattgtctattgtgaaagcacggctgctgccatgcagaaagtagcagggctcaactcgtcagaagtggcagcgttaggtagtgaagcagggggggcactctataaattacgagttttggaaaacaatttggcaaatcagcaaaataatagtactcgctttattgttgttgccaaaaaacccattgatgtgtcaaatcaggttcctgccaaaaccacgtttatcatgtcaacaggacagcaggctggtgctctggtcgatacgcttattatcttgaaaaaacacgatattataatgagtaagttggaatcacgtcccataaacggcaaaccgtgggaagagatgttttatattgatgtacaagccaatcttcgctccatgaagatgcaacaggcacttaaagaattgtcagaaatcacccggttcttgaaagtcttgggatgttatccctcagaaaatgtgacttctatcgatccctgttaa

SEQ ID NO: 253 - DNA, 1122 bp, Xenorhabdus bovienii
  Coding sequence Name=Xb4151_4152.C402.gene7.dna; Position on contig =7768..8889bp; Strand=-
atggtagcaaaattatcacaattgcgggaacaaattgatgaggcagataaagcattattggcgttactggcgaagcgaatgtatttagtggcagaagttggcgaaattaagagtcaactgggtttgccgatttacgtaccagaaagggaagcgtccatgctggcttcccgccgccaagaagctgaagctatgggaattccgccagatttaattgaagatattttgcggcgcattatgcgagagtcctacgtaagtgagaacgataaaggattcaaaaaactcagtacccatctgatgccagtggttattattggtggctcagggaaaatggggagactgtttagccgcttgctgactttatctggctacgaagttcgggttcttgagtcaggagattgggataaggctgaacatatactggcagatgcagggatggtaatcgtcagtgtgccgattcatctgacagaagaggttatccgccgtttacctcctttgccggaacagtgtgttttggttgatttggcctctattaaacaaaggccgttaaaggcgatgcttgatgttcatcaaggccctgttttagggttgcatcctatgtttggatccgatgtgggcagttttgccaaacaggttgtcgtgtattgtgatgggcgtcagcccgaagcataccaatggtttttggaacaaatatcagtatggggtgcgcgattacatcaaattagcgcagagcagcacgacaaaaatatgagtttcattcaagcgctacgtcatttcactactttttcttatggtcggcatcttgcaaaagaggatatcgatttgcagcaactgatatcactatcctccccaatctatcgattggaattggctatggttggtcgattatttgcccaagatcctcagttatatgccgatatcattatgtccagtcctgaaaatattgagctgatccgccgttatcaccagagttttggacaggcgattgaaatgctggaaagtcaggataagtcggcttttattgcgaattttaaccaagtgaatgagtggtttggtgatgaagccactcgatttatgaaagagagtcagtctcttttgcagcaggcgagtgatagccggatatag

SEQ ID NO: 254 - DNA, 1095 bp, Xenorhabdus bovienii
  Coding sequence Name=Xb4151_4152.C402.gene8.dna; Position on contig =8895..9989bp; Strand=-
atgatcatgcaaaaaggtgcacttaataacattcatattcttggtgaacagatttttatcacacctgaggaactgaaacagaaatacccattgagtcgcaacgatctgcataccatcacaaatgcccgtaataccatcgctgatattattcagcaccgtgatcctcgtttgttagtggtgtgtggcccctgctcaattcatgatgtggacgctgccctcgattatgcccgtcgcctgaaagtactttctgctgaattaagtgattgcctgtatattgttatgcgtgtctattttgaaaaaccccgtacgacagttggttggaaaggcttaatcagtgatccccatatggatggttcgtttgatatagatgctgggctgcatattgcccgcagtttattaatgaatttagttaaaatgggattaccactggccaatgaagcactagatattaataatcctcaatacttgggagacctattcagttggtcagctatcggggcgagaacgacagaatcacaaactcaccgcgaaatggcatcgggattgtctgtctccgttggattcaaaaatgggactgatggtaatttgaatactgcaattaacgccatgaaagcggctgccatgccacattgcttcatgggaataagtcagtcagggcaagtctgtctgctacaaactcaaggtaacccaaatgggcatgttatcctgcgtggtggtgctgaaccgaattacagttctgagcatgttgctgactgcgaaaaccaaatgatcaaggcaggtttaacgccatcgttaatgattgattgcagccatggtaattccaataaagattttcgtcgtcagagcatcgtagtggattctgttgctgaacagattatgtctggaaatcgatctatcattggtattatgttggaaagcaacattcacgaaggaaatcagccttcagaacagcttcgttctgagatgaaatatggtgtttcagtgactgatgcctgtattaactggcaaaccacggagcaggtattaagaaaattacaccaacaaatagccccacgttttgcaaaacgtaacatgatgatggaaaaagcaggataa

SEQ ID NO: 255 - DNA, 354 bp, Xenorhabdus bovienii
  Coding sequence Name=Xb4151_4152.C402.gene9.dna; Position on contig =11097..11450bp; Strand=-
atgagcaacattattaaacaaattgaacaagagcagatgaagcaagacgtaccttcattccgtccgggtgacaccgtagaagttaaggtatgggtcgttgaaggttctaaaaagcgtctgcagacattcgagggtgtggttattgcaattcgtaaccgcggtctgcattctgcattcactgttcgtaagatttctaacggcgaaggagttgagcgtgtattccagactcactcccctgtcgtagacagcatcagtgttaaacgtcgtggtgccgttcgtaaagctaaactgtattacctgcgtgagcgttctggtaaggcggctcgtattaaagagcgtcttaacgctagataa

SEQ ID NO: 256 - DNA, 753 bp, Xenorhabdus bovienii
  Coding sequence Name=Xb4151_4152.C402.gene10.dna; Position on contig =11515..12267bp; Strand=-
atgtggattggggttattagcctgtttcctgaaatgttccgcgcaataaccgattacggggtaactggtcgggctgtaaaaaatggcctgttgagtattgaatgctggagtcctagggattttacctacgataggcatcgtaccgttgataatcgtccttatggcggtggtccaggaatgctaatgatggtgcaaccgttacgggaagccatccatgcagccaaagcagcggcaggcgttaatgcaaaggtgatttacctttcaccacaggggcgcaaactcgatcaacagggagtttgtgagctggcagaaaatgagaaattgattcttgtttgtggccgttatgaaggtattgatgagcgtgttatccaaaccgaaattgacgaagaatggtctatcggggattacgttctcagcgggggagaacttcctgcaatgacgatgattgactctatatctcggtttattccgggagtattggggcatcaggcatcggcagaagaagactcgtttgctgatggattattggattgtccacattatacccgccctgaggtgttagatgggatggaagttccccctgttttattgtcgggaaaccatgccgaaattaatcgctggcgaatgaaacaatcgcttggccgaacttggttaagaaggcccgaacttctagaaagcctagctctgactgacgagcagaggatgttgctgtctgaattccaacaggaatatcaggatcaggcaacgagttaa

SEQ ID NO: 257 - DNA, 549 bp, Xenorhabdus bovienii
  Coding sequence Name=Xb4151_4152.C402.gene11.dna; Position on contig =12305..12853bp; Strand=-
atgagcaagcaaacgggcctggagccgcctgttgatccaatagtgttggggaaattgggttccacatatggcattcgtggttggctcagagtgttttcttccaccgaacgtaccgaagacatttttgaatatcaaccgtggtttattcagcgttcaggccagtggcaacatgttgagctggaaacgtggaaataccacaatcaggatctgatcatcaaaatcaaagatattgatgatcgggatgctgcgaatttattcactaactgtgaagtggtggtggattctaccaaattaccagaactggaaaccggtgattattactggaaagaccttatgggttgtcaggtaataagtattgcaggttataaccttggaactatcaacgacatgatggaaacaggttctaacgatgtgatggtaataaaagcaaacctgaaagatgcattcggtatcaaggaacggttagttccgtttcttgatgggcaggttatcaagaaagtcgatctcgctactaaaactattgaagtagattgggatcctagtttttaa

SEQ ID NO: 258 - DNA, 258 bp, Xenorhabdus bovienii
  Coding sequence Name=Xb4151_4152.C402.gene12.dna; Position on contig =12872..13129bp; Strand=-
atggtaacaattcgtttagctcgtggcggcgcaaaaaagcgtccgttttatcaagtagtcgtgactgatagccgtaatgcgcgtgatggtcgtttcattgaacgcgttggtttcttcaatccgatcgcatcagggcaagcagaagctctgcgtttagatctggatcgtatcgaacattgggttggtctgggtgcatctgtgtctgatcgtgtttctgcactgatcaaagatgctaaaaaatcagctaaagcagcttaa

SEQ ID NO: 259 - DNA, 1362 bp, Xenorhabdus bovienii
  Coding sequence Name=Xb4151_4152.C402.gene13.dna; Position on contig =13268..14629bp; Strand=-
atgtttgataatttaactgacagactatcgcgcacattgcgcaatatcagtggccgcggacggctgactgaagataatattaaagatacattgcgtgaagttcgcatggctttgctcgaagcagatgttgcattgcctgtcgtgcgtgattttatttcacgaatcaaagagaatgccgtagggcatgaagttaacaaaagtctgactccaggacaggaattcgtcaaaatcgttcagaatgaattggttaaggcgatgggagaggtaaacagtgagttgaacctttctgcacagccacctgctgtagtcctgatggcgggtttgcaaggcgcgggtaaaacaaccagcgttgcaaaattgggcaaactgctcaaagaaaaaaataagaaaaaagtactggtcgtttctgttgacgtatatcgtccagcagcgatcaaacagcttgaaacactatctgaagctgttgatattgatttttttccttcagatccacaggaaaaaccagttgatatcgccaataaggctatccagcacgccaaactgaaattctatgatgtgctgttggtcgatactgcaggtcgtctgcatgttgatgaagcaatgatggacgaaattaaagcggttcatgcggccatcaaccctgttgaaactttatttgttgttgatgcaatgactgggcaggatgcagcaaatacggcgaaagcatttaatgaagcattgccattgacaggggttgttctgaccaaagttgatggtgatgctcgcggtggtgctgcgctttccattcgtcatattactggaaaaccaattaaattccttggggttggtgaaaaaacagacgcattggagcctttccatccagatcgcattgcatcccgtattctgggtatgggagatgtgctttcattgattgaggaaattgaaagcaaagttgaccgaacccaagcagagaaactcgcatcaaaactgaaaaaaggtgatggttttgatttaaatgacttccttgatcagctcaagcaaatgcgcaatatgggtggtatgaccagtatgttgagcaaaatgccgggcatgtcgcagatccctgatgccgtcaagtcccaaatggatgacaaagttctggtgaaaatggaagccattatcaattcaatgacccgtaaagagcgtgaaaaaccggagattatcaaaggttcccgcaaacgtcggattgcgtcagggtctggtactcaggtgcaggatgttaaccgtttgctgaaacagtttgatgaaatgcaacgtatgatgaaaaagatgaagaaaggtggtttagccaaaatgatgaaaggcatgaaaggcatgctgccacctggctttatggggcgataa

SEQ ID NO: 260 - DNA, 394 bp, Xenorhabdus bovienii
  unsure (1)..(394): unsure at all n locations
  Coding sequence Name=Xb4151_4152.C402.gene14.dna; Position on contig =14818..15211bp; Strand=+
atgccagtattttcaattattgctttacttgcttatctcattagcctgatgctcattgtgccgggtttattgcggcaacaaaacagttatcaaaagctggctctgcttttctctattatggccctgattaatcatgcgattgcattgaaatatcagatttttcatgtcagcagcggccaaaatctcacgttgttaaatttaggctcgattgtcagcttactcatgagcaccattatgactgtcgtggctttccgtggtcgggcatggtttctgcaacccatcgtttacagtttcgccatgacaaatttaatgctggccagtatggtgccaggagcgttcattacccatggggatctnctagagtcgaacctgcgagtctatgnaacgntagtcg

SEQ ID NO: 261 - DNA, 694 bp, Xenorhabdus bovienii
  Coding sequence Name=Xb4151_4152.C403.gene1.dna; Position on contig =1..694bp; Strand=-
gtgacaaataaatattttcttaccggaaccgacaccgaagtcggtaaaactgtcgtcagttgcgcgttgctgcaagcagcaaataagcaaggatatcaaaccgcaggttacaaacccgtggcatcgggcagtgagatcacctcagaaggaatacgcaatggagatgcactggccttacggcgcaacagttccgtgtctttgacttatcaagaagtcaacccactggtatttgttgagccgacatctccccatattgtgagtgccgcacttaatcagccgattgagtttgaggtgatatcacagggtttggaaagattgacggcaaaatctgattggattttggttgaaggtgcaggcggttggtatacacctttgtcggaaaataccacttttgctgattgggtgattcaggaagaactgcctgtgattttgacagtgggagtcaaactgggatgtattaaccatgcggtattgacggcaaaagcgattcaacattctggactgaggttggccggttggattgccaatgaaattgaacccgcgggtaaacgtcagacagaatatttggcgacgttggaacggatgatccccgcacctttattagggattatcccccacttaagcgaatcgagtgataacaataatatcggagaatatataatattatttttggtaactattgttactggcacag

SEQ ID NO: 262 - DNA, 774 bp, Xenorhabdus bovienii
  unsure (1)..(774): unsure at all n locations
  Coding sequence Name=Xb4151_4152.C403.gene2.dna; Position on contig =684..1457bp; Strand=-
atggatctggctgttaaggccgttgacaagcaggcgattgcaggcgcttttgggcgcgccgcttctcgttacgatacggctgctaaattgcaacagcaaacaggtgaatacctgatggaactggcgcaggcagaaaatctcggtattcgggtattggatgcaggctgtggaacggggtttttcagtgcgcgctggaagcagcagggtaagcaggttatcgcactggatttggcttctggtatgttaaatcatgcgcaggagcagcaagttgccgatcactacctgcaaggggatattgagcacttggggctggcggataatagtgtagatatctgtttcagtaatttggctgtgcagtggtgtaatgaactgccatgtgcactgcaagaattctatcgggttacccgtcccggtggcctcattttattctccactcttgtgcaaggttcactgtgcgagctggaagcggcgtggggtcaagttgacacgtatcggcatatcaaccaattcctgcccttacaagccatcactgacgcgtgccaagcctatcggcacaagataataagccaacaatattgccaatattacccgcaactgctgtctttgctgaactcgctgaaaggaataggggctacgcaccttcatcatggtcgccaacatggacttatgaccagaaaacgcctgaacactctggctgaagcgtatccacggaataatgaggattacccattaagtantcagattgcttttgaagttatttactgtgacaaataa

SEQ ID NO: 263 - DNA, 1152 bp, Xenorhabdus bovienii
  Coding sequence Name=Xb4151_4152.C403.gene3.dna; Position on contig =1441..2592bp; Strand=-
atgaactggtcagacacgatttcccgacgattgaccgaacgtcggggaacatctctatggcgtagcagacaagtccatctgggttcagatgggcgtttattacacacttcagacggtcaatacctgaacttttccagcaacgactatcttgggctgagtcagcatccccagattattgctgcctggcagcagggagctgaacaatacggcgtaggcagtggaggttcggggcacgttacaggttacaccgccgttcaccacacattggaacagcaattagcggaatggttgggttattcccgcgccttactattcatttctggctatgcggccaatcaaggtgtgatagcggctttgatggaaaaagacgaccgggttattgctgatcgcctgagccatgcttcgctgatagaagccgccatgcactctcccgcacagtttcgacgttttctgcataacgacccaaattccctgaagcagaatctggcaaaagattgtgcgggtaaaactctggtagtgacggaaggtatttttagcatggatggggattgtgcgccgcttgcatcccttgctcagcaaacaaaatctacgggcagttggttgatggtagatgatgcccacggcatcgggattcacggtgaacaagggcggggcagttgctgggcgcagaatgtcaaacccgaaattttgattgtcacctttggtaaggcgttcggattgagtggggcggcggtactgtgtgatgaacaaaccgcagaatacctgatccagtatgccagacacttaatttacagcacctccatgccacccgcacaggcggtggcactgtctgaagcggtacggcaaattaaggaaggagatgaattacgtcagcgattacaaaacaacatcagatattttcgccgcgaagcacatcatttgccttttaccctgatggattcagagacggccattcagcctttgatcattggtgacaatgaacgctgtattgccctatcccatacgctaagacagcaaaaagtgtgggtaaaaccaattctcccgccaacggttccactggaaagtgcccgcctgcgcatcacactgacggcgagccatacacaacaggatattgagatattactggaggcgttgcatggatctggctgttaa

SEQ ID NO: 264 - DNA, 1041 bp, Xenorhabdus bovienii
  Coding sequence Name=Xb4151_4152.C403.gene4.dna; Position on contig =2592..3632bp; Strand=-
gtgagtgagcgtcagcaatggacggtcaaacaggctcaggctttgtttgatcaaccttttttcgaattgttatttcaggcacagcaggtacaccgtgaacattttgatccgcaacaagtacaggtcagtacgcttctttcaataaaaaccggcgcctgtccagaagactgcaaatattgtccgcaaagctcccgttacaaaacaggcttggaaaaagagcggttgatggaagttgagcaagtcatcgaatctgcgcgcaaggccaaaaatgccggttcaacccgtttctgcatgggagcagcatggaagaacccccacgagcgtgatatgccgtatctggagacaatggtcaaggaagttaaagaattaggtatggaaacctgtatgactctggggatgttgaatcaaactcaggcacagcgtctggcagaggctggtttagactattataaccataacctggacacctctccggaattttacggcaatgtcatcaccactcgcagctatcaggatcggttgaatacgttgggaaatgtcagggatgcgggcatcaaagtctgttctggtggcatcgtcggtctgggagaacaaatccgtgaccgtgcggctctgctggtgcaactggcgaatttgccgaagccaccggaaagtgtgcctattaatatgctggtgaaagtaaagggaaccccgttggaaaacaacgatgatgttgatcctttcgactttattcgcaccattgctgtggctcggatcatgatgccagcatcccatgttcgtttatccgcaggacgtgagcagatgaatgagcagacgcaagcgatgtgctttatggcgggtgctaactccattttttacggctgcaaattactgaccacgccaaacccgaatgaagacaaagatctgcaactgttccgcagactgggcatcaatcctcaacagactcagacagcatttggtgacaatcaacagcagcagaatctgactgaagccatcatcaataatgttgattacgaacaattctataatgcggcagtataa

SEQ ID NO: 265 - DNA, 1269 bp, Xenorhabdus bovienii
  Coding sequence Name=Xb4151_4152.C403.gene5.dna; Position on contig =3730..4998bp; Strand=+
atgaatccttccgatcttgaatttgacctacgccatatctggcacccatatacatcaatgacccatccactccccacttatcctgtggtttcagccgccggagttgaactggagctgtcagatggccgcaggctgatcgatggcatgtcttcatggtgggcggcgatccacggttataatcatcctgtgctcaatgaagcagcaaagtcgcagattgacaggatgtctcatgtgatgtttggcggtatcatccatcctcccgccattgaattatgtcagcaattagtcgcaatgacgcctgccgcactggagtgtgtttttctggcggattcaggatctgtcgctgtagaggttgccttgaaaatggcgctgcaatactggcaagccaaaggagaaaaacgccacagattcctgaccctgcgtcatggctatcatggtgatactttcggtgccatgtctgtctgtgatcccgacaattcgatgcataacctgtataaaggttatctccctaatcatctgtttgctgatgcaccacaatctcggtttgagggtgagtggcaacctgaggatatcacttcgttccggcagttattgctccaacaccacaatgaaatcgcggctgtcgttctggaaccgattgtgcagggcgcaggtgggatgcgtatttatcatcctgaatatctgcgtcaggttcgtaaactgtgtgatgaataccagatcttgctgattgccgatgaaatcgccactggatttgggcgaacgggcaaactattcgcctgcgagcatgcacagatcgagccggatattttgtgtctgggcaaggccttgacgggcggttatatgacattatcggcaacattagccactcgccatgtagctgaaactatcagtcaaggcgaagccggctgttttatgcacggcccgacgtttatgggaaatcctctggcttgcgccgttgccagcgccaatctgaaattgctctctgatagtcagtggcaaccgcgcattcaatccattgaggctcagttaaaagtagaattgctccctttgaaatcacacactaccgtcaaagatgttcgggtattgggtgcgattggggtcgtagagatgaaacagcccgttgatatggcttcgctacagcgccgctttgtacagcatggtgtctggatcaggccatttggccggttaatttatttaatgccaccttacattattcggtctgagcaattatctaaactgacaaatgcaattaatgatgtaataatttaa

SEQ ID NO: 266 - DNA, 573 bp, Xenorhabdus bovienii
  Coding sequence Name=Xb4151_4152.C403.gene6.dna; Position on contig =5222..5794bp; Strand=+
atgagcgacgaaaaatcaattatgccttctaacgaagaaatgcaagctacattttcattatctaaggagatgcatgaaaaggaaatatcacaccactcaactgttgcaagagaaatacctgagttagcccatttgtttgtaaaaaatcccaacgtgatttcatcaacgggttatggtgctggtctgatagaatatattagtggaagttttaatcttaatacattccaacaatatggaagttatccttttatccaaatatcatcccattcggctataattgggtatgcgccaaatgttggtcagcgggttaaatttaatggatatgttaatgccgggcatattattccaattattaattggaataatttttatttcgcaggcacagtacataatgttagatctattataaacgtacaactgaccatccaactttacattaatcaacagaatattttcatccgtctttttgatggaaatatttatttgggcgatttagtttctgtatatagacctaatgcaattattcctgtacctatggtaatatcaggcgttggttcatttagtttaatatga

SEQ ID NO: 267 - DNA, 987 bp, Xenorhabdus bovienii
  Coding sequence Name=Xb4151_4152.C403.gene7.dna; Position on contig =5923..6909bp; Strand=-
atgaaacaggtggtttatacagccagccctaatagtagtcagattcacgtatggtcgctgaatattgtaggggaactctcacttctccagacagtgaatgtgcctggcgaagtgcagccaatggtggttaaccctgatggcaaacacttatatgtgggaattcgccctcagttcagtatcgtcacttatgcaatcgggttcgatggacggctcgaacagcaggccattgcgccgttgccgggtagccctacgcatatttctacggatagagcggggcgttttttatattctgcttcctatggtttcaacaaactcagtgttcaccctattgatgaaaacggcattgtcaaagcacctgtccagatcgtggaaggcctgcaagcaccccattctgccaatattgatcgggaaaaccgccagttactggttccatgcctgaaagaagatcacatccgcattttcaatttggatgagcagggttatctgatagaaaaccgggcggatgaaatcagtacagtagcaggagcaggcccacgtcatatggtttttcatcctgaaaaatcggcgatttattgtatcaatgagctagatgcgactgtagatgttctgcgtaaatgggacaaataccgcattgtgcaatctgttgattcattaatggctgatttttctagtgttcgctggtctgcggatatccacatgacaccggatggtcgccacctttatacctgtgagcgttcagagagcctgatcagccatttccgcgtttcagaagatggctatcacctgacattagttggaaattatccgacagaaagtcagcctcgtggttttgcgattgaccacagcggcagcttcctgattgcctcagggcagaaatcagatcatatttcagtgtcacgtattgataaatattctggaaaattaacgcaattagcacgttatccagtgggcaaaggcccgatgtgggtgacggtgctggcattgtaa

SEQ ID NO: 268 - DNA, 816 bp, Xenorhabdus bovienii
  Coding sequence Name=Xb4151_4152.C403.gene8.dna; Position on contig =7057..7872bp; Strand=+
atgtcatatcgcgttatcgcgctggatctcgacggcacagtgcttgatccacaaaaacgtattttgccagaatcactagctgccctgaatgaagcccgtcaagctggtgttaaggttttgattgtcactggccgccatcatgtcgctatccatccgttctatcaagcactacaactcgatactccggctatttgctgcaatgggacttattcatatgattaccatgcaaagaaagttctggattccaaccccctttccacccaagaagccgttcaggtgctttcttatttgcaaggaacggaaattcagcatctgatgtatgtcgatgatgccattttatatcaatttcatgacactatatcacgcacgctggcatggtctgattctctgcctgaacatcaacgccccaatctccagcaggtcaatagctttcaagacgccatctataatgtgaattgcatttggaaatttgccaccagctccccaaatgtggtgaaactgcgtgaaatcagtgaacagattgaggaaaaagtcggtcttgagtgcgaatggtcgtgggttgatcaagtggatattaccaaaaaaggcaatagcaaggggatgcgcttgaagcaatgggttgagtcacaaggcatatccatgaaagaagtgattgctttcggtgataattttaatgatatcagcatgctggaaacggctggtttgggcgttgctatggaaaatgcggctgacgcagtcaaagagcatgccgatattgttacgcgggataatacccagcctggcatcgctgaagtgattcgaaaatacgtgctttaa

SEQ ID NO: 269 - DNA, 1152 bp, Xenorhabdus bovienii
  Coding sequence Name=Xb4151_4152.C403.gene9.dna; Position on contig =7937..9088bp; Strand=-
atgtgtgattgcgatcgtgctggcattggtttcattgatgctttccgagtggctgacccgttggggcagaaaacgtctgggggcagcatgttagagctggagtttgagcaacgtctgggtaacctgcacatgcaggtcgataccactctgccaacagaaagcattacggctatatttgggctttccggcgcgggcaaaacgtctctgatcaatgttattgccgggttgagcaggccacagagaggccggattgtcctgaatggccgcactttggtggatatagagcagaaaatctttctgccgccggaaaaacgccggatgggttatgtttttcaggatgcccgcctttttcctcattattgcgttaagggcaacctgcaatacggtatgtcgccagacatgaaaccacagtttgacaacatcattggcttactgggcattgaacacttactgtcacgttttcccatgaccttatccggcggggaaaagcagcgggtagcgattggacgggcattactgaccgcgcccgaaatcttgctgatggatgagccgctggcttcgctggatttaccccgcaagcgtgaattactgccgtatctcgaaaaactgtccgccgatgtcaaaattccgctcctgtatgtcagccacaatttggatgaaattctgcgattggcagataacgtgattgtaatggacaaggggaaagtcagagcgacaggcacattggaagaagtctggtcaaacagcatattacgcccgtggctgcaaaaagagagccttagcagcatactgaccgtctctgtcatggagcatcatcagcgttatcatatgacagcggtggcggtaggagataaagctctctggttgcctaaaatggatgcggctccgggtacagatctgcgtattcgtgttgatgcatcggacgtttctctcgttttggaacccccgaaagtcagtagtattcgtaataccttgcaggttaaagtcattgaatttttcgaagatgatggtcaggttgatgtcaagctggcattgcgtgaatatttcctatgggcgagaattacctcttgggcgcgggaagaacttaacctgcggtcaggtcaatggctgtatgcgcaaataaaaagcgtttcgctgaatcaacctttataa

SEQ ID NO: 270 - DNA, 699 bp, Xenorhabdus bovienii
  Coding sequence Name=Xb4151_4152.C403.gene10.dna; Position on contig =8995..9693bp; Strand=-
ttggagatgttaagtgaatatgaatggcaggcgattttactgagtttaaaaatctcaggtatctcggtgttattcagtttgccattagggatattgatggcatgggttctggctcgctgccagtttttcgggaaatccctgctggatagcattatccatctgccgctggtattaccgccagtggttgtaggatatctgctgctgctcagcatggggcgccgtggtgtcatcggcgaatttctttatgattggtttggcatcagcttcgcatttagttggacgggagcggcgttggcttcggcagtcgtggcttttcccttgatggtcagagcgatccggctggcgctggaaagcattgatcgtcgtctggaacaggcagcgcgtacattgggagctagttcgcttaaggtctttttcaccattaccctgccactttcattgccgggtgtgattgtcggtgctgttctggcttttgcccgttctctgggggaatttggtgcaacaattacgtttgtatcgaatattccgggggaaactcgcaccattccccttgccatgtacacattgattgaaacgccgggcgcagaaacggcagcggcgcgtttatgtgtgattgcgatcgtgctggcattggtttcattgatgctttccgagtggctgacccgttggggcagaaaacgtctgggggcagcatgttag

SEQ ID NO: 271 - DNA, 771 bp, Xenorhabdus bovienii
  Coding sequence Name=Xb4151_4152.C403.gene11.dna; Position on contig =9705..10475bp; Strand=-
atgaaaaagagcctgtaccaattgttgacaggggctgtggtttattttgcgctggttgggaatagctggagtgcagaaaaagtgaccgtttttgcggcagcgtcattgaccaatgcacttaacgatattgccgttcagtacaaaaaagaacaacagggtgacattgttgcctcttatgcctcatcgtcaacactggcacgtcagattgagcatggcgcccccgctgatatctttgtttctgctgatcagcaatggatggactatgtcgcaggcaaaaaactgattgctgacaatactcgtcatactttgttaggtaatcaacttgtcttgattgcacccaaagagagcaagctggataaaatcgacatcgatcgagaaacaaaatggaaatctctgctggcagatgggcgtctggctgtaggtgatcccgatcatgtccctgtcggcatttatgccaaagagtcgctgcaatctctgggagcatgggaagtggtcaatccactgatggcacgtactaacaatgtacgtagtggtatggcgctggtagagcgggcagaagtaccgttgggaattgtctatggttctgatgccgttgccagcaagaaagtgaaagtagtcggtatattcccatcagagagtcataaaccagtggaatatcctatcgcaattattaaaggtcatgaaaatcaggccgtccgtgatttttatgattatctcaaaacccctgaagccgcagtcattttcaaacactatggtttcagtccactgtag

SEQ ID NO: 272 - DNA, 141 bp, Xenorhabdus bovienii
  Coding sequence Name=Xb4151_4152.C403.gene12.dna; Position on contig =10734..10874bp; Strand=-
atgtttgagttgattggaagtatggcgtttgcgttgatcatggttcctgttgtgatggcactgattttggggctgatttacgggcttggcgcagtgttcaacgttatttccaaaacaggaaataccgaacggcagccttga

SEQ ID NO: 273 - DNA, 189 bp, Xenorhabdus bovienii
  Coding sequence Name=Xb4151_4152.C403.gene13.dna; Position on contig =10889..11077bp; Strand=+
atgagtgaccataattcagccaaaaaattaactgtgcaacattcggcgttatttttccttaatggaaaaacggtgcttcatgacacaggcggtgatctcactattctagacaataaaaaagtaacagtaaccgacgaaacgtgcgattcttacggtcatcctgtaagaaactctcaaatatttgcctga

SEQ ID NO: 274 - DNA, 792 bp, Xenorhabdus bovienii
  Coding sequence Name=Xb4151_4152.C403.gene14.dna; Position on contig =11089..11880bp; Strand=+
atgcaagccgaaatattgttaatactcaaattacagcaacgtcttttcgctgatcctcggcgaatcgaattgcttaagcagattaaaataacaggttctatcagtcagggagcaaaacaggccgggatcagctataaaagcgcctgggatgccatcaatgaaatgaatcatctcgcagatgaagtattggtagaacgtgctactggcggcaaaggtggcggaggggcgcaacttacgcactatggcgaacgcctgttacaactttatgatctactggaaagaattcaacaaaaggcattcgatgtgctgaaagaggattctctgcctctggatagcctgctcgcggctatttcccgtttttcgttgcaatccagcgcccggaaccaatttttcggtacgatagtcgaacgtgatcatgagaatatccagcaacatgtccgtatcttactggctgatggcaaaacatcgatctctgccgcgctgactgagcaaagcgcaaaccgactgaagctggtaaaagggaaagaagtgctggcattaattaaagcaccgtggataaccttaagcaaagagcctgtaacagcgacgccattcgataatgccttatccggccaagtcagtctgattgaaacaggaacagaacacagtgaagttatcctgacgcttgatgggggtgaatcactctgcgttacgctagccaatcaggaaatggagcgttcgggtcttcagcctaatgatttcgtcaccgcactctttaatgccgataaagtgattattgcaactctgtgttaa

SEQ ID NO: 275 - DNA, 1485 bp, Xenorhabdus bovienii
  Coding sequence Name=Xb4151_4152.C403.gene15.dna; Position on contig =12063..13547bp; Strand=+
atgtctgagttgcaaataacacaaggtagtttccgtttaagtgacacccgtaccctgcggctgccgtcactgaaaattatttctggagaaaattgggcgtttgtcggcgcaaatggcagtgggaagtcttctctggctcgtgctctgtcggatgaattaattcaacttgcaggtgaacgccattgttcatttaatacacctgttcacctctctttcgaacaacttcaacaactgattgatgaagagtggcaacgcaacaatacagatttgctcagtgaagatgaggaagatactgggcgtaccgccgcagagatgattcagctccaccataaagataatgaattatgccttgaactggcagcgtattttggtatcaaggatttgctctcacgccgattcaaatatctctcgacgggagaagttcgcaaggtgttgctttgtcagacattaatggctaatcccgatctactcatccttgatgaacctttcgacgggctggatacttatgctcagaatcaactgtcccaattattaagatcgctggcaacaaaaggcatcacgttggttttaatactgacccgattccatgaaattcctgattttatcgaacagatcggtgtactggctgattgccacctgacacggacagggaagaaagagaatattctgtcagaatctctcgtggcacagttagcccacagcgaaacactaaaagacattcatcttcctgaaacagacgaataccgtgcagatgagcaactccccgaagatcaaccacgggtatcgatgtgcaatgttgttgttcagtacaatgacaaaccgatactgcatggtctgaactggcaaataaatccagatgaacactggcagatcatcggtgaaaatggtgcagggaaatccaccctcctcagcctgattacgggcgatcatccccaaggttacaacaataagctgattttattcggccggcagagaggtagtggcgaaaccatctgggatattaaacgccacattggttatgtcagtaacagcattcaccttgagtatcgtgtcagtacctgcgttcggaatgtcattctctctgggttcttcgattccatcgggctgtatcaggccgtttcagatcagcagcagcaactggctgatgagtggctggctttgttgggattctctgaaacaatcgcaaacagcccatttcacagcctatcatggggacagcaaagactcgttctgattgcccgtgccttggtgaaacatcccactttattgattctggatgagccattgcagggacttgatcctctcaatcgtcagttagtcctgcgttttattgatatcatgattgccaatggtgatacacaacttctgtttgtttcccatcatcaggaagatgcgccagaatgtattactcaccgcctgaaatttattcctgatggctatatttatcggtatgaaaccgaagatatctcccaacagtctttgtag

SEQ ID NO: 276 - DNA, 828 bp, Xenorhabdus bovienii
  Coding sequence Name=Xb4151_4152.C403.gene16.dna; Position on contig =13780..14607bp; Strand=+
atgtcttgggcgttacttgccgtttcattggcgcttttggatacacgtcgcattattgcattttccatcgcatttctagctttaatcgttgggatcagcactaacgtgcttacctttcccgcagttgctgcgcttattgtaattgctggtttaggtacagcacacgtttacctcaaaaaacatcctacattcagaattatcactgaggtgttactactcatctctgtagttttactgttcatgcattacattccgggatttaataacttgaaatacctagataaggtgcaggttggcccgctgagtgcacctttttcaatgtatttcaactttgacaaggcactgattccattcattctattattctgcatgccaagcctgttcactcgaaagcccgtggcagatgccttcccacatgtatgggcagcattgatagtcgcgatacctgcgctattgggtcttgccacagaattagggggattagccgttgagctgcatttacctagttggttccctgctttcgtcattgccaatattttctttgtctcattggcagaagaagcgctgtttcgtggctacctccagcaaaagctgagtcagtggatgaatccctattcggcactcgttatcacttcactgatttttggtgccgcccattttgccggtggtagtttattgatgattttcgcaactctggcagggttaatttatggtctggcatggatgtggagtggtcgtttatgggttgcagtagctttccacgtttcactcaatctaggccatctcctgtttttcacctatccggtaaaatcattactcatacagtag

SEQ ID NO: 277 - DNA, 753 bp, Xenorhabdus bovienii
  Coding sequence Name=Xb4151_4152.C403.gene17.dna; Position on contig =14735..15487bp; Strand=+
atggctgtaactaaactggttcttgtaaggcacggagagagcgagtggaacaaagagaaccgttttactggctggactgatgttgagttgtctgacaaaggccgtactgaagcacaacaggcgggtcaattactgaaacaagaaggtttcgcttttgatttcgcttacacttctgttttaaaacgtgctattcacactttgtggaacattctggaccaagtcgatcaacaatggctaccggttgagaaaaactggaaactgaatgaacgccactatggcgcactgcaaggtctggataaagctgaaactgccgctaagtacggggatgatcaagttaaattgtggcgccgtggcttcgcgattactccaccagatttggctaaagatgatgaacgttatcctggccacgatcctcgttacgcgaacttaaaaccagaagaacttcctgccacagaaagccttgcagccacgattgagcgtgttgttccttattgggaagacgttatcaaacctcgtgttgcaaatggtgaaaaaattatcatcgctgctcacggcaactctctgcgtgctttagtgaaatatttggatggtatgagtgaggaagaaattcttgagctgaatatcccaactgctgtgccgctggtttatgagtttgatgaaaacatgcgacctatcaagcactattatctgggcaatgctgacgagatcgctgcaaaagcagccgctgtagcaaaccaaggtaaagcgaaataa

SEQ ID NO: 278 - DNA, 1053 bp, Xenorhabdus bovienii
  Coding sequence Name=Xb4151_4152.C403.gene18.dna; Position on contig =15557..16609bp; Strand=-
atgaattaccagaatgacgatataagaattaaaaaaataacagaattattgccaccagttgcattactcgaaaaatttcctgcaacaagaaataccgctactaccgttcgtgaagcccgtgaagctattcataacgttttaactggtgaagatgatcgtctattggtagtaattggcccgtgttcaattcatgacccaaaggcagcactggaatatgcagaacgcctgaataagttacgtggagaattgaaagcagatttggaaattgtgatgcgggtttattttgaaaaaccccgtaccacgataggttggaaagggttaattaatgacccgaatatggattgtagctttgatattaatgatggcttacgtactgcccgcaagcttctgatcgatattaacgacatggggctgcctgctgcgggtgagttccttgatatgataacgcctcagtatcttgctgatctcatgagctggggcgcgataggggcgcgtacgacggaatctcaggttcaccgtgaactggcttcagggctttcttgtccggttggctttaaaaatggaactgacggcacaataaaagttgccattgatgctatcaacgcggccagctcacctcactgttttctttctgtaactaaatggggacactcagcgattgtcagcacaacgggtaatcaggattgccatattattctgcgtggtggcaaagagccgaattacagtgcggagcatgtcagtgtcgttaaagaggaattaatgaaagctggtttagcacctcgtgtgatgattgatttcagccatgcaaacagttcgaagcagttcaaaagacaaatggacgttaatgatgatgtttgtgatcagatcgcaaggggagaacgcgcgattattggcgtcatggtcgaaagccatctcgttgaaggaagccaaaatctcgatagtgataagcctttggtttatggacaaagtgtgacagatgcctgcattggctgggatgacacagaaatgttactgcgtcagttatctcagtctgtcaaagcccgaaggggataa

SEQ ID NO: 279 - DNA, 705 bp, Xenorhabdus bovienii
  Coding sequence Name=Xb4151_4152.C403.gene19.dna; Position on contig =16877..17581bp; Strand=-
atggattttttcagtattaagagcatattggtacatattccattaggtgcagacggctatgatctctcgtacattgaagctgttggtacgatagctggtttattatgtatctggcttgccagtcaggagaaaatcattaattacctgtttggattgattaatgtttttctctttgccgttatcttcttccaaattcaactctacgccagtcttctcctgcaaatctttttcttcgcggctaatatctacggttggtatgcctggagtcgtgtcaatgaacagaaacagatagaacttaagatccgctggctcaaccctaaacaaacaattgccgtcgccgcagtttccatatttgtaatcttggtaatgatgttcaatatcgaccaaatctttggctatatggcaaaaattgtggtttttgctttgcagggtatggggttcaatattgcgatgccagccttagagccggatgcatttccattctgggattcggtgatgacagtattatcgatagtggcaatggtactgatgacccgtaaacacgtggaaaactggctggtatgggtgatcatcaatgtgatcagcgtagtgatttatttccaccaaggtgttctggcgatgtccttgcaatacattatattgacgggtattgcactgaacggtgctcgcctgtggatcacggctgctaaacccaatgggtcgtaa

SEQ ID NO: 280 - DNA, 2709 bp, Xenorhabdus bovienii
  Coding sequence Name=Xb4151_4152.C404.gene1.dna; Position on contig =778..3486bp; Strand=+
atgtataaacaagcatctatcaagccatctactattccccgtttttacgcactatttattattttgctttttacgtctctatttttattcgggtataactattttgatagttggctcacagataaaaaatatgctattagcagtgtaacagttaagatgagattgcaaatcgaaaattatcgttatcatgccaatcatatctttgaacaatctaatattccgctctctgcctcctctcaggaggcaacatcattgtttaaattgcgtcccgatgtccattggctggaaagtcgttataagacagtcgatgcaattatttttggtcagtacaatcattcaagtattcaactagctcagcggttatctaactatctggaaattctctggggttcccgtaatgaatacgaatctatgtattatctcaatggtaaggataacaatttacttttggtaacaactcatcctattttaaaaccagaaatcaggtttaaggagagttatctgaccctgacgtctgaggccaaacgaactgaaatgttggctcaatcgatagcgctggatgaaaaagaaagcatttcagccatcaatgtgctgcgtggggagaatatttatttctatacttataaagctgcattcaatttgcctgggcaattaactaccgttatcgcctttgaactgcccattaataaccttttgccgattgatatgtcaccggcaaactttcgcttgaatttgaccaacttgcatgatgctgagggttccaataaagttgaggtttcactgaacggtttttggctagagttctcccagaatctcaatgccatgccatatgaattggtttatcaagttccactgaaagccctggttatagatttactgatcaggaatatgtggctcttgttctcaatattacttttcgcaatgttctcattgagtggtttgttctatatccgccgtagatatattacacctaatgcttcgatggatcatgagctgaaaattaaggactctttaggtaatgatatcatctccaatattcctatcggtttgttgatctacgatttttcatcaaatcggttaatcactagcaataaaattgcagaacagttaataccttatcttgatttgaataaagttaaggctatggcacaacaacatcatggcgtcattcaaacatctattgatgacgcgaattatgaagtcaagatgtataatagcaatctattacccgaaacatatctctttctgctgcaagatagagatcaggaggttatgataaatagacggctccagcttgccaatcgagaatatgataaaactgttcaggccagacgttcaatgctatcaaatattaataatgaaataaaaataccgattcagagcttaaatgagattgctgcccagttgaaacagatatcacaagatgaaaacatgcagaacttgctggataagttattggttaaatcggaatatattaccaaatgggttgaaaacatttcattactcaatgagctggagtctggtgactggcagtctgctactgaaatattttctttgtcttcacggttggagcatattctgaaagcttctctgtcgacattaaatgccaagggattgaaaatttattaccattttaattttcatcatgaatctttgttcattggtgatggtgtggcaataactaaaatcgtctcgctgttatttaattacgcaataacgacaaccagttatggaaaaatatcactgtccattaatagctctggcgaatatgacaattgcattcaaattgatctcattgataccggttcaggtcttagcgaaaaagatttaatcagtttgaattatcccttcttgaacaaatcagcagaagataagtattatacgaactctgggctaactttttatctatgtaatcagttgtgcaaaaagatgggagggaattttgaaattaaaagtaagttgggtttgggtacacattatgtcattaacctgcctctttcgcagcatagtgataacaatggcgaaacgcctcagcttttgcagggtgtgacagccttaattgatatcagtaatcctgaaatcagtaaaataatccacaattacttgaataattatggtgcgtcatacttcgataaaatcaaagggaatgttacagaagaatacgatattatctttacggatatgcagtgcaaagtagaaaaaccaactatattattagttgatggtttggctgatttcaagcagataaaacctaatctggttaagtgtaattataattttgttgatgcggttatcaatgcaatatcgttactggttgaagaaaatttcagtctagatgaatcttgctatgctcttgaaacccctaaatcagaatgcaatgttgtcagtagtgttgacaatattctcaagggctaccaaacacagttggcagatagtgattataggaaattatttatagagacagtaccgatggatattactaaactgtatactgatatggaacgacatgatttgacattactttcgcaaacggtacaccgccttaagggtgcgtttgctatgttagatttaaaattgctcaaattatcatgtgaggcgttggaacaacacatagcagacaataatgaaatagaaatcgaaaatagcatcagccgtattgattcttttgtcacgaagctgttgcagcaaggtaaccaagaatatgaataa

SEQ ID NO: 281 - DNA, 651 bp, Xenorhabdus bovienii
  Coding sequence Name=Xb4151_4152.C404.gene2.dna; Position on contig =3479..4129bp; Strand=+
atgaataaccttaatgtcattattgccgatgaccatcccattgttttgtttggcatccgtaaatcactcgaacaaattgagtggattaatgttgtcgctgagtttgaaaattcaacgacactcattaacaatttaccgcacatagaagcggatgttctcataacagatctgtcaatgccaggcgacaaatacggtgatggcattaccctgataaaatatattaaacggcattacccaacactggctatcattgttcttactatgaacaataacccagctattttaagcgctgtgcttgaacttgatattgagggaattgtattaaagcagggagcacctactgatttgcccagagcactttctgctttgcaaaagggtaaaaaatttacacctgaaagtgtttctaaattgctggaaaaagtcaatgctaatggttatggagataaaccattatctccgaaagagagtgaagtactgcgtttatttgcggatggtcttcttgttactgatatcgctaaaaaacttaatcgcagtattaagaccattagcagccagaaaaaatcagctatgctgaaactgggtgtagataacgatattgcgctgcttaattatttatcatctgtcactattgaaaaagatatcggtagataa

SEQ ID NO: 282 - DNA, 2766 bp, Xenorhabdus bovienii
  Coding sequence Name=Xb4151_4152.C404.gene3.dna; Position on contig =4209..6974bp; Strand=-
atgctgtgggtattaggcgccttattaaccagtttttatctggtaaatatttttaatgaagtcaaatcagacattcgtcaagaatataatactaactacgatacaatgttctcttatattcggcatactaccaacaccttgcgggatatccaatatatgacggagaaacatttatcacaaaagaatgaaaaagatctaactattactctgccgtataataaccctgctttctcatatactcctctgaatatgaattcagattgtgatctcttacgtaaaagcacacatagttatttggactcattaaataatctgattttattttggaaagataatattgccgctccgcgaggcctgaatcagatctttctggttggtacacaaagtatgtgtatggtgagcttttcagttcgcagtaccataacagaacctgaaacactgaagaaaatggtctacgaaaatttccgtaaactaatcattttgaaagaacaaggaaaagaacggaatgtcttttgggtcatgcctaacacaagagctgacagcggtactttttatatccttgcgccgatctataccaatgggcaaatgacagcagtgataggtattgaacaagctatcaggttagactcatttctaccaacaagaaatcgacctatttctattacaatgctaaaccactataatcagcctgaattatattacccagtaaaaaatgataataaatttcgttatgctgactataatatacagaccccttattttggttatgatgaaggtttttccaatttattattaaaacgacgcttagcaccatcttcattcaacgttgttttttcattaccattaaaatatatctatagtgaattaaaggtaacaatcattaacagtatcgtattgaatcttatctttacgatcctgattattttttttgtctggttatttgaacgtaaaatattttctcctgctgaagaaaatgctattcgtcttgaagagcatgagcaatttaaccataaaattgttgcctctgcaccagttggcatcagtattttacggattaatgatggtgccaatattctcagtaatgaactggcacataattacaccagaatgctaacgtatgaagatcaaaaacgtatcgtcgatattatctgtgataaaaccagcagctatattgatgttgtcaccagtaacaacaatcacctgcaaattagctttgtacattcacgttatcgaaatgaagaagtagcaatctgtgtactagtagatatcagtacacgggtaaaaatggaacaatcattacaggaaatggcgtcagcagcagaacaggctaatcaggcaaaatccatgtttctggcaacagtcagccatgaattgagaacaccactgtatggcattattggcaatctggaactgctgcaatctcatacattgccatcagaatctgcacggctactatcagcaatgaataacgcatcatcattgttactaaaaatcatcagcgatattctcgatttttccaaaatagaatctaagcagctcaaaattgattccaagaaattctcttgtaaagaaattgtattgcatgtgatctcaaattatcttcccctcattgtgaaaaaagagttgggattatactgctatattgaaccggacattcccgatattatcaataatgatcccgtaaggttgcagcaaattatctccaatctgctgaataatgcaattaaattcacagaaactggcagtgttgtcattaccatttctataaagcatagttacctgtatatcagtatcaaagataccggggttggaatcgaagataaattacaaactcagttgtttgaaccattttttcaaatcaacgccaataaacaaaccttctcgcaaggtactggattgggattagctatttgcgaaaaattgatcaatttgatggatggtgatattgaatttatttcacaacagtatattggtagtatcttttctatccgccttccattgtatggagcaaagtatcataccaaagcgtattccaaaaaccgcactcaacaaaaaattgtactggctgttcgcaatgattatctagagaaatatctacagaattttcttacgaagaactattttcagattgccttatatgacaaaagtaaaatagatggcacagaattggtgatccttgaccagcctgatgtactagacattgctgtacgttactacatagagatatcagaaaaacatattgggccgccaaaacaaattcgagaacattactggttgcataacacttatcaactcatcgagcttgacagtgtgatcgataaactgctatcaaaaaataatcatatctcccctgccactatatcaatgtcaacatcaattcgggcagatagccgcttgagtaccattaagatcttggttgttgatgatcatcctttaaaccgacacttattgatcgaacaattaaatacaataggattcagaacagcctcggcgaatgatggtattgatgccatcgagcacctgaaaaataattcaacggatattattctgacagacgtgaatatgccaaatatggacggatatgagctcacgaaatacctgagggataaaggatataccagccccatcattggcatcactgctaatgccctggcagaagaaaaacaacgttgtgcggatgcaggaatggattattgtctatcaaaacccgtctcattggcaacattaagagatacattaatagaatacagtgatattcaatcttaa

SEQ ID NO: 283 - DNA, 2643 bp, Xenorhabdus bovienii
  Coding sequence Name=Xb4151_4152.C404.gene4.dna; Position on contig =7226..9868bp; Strand=-
atgagcgacattgccagagaaatcacaccggtcaatatcgaagaagagctgaaaagctcatatctggattatgcgatgtccgttattgttggacgcgcactgccggatgttcgagatggactgaagccagtacatcgccgcgtactttttgcgatgaatgtattaggaaatgattggaataaatcctataaaaaatcagcccgtgttgttggggatgtgataggtaaatatcacccacatggcgacagcgctgtttatgacacgattgtacgtctggcacaacccttctccatgcgttatatgctggttgacggtcagggcaacttcgggtcagtggacggcgattctgcggctgcgatgcgttataccgaagtacgcatggcgaaaattgcccatgaactgctggcagacttggaaaaagaaactgtcaattttgtgcctaactatgatggtacagaacagatccccgatgtgatgccaacccgtatccctaatttgctggtgaatggctcatcaggaattgcggttggtatggcaaccaacattccacctcataacttatctgaggtggttgatggctgtctggcttatattgatgatgaaaatatcagtatagaaggcctgatggaatacatcccagggcctgattttcctacagcggctattatcaatggacgccgtggcattcaggaagcctatcgtaccggtcgcggtaaaatttatattcgcgcccgcgcaaaaattgaaactgacgaaaaaaatggccgcgaaaccattatcgtcaatgaaattccctatcaaataaacaaggcccggctgatcgaaaaaattgccgagctggtgaaagataagcgcattgaaggaatcagtgcactgcgtgatgaatccgataaagatggcatgcgtattgttatcgaagtgaagcgcgatgccgtggctgaggttgtcctgaataacctgtattcactcacgcagttgcaggtttcattcggtatcaacatggttgctctgcatcaggggcagcctaaactgcttaacctgaaagatattctttccgcgtttatcaaccatcgccgcgaagtcgttacacgccggactatctttgaactgcgcaaagcccgcgaacgtgcacatatccttgaagcactggctgtcgcactggtcaatatcgattctgccatcgagctgattcgtcgggcatcaacccctgccgaagccaaagcaaacctgattgcccaagcgtgggaattgggtaatgtttcagcaatgctggaacaggctggtgatgatgctgcacgccctgaatggctggagccggaatatggcattcatgacggcaaatattacctgaccgaacagcaggcacaggccattttggatctgcgcttgcagaaactgactggtctggaacatgaaaaactgctcgatgaatatcgtgaactgctgaaattaatcggtgaactgcttttcattctggaaaacccagaacgtttgagagaagtcattcgtgaagaactactggccatcaaagatcaatataacgatgcccgccgtactgaactcactgaaaactcagcggatatcaatattgaagacctgatcaatcaggaagatgttgtggtaacgctgtctcatcagggatatgtgaaatatcagccattgtccgattacgaggctcagcgtcgtggcggtaaaggcaaatcagcagcacgtatcaaagaagaagacttccttgagcgtttgctggtcgccaatacacacgataccatcctctgtttttcaaacaaaggtaaaatgtactggatgaaagtctaccagttgccggaagcaagccgtggcgcgcgtggacgtccgattgtcaacctattgccactggagcaagaagaacgcattacagccattctgccagtacgtgaatatgaagatgggctgaatatcttcatggcaaccgcaagtgggactgttaagaaaactaaactcagtgaattcagtcgtccacgtagtgccggtattatcgcggtaaaactaagtgacggtgatgaattgatcggtgttgacctgactgatggcagcaacgaagtcatgctgttctctgcgaagggtaaagtcgttcgtttcctcgaagaagatgaagagactctggaagacggtactatccgtgtgaaaggtgtacgtgcaatgggacgtacagcggcgggggttcgtggtatcaaactgagtgcaggcgataaagtcgtctccctgatcatccctcgtggagaaggcgaaattctgactgtcaccgaaaatggctacggtaaacgtactgctcagagcgaatatccgactaaatcccgtgcgactcaaggtgtcatttctatcaaggtcagcgaacgcaacggtgatgttatcggtgcaattcaggttgaaaccactgatcagatcatgatgatcaccgatgcggggacactagtacgtacccgtgtttctgaagtcagcgttgttggccgtaacacacagggtgttactttgatccgtacaacagaagatgaaaaggtcgttggtttgcaacgtgttgctgaacctgacgatgatgaagacgaagaaaataatataacgtctccttctgatgaagggaatagcgaatcagaagatcaggtataa

SEQ ID NO: 284 - DNA, 195 bp, Xenorhabdus bovienii
  Coding sequence Name=Xb4151_4152.C404.gene5.dna; Position on contig =9896..10090bp; Strand=-
atgtgtgaatcgggggttttgacgttcatcagcgatatcgctcctaagaactgcttcacagaaagctgctccacagaaaatgtaacagtattatggggatgtgtgataagagggtattatacatgccttaatcttgaaatacccgcatctggtttttataaaactgtcaatttgtggtataatttaaacctttga

SEQ ID NO: 285 - DNA, 735 bp, Xenorhabdus bovienii
  Coding sequence Name=Xb4151_4152.C404.gene6.dna; Position on contig =10062..10796bp; Strand=+
atgaacgtcaaaacccccgattcacacatcccgtctcatcccaatgtggatcaacaggaaatcgaaaaatttgaagcggttgcttcccgctggtgggatcttgaaggagagttcaagccattgcaccggattaacccattgcgtttgaattatatcctgcaacgtgccggaggtcttttcggcaaaaaagtgctggatgttgggtgtggtggtgggattctgtcagaaagcatggcgcgtgaaggtgcggatgtgacggggctggacatggggtttgaacctttgcaggttgcccgattgcatgcactggaatccgatactccagtcacttatgtgcaggaaacggtagaaagtcatgctgaacagcatttgcattcttatgatgttgtgacatgcatggagatgctcgaacacgttccagatcctgaatccgtgattcgcgcctgtgccaaattagtcaaaccgggtggccatgttttcttctcaacgattaatcgtaatcgtaaagcctggctaatggctgtcattggtgctgaatatattttgaacatggtgccgaaagggacgcatgatgcgaaaaaatttattcgcccttctgaactgattggctggatagataagactcctctgaaagatcaacatattattggattacattacaacccgttgacagataaatttcgacttggacacaatgtagacgtgaactatatgcttcatactcaatcggtttaa

SEQ ID NO: 286 - DNA, 2292 bp, Xenorhabdus bovienii
  Coding sequence Name=Xb4151_4152.C404.gene7.dna; Position on contig =11162..13453bp; Strand=+
atgaaccagagtctgctagtaaccaagcgtgatggacataaagaacaaattgatctggataagatccacagggtcgttgcctgggctgccgaaggtctgaaaaatgtctcagtgtcacaagtagaactgcgttctcaaattcaattttacgatggcatcaaaacagccgatattcatgaaaccatgatcaaggcagcggctgatttgatttctggcgatgcgcctgattatcagtatctggcggctcgtttggccatcttccatctgcgcaaaaaggcttacggtcagttcgaaccacctgctctgcatgatcatgttgtacggatggtgaatttaggcaaatacgacaagcatttgctggaagactattccaaagaagaattcgagcaaatggacagttttattaaccatttgcgtgatatggacttctcctatgcagcagttaagcagcttgaagggaaatatctggtacagaaccgtgttaccggtgaaatttatgaaagtgctcaatttctctacattctggttgcagcgtgcctattttcaacttatccaaaagaaacgcgcctgagctacatccgtcgtttttacgatgcagtttcgacgtttaaaatttcgctgccaacgccaatcatggcgggggttcgcacaccaactcgccagttcagttcctgcgttctgattgagtgtggtgacagccttgactctatcaatgcaacatccagtgcgattgtaaaatacgtttcccagcgagcaggcattggcgtgaatgcaggccgcatccgtgctttgggtagccctatccgtgatggtgaagctttccatacgggctgtattccattctataaacattttcaaacagctgtgaaatcctgttcgcaggggggagtccgtggtggtgctgcgactttgttctacccgctgtggcatttggaagtagaaagcctgctggtactgaaaaacaaccgtggtgttgaaggtaaccgcgtgcgccatatggattatggtgtgcagctcaataaattgatgtatgaacgcctgatcaaaggggaagacattactctgttcagcccatctgatgtcccggggctgtatgatgctttctttgcggatcaagatgaatttgagcgtctgtacactcagtacgaaagtgacgtaactatccgtaaagagcgcattaaagccgtggagctgttctcactgatgatgcaggagcgtgcttcaaccggccgtatttacatccagaacgttgaccattgtaatacacacagcccatttgatccggcggttgcacctgtgcgtcagtcaaacttatgtttggaaattgcactgccaaccaagccaatgaataatatcaatgatgaaaatggtgagattgccctgtgtacactgtctgctttcaacctgggtgccattaataatctgacggaactggaagaattagcagaattggccgttcgagcactggattctttgctggattatcaagattatccaatcatcgcggctaaacaggggtcaatgggacgccgtacgctgggcattggtgtgattaacttcgcttattatctggcgaaaaacggtgtccgttattctgatggtagtgccaataacctgacacacaaaacatttgaagccattcagtattacctgctgaaagcctcgaatgggctggcgaaagagaagggtgcttgcccgtggtttggtgaaaccacttatgcacagggtattctgccaattgatacttacaaaaaaacactggatacactgacccgcgaacctctgcatatggattgggaaaccctgcgtaatgacatccggcagcatggcctgcgtaactcaacattgtcagcattgatgccgtcagagacttcttcgcagatctccaatgcgaccaacggtattgagccaccacgcggctatatcagtatcaaggcatcaaaagatggcatcttgcgtcaggttgtaccggaatataaccgtctgaaaggggcttatgagttgctgtggcaaatgccgggtaccgatggctacctacagctggtggggatcatgcagaaattcattgaccaatcgatttctgccaatactaactatgatcctgctcgtttcccgaacggcaaagttccgatgaatcagttgctgaaagatttactgctcgcttacaaatatggcgtgaaaacactgtattaccacaacacccgcgatggagcggaagatgttcagggtgatctggaagaggtcgttgagtctgctgattccgattgtgacggcggcgcgtgtaaaatttga

SEQ ID NO: 287 - DNA, 1131 bp, Xenorhabdus bovienii
  Coding sequence Name=Xb4151_4152.C404.gene8.dna; Position on contig =13466..14596bp; Strand=+
atgtcttataccactttttcacaagtaaaaaataatcaactacaggaaccgatgtttttcggccagcctgtgaacgtagcgcgttatgatcagcagaaatatcctatttttgagaaactgattgaaaaacagctttcgttcttctggcgtcctgaagaagttgatgtttcccgtgatcgcattgactacaatgcattgccggatcatgaaaaacacattttcattagtaatctgaaatatcaaacgctgttggattccattcagggccgtagtccgaatgtggcattcctgccgctgatttccattccagaattagaaacctggattgaaacatggtcgttttcagaaacgattcattcgcgctcctatacgcatattatccgtaatatcgtcaatgatcctgccattgtgtttgatgatatcgtagccaacgagcagattttaaagcgcgccaaagatatttcggggtattacgacgttctgatcgaaatgactaactactatcatcagctgggcgaaggtacatacaatgtggcgggtaaaaacattacagttagcctgcgcgcattgaaaaaacagctttacctgtgtttgatgagtgttaacgctctggaagctattcgtttctacgtcagttttgcgtgttcattcgctttcgcagaacgcgaattgatggaaggaaatgccaaaatcatcaaactgatcgcgcgtgatgaagctctgcatttaacgggaacccagcatatgctgaacttgctgcgctctggtcaggatgaccctgaaatggcggaaattgccagagaatgtgagcagcagtgttacgatctgtttgtacaggcggctgaacaagaaaaagagtgggcagattatttattcaaagatggttctatgattggcctgaataaagatattctgtgtcagtatgtcgaatacatcaccaatattcgcatgcaggcggtgggtttgaagctaccatttgaagctcgctctaacccaatcccatggatcaatgcatggctggtttctgataatgttcaggtggctccacaggaagttgaagtcagctcttacttagtcggtcagattgactcggaagtcaatgctgaggatctcagcggtttcgaactctga

SEQ ID NO: 288 - DNA, 222 bp, Xenorhabdus bovienii
  Coding sequence Name=Xb4151_4152.C404.gene9.dna; Position on contig =15162..15383bp; Strand=-
atgatatcagccctattaaaacattcactgaactgcccaatccattcgactatatataacgaaattaactttaacttattgtttgtaaagaaaatatctaattattattttatttgtgattttaagaaatatcttaatattaaaaaagtagataagggacaaataggaaagattattattctttctgtaacacattattatattaattttttatcattataa

SEQ ID NO: 289 - DNA, 561 bp, Xenorhabdus bovienii
  Coding sequence Name=Xb4151_4152.C404.gene10.dna; Position on contig =15519..16079bp; Strand=+
atgaaaaaaacgttattaacagccgctattgcagcaggcttatctatttttgctttcggtgctaatgccagtaatagtggtaaaagtactatttctttggggtatgctcagactcagaacagtgccaatggtattaaagtatttaagagtgaaggtactgaatggaatacaaaacaacatggattgaatttaaaatatcgttatgagttagatgaccaccttggtgtggttggctcattgacctatacgctcaataggtttgaaaatgatcacgttggaaacgttaccaaatttaagtcggatagttactccttattagctgggccatcatatcgttttaatgattatattagcgcatatggaatgattggtgcagcccacaataaaattaagatacaagatgatagtgagtttgatataagcaagacatcactcgcttatggtgccggtttacaattcaatcctattgaaaacattgcagttgatgcatcgtaccaatattcaaaatttagtgatatcaaagttggaacatgggtgctgggtataggatatcgtttctaa

SEQ ID NO: 290 - DNA, 396 bp, Xenorhabdus bovienii
  Coding sequence Name=Xb4151_4152.C404.gene11.dna; Position on contig =17100..17495bp; Strand=-
atgaaaacaacgcctgtccttagaattgccagagcaacagacaatttgtctgcaatcaaagatatgtattgcaaaggattgcaatttactctattaggtgaattcagagatcatgataattttgatggtgtaatgttagggcaccccaatcattcttggcatctcgaatttactcatcaccacaatacatctgttggtaaggcgccgacacaagataatttattggttttttatatcgaagatgtgtctgaatggcagaaacaaagccaattgatgcaagaagccggtttttctctcgtcccctcttataatccttattgggatcgaactggaaaaacattcgaagatattgatggctatcgtgtcgtattacaaaatacaccaccacatatttaa

SEQ ID NO: 291 - DNA, 594 bp, Xenorhabdus bovienii
  Coding sequence Name=Xb4151_4152.C404.gene12.dna; Position on contig =17634..18227bp; Strand=-
atgaacattaaaaagtcattacttttggtgggattgactacttttggtgcaatcccattttatagtactgctgaccccgtgtctcgccatggatatgtagattctccacccagtagagcttttttatgttatcagcgtaccaacaaagactgcggcaatatcatgtatgaaccgcaatctgtagaagggcctaaaggtttcccggaatcagggccacctgatggtcaaattgccagcgggggcgttggccagttcagtcctctaaacgaacaaagcgctcagcgctggcatcacgtcacagtcaacaaaggtcaaaacaactttaagtggacgctaaccgccagacatagtacaacctcatggcaattttttattactaaatctggttgggaccctaacaaaccactcactcgggcgcaatttgatctaaaaccgttttgtgaacgtgatgatcatgggaaacttccggttcaaaatgtctcaattacatgtgaggttccagagcgttctggataccatgtcattctcggtgtttggacaatttcagatactgataatgctttttatcaagtcattgatgctgatataaaataa

SEQ ID NO: 292 - DNA, 216 bp, Xenorhabdus bovienii
  Coding sequence Name=Xb4151_4152.C404.gene13.dna; Position on contig =19342..19557bp; Strand=+
atgtctaatacaatgactggtacagttaaatggttcaacagcgataaaggttttggctttatctctccaaaagatggaagcaaagatgtttttgttcatttctctgcaattcagagcaatgattataaaactttagatgaaggccaggaagtttctttctcagtagaaagtggcgctaaaggcccatcagcaactaacgtgattgctttatcttaa

SEQ ID NO: 293 - DNA, 462 bp, Xenorhabdus bovienii; identical to SEQ ID NO: 220
  Coding sequence Name=Xb4151_4152.C404.gene14.dna; Position on contig =19879..20340bp; Strand=-

SEQ ID NO: 294 - DNA, 1534 bp, Xenorhabdus bovienii
  Coding sequence Name=Xb4151_4152.C405.gene1.dna; Position on contig =1..1534bp; Strand=-
atgctagatcttaaactgaggataccaaacacagattggattccccaatttgatttggtcactggtaaagaaggtgcgccagcttttcggttggaaactaataagaaggatattacagggaacatccaatcgcgtttaatgtctttaacgctgacagataaccgcggtttggaatcagaccagctcgatattgagttggatgatgcggatgggcaacttatatttccttcccgaggcgatattctagcattggaattggggtggcatggcgattctttaaccccaaagggaaaatttgtcgttgatgaaattgaacataccggtgcgcctgatcggctgacaattcgtgcccgcagtgctgattttcgaggtaatttgaatgttaaacgcgaagagtcttaccataaacacacgttagagagcattgtgagtacgattgctgcgagaaaccagctgacatttaaaatcagcgaggaattgaaggggatctctatgcacattgatcagaccaatgaatctgacgtgagctttttgactcggatggcaaagcaggaaggggcgattgcttcggtcaaaaatggtgagttgctgtttgttcaacaaggacaaaataaaacttcaagtggtcaggatattccacttgtattgattactcgtgaatcaggggacagccatcggttttctctgtctgatcgtgaagcttatactggtgttgatgctcaatggcaggatacacgcacagcggctaaacagacggttaaattgaggcgggtagaatcaaaaaacggggaaattaaaattattgttgaatatggaagcagcgagaaaaaatcgtcagccaagaatattcctcaaaaagacaaaagcctttccttaaaagagaaagactcttccaagaaaaaagaatttcgaatcgttaaagaggaaaaagaacataaaagtgagtcgcctcgtggaatgaaccttactaagtcagctcagtccaatggagtgagtctggaaaagaaaggtggcatcgatttgacgaagaaaaatcacaaaaaaaaaggaagggaaaaacctgcttatattgaaaaaggacaaaaagaacgtaaaagaaaaaacaaggataacggaaatattgatagaaaaaagaatatcgataccaagggaagtccatcttctaaagaacaaagaaaatcgacggcggagcaccataagacaacaacggcacagcaaaaatccgcaaaatatttgacaggaactcaggaaaatgttctgacgctttcccgcatttattctaacaaggaaaacgcggagcgtgctgcaaaagctgtttgggataaaatgcagcggggggcggcgcagttctctattacattggcgaaaggacgagctgatatctaccctgaaacacctattcagctaaaggattttaagacggaaattgatggaacgcattggacgttggtgaaagtaactcacaaccttaacggcagtggttttaccacatccttggatctcgaaatcaaaattgatgatgttgaggtcaaga

SEQ ID NO: 295 - DNA, 516 bp, Xenorhabdus bovienii
  Coding sequence Name=Xb4151_4152.C405.gene2.dna; Position on contig =1521..2036bp; Strand=-
atgatggctgcacttggtttatttgtttttatgttgaaaacaacgccataccaaagtttccaatataaacaaagttggagacatgctttcaatagccgtgtgggagcacggcctgcatggcaatttattggttcagataatgatacggttacgctatcgggggaactttatcctgaactgacaggcggttctctttcactgactgcattgacattgatggcagacagaggtaaggcgtggtctttcattgatggaagtggcgcaatttatggaatgttcgttatcgaaagcattgatgagacaaaaacggaatttatgtcgggcggagcggccagaaaaatcagttttacactgaccttacggcgcgttgataacaatttgtttgaaatgttgggtgatttacaggatcaattatctgatataaaaggcaaaccacctacatcactggataagccttctggtcttacgagaaaggctataggtgaaattaaggagcatcctaatgctagatcttaa

SEQ ID NO: 296 - DNA, 3336 bp, Xenorhabdus bovienii
  Coding sequence Name=Xb4151_4152.C405.gene3.dna; Position on contig =2033..5368bp; Strand=-
atgagtaatatacagtcacagctaaacaaggttctgagtgccgttggaaagctgaccggttcctttaaatcttttcaacggcataataaaaagctggaaaattcagtcgataaaattcataaccagttcaaaaaactcaataagaccgttgagagcttaaaacctatcgtgggttatgcgcaggaaactgcgcgtatacgcaccgatcttaaagcctataatcaaacaattaaacaatctttatctgcgcggcagaattcgacaagaacgctgcaggttagtgctgccagtcaatcagctaatattattcaaactacccaaattatcaaacaggaaaattcatccagtaaaaaaaacgaatttaatcttggtgcaacggggaatatgactaacaattttacattgttagataagttggttattaatatcaatccaaagataacaattttatttagtattctgaataaaattaatgcggttttgaatgtaactactggtgcagtaaaagtagtatttcaaactctggttggttatatacaactatttggaaatgttggtataaaaacattcgattttttaagagtcagtttgaatatatttacgcagttgggtattcaggcttttgtatctttaaaagttagtctgaatatttttgcacagctagggattcaggctctggtgtccttaagagttaattttaatttctttgcacagttaggaattcaggcgctggataaattaaaatccagtctggatgcatttgtacagttaggacttaatgcttttgaagaattaaaagccagtctgaatttttttgcacaattaggggttcaggcgctggataaattaaaatccacactggatgcatttgtgcagttgggtgttcaggctctgaataaattaaccgctcccctggatatatttgcgcagctgggaactcaggcgctggataaattaaaatccacactggatgcatttgttcagttgggtgttcaggctctgaataaattaaccgcacccctggatatatttgcacagctgggaactcaggcgttggataaattaaaatccacactggatgcatttgtgcagttgggtgttcaggctctgaataaattaaccgctcccctggatgtatttgctcagttgggactcaacgcttttgaagaattaaaagccagcctcaatttttttgctcaattgggaattcaggcgctggataaattaaaatccagtctggatgcatttgtacagttggggcttaacgcttttgaagaattaaaagccagtctgaatttttttgcacaattaggaattcaggcgctggataaattaaaatccacactggatgcatttgtgcagttgggtgttcaggctctgaataaattaaccgcacccctggatatatttgcgcagctgggaactcaggcgttggataaattaaaatccacactggatgcatttgtgcagttgggtgttcaggctctgaataaattaacagcacccctggatatatttgcgcaactgggaactcaggcgttggataaattaaaatccacactggatgcatttgtgcagttgggtgttcaggctctgaataaattaacagcaccattggatatatttgcgcaactgggaactcaggcgctggataaattaaaatccacactggatgcatttgtgcagttgggcgttcaggctctgaataaattaacctctcccctggatgtatttgctaagttgggtatgcaggctttagaagagttaaaagccagcctcagtttctttgctcagctgggcgttcaggcgctggataaattgaaatccagtctggatatatttactcaggttggtgttcaggctctggaagaattaagagccaatctgaatagatttgctcaagtgggtattcaggctatggagaatttaagagatggcttgaaggtattcgcacaattgggaactgaggctttagaagcactaagagccgctatggatttttttggtaaaaccggaaacaaagtttttggctcacttaatgatggcgctgatttgctatctaacaaaggaggtaaagatacttttggaaaccaaagaaaaggccttgaaatattagggaatattggtcaaaaagtttttggtgttttgggtagtggtataaatattctggcaaatgttggtgtaaaaggcctgtcttttttaagtagtactttcagtgtattaggaaaatcaataatgttcattggtcgggctatgatggcgaacccgattcttgccattattggtgttatcgcaatggctgctatttatatttggcagaattggggaacgttggggccaaaattcacagccttgtgggaaggtatcaaaaatgtttgtagcaatgtatggcagggaattaaaaacatagtcagtgccgcatgggaaggtatcaagagctttttcatgaatggaggactgatcggcattatttaccaaaactgggatgctattaaacaaagcgcttcagaagtttgggaagcgattaaagccttattaagtgagaaatgggaatctattaaacaaagcgttcttgccacttgggaaaatatcaaagcccaaatcagtggtgcttgggaatccgttaaacagaatactttggaaatctgggaaagcatcaaaaaatcaatttcagatagatggaatgaaattgttagtgatgttcaagctattccagagaaattaaagaaagcgggttcggatatgatcgacagcttgttaacgggtattcaagaaaaatgggaagccttgaaggggaaaattacctctattactgacatattcaaatcatggtggtcaggtgatgataaaaaggaagtagctgtaaaaacatcacaggaaataacgaatagcgcaactacgcaacaagcggcacaaattactaaacatgatacaggcggatctatttcagccgggaaattcggcattgcgggtgagcgtggccctgaaattattagcggcccagccaatgtaaccagccggaaaaatacggcgaagctcgctgccgtgggacttgccgttagttcaatgtctttgcctattgccgcacaggatgcaccgttgcatgcgcaaagtctgcctgctcatacttatgaggctgttcaggcgaagaaagaacgaagcctgccaccgcagcttagcggagcaccacaatataacatctatgtctatggcgctcagggacagtccgcgcaggatattgcccgtgtggtcaggcaggaattggaacaacgggaacgtatccagcaagcccgtatgcgtagctcactttctgatagaggagaagatttctcatga

SEQ ID NO: 297 - DNA, 318 bp, Xenorhabdus bovienii
  Coding sequence Name=Xb4151_4152.C405.gene4.dna; Position on contig =5495..5812bp; Strand=-
atgacagaaacactgaacactcaaaatgacgatctgcgcaccatcgaattggaagctccattggcgcgaggtaacggcgaaatcacggaagtgatggtacgcaagcctaccagtggtgcattgcgcggtgcacgtttacaggcgctgctggaaatggatgtggattctatgctgcttgtcctgccgcgtgttaccactcctgtattgaccaaaaatgacctaatgatgatgtcacccggtgatctgattaatctcagtgtggaggtggtcaattttttgttaccgaagtcggtcaagtccgattcccagaacaattaa

SEQ ID NO: 298 - DNA, 519 bp, Xenorhabdus bovienii
  Coding sequence Name=Xb4151_4152.C405.gene5.dna; Position on contig =5918..6436bp; Strand=-
atggcattacctcgcaaacttaaatacctgaatttgttcaatgatggcaacaactatcaggggatcgtggaagaactgactcttcctaagttaagccgcaagctggaagcttatcgtggcgccggcatgaacggcagcgcaatggtggatctgggtctggatgaaggcgcattggatgcggaattcactctgggcggtattgaatctcaactgtataagcagtggggcattgcgacagcagatggcgttatgttgcgctttgctggttcttttgagcgcgaagataccggtgatgtggttgcggttgaagttgtgatgcgtggccgcttccaggagttcgatcacggcacttataaacaaggtgataactctcagaccaaaatcaccgcgaaaaacacttatttcaaactgacatgggatggcgaagagctgattgaaatcgacaccatcaacatggttgagaaagtgggcggagaagatcgtctagagcagcatcgccgcaatatcggtcttttttaa

SEQ ID NO: 299 - DNA, 1173 bp, Xenorhabdus bovienii
  Coding sequence Name=Xb4151_4152.C405.gene6.dna; Position on contig =6448..7620bp; Strand=-
atggcacaagattatcatcacggcgtccgtgtacaggaaatcaatgaaggtactcgcaccatcaccacagttagcaccgctatcgtgggtatggtttgtactggtcctgacgcagacgaaaaaacatttccattaaacactccagttttgattactgacgttatgagcgccagtggcaaagcagggaaaaagggaactttgtactcatcactgaaagcgattgctgatcaggctcagcctgtcaccgtcgttgttcgtgtggctgagggcgaatctgaagaagtaaccgtttctaatatcatcggtactgtcactgatgcaggtaagaaaaccggtatgcaggcactgttggcggcgcaaagccagctcggtgttaagcctcgtattctgggtgttccaggtctggattcaaaagcggttgcgattgaactggccagcgttgctcagaaactgaaagcaatggcgtatgtcagtgcttatggcagcaaaaatatctctgaagtcatcaaataccgcgacaacttcaatcagcgtgagctgatgctgatttggccggatttcttgagctgggatactgtttccaatagcgagtctatcgcttatgcaaccgctcgtgctctgggcttgcgtgccaaaatcgacgaggaaactggctggcacaaaacactgtccaacgtgggtgttaacggtgtaaccggtctgtctgctgacgtcttctgggatctgcaagataccgcaactgacgctgatctgttgaacaagagtggcatcactacgctgatccgcaaaaacggcttccgtttctggggctcccgtacttgctctgatgacgcactgttccagttcgaaagctacacccgtaccgctcaagttctggctgacaccatggctgacgcacatatgtgggcaatagacaaaccactgacaccatcactggtacgcgacatcattgaaggtattaatgccaagttccgcgaactgaaatctggtggttacatcatcgacggccgttgctggtatgacgaaaaagccaacgataaagacacgctgaaagcaggcaaactgaccatcgattacgactatacacctgtaccgccactggaaaacatgatgttacgccagcgcattacagatagttacctgatgaatttcgctaaaagtatcaataaataa

SEQ ID NO: 300 - DNA, 1182 bp, Xenorhabdus bovienii
  Coding sequence Name=Xb4151_4152.C405.gene7.dna; Position on contig =8095..9276bp; Strand=+
ttgacgggggatgtgaccctgagtgcggaggatgttcagggagagccccgttttaaccagacgatagatctaacgggtttgagtagtgatcggtattatccggtatggtggaaattcccgtttaatgagcgtggagctaattcatggctgacaatacaccgtaattacgccgagaatcgggagaataaaaatccatttgggaaagatgtaactcatttagcagggctagaggtacaaatagaaggaagcgatacactctggggaggagatgctcagtacctgaatataaaacggatcaatcaacgttatcgtaataccgtcaaaaagattcagtatggcatgatgagtattgcaaggtctgttgatggtaagtaccctctatactatgattggaaatctggcgatatcacagaatgccgtgtatatagtggatgttatttacgaggaggattaacctatcatgttactagtaatttcaataacttagattattcccgtaaagaagatgaagtagaaatatggcatggcgtaagtgattctgataagcgggagattaaatggacggttaaatcttatgctattgatgatcctttattaggaaaagattatgatgatacagtaacgccttacggatctgatattacagatatgctatatcctgtaggaatagttgtatggtttgctcagaataaaaatccaaataatttatttccggggacatcgtggaaatatattggcgaaaatagaactgttcgcttggctgctgctaatggttcaaatgtgttatcaacgggtgggaatgatactaaatggttatctgtcaaccaaatacctaagcacagtcattcttttagcgcaaatactagtaatgcaggcggtcataatcatagtcgtggagatatgaacattactggttatctaccaagtgttattcaacatggggatgatgtttttggtggtgcttttgctagaaatgggcagaataaaccagccgtagactatactgaccactggaaagaacttactacatttgacgcatctcgtacttggactgggcatacatcatggggtggtgagcatattcataatgttagtggtacaacatcagaaattggtaaaggggaaggatttgatgttactaactcttatgttatgttaatggggtggtaccgtatttcttaa

SEQ ID NO: 301 - DNA, 498 bp, Xenorhabdus bovienii
  Coding sequence Name=Xb4151_4152.C405.gene8.dna; Position on contig =9325..9822bp; Strand=-
atggagcgcattgtcgttggcgttagcctgtctgctggagcttattcagatgctccagaactaccagaatcggtagatatcgctgtttgtcgtagtactgatggaaagtcatggattaatgtaccggattaccgtggaaaaactgcctatcacatcaaaaccctaaaacctatgaaaatacagtcaattggcgaaataccttttgaattaactctactagaacctaagactttattcgataaatgggatgggaaacagtgggtaactgatcttaatgaacagaaacaacatgatttaaagcaaatagaaaatcaaaaacaatcgctgttacaggaagccgaaaaaagaattattcaattggaacgtaaggttagacttaatatggcctcaaaggaagaaatttcactattaaatgagtgggaagtttatagtgttaaattgattgatattgatatttcaggtattaacaaacttggctggcctaaaaagccaaattag

SEQ ID NO: 302 - DNA, 375 bp, Xenorhabdus bovienii
  Coding sequence Name=Xb4151_4152.C405.gene9.dna; Position on contig =9942..10316bp; Strand=-
gtgctgccggacagtctacacggttcaatagcacacagtgtcgtttccacgctgtcagtgctgcccgttgatagtgaacgtattccgctcagttatgaatcaccaactctgataagaacggtagttcttgattatgtagggggagttcgtgcagaagctattggcattcctttcgatagtgctgattttacaactcaagcacaacctaataccgcgaaaactcctaataatcaaccaatacctggtggaaatactgattcaggaatatcaggaatagtctctacagcagctttaagagtgtctgactgggcttcttggtggtttagcacccgtccccgtaacatcgcatttttatatatagtgagagcagcataa

SEQ ID NO: 303 - DNA, 546 bp, Xenorhabdus bovienii
  Coding sequence Name=Xb4151_4152.C405.gene10.dna; Position on contig =10417..10962bp; Strand=+
atgaagaagaaaagatattctcagacattcaagctgaaagtggttctgcactacttatcacacccagattgcggatacagtcgaaccgcatcacttttcggactgcatcgtaatttggtaaacaagtggattgatatttatcgcgttcatggtgagcatggactgaaaaaatcattgaacaggtcttattcttttgaatttaaaaagcatgtcgtactgaccatccaacacgaaggactttcattatctgaagccatgaaacgctttaaactgaaagatacagggatgatatctcgatggttggctttgtacagaaaagggggcattgagctactgaagccccgcaaaaggagcagaaaagcatgtacgcgcaacgctgccacccaatataaaccggagtccacaaaaagcgcaaaaccgccccctgaacttttggatgagttagcttatttacgggcggagaacgcctatctaaaaaagctcaccgccttaattgggaaggaagaaaacacatatcagcaaaaacaaaaattatcaccgaattga

SEQ ID NO: 304 - DNA, 420 bp, Xenorhabdus bovienii
  Coding sequence Name=Xb4151_4152.C405.gene11.dna; Position on contig =11369..11788bp; Strand=+
atgatggatctctttaatagagaaatagttgctttccgaacttcccgtaagccggtctttgatttggttaaaaatatgttatctgatgcaatggaaaagctgaaatcacatgagaaacccctgattcattccgacccgggttggcagtaccagatgattcattatcagaaccaaataacagaaaacgggctcatacaaagcatgtctcgcaaaggtaactgtttagataatgccgctatggagagtttttttggaatattgaaatctgagtgttatcacggagtggaatttagctcaatctatgagttggaaaagacgataaccgattatatttattactataatcatgacagaatcaaaattaaattgaatggattgagtccggttgagtacagaactcaatccattatggggatataa

SEQ ID NO: 305 - DNA, 201 bp, Xenorhabdus bovienii
  Coding sequence Name=Xb4151_4152.C405.gene12.dna; Position on contig =11833..12033bp; Strand=-
gtgcagactgcaacaaaacgcctgtatctattaaatgaggttgatacgcaaattatgcggctagagcgtatcacccgcagggaaatagcaacgccagatgagcaaaaatggtttgatgcatgggagctgtatagcattgaactgcaacgactggacaccacagcagcacctgacattgactggcctaaagcgccaaaataa

SEQ ID NO: 306 - DNA, 900 bp, Xenorhabdus bovienii
  Coding sequence Name=Xb4151_4152.C405.gene13.dna; Position on contig =12529..13428bp; Strand=+
atgaatattttcgacctaaaatgcaaacttttcggatggcaagaaacaaacttcactgaatacgaaaagtcttatttttcttttggtggtaacttagccactcatcctctcgtattaaaatttatccatgaacgatataattttaaagaaaaatatttcataaataaaaatagaaattctattaacacatcaatatgtgtatgggataataaatacttagctaatgatcctgcttgtcctttatcaaatgaaataggtattgttgtaccaaatgatgaaatagtgataccttcaagtgaaaatgctcgttttctattaccgattaagtcgaagttcatctcaccattaaattcagaaaatattattaatttaactttcaaacataatgccaaaagatcattatgtttagctaagcctttatcagaaaaatcaaataaaaaatacaaatatagactaaatagctttatgaaatttggtggtgaattagtagatgttcaaatatttagtgcggatgaattaaccgatttttattctcaacttgtagaagaacgatgggggacatgtagttttgataaagaaatgataaatgagttatttcatttaataaaacctatgatttttggtaatgttttattttttaaaggccaaccttgcgcttttcatttcattacaaaaactcaattccatcatcacacaaatattgaatttattcaggctggaatggatagatctgctgaattagctaagtattctattggttcactactgatatggagtaatatatataaagctgtgaatgagtttgataacgttagattttcatttggtagaccatcacgagattataaattaagatggagtaacatttacccaataggcagaacgattacactgatttaa

SEQ ID NO: 307 - DNA, 1518 bp, Xenorhabdus bovienii
  Coding sequence Name=Xb4151_4152.C405.gene14.dna; Position on contig =13546..15063bp; Strand=-
ttgacgggggatgtgaccctgagtgcggaggatgttcagggagagccccgttttaaccagacgatagatctaacgggtttgagtagtgatcggtattatccggtatggtggaaattcccgtttaatgagcgtggagctaattcatggctgacaatacaccgtaattacgccgagaatcgggagaataaaaatccatttgggaaagatgtaactcatttagcagggctagaggtacaaatagaaggaagcgatacactctggggaggagatgctcagtacctgaatataaaacggatcaatcaacgttatcgtaataccgtcaaaaagattcagtatggcatgatgagtattgcaaggtctgttgatggtaagtaccctctatactatgattggaaatctggcgatatcacagaatgccgtgtatatagtggatgttatttacgaggaggattaacctatcatgttactagtaatttcaataacttagattattcccgtaaagaagatgaagtagaaatatggcatggcgtaagtgattctgataagcgggagattaaatggacggttaaatcttatgctattgatgatcctctattaggaaaagattatgacgatacggtgctgccttatgcgcatgattactcagaaaccatcaatttagcgaaaaatgcttatccaatcacaggtggaagacttaatggtgaattagttgcttcaaatgttgttatctctcaaggagatggaagacagcatttttcacttagagataatgatgggcaaacacgtgcttggatatataaagacaaaggtggtgatggaatacatataaataatggctatgatggtggtggagaatggattttaaataaaagtggtgaaatgtattgccctggtacaataagttcttatttagaacacaccattagacatgctggttatgggagaattaattatgtccatcaaaatactggagattatatctttttagaaacaactgaagatggaaaaggcatctatttcgttcaacgaaataaagatcataacaatcaatgggtattacgtttccctcaaaaagatggggttgtagcgacaactgatgacatagctagcaccaataatattcctgttggcattcctttaccatggccacaagaaacaccacctcctggttatttaatttgtaatggtgaaagttttgataaagctaagtgtcctcaattagcattagcgtatccatctggtgtattacctgatctacgtggtgaatttattcgtggtctggatgcaggacgtaatgttgattctgggcgtaaggcactatcatggcaggcagatgagtttagatcccacaatcatgaatttgaagctataaggaacgaaacaggtaattcagtatgggcagacttctttggaactggttctgatttcggcagaaaaaaatacccagttagtaatagtggtggtaaagaaacacgtcctcgtaacgttgcatttttatatatagtgagagcagcttaa

SEQ ID NO: 308 - DNA, 414 bp, Xenorhabdus bovienii
  Coding sequence Name=Xb4151_4152.C406.gene1.dna; Position on contig =29..442bp; Strand=+
atggctaaaactaaaaatacttccctttttatagaacagcttagtgaaattcagcgctatgttacgcaaaaagcaggaaccgaaccgccattttcaggaaaactactgcataacaaaaaaagtggcatttatcactgcctgtgctgccgtcagccattatttatttctgacactaaatttgattctggctgtggatggccaagcttttaccagccgttcaatgataaatccatcaattgtattgatgattattctcacaacatgcatcgaatagaagtgcgttgcagtcactgtcaggcacatttagggcatgtttttcctgatggccccaaaccgacaggagagcgtttttgcatcaattctgcggcactgcgcttcattgacgaggaaactggggatgaaacagaaggttag

SEQ ID NO: 309 - DNA, 276 bp, Xenorhabdus bovienii
  Coding sequence Name=Xb4151_4152.C406.gene2.dna; Position on contig =542..817bp; Strand=+
atgaagttggatgatttactttccgccatgacacctgaaatttatcagagattggttcaggctgttgaattaggcaagtggcaggatggtgtaccgctaacgccggaacagaaagagcacagtttacagatggtgatgctttggcaagccaagcataaccacgatcctgaacatatgacgattggtacggatggccaaattaccataaaaagtaaacaagagttgaaggtcatgttccagtcagaaatggtcgtgaaaccacagccagaagaatga

SEQ ID NO: 310 - DNA, 636 bp, Xenorhabdus bovienii
  Coding sequence Name=Xb4151_4152.C406.gene3.dna; Position on contig =900..1535bp; Strand=-
atgaaaacagcattattacttatcgacctgcaaaatgacttctgctcagggggagcactggcagtcaaagagagtgaagaggtcatcgcaatagcgaataaggctatcagcctctgccagaaaaacaatattactattatcgcaagtcaggactggcatcccgccaatcatatgagttttgcagtcaatgcctgtcagcctgttggagaatctgggttgctcaatggcattcctcaaatatggtggcccgttcattgtgtacaagggcaatcgggcgcagattttcatcctgcgttgaatcaatccgctattcaagaaattttccgtaagggtgaaaatccgcagatagacagctacagtgccttttttgataatgaccataagagcgcaacccggctacatgggtggctggcggagcaaaatattcaacgactgattatgtcgggtatcgctacagattactgcgtaaaatttacagtactggatgcactggaacaaggttatgaaacctacgtgattactgatggttgtcgtggcgtcaatcttcaggataatgacagcctgaaagcacttaaggaaatggcaactaaaggcgctaagctaatcccactgcatgaattaacaacacttttttaa

SEQ ID NO: 311 - DNA, 1020 bp, Xenorhabdus bovienii
  Coding sequence Name=Xb4151_4152.C406.gene4.dna; Position on contig =1559..2578bp; Strand=-
atgcagaagaaatctatttacgttgtttacactggcggcacaattggaatgcagcgctcccctaatggctacatccctgtttctggtcatttacaacgacaactctcacagatgccggagtttcaccgtccagaaatgccaacctttacaatccgtgaacaccaacctctgattgattcttctgatatgagtccaaacgactggggaattatcgccaacgatatctaccagaattaccatgactacgatggctttgtgatcctgcatggtacagacaccatggcttttaccgcagcagcactctctttcatgtttgaaaatcttaaaaagcctgtgatcgtgacagggtcacaaattccactggaagctctgcgttctgatggtcagacaaatttacttaatgctctgtatctagctgctaactatcccatcaacgaggtcggtttatttttcagcaataaactgtttcgcgggaaccgaacaattaaagcccatgctgatggctttgaagccttctcatcccccaactgtcagccactgatcgaagctgggatcaacatccgtacgttcaatacaagcccgatacctgccagtcatggtgggtttaccgtacaccagatcacatcacagcctattggtgttgtgaccatctatccgggattatccagccaagttgttgaaaatatcctgatgcaacctgtcaaggcattgatattgcgctcctatggtgttggtaatgctccacaacgtgctgatttattgaagatcttaagggaagccactgaacggggtattatcgtggtcaatttaacacaatgcatttctgggcgcgtcaacatgaaaggttatgcaaccggccacgctctggctacatcaggtgtaatcagtggctatgatatgacttttgaagccaccctgaccaaattgcactatttattgagccagccctatgaatccgaagagatccgccaccttatgcaacagaatctacgtggcgaattgagctattcagataaataa

SEQ ID NO: 312 - DNA, 1911 bp, Xenorhabdus bovienii
  Coding sequence Name=Xb4151_4152.C406.gene5.dna; Position on contig =2689..4599bp; Strand=-
atgcgtattttatggaagtttataacagcattatttaaatggagttggaaactgctaaatttcgctcgccaacttatttcaaatctgatttttatcctactagttattgtagtagctactggtgttctagtttatcagcaacaatccaaatccgttgatgattatcgcggagccttatatgttgatctgtctggtattgttgtggatcaagtctccgcccgcagtccattagatcaatttggccgggatcttatcggcgtgtctagtagcagctcacaggaaacgtctctgttcgacattgttgacagtattcgacgggcaaaacatgacgctaaaattactggtatggtcttaaaactggataattttctcggtgccgatcagccctccatgcaatatattggtaaggctatcaatgagtttaaggcagctggtaaaaccgttatcgccatcagtgatagttatagccaaccacaatattatttagccagctatgccaataaagtgtacctttctccacatggagcagtgtctcttcatggtttctcaaccaatcatctgtattacaagtcattattggacagtctgaaagtttccacccatattttccgtgtcggcacatataaatcagcggtagagccaatgacacgggacaatatgtcagaagaagcacgccaagcagatagtctctggctgaatgaactttggaacaattaccgcaatacgattgcagttaacagaaaaatccctgccgttagagtgctgccggaacctacccagtttattgaagaattccgtcaagcgggtggagatagtgcactgtacgctgcaaaaaataagttagttgacgaaattaaacctcggaatgttattgaaacagaattaagcaacaaatttggttgggatgagaaaaacaaacatttcaattacatcagcctctatgattatatcgcacagcagccaatcaaaaattctgatcaaagcaatagcaacattgccgtaattattgccgaaggtgcaatcatggatggcagacaatcagaaggcatagcgggtggtgataccatagcggaacaacttcgcgaggcacggttgaatccaaatataaaagccattgtgttacgcgtgaacagccccggtggtagtatcagtgcatctgaacttatccgcagtgaactcgtcgctatccgtgaaggcacaacagtaaaaaataaagaaggtcatactgttaaagaaaatcaaaaaccgattgttgtgtccatgggtggacttgctgcctcagggggttattggatttcaaccccagctaactacatcatcgctgacaaaaatacgctgacaggctctatcggtgtttttggtgttctcaatacttacgaaaaaggcttaaattatcttggtgtaaatacagacggtatttcaacgtatccgctggcagacatttcagttaccaaaggaataaaccctatgttttctgatgttatgcaactgtctattgaaagtggctatcataaatttatcgaattggtcgcacaatctcgccagaagacacagaacgaaattaaagaaatcgctcagggtcgagtctggagtggcagtgatgccaagaaaaatggtctggtcgatcagttaggtgactttgatgatgcagtcaataaagctgctcaattggctggtatcaaaacagtatcattgaattggatgcaaccagaactctcattctctgaaaaactcatgctggagttttcctcatcagcacaagcactgttgccaaataccctgcaatcaatgctgccggctccaattgcccaaattgcgcaagatatgaagcagcaagctgtattttataaccgtatgaatgatcctcagaatatctatacgttctgcctgaactgtgcagatatccgctag

SEQ ID NO: 313 - DNA, 552 bp, Xenorhabdus bovienii
  Coding sequence Name=Xb4151_4152.C406.gene6.dna; Position on contig =4767..5318bp; Strand=+
atgaatgctttggaacttttattaaatcgtcgttcagcttcacgtttgaccacgcccgctcccgaaggaaatgagctggagtatattctggcagcagggatgagagcgccagatcatggggcattgcgtccttggcattttgtcgtcatgcagggcgagggtattgataaattcagtaaattgttggaaaaatcagcgattgagaatgctttgggccaagaagttgaggaaaaagcgagaaatgcaccttatcgtgcacccatggttatcactgttatcgccaaagttgttgaaaatacgaaaatacctgcatgggagcaagtcgtagcggctggttgtgcggtacatgccatgcaaatggcggctgtggctcaggggtttggtggaatatggcgttcaggatcatggacagaagatcccgttgtcaaagcaggtctgggatgtggagagaatgataaaatcgtcgggttcctctatttgggaacacctgtactcaaagcacctgaaaaagtagcattaccggatttgactaactttgttagttacttctaa

SEQ ID NO: 314 - DNA, 390 bp, Xenorhabdus bovienii
  Coding sequence Name=Xb4151_4152.C406.gene7.dna; Position on contig =5331..5720bp; Strand=+
atgccaactgaaatccgtctgactcagtatagtcatggtgctgggtgtggctgtaaaatctcacccaaagtgctggagactattctgcgcagtgagtggccaaaatttttcgacccaaatctgctggtgggaaacgaaacccgtgacgatgctgccgtatacgatatcggcaatggtactggtatcatcagtaccacggatttcttcatgcctattgtcgatgacccatttgattttggccgcattgcaggcactaatgccatcagtgatatctatgcgatgggcggaaagccagtcaggcgattgcgattttgggctggccaactgctaaactattcccagaaatcgcgcaaaaagttattgaaggagatcgggccgtatgtaaattga

SEQ ID NO: 315 - DNA, 198 bp, Xenorhabdus bovienii
  Coding sequence Name=Xb4151_4152.C406.gene8.dna; Position on contig =5734..5931bp; Strand=+
ttgattggggagatgacagcgcgtcagcgccatctcttgtgtgatccacaaacttcgggtggtttattgctggcagtactgccagatgccgtggaagaggcgaaagccattgcacgaagccacaacattgatttaattgccattggtgaactgactgaaccacactcagacagggcattgattgaagttattgaataa

SEQ ID NO: 316 - DNA, 1935 bp, Xenorhabdus bovienii
  Coding sequence Name=Xb4151_4152.C406.gene9.dna; Position on contig =5938..7872bp; Strand=+
atgcgtctttttattgcagaaaaacccagcctcgcgcgagctattgcagatattttgccgaaaccccatcgtcggggggatgggtttatcgaatgcggtaacaaccaatttgtgacttggtgtgtaggccatctattagagcaggccgagccagatacctacgatagccgttatgcgcgttgggtcttgtctgatttaccgatcattcctgaaaaatggcggttgaagccacgggctgctgtggctaaacagctcaacacgattaaatcccttctggaaaaagcggacgaagttattcacgcaggtgaccctgatcgcgaagggcagttactggtggacgaagtgctggattttctgaatcttagggatgataaaaaacagaacgtccagcgctgtctgattaatgacctgaaccctcaggcggtaatcaaggcggttgaacgtctgagaagtaatcgggaattcattcccctgtgtgtttccgcactcgccagagccagagccgactggctctatggcattaacatgacccgtgcttatacattattggggcagaatgctggctatcagggagtgttatctgtcggacgtgtccagacaccggttttgggactggttgttcgtcgtgacgaagaaatagagcactttgtgccgaaagatttctttgaagttaaggcgtacattgttacgccaaacgaggaacaatttacggccttatggcagcctagtgaatcctgcattgattttcaagatgaagaaggacggctcatacaccagccattggcagagcatgtagtggctcgtattacgggccagcctgcttatgttactgcctatcaggataagcgggaatcagaaacggcaccgttgccattttctctttcttctttgcagattgaagcggccaagcgttttggtttaagtgctcagaatgtactggatatctgtcagcgactttatgaaacccataaactgatcacctatccgcgttctgattgccgttatttgcctgaagagcatttcgtcgggcgtcatgctgtcttgaatgccatttcgatacattcttctgatttacttccgcaggatgcactggagagtgataagaagaatcgttgctgggatgataagaaagttgatgcacaccatgcgattgttccgactgctcgaagcagccaagtcaatttgacagaaaatgaaaggcaaatttatggtttgattgccagacagtatctgatgcagtttttacctgatgcggtattccgtaaatgtacgattgaacttgatattgcgggtggcaaattcattgctaaagcgcgttttctggccgaagcaggttggagaactcttcttggcaacaaggagcgggatgaggaaaatgaaggcactccattgcctgttgttgccaagggggatgagcttttgtgtgaaaaaggggaagtggtggaaaggcagactcaaccgccgcgcccttttagcgatgcgactttactatctgctatgacaggtattgcacgatttgtacaggataagtcactgaagaaggtgctacgtgcgacggatggattaggtacagaggcaacaagagccggtattattgaactgctgttcaaacgggaattcttgtacaaaaaagggcgtaatattcatgcaacacctgctggacgagcacttattcatgtattgccggatatggcagtattaccggatatgactgcacattgggaatccaaattaacgcagatcagtgagaaacagtttcgttatcaggattttatgctgccccttcaggaaacattacagcagttaatctggcaggcgaagcagtatcggaacttgaaagcttttagggacttgcctcctgttcctatgaaaggcaaaaaagggaaaacaaaacaggtaaaaaagggcaaagaaaaagtgaataaaacggagtaa

SEQ ID NO: 317 - DNA, 807 bp, Xenorhabdus bovienii
  Coding sequence Name=Xb4151_4152.C406.gene10.dna; Position on contig =7934..8740bp; Strand=-
atgaaatttgtctcattcaatattaatggcctgcgggcgcgtcctcaccaacttgctgccatcgttgaacagcaccaaccagatgttatcggattgcaggaaacaaaagttcatgatgaaatgtttcctttagaagaagttagcaaacttggttaccacatcttctatcacggccaaaaatcccactacggtgttgccctgctcacccgtcagcaacccgttactgttcgtaaaggctttcctactgatgatgatgacgcacagaggcgcatcatcatggctgatatcgaaacgccgcaaggcttaatgaccataatcaacggttactttcctcaaggcgaaagccgtgaacatccggttaagtttccagcaaaagaaaaattttatcaggacctgaatcgctatctggaaaaaaaccaatctccagattcacatattctcattatgggtgatatgaatatcagcccaactgatctcgatattgggatcggagaaaataaccagaaacgctggttaaaaacggggaagtgttcctttttaccggaagaaagagaatggatgggacgtcttaaagactggggcttaatcgacacattccgggcacagcatccagaagccagtgaccagttctcttggtttgactatcgctcaaaagggtttgatgataatcgagggctgcgcattgatttgctgcttgccagccgcccattggcagaacggtgcctctcttctggcatagattacgctatccgcagcatggaaaaaccatctgatcatgcaccggtctgggcggagtttggaatatag

SEQ ID NO: 318 - DNA, 864 bp, Xenorhabdus bovienii
  Coding sequence Name=Xb4151_4152.C406.gene11.dna; Position on contig =9390..10253bp; Strand=+
atgtttttttctcgtaaattagaagcattcatggcggtggtggaaatgggttctttaagcaaagcggcaagagtgatgaaccgtactactcccccagtcgctaaatcaattaaagacttcgaagcgacgttaggaaagcgcttatttaaaagggagaagtttgggatgattctgaccaaagacggagtggaactatataatgacctaaaagaactttatttgaaagagaaagaaattacaaagaaacacatcagcgggagtatttgtaatgttgtaaatatataccatgattggggtaagaaaaagcatctaatttcgctttataaagcagcagacagaaataatgctcaagttaatatattacgcttcagttatgataacatcgatgaaatagttgactatgagggcaatacgataattttaagctcagaaaaagtactcagtgatcgattcagccttgtccgaaaaattgaaggaccaaatttagggatctgctgccgtaaggaattattggatgaggttcacggcgactttactcaattgctgaaaaagagaacatggttatgtgacccagtactctataaaggtaatttgataaagaatttagaagaagaaatgataaaaaatggagagaaagtcaatatacggcaaatggatagtatcgagtgctgtcttaattttattcagtcaacagattatatctttattacagattcccactctggtgcattggaagagggagaaagcttaggctttattccaatatcacgaactgatgcagttaatcagtgttatgtctacaaatcaaaatctcattcaagtgtgttaaatcgctttatagactctgttagcgatatggagtaa

SEQ ID NO: 319 - DNA, 849 bp, Xenorhabdus bovienii
  Coding sequence Name=Xb4151_4152.C406.gene12.dna; Position on contig =10895..11743bp; Strand=-
atgcaaaacgcaaacatacaaaaaaaaatcttgcgtacaatctgtcctgatgccaaaggattaatcgcaaagatcacgaacatttgctacaagcatcaattgaatattgttcaaaataatgaatttgtagatcatcgtactggccgtttttttatgcgcacagagctggaaggtattttcaatgatgaaacatttctagccgatttggatgatgccttgcctgcgggttcaaaccgtgaattaaatacagcaggtcgtcgccgtattgtcattatggtgacaaaagaagctcattgtatcggtgacatcttagtaaaaagcgcttatggcggattggatgtcgagattgctgccgttatcggcaaccatacgatcctgcaacacttggtggaacaatttgatattccgttccactacattagtcatgatggtttaacccgagaacaacatgacgaagcattgatggttcaaatcgaacaatataaacccgattatgttgtactcgctaagtatatgcgtgtcttgacgccagcatttgttcagcattatccgaaccaaatcatcaacattcaccattcattcttgcctgcttttattggtgcccgcccctatcatcaggcttatgagcgtggcgtcaaaataataggtgctactgcacattatgtgaatgataacttggatgaaggcccaatcatcacacaggatgtgataaatgtggatcatacctatactgccgaggagatgaagcgcgcaggattggatgttgaaaaaaatgtgctgagtcaggcattgcactgggtcttttctcagcgggtttttgtgtatggtaatcgtactgttattctctga

SEQ ID NO: 320 - DNA, 363 bp, Xenorhabdus bovienii
  Coding sequence Name=Xb4151_4152.C406.gene13.dna; Position on contig =11811..12173bp; Strand=-
atgcgttccagatatagtgcttatgcaacaaaaaatgcagattatctcatcgcaacttggcacccggattgtcaagctgaaagctggcgttctgaaatagaacaaagttttgcgagtgtacagtggctaggtctaaatgttattgagacaagtgaagggcaacataataacgaagcctatgtcgaattttcagcctgctttattgagcaaggaaagcaagatagacaattgatccatgagcgctcccgttttttgcgcattgaccggcattggttttatttagatggcatacgtccccaaacaggccgtaatagtccttgtccatgtggttcaggcaaaaaatacaaaaagtgctgtggctag

SEQ ID NO: 321 - DNA, 924 bp, Xenorhabdus bovienii
  Coding sequence Name=Xb4151_4152.C406.gene14.dna; Position on contig =12527..13450bp; Strand=+
atgtgtgcatcaaatggagaaatggcattacagatggttgatagagagataaaacctgaactcattttctgcgatttaagcatgcctattatggatggcattgaatttatgagccatatggcgatgaagggattgactattcccatcattattgtttccgcaacaagtaagatgacggagatagatgatgcgctgcgccttggagctaaagacattctgttaaagccgatagccaatctcaatgaggtaaaggaaatggctttggattatttacatccgaaggtatttatgtctgatgcgatagagcaaaaccgcctgattcaggaactgtcgagactaaaacaaaatacggaatcagtctggtgtttattaaaacaactacagccaccggtctcccaaactattgctaactgtagggtaaattaccgcttattaaacacagtaggtaaaatgggtttggtttttgacatcacagcactttctgataatgaaatgattttctattgtctggatattagccgttcgaaagataatggtgctgtatctgcactgctattgagagtagttttcaataatttattgaaaaaacgaaagtttcataaaaaaagtggtctgccagatatgcaagagatcatgaactgggtgaaccggatattaaatgatacggagatttcagaaccacttccattattattgggttattacaatacgcataataaaaccatcttaatgtcatcagcaggattaagtgcgcgtattcagtctggtaatcatcaacagcagttgggtagagggattcctcttggtacgttgaagataattcattcacatcaggtatgtgaacatagttctctttggcaatgccgcatatggaataacaaaaatcaaataaaactgatgttttctccaccattttatcagtga

SEQ ID NO: 322 - DNA, 918 bp, Xenorhabdus bovienii
  Coding sequence Name=Xb4151_4152.C406.gene15.dna; Position on contig =13691..14608bp; Strand=+
atgtcaattataaacaaaaagataaaaaaagctgttatccctgttgctggtttgggaacaagaatgttgccggcgaccaaagccattcctaaagaaatgctcccgctggttgataaaccacttattcagtatgtcgttaatgaatgtattaaggcgggtattaatgaaattattctggttacgcattcatccaaaaactctatagaaaaccattttgataccagttttgaattggaagcgatccttgaaaggagggtcaagcgccagttgctagatgaggtacaatcgatttgcccaaatcatgtgacaattatgcagacccgtcaggggatcgcaaaaggattgggccatgcggtgttatgtgctaagccactgattggtgatgaaccatttgctgttattctgccagatgtcattttggatgaatacagtacagatttgtcgaaatataatttgagtgaaatgttgtcacgctttaatagcagtggagcgagccagatattggttgaacccgttcctttggaaagcgtcgcagattatggtgttgttgattgccttggcgaaaatctgcaacctggtgacagcaagcctattgctcgtgttgttgaaaaacccaaaccggaagaagccccatcgaatctttccatcgttggtcgctatgtgttgtctgaaaaaatctggccattattggcgaaaactgcaccgggtgcaggagatgaaattcagctgacagatgccattgctatgctgatggaaaaagaacccgttgaagcttatcatttgcaaggccgcagtcatgattgtggtaataaattgggttatatgcaggcattcgtcgaatatggtatgaaacataaggacttaggtacagcattcaaggattggatcatgacattgcagaatcagatcgaaaaataa

SEQ ID NO: 323 - DNA, 1344 bp, Xenorhabdus bovienii
  Coding sequence Name=Xb4151_4152.C406.gene16.dna; Position on contig =14633..15976bp; Strand=+
atgaaagttactgtatttggtattggctacgtgggcttggttcaagcaactgtatttgctgaagtcgggcatgatgtactttgtgtcgatgttgatgcaaaaaaagtcgaaaacctgaaaaatggccagatccctatttttgagccaggtttagtaccgcttgtgaagaaaaattttacggaagggcgcctgaattttacaacggatgctaaagccggtgttgcacatggcaaattacagtttattgcagtaggaacgcctcctgatgaagatggatcagcagatcttcaatatgtcactgctgtagcccgtactattgcggaaaacatggatggctacaaagttgttgttgataaatcaacggtacctgtaggtacggctgataaagtcagagcagtgatgcaaacggcattaactcaacgcagcgcagattttccatttgatgttgtctccaaccccgagtttttgaaggaaggggcagcgatttctgactgtatgcgtcctgagcgtattattattggctgtgataatgacaatgtgattgatgtgatgcgcgaactgtatgagccatttaatcgtaatcatgatcgtatgattgtcatggacatccgcagtgcagagttgactaaatatgcagctaactgcatgttggcaactaagatcagttttatgaatgaaattgcaaacttggcagaaatgttaggggctgatattgagcatgtacgtcagggaataggttctgattcgcgtattggctatcatttcatttatccaggatgcggatatggtggttcatgtttcccgaaagatgttcaggcattgatccggacttccgagcagattggatatacacctaaaatacttcaggcggtggaactggttaacgaaaaacaaaagagtaagctgcctacttttgttaaacgccattttggtgatgatttatcaggtaaaacattcgcaatttggggattatcatttaaacctaatacggatgatatgcgtgaggcatcaagtcgcgtattgatggaagcattgtgggaaagcggtgctaaagtgcaggcatatgatccagaagctatgcaggaagctcaacgtatttatggccagcgtgatgatctttctcttatgggaacaaaagaagcggcattaaaagatgcggatgctttgattatctgtacagaatggcagaatttcagagcgcctgatttcgatatagtgaaggattcaatgaaatcgccaataatttttgatgggcgcaatctttacgatccagaacgcctgcaatcgcgtggattcacttactatggcattggtcgtggcgcctctatcaatccagttgtttga

SEQ ID NO: 324 - DNA, 1017 bp, Xenorhabdus bovienii
  Coding sequence Name=Xb4151_4152.C406.gene17.dna; Position on contig =15985..17001bp; Strand=+
atgaaatttttagtgacaggttccgctggttttattggttttcatgttagccagcggttattgagtatggggcatgaagttgtcggtatcgataacatcaatgattattatgatgttaatttgaagcagtcgagattaaatttattactccctcatacgaattttcaatttgaaaaattagatctggcagacagaattgcaatctcggaattgtttgttaaacaccaatttcagcgagtcatccatctgggagcccagccgggggttcgttattcaatacaaaacccaatggcatatattgacgccaatatcgttggtcatatcaatattcttgaaggatgtcgtcataatcgtgttgagcacttattatatgcatcttcaagttcagtgtatggattaaataaaaagcaaccgttttccactaatgattcggttgatcatcctgtttctttatatgcggcgacgaaaaaagctgatgagttaatgtctcacagctattctcatctctatcaactaccaacaacgggattgcggtttttcactgtatacgggccgtggggacgccctgatatggctttatttaagttcactaaagctatgttagaggggcggtcaattgatgtttataatcatggtaatatggtgagggatttcacatatattgatgatattgtcgaatctataatcagattgcaagatatcattcctattcctaataaagactggttagttgaagatggggagatatcttctagctctgctccgtatcgtatttacaatattggtaacggtcagccgacaaaattgggtgattttattgaagctattgaagcgtcattagggattaacgccaagaagaactttatggaaattcaggatggtgatgtattatcaacttgtgcggactcaaacacactttatgataagattggcttttcacctgatactccagtgaaggaaggggtgaaacggtttgtcgattggtatttggatttttaccagaaatcggaacaatga

SEQ ID NO: 325 - DNA, 402 bp, Xenorhabdus bovienii
  Coding sequence Name=Xb4151_4152.C406.gene18.dna; Position on contig =17235..17636bp; Strand=-
atgagcgaaaatttaaaatccttaaataacatccgtaccttgcgcgcacaagcaagagaatgtgaacttactaccttagaagaaatgttggaaaaactaacgattgttgttgaagaacgtcgtgacgaagacagccaagctcgcgcacaaatagaagagcgcagccgtaagcttcaagaatatcgtgaaatgctggagaaagacggcattgaattaagcgatttagtagatgctttaagcggtaaagccactagcaaatctaagcgtgctacacgtccagccaaatattcatactttgacgaaggtgaaactaaaacttggactggccaaggccgtacaccagctgtaatcaaaaaagcaattgatgaagaaggcaaaaagctggaagatttcttgatctaa

SEQ ID NO: 326 - DNA, 600 bp, Xenorhabdus bovienii
  Coding sequence Name=Xb4151_4152.C406.gene19.dna; Position on contig =18284..18883bp; Strand=+
atggctcagctttatttttatcattctgccatgaatgcagggaaatcaacttctttattgcagtcctcctataactataacgaaagaggaatgagaacgctgatttttacagcagaaatcgatacgcgatttggtaaagggcgggtcagttcccgtattggtctatctgtcgatgccttattgttttcaccggagacaaatatcgctgaacttatcagatgtgaaaacgagatgaaaaaagttcattgtgtcttgattgatgaatgtcattttttaacaaaaaaacacgtcgaacaactgtgtgaaatcgttgattatgacgatatccctgtcctttgttacggattacgaaccgatttccaaggtgagttattcagtggaagccaatatcttctcgcttggtcagataaattggttgaattgaaaactatttgccattgtggaagaaaagccagccgcgtactgcgttttggcagtgacggaaaggttgtttatgatggtgcacaggttgatattggaggcaatgaaaaatacgtctccgtgtgtcgtaggcactatactgacgttattcgtgaagctcagacaaaaaaaattccatga

SEQ ID NO: 327 - DNA, 2655 bp, Xenorhabdus bovienii
  Coding sequence Name=Xb4151_4152.C406.gene20.dna; Position on contig =18987..21641bp; Strand=-
atggctgtaactcagattgccgaactcaatgaattaattgctcgtgtaaaaaaagcccagagagaattcaccaatttttcccaagaacaaattgaccgaattttccgtgcggctgctctcgcggcagcagatgcccgtattccattggcaaagttagctgtagctgaatctggtatgggtattgtggaagataaagtgatcaaaaatcacttcgcttctgaatatatttataacgcctataaagatgataaaacctgtggaattttatctgaagacaataccttcggtacgataaccatcgctgaacctattggcttgatttgcggtattgttccaaccacaaatccaacgtcaaccgcgattttcaaagcacttatcagcctgaaaacccgtaatggtattattttttcgccccatccacgcgccaaaaaagcaaccaatagggcagcagaaatcgttcttcaagctgctgttgcagccggcgcaccaaaagatatcatcggttggatagatgaaccttctgttgaactatccaatgctttaatgcatcaccctgatattaatcttattttggcaacgggtgggcccggcatggtaaaagcagcctatagctcaggcaagcctgcaattggtgttggtgcgggtaatacgccagtggtgatcgatgaatctgcggatatcaaacgcgccgtagcatcgatcctgatgtccaaaactttcgataacggcgtaatttgtgcttctgagcaatctgtaattgtcgtcgataacgtttatgatcaagtccgtgaacgtttctcaacccacggtggttatctcctgcaaggagaggagcttcaagccgttcaagatatcattttaaaaaatggcagtctgaatgccgccatcgttggccaacctgcaaccaagattgctgaaatggcaggtatttgcgttcctgatgaaactaaaattcttatcggtgaagtcactttggtggacgaaacagaaccttttgcccatgaaaaactttcgccactgcttgctatgtaccgtggtaaaaactttgaagatgccgttgaaaaagcagaaaaactggttgaaatgggtggtattggtcacacctcctctctctatactgatcaggataatcaatccgaacgtatcgaatatttcggcgacaagatgaagactgcccgtattctgataaatacaccagcatctcaggggggaatcggcgatctttacaatttcaaactctccccttctctaacactgggttgcggctcttggggaggaaactccatttccgaaaacgtggggccaaaacacctgatcaatacgaaaactgtcgccaaaagagccgagaatatgttgtggcataaacttcccaaatcaatctattttcgccgtggctccctgcccgtagcactggaagaagttgctacagatggcgcgaaacgtgctttcatcgtgacagaccgtttcttgtttaataacggctacaccgatcaggttatcaacgtattgaaatctcacggaatagaaactgagattttcttcgaagttgaagccgaccctactttaggcatcgtccgcaagggcgccgaacaaatgcatctgtttaaacctgatgtcatcattgccctaggagggggttcacctatggatgcagccaaaattatgtgggttatgtatgagcatccagaaactcactttgaagaattggcactgcgttttatggatatccgcaaacgcatttataaattccccaaaatgggcgtgaaagcaaaaatggtagcgattacaaccacctctggaacaggttcagaggtaacaccttttgcggttgttaccgatgatatcactggacagaaatatccattggcagattatgcactgacacctgatatggcgattgtcgatgcaaaccttgttatgaatatgccaaagtcgctgtgtgcctttggtggattggatgccgttacccatgcactcgaagcttatgtctctgtcttggctaatgaatactctgatggtcaagcattgcaagcgctgaagctattgaaggattttctgcctgccagttaccatgaaggtgctaaaaacccagttgcccgcgaacgtgtccataatgcggcaaccattgccggaattgcctttgccaatgcttttctgggagtctgccattctatggctcataaactgggctctgagttccatatcccacatggattggcgaatgcgttgttgatctgtaacgttattcgctacaacgctaacgacaatccaacaaaacaaactgcattcagtcaatatgaccgtccacaggcacgacgccgctatgctgaaattgcagagcatctggggttgacggtatcaggggataacactgccgccaagattgaaaaattactggcttggctggaagagctaaaatctcaattaggtattccagtatcaattcgtgaaacaggcgttcaggaaaccgattttctaacgaaaatcgataaactcgcagaagacgcttttgatgatcaatgcacaggcgccaacccgcgttatccactaatttctgagttgaagcaattgatgctggattctttttacggtcgtgaattcacagaatatgccatatctcaggaagcagaaaaaccaaacagaaaaaataaataa

SEQ ID NO: 328 - DNA, 456 bp, Xenorhabdus bovienii
  Coding sequence Name=Xb4151_4152.C406.gene21.dna; Position on contig =21970..22425bp; Strand=-
gtgggtaaaaatcataaaagtgcattattgacattagttgaacgaaaatcgttatttactattataattaaacttgaaaataaaacagcagaaggggtcgcaaaagcggcaacaagacatttatcactgataaaacataaaattaaaacaatgacctttgataacggcctcgaatttgccgaacacgaactgatcagtaaaaatttagagacaaaaatttattttgctcacccgtattccccctgggaaagagggataaatgagaacacgaatggattaatcagagattacttcccaaaaggaactgattttaataaggtgtcagagcgggagattaaccttgtggcaaaccgattaaataatcgtcctcgtaaaacacgagattacaaaacaccgaatgagttatttaaaggaataccctctcatttacttcgtccattacggtgttgcgcttaa

SEQ ID NO: 329 - DNA, 93 bp, Xenorhabdus bovienii
  Coding sequence Name=Xb4151_4152.C406.gene22.dna; Position on contig =22508..22600bp; Strand=-
atgactggtaatttctggcaacatcttaggcttgcgaaaaaaccgtatcgtaaacgctatggaagttatgaagccgccagaggaaaaaattaa

SEQ ID NO: 330 - DNA, 1191 bp, Xenorhabdus bovienii
  Coding sequence Name=Xb4151_4152.C407.gene1.dna; Position on contig =469..1659bp; Strand=+
atgttggatagccaagttatcgctaccgtaaaatccaccatcccactgatcgtttctaccggcccaaaactgaccgcacatttttatgaacgtatgttcaaacacaatcctgaattgaaagatattttcaacatgagcaaccagctaaacggtgctcagcgtgaagcgcttttcaatgctctttgtgcttacgcttccaatatcgataatttacaggcgctattacctgccgtagaaaaaattgctcataaacataccagcctgaatattcagcctgagcattatcagattgttggcactcacctgctggcaacacttgatgagatgtttcatccaggcgatgaagtcctgaatgcatggggtaaggcttacgaggtattggcagatgtctttatcaatcgagaagaagatatttatcaaagaggtgaatctgaggaaggcggttggcgtggattacgtcaattccgtgtcaacaagaagcaaccgcagagtgacgttattaccagcttcgagtttgtgcccgctgatgggggtaaggtcatagattacaaagcagggcaatatttaggcatctacctggacactcccgtttttgaaaaccgagaaatacgtcagtattcactgacaacagcaccaaacaaccacagctaccaaatcgcgattaaacgtgaagcacaaggtaaagtatcaaactatatgcatgataatgtgcaggaaggcgataccatattactggcaccaccacgcggtgactttttccttgatgtccaatcagatacacccgttacactgatttctgctggtgtcgggctgactccgatgatgagtatgctgcaacatctgcataaccaacaccatgtcggtacagtgaattggttccatgccacagagcatggcggttatcatgctttcgcagataaagtgaatacgattacccaatccatgaccaatttacatactcaagtttggtatcgcgagccaagaaacgaagatcaacaaggcgcagattaccagcatatgggactcatggatttatctgtcgtgaaagattcaatcactgaggaaggaatgcaattctatttctgtggccccgtcgtattcatgcaatatatcgcccaacagctcttggcaatcggcattgataaacagcatattcattatgaatgttttggcccacataaagtactttaa

SEQ ID NO: 331 - DNA, 339 bp, Xenorhabdus bovienii
  Coding sequence Name=Xb4151_4152.C407.gene2.dna; Position on contig =1744..2082bp; Strand=-
atgaaaaagattgatgcaattatcaaacctttcaagctggatgatgtgcgtgaagcgctggcagaagtgggtatcactggtatgaccgtgacagaagtgaagggatttggtcgccagaaagggcatactgaattatatcgcggtgcagaatatatggtggattttctgccaaaggtcaaaatagaaattgtagtaccggatgatattgttgatacctgcgtcgaaactatcattcagactgcgcaaacgggcaaaatcggcgatggtaaaattttcgtctttgatgttgcccgtgttgtgcgtattcgtactggtgaacaggacgaagaagcgatttaa

SEQ ID NO: 332 - DNA, 1623 bp, Xenorhabdus bovienii
  Coding sequence Name=Xb4151_4152.C407.gene3.dna; Position on contig =2098..3720bp; Strand=-
atgagtcgtactcttaatatcgttcttgcccagctaaattggctggtgggagacatcgaaggtaacagcgaacgtatgttgcagacagtacaggaacagcagaaaaaaggtgctgatctggttatgttttctgaattggcgctgtcgggctattttcctgaagatctactgtttcgtgctgatctgcatcaacgttgccgtgaacaattggtacgtttgcaggaggcaagctctcaggtcgctattctggttggtcatccgtggcaacaggacggtaagacttacaacgcactttctctgttttggaaaggcgaaattattgcccgttatttcaaacaattactgcctaactatggcgtttttgatgaagatcgttatttcaaagcgggtgatcaaagctgtgttgtaccattcaaaggctataatctcggtttattaatctgcgaagatttgtggtttgatgcgccgattgacgcgttgaaacaagcaggatcggatatcattctttcccttaacgcttcgccttataaccgggaaaaaccgaatattcgcagcacattgattcaatcgcactgtcagcgaactcaattgccgatcatctatctcaatcaggtggggggacaagatcagctaatctttgacggttgctcgaaagtctttgatgcaaatggcaaaattacccatcggatggcggcttttgaagaacagattgagcagtgccgtttcaatgagatgaatattgagccaatggcaaatttgatccctcaattgtcgccgcttgcgcaaatctacaaggcactagtgctttctgttcgtgattatgtgcataaaaatggttttaaaggtgcattactgggcttatcaggcggaattgactctggcctgacactggcgattgcggtggatgccttgggtaaagatcacgtacaggcagtgatgatgccattccgctatacctccgaaatgagcattcatgatgccagagaacaagcggaattactgggtgttgaatttgatgtggtatccattgaaccgatgtttgatgcgtttatggcgcaactcgaaccgatgtttgcggggacagaaaaagacacgacagaggagaatttgcaggcacgttgccgcgcagtcattctgatggcgatgtcgaacaaacgccgccgtctggtactgacaaccagtaacaagagtgaatcggcggtagggtactcgaccctgtatggcgatatggcgggtggctttaatgcattgaaagacgtacctaaaactatggtatttgcgttgtcgaaataccgtaatacagtatctcctgccattcctcaacgtgtgattgatcgaccaccatccgcagaactggcacctgatcaacttgatcaggatagtttgccgccatatgacatgttggacgctattcttgaaggatatgtagaaaaagataaatccgtggctgacttagttgctcaaggttttgacgaagccatcgttcgtaaggtgatccggttggttgatatcaacgagtataaacgccggcaggcacctatcggcccacgtattacagagcgtgattttggtaaagacaggcgctacccgattacttctggttttgggcgtaaaaactggtaa

SEQ ID NO: 333 - DNA, 1338 bp, Xenorhabdus bovienii
  Coding sequence Name=Xb4151_4152.C407.gene4.dna; Position on contig =3826..5163bp; Strand=-
atgactgtgcgcaatcccgcccgtcttcttttagttgacgatgatccaggcttactaaaactattgggaatgcgtctgaccagcgaagggtttcgtgtcacgacggcagagagtggtcatgaagcgttgcgtctattggcgaaagaaaaagtggatttagtcatcagtgacttacgcatggatgagatggatggcatggcattgtttgcggaaatccagaagcagcatcccggtatgccagtgattattctgacggctcacggttctattcccgatgctgttgcggcgacacagcaaggtgtatttagtttcttgactaaacccgttgatcgtgacgctctttataaagccattgatgctgcgttggaactgtcaaaaccggccatagatgggcagtggtgcgaacagattgtaacgcgaagccccttgatgctgcgtttgctggaacaggcaaaaatggtcgctcaatcagatgtcagcgtcctgattaatggacaaagcggaacgggtaaagaagtgttggctcaagctatccatcgggtaagccccagagtgaagaaaccttttattgcgatcaactgtggcgctttgcctgaacaattgctggagtctgaattattcggccacgccaaaggcgcatttactggtgcggtcagcagtcgggaagggctgtttctggcggcgcagggaggaacattattccttgatgaaatcggtgatatgcctttggcactgcaagtcaaactattgagagttttacaggaacgcaaagttcgcccattggggagtaaccgtgatatagacatcgatgtcagaattatttccgccactcaccgtgacttacccaaggcgatgcagcgtaatgaattccgcgaagatctctactatcgactgaacgtcgtcaacatgaaaattcctgccctgaacgaacgggctgaagatattcctttattggctaatcacctgttacgtgcatctgccaaacgccataaaccttttgtccgcagtttttcgactaatgcgatgaaatgtctgatggcagcgagctggccgggcaatgtacgtcagttggtcaacgttatcgagcagtgtgtcgcactgacgactgcaccggtgattagtgatgcactggtcatgcaggcgctggaaggggaaaacacggcattgccgacatttgtggaggctcgtgggcaatttgagttgcactacctgcgtaaattgctgcaaatgaccaaaggcaacgtcacccatgctgcccgtatggcaggacgtaaccggacggagttttataaattgctggctcgtcacgaattggatgccaacgattttaaggaataa

SEQ ID NO: 334 - DNA, 876 bp, Xenorhabdus bovienii
  Coding sequence Name=Xb4151_4152.C407.gene5.dna; Position on contig =5166..6041bp; Strand=-
atgtataacaggtttacttaccgttttatgatgaagacggagcagcagaatattgtgattcaaccgatgaaaaaacctgctgtcatgcagcattttcttgagcgggcttcagccttgcgtttccgtgtcatgatactattgtttattccctatttgctgtcaggatgcgctgaaactaccggaaatgatgagttattgacaatagcccaagccattatgccagaacagcgggttacggattaccggcttaagggatgtgatggaatatggaatatcgtcaaaccagcggcaatggaaaacggtctttattggttgaaggtgatggattgcacggatcgactatcctcgctggaagcccgcgatactgccaaacgttttacgccggctgcaccgactgattgggggcacgttttcaaacaaagtatcttgatgaatcgagccactcctacgctgattgaacgtcgcaaaattgtagaaaacctcaaccgatatagtccacaatttccgtctgcattgaggccgctactgcaattgtggcgggaacagcaatatttgaaaattaaccttgcagaagaaaggttgaaattccagcgattgcagtttgatagtgacagtaaaattgatcgactgaaagaaatacgggcacgtttggagcatgatcttcgttcaatttcccgcaagctggaaaatttgactgatattgaacgccagctttcctcgcgcaaacaagatcagagcagtgttgccacattgggtgaaacagagcatttaagcaatgtagaagcctctgagcaattaaaaccggaagctaagccggaaatgcaccagaaaaccgaatcagaagccaatctcccagaagaaaaaggagttgaataa

SEQ ID NO: 335 - DNA, 1476 bp, Xenorhabdus bovienii
  Coding sequence Name=Xb4151_4152.C407.gene6.dna; Position on contig =6047..7522bp; Strand=-
atgtcggttagcatcaatgtaattacaggttatgagatgatttctttgaataaatggcgtttatttccccgttcattgcgccaattggtgttaatggctttctggctggtgttattgccactcttagtactggcttatcaggcttatcaaagtcttgatcaactcagtacacaagctgccgaaattaaccgcacgactttggcagatgcccgccgtagcgaagcgatgataggcgtagcccttgagatggaacggagctatcgccagtattgtgtattgggggatgtcaggcttgaaaagctctatcaacgtcaataccgacagtacctcaacatgcttggcaatcagatgatgatgctggctaataaggaatatacccagcggtttaatcaattactgtccggtcttaccaaaatttcctgtagtaatggcatgccagaaccggtggcaaacaagcggcttgaacaattttccacagccaataatctcctggtgcaagaaacccgtaacatcatctttattcgtggtgagcaactacaaaaagatattgcagacaaagggcagttatttggctggcagagcctaatcttattcctgctgagcgcttttttgatcaccctttttacccgtatgattatcgggccagtgaaagggatcgagaatatgattaatcggctgggggcgggacaaacactggataatcagattgaatcctttcagggaccccgggaattgcgatcactggcgcagcgtattatctggctgagtgaacgtttgtcttggcttgaatctcagcgtcacgaatttttacgtcatatctcccacgaattaaaaacgcctcttgcgagtatgcgtgaaggcacagaattactggcagatgaaatagcagggccactgacggcagatcaaaaagaagtggtgagtattctggacagcagtagtaaacatttacaacggctcattgaacagttgctcgaatataaccgcagattggcagatagctctgtcgagcatcagattgtatctttaaaagaaattgtcgatagcgtcgtattgtcacatcagttgccagcacgtgcaaaaaatattaatactgaaattcaattggatacatttttttgttgggcagagcctaaactattaatgggggtgattgataatctctactccaatgcagtgcactatggtgctgaatccggtaacatctggatttccagtcggcaagtaggtaaaaatattcagattgacattgctaatacggggacgcctatccctgaattagagaagagcatgatttttgagccattttatcaaggaaagctgcaacgcaaaggcgcggtcaaaggaagcggtcttggcttgagtattgcgcaagattgtattaaacagatggggggagaactgcatctgatagaacccgaatttgctgacgtatgttttcgaattgaactgccattaaccgcagagaatgactaa

SEQ ID NO: 336 - DNA, 156 bp, Xenorhabdus bovienii
  Coding sequence Name=Xb4151_4152.C407.gene7.dna; Position on contig =8087..8242bp; Strand=-
atgttgcgtaagctctcaaagtttttgctaaataaaacaaaacagtggggagataagggggactattccggtgttttctgcgatgcaacatacactctcattgtctctatatcgcgacaatggcctcttaatgcgtctcaaataagagacatttaa

SEQ ID NO: 337 - DNA, 3888 bp, Xenorhabdus bovienii
  Coding sequence Name=Xb4151_4152.C407.gene8.dna; Position on contig =8368..12255bp; Strand=-
atggaaattctgcgtggatcgcccgctttatcagcgtttcgtattactaagctcctttcccagtgccaagatcagcagcttcccgttacagagatttatgcggaatatgtgcattttgcagaaattaattcgcctatcacaggagatgagcgggagaaattaaatcggttattaaaatatggcccctctttggatgaacatgaccctaaaggtcaactattgctggtgactcctcgtccgggcacgatatctccctggtcatcgaaagcgacagagattgtgcacaattgtggtctgaaacagattacccgcttggaaagggggattgcctattatatccagagtgatgaaatgagcgatgggcagtggcaggagctgtctgcattactgcatgatcgaatgatggaaagtgtgttcactcaatctgaacaggctgaagccctgttttctcaccaacagcctgcaccactgaaacagatcgatatcttgcagtcagggcgtgctgcattggaatcagccaatattgaattgggattggctttggcagcagacgaaattgattatctggtgagagcctttcagacattaggccgcaacccgactgatgttgaactctacatgtttgcgcaggcgaactctgagcattgccgccacaaaattttcaatgcggattgggtgattgatggtcaggaacaacctaattcactgttcaagatgatcaaaaacacgtttgaacagacgccggattatgttttctctgcttataaagacaatgccgccgtgatggaaggttcgcagattgggcgctttttccctcatcctgaaagtggtgtgtatgattaccaccaggaacccgcccacatattgatgaaagttgaaacacataaccatccaaccgccatttctccttggcccggtgcggcaacgggatcaggcggggaaattcgggatgaaggggcaacagggcgaggtgcaaaacccaaggccggattggttggtttttcggtatctaatctgaaaattcccggatttgaacaaccgtgggaagaagatttcggtaagcctgatcggattgtcagtgcgctggatatcatgctggaaggcccgttgggaggtgccgcattcaacaatgaatttgggcgtccagcgttgctagggtatttcagaacttatgaagaaaaggtgaattcccataatggcgcagaattgcgtggttatcacaagcccatcatgctggcgggagggatcgggaatatccgtgaagaacatatccagaaaggcgatatttctattggcgcgaagctgatcgtactgggtggcccaagcatgaatatcggtttgggtggcggtgctgcttcctcaatgacatcaggccaatctgatgcagagctggattttgcatcagtgcagcgtgacaacgcagaaatggaacgacgttgtcaggaagtgatcgatagttgttggcaattaggggataaaaatccgattttgttcattcatgatgtgggtgcgggtgggttgtcaaatgcaatgcctgagttagtcagcgatggcggccggggtggtcgctttgagttgcgcaacattctcaatgatgaaccgggaatgagtccattgcaggtatggtgtaatgaatctcaggaacgttatgtcatggcagtggcaccagaacaacttgtacagtttgaggaaatctgccgtcgtgaacgtgctccgtacgcagtgattggagaggcgacggaagaacgtcatttgctactgaatgacaatcattttgataatcaacctatcaatatgccgctggatgttttactcggcaagacgccaaagatgctgaaaaatgtgatgaccctgaaagcgcagggtcatagtttagaacgcagagatattgatttagctgaagcagtaaaacgagtcttgcacttaccggcagtggcagagaaaacattcctgattacgattggcgatcgttcaattactgggatggttgctcgtgaccaaatgattggcccgtggcaaattccagtggcggattgcgctgttactacggccagtttggacagctattatggtgaagcgatgtcaataggtgaacgcgcgcctatcgctctattgaattttgcagcatcagcgcgtatggcggtcggggaagcgctgaccaatatcgcctctgcctatgtacaagatctgaaacgggtgaagttatcggctaactggatgtcagcatcaggccatgccggggaagatgccggattatatgctgcggtcaaagcagtgggcgaagaactgtgtccggcgctgggattaacgattcctgtcggcaaagattccatgtcgatgaaaacttgctggaaccaaaacggtgaagaacgtgaaatggccgcaccgctttcattggttatcactgcatttgcacgggtggaggatgttcgttgtaccgtgacaccagagttatctaccgatgatgataacgcactgctactgattgatctggggcaagggcaaaatgcgttgggaggaacagcactggcgcaagtttatcgtcagcttggtgacaaaaccgcagatgttcgcagtactgagcaactcgcaggtttctttaatgcgattcagcaattaatttcagaacaaaagctgctggcctatcacgatcgctctgatggtggcttgttggtgacactggcagaaatggcttttgcgggtcattgtggactgcgtgccgatatcagtgcattcgatgaagatattttggcagcactgtttagtgaagaattgggcgcagtgattcaaattcgtcagaccgacagagaacaggttgaaaaactgctggctgattatggactgagagaatgcgtacactatttggggctggctcaggcgggagaggatttcgtgatctccagcaacgatatggatgtctatcgccaaaatcgcagcacattgcgcttatggtgggcggaaacgacgtggcagatgcagcgcttgcgtgacaacccagagtgtgctgaccaagaacatcagacgaaacagaatgtgaacgatcccggcttgaatgtaaagttaaccttcgatccggcagaagatattgctgcttgttatatttcgaaacaagtgcggccgagagttgcagtattgcgcgaacaaggtgtgaactctcatgtcgaaatggcggcggcattccatcgtgctggttttgacgctgtggacgttcacatgagtgacttgctgagtgggcggattacgctggatcaattccagacactggttgcctgtggcggcttctcatacggtgatgtactgggtgcgggcgaaggttgggcaaagtctattctgtttaattcacaggtacgggatgattttgcgaactttttcgcaagaccggatactttagcccttggcgtgtgtaacggctgccagatgatctccaacttacatgaattgattccgggcactgagcactggccgcgttttgtacgtaatcgttcagaacgctatgaagcacgtttcagtttagtggaagtggcagatagtccttcactatttttgcaaggaatgacgggttcccgtttgccaattgcggttgctcatggtgaagggcaggttgaattcaggaatagccagagcttggctgaactggaaaaacaccagcaggttgcattacgttttgttgataactacggtctggcgacagaaaactatcctgctaacccgaatggctctgtgaacggtattactgcggtgactagccttgatggacgagtgacggcgatgatgccgcatcctgaaagggtattccgtactgtcagccattcttggcatcccaaagagtggggggaagacggcccatggatgcgtattttccgtaatgcgcgcaggcagttaggttaa

SEQ ID NO: 338 - DNA, 1497 bp, Xenorhabdus bovienii
  Coding sequence Name=Xb4151_4152.C407.gene9.dna; Position on contig =12520..14016bp; Strand=+
ttgagcaatatcaagataaattattttgtcatcgtcattatcgcgctcctctctgctgcaatcattggccgtaatatcagttggcccaacaaacagcaggagcagataaacaggattctggcacggggagagcttcggattagtaccatcagctcccctctgatttctgcgaacagcaaaaatgaagcaacggggtttgactatgaattagccaaacggtttgctgaatatctaggcgtaaaacttgtcattcattttcgcactaatattaaccagatttttgatgacttaaacaacgataacgcagattttctcgctgctggccttatttataatgaggagcggttagaccaggcacgcattggccctgcctattattcagtctcacagcaactgatttaccgcaaagatacaccccgcccacgcacgtttggcgatttaaacggcacactggttgtcactgaaggatctgcccatgccagagaactcaaaaaatataaagaagagtcttatcccaatttaacttgggaagatacatcacgcgataacacactagaactacttgagcaggtgtccgaaggcaaaattaactatacgatcagcgattcgatcagtttttctctgcaacagcgtattcatcctaatttggcccttgcttttgaagtaaatggggaacgtcctctgacttggtatttgaagcgcagtgatgactataccctttactctgctatgctcgattttttcaatcagatgtcagaaaacgatgtgataccacagctggaagaaaagtatttcagccatatctaccaattcgattattttgatactatttcattcattcgcgctatcaatagcacattaccgatatatcagcctatttttgagaaatacgctggctcacttgactggcaattagttgcagccatcgcatggcaagagtcacattggaacccgcaggcaacttcacccacaggtgttcgcggtatgatgatgcttactcgcccgaccgcagaatgggtcaagatcagtgatcgacttgatccggaggaaagtgtaaaagggggtatggtttatctgcattatctgatggagcggttgccgaaaaccattcctgaagatgaacgtatctggttcgccctagctgcttataacatgggttatgggcatattctcgatgtccggaaactcacggcagaacaaaaaggtaatcctgaccgttggctggatatcaaatctcgccttgatctgttaagcaagaaaaaattctataccaacacaacatatggctatgcccgcggacatgaagcatatcgctatgtcgaaaacattcggcgttattaccagagtctggaagggtacttgcgagcaaaagataaacacagcaagaaagcagaatatgaaacaccgattgataagatcatcgtgcctctttcagatagggaaggaaataaagccgtggttaatgaaaaaacgccggaagtcaaaacaccgacgtaa

SEQ ID NO: 339 - DNA, 510 bp, Xenorhabdus bovienii
  Coding sequence Name=Xb4151_4152.C407.gene10.dna; Position on contig =14045..14554bp; Strand=-
gtgacagaaatatatagtgatgaatactggatgcggcgggcaatggagctggcaatgcaggcacaatctcaggacgaaattcccgtcggggctgtgctggttgccaataataaaattattgcagaaggctataatcatccgattaccgagcatgatcccactgcccacgcagaaatcattgctctgcggcgtggtggcatcgaattgcagaattaccgtttgttgaatacaaccctatacgtcactctggaaccctgtgttatgtgtgcaggcgcgatggtgcatagccggatacagcggctggtatatggtgcaagtgatatgaaaaccggcgcagccgggtcattgattgatatcctacggcatccgggcatgaatcatcagattgaaatcacggctggcgtactggcgcaagaatgtgccacgatgttgagtacgttctttaaacaacgcagagaacagcataaggcattaaaaaaactaaaaatacaacagcaggaaacgctatag

SEQ ID NO: 340 - DNA, 645 bp, Xenorhabdus bovienii
  Coding sequence Name=Xb4151_4152.C407.gene11.dna; Position on contig =14633..15277bp; Strand=-
atgttatttttttcaccatttgaagatttagcccaacaacttttgcctattgcagtagaaggtgattatggcgctcatgatattgcccatttgcatcgagtatggcgaaacgcgaagagaatttgtgaggttgaatctggaaatttacagtgggtattggccgcagttttattacacgattgcgtcagtgttgaaaaaaatgatcccaatcgacatcttgcttctcatatggccgcagaaaaagccgcattgatactgaaaaatttagggtggggtggagaagatatcgctgctgtctgccatgccattgaagctcatagtttctcagccggtttaactcccagaacattggaagccaaaattgtacaagatgctgatcgattggattccattggaatggttggtgttgctcgttgtttttacattgccggtcgtatgggttccgcactgtataattttcacgatcctctggcaaaacaccgtgaatataatgactctgcctatacgctcgatcatttttataccaagatattgaaaatagaatctggctttcaaacggaaacgggtagacaaatggctcgtgaaaggacagaacgcatggaacactttcttgaggcttttttgaatgaaattcaggtcacataa

SEQ ID NO: 341 - DNA, 897 bp, Xenorhabdus bovienii
  Coding sequence Name=Xb4151_4152.C407.gene12.dna; Position on contig =15561..16457bp; Strand=-
atgaaactaagctcttttacggaaataatattaccgagtaattatcacgttcaagattttttggcctttcatcacagagatgaaaagggtgcttctgaaatagtgcaacaaagtcgaatgaaaaagggaattatttggcacggaaatccggctttactgactgtatctattaataaacaccgggcgcagattcagcttgaggttgatggtgatgacgcacatcaatccgaggaggctttatccatgctagcttcacatatgctgggattgttgcagcctgttgaagaatttgaatctatgtatcaagctgatccggttattggcgagttggttaccagacaggcggggttacgaatttatcagtcagcaacaccttttgaggcacttagttgggcaatcattggtcagcaaattagcttaagtgcggcaatttctatccgtaggcgatttattcaggctattggcgttaaacattcttcaggattgttgtgtcatccgactcatgagcaaataattcagtgttcagaacacgatctacgccaatgtggtttttctgtcagtaaagccaatgcgttgctgaatgttagccaattaattgattcgggtgagttgaaattagccataatagaaggtggaattaaacggcttacggataatctgctcgccattaaaggaattggtatgtggacaatcaattacgctttgtcgcgcggatttaattatttaaatggttcactacatggcgatgtagctgtaaggcgcaacctccaatatttactcaggcaggaagacaaggtcaacgctgagcaaacagaagcatggctgtcagggttttctccttggaaggctcttgtggctgcacatttatggaggcagcagtccagtagtgggtattga

SEQ ID NO: 342 - DNA, 618 bp, Xenorhabdus bovienii
  Coding sequence Name=Xb4151_4152.C407.gene13.dna; Position on contig =16713..17330bp; Strand=-
atgaatctcttacagcgtatagactggcggcacggtggcttaatcttcgtgttattcgtcattctagggctggcaggtatctacatttaccaaatcttttattctcatgaacctgagatagccctaatgattggtgaaccttacgaagatatgcgacaacgttccagtgctgctattaatcccgctcttccaggtaaaatttggtataacgttccaaaaatggacgcacgcttacgttttaccgatccaaaatatggatttatgacaccagctgcccggttttttgttgttaagtataataatggaataatcgagagtgtacgcatatctccacaaattgagccattactcttcgatgatgtgatcaaaattgtactagatttacaaaatcagtggcgtaaagcaggttggatacctgtttatgataggacgttcccacctctggctaatacgccagaattgcgaacccaacttcgcagtttaaaatgttctgaaacaacctactggagagctggtgatcaatatcaaattatgatgaatttgggatgctttaacgacaagaaacatcctgatgaagaacgatttatgatcacgatggatattgccaaggcgcgataa

SEQ ID NO: 343 - DNA, 819 bp, Xenorhabdus bovienii
  Coding sequence Name=Xb4151_4152.C407.gene14.dna; Position on contig =17327..18145bp; Strand=-
atgccgaccgacgcgtgcgcaagtgagctagaaaacacaatggataatccattttactttcttcatccaaagctgaaggcgcaagcagaaaataaagttgaggattttgctcaagctgtggaagaagcaaggcaagccagtaaaaacaatagattatcaatatcttcctatgtacccggccttcagggaatatcaagtttgtcacagtattcattcaactatgtgtatgaaaagatggcactgggaaatacgacgctatttttggatgtataccagcttcatgctttctgcaagcaacgtggattggaagacctcaaaacttgcctaaatttacgccaagatatctacggtaatagccaatttccaatattgtggccaataggacaaaataatttgaagtttggccttccctatgacgatattctactcgcttttgaggcgatagaagcaggaaatattgctcaaggtgttgtacatctcgcctatcacgagcaaatcaatatattgcaaaccacaatgtacagtgacgagcaattaatagtgttcttgtggggtaaccaattctcctatgtcacaggctttttacctgataatgtggcacaacctgttgagttaacgttggctagtcaatgccaattcattgataatgaaagaactatcaaatttagcgatgatgtggctaatcttgccgatgcagatcagcgtatgcctttcgtacttaatgcagcggagcgttttgatgaattgctgcgtggtagagaccggcatttgattgaaaaatctttacaagatattgaggcagggagaggtgtaaaatga

SEQ ID NO: 344 - DNA, 171 bp, Xenorhabdus bovienii
  Coding sequence Name=Xb4151_4152.C407.gene15.dna; Position on contig =18120..18290bp; Strand=-
gtggtttatcagaaagaggcagaagataccgtcgcacccggtggtaaactgattgcagatcccatagaacggaacaaacgtattaatcaggcttatgctagatgctgtcgtcatgatatgcatgaacagatacaagctaataatgatgccgaccgacgcgtgcgcaagtga

SEQ ID NO: 345 - DNA, 618 bp, Xenorhabdus bovienii
  Coding sequence Name=Xb4151_4152.C407.gene16.dna; Position on contig =18416..19033bp; Strand=-
atgagcctcttacagcgtatagactggcggcacagtggtttaatcttcgtgttattcgtcattctaggactggcaggtatctatatctaccaagtcttttattctcgcgaacctgagatagccctgatgatcggcgaaccttatgaggcgatgcgacagcgttccagtgccgctattgatcccgaccttccaggtaaaatttggcataatatcccaaaaacagatgcacgtttacgctttatcgacccgaaatatggatttgtcacgcctactgcccgattctttactattttgtatgatgatggaatcatcactagtgtacgcatgtcgccacaaatagagccattactctacgaggatgcgatcaagattgtgttggatttacaagatcagtggcgcaaagcgggttggatacctactcgtaccagggagtacccacccttggttaatacaccagaattacatgatagccttcgcaagatgaaaaacccaggaacaacctattggcaagctggtgagcagtatcaaatcatgatggacgtagggcgtttcaaagatgataggcatcctgatgaagaacgctatttgatcacattggtgatttccaagccatggtaa

SEQ ID NO: 346 - DNA, 522 bp, Xenorhabdus bovienii
  Coding sequence Name=Xb4151_4152.C407.gene17.dna; Position on contig =19030..19551bp; Strand=-
atgaagcatacgactgtagtactaggtgtacgccaaaaaattgactacagcagccaattcccaatactatggccaatagggcaagataagttgcgttttggtcgtgactatccagatattctactcgcctttgaagcgatagaagcagggaatattgctaaaggtgttgtacatctcgccaatcacgaacaaatcaatatattacaacccacaatgtatagtgattctgatttagtatttgcattaaatggcaaccagttcgcctatgtcacaaatattttgccttctagtgtaacacaacctgttgagctaacattggccagccagtgcaaacgtatcgataataaaagaactattacgtttagcgactataaccctatagctgatttatcagatgtaaagcaacgtatgccttttgttttaaaggcagcagatcgttttgatgaactgctacgtggcagtaaacgatctttgatcggagagtctctacaagatattgcgtcatggggaggtgtaaaatga

SEQ ID NO: 347 - DNA, 1035 bp, Xenorhabdus bovienii
  Coding sequence Name=Xb4151_4152.C407.gene18.dna; Position on contig =19603..20637bp; Strand=+
atgcacttaccgactcacgcctgggaacaggaactgctctcactccatacccgtctggctccgttgtttcaccatcacgccccacagcaacgcagcctcgcttatctccggggactgctcagtgacgttgagcgtaaaaatggctggcaactggcggaatggataggcgaacgtacgcctgatggggttcagcatctgctggagcgcgcccactgggatgttgatatcgcccgcgatattttgcgcgactatgtcacagagcatttgggggatgaacacggggtgctcattgtggatgaaaccggctttatcaaaaaaggcacgcattctgccggtgtgcaacgtcaatacagtggcaccgccggtcgcgtcgaaaacagtcaaacaggcgtctttctctgttatgccggtcagggcggtcatgcctttattgaccgggcgttatacctgcccagacaatggacggatgaccggccccgctgtgaagctgccggcattcctgacgccgtcccctttgccactaaaccccaactcgcccggcagatgctggaacgcgcattcgaggccggcgtgctctgccgctgggtgacggcagatgccatttatggtcaggatcgccgcctgcgttgctggctggaatcccgatatcaaccgtttgtgctggcgatccccaaaaatgaaccgttgtggtggcaagggccaacttttgtcagagcggacaagattgtagacaatctgacacctcagcgatgggaaacccattcggcggggtggggagcgaaaggcgaacgtcagtatgactggattcgggtgccgctctggcgtttacaactcagtgagaaagaacgggaatatggccattatctgctggttcgtcgcagccgggatgaaaaacaggaacgggcttactatatcgtgtatgcgcgcagagaccaggcggctctgaaacccctggatcaggtggcaggttgccgctgggaaattgaatgtggttttgaggaaacaaagggagaatgcggtctggattccgtttga

SEQ ID NO: 348 - DNA, 498 bp, Xenorhabdus bovienii
  Coding sequence Name=Xb4151_4152.C407.gene19.dna; Position on contig =20811..21308bp; Strand=-
atgtctgacgttattaatcccgaaatgaatttggaagattatatgctggtttttgatcttaattcagcgactggtgaacttgatgatggtactcaaggctggggatatatgagtggcaaggcatcggatggtccacgcggattctttggtactttaagagtaatacagaacaaaatagatattaaaaatatatccaatttctattggaattcgcctaattttttgtcgttgtcgttgtcgttgtcgttgtcgttgtcgtttagaataccctctgataagaggcaaggtgagccaaatagcgttccccccttatttcagggcaatttttatgtcactgttgataatgtaacctatgatcttggcgctccttatgattcttatgaaaaaatcggcaagcgtatatacaatgcgcgttataatagtgaggacgcgctaaaattaagcactatattgaaacaaacaggccaaaccaagcgcttctattgcaactggcgttaa

SEQ ID NO: 349 - DNA, 525 bp, Xenorhabdus bovienii
  Coding sequence Name=Xb4151_4152.C407.gene20.dna; Position on contig =21711..22235bp; Strand=+
atgcaagataagaagcctgatatatcagaattaaaagatactacattagagcagcaatcttatgaagaccttggttatacagtgatacctattggtgttcctgttccttggccatcagaaatcccaccagacggttggcttaaatgcaatggtgaagtatttgatacagtaaaatacccaaaactcgcccttgcctatccatccggcagattacctgatttaagaggtgaatttatccgtggttgggatgatgagcgtggcgcggattctaatcgcaatgttttatcttggcaggaaggttcttatttagttcaagaagtgtacaatccgcctgatcgtatcgttaatttttcacttgatgagaggaaggatttaaattgggatattccagacacagaggtgatcaaattgcgtggcaaagcagtaacagcagataaaagtggaacctggagtatagataaaagatacctaggcgtaacccgcccccgcaacatagcattcaattacatagtcagagcagcttaa

SEQ ID NO: 350 - DNA, 1275 bp, Xenorhabdus bovienii
  Coding sequence Name=Xb4151_4152.C407.gene21.dna; Position on contig =22879..24153bp; Strand=+
atgaagcctgtgacgattatcgctataaaacaccagttaatgcaattcttcagtgacatttctttgcagcatattgctttccaatgtgcgtttatgaaacgtatcagaaatatcgagccccacgtgttgatcctcagccttatcgctgcactgagcacgggtaaaatcacgtctattgcccagttacaccaaaaatttaatggcctgtgcccggataaaaagcaaccagtcagttaccgccccttttataaccagctccgtaaagcggcttttgtcgaatttgtcaaaatattggtcagatttgccatggcgcaatgggtggagaaacaggtctcctcaccccaaaaactcatgaaatttaaacaggttattctccaggatgggagttcgttcaaagtccattctgccctggccgatgtttttccctatcgcttcaggacaacgggggccgcggtggaatgtcacatgacaatgtccttgctgactcagtcaccggtaaaaatgaccgtgaccgcagataccgcccctgagcgggcttacctgcctgtaccggcgatgttacgtgaccaattattattggccgatgccggttatgtcgactttgcgtattttgagcaagtgtcactttccggtggttcgtttattgtcaggggaagcaagtcccttaatcctcagatagtggtggcccgcaatggtcaggggaaattattgcccaagctgctcaataagccgctgaaatccatcactcgccgaaccaaccgttccgaagtgctggatctgatttgtcggcgtaatggctatgaatttcgcttaattcgtcgctggtttgccgaagaaaaacgcttttgtctctggttgagcaacttgtccgtggaagagtttacggctaatgacatcatggatatttatcgttgccgctggcaagtagaactgctgttcaaagagttaaaatcacacacaaactggcatcgatttgccacgagaaaagaaacgttagtcacgggcctcatttggctgagtttgctggctctgttgctcagacgttcgctggccagcagattattccccgccgtttcattgctcaaagcagcccaaaatacggaagtctggctgtggcccataatcgaaaacctactccaacgggcgtggtcggaaaccggtttttggctggaaaaagcccaagcgtatttatgtcagaacgcgttcaaaacaccacaaagaaaatcatgtaaatacaaaacattggatgcgtgttttgaaaggcttaattcttaa

SEQ ID NO: 351 - DNA, 192 bp, Xenorhabdus bovienii
  Coding sequence Name=Xb4151_4152.C407.gene22.dna; Position on contig =24175..24366bp; Strand=-
atggataatgcgcctttccataaacggaatgacacgacacaagcgatagcagacagcagatgtcaactggaatggcttcccgcttatagtccggatttaaaccctatagaacacaaatggggcggagcaaaagcgataaggaggcaaaaaagatgttcagttgatgagttgtttacggagcatattgaatag

SEQ ID NO: 352 - DNA, 291 bp, Xenorhabdus bovienii
  Coding sequence Name=Xb4151_4152.C407.gene23.dna; Position on contig =24547..24837bp; Strand=-
gtggctcatgtttttggcgatcgcagtcgaaaaacgttagacaagctgcttaccctcttatcttcctttactattcggttttactgcacggatgactatgttgtttacgacccacttcccgaggaagagcacttgactggaaaggcgtttactcagcgtatagagagaacgaatttaacgcatcgtacccgaatcaaaaggctgaatagaaaaaccattgggtattcaaaatcggaagaaatgcacgataaagtgataggaacctttattgaacgtgaacattatttttaa

SEQ ID NO: 353 - DNA, 276 bp, Xenorhabdus bovienii; identical to SEQ ID NO: 154
  Coding sequence Name=Xb4151_4152.C407.gene24.dna; Position on contig =24966..25241bp; Strand=-

SEQ ID NO: 354 - DNA, 234 bp, Xenorhabdus bovienii
  Coding sequence Name=Xb4151_4152.C408.gene1.dna; Position on contig =46..279bp; Strand=+
atgattaagtgtcctctgtgtgggcagtcagcgcatactcgtagcagcttcgagcactcaagccagacaaaggagcgttataaccaatgtcagaacatcaattgtggagcaacgttcgtcagccatgaaacgtttgtgcgttttattgctaagccaggtgacgtcgaaaatgttacaccacatccaagggtgaaaacgaagagacaacctcgtcagaaagctgacgcacaataa

SEQ ID NO: 355 - DNA, 219 bp, Xenorhabdus bovienii
  Coding sequence Name=Xb4151_4152.C408.gene2.dna; Position on contig =464..682bp; Strand=-
atgtttccagaatatcgtgatttagtgtccaacctgaaagaatctaacccgcgtttccaatccctgtttgaaaaacataaccgacttaaccacgagatatcacagctagaaggcccaaatggaaccggctatagcgataaagttgtgcgcctgaaaaaagaaaaactacacatcaaggatgagatgcaaaggatcttacaggcaaagtcccaaaaataa

SEQ ID NO: 356 - DNA, 483 bp, Xenorhabdus bovienii
  Coding sequence Name=Xb4151_4152.C408.gene3.dna; Position on contig =954..1436bp; Strand=+
atgaaaaagtatctacttcctttagccgctatgatggtttcggtttctacttttgctcaggctgataagaaacttgaagatgtcgccccttatcctaaggcttcagaaggaatggtacgcaatgtcattgaccttgcgccagaagaggatgaaggcgattacatggttgagcttatgattggtcaggatataaaagtagactgtaatcatcactggtttggtgggcaacttgaaacaaaaaccttggaagggtggggatacgattattatgtattgaataaagtcaccggcccggcgtcaaccaaaatggcttgtccagggcaaaaagaaaccgtgcgctttgttcaagtgcagttaggcaaagatgcgcttatacgctataacagcaaattacctatcgtggtatatacgccaaaatcaatgacagtcaaatatcgtatttggcaggcattggatgatatcgataatgcagtaatcagataa

SEQ ID NO: 357 - DNA, 102 bp, Xenorhabdus bovienii
  Coding sequence Name=Xb4151_4152.C408.gene4.dna; Position on contig =1572..1673bp; Strand=-
atgcgcaaggaaccacaggcagaaaataaaggactggcgaatatgacaggcgatgatttaagagttatttcatttgaaacggttttattgtcaacctggtga

SEQ ID NO: 358 - DNA, 693 bp, Xenorhabdus bovienii
  Coding sequence Name=Xb4151_4152.C408.gene5.dna; Position on contig =1745..2437bp; Strand=+
atgtttaaaaaattatcggcagagtttttgggtactttttggttggtgtttggcggatgtggcagtgctgttttagccgcagcgttcccacaactggggattggttttgtgggggtatctctggcttttggtttcacggtagtaacaatggcttatgccgtagggcatatttctggagggcactttaatccggctgttacattaggattatttgctgggggacgcatttcagcaaaagatgttattccttatatcattgctcaagtgattgggggaattgctgccgcggccgtactttatcttattgccagcggtaaaagtggttttgatgcaacggcaagtggtttcgcatccaacggttatggtgaacattcacccggcggtttttcattacaggctgccattatcattgaactggtattaaccgcatttttcctgattgtgatcctcggaacaaccgataaaaatgcatcagtagggtttgcgccactggccattggtttggcattgacacttatccatttaatcagtatccctgtgacaaatacgtcggttaacccggcaagaagtacggcagttgctatttttcaaggcacatgggcgttgaatcaactttggctgttctggctgatcccattaattggtggtgctatcggtggcttgatataccgtacgttattacagaaagattga

SEQ ID NO: 359 - DNA, 444 bp, Xenorhabdus bovienii
  Coding sequence Name=Xb4151_4152.C408.gene6.dna; Position on contig =2534..2977bp; Strand=+
atggagcaaaatataacgtgggaacaaggtgaatactgggttaccacggataaaacaaaatttgatattcattttgttcataataatcttacccaattatattgggcgcgtgggattacgtttgagaaagtcagaacagggatagagcatagcttatgttttgccttgttccattgcgataaagaaattggtttcgcgcgattaattacagatttttcaacgtttgcttatctttgtgatgtctttattgtgccggactatcagaagagagggttggggcgttggttgatggaatgtgttttacagcatccgattatttctcatgtgaaacgggtcatgttggtgacctcttcggcgggagggctttatgaaaaatttggttttgagcctgtcagggtgcaggattttgtttggacgttagagaaaacgaaagcgtctgagtaa

SEQ ID NO: 360 - DNA, 1008 bp, Xenorhabdus bovienii
  Coding sequence Name=Xb4151_4152.C408.gene7.dna; Position on contig =3854..4861bp; Strand=+
atggaacatattgacatagaaaaggtgtcgggcaaaattttacatgaattgttgcaatatagacgccgtttctcagaatctgaacatacgattgaatatgaagaacaaaaagtctctgaagttcagctgccacgcattcgtgcgtttgttgaacagggcaaagctgttgaatgtattcttcctgcatttccgacaaaatcgccgaacccccgtaaagtactgggtacaatgcctgatatggcagaaaaattatcactgatttttctgaattctctgtgtcagcgcattcaactttattatccaccaggtgcaaatattgttatttgttctgatggacatgtattcagtgatcttatccacgtcgacgatgaaaccattacccattatcaattggagattgaaaagttgctgcatgaactgggcgcaaccaatctttcagtttttaatctcggcaacgttgaatcactcacccaatataccagcaattatgatcaactgcgtgagctgctggtgaatggttatgcttcttcgacggaagaaattaaggccacgcttaaagagagtgaagaagggcttcagctctatcgggcgattactcgttttctctatgaagatagtctgttgccgggatatgacggttcgaaaacagccttgcagaaagatgcgcgtcaacgagcggttggcgttatccagcgtagttgggcttggggaaatctgctggctgaacagtttccactggctattcgcctttctatccatccgcagcccgttgacagtattaaaatcggtattcatatgatgcctacccgggatgattggctcacgccgtggcatggtgtcgcagccaatattaacggtcaatttgtgctgatgaaaagtgatgaagtgaaaaagatgcaggggaaattggtcgagatccgtggtgtccccagccattacatgattgaagccgtatctgagcaaaatcagcagacagaaccgctggttgccgctttgcaggaacagtaa

SEQ ID NO: 361 - DNA, 900 bp, Xenorhabdus bovienii
  Coding sequence Name=Xb4151_4152.C408.gene8.dna; Position on contig =4917..5816bp; Strand=+
atgagcatagatgaactggattgtcgcattgaaccgatcatgccttttggactactgattacgcccaatgcccctcagcaggacatcactacgttgtctattgataccctgcgcgagctggcacgtacccacaaactggttgtattacgtggtttttcttctggttttacggatccggaaaagttgacggaatacactggccgttggggagaaataatgatgtggccgtttggcgccatattggatgttatggagcgtcctgatccttctgatcatgttctggacagcacccatgtgccactacattgggatgggatgtataagccgacaattccggagtttcagatatttcactgcgtttctgcgcctgaggcaagtcaaggagggcgaaccacgtttgttgatactgagcaattgattgccgatgcgagtgatgatgaacgccatgaatggaaaaacaccacgataacttaccgtacaagcagagtgacgcattatggtggagaggtggtttcaccgctgatttgtcttcatcctgatggtaaaaaatgggtgatgcgttacaacgaacccatgacaggaaaagacgataaatatgctgaccatcatttattgacgatccatgggctgtcaattgaacagcaaaaagaatttgaaaaaaatctgtttaacagattgtatgactcacgttatttctatgctcatcaatggcagtcaggtgatttagtcattagtgataattttactttgctgcatggtagggaagcgtttattactcattctccccgacatctccagcgggtgcatgttcatggaacaccagtttgtgagaatctcagtttccgaactatttccaattcagattctggtgtagctgaagttgagttgaaggaggtttaa

SEQ ID NO: 362 - DNA, 1281 bp, Xenorhabdus bovienii
  Coding sequence Name=Xb4151_4152.C408.gene9.dna; Position on contig =5820..7100bp; Strand=+
atggctcgtattgttttggctgcgattgcaactccaggccatgtttttcccatttgttccattgccaggcatttgatagagcaggggcacgaagcgacaatattcactggctctatttttcggcagcaggcagaagcgttaggggcaagcttcgtcgccttcgatcagcaggttgatgttgattaccgtaatctggaagagaaatttcctgagagagggcagcatcctcccggaaatcatcagatgacacatgcccttaagcaattttttgctggccctatacctgtgctgtaccgtcagttggagcagttggttaaaggcgctgatttactgattgtggacaatacgttctatgcggtactcccactgctacagaaacctgcccatgatcgtattcctattattgcgattggggtgacaccgttgtcatggtcgactcgggataccatcttctgggggccgcgtattcctcctgaattattgcctgctgatttgatgcgtgagcaattggtggatgaggaaacggctcagttgattggacaggtacgggatgcattcaacaccgctctgttggaagtagcatctcctcctctgacacaagatcataatgatgtcgttatcagtcgagctgatcgtttcctgcaattggcgaccaaatcgtttgaatttcctcgtgatgatttaccggaaacggtggattttatcggcgcgctgggtgttgaagtacaggatgacaaaacccagttggagtggtcagatgaaagtctgccgcttgtcttagtcacacagggaacgctggcgaatgttgatttcagccagttactattacctaccttgcgtgcattggcgacgttgccagtacgtgtgctggcaattacggcaggaaggccagtcgaaatgttgggtgaagagatccctgacaatgccagggtggtggaataccttaactttgaacactggcttcctcgttcagcaattttcattaccaatggtgggtatggttctcttaatgcggccattcgtcacggtgtgccgctggtggttgctggtacaggagatggtaagctggaagctgttgcccgtgttatctggtcacgatgcggtattagtctgaatacagatacaccgagtgaaaaacagttatatcaagcggtgacccggatactttcttctcctgaatggcattatcagtcacagagaattaaggcagattatgatgctcataatgctttggaattgatcactcgtcatgttaatgaattgattgctgaatcagtttga

SEQ ID NO: 363 - DNA, 582 bp, Xenorhabdus bovienii
  Coding sequence Name=Xb4151_4152.C408.gene10.dna; Position on contig =7233..7814bp; Strand=-
atgttaaaaaagatgttaattggcctgagcgcaggcgctttattaatgagtacaggctctgcaatagccgctaactataaaatcgatacgattggccaacacgcctttattgaatttcgtatccaacatttgggtatgagctggctttacggtaatttcagaaaatttgacggggattttgctttcgatccgcaaaatccagaaacgaacaaagttaatgtcgttattaagacaaatagcgtagataccaaccatgccgagcgcgataaacacctgcgcaagcctaattttttaaacacggaaaaatatccagaagccaaatttacttcaactaagatcagccaagagggagaaaaatacacagttatcggtgatctaacattaaatggtgtcaccaaacctgtgacgctgaatgccaaattaatgggagaaggtaaagatccttggggtggataccgtacgggttttgaagctaatggtaaaattaaattgaaggattttgatattaaggctaatttagggccaaaatctcaggaagttgaattggttatttccgttgaaggtgtacgggaaaaagcctga

SEQ ID NO: 364 - DNA, 555 bp, Xenorhabdus bovienii
  Coding sequence Name=Xb4151_4152.C408.gene11.dna; Position on contig =7837..8391bp; Strand=-
atgcttttaaaaaatacgtccacgcgctttggtcatgtttctgttttcatccattggttagttgcactcgctgtttacggtatgtttgcacttgggttatggatggtgacattaagctattacgatacttggtatcatcaggcaccagaactccataaaagtattgggagtttaattttttttgtcatggttattcgtcttatctggcggtttatttctccgccaccaaaacctctgacaagttacagctatttgacgcgaatcagttccaaactggctcatttcacgctatatctggctctgtttggcattttaggcagcggatatcttatttctacggctgacgggcaacctatcagcgtttttggatggtttaatatccccgccacgctatcagaacagggcatacaggcagataccgctggcattatccacctttatctcgcttgggttgttgtggtgctctccctgctgcacacacttgctgcattgaagcatcattttattgaccgcgatagtaccttaaaaagaatatttggcttcaaccctgactaa

SEQ ID NO: 365 - DNA, 984 bp, Xenorhabdus bovienii
  Coding sequence Name=Xb4151_4152.C408.gene12.dna; Position on contig =8545..9528bp; Strand=-
atggcctataaacaactgaccgaaacagaaagatatcagattttcagcctgaaagaagccggtttttcacaacgggagatttcaaagtcactcaatcgaaacccatcaacgattagccgggaattgagacgaaatcgggaggcaaagaaatatacgcctgaacaagctcagcttaaggccgtagcgcgccgacagtgtgctacaaaagcagtaaaagtgaaaccagagatagaaatgtggatcaaacagttaatttggcaagatttaagtcctgaacaaacagtcggttatctcaaaagggaaaatataatatctttgcatcatgaaacagtttatcgattgatttataaggataaacttaatgatggtaatttatggcaacatcttaggattgcgaaaaaaccgtatcgtaaacgctatggaagttatgagcgcagaggaaaaattaaaaacagagtcagtattgataagcgccccaaacttgttgataaaaagcagcgtattggtgattgggaaggagatactatcgtgggtaaaaatcataaaagtgcattattgacattagttgaacgaaaatcgttatttactattataattaaacttgaaaataaaacagcagaaggggtcgcaaaagcggcaacaagacatttatcactgataaaacataaaattaaaacaatgacctttgataacggcctcgaatttgccgaacacgaactgatcagtaaaaatttagagacaaaaatttattttgctcacccgtattccccctgggaaagagggataaatgagaacacgaatggattaatcagagatgacttcccaaaaggaactgattttaataaggtgtcagagcgggagattaaccttgtggcaaaccgattaaataatcgtcctcgtaaaacacgagattacaaaacaccgaatgagttatttaaaggaataccctctcatttacttcgtccattacggtgttgcgcttaa

SEQ ID NO: 366 - DNA, 630 bp, Xenorhabdus bovienii
  Coding sequence Name=Xb4151_4152.C408.gene13.dna; Position on contig =10080..10709bp; Strand=+
atgtacacattgtggatagccaataaaaattattcttcttggtcactgcgtccgtggattttgctgaaggcgctggagatcccatttaacgagcagcttagttattttgaagataataaaagtagttatgaaaaattcaaagcattctcacccactgggcttgttccttgtctggtagagggtgaaattaccgtttgggattcactggctattgctgaataccttgcagaacaccatacacaggtttggccacaagatcgcatcgccagagcgtgggcaagaagtgcttcggcagaaatgcactctggttttgccacattgcgccaaacttgcgcgatgaattgttcaaaacagtttgaattggaggaaatttcccctgagttacagtgtgatattgaccgccttgatgctctttggtcagacgggttaacgaaatttggcggtgaatggctggctgggagtacattcactgcggttgatgcgtttttcgctccagtggctttccgtgctcagacctatgggctgaaattttctgctgtcagtcaggcatgggttgatcgaatgcttaagcatccggcaatggtggaatgggctgaggcggcagcaaaagagcctgaaatgaagcattaa

SEQ ID NO: 367 - DNA, 1935 bp, Xenorhabdus bovienii
  Coding sequence Name=Xb4151_4152.C408.gene14.dna; Position on contig =10957..12891bp; Strand=-
atgtcattccaagatttttatcagtattcgattgatgatcccaatgccttttgggcagaacaggcccgacgaatacactggcagcatccttttgcacaggtattggattacaataacccgccttttgcccgctggttcagcggtgggaaaaccaatctatgctacaacgcactggatcgctggctggaaacccaacccgatgccaaggcactgattgccatttcaaccgaaaccaatagtgaagaagttttcacctatcaagaattatatcaggaagtcaaccgagccgcggccatgatgctctcactgggagtaaaaaaaggtgatcgcgtggtggtttatatgccaatggtcgcagaagcgctgttcgtcctgctcgcctgcgcccgtatcggggcgattcattccgtcgtgtttggcggctttgcttcccacagtctcgccacacgactggataacgcagagccggtgctggtcgtctctgcggacgcgggatcgcgggggggcaagattattccctataaacccctgctggatgaagcgattgaactggcacagcacacaccacgccatgtcttgatggtgaaccgcggtctggccgcaataaattggctggaaggacgggatatcgatttcgccagcctgcggcaaatacaccttgatgcagatattcctgtcacatggatggaatccaatgaaacctcctgtgtgctatatacatcgggcacaacgggcacgcccaaaggcgtacaacgtgatgtcggcggctatgcagtagcactggcgacctcgatggataccatttttggcggcaaaccaggcggcgttttcttttgcacatcggatatcggctgggtggttggccactcttacattgtctatgccccacttatcgctggcatggcaaccatcatgtatgaagggctgccgacccgccctgatgcgagtatttggtggcagatcgtggaaaaacatcgggttaacagaatgttttctgcgccaactgcaatccgtgttctgaaaaaatatcccacagattgtattgcaaaatacgatatttcatcacttgaggcattatatttggccggtgagccgcttgatgaacataccgcccgctgggttgcggaaatcatcaacgttccggtcattgataattattggcagaccgaaaccggctggccgattatggcgattgcgcgtggattggatgaccggccgagtcgttttggcagccccggttttccaatgtacggcttcaacgtcaaactgatcaacgaactaactggtcaggaatgtggcgataatgaaaaagggatgttggtcgccaaaggccccctgcctcccggttgtattcagaccgtttatggtgatgatacgcgttttataaatacttactggaagcattttgcccagcagatttattctacgttcgactggggcatccgtgacagcgacggttactattttattctggggcgttcggatgatgtgattaatatctcagggcatcgcttaggaacacgagaaatcgaagagtgcattaccagccatgaagacgtggcagaagtagccgtgattggcatcaaagatgaagtaaaaggacaagccgcggttgcctttgcggtacttaaggaagggcggaaaatccagagtgctgaccatttcgcagcgctggaaaaagcattgatggatttggtcgataagcagctcggcagtgtcgggcgtccggcacgggtctattttgttacccagcttcccaaaacccgctcagggaaaatgctgcgccgcaccatgcaggcgatttgtgaaggacgggagccgaacgatattgcattaattgagaactctgcctcgctggagatgatccgggatgtcgtttctcatcaggccacagccaataaaaaatataaggtgtctcccaatgacaaaaactga

SEQ ID NO: 368 - DNA, 1452 bp, Xenorhabdus bovienii
  Coding sequence Name=Xb4151_4152.C408.gene15.dna; Position on contig =12959..14410bp; Strand=-
atgtctacctctgttgtcaacaaccgccctgattacgatcaggtgattgtggatattgtggattatgtcatggacgacaccataacatcccccgttgcctacgaaactgcccattactgttttttggatacactgggctgtgggctggaagcactggaatatcctgcctgcaaaaaattattggggccgattgtaccgggtaccgtggttccgaatggtgtgcgcgtaccgggaactcagttccaactcgatccggttcaggccgcctttaatattggcaccctgatccgttggctggatttcaacgatacctggctggcggcagaatgggggcatccatcggacaaccttgggggtattcttgccatcgccgactggctgtcccgaacagcggttgccaatggaaaacagcccctgaccataaaagatgtgctgaccggcatgattaaagcccatgaaattcagggctgtctggcattggaaaatgcgttcaataaagtcggactggatcacgtggtgttggttaaagtcgcttcaacagcggtggttgcccagatgttaggtttagcgcgtgaagaaatactgagtgccgtttcgcttgcttgggtggacggacaatccctgagaacctaccgccatgcccctaacacgggttcccgcaaatcctgggctgccggtgatgccacttctcgtgccgtgcgactggcgctgatggcgcaaaaaggcgagatgggatatccctcagtattaacggcaaaaacgtggggattttatgatgtcctgttcaatgggcaaccgttcaaattccaacgtccctatggcacgtatgtgatggaaaacgtgctgttcaaaatcgcttttcctgccgaattccactcacaaacggcggtagaagcggccatgactctgcatcagcaattgaaagcagcaggtaagcaggtcgaagacattgcccgaatcactatccgtacccacgaagcctgtatccggattattgataaacagggttcattgaataatccggcggacagagatcactgtatacaatacatggtcgccattccattattgttaggtcgtctgacggcggccgattatgaggataatgtggctgccgatccacgcattgatgttttgcgggaaaagatgatatgtgtcgaagatcccgatttcacccgtgattaccatacccctgagaaacgttcgattgccaacgccctgaccataacatttaacgatggcagccggcttgatgaagtgaaagtcgagttcccgattggacatgcgcgccgccgcaaagatggcatcccattgctactgaaaaaattcagtaccaatctggcacggcaatttccggacacccagcaacgaaaaatcctgtcggtttcgcttgaccgcactttattggaaaacatgcccgtaaacgaatatctcgatttatacgttatctaa

SEQ ID NO: 369 - DNA, 1176 bp, Xenorhabdus bovienii
  Coding sequence Name=Xb4151_4152.C408.gene16.dna; Position on contig =14472..15647bp; Strand=-
atgagtaaacagaatacgatgactggatctcctgaagcggcaacatttaaaccgaaaaaatccgttgccttgtccggcgtgactgccggtaatacggcgctctgtactgttggcaaaaacggcagcgatttacattaccgtggctatgatattctcgatttagccacgtattgtgaattcgaagaaattgcttatctactcatccatgaaaggctcccttcccgcgcagagctggccgcttacaaaaccaaactgaaagccttgcgtggcctgccaagcagcgtcaaagccgcattggaagctttgcctgcggtcgcccatccgatggatgtaatgcgtacgggcgtttctgtctttggttgtactctaccggaaaaagaagatcataatcttaccggcgcccgtgatatcgccgatcgtttgctggcatccctcggctctatcctgctttattggtatcactacagccataacggacgccggattgatgttgaaactgatgatgattccatcggcgggcattttctgcatcttttacatggacaaaaaccgcgtgattcatgggaaaaggcgatgcatgcctctttggttctgtatgctgaacatgaatttaatgcttcgacatttaccagtcgcgtgattgccggcacaggatcagatacgtactccgctattatcggtggaattggcgccctgcgcgggtcaaaacatggcggtgccaatgaagtttcattcgaaattcagcagcgttatgactctcccgacaaagccgaagccgatatccttacccggctggaaagaaaagaagtcattattggctttggtcatccggtttataccgtctccgatccgcgccataaggtgattaaagagatttccctgcatctttccaaggaagccggcaccactcagatgtttgatattgcagatcgcattgagtctgtaatgcgggataacaaaaaaatgttcccgaaccttgattggttctcggcggtgtcttatcacatgatgggggttcctaccgccatgtttaccccactgtttgtgattgcccgtacggcgggttgggccgctcacattattgaacaacgcatagataacaaaattatccgcccttcagccaactataccggccctgaaaacctgccgtttacgccaatcgaccaacgcaagtag

SEQ ID NO: 370 - DNA, 891 bp, Xenorhabdus bovienii
  Coding sequence Name=Xb4151_4152.C408.gene17.dna; Position on contig =15653..16543bp; Strand=-
atggcattttcttctgctggtctggcttttcgccgggcaatagaggccgaatctccgttacaggtggtcggaactatcaatgcaaaccatgctttgctggcgaaacgagcgggctacaaagccatttatctttctggtggcggtgtttcagcaggttcgttaggtctgccggatctgggcatttcgacgctggatgatgtgctgaccgatatccggcgtatcaccgatgtatgcgatttaccgctactggtagatgccgatattggttttggttcttctgcattcaatgtcgcccgcaccgtttgttctattattaaggcaggggctgcgggtctccatattgaagatcaggtaggtgccaaacgttgtgggcatcgtccaaataaagaaattgtctccaaagaggagatggtcgatcgtatcaaagctgccgttgatgcccgcaccgatgagcattttgtgattatggcgcgcacagatgcgctggccgtggaagggttggaatccgctcttgacagagccgaagcttatattgcagccggtgcagatatgctgtttcctgaggcgataacagaactgcaaatgtatcaggtatttgccgcaagaacgcaggttcccatactggccaatatcaccgagtttggtgccaccccactctttacgaccgaagaattagctagtgtagacgtcgctatcgcactttacccgctctctgcatttcgggcgatgaatcgagcggcagagcaggtctacaccacactccgccgtgacggcacacagaaaaacgtgatcgatctgatgcaaacccgtaatgagctttatgaaagcattaattattacgattttgagcagaaattggatgccctgttttcccagaaaaaccagaggtga

SEQ ID NO: 371 - DNA, 1656 bp, Xenorhabdus bovienii
  Coding sequence Name=Xb4151_4152.C408.gene18.dna; Position on contig =16850..18505bp; Strand=+
atggcgtcaggatatacaggggagcgtgataacaacaaaccggtgatctggacagtatcggtttcccggctttttgacctttttcgtgacatcacgccggaatttgatcatcaggctgatatcacaccgattaatcttggttttgaacaggcggttcagcatattcgtaaacgtctggaaacagagcactgtgatgccgtgatttgtgccggctcgaatggcgcctatctaaaaagtcgtttatccgtaccagtgattatcgccaaatccagtggttttgatttcatgcaggcactggcacgagcgaggcaaatcagcgcccggattggcgtcatcacttatcagaataccctgccagcattggaagaatttcagcagcgtttcaacttgcggattgaacagcgcagctatgtgacggaagaagatgccagaacgcaggttaatgcgctgaaagccatcggtatcaaggtcattgtgggggcagggctgattaccgatctggcttatgaagccgagctggtgggggtgtttctctattctgccgacactatccggcaggcatttcatgatgcgttggaaatggccagaatgactaagctcaatctgggggggagttcgccttatcctacggaggataagttgcgcattcgtcatacgcttaacgatattataggtgattctgctgtggtagagcatgtacgcaacacgattatgctgtatgcccgctcgacggccacagtgttgattcaaggggaaagtggtacgggaaaagagctggtggcacaggcgattcatcatgaatacagcctgcgttatgggcagtctgtgggtaaacatccgcgtccctttgttgcggtcaactgtggtgccattaccgagtcattactggaggcagagctgtttggctatgaagaaggcgcttttacaggctcccgacgagggggacgggcgggtttgtttgaaattgcgcacagaggaacgttgtttctggatgaaataggcgaaatgccattgccactgcaaacgcggttattgagagtgctggaggagaaatccgtcgtcagggtcgggggatatcgtccgattgcggttgatgttcggatcatttgtgccactcattgtgatttagatacgtgggtgcgagaagggcgttttcggacagatctcttctaccgcttgagtgtgctgagaattaatgtgccagcattacgtgaaagagggagtgatattgggctactggccgtggagtatctgcggcgggcatttgcggcgcttaacttgcctgtttcatcgtcaaaaatacgggaactttctgcttgtcatgcagcgctgcaatcttaccattggccgggtaatgtgcgggaactgcgtaatttgatggagaggattgcactatacttaagtgcccatcccgaacaggcattgacacctgctttgatcttatcgctttcacctgagcggcagattgatatcagttcggtgaagagcaacgcgaaaactttcgagattgaacctccttcttcaatggcagtttcttcctctgtccatgatattgtggcgagatttgcgggtaatcgacaggcggcggcagaatatctgggaattagccgcacgacgttatggcgaaggttaaagcaagaaccggagaaagattaa

SEQ ID NO: 372 - DNA, 516 bp, Xenorhabdus bovienii
  Coding sequence Name=Xb4151_4152.C408.gene19.dna; Position on contig =18922..19437bp; Strand=-
atgcacagcgagctgctcaaattttctcacaaaaacgcaaaagaaggacaatggctgttatcagaaggtaatttttatcgagttatagctactggtgtagaaaccaacagtcgttacagtctggttgaaatcattgttgaaccagggaaaggtgctccatttcatttccataaattagaggaagaagctttcttcatactagaaggtgaaatggttttttatacgcagactgaaacaatgtatggaaagcaaggcgcttttttaaatttttctgttgggcaaatccgcggttttcgtaatgaaacagataaaaatacacgaatgctcattattctttcacctccaggaatggaacaaatgttttttgaaggtggtaaggcaattgatgctcctattgatttgaatacaacatttgtggaaaacataggtcaaacagtaacctgtccagaaattgcaggacgatacggcatagaaaatattcctttgccattaccggaaaaaaagacaaccacttga

SEQ ID NO: 373 - DNA, 447 bp, Xenorhabdus bovienii
  Coding sequence Name=Xb4151_4152.C408.gene20.dna; Position on contig =19784..20230bp; Strand=-
atggtagacaatctgacacctcagcgatgggaaacccattcggcggggtggggagcgaaaggcgaacgtcagtatgactgggttcgggtaccgctctggcgtttacaactcagtgagaaagaacgggaatatggccattatctgcgggttcgtcgcagccgggatgaaaaacaggcacgggcttactatatcgtgtatgcgcgcagagaccaggcggctctgaaaaccctggctcaggtggcaggttgccgctgggaaattgaatggggttttgaggaaacgaagggagaatgcggtctggatcattacgaagtgcggcaatggcacagttggtatcggcacatcaccttatcgcttctggcccatgcagtgctggcagttttgcgaatacaggagaaaaaaaacgccgacggggctggtagccctcagtatggcggaactgcgtaa

SEQ ID NO: 374 - DNA, 396 bp, Xenorhabdus bovienii
  Coding sequence Name=Xb4151_4152.C408.gene21.dna; Position on contig =20224..20619bp; Strand=-
gtgctcattgtggatgaaaccggctttatcaaaaaaggcacgcattctgccggtgtgcaacgtcaatacagtggcaccgccggtcgcgtcgaaaacagtcaaacaggcgtctttctctgttatgccggtcagggcggtcatgcctttattgaccgggcgttatacctgcccagacaatggacggatgaccggccccgctgtgaagctgccggcattcctgacgccgtcccctttgccactaaaccccaactcgcccggcagatgccgtttatggtcaggatcgccgcctgcgctgctggctggaatcccgatatcaaccgtttgtgctggcgatccccaaaaatgaaccgttgtggtggcaagggccaacttttgtcagagcggacaagatggtag

SEQ ID NO: 375 - DNA, 294 bp, Xenorhabdus bovienii
  Coding sequence Name=Xb4151_4152.C408.gene22.dna; Position on contig =20479..20772bp; Strand=+
atgaccgccctgaccggcataacagagaaagacgcctgtttgactgttttcgacgcgaccggcggtgccactgtattgacgttgcacaccggcagaatgcgtgccttttttgataaagccggtttcatccacaatgagcaccccgtgttcatcccccaaatgctctgtgacatagtcgcgcaaaatatcgcgggcgatatcaacatcccagtgggcgcgctccagcagatgctgaaccccgttcgcctatccattccgccagttgccagccatttttacgctcaacgtcactga

SEQ ID NO: 376 - DNA, 213 bp, Xenorhabdus bovienii
  Coding sequence Name=Xb4151_4152.C408.gene23.dna; Position on contig =20678..20890bp; Strand=-
atgcacttaccgactcacgcttgggaacaggaactgctctcactccatacccgtctggctccgttgtttcaccatcccggcccacagcaacgcagcctcgcttatctccggggactgctcagtgacgttgagcgtaaaaatggctggcaactggcggaatggataggcgaacggggttcagcatctgctggagcgcgcccactgggatgttga

SEQ ID NO: 377 - DNA, 744 bp, Xenorhabdus bovienii
  Coding sequence Name=Xb4151_4152.C408.gene24.dna; Position on contig =21011..21754bp; Strand=+
atgccaaccgacgcgtgcgcaagtgagctagaaaacacaatggataatccattttactttcttcatccaaagctgaaggcacaagcagaaaataaagttgagaattttgctcaagctgtggaagaagcaaggcaagccagtaaaaacaatagattatcaatatcttcctatgtacccggccttcagggaatatcaagtttgtcacagtattcattcaactatgtgtatgaaaagatggcactgggaaatacgacgctatttttggatgtataccagcttcatgctttctacaagcaacgtggattggaagacctcaaaacttgcctaaatttacgccaagatatctacggtaatagccaatttccaatattgtggccaataggacaaaataatttgaagtttggccttccctatgacgatattctactcgcttttgaggcgatagaagcaggaaatattgctcaaggtgttgtacatctcgcctatcacgagcaaatcaatatattgcaaaccacaatgtacagtgacgagcaattaatagtgttcttgtggggtaaccaattctcctatgtcacaggctttttacctgataatgtggcacaacctgttgagttaacgttggctagtcaatgccaattcattgataataaaagaactataaaatttagcgatgaggtagctaatctcgccgatgtagatcagcgtatgcctttcgtacttaaggcagcagatcgttttgattaa

SEQ ID NO: 378 - DNA, 636 bp, Xenorhabdus bovienii
  Coding sequence Name=Xb4151_4152.C408.gene25.dna; Position on contig =21826..22461bp; Strand=+
atgagtctcttacagcgtatagattggcgacacggtagtctaatcttagtgttgtttgtcattctaggatcggctggtatctatctctatcatttcttctactccagtgaacctgagatagccttggtgattggtgaaccttacgaggctatgcgacaacgctctagtgccgctattgatcccgacctttctggcaaaatttggtacaatatcccaaaaacggatgcgcgtttacgctttactgacccacaatatggatttgttacaccaaccgctcggttttttactgtttcatacaataaaggaatagttgagagtgtacgtatgtctccacaaatcgagccgttactttacgatgatacaattaagatagtgttgaatttacaaaaccagtggcgcaaatcgggttgggtacttactcaagctaggggatttcctgctttagcggatacaccagaatggcatgatactcttcgccgtaggaaaaacggtgctggaacgacctattggcaagctggagataagtatcaaatcatgctgaatttaaggcgtttcaaagatgatcgacatcctaacgaagaacgatatttgataacgttggcaattgccaagccgtgggtagattttaatccttaa

SEQ ID NO: 379 - DNA, 333 bp, Xenorhabdus bovienii
  Coding sequence Name=Xb4151_4152.C408.gene26.dna; Position on contig =22538..22870bp; Strand=+
atgagatgctacatgatagcaaccgaatgtagaatgagcttgttacaacgtataggtcagtggcgtagtggtctaatcttggcgatattaatcattctaggtctggtcaccatttatctctaccaagtcttttattctcgtgaaccagagatagccttggtgattggcgaaccttacgaggcgatgcggcaacgttccagcgctaaaattagcccaccctatgataatagcatcgggttcagaatcccaaaaacggatgcacgcttacgctttaccgatccgaaatacggatttattaccccccctgcacgatttttttactgtttcctataa

SEQ ID NO: 380 - DNA, 435 bp, Xenorhabdus bovienii
  Coding sequence Name=Xb4151_4152.C408.gene27.dna; Position on contig =22758..23192bp; Strand=+
atgataatagcatcgggttcagaatcccaaaaacggatgcacgcttacgctttaccgatccgaaatacggatttattaccccccctgcacgatttttttactgtttcctataataaaggaatcatcgagaacgtgcgcatgtctccacaaatcgaaccgttactctatgacgatgcgatcaagattgtgctggatttacaagatcagtggcgcaaaacggggtgggtgctgactagagaataccaacctttagtaaatacaccagaattgcatgatagccttcgccgaatgaaaggcactggaatgaccttttggcaagcaggcgatctatatcaggctatgctgaatatggcgcgtttcaaagatgatcggcatcctagcgaagaacgatatttgattacattgcagattgccgagccgtgggtaaagccataa

SEQ ID NO: 381 - DNA, 192 bp, Xenorhabdus bovienii
  Coding sequence Name=Xb4151_4152.C408.gene28.dna; Position on contig =23270..23461bp; Strand=+
atgagtctgttacaacgaataggccaacgacggagtggtttaaccttcgctttattaatcattctgagtttaatcgccgcttatctctaccatgccttttattcccgcgaacccgccgaaatagctttggtgatcggtgagccttatgaggaaatgcgacaacgttctaggtcgtgtcccttaattatataa

SEQ ID NO: 382 - DNA, 693 bp, Xenorhabdus bovienii
  Coding sequence Name=Xb4151_4152.C408.gene29.dna; Position on contig =23544..24236bp; Strand=-
atgggtaacttagccaaaaccgataaaatagatgctcaggtgctggcacagttagccctggttttatctcaacgaacagaccgggataaaatagtcaggatattgccctctgctcagcaacgagtcttgcaagccatgatcgcacgtcgtcgccaattggtcgtactttccatctcagaacgccaaaggttggggaattgccatccagacattcgagaaagcatcactttaatgatcagctttatacaggaacagcttaaggtcattgaatctgccttgtctaaacacattaaaacctatcatcgttccaaactcgatttattatctacagtaaaaggcgttgggcctgccacaatagccactttgatcgctgatgtaccggagttgggtaagttaacacgccgggaaattagtgccttgattggtgttgcaccgtttaatcgagattctggatttttccgggggaaacgaacaatctttggaggaagagcaatggtgcgtcgaatgctatatatggccacgttaacggcaattagatttaaccccgttctctgcgctttctacaagagattgaccgaagcaggcaagccaaacaaagtcgccatcgttgcgtgtatgcgtaaattactggtcattctcaatgcaatgataaaaacaaatagaccgtgggacgaatcattccacacggtgtaa

SEQ ID NO: 383 - DNA, 339 bp, Xenorhabdus bovienii
  Coding sequence Name=Xb4151_4152.C409.gene1.dna; Position on contig =269..607bp; Strand=+
atggactacggcaagttcctctatgagaagagtaaatcagtcaaagaacagaaaaagaaacaaaaggttattcaggttaaggaaatcaaattccgtcctggtacagatgaaggcgactatcaggtcaaactacgcaacctgattcgttttctggaagatggcgataaagctaaaatcaccctgcgtttccgtggacgtgaaatggcgcatcagcagattggtatcgaaatgcttaaccgcattcgtgaagatctgagtgaactggctgtggtcgaatctttcccatcgaggatcgaaggccgccagatgatcatggtgctcgctcctaagaagaaatag

SEQ ID NO: 384 - DNA, 198 bp, Xenorhabdus bovienii
  Coding sequence Name=Xb4151_4152.C409.gene2.dna; Position on contig =703..900bp; Strand=+
atgccaaagattaaaacagtacgcggcgcggctaaacgcttcaagaaaactgccagtggtggtttcaagcgtaagcacgctaaccttcgtcacattctgactaaaaaatcaactaaacgtaagcgtcatttacgtccaaaaggcatggtctccaaaggagatttgggcctggttgttgcttgtctgccatacgcataa

SEQ ID NO: 385 - DNA, 357 bp, Xenorhabdus bovienii
  Coding sequence Name=Xb4151_4152.C409.gene3.dna; Position on contig =943..1299bp; Strand=+
atggctcgcgtaaaacgtggtgttattgcccgtgcacgtcacaagaaaattttaaaacaagcgaaaggttactacggtgcccgttcgcgcgtttaccgtgttgctttccaggcagttatcaaagctggtcagtacgcttaccgtgaccgccgtcagcgtaaacgtcaattccgccaattgtggattgcacgtatcaacgctgctgcacgtcagaacggcatgtcttacagccgtttcatcaatggcctgaaaaaggcttcgattgaaatcgaccgtaagattctggctgacatcgctgtattcgacaaagtagcatttgctgctttggttgaaaaagcgaagggcgctctggcataa

SEQ ID NO: 386 - DNA, 984 bp, Xenorhabdus bovienii
  Coding sequence Name=Xb4151_4152.C409.gene4.dna; Position on contig =1602..2585bp; Strand=+
atgtcacatcttactgagctggttgcaaaggcagaagcagccgtagaggaagcccaggatgttgccgcgttggatttggtgcgagttgaatacctgggaaaaaaaggccatttaaccctccagatgtcatcgctgcgtgacttaccagccgacgaacgtccagcggcaggggctgttattaatcaggcaaaacaggaagtgcaggaagcattgaatgctcgcaaggctaaactggaagctgatgttctgaatgcacgtttggcagcagaaaaaatcgatatttcattgcctggccgtcgtatggaaaatggtggattacatcctgttacccgcacgattgaacgtattgaaactttctttggcgaattgggtttttctgttgaatctggcccagaaatcgaagatgactatcataacttcgatgccctgaatattccggcacatcaccctgctcgtgctgatcatgatacattctggtttgatgcaacgcgcttgctgcgtacacaaacttcaggagtacagatccgtactatgaaagaacgccagccgccgatccgtatcattgcaccaggtcgcgtataccgaaatgattatgaccagacacatactccaatgttccatcaggtagaagggctgattgttgataaagatatcagctttactaatctgaaaggtacattacatgactttttgaataactttttcgaagaagagatgcaagttcgtttccgtccttcctatttcccatttacggaaccttccgcagaagtcgatgtgatgggtaaaaatggtaagtggctggaaatattgggttgcggcatggtacatccaaatgtattgcgcagtgttggtatcgaccctgaaatctattctggttttgcttttggtatggggatggaacgcttaactatgttgcgttacggcgtcacagatttacgtgctttcttcgaaaacgacttgcgtttcctcaaacaatttaaataa

SEQ ID NO: 387 - DNA, 2388 bp, Xenorhabdus bovienii
  Coding sequence Name=Xb4151_4152.C409.gene5.dna; Position on contig =2600..4987bp; Strand=+
atgaaattcagtgaactctggttacgcgagtggactaaccctgccatcagcagtgaagcattgtctgatcaaatcaccatggcaggtttagaagttgatggtgttgaaaaagtggcaggtcaatttcacggtgttgttgtgggtgaagtcgttgaatgtggccaacatccaaacgcagataaattgcgtgtcacaaaagttaatgtaggtggcgatcgcctgctggatattgtttgtggagcaccaaattgccgtcagggactacgtgtcgccgttgctacagtgggcgcggtattaccgggtgatttcaagattaaagctgcgaaattgcgcggagagccatcagaagggatgctttgttctttctctgaactgggtattgcagatgatcatgatggcattattgaactgcctgcggatgcaccgattggtattgatctgcgagattatatcaaattgaatgatagtgccattgaaatcagcattacacctaaccgtgcagattgtttaagcatcatgggagttgctcgtgacgttgctgttatcaataaactgtcaatgacagagccacagatcgaggctgtaaaactcactacagaagccacattccctatccgtgtcgacgcaccagaagcctgcccacgctacttggggcgcgttatcaagaatgtaaacgtcaaggctacaacaccactgtggatgcgtgaaaaactgcgtcgtggtggtattcgttctattgacccaattgttgatgttactaattatgtactgttagagttgggacaaccactgcatgcattcgatttggaacgcttaagtggctcaattattgttcgtctggctgagcagggtgaaaaattaacactgctagatggtaacgaaatagaactttctgctgatacactcgttattgctgatgaaaagcaagcccttgcaatggcaggaatttttggcggtcagtattctggtgtgaattctgaaacacagcatattttactggagtgtgctttctttgcaccattagcgattacaggtcgtgctcgttgttatggcctgcatactgatgcttcccatcgttttgaacgtggcgtagatccacaacttcagcataaagcgatggaatatgccacccaattgctgattgccatttgtggtggggaagccggagaaatcattgatgttaccagtggttcttatttgccaaaatcggcgactattactctgaatcgcaagaaattggatcgcctgattggtcatcatatcgttgatgacgaagtcacggatattctgacacgtttaggctgtcaggtgacagtgcagagcaatagctggcaggctgttgtacctagctggcgttttgatatgcagattgaagaagatctggttgaagaaattgcacgtatttacggttacaataacataccagacgtgcctgtgcgcgctgatcttgtgatgactgcacaccgtgaagctaatctgccattgaaacgcgtcaaaacgatgctggtggataaaggttatcaagaagcgattacctacagttttgttgatccaaagattcagcaatatttgcatccgcaggaagaagcattaatcctgccaaatccgatttcggctgacatgtcggctatgcgcttgtcattgttgacaggattattgaccactgttgtttataaccagaaccgtcagcagaaccgtatccgcttatttgaaactggcttgcgttttgtgcctgatgaaaatgctgaacatggtattcgtcaggaattgatgcttggtggtgtgatagcaggaaatcgttttgaagaacactggatgcttgaaaaacaagcagttgacttctttgatcttaagggcgatttagaatccgttttagaattgactggtatgctatctagcatttcatttagggcggaggaacatcctgctttacaccctggacaaagcgctgggatttatctggaaaataattatattggttatataggtgttgttcatccagaattggagcgcaaatttgacttaaatggtcgtaccgtgatattcgaattattgtgggccagtctggtggaccgcgtgattcctgaaatgaaggaagtttctcgcttcccatccaatcgccgtgatatcgccatagttgtgcctgaaaatgtagccgcagaagatgttcttgctgaatgtaagaaagttggcgtaaatcatatagttggcataaacttatttgacgtgtattgtggtaaaggtgtcgcggaaggccacaagagccttgctattagcttaatcttgcaggataccgtgcgtacactggaagaaaaagagattgctgcgaccgtcaacaaatgcgttgctgcattagaacagcgattcaaagcatccttgagggactga

SEQ ID NO: 388 - DNA, 297 bp, Xenorhabdus bovienii
  Coding sequence Name=Xb4151_4152.C409.gene6.dna; Position on contig =4992..5288bp; Strand=+
atggcgcttactaaagctgaaatgtcagaaaatctgtttgagaaactgggtattagcaaacgtgatgctaaggatctagtggaaatattctttgaagaagtgcgtcattctttagagaatggggagcaggttaaattatctggatttggcaactttgatttacgagacaaaaatcaacgtccaggtcgtaatccgaagacgggtgaagatattccaattacggcccgccgtgttgtcacgtttcgcccaggtcaaaagttgaaaaatcgggtggaaaaagctttaccaaaagaataa

SEQ ID NO: 389 - DNA, 996 bp, Xenorhabdus bovienii
  Coding sequence Name=Xb4151_4152.C409.gene7.dna; Position on contig =5386..6381bp; Strand=+
atgcactctgtttatgaattaatcactctccagaaaaaacgtgactatcgtgtgatagcactcctatccatcttatttattatgttatttattttgtcattgtgtgcaggagaattatggttctggcctgatcaatggctgtctgactcggcccgattatttatctggcaattgaggttgcccagagcgattgcggtgatagtggttggtgcgagtttggctgtgtccggcgctgtcatgcaggcgttatttgaaaacccgctggcagagccgggattattggggatcagtaatggcgctggagttgttgtggtatgtctgatccttgtctttcatggcattgctccattgtggttattaagtattggtgcggttcttggggcgttcgctatgactgctattttgttgggcttttccagaaaacatcaagtgacgaatacacggttgctattgattggcgtcgccttcggagtgatgtttggcgctatgatgacatggatggtttacttcagtaccagtctggatttacgtcagttgatgtattggatgatgggtagcttcagcggtattgactggcgccagaaatggttggttattgcactggttcccgctattttctggctgagtcaacaagggaaagtccttaattacctatcgcttggtgagttacaggctcaacagctgggaatatcacataataagtggcgtaatttatttatatcgatagttggattgttggttggtttgagcgttgctttggcaggggcgattagtttcattggtttggtgattccacatatcttaaggttaactggtctgacagatcataagaccttgcttcccgcttgtgcgctggcgggaagtagtggtttattattggcagatctattttcccgcttgtcattatcccatgcggaagtgccgattggagtggtcacagtaaccttgggagcaccaatttttatatggctactattaaaaacacatcatagataa

SEQ ID NO: 390 - DNA, 768 bp, Xenorhabdus bovienii
  Coding sequence Name=Xb4151_4152.C409.gene8.dna; Position on contig =6414..7181bp; Strand=+
atgacctgtcaaccgattttagaattgaataatattacggttgacaagagactgaccacattgtctgaatctgttatagcaaaagagcaaattcatctggtcgggctgaatggttcagggaaaagcacgctgctttcagcaattgcaggaattttaccttacagtggcaagattcatctgaacggcagaaacctgcgtgattatcgacagtacgagttggcgaaatatcgggcatggttttctcaatcagtttctgttcctatcatgccagtttaccagtatctggatatgtatcgtcctgattcagcgccattggatcagagtgaaagtgtgttatatgaactttgtcggcagctaaaactcacttcattgctgtcttcttcaattgggcagctatcaggaggtgaatggcagcgtgtcaggctggcaggagtctttttgcagatatggccagagttgaatccgaatggaaaattattactccttgatgaaccgacaaacaacctcgatattacacagcaaacagttttggatcagttaatcaaacaattttgttcactgggcggctcggtcttaatgagcagccatgatcttaatcacacttatgaacaagctaccagtgtatggttattgtcgcatggaaaattgttagtatctggaataccacaaaatgttatgactaatcaaaatttatcagaaatttttgaagtaaatattagacatatccaaaataccagctataaactatggagggttgatcatctttaa

SEQ ID NO: 391 - DNA, 1026 bp, Xenorhabdus bovienii
  Coding sequence Name=Xb4151_4152.C409.gene9.dna; Position on contig =7470..8495bp; Strand=+
atgtttggttgcagacacgcgattgcattatgttctgctacggcggggatgcatttggttctgctggcattgggcatcggcccaggtgatgaagttatcaccccttcccagacttgggtttccactatcaacatgatttgtcttctgggcgcagagcctgttatggtcgatgttgaccgtgatacgctgatggtcagtgcggaaacagtcagaaaagcgattacaccaaacactaaagctattatacctgtccattatgcgggagcaccttgtgatcttgatgccctgcgtattgttgctgacgaagctaatatccctctgattgaagatgctgctcatgctgtaggaacccgttataaaaatgagtgggtgggagagcgaggaacagcaatcttctcttttcatgccattaaaaacatgacatgcgctgaaggcggcatgttcgttacggataatgacgagcttgcacaacgggttcgctgcctaaaatttcatggattggctgtcgatgcatttgatcggcagcttcagggcaggaaacctcaggcagaagtcattgagcccggttttaaatataatttatcagacatccatgcggcgatggcggttgtacagttaggcaaactggaatccatgaatgcccgtcgcggggagttagtagctcggtatgctgctgctctgagcaattcaccgttacaaatgttgagtgttcctgaatatgaacacgggcatacccatcatttattcatggtgcgtgttgaccaagatgtctgtggtattgatcgcgatacttttatggcacgtttaaaagaaagaaatattggtacaggcttgcatttcagggctgcacatacacaaaaatattatcgggaacgttttccgatgctgtctttgcctgcatcggagtggaactcggcaacactttgctcgttgccactttttccagatatgaataatgacgatgtagatcgtgtcgtgaattcaatcactgaaattctttcggagcatagaaatagtgacatttga

SEQ ID NO: 392 - DNA, 978 bp, Xenorhabdus bovienii
  Coding sequence Name=Xb4151_4152.C409.gene10.dna; Position on contig =8485..9462bp; Strand=+
gtgacatttgaaaaaattaagaaagtctcggttgttattccagtttataacgaagaagaaagtctaccccaattattggaaagaacgatcgctgcgtgccaacaacttgagcagaaatatgaattaattctggtggatgatggcagccgtgacagctctgccgatattttaactcaggcggcggaaactcccgaaaatcacgttattgctattttacttaaccgtaattatgggcaacattctgcaatcatggcgggatttcatcaggctgatggtgatcttgtcatcacacttgatgcagacttgcagaatccaccagaagagatcccccgtctggtgaaaacggcagaagaaggatatgacgttgtgggaacacgtcgtgccaatcgtcaggattcttggttccgtaaaactgcgtccaaaataattaatgtgatgataactaaggctacaggccgttcgatgggtgattacggctgcatgctgcgcgcttatcgccgtcatatcgtacatgcgatgctgcaatgccatgaacgcagtacatttattcccattctcgctaacacatttgcccgtagaacgactgaaattgatgtaactcatgcagaacgtgagtttggggattctaagtacagtttcatgaagctgatcaatctgatgtatgacctgttgacctgcctgacaaccgcaccactacggttattgagtgttgtgggaagcattattgctgtgacaggttttctgctggcggtattactgatcactttgcgcctcattttcggatcaatatgggctgctgaaggtgtatttactctatttgccatccttttcatgttcattggtgcacaattcgttgcgatgggattgctcggtgaatacgttggccgaatatataacgatgttcgcgcccgcccgcgttattttattcaaaaagtagtcggagttagaaagatcaacgacaatcaggaaaaaagctaa

SEQ ID NO: 393 - DNA, 1986 bp, Xenorhabdus bovienii
  Coding sequence Name=Xb4151_4152.C409.gene11.dna; Position on contig =9462..11447bp; Strand=+
atgaaagcagtaatttttgcctatcatgatattggttgtgtcggacttaatgcgctggttaaagcaggctttgacattcaggctgtatttacacacactgatgacccgaatgaaaaccattttttctcttctgttgcacgcattggtgccgatttgggattgcctgtatttgcgccagaaaatgtaaatcatccgctttggattgagcgcatccgtgagatgaagccggatgttatcttttctttttattatcgcaacatgcttagtcaggatcttttatctttagcagaaaaaggtgcgtttaacctgcacggttcattattgccgaaatatcgtggtcgtgctcccgttaactgggcggtgttaaatggtgaaaccgagacaggcgtgacactgcatagaatggtgatgaagccggatgcaggagatatcgttgcacagcaggctgtactgattggtgaaaccgatacttcactggacgtgcatggcaaaatccgtgaggcagccgttgaattactggatagtatcttacctcaaataaaatcaagtcattatttatccatcccacaggacgaaaatcaggccacttattttggtcgtcgtacggctgaagatggcgaaattgattggcataaatctgctaaagagattaataacctggttagggcggtaactgagccatatcctggggcatttacgttccttggcgagcgtaaaattacggtttggcgttcgcgtccactcattcaggttcatgacaaacttccaggaacggtgctttctactactccatttgtcattgcctgtggagaaggtgcactggaaattaccagtggccagggcgaatccggtctttatgttcaaggaagccgactggtgctggaaatgggcattgtgacagatgttcgagtcggctcgaaagcaaccgcacaaattagtcgtcgtaagcgtgtgctgattctgggagttaatggatttatcggcaatcacctgacggaacgtttgttagacgatgaaaagtatgacatctatgggatggatattgggtcttctgccattgagcggtttatcggcaatccccgttttcattttattgaaggagatgtcagtatccatacagaatggattgaatatcacattaaaaaatgtgatgtcattcttccattagtggcgattgcaacacctattgaatatacccgcaatccactccgtgtctttgaactggattttgaagagaatctgaaaattgttcgctattgtgtgaaatacaataaacgcattattttcccgtcaacatctgaagtctatggcatgtgtgacgacaaggaatttgatgaagatacttcgcgcctgattgtcgggccaatcaataaacaacgctggatctattcagtatccaaacagttacttgaccgggttatttgggcatacggtgtaaaagaaggtttgaaattcactttattccgtccatttaactggatggggccaagattggataacctgaattcggcgcgtattggtagctcaagagcgatcactcagttgattttgaatctggtagaaggctcaccgatcaaattggttgatggaggagaacagaaacgttgtttcactgatatcaatgacggaattgaagctctgttcagaatcatcgaaaaccgtgatggactgtgtgacgggcaaattattaatatcggtaacccaaccaacgaggccagcattcgccaactcgctgaaatgttactggagagctttgaaaaacatgaattgcgcggaaatttccctccgtttgccggattcaaaaagatcgaaagcagtagctactatggtcagggctatcaagatgttgaacatcgtaaacccagcatcaagaatgcggagcgtctgctgggatggaaaccaaccattgatatgaaacaaaccattgatgaaacgctagatttcttcttgtgtggggaagttgaagaattaaccagggaagactaa

SEQ ID NO: 394 - DNA, 894 bp, Xenorhabdus bovienii
  Coding sequence Name=Xb4151_4152.C409.gene12.dna; Position on contig =11467..12360bp; Strand=+
atgaagaaagttggtttgagaattgatgtggatacttatcaaggcacaaaggaaggtgtaccccaattgcttgaaattttgcagcgacaccacattcaggccagctttttcttcagtgtagggccggataacatggggcgccatttgtggcgcctactgcgaccaaaatttctttggaaaatgttgagatcaaatgctgtgtccctttatggtttggatatcttactggcgggtacggcgtggccagggaagaagatcgcaaaaaatttagggtatttgatgaaacaggcagtggatgctggtcatgaaattggtctgcatgcatgggatcatcaaggctggcaagccaaagtagagcgctggtcagaagctgaattagcagagcaggtgcagctaggtattgatgcattgaaaaaagcaacagggcaagcgattacgtgctcggcagttgcaggatggcgggcggatgaacgcgtactgacggttaaacagagatttggttttgattacaatagtgattgtcgtggaacacatccattcaggccactattacctgatggaaccattggcactgtgcaaatccctgtcacattaccgacctatgatgaagttgttggaacacaggtcagcgatgcagatttcaatcgctttatccttgacgcaatgaaaaatgatcttggtgtttctgtttatactattcatacagaagttgagggcatgtcgaagtctccacagtttgaaaccttactgaatatgctccatcagcaagatattcagttttgtaaattaagtcatttactacctgaaaatagagaaacgcttcctattgggaaaattgttcgttcagattttcctggtcgtgaaggctggttaggttgtcaacaaaaggtataa

SEQ ID NO: 395 - DNA, 1623 bp, Xenorhabdus bovienii
  Coding sequence Name=Xb4151_4152.C409.gene13.dna; Position on contig =12407..14029bp; Strand=+
atggctcttttttttattcttacttatttattacccctgaatggccgccttttgtggcagccggatgaaactcgatatgctgaaatcagccgggaaatgttacaacgcggagattggattgttccttatttcttcgatatccgctattttgagaaaccggtagcaggttattggtttaataatattagccaatggatttttggagacaacaacttcgccgttcgttttggctcagtgttcagtaccttactcagcgcatttcttctttatctattagcgatgatgatgtggaaaaaccgtcagattgcctttgtttccagtctgatttacatctccatgtttattgttttttctattggctcttatagcgttcttgaccccatgttctctttatgggtcactgcggggattgtcagctgctattgggcacttaaagctggcagtactcgtgagcgaatgctggcatggtctgccttagggctggcttgtggcatggcgtttatgactaaaggctttttagcattagccttgcccgtcatttccatgatacctatcacgatataccagaaacgtttttgggaaatggttcgctttgggccacttgctgttattttcgctattttgattagtttgccgtgggtgattgcgattgccctgcgggaacctgattattggcattattttttctgggtagagcatatacaacgttttgcatcagataaggcacagcatattgcaccgatgtggtattacctgccaatactggtgttgggtgtacttccttggcttggattattgcctggttccttgatgaaaagctggaaagagaaaaaaagccatccagaaatgtttttcttgctttgttggttcatcattccattcgtcttttttagtattgcaaaaggaaaattgccgacttacgttttgccatttatcgggcccttggcactgatgatggcaaaatacagtattgattgtgtcagtaatggcaagatgaaagcgctgaaaataaatgggttggtgaatgttctctttggcattattgcgatattggtgttgctcgttatgcagacactcttaaatcgccccttttatcaacccagcgaatggtcaaaatggctattgggaacggtggcttttggtgcctggggaatcatcggttacctgtgtttcattcataatggtaaacgttggttgtgggcagccgcctgttcattggtactcagtttgtcatttagtagcacattgcccaacaggactatcgattctaaattacctcagaatttcattaggcaaaatgtgcaagaactgactgacagtaaatatattttatctgaggcagtaggcttgggagctgcagtagcatgggaattaaaacgcagtgacatttacatgtttgatcgcacaggcgagttagaatacggtcttgcctatcctgacagccaataccgatatgtagcacaagaaaaattccctgcgtggctggagaaagcgcgtaaagaaggtcaagtagcgattgttttcctattgtcttcaaaaggaggtcttcctgagttgcctaaacctgatcttgtgcgccgtagtgaccgttttgttcttgtgatttataaaaaacaatcatga

SEQ ID NO: 396 - DNA, 282 bp, Xenorhabdus bovienii
  Coding sequence Name=Xb4151_4152.C409.gene14.dna; Position on contig =13965..14246bp; Strand=-
atgggatatgcaatactcagtggcaaatattgcagcagtcgcagccagaatatcatccctatccccaacaaaagaatagcacccgtcagccagatcgccacagatacccccttatggtgggtatctgttttctgccaacaggtgacggcttgtttctggcatagctgtccggcacaggtcagcaggctaactaatatcaataatgctaaattgctggtcatgattgttttttataaatcacaagaacaaaacggtcactacggcgcacaagatcaggtttag

SEQ ID NO: 397 - DNA, 231 bp, Xenorhabdus bovienii
  Coding sequence Name=Xb4151_4152.C409.gene15.dna; Position on contig =14146..14376bp; Strand=+
gtggcgatctggctgacgggtgctattcttttgttggggatagggatgatattctggctgcgactgctgcaatatttgccactgagtattgcatatcccatgcttagtattaattttgtcgtagtaactctggtcgggcaattcctgtatcaggaaaaagtggggctaaaacactggataggcgtttttgcgattatgttcggaattttattgatgagtctaaatcaatga

SEQ ID NO: 398 - DNA, 387 bp, Xenorhabdus bovienii
  Coding sequence Name=Xb4151_4152.C409.gene16.dna; Position on contig =14373..14759bp; Strand=+
atgagaggttatctttggggactaacgagtgtgctattgatcactgtggcacaactattgttaaaatggggagctgctcgtttacctgagctttcgttatcaacatattggttggatatagattggatttgggcacatcataatcctttgttgatggttatggcaggattggcaggttatgcattatccatgttatgttggctttttgttctgcaatacctgccattgaataaagcttatccgatgatcagtttgagctacgtttttgtttatttaatggcagctttattgccttggtttaatgaaaccctctcatggttgaaaacggctggagttctttttattttattgggagtctggcttattagccgaccagatgccaaatga

SEQ ID NO: 399 - DNA, 279 bp, Xenorhabdus bovienii
  Coding sequence Name=Xb4151_4152.C409.gene17.dna; Position on contig =15045..15323bp; Strand=-
atgaaaaaattagcgatcctgttagccgcattactttcgtttggtgcttgtgctaaaaccaaagtcgatgtgtctaaaatttatgggaacattaaagttgttagctctggtgcggactataaggttaaggtcgttagctcgtcacctgacctgaaagtcaaaatcgtcaccagttccgctaactcgccgggtaaatggaaaatggtaaattcatcccctgattacaaaattcagttcgtaaactcattcccggactttactatcaaatacgtcaattag

SEQ ID NO: 400 - DNA, 273 bp, Xenorhabdus bovienii
  Coding sequence Name=Xb4151_4152.C409.gene18.dna; Position on contig =15594..15866bp; Strand=+
atgcctaatctcaaagatctatccaaccaactggcactgatacgaaaacaaattccgttcgctatggctcaggtactgaccagcgttgcgcatgatgatgtatggcaacgtaagaaatccaaatcgaagaagagtaagcgccgccggtttggtgatgctctgccagtcgagccaatactcagttatcaggaacgggcgcaacaaatggctcaatcgttgatgcctgctgctatcagtcaggcattgagcgaggcgatacaaacagctaaatag

SEQ ID NO: 401 - DNA, 396 bp, Xenorhabdus bovienii
  Coding sequence Name=Xb4151_4152.C409.gene19.dna; Position on contig =16616..17011bp; Strand=+
ttgcggacagcactttctgatccaattatggtcattgctcagttaaaagagcaacttaatcaatggcacggtacgccttatcgatatggtggaatagatcagcgtggtgttgattgctctggctttgtttaccgtacatttcacgatcgttttaatattcaccttccgcgtacaacaaacgaacaaaccaaattaggcacccagattagtaaagatgatttgatgccgggtgatctggtatttttcaagacaggcagtggcgagagtggtttgcatgtaggtatttatgatatcaacgacgagttcattcatgcatcgaccagtaaaggcgttatacgttcttctcttggtaatgtgtattggcgacgtgttttttggcaagcccgcaggatgtaa

SEQ ID NO: 402 - DNA, 1017 bp, Xenorhabdus bovienii
  Coding sequence Name=Xb4151_4152.C409.gene20.dna; Position on contig =17085..18101bp; Strand=+
atgtctacattacgcctgctgttgtctgattcccatgatccttggtttaatcttgcagttgaagaatgtattttccgacagatgtcaccagatcagcgcgtcttgtttttatggcgtaacgccaatacggttgtggtagggcgcgctcagaacccatggaaagagtgcaatacacggagaatggagcaggatggaataaaattggctcggcgcagtagtggtgggggcgctgtttttcatgatttgggtaatacctgttttacctttatggcaggtaagccagaatataataaaactgtttccactcaaatcattctggaaggattaaaaaaagcgggcatccatgcgatggtttctggtcgtaatgacttaattttatcatcccctgaaggtgagcgtaaaatttcaggctcggcgtatcgcgaaaccaaagacagaggttttcatcatggtacgttgttgattaatgcagatttgaaccgccttgccgattatcttaatcctgatcctaaaaaattacaggcgaaaggtataacgtctgttcgttccagagtgacgaatttatcggaattattacctgatatcacacatgaaaaagtgtgtggtggaattaccgaagcattttttgaatatttcggtgaagtagccaagtcagaactcatttcgccgcaggccgtacctgatttaccgggatttactgacgtttttgccaagcagggtagttgggaatggaattttggtcaggcacccgagttcagtcatacattggataaccgtttctgttggggaggaattgaactccatgttgatattgaacacggtactattggtcgttgccagattttcactgatagcctggaacctgcgccattcgagttattggctgaaaagcttgttggtgtactgtatcaaccacaggcagttgggcaagtgattcaacaaatcagagaacaatattccttactggataaagaattacagcagttgtatcactggttggttgacgaattgaaatga

SEQ ID NO: 403 - DNA, 363 bp, Xenorhabdus bovienii
  Coding sequence Name=Xb4151_4152.C409.gene21.dna; Position on contig =18248..18610bp; Strand=-
atgttagaaagtgtcatcaacgatattgtcagatggctagaaagccagcttcaacgtactgaaggtatcaaaatagatgccattgcacataaaagtggctattcaaaatggcatttacagcgaatttttaaggaactgaaaggctgtacactgggtcaatatgtgcgtagacgtcgtctccatgaagcagcaaagtctttgcatgaagatagcttgccgattcttgatattgctttgcaatatggttttagttctcaggctacatttacccgaatatttaagaagcattttaatacaacacccgctaaattcagggcaagtgggcagttacccgagtttaagactttcttacattgcgaataa

SEQ ID NO: 404 - DNA, 201 bp, Xenorhabdus bovienii
  Coding sequence Name=Xb4151_4152.C409.gene22.dna; Position on contig =18771..18971bp; Strand=-
atgatccgcaatttacacgttatgttaggtattcccgcagatgtcctgataaaaccaacaaaaaacagtcctgttatgggtaataccactcgcttaagcaaattcgattgcattacagcctcatttataattaataacgtagctataatatcactgtacttaaaaacaaataaacatctgatgcgcaccattaattcataa

SEQ ID NO: 405 - DNA, 498 bp, Xenorhabdus bovienii
  Coding sequence Name=Xb4151_4152.C409.gene23.dna; Position on contig =19545..20042bp; Strand=+
atgaagattatcaatatattattttgtgcagctttatattgtttgttgatatccccagtccgggcagatgagaaaatggttaatgcagaaaaacaacagattctttctgctgactataatatggaatttaaaaattcctcttcttctgtaaatgatttcatgatagccaaacgaagcaccgactgtatgtatgatagtggtgcagatcagataagggttgagcctggtaaccagcaaagtactcatttacaagacaacgataatttatttagtgcttgtacacttaggcctaaatgggttgagtgggcggtttctagtggctcgacgagttgtgctttgagatttgagcgtgggtttgatggaggatggtatacagtaattaaagggtgtccgaatatagtcaaaagcgcgacttgtggagatgctgactgcaatcagaataacgtttacggaagctcatcgtatatggatataagtgtggaattgcttattcggtaa

SEQ ID NO: 406 - DNA, 795 bp, Xenorhabdus bovienii
  Coding sequence Name=Xb4151_4152.C409.gene24.dna; Position on contig =20225..21019bp; Strand=-
atggaatcagtaatgtcggaaaatttacttgaagccagaaatttaaactatttcattgggcatcgtcagattatcaaggatatttcactttcccttcagaaaggggaagttgttgcaattattggccccaatggggccgggaaatctacgctgttacgcttattaacaggctatattccgtccaattcaggcgaatgcctgttaaaaggcgttccaatctcccgttggccaacccagcaacttgcacgtattcgtgccgttatgcggcaatacagttctctttcttttcccttcagtgtggaagaaatcattgccatgggccgtgtgccacatgaaaatacccacagaaaaacggccattgatgaagcgattatgctgacagaatgtgaagagctaagacatcgaaattatcagcagttatctggaggggaacaacagcgggttcaactggcaagagtactgacacagctttggcatccagagccaacagaatcttgtctatttctggatgaacccacatcagcattggatctttaccaccagcaacatacattacggctggtacatcgcctgacacgtcagcgccctctggctgtttgctgtgtactgcatgatttaaatttggcttcactctatgcagacaaaattatcctgttacacaaaggaaaactggtggcgtctggttccccgcaggatgtgcttcgcgatgatattcttaaacaatggtatcgggctgatttaggggttactcagcatcctgaaacctatcagccacaagtttatctccggcaataa

SEQ ID NO: 407 - DNA, 1002 bp, Xenorhabdus bovienii
  Coding sequence Name=Xb4151_4152.C409.gene25.dna; Position on contig =21019..22020bp; Strand=-
atgagtcgttcccactcccccagtttcggcttgatggctctcggcttgttgctattcttgttagcaatcagctcagccaatatgggggcattgccactttcttttaaaaccctgtgggagtcctcattggatgacccacagtggcagatttggttaaatatccgcttaccgcgcattctgctggctattttggttggcggtgcgctggctgtgtccggtgccgtgatgcagggattgttccgcaatccccttgccgatcctggcttattagggatcagtagtggtgctgcacttaccgtagcaacggtgattgttctgccttttacgctacctgccagtatcgcgttatatggccatattattgcggcttttatcggcagtttactggtttcattcctgatattttcgttaaataaatataaccacggtaatctatccaaattattacttgccggtattgccatcaatgccctttgtatgtcgtttatcggtgtgttgagctatgtcagtaatgatcagcaattgcgccaattttcgatttggatgatgggttcattgagccaaattgaatggccaacactgattatcgccgcgtctctcattattcctgtttgcattttggcattcagtcaatcacgaaaactcaatctgcttcaattaggcgatgaagaagctcactatctcggtattaatgtccaacgtactaagtatcaattattattgctgagtgccctgctgattggctgtgctgtcgctttgagcggtgtcattggttttatcggtctggtgattccacaccttgtcagactacggtttggcggtgaccatacttggcttctgccaatctcggtactgggcggagcatgcctgctgttaagtgctgatacactggctagaacattagtttctcctgcagaaataccagtaggacttatcaccggtttgatcggtgctccctattttttatggttgattcttaaaccatcaggaggccgtttataa

SEQ ID NO: 408 - DNA, 819 bp, Xenorhabdus bovienii
  Coding sequence Name=Xb4151_4152.C409.gene26.dna; Position on contig =22017..22835bp; Strand=-
atgaaaaagtggcttctaacatttatgtttgccatctctggcaatgcattctctgctgaacgcattgtcacaattggtggtgatgtgtctgaaattgtttttgcacttggcgaagggcagaatgttgtcgcaagggatagcaccagccaaaaccctaaagcattactctcactacccgatgtgggatatatgcgaatgctgaattcagaagggatcctatccatgcgcccatcactggtgattgtaagtgaatcggcgcaaccgtctctcgcacttaagcaagtcgaaaattcaggtgtaaaagttattaaagtgaccagcaaagcctcgttagaagccgtttctgaaaaaattttgaccgttgcaaaggcggtcaatcaggaaaaaagcggtgaaatgctgatctcccaatatcgacaacagttagccgaaatcaacacgtcaaatattcccactaaggtgatctttgtcatgagccacggcgggatcatgccaatggcagccggtcaacagacagccgcagaccagattatccgtagtataggtgcacagaatgccatgcagggatttaaaggatatcgtcccctatctcaagaaggagtcattgccagccagcctgatttgctgctagtcagtactgaggggctgaaaacgctgggaggtatggataaactctggcagcttccgggattaaatttcactccggcaggcaagaaaaaacaggttattattgtggatgaaatgggtctgcttggatttggcatccaaactccagccgtcatgaaacaagtccgcgaggcggcggagaaagtgcaatga

SEQ ID NO: 409 - DNA, 1074 bp, Xenorhabdus bovienii
  Coding sequence Name=Xb4151_4152.C409.gene27.dna; Position on contig =22832..23905bp; Strand=-
gtgaatcagtcactttatgaacgttacctacaggccaaagcggataacaaagctaaatatgcacgtgatctcgctgcttacctcaatgtcagcgaaggagaattattgcatagtcgtgttggtatcgacgcaaaacgtttgaacgttgatgctcctgccctgcttcaagagctggcaacggtcggagaaactaaagccattacccgtaatgattttgccgttcacgaacaggtaggtcgttacgaaaatacacagttcagcccacatgtcggtttgattctcaacccacgagaacttgatctgcgactattcttcgaccattgggcctgcgttttctctctggttgaaccagccaaaaatggcctgcgtcacagtattcaattctttgaccgccaaggtgatgctctgcataaagtgtacacaaccaaagataccgatatggctgcatgggaagccttgatcgaaaaatatcagaccgatgaaaatccagctctggaaattcaacctgaaaaagtatctgagcacaaagaagtcacagaacaactgaaagctcaattggatgaagaatggcgtgctatgactaatgttcaccaattttttatgatgatgagccgtcataacctaaaccgtcagcaaattttcaatgctgtcggtaatgatctggcctaccgtgttgaaaattcatcactgactcaaatcattgaaaccgcgcataacgatcaaaatgaaatcatgatttttgtcggaaatcgtggttgtatccagattttcacgggtaaactggaacgtttgatgccttatcaggaagaaaattctcctcagaaatgggtcaacattttcaatcgtgatttcactttgcacctgattgaaagtgctattgtagaaagctgggtaacacgtaagccaacaactgatggttttgtcaccagccttgagctatttgatgccgaaggtaaccaaatcgcacaattgtacggccagcgtaccgaaggtacgcctgaacaggcacattggcgtaagcagattgccgcactgcctaaactggaatcagaaaaggaaacttgcatagtatga

SEQ ID NO: 410 - DNA, 2061 bp, Xenorhabdus bovienii
  Coding sequence Name=Xb4151_4152.C409.gene28.dna; Position on contig =23981..26041bp; Strand=-
atgaacccaattaaattaccaaacctaaaattatcatcattaagtgtggtcattttgactgggttatcttctgctcatgcaacaacaatccttgctgaagaaaataaatcatccaaagatactttgactgtttacgcgactggcaatgagcgcgatagttttgaagcgcctatgatggtaacagtcattgaaggaaactcagccaacaatagagtggcaggcaatgcccatgatttactgcgtaaccttcctggtattaacgtttctggttctgggcgcaccaatggacaagacatcagtatgcgcggttattctaaaaaaggtgttttaacgcttgttgatggtattcgtcagggcaccgatactgggcatctcaatggtttatttctcgatccaagcttgattaaacaggtcgaagtcgttcgtggtccatccgccctactttatggcagtggtgcactgggaggcgttattgcctatcagacagttgatgcagccgatttattgcaagagggaaaaaatactggctttcgtgttttcagtcgcgcagcaacaggtgatcatagcctgggatttggtggtgctgcatttggtaagacagagcaactcgatgggttatttgcattcagtagccgtgatgttggcaatattcgctatggtaacagcctaatcggtcataatgacgaaaccattggtaatatgctggcaaaagggaaatggaatatcaatgatagccaatcactcagtagcgaacttcgctattaccgcaatcagtcccatgagcctaaaaacccacaagctatcacagataatgctaaaaacgataacccgagagcagatcgcaccacgacacaacatgatgcacaactgacttatcgactcaatccggctgagtacaactggctgaataccaaagcggatatctattactcggacgtcactattaatgcaaaaaccaaagagaaaggttttgaaggtcgcaaacaagaaacttacggcgttaaattagagaaccgttcacatctgggtgcaaacactttttcagttcatcaattcacgtacggtggcgaggcttacaaacagaaacagaagccaaacggcaatacagaaagtttccctgatgccgatatccgttttgcatccggttgggttcaagatgaaataaccctgcgtgatttgcctgtttcattcatcgtcggtacacgttacgacaattacaacgcttcaaatgctaaatatgacgatatcagtgccaataaatggtcatcaaaaggcgctgtcagcattacgccaactccttggtcaatgttattcacttcctattctcaggcatttcgtgctccaaccatgggtgaaatgtataacgattctaagcacttccacatgccagcaatgagaggaaagccgggattcactaattactggaaacctaatcctaacctgcgtccagaaagcaatgaaactctggaatctggctttggactgcgtttcgatgatttattctccagtaacgatgagttgaaattcaaagtcagttattttgacactcaagcgaaggattacatcacttccatcgtgacaatgccggatatgagatctacaacgtcaatcaatatccctaaaaccaaaatttggggctgggatgcttcaatgagttatgaatcaaattggttctcatggaatctcgcttacaaccgaacaatgggaaaaaacgaagaaacaggagaatctatcgccgacctcagtcccgatactttgagcagcatgctagatatccctctatctaacaccggtttttcccttggttggatcggtaaatttacccaacatactcagttcagagggattaatggtgataaaaatgagcgcggtcagaaactctctcaatacgcaggctacggaatcaatgatttctatgtcagttatcacggcgatggaaaattaaaagggctaacaacttctgtcgtacttggaaacgcgttcgacaaagaatattactcgccattgggcgccccacaggatggccgcaacggtaaactgttcatcagctaccagtggtag

SEQ ID NO: 411 - DNA, 1047 bp, Xenorhabdus bovienii
  Coding sequence Name=Xb4151_4152.C409.gene29.dna; Position on contig =26516..27562bp; Strand=-
atgcacaaaacagatgaattaagaacccgttccattggtcgtttgattacacccaaagcacttgctgaacaatatcctatatcagaaaaaatccggcaaaatgtgacattgtcacgtaagcgaattgaatccattcttacaggcaatgacccgcgtttactggtcattattggcccttgttcaatacacgatgttgatgcggctcttgattatgccgcccgcctgcaagtattacgtgaaaaataccagcacagtctggaaatagtaatgagaacctatttcgagaaaccccgtactgttattggctggaaagggttaatttcagatcctttgttagatggctcctgtcaggttaataagggaatctctctcgcccgtaagctattaaatgatattaatgaactgggtatgccaacggccactgaatttttggatatggtcacagggcaatatattgccgatttaattagctggggtgccatcggagccagaacgacagaaagccaaattcatcgggaaatggcatctgctctgtcatgccccgttggatttaaaaatgggacagacggaaatacgcatatcgctatcgatgcgatacgcgcagcacgtgccaaacatatgttcttgtctcctgacaaagatgggcggatgactatttaccagaccaacggaaatccccatgggcatatcattatgcggggcggtaaaaagcctaattacaaagcagaagatattgctgccgcctgccagaaattacatgaatatcaattaactgaacgcctgattgtggattgtagccacggtaactgtcaaaagatccatcgccgccagctagatatcgcgaaagatatcggccagcaaattcaatcgggttcaacatctattgcgggtgtcatggctgaaagtttcttgatagaaggtactcaaaaagtagtacatggagaacctttaacctacgggcagtccattactgatccctgtcttagctggcaagataccgaacagtttatcaatattctgtccagagcggtcaaagatcgtacttga

SEQ ID NO: 412 - DNA, 864 bp, Xenorhabdus bovienii
  Coding sequence Name=Xb4151_4152.C409.gene30.dna; Position on contig =27730..28593bp; Strand=-
atgacagaaaaccatacctccaaaacacaggaaaatgaaactctggaacgcagtgtgttttttatttccgatggtacggcaattacagctgaagtacttggacatgccgtattgtcccaatttccgattacagtcacttcttatactctgccttttgtaaacagtaaaatgagagcagaagaaatcaaaactcagataaacgcgatatatcaagaaacacagcttaagccactggttttttattccattatttcggatgaagtcaaaagtatcatcacaagcagtgacggtttctgtcaggatattgtccagacactggtggctccactgcaacaggaaatcgggctggaacccaagccagaattacaccgtacccacggtttatccaaaaagaatctggggcaatatgatgctcgtattgcagccattgattatgctctcgctcacgatgatggcgtttcattacgtaatcttgaacaggctcaagtgattattctgggcgtatcccgctgcggtaaaacccctaccagcctctatcttgccatgcaattcggtattcaggcagcaaattatcctttcaccgcagacgatatggacaatctacaattacctgctgccttaaaaccctttcaacataaattattcggcctgaccatcagcccagaaagacttgctgctattcgagaagaaagacgtgaaaatagtcgttatgcctcattgcgacaatgccgattagaacttgctgaagttgaagcattgtttcgtaagaataaaattaactatttaaataccaccaattattctgtcgaagaaatttcaaccaaaattattgacagtatgggattgaaacgccgcatgttctga

SEQ ID NO: 413 - DNA, 2379 bp, Xenorhabdus bovienii
  Coding sequence Name=Xb4151_4152.C409.gene31.dna; Position on contig =28842..31220bp; Strand=+
atgtccaacaatggcctcaccccatgcaatgtgctctggtataaccaattaggcatgaatgatgttaatcgagtcggtggtaaaaacgcctctcttggtgagatgatcaccaatctggctgaacttggtgtgtctgtccccaatggttttgctacgaccgcacaggcatttaatgattttctggaacaaagcggcgtcaaccagcgtatttatcagttgctggatgaaaccaatgttgatgatgttaatcaattggccaaggctggcgcacagattcgtcggtgggtgattgatacgccatttacggcacagctggaaaacgatatccaagatgcctacctgcaattgtctgaaggtgagcccggtgcctcttttgctgtgcgatcttccgccacagcagaagacatgccagatgcctcttttgcaggacaacaggaaactttcttgaatgtgcagggcattgatgccgttatggttgccatcaagcatgtctttgcgtcactttttaacgatcgggccatttcttatcgtgtccatcagggatatgaccatcgcggtgtcgcgctctctgcgggagtacaacgcatggtacgctctgatttagcatcgtctggtgtgatgtttacgattgatactgaatctggttttgatcaagttgtgttcattacgtctgcttatggcctcggtgagatggtcgtgcagggagcagtgaatcctgatgaattttatgtccataaacccacactgcaaaacaatcgccctgcgatagtgcgtcgtaatttgggatcaaagagaatacgcatggtttatgcggacagtaaagagcatggaaagcaggtacgtacagaagatctgtcagatgtgctacgcaatcgtttctctttgacggatgacgaagtagaagcgctggccagacaagcgctgttgattgaaaaacattatggccgtccaatggacattgaatgggcgaaagatggaaataatggcaagttatatattgtacaagctcgccctgaaaccgttcgatcaaatcaacaggtgatggagcgctatcaactcaacacacagggttcggtattggtagaaggtcgtgctatcggacatcgtatcggtgctggtacggttaaggtcattcataaccttagtgagatggatcgtattcaggctggtgatgtgttggttactgatatgactgatccagattgggaaccgataatgaaaaaagcggctgcgattgtcaccaatcgtggagggcgtacctgccacgcagctattattgcccgtgaactgggtattcctgctgtggtaggttgtggtgatgctactgaacgcttgaaggaaggacaagaagtaacgatttcctgtgctgaaggggataccggtttcgtttaccaaaataaattggattttagcatccaaagctcccaagttgatgaattgccaaaactggatgttaaaatcatgatgaacgtgggtaatcctgatcgtgcatttgattttgcctgcttgccaaatgaaggtgttggtctggctcgtctggaattcatcattaaccgaatgattggtgttcatccccgtgctttgctcgaattttcccaacagacacccgaattgcaagagcaaattaacgcgttgatggtcggctatgacgatccggttgaattttatattggacggttaacggaaggcgttgcgacactggcagccgcattttggccgaagcgtgtgattgttcgtttgtctgatttcaaatccaatgaatatgcaaatttagtgggtggggaacgatacgaaccgaatgaagaaaaccctatgttaggtttccgcggggctggtcgctatgtttctgacagtttccgcgcatgttttgcactggagtgtgaagccatcaagcgggtgcggaatgttatggggttaactaatgttgaagtgatggtcccgtttgtacgcacggtagcacaagcagaagctgttgtggcagaattggctgcgcagggcttgaaacgtggtgaaaatgggttgaaagtcatcatgatgtgtgagattccatcgaatgcattattggcagaacaatttctcgaacattttgacggtttttcaattggctcaaatgatatgactcagctagcactgggattggatcgtgattctggtgtggtgtctgagttatttgatgagcgtaatgatgccgtaaaacaattactttctatggcaattcaagcggctaagcgtcaaggtaagtatgtcggtatctgtggacaaggtccttcggatcacgaggattttgctgagtggttagtgaaagaaggcattgacagtttatcgttgaatccagataccgtggtaaaaacctggatttcgttggctgaaaacaattaa

SEQ ID NO: 414 - DNA, 1110 bp, Xenorhabdus bovienii
  Coding sequence Name=Xb4151_4152.C409.gene32.dna; Position on contig =31693..32802bp; Strand=-
atggaaaaatcgcaatcacgccaggatttacccaagctgctatttgtgctgttctttattctactgctcattgcgacctgcttttgggttttaagtccatttgtcctggggttcatttggtccggaatggtcgttattgcaacttggccattattagaaaaattacaacaacatctatggggaaaacgctggattgccgtttctattatgacattgctgctagttttattatttgttatcccaattgcattattggttagtagtttgctggaaaacagcactccattgattgaatgggcaaaatccccctcgacgtttcaattacctcaactagaatggctcagccggatcccggtcataggtgaagatttatatgttaaatggcaggacacggttgctgatggaagcaacattcttctcaccaaaattccaccctatattggtaaaacggcaacatggttttttacccaagcagccaacgctggccgtttcttgttccatcttgtactcatggtgctgttcagtgttctgctttattggaaaggtgaacaggtcatgttaagtatccgtcattttgccatccggctggcagaccaacgtggtgatgcagtcgtactgctggctgcccagtctattcgtgcggttgctcttggtgtggttgtcacggcactggtacaagcaatcgccggtggaattggattagcaattgcaggcattccctatgcaatgatactgactgtattaatgtttatatgctgtgttgcccagctggggcctctattggtgctcgttccgtctatcgcgtggctttattggacaggtgaaacaacttggggaactgttctagttatctggagcctggtcttgaccacaatggatggcgttcttcgccctttccttattcgacttggggcagatttgcccatggttttaatactcacaggtgtaatcggtggcatactttcactgggtttgattgggctatttattggccccgttgtattggctgtctcttatcgcttactgctggcatggatgaatgaagttcctaaacctgaaaataagacagaagacactgaaaaatacttccaaaaagatcatatagaataa

SEQ ID NO: 415 - DNA, 3072 bp, Xenorhabdus bovienii
  Coding sequence Name=Xb4151_4152.C409.gene33.dna; Position on contig =33010..36081bp; Strand=+
atgatcccacgtataccacaagccccccatgtcagtgaactggcacaggaatatttgactgcactgaaggaagttggttttacaggcgatactgtcagcagttatgccgatagattgactatggcgacggataacagtatttatcaattattgccacaagcagttatctttccgcgctctagtgctgatgttgctctgctggcgagagttgctggagaagaacgtttttattccctgacatttactcctcgcgggggaggaacgggtaccaacggacaatcacttaataatggtattgtggtggatatgtcccgttatatgaaccgtattcttgagatcaacccagaacaagggtgggttaaagtcgaagccggtgtcataaaagatcaactcaatcaatatctaaaacctttcggttattttttctctcccgaattatcaaccagtaaccgtgctacgttaggcggtatgattaatactgatgcttctggtcagggatcactggtttatggcaaaacttctgatcatgtacttggtgtccgcgccgttttattgggtggggaaatgtttgatacccgtcctatgagtacgttattcgcggaatcgattgctcaagaagaatctgtcattggacagatctataaaacggtgcttgaacgttgccgtgagcaacggaagttaatcgtcgaaaaattcccgaagctcaatcgttttctgaccggatatgatttgcgtcatgtttacagtgatgatatgcaaacatttgacttgacccgaattttgactggttctgaaggaacattggcttttattacggaagcaacactggatattacgccactgccaaaagtcaggcggttggtgaatgccaaatatgattcctttgattcagccctgcgcaatgctcctttcatggtggaagccaaagcgctttcggttgagactgtggattccacagtgctcaatttggcacgtgaagatattatttggcactcagtaaaggaattgattacggatgtagctgataaagatatgcaggggctgaatattgtcgaattcagtggcaatgatgaacagcaaattgaccagcaggtttatgatctttgtcagcgccttgatgaattgatggaggaaaaccagaccggcatcattggttatcaaatttgccatcatttagtggatattgagcgtatttatgccatgaggaaaaagtctgttgggttactcggtaatagcaaagggaacgccaaaccgatcccgtttgtcgaagatacctgtgtacctcctcagcatcttgccgattttatcactgaattccgtcagctcctcgatagccatcagcttaactatggtatgtttgggcatgtcgatgcgggtgtcttacatgttcggcctgcgttggatatgtgtgatccacaacaggaaatcttgatgaagcagatttccgatgaaattgttcgtctgacagccaaatatggcggcctgctatggggagaacatggcaaaggttttcgggcggaatacagtccagacttttttggcgatattttgtatgacgaattgcgtcggataaaagcggcatttgatccgctgaatcgtcttaatccgggaaagatctgctcaccgattgacactgacgccccaatgatgaaggtagatgcggccaagcgcggaacttatgaccgtactattcctgttaatgtcagaacggcatttcgtggagccatggaatgtaatggcaatggactatgcttcaatttcgatgtcaaaagcccaatgtgtccttcaatgaaggtaagtcaacatcgcattcactcacccaaaggcagggcgacgcttgtcagagaatggttgcggcttctgactgaacagggggtgaaccctaagttgttggagcaggggcttgatcaagcgcatcctagcctgcgggggttaattgacaagacgcgctatagctggcaggcctggcggggtgaatatgatttctcgcatgaagtgaaagaggctatgtcaggctgtctggcctgtaaagcctgttcgacacagtgcccaattaagattgatgtaccttcatttcgttcgagttttctgtcgctttatcacagccgttatctgcgtccgctgcgtgatcatattgttgccaatgttgaaagcagtactccgttgatggcaaaggtgcctcaagtatttaacttttttttgaaacaaccgtgggtacagaaaatcagccagcacaccattggtatggttgatctgccgctactttcctatccaacactgcaacagcagctttcaggccactatgccgcaagaacgacactggaacagctcgaaacactgtcacaatctcaacgtaagcagcatgtgcttatcgtccaagatcctttcacgagttaccacgatgcaaaagttgtcgctgattttgtgcgattgaccgaaaaactaggatatcaacctgtgctattaccgttctcacctaatggaaaagcacaacatgttaaaggattcttgactaaatttgccaagactgctgagaagacagccagttttcttaatcgaatagcttgcctgaatattcctatggtgggaattgatcctgcgctggtgctgtgttaccgagatgaatacaaagatattcttggtgagcgacggggtaactttagcgtccaattggtacatgaatggctcatggatattctgccagagacaccagcacaagagaaacgtgacgattcaacatccagctatgactggtatttactggggcattgtacagaagtgacagcgttacccaacagcggtaagcaatggacggatattttccgtcattttggctgtcaattgaataatgtcagcgtgggatgctgtggtatggccggtacatatggtcatgaaaaaaagaatattgataactcgatcggtatctataaactttcatgggctccggcgctgggcaatcttggtctggaacgttgtctcagcactggctattcatgccgtagtcaggtgaaacgcatggaaggacaaacagttaaacatccattacaagccttattggagataataccgtga

SEQ ID NO: 416 - DNA, 414 bp, Xenorhabdus bovienii
  Coding sequence Name=Xb4151_4152.C409.gene34.dna; Position on contig =36078..36491bp; Strand=+
gtgatttggaaacgtactacagatgtgaacgcgcttaatcaatttaatcgcgagtgcatgctaggacatataggaatagaaattacccagattggtgaagattttattgaaggaacaatgcctgtcgatcagcgcactaaacagccgtttggtctcttacatggtggggcatctgtggtgctggctgaatcgctcggttctcttgcagggtatctctgtttagagggtgagcagaaagttgtgggagtagagatcaatgccaaccatatcaaagcggtgagtaaaggtgctgttaaaggtgtttgtaaacctgttcatcttgggcgctctcaccaagtctggcagattgacatctataatgaacggcaacagttatgctgcacatctcgcctgacaaccgcagtcttgtcgtag

SEQ ID NO: 417 - DNA, 555 bp, Xenorhabdus bovienii
  Coding sequence Name=Xb4151_4152.C410.gene1.dna; Position on contig =95..649bp; Strand=+
atgtctactgttttacgccaatacttaaatctctatccacaggttggtcaaagagtcatgttagattcttcttctattgtgattggagatgtcagattagcgaatgatgtaagtatttggccccttgtggttatccgtggtgatgtaaattatgtttcaattggtgcacgtacaaatattcaggatggttccgttttgcatgttactcataaatcacctgataatcccgctggcttcccattgataataggagaagaggtcactgttggtcataaaacgatgctgcatggctgtaagattggaaaccgagtactggttggcataggttctattctacttgatggcgctattattgaagatgatgttgttattggggcgggaactcttgtccctccaggaaagaaattagaaagcggatatctgtatataggcagccccgccaaacaagtgagaaaactcaaacctgaagaactggaagggctactttattccgctaataactacacctactggaaagataattatttagcagacacgtcagagggcaaggagtaa

SEQ ID NO: 418 - DNA, 270 bp, Xenorhabdus bovienii
  Coding sequence Name=Xb4151_4152.C410.gene2.dna; Position on contig =616..885bp; Strand=-
atgaatcaagctattcaatttcctgatcgtgaagaatggaatgagatggaaagcaaagtgattttcccagctatggtcgatgggttattggtacaatgtatgattagttccgatgagctagctgaacgttatggtaaagatcatcacccactggacttatttcaccgacatcgctgggatctagaagagaaatttgaagccgccatcttgagtgggcatgatgatcaatttgggcgttactccttgccctctgacgtgtctgctaaataa

SEQ ID NO: 419 - DNA, 819 bp, Xenorhabdus bovienii
  Coding sequence Name=Xb4151_4152.C410.gene3.dna; Position on contig =882..1700bp; Strand=-
atggataaatttgcggtttttggtaaccctattgcacacagtaaatctccttacattcatcgattatttgctgatcagacggggattgatcatctatatgggcgggtgcttgctccgatagaacattttgaacaaactttggatcgtttttttgaacggggcggtctaggagcgaatattactgtaccttttaaagaaagggcttatcagcgctcagatgaattgactgagcgagcaagaattagtggtgcggttaacacattaaaattgattgaaggtaatcgtctccttggtgataatactgatggggtcgggttactggcagatttacagcggttaggtttcattactaagggccggcatattctgattattggggctggtggtgcagcaaaaggagtgttatctcctttattagaactaggatgtgccgtcactatcacgaaccgtacattcgcgcgtgcgcagataattgcagataaattttcccaattgggcgatattcagccaattgaaatggaatcccttctttccccagatttcgatatcatcatcaatgcgactgcttctggtattgatgggcagattcctgaggtatcaccgctgattttttgcaatgatattgcttgttacgatatgtattaccaacacggattaactccattccttgattttgcccggcaaaatggtatttcacgtttggctgatggattaggaatgttggtgtggcaagctgcgaatgcttttgaattgtggcatggagtattccctgaaatagaatcagttttaaccgctttgaggcgagagttacacgcatga

SEQ ID NO: 420 - DNA, 570 bp, Xenorhabdus bovienii
  Coding sequence Name=Xb4151_4152.C410.gene4.dna; Position on contig =1707..2276bp; Strand=-
atgagtaacaaagtctcacctgcatttgatgtgattatcactgcgttaaaagaagaaaaagtgattgcttatccgacagaggccgtttttggattgggttgtgatcctgacagcgagaaagcagtgaacgaattattatcgctgaaaaatcgaccgtgggaaaaagggctaattctcattgctgatagctatgaaaggttatgcctttatattgatgatgagcaacttaatgatatacagaaagaaacagtattttcattttggcctggtcccgtgacatgggtaataccagcgaaaacgacgacaccaaaatggttaacagggcaattttcaacactggcggttcgggtcacagatcatcctctggttaaacaattatgctctttttatgggaaagcccttgtatcgacaagtgcaaatttaagcggactagagccatgtcggagtgcggaagaagttcgtcaacaatttggaaaccgagttcctgttttggaaggagaagtagggggacgtaaaaatccatcagaaatcagagatgccttaaccggcaaattatatcgacaagggtag

SEQ ID NO: 421 - DNA, 1077 bp, Xenorhabdus bovienii
  Coding sequence Name=Xb4151_4152.C410.gene5.dna; Position on contig =2887..3963bp; Strand=-
atgaaagagatggaaatatggttgcgaatgaagatggtttcccatctttcaacgattaaagctgtgtctattatagaacatctattgagaactcaaaactatagtaataatgaacttaaggcgtgtggtttgtctcccacacagtgtttacagtttactaaggctaactctactgagctggctatttgctttacgtggttggagcggccgggcaaccatttgttgaccttctctcatcccgcatacccacctttattaaaacagatacactctcctccacttatgctttttgtgtcaggggatgtaactgtgttatcccaaaagcaggtggcaatggtgggtagtaggtcagcaagtttttatggtgagaaatgggggaaaatctttgctggtgaattagcgaaaaatggagttgtgataaccagtgggttggcaatcggtattgatgggatttgccatcaggcagcgcttagtgctggcggaaaaaccattgctgtacttggcagtgggcttgaaaaaatttatccctatcggcatgactctctggcgcggtttattgaagaaaatggtgcattagtttctgagtttttccctgaaatgccacctaaagctaaaaattttccaaggcgcaatcggatcattagtggcttgagtctcgctcttcttattgtagaagcttatgaaaagagtggttcgttgattacagcgcgttgtgcgcttgaacaggggcgagatatttttgcattacctggtgcattaggcactccttcaagtgagggcaatcattggttgataaagcagggggcttatttggcagtgaatccaacggatataatggaacatattaatggcgcgtttcgatggttgaatatagaaaaagaagaacgcgtgcaagttgaccaaatagagttgccatttgctgatgtgctggttaacgtaagtcacgaagttactccagttgatgtgattgctcaacgctcttgtcttcctgtcacagaagtcatgactagacttttggagctggaactcatgggaaaagtcgccgttgttgctggtggctatattcgggtaaattga

SEQ ID NO: 422 - DNA, 513 bp, Xenorhabdus bovienii
  Coding sequence Name=Xb4151_4152.C410.gene6.dna; Position on contig =4096..4608bp; Strand=+
atgtcagttttacaagtattacattacccagacgagcgacttcgcacaattgcaaagccagttgaaaaagtcgatgcaggaattcagagcatcattgatgatatgttcgaaacaatgtatgcagaagaaggtatcggtttagctgcaacacaagtcgatattcatcagcgaattatagtcattgatgtctctgagaatcgtgatcaacgccttgtcctcatcaaccccgaattgatgaatgaagttggtgcaacaggaattgaggaaggatgtttatctgtccctgaacaacgcgcatttgtaccacgttttgagcaagtaaaaattaaagctttagattatcacgggcagcagtttgagttggaagctgacgacctgctagcaatctgtattcaacatgaaatggatcatctggtaggtaaactttttatcgattatctgtcaccattgaaacgccagcgtattcgccagaaagttgaaaaaattgaccgtctgagagctaaagaaaaataa

SEQ ID NO: 423 - DNA, 948 bp, Xenorhabdus bovienii
  Coding sequence Name=Xb4151_4152.C410.gene7.dna; Position on contig =4633..5580bp; Strand=+
gtgtctgattctttacgtattatttttgccggaaatcctgatttcgcggttcaccatttggctgctttattaaaatctcaacatcaagttgtcggagttctcacccgaccagacaaaccggcaggaagaggtaaaaaactgacaccaagtcctgtaaaagcattggctgaagaacatagtatttctgttttccagccaaaaaccttacgcacagaagaaagccagcaatggatcatgcatcagcaggcagatattatgatcgttgttgcgtatggcctgattctgcctcaagccgttctggacataccacgcttaggatgcctgaatgtccatggttctttgttaccacgctggcgtggcgccgctccgattcagcgtgcaatctgggcgggagatcaagaaactggcataacaattatgcaaatggatgctggtcttgataccggtaatatgctactaaaagcagcttgcccaattacaaatcaagataccagctccagcctgtatgaaaaacttgccaatattggtcctgatgcattacttaacacattagatctgataatattaggaaattgccaaccaagcattcaggatggtactttagcaacttacgctgaaaaactcagtaaagatgaagccaaaatggactggcatttacctgccattcagcttgaacgttgtgtccgctcatttaacccatggccgatgagcttctttctcattgatgaataccccattaaggtatggcacgctgaagccattgctgaacaaactactcactcccctggaaccatcattaaggcagataagaaaggtattcaaattgcaacctctgatggaatattaaatatcacacaattgcaagcatcaggtaagaaagcaatgccagccgccgatttcttaaactcaaaacgtgattggtttacaccgggtaacaaaatcaaatga

SEQ ID NO: 424 - DNA, 1287 bp, Xenorhabdus bovienii
  Coding sequence Name=Xb4151_4152.C410.gene8.dna; Position on contig =5664..6950bp; Strand=+
atgaaaaatacatataacctgcgaaacatcgccgcaaaagcgatccatcaagtactggaacaagggcagtcactcagcactgttattcctgaactccaacaaagagtttctgacaaagataaagctcttctccaagaactctgttttggcgtaataagggtattacctcaactagaatggttcattggtcagttgatggcaaagccattgaaaggcaaacaacgcatttttcactatctaatcatggttggaatctatcagctcacttatactcgtatacctgcacatgcagcgcttgccgaaaccgtcaatggcgcgatcagtttaaaacgtccgcaattaaaaggcttaattaatggcgttctccgccaatttcagcgccaacaacagacattagtcgagcaagttaataatgtcagctgccatttacatcccaaatggctgttagatcatattcaaaaagcctatccacaggactggcaaaagattattgacgcaaataatcaaaaacctcccatgtggttacgagttaatcagcgctatcatagtgctaatcaatatctagctctgttgcaagaagctaatatagacgcagagctagatgaaaatcatcccagcgctattcgcttgctaaatccttgccctgttaacactctacccggattcgatcaaggatgggtgactattcaagatcgctctgctcaagggtgtgctgaattattaacgccatgtgacggagaatctatactggatctgtgtgctgcccctggaggaaaaaccacccatatccttgagatagcgccaaagtcaaaagtacttgccgtcgatattgatgaacagagaattaaacgagtgaaagaaaatttacagcgccttaatttgcatgctgtcgtcaaaacaggtgatggacgttttccacatgaatgggcaacaggggaacagttcgatcgcattcttcttgatgcaccatgctcagcaacaggtgttattcgtcgtcaccctgacataaaatggctgcgtcgaaatgaagatattgaccaattggttacgctacaaactgaaatccttgatgccatttggccatatttaaagaaacatggcactctggtttatgcaacctgctccattttacctcatgaaaatagccaacaaataaaagcattcttaggacgccacacagatgctgcattatcagatacaggcacgcttgacaaaccagggatacaaattattcctgaaacaacaggtggtgacggcttcttttatgcccgactaactaagtattga

SEQ ID NO: 425 - DNA, 1377 bp, Xenorhabdus bovienii
  Coding sequence Name=Xb4151_4152.C410.gene9.dna; Position on contig =7049..8425bp; Strand=+
atgaaaataattattctgggtgctggtcaggttggtggaacattagctgaaaatttggttgatgaaaataatgatattactgtcgttgataccgatactgatcgcttacgccagttacaggacaaattcgatctacgggttgtaaatggtcacggctcccaccccagagtattgagggaagcaggtgcagaagatgccgatatgttggtagccgtcacaaattcagatgaaaccaacatgattgcgtgccagatcgcttactccttatttaatacccccaataaagtcgctcggatacgttcatcagaatatatctatgaatcagagaaattatttcaacccaatgatatccctattgattatctgatatctcctgagcaattggttattgattacatctataaattaattcaataccccggagcattacaagttgtcaattttgcggaaggccgtgtcagtatcgtcgcggtcaaagcctactatgggggttcactagtgggtaatgcattatcctcgcttcgagagcatatgccacatatcgatagcaaagttgctgcaatatttcgtcaagaccgcccgatcaggccacaaggctccacaattattgaagcgggagatgaagtattttttgttgccgcatcacaacatatcagagcggtgatgagtgaattacaacgccttgaaaaaccatataaacgtctcatgattgttggaggtgggaacgtcggtgcaggtttagcgctgcgacttgagaaagattacagcgtcaagctgattgaacataatcaagaaagagctacaaagctagcagagctcttgcacgatactatcgttttctacggtgatgcctctgatcaagagcttctgtcagaagaacatattgaacaagtcgatgttttcattgcattaactaacgatgacgaagccaacattatgtcagccatgcttgcaaaacgaatgggagccaaaaaagcgatggttcttattcaacgcagtgcatatgttgatttagtacaaggtggtgttattgatatcgccatctcacctcagcaagctaccatttctgcattacttggccatgtccgtaaagcagatatcgtcagtgtatcttcattaagaaggggagtagccgaagctattgaagccatagcacatggtgacgagcatacttccaaagtagttggacgcaagattggtgatattagactaccaccaggcacgataattggcgcaattgtccgcggtgaagaagtaatcattgccaatgattacagcatcatccaacaaggcgaccatgtaatcatgtttattaccgataaaaaatttgttcctgaagtggaaaaactattccagccgagcccttttttcctgtaa

SEQ ID NO: 426 - DNA, 201 bp, Xenorhabdus bovienii
  Coding sequence Name=Xb4151_4152.C410.gene10.dna; Position on contig =8472..8672bp; Strand=-
atgacgacataccgccataaaaaaggcgtcatcaaagataatgctatagaggcactgttgcacgaccctttatttaggcagagagtagaagcaaacaaaaagggtaaaggaagttatagtcgtaaagaaaaacatggcaaaagtagtggttgggaggccaatgatgataattttttcaagttgttatcattggccttctaa

SEQ ID NO: 427 - DNA, 414 bp, Xenorhabdus bovienii
  Coding sequence Name=Xb4151_4152.C410.gene11.dna; Position on contig =8748..9161bp; Strand=-
atgtatcgcattggtcagttggctaaattagcgagtgtcacgcctgatactattcgtttttatgaaaaacaaggtttgatggctcatgaggaaagaacagaaggcggttatagactttataccgaacaggatttacaacgattacgttttattcgttatgcaaaacaatcgggttttacactggaagcgattgtagagttactgtctattcgtgttgatcctgagcatcatacatgtcaagaatcgaaacaaattgttgattctagattacaggaggtcgaagataaattattggaaatgcaaaaaatgcgcaattctttaaaaatgttgagtgatgcatgttgtggtagtgcgcataccagcacatattgttccatattggaaattttggaagaaggagcaactaataaataa

SEQ ID NO: 428 - DNA, 393 bp, Xenorhabdus bovienii
  Coding sequence Name=Xb4151_4152.C410.gene12.dna; Position on contig =9340..9732bp; Strand=-
atgcgccatcgtaagagtggtcgtcaattgaaccgcaacagcagccatcgccaagctatgttccgcaacatggcaggttctttggttcgtcatgagatcatcaagacgactctgcctaaagcgaaagaactgcgtcgcgtcgttgagccgctgattactcttgccaagaccgacagcgtagctaatcgtcgtctggcattcgcccgtactcgtgataacgaaatcgtggcaaaactgtttaatgaactgggtccgcgttttgcgagccgtgcaggtggttacactcgtatcctgaagtgtggcttccgtgctggtgacaatgctccgatggcatacatcgagcttgttgaccgcaccgttgagtctcagacagaagcagcatctgcagagtaa

SEQ ID NO: 429 - DNA, 990 bp, Xenorhabdus bovienii
  Coding sequence Name=Xb4151_4152.C410.gene13.dna; Position on contig =9773..10762bp; Strand=-
atgcagggttctgtgacagagtttctaaaaccgcgcctggtagatatcgagcaagtcagttcgacgcacgccaaggtgacccttgagccattagagcgtggctttggccatactcttggcaacgcactgcgccgtattctgctttcgtctatgccgggttgtgcggtgactgaggttgagattgatggtgtactgcatgagtacagcaccaaagaaggcgtacaggaagatatcctggagattctcctcaatctgaaagggctagcggtgaaagttcagggtaaagatgaagttatccttaccttgaataaatctggcattggccctgtgactgcagccgacatcatccatgatggtgatgttgaaatcgtcaagccgcagcacgtaatctgccatctgactgacggaagtgcttccattagcatgcgtattaaagttcagcgcggtcgtggttatgtgccggcttctgcccgaattcattcggaagaagatgagcgccctatcggtcgtttgttagtagatgcttgctatagcccagtagagcgtattgcctacaatgttgaagcagctcgtgtagaacagcgtactgacttggataagctggttatcgaaatggagactaacggcacaatcgatcctgaagaggcgattcgccgtgcagctaccattctggccgaacaactggaagcttttgttgatttacgtgatgtacgtcaaccagaagttaaagaagagaagccagagtttgatccgatcctgctgcgccctgttgacgatctggaattgactgtccgctctgctaactgccttaaggcagaagctatccactacatcggtgatctggtacagcgtaccgaggttgagttacttaagacacctaatctgggtaaaaaatctcttactgagattaaagacgtactggcttcgcgtggactttctctgggcatgcgtctggaaaactggccaccagcaagtattgctgatgaataa

SEQ ID NO: 430 - DNA, 621 bp, Xenorhabdus bovienii
  Coding sequence Name=Xb4151_4152.C410.gene14.dna; Position on contig =10788..11408bp; Strand=-
atggcaagatatttgggtcctaagctcaagctgagccgtcgcgagggtacagaccttttcctgaagtctggcgttcgcgcgattgacaccaagtgtaaattagaacaggcaccaggccagcacggcgcacgtaaaccgcgtctgtctgactatggtgtgcagttacgtgaaaaacaaaaagttcgtcgtacttacggcgttctggaacgtcaattccgtaactactataaagaagcgactcgtctgaaaggcaacacaggtgaaaacctgttgactctgctggaaggtcgcttagataacgtcgtttatcgtatgggcttcggcgcgactcgtgctgaatcacgtcagatggtgagccataaggctatcatggtaaatggttgcgttgtcaatatcgcttcttatcaggtatccccgaatgacgtagtcagcgttcgtgaaaaagcgaagaagcaggctcgtattaaggcagctttagagctggctgagcagcgtgagaaaccaacttggttggaagttgatgctgcgaagatggaaggtgtgttcaaacgtattcctgaacgtactgatctatccgctgacattaacgaacacctgatcgtcgagctttactctaagtaa

SEQ ID NO: 431 - DNA, 390 bp, Xenorhabdus bovienii
  Coding sequence Name=Xb4151_4152.C410.gene15.dna; Position on contig =11453..11842bp; Strand=-
atggcaaaagcacctattcgtgcacgtaagcgtgtaagaaaacaagtctctgacggtgtggctcatatccatgcttctttcaacaacacaatcgttactattactgatcgtcagggtaatgctttgggttgggcaactgcaggtggttccggtttccgtggttctcgtaaatctactccgtttgcggctcaggttgcagcagagcgctgtgctgaagcagtaaaagaatacggaattaagaacctggaagttatggttaaaggacctggtcctggccgtgagtcaactattcgcgcattaaacgcggctggtttccgcatcactaatattactgatgtgactccgattcctcataacggttgtcgcccaccgaaaaaacgtcgcgtttaa

SEQ ID NO: 432 - DNA, 357 bp, Xenorhabdus bovienii
  Coding sequence Name=Xb4151_4152.C410.gene16.dna; Position on contig =11858..12214bp; Strand=-
gtggcccgtatagcaggcattaacattcctgatcagaaacataccgtaatcgcgttaacctcgatttacggcatcggtaaaacccgctcacagcaaatctgtgaagcagcgtgtattgctgaaaatgttaagatcagtgagctgtctgaagagcaaattgacaagctgcgtgacgaagttgccaaatacgttgtagaaggtgatctgcgtcgtgaagtgaccctgagtatcaaacgtctgatggaccttggttgctatcgtggtttgcgtcatcgtcgtggtctgccagttcgcggtcagcgtactaagaccaatgcacgtacccgtaagggtccgcgtaagccgatcaagaaataa

SEQ ID NO: 433 - DNA, 1332 bp, Xenorhabdus bovienii
  Coding sequence Name=Xb4151_4152.C410.gene17.dna; Position on contig =12513..13844bp; Strand=-
atggctaaacaaccaggattagattttcaaagtgctaaaggcggattaagcgagttaaaacgcagacttttgtttgttattggagctctgattgttttccgtattggctcttttattccaatccctggtattgatgccactgtgcttgccaaattgctcgaacagcaacgaggcaccatcattgaaatgtttaacatgttctctggtggtgctttaagccgtgcttctatcttcgcactgggtataatgccgtatatttctgcatctatcattatccagttgctaactgtggttaatccccgtttagcagagattaagaaggaaggggaagctggtcgtcgtaagatcagtcaatacacccgttatggtacgttagtgctggcaatattccagtcaatcggtattgctactgggttgccgaatatgcctggaatgcaaggtttagttattaaccctggctttgcgttctatttcacggctgttgtaagtttggtcacgggaaccatgttcctgatgtggctgggtgagcagattactgaacgaggtatcggtaacggtatttcaatcataatctttgctggtatcgttgcgggtttaccgcctgcaattggtcacaccatcgagcaagctcggcaaggcgatctgcacttcctcctgttgctgttggttgcagtattagtgtttgccgtaactttcttcgttgttttcatggagcgtggtcaacgccgtatcgttgttaactatgctaagcgtcaacaaggtcgaagagtttatgcggcacaaagtacacatttaccgttgaaagtgaatatggctggggttatccctgcaatttttgcttctagtattattttgttccctggtaccatagcctcttggtttggtggtggaacaggctggaattggctgacaactatttctatgtatttgcagccaggtcaaccgctttatgtgttattgtacgcatctgcaatcatcttcttctgtttcttctacacggctttggtgtttaatccaagagaaacagcagataacctgaagaagtccggtgcatttgtaccaggaattcgtccgggagagcaaacggctaagtatatcgataaggtaatgactcgcctgaccttagttggtgcgttatacattacctttatctgcttaatcccggagttcatgcgtgacgcaatgaaagttccattttattttggtggtacttccttactgattgtagttgtcgtcatcatggactttatggctcaagtgcaaactctgatgatgtcgagtcaatatgagtctgcattgaagaaggcaaacctaaaagggtataaccgttaa

SEQ ID NO: 434 - DNA, 435 bp, Xenorhabdus bovienii
  Coding sequence Name=Xb4151_4152.C410.gene18.dna; Position on contig =13852..14286bp; Strand=-
atgcgcttaaatactctgtctccggctgaaggtgctaagcacgcatctaaacgtgtaggtcgtggtatcggttctggcctaggtaaaaccggcggtcgtggacacaaaggtcagaaatctcgttctggcggtggtgttcgtcgtggttttgaaggcggccaaatgcctttataccgtcgcctgccaaaatttggttttacttcacgtaaggcaatgatcactgcagaaattcgtctgtctgattttgcccatgttgaaggcgatgttatcgatctgaatgcactgaaagctgctaacattgttggccctcaaattgaattcgcaaaagttatgctttctggcgaagtcaatcgcgcagtaactgtgcgtggcttacgtgttacgaaaggcgcccgtgctgcaattgaagctgctggcggtaaaattgaggaataa

SEQ ID NO: 435 - DNA, 180 bp, Xenorhabdus bovienii
  Coding sequence Name=Xb4151_4152.C410.gene19.dna; Position on contig =14290..14469bp; Strand=-
atggctaagactattaaaattactcaggttcgcagctcaattggtcgtttgcctaagcataaggcaactctgactggtttaggtctgcgtcgcattggtcatactgttgaacgcgaagatacaccagcggttcgtggtatggtcaacttggtttcctatatggttaaagttgaggagtaa

SEQ ID NO: 436 - DNA, 501 bp, Xenorhabdus bovienii
  Coding sequence Name=Xb4151_4152.C410.gene20.dna; Position on contig =14475..14975bp; Strand=-
atggctcacatcgaaaaacaagctggcgaactgcaggaaaagctgatcgcggtaaaccgcgtatctaaaaccgtcaaaggtggccgtattttcagctttacagcactgactgtagttggtgatggtaacggtcgcgttggttttggctacggcaaagcacgcgaagttccggcagcgatccagaaagcgatggaaaaagcacgtcgcaatatgaaaaacgtcgcacttaacagcggcaccctgcaccacccagtgaaaggtggacacaccggttctcgcgtgttcatgcagcctgctcacgaaggtacaggtatcatcgccggtggcgcgatgcgtgctgttctggaagtggctggagttcgtaacgtactggctaaaacctacggttccactaacccgatcaacgtggttcgtgcaactctggacgctttagacagcatgaagtctccagaaatggtcgcagctaagcgtggcaaatccgtcgaagaaattcaggggtaa

SEQ ID NO: 437 - DNA, 354 bp, Xenorhabdus bovienii
  Coding sequence Name=Xb4151_4152.C410.gene21.dna; Position on contig =14990..15343bp; Strand=-
atggataagaaagcagctcgtatccgtcgtgcgacccgcgcacgccgcaagctccaggaactgggtgcaactcgcctggtggtacaccgtacccctcgccatatttatgcgcaggttatcgcaccaaatggttctgaaactctggtggccgcttctactacagaaaaagctattagtgaacaactgaaatttactggaaacaaagaagccgcagcagtagttggtaaaattgttgctgaacgtgctctggaaaaaggtatcaaaaatgtatcctttgaccgttctggtttccaatatcatggtagagtccaggcactggcagatgctgcccgtgaagctggccttcagttctaa

SEQ ID NO: 438 - DNA, 534 bp, Xenorhabdus bovienii
  Coding sequence Name=Xb4151_4152.C410.gene22.dna; Position on contig =15353..15886bp; Strand=-
atgtctcgtgttgcaaaagcacccgtcgtcattcctgccggcgtagaggttaaactcaacggtcaggttatttcgattaagggtaaaaacggcgaactaagtcgtaaaatccacaatgcagttgaagttaaacatgcggatggccaactgactttcgctccacgcgaaggttttgctgatgcttgggcacaggcaggtacaactcgttctctgctgaatgcaatggttatcggtgttaacgaaggcttcaccaagaagcttcagctggtgggtgtaggttaccgtgcggcagttaaaggcaacgctgttagtttgtctttaggcttctcgcatccggttgagcatcaactgccagcaggcataactgcggaatgcccgtcacaaactgaaatcgtactgaaaggtgctgataagcaggtgattggtcaggttgcggcagatctgcgtgcctatcgtcgtcctgagccatataaaggcaagggtgttcgttacgccgatgaagtcgtgcgtaccaaagaggctaagaagaagtaa

SEQ ID NO: 439 - DNA, 393 bp, Xenorhabdus bovienii
  Coding sequence Name=Xb4151_4152.C410.gene23.dna; Position on contig =15901..16293bp; Strand=-
atgagcatgcaagatccgatcgcggatatgctgacccgtatccgtaacggtcaggccgcgaataaagttgcggtcaccatgccttcctccaagctgaaagtggcaattgccaacgtgctgaaggaagaaggttacattgaagattttaaaatcgaaggcgacactaagccagaactggaagtcactctgaaatacttccaaggtaaggctgttgtagaaagcattcagcgtgtaagccgcccaagtctgcgcatctataagaaaaaagatgagctgccaaaagttatggctggtttgggtatcgctgttatttctacctctaaaggtgtaatgactgatcgtgcagctcgccaagctggtctgggtggcgagattctctgctacgtagcttaa

SEQ ID NO: 440 - DNA, 306 bp, Xenorhabdus bovienii
  Coding sequence Name=Xb4151_4152.C410.gene24.dna; Position on contig =16327..16632bp; Strand=-
atggctaagcaatcaatgaaagcgcgtgatgtaaaacgtgcgaaattagctgagaaattcttcgcaaaacgcgttgaactgaaagcgatcatctctgatgtaaacgcatctgacgaagaccgttggaatgctgttctcaagctgcaaacactgccacgtgattccagcccttgtcgtcagcgtaaccgctgccgtcagactgggcgtccgcatgcatttttgcggaagtttgggttgagccgtattaaagtccgtgaagccgctatgcgcggtgaaatcccgggccttaaaaaggctagctggtaa

SEQ ID NO: 441 - DNA, 540 bp, Xenorhabdus bovienii
  Coding sequence Name=Xb4151_4152.C410.gene25.dna; Position on contig =16645..17184bp; Strand=-
atggcgaaactgcatgattactacaaagacgaggtagtccagaaactgatgagtcagttcggttaccattctgtcatgcaagtccctcgggtcgagaagatcaccctgaacatgggtgttggtgaagctatcgctgacaaaaaactgctggacaatgcagcagctgacttgacagcaatctctggtcagaaaccattgatcaccaaagcacgcaaatcagttgcaggcttcaaaatccgtcagggctatccaatcggctgtaaagtaaccctgcgtggcgaacgtatgtgggagttctttgagcgcctgatttctattgctgtaccacgtattcgtgacttccgtggtttatccgctaaatcatttgatggtcgtggtaactacagcatgggtgtgcgtgagcaaatcatcttccctgaaatcgattatgataaagtggatcgtgtacgtggtttagatattactatcaccactactgcgaaatctgatgatgaaggccgggcactgttggctgcgtttaacttcccgttccgcaagtaa

SEQ ID NO: 442 - DNA, 315 bp, Xenorhabdus bovienii
  Coding sequence Name=Xb4151_4152.C410.gene26.dna; Position on contig =17198..17512bp; Strand=-
atggcagcgaaaatccgtcgtgatgacgaaattatcgtgctgactggcaaagataaaggtaagcgcggtaaagtaaaacaggttctttcttctggtaaaattatcgttgaaggtatcaatctggttaagaaacatcagaagccggttccggcactgaatcaaccaggtggcatcgttgaaaaagaagcagctattaatgtttctaacgttgcaatctttaatgcagcaaccagcaaggctgaccgtgtaggttttaggtttgaagacggcaaaaaagttcgtttcttcaaatctaataacgaaactatcaagtaa

SEQ ID NO: 443 - DNA, 372 bp, Xenorhabdus bovienii
  Coding sequence Name=Xb4151_4152.C410.gene27.dna; Position on contig =17524..17895bp; Strand=-
atgatccaagaacagactatgctgaacgtggccgacaactccggtgcacgtcgcgtaatgtgtatcaaggttctaggtggctcgcaccgtcgctacgcaaacgtcggtgatgttatcaagattaccatcaaggaagcaattcctcgtggtaaagtcaaaaaaggtgatgtcctgaaagcggtagtggtgcgcaccaagaagggtgttcgtcgcccggacggttctgtcattcgctttgatagcaatgcttgtgtattgttgaacaacaatagtgagcaagttatcggtacgcgtatttttgggccggtaactcgtgaacttcgtaatgaaaagttcatgaaaattatctccctggcacctgaagtactgtaa

SEQ ID NO: 444 - DNA, 255 bp, Xenorhabdus bovienii
  Coding sequence Name=Xb4151_4152.C410.gene28.dna; Position on contig =18072..18326bp; Strand=-
atgaccgataaaatccgtactctgcaaggtcgtgttattagcgataaaatggaaaagtccattgttgttgctattgaacgtgtggtgaaacaccctctgtatggtaaattcatcaaacgtacgactaaactgcacgtacatgacgagagcaatgaatgtggaattggcgatgtggtggaaatccgcgaaacccgtccactgtctaagactaaatcttggactttagttcgcgtcgttgagaaagcggttttataa

SEQ ID NO: 445 - DNA, 192 bp, Xenorhabdus bovienii
  Coding sequence Name=Xb4151_4152.C410.gene29.dna; Position on contig =18326..18517bp; Strand=-
atgaaagcacaagagctgcgcgataaaagcgttgaagagctgaacactgagctgctgaacctgttacgtgagcaatttaatctccgtatgcaggcggcaagtggccagctgcaacagtctcacctgttgaaacaagtgcgtcgtaatattgcacgcgttaagactttactgactgagaaggcgggtgcgtaa

SEQ ID NO: 446 - DNA, 411 bp, Xenorhabdus bovienii
  Coding sequence Name=Xb4151_4152.C410.gene30.dna; Position on contig =18517..18927bp; Strand=-
atgttacaaccaaagcgtacgaaattccgtaaggtgcataaaggccgcaaccgtggtctggctgcaggtgcggatgttagcttcggcactttcggtctgaaagctgtgggtcgtggtcgtctgactgctcgtcagattgaagcggcacgtcgtgctatgacccgtgcaattaagcgtcaaggtaaaatctggatccgtgtattcccagacaaacctatcaccgaaaagccactcgaagtgcgtatgggtaaaggtaaaggtaacgtagagtattgggttgccttgatccagcccggtaaagtcctgtatgaaatggacggtgtgcctgaagagctggctcgtgaagcattcaagctggcagcagcgaaactgcctatcaaaaccacctttgtaactaagacggtgatgtaa

SEQ ID NO: 447 - DNA, 702 bp, Xenorhabdus bovienii
  Coding sequence Name=Xb4151_4152.C410.gene31.dna; Position on contig =18940..19641bp; Strand=-
atgggtcagaaagtacatcctaatggtattcgtctggggattgtcaaaccttggaactctacctggtatgcgaataccaaagaattcgctgacaacctggacagcgattttaaagtgcgccagtacttgaacaaagaactggttaaggcatctatttcacgtatcgttatcgaacgtcctgcaaaaagcatccgtgtgacaattcacactgcccgcccaggtatcgttatcggtaagaaaggtgaagacgttgaaaaactgcgtaagactgtagcggagatcgctggtgttcctgcgcagattaatattgccgaagtgcgcaagcctgaattggacgcaaaattagttgcggacagcattagttcacaattggaacgtcgtgtaatgttccgtcgtgcgatgaaacgtgctgtacaaaatgctatgcgtctgggcgctaaaggcatcaaagtggaagtcagtggtcgtttaggcggtgctgagattgcgcgtactgaatggtaccgtgaaggtcgtgtacctctgcacactctgcgtgcagacatcgattataacacttcagaagcgcacaccacttatggtgtaatcggcgttaaggtatggatcttcaaaggtgagatcctgggtggtatggctgcagttgaacaggcggaaaaaccggctgctcaacctaaaaagcagcagcgtaaaggccgcaagtaa

SEQ ID NO: 448 - DNA, 333 bp, Xenorhabdus bovienii
  Coding sequence Name=Xb4151_4152.C410.gene32.dna; Position on contig =19659..19991bp; Strand=-
atggaaactatcgctaaacatcgccacgctcgttcttctgctcagaaggttcgcctcgtggctgacctgatccgcggtaagaaagtgtcgcaagctctggaaactctgctctataccaacaagaaagctgctggtttagtgaagaaagtacttgagtctgctattgctaacgcagaacacaacgatggcgctgacatcgatgatctgaaagtcacgaaaattttcgtagacgaaggcccaaccatgaagcgtattatgcctcgtgccaaaggccgtgcagatcgtatcctaaagcgcaccagccacattactgtggttgtgtccgatcgctga

SEQ ID NO: 449 - DNA, 279 bp, Xenorhabdus bovienii
  Coding sequence Name=Xb4151_4152.C410.gene33.dna; Position on contig =20006..20284bp; Strand=-
atgccacgttctctcaagaaaggtccatttattgacctgcacttgctgaagaaggtagagaaagcggtggaaagcggagacaaaaagcctattaagacttggtcccgtcgttcaacgatctttcctaacatgatcggtttgaccatcgctgtccataatggtcgtcagcacgttccagtttttgtttccgacgaaatggttggtcacaaactgggtgaattcgcgccgacccgtacttatcgcggccatgcggccgataaaaaggctaaaaagcgctaa

SEQ ID NO: 450 - DNA, 822 bp, Xenorhabdus bovienii
  Coding sequence Name=Xb4151_4152.C410.gene34.dna; Position on contig =20302..21123bp; Strand=-
atggcaattgttaaatgtaaacctacgtctccgggccgtcgccacgttgttaaagtggttaaccctgagctgcataagggcaaaccttatgctccgttgttggaaaaaaacaacaaaactggtggtcgtaacaacaatggtcgtattaccactcgtcacattggtggtggccataaacagcattatcgtctggttgactttaaacgcaacaaagatggtatccctgctgttgttgaacgtctggaatatgatccaaaccgttcagcgaacatcgcactagttctgtatagagacggtgagcgtcgttacatccttgcacctaagggtctgaaagcaggtgatcaaatccagtctggtgctgattcagcaatcaaggccggtaatgctctgccaatgcgcaatatcccggttggttctactgttcacaacatagaaatgaaaccaggtaaaggtggtcagctggctcgttcagcaggtacttacgctcagatcgttgcacgtgacggttcctatgtaaccttgcgtctgcgttctggtgaaatgcgtaaagtgctgtctgactgtcgcgctactttaggtgaagttggtaacgcagagcacatgttacgcgttctgggtaaagctggtgcaagccgctggcgtggtatccgtcctaccgttcgtggtacggcgatgaacccagtagaccatccacatggtggtggtgaaggtcgtaactttggtaaacaccctgtaactccatggggcatccagaccaaaggtaagaagacccgtagtaacaaacgtactgatcaatacatcgtacgccgccgttctaaataa

SEQ ID NO: 451 - DNA, 303 bp, Xenorhabdus bovienii
  Coding sequence Name=Xb4151_4152.C410.gene35.dna; Position on contig =21143..21445bp; Strand=-
atgatccgtgaagaacgtctgctgaaaatactgtgcgcgccgcacgtatctgaaaaagcttctacagcgatggaaaaaagcaacaccatcgttctcaaagttgcgaaagacgcgactaaagcagagatcaaagctgccgtacagaaactcttcgaagttgaagttgaaggtgtaaacactttgctagttaaaggtaaagttaaacgccacggtcagcgtattggtcgtcgtagcgactggaaaaaagcttacgtcaccctgaaagaaggccagaacttggacttcggcggcggcgctgagtaa

SEQ ID NO: 452 - DNA, 606 bp, Xenorhabdus bovienii
  Coding sequence Name=Xb4151_4152.C410.gene36.dna; Position on contig =21442..22047bp; Strand=-
atggaattggtaatgaaagacgcgcaaagcgcgctgactgtttccgaaactaccttcgggcgtgacttcaatgaagcgcttgtgcatcaagtagttgttgcgtacgcagctggtgctcgtcaaggtactcgtgctcagaaaactcgtgctgaagtttctggttcaggtaaaaaaccatggcgtcagaaaggtactggtcgtgcacgtgcaggttctattaagagtccaatctggcgctctggtggtgtaacttttgcagcgaagccacaggaccacagtcaaaaagttaataaaaagatgtaccgcggtgctctaaaaagcatcttatctgaactggtacgtcaagaacgtctgatcgttgtcgagaagttctctgttgaagcacctaaaactaagctgctggtacagaaactgaaagaaatggctctgcaagacgtgctgattgtcactggcgaagttgatgagaacctgttcttagcagctcgtaacctgtataaggttgacgttcgtgatgcagcaggtatcgacccagtaagcctgatcgccttcgacaaagtggttatgactgctgatgctgtaaagcaggttgaggagatgctggcatga

SEQ ID NO: 453 - DNA, 150 bp, Xenorhabdus bovienii
  Coding sequence Name=Xb4151_4152.C410.gene37.dna; Position on contig =22064..22213bp; Strand=-
atggcaggccaaatgggtaatgaacgtgtaactgttcagagcctagatgtagtacgtgttgacgctgagcgtaacctgctgctggtcaaaggtgctgttccaggtgcaactggcagtgacctgatcgtaaaaccggctgttaaggcgtaa

SEQ ID NO: 454 - DNA, 372 bp, Xenorhabdus bovienii
  Coding sequence Name=Xb4151_4152.C410.gene38.dna; Position on contig =22326..22697bp; Strand=-
atgattggtttagtcggtaaaaaagtgggcatgactcgcatcttcactgaagatggcgtttctatccctgtaagtgttatcgaaatcgaagagaaccgcataactcaggttaaagaccaagagagtgacggttatcgcgcaattcaggtaacgactggtagcaaaaaagctaaccgcgttaataaacctgaagcaggtcatttcgctaaagctggcgttgaagctggccgtactctgcgtgagttccgtctgtcattagacgacgaagagtacacagtgggtcaaagcattagcgttgaaattttcgctaacgttaaaaaagtcgacgttactggtacatctaaaggtaaaggtttcgcgggtacctgttaa

SEQ ID NO: 455 - DNA, 312 bp, Xenorhabdus bovienii
  Coding sequence Name=Xb4151_4152.C410.gene39.dna; Position on contig =22730..23041bp; Strand=-
atgcagaaccaaagaatccgtatccgcctgaaagcatttgatcaccgtttaatcgatcaatcaactgcggaaatcgtagagaccgctaagcgcactggtgcgcaagttcgcggtccgatcccgctgccgactcgtaaggagcgttttaccgttctgatttctccgcatgttaacaaagatgcgcgtgatcagtacgagattcgcactcacaaacgtctggttgacatcgttgagccaaccgagaaaaccgttgatgctctgatgcgtctggatctggctgctggtgtagacgtgcagatcagcctgggttaa

SEQ ID NO: 456 - DNA, 474 bp, Xenorhabdus bovienii
  Coding sequence Name=Xb4151_4152.C410.gene40.dna; Position on contig =23336..23809bp; Strand=-
atgaaaggtgataaaaagataattgcacatcttaataaacttcttggcaatgaacttgttgccatcaaccagtattttttacatgcccgaatgtttaaaaactgggggttaatgcgtctaaatgaagttgaatatcgtgaatctattgaggagatgaaacacgctgataagtatattgagcgtatcttgtttctggaaggtttgccaaatctacaggatttgggcaaactcaatatcggtgaggatatagaagaaatgctgcaatccgatctagcactagagatacgcggtgccaaggatctgagagaggcaattgcatatgccgattcagcttatgattatgtaagcagagacttgatgattgaggttctttctgacgaagagaatcacatagactggttggaaacccaactggacttgatcaatcgagtgggaatacaaaattatatccaatctcaacttgttgaagaataa

SEQ ID NO: 457 - DNA, 195 bp, Xenorhabdus bovienii
  Coding sequence Name=Xb4151_4152.C410.gene41.dna; Position on contig =23886..24080bp; Strand=-
atgtatatctgtctctgtaatgctataagcgataaaacgatacgcaatattgtttgccagcaacatgttcgttctatcagagagctgagggactttgtgcctgtagggagcaattgtggaaaatgtatacgtcaagcacgtgaaataatgaatgaggagattgcccaactgtctcccataaataatttcgcttaa

SEQ ID NO: 458 - DNA, 354 bp, Xenorhabdus bovienii
  unsure (1)..(354): unsure at all n locations
  Coding sequence Name=Xb4151_4152.C411.gene1.dna; Position on contig =67..420bp; Strand=-
atgtttgaaccactggaattaaccaacgacgcggtgattaaagtcatcggcgtcggcggcggcggcggtaatgctgttgagcacatggtgcgtgaacgtattgaaggtgtagacttctttgcgattaacaccgatgctcaggcgctgcgcaaaacagctgtcggtcagactatccagattggcaacggcattacaaaaggattgggcgctggtgcaaaccctgaagtcggncgtactgcggcagaagagatcgcgaagcattgcgtactgcccctggaagtgccgacatggtattcatcgctgccggcattgggcggtggtacggggactggcgcagcccccggttggggctga

SEQ ID NO: 459 - DNA, 1257 bp, Xenorhabdus bovienii
  Coding sequence Name=Xb4151_4152.C411.gene2.dna; Position on contig =487..1743bp; Strand=-
atgatcaaatcaacggacagaaaattggtagttggccttgaaatcgggacagcaaaggtatctgccctggttggtgaaattctgcccgatggtatggttaatattatcggagtgggaagttgtccatcccgcggtatggataaaggtggtgtcaacgaccttgaatcggtcgttaaatgcgtacagcgtgcgattgatcaggctgaattaatggcggactgccagatatcttcagtttatctgggactttccggtaagcatatcagttgccagaacgaaattggcatggtgccgatttcggaagaagaagtgacacaggacgatgtggacagtgttgtccatacggccaaatcggttcgtgttcgtgatgaacaccgtgttttgcatgtgatcccacaggaatacgctatcgattatcaggaagggatcaaaaatccggtcgggctttctggcgtacgtatgcaggcaaaagttcacttgattacctgccataacgacatggcaaaaaatattgtaaaagctgttgaacgttgtggactgaaagttgatcaacttatttttgcgggtctggcggcaagttatgctgttctgaccgaggatgaacgtgaattgggcgtctgtgtcgttgatatcggcggcggcacaatggatatcgcagtatacactggtggcgcattgcgccataccaaggtgatcccttatgcaggaaatgtcgtcactagtgatatcgcctatgcgtttggaacccctccgagtgatgctgaaaccatcaaggttcgtcacggttgcgcattgggttcgatagtcagcaaggatgaaagtgtagaggttccaagcgtgggagggcgtcctccccgtagcttgcaacgccagactctggctgaggtgatcgaacctcgttataccgaactgctgaatttagtgaatgatgaaattctgcgattgcaggaacaattacgtcagcagggagtaaaacatcatctggccgcagggattgtcttgaccgggggaggagctcaaatagatggcgtggccgaatgtgctcagagggtattccatacccaagtacgtattggccgtcccctgaacattactggtctgacggattatgtgcaggagccttgctactcaacggcagtcgggcttctgcattatggtaaagaatctcaccttggtggcgattctgatgccgataaaagaacgtcagtgagcggctggttcaaaaaagtcagcagctggctgagaaaagaattttga

SEQ ID NO: 460 - DNA, 726 bp, Xenorhabdus bovienii
  Coding sequence Name=Xb4151_4152.C411.gene3.dna; Position on contig =1766..2491bp; Strand=-
atggtgattggcaccatcgtatggggaggctggatgacattggactggatgaaggattcaaacagattagcgctctcaaaactggtgttgactggtgaacgccattacaccacgaatgatgatgtcaggcgagcaataatggcatttggcgctatcgggacatttatgacacaggatgtcaacattattcaggggcagatagaacgactaccgtggattcggcaagtcactgtgcgtaagcaatggcctgatgaactaaaaattcatctggtagaatacgtgccttatgtacgttggaatgatacgtacatgctggatgcagaaggaaatgtatttagtttgccgatagagcgtagtgtcaaagggcattacgccatgctttctggccctgaaggtaaagagaaagaggtattggcagaatataacaaagtagcgcccttgtttactgaacataaaatgaaattgaaaacggtgatcatgacggagcgtaatgcttggcaattaattctgaataacgacattcggctggaactgggaaataaaaatgatgtgaagcggattaaacgttttattgaactttatcctgtgttgcagaaaaatacggagaaacgcgtggcttatgtagacttacgttatgacagcggcgctgcggtaggttgggctcctttattaattgatgcgccggtttcaatcaacgggcagaaaaataacagtgactggcaataa

SEQ ID NO: 461 - DNA, 921 bp, Xenorhabdus bovienii
  Coding sequence Name=Xb4151_4152.C411.gene4.dna; Position on contig =2592..3512bp; Strand=-
atggttgagaaggtcgctgttctattgggcggaacctccgctgagcgggaagtttcactgcaatcaggacaatctgttgtggccgggctgaaagaagcaggcattaatgcatattcagtcgatacaaaagactttgatgtgactaaactcaaaggagaaggattcagcaaagccttcatcgctctgcatgggcgtggtggtgaagatggtacgctgcaaggggtactggagtttttgcaaatcccttataccggcagtggtgttatggcatcagctttgtcaatggacaaattgcgcacaaaacagttatggcagggagcaaagttgccggtttctccgtatgccgcaattaatgctcaaaaatttgaacaagttaatgatttccaactccaagaatatgttcgagaattaggacttccattaatggttaagccgaatctggaaggttccagtgttggtatgactaaagtgaatgattattccgaactgcgtggggcattggagctggcgttccagcacgacacggatgtgctggttgaaaaatggttgttgggtcctgaatataccgtggcatttttgggcgatgaggttttaccctctatccgtatccaagctccggaagtgttctatgactacgatgcgaaatatctttccaatgaaacgaaatacttctgcccaagtggcctgagtgcagaaaaagagctggagttggcagagattgcatcaaaagcgtataaggcgctgggatgcagtggttggggtcgggttgatatcatggatgatggcaatggtaatttctatctgttggaagtgaatacatccccaggtatgaccagccatagcttagtaccgatggccgcacgtcagtccggactcagtttttcacagctggtggtgaaaattctggagttggccgattga

SEQ ID NO: 462 - DNA, 1476 bp, Xenorhabdus bovienii
  Coding sequence Name=Xb4151_4152.C411.gene5.dna; Position on contig =3505..4980bp; Strand=-
gtgaatacacaacagttggcgaaattaagagtttccgtgcctgaaatgagaaaagtcaggcatatccactttgtcggcattggtggtgctggcatgggtggtatcgccgaggtgttggctaatgaaggttatcagataagtggttctgatttggcacccaatcccgtcacacaacagttgctcgcactgggtgcaaccatttattttaatcaccgtttggaaaacgtacgaggtgccagtgtggtcgttgcatccacggcaatctctgcggacaacccagaaattattgccgctcgtgaagcccgcatcccggttattcgccgtgcggaaatgctggcagagctgatgcgttatcggcatggcatcgctatcgcgggaacgcatggaaaaacgacgacgacagcgatgattgccggcatttatgctcaggctggccttgatcctacattcgtcaatggggggctggttaaggccgcaggcacgcatgcccgtcttggaaccagtcgttacctgattgctgaagcggatgaaagcgatgcttctttcctgcacttgcagcctatggtggcggttatcaccaatattgaagctgaccacatggatacctatcagggggatttcgaaaatctgaaacagacattcgttaatttcctacataacttgccattttatggtcgtgccgtgatgtgcattgatgatcctgtcgtgaaagagttaattccccgcattggacgttatatcacgacctatggtttcagcgaagaagcagacatccgcattacacattacgagcagaaggcagcgcaggggtttttcaccatcagccgtgacgacttgccagaattgcatgtcgtattgaatgcacctgggcgtcataacgcgctgaatgcaaccgctgctgtcgctgtagcgacagaagaagggatcaatgatgctgctattctggcttcactggctgaatttcagggaacggggcgccgttttgattttctgggtgaattctccctcaaacatattaatggcaaagaaggtcgcgtgatgctggtggatgattatggtcatcacccaaccgaagtcgatgccacgattaaggctgcgagggcgggttggccagataagcgtattgtgatgctgttccagccgcaccgctatacaagaactcgtgatttatatgatgattttgccaatattctgagtcaagtggatgttctattgatgctggatgtgtattcggcaggtgaaaccccaattccgggggctgatagccgctctttgtgccgtaccattcgtagtcgtgggaaattggacccgatttttgtgtcagattcagagcaaatttcagccatgctgtcacaggtaatagaaaacaatgacttagtgttggttcagggtgccggtaatatcggtaaaatagcgcgcaatctggctgaaacaaaattacagccgtcttttaatgagggagagcatcatggttga

SEQ ID NO: 463 - DNA, 1086 bp, Xenorhabdus bovienii
  Coding sequence Name=Xb4151_4152.C411.gene6.dna; Position on contig =5017..6102bp; Strand=-
atgagcggcagaaaccggcgtttaatggtaatggctggtggtacgggaggccatgtttttccgggactggcggttgcccaacatttaaaagaacaaggctgggaaatccgctggttgggaaccgctgatcgcatggaggcggatttggttcctaaacagggtattgatattgaatttatccaaatttcaggattgcgtggcaaaggaataaaagcactctttgcggctcctgtcagaatttttaaggcgatccggcaggcaaaaacgatcatgcgccgctatcagccggacgttgtgctgggtatgggtggctatgtctcaggacccggcggaattgctgcatggctgtgtggcattccggttgttctgcatgaacagaatggtattgccggattaaccaaccgctggctggccaaaattgcgaaaacggtcttgcaggcatttcccggcgcattttctgatgcacctgttgtcggcaaccctgtgcgtgaagatgtactggcgctgccagtgcctgcacagcgtctggcaggaagagaaggatctatccgtgtactggtcgttggaggtagtcagggtgcaagaattctgaatcaaatcatgccagaagtggctgagcgtatgggtgttcacatcactatatggcatcaggcaggaaaaggtgcgcaggaagaaacacacagaaaatatgaaaattcagctaaatctgaatttaaagtgactgaatttattgatgatatggcgcaggcttatgcgtgggctgatatcgtggtgtgtcgttcgggtgcattgacggtcagcgaagtttctgcagcaggattacctgcgatctttgtgccatttcaacataaagatcgccagcaatattggaatgctttaccgctggaaaaagcgggagcagcaaaaatacttgaacagcctcaatttacggccgaagccgtagtagatctgctcacacagtggcagcgtccacaattgctggaaatggcagaaaaagcgcgttcagtagccatcgttaatgcaactgagcgtgtggcagcagcattgatcgatgctgttgaaaattattcaggccgttccaagtag

SEQ ID NO: 464 - DNA, 1194 bp, Xenorhabdus bovienii
  Coding sequence Name=Xb4151_4152.C411.gene7.dna; Position on contig =6099..7292bp; Strand=-
atgactattccaggcctcggtaaatttaaaaattggctgacggggaacgtggagaccgatgccacggatatcgtcatgtatgatcgtaccctggtctggatgatattgggattagctgtgataggttttgtgatggtgacatcggcctcaatgccagtgggtcagcgtctcgcacaagatccgtttatttttgcgcagcgtgatgcaatttacttggtgctggcgtttatattatcactcatcaccttgcgcatcccaatggagttttggcagcgttacagcaacattatattgctgggcacgatcatcatgcttgttgtggtgctgctggttggcagttctgtcaatggtgcatcgcgctgggtggcaattggcccattgcgtattcagccagcggaattatcgaagttgtcacttttctgttacctatcgagctatctggttagaaaagtggaagaagtgagaaacaacttttggggtttctgcaagcccatgggcgtcatgattgcgctggctattctgctattggcacagcccgatttgggaaccgttattgttttgtttgtgacaacgctggcgctattatttctggccggtgccaaattgtggcagttccttgccatcattggctgtggaatatttgccgtctgcgtgttgattgttgctgaaccttatcgtatgcgtcgagtaacttctttccttaatccgtgggatgatccgttcggcagcggttaccagttaacacaatcgctgatggcatttggtcgtggggactttttcggacagggattaggaaattcaatccagaaaatggaatatctgcccgaagcgcatactgactttattttctctattctggccgaagaattaggttatttgggtgtggttttagtgttgtcaatggtattcttcgtcgcctttcgcgcaatgatgattggtcgccgagcattacagcttaatcagcgctttgctggttttttggcttgtgcaatcggcatctggttcagctttcaggcattcatcaatgtcggtgcagcgtcaggtatgttgccaacgaaaggtttgacattacctcttgtgagttacggtggttcgagtttgatcgtgatgtctacggctatcgtcttattattgcgaattgattatgaagtgcgtctggcaaaagcacaggcgtttgtaaggagccccaaatga

SEQ ID NO: 465 - DNA, 1311 bp, Xenorhabdus bovienii
  Coding sequence Name=Xb4151_4152.C411.gene8.dna; Position on contig =7292..8602bp; Strand=-
atggctgaatatttgggtaaaaaagtcgttattgttggattggggctgacgggcctctcctgcgttgactttttcatggcacgtggtgtgactccacgtgtgatggatacccgcctagtgccaccgggcagcgataagctgcctgatgacgttgcgtgtcacactggtagcctgaatacacaatggttgatggacgcggatttaatcgttgccagtccgggtattgcactggcaacacctgagttacaggcagcggccgacgccggcattgaaattgtcggtgatattgaattgttttgccgtgaggcgacgacaccgattgttgccattacggggtcaaatggtaaaagcaccgtcacgactcttgtcggggagatggcaaaagaagccggatggcaggttggtgtgggaggaaatattggtattcctgcactggaactgctgaaacagccttgccagttgtatgtattggaactctccagctttcagcttgaaacgacttacagtctgaaagctgccgcagcgactgttctgaatgtcactgaagaccatatggttcgttatcctgatgggttgtcgcagtatcgtgcagcaaaactgcgtatctatgatcaggcaaaagtgtgcgtggtgaatgaacaggatgcattgacattgccggaagcaggtaaagatagccgctgtatcagttttggtgtggatagtggtgcttaccagcttgagagtggacgtcaacaattggtggttaaccatcaatctttattggaaacccgtcagattcggttaacagggcaacataattacaccaacggcctggcagcattggcgttggctgatgctgtaggtatccctcgcgaagccagtattcaggcattacagacttatccgggattggaacaccgttttcaagtcgtgcatatgagaaatggcgttcgttgggtaaatgattccaaggcaacaaatgtcggcagtactcaggcagcactcagtggactgacattggaaggtacgctctatcttttactcggcggggatggaaaagccgctgactttactccactgcaaccttatgtatcgggaaataacattcgcctttactgttttggttgtgatggaaatcagctggcgcaattgcgtcctgaaatttccgtgttgacagaaacgatggaacaggcgatgaggaaaattgcaccgaagttgatgactggcgacatggtgctgctgtcacccgcttgtgcgagctttgaccagttcaatggttttgaacatcgcggccatgaattcgcccgtttggccgaggagttaggctaa

SEQ ID NO: 466 - DNA, 1083 bp, Xenorhabdus bovienii
  Coding sequence Name=Xb4151_4152.C411.gene9.dna; Position on contig =8605..9687bp; Strand=-
atgttagtttggttagctgattacctggttaaatatcacacagtctttcacgtcttttcctatctgacgttcagagccattgtcggcttgttgactgcactatttatcgcattatgggtgggaccaactttaatcggctacctgcaaaaattgcagattggtcaagttgtgcgtgacaacggcccagaatcccatttcagtaagcgcggtacaccgacaatgggtgggttgctgattctattctctatcaccatgtccatattactgtggacacgtctggataacccttatgtctggtgtgtgctggccgttctgctgggttacggcgtagtgggatttgtcgatgattatcgcaaagttgttcgtaaagataccaaagggctgattgctcgctggaaatatttctggcagtcagtcatcgcattgggtgtggcgtttgccatgtacagtatgggtaaagatactgccgcaacacaactgattgtgccatttttcaaagaagtcatgccacaactggggctgctttacatcctgctggcgtatttcgtgattgtgggaaccagtaatgccgttaatctgaccgatgggcttgatggtctggctatcatgccaacggtgttcgtcgcagcgggtttcgctatcgtggcatgggcgatgagtaacgtgaagtttgccctttatttgcacattcctcatttagtccacgcgagtgaactggtgattgtctgtaccgcaattgttggcgctgggttgggcttcctgtggttcaacacctatccggcgcaagttttcatgggggatgtcggttcactggctttaggcggcgcgttgggaactattgcggttttgctgcgtcaggaattcctgctgatcatcatgggcggggtatttgtcgtcgaaacgctatctgtcattttgcaggtgggatcgttcaagcttcgggggcagcgtattttccgcatggctccgattcaccatcactatgaattgaaaggctggccggagccacgcgttattgtgcggttctggattatttccctggtgctggtactgattggtctggcaacgttgaaggtacgttaa

SEQ ID NO: 467 - DNA, 1383 bp, Xenorhabdus bovienii
  Coding sequence Name=Xb4151_4152.C411.gene10.dna; Position on contig =9681..11063bp; Strand=-
atgattccgctgacactcaagcaattgacaaaactgacaggcggcgtgctatatcacacttccgaacagcaggcggctacttgccaaatcaataccgtggaaattgatagccgaaaaatggtgcgtggaggactgttcattgccttaaaaggggaaaagttcgacgctcatgatttcgtagcagatgtcgcgaaacagggagccggtgctttgttggtcaaccgccgccttgaaattgactgccctcaggtggtagtggaaaacacccgcttggcgatgggcaaactggcggcttgggttcgccagcaaagtaaagcacggatagtggcactgactggctcatcgggcaaaacgtcggtcaaagagatgacggcggcgattctgtgtcaacgcggtcataccctttataccgcaggcaacttcaataacgacattggtgtgccattgacactgttcaggctgactgaagaacaccaatttgccgtgattgagctaggtgccaatcacattggcgaaatcgcctataccgctgaaatgacctgtcctgaaagtgcgctggtgaataacctgtttgcggctcatctggaaggcttcggctctttggcgggagttgccaaggcaaaaggcgaaatttttgcggggctttcatcagcaggaaccgccatcatcaatctcgatagcaatgattggacgcattggcagcagggtatgagcgagccgcaggctgtatggcggtttgctgtttcacccgtgccagaagctgatttttacgccactgacattcaggagcaaccgctggcaacgagtttctgtctgcatacaccgattggaaatattgaggtaacactgccactgccggggaaacacaatattgccaatgcattggccgccagtgcgctggcgatctctgtgggtgcttctctcagtgatattcgtgccgggttattagaactgaagcctgtttcaggacgcttattccctattcgacttgcagagggaaaaatcgtgctggatgacacgtataacgcgaatatcggttccatgattgcggccgccaataccttgtcacagatgcccggttatcacgttatggtcgtcggtgacatgggtgaattgggagatcaaaccgttgagtgtcaccgtcaggttggtgaagccttggcatcgacaaaaatagacaaaataatgagcgtcggtgagttcagttctcatatcagtgaaacaagtggtcggggacagcatttcgctaacaaggcggaattagttgcagcgctgcttcctttactggaacaacacgaaatgatttctattttaattaaaggttcacgcagtgccgcaatggaagaggtagtgaacacactgaaggagaacttccaatgttag

SEQ ID NO: 468 - DNA, 1488 bp, Xenorhabdus bovienii
  Coding sequence Name=Xb4151_4152.C411.gene11.dna; Position on contig =11060..12547bp; Strand=-
gtggcagatcgtaatttacgcgatttactggctccatggggtgttgatactccggagcttccgctgcgcgaaatgacattagacagccgtaaggcggctgccggagatctgtttgttgcagttaaagggcaccagacagatggccgaaattatattcctcaagccatcgctcaaggtgttgctgcggtgattgcagaagcgaagggaaaaacggataacggcaccattcaagcaatgcacggtgttccggttatctatctggatgatctcaataataaactgtcaaaattggcaggcgaattttaccagcatccgggtaataaactgaaactcgtcggagttactggaaccaacggcaaaaccacgacgacacaattgctggcacaatggagtcagggtcttggggaaatcagtgccgtaatgggaacggtaggaaatggcctgttgggaatgatagttccaagtgaaaataccacgggttccgccgttgatatccagctcgatttacagcagctcgttaatcaaaaagccacttttgccgcgatggaagtttcttcacacggtttagtgcagggacgagtggccgccctgccatttcaagccgccgtttttaccaatttaagccgtgatcatcttgattatcatggtgatatggaaaattacgaagaggccaaatggttgttgttcagcagtcatgatgtaaaacagaaaatcattaatgccgatgatgatgtggggcaaaaatggcttacccgcttacctgaaacggtggccgtcacgatggaaaatcgcctgccgaaaaattggtcggggcgctggttatccactagtgacatccactatcacgacaaaggtgcatccattacgtttacatcctcttgggggcagggaactctcaacagtccccttatgggagcgttcaatgtcagtaatctgctgctggcactcgctaccttgctgtcactggaatatccactgcaaaaactattggaagccgcttcctgtctggagcctgtctgtgggcgcatggaagtctttgctgcgcgagatcgtccgacggtcgtggtggattatgcccatacacctgatgctctggaaaaagccctgtctgcggcacgattgcactgtaaaggccaactttggtgtgtattcggctgtgggggtgatcgcgataaaggtaagcgttcactgatgggcggtatcgccgagcagggcgctgatcgggtgatagtgactgatgacaatccccgtagtgaagaaccccattctattgttgaagatattctgaccggtttcatcgatccgggtcgggcgatggcgattcacgggcgtgttgaagcggtgaccagtgccattatgcaggctgctgaagaggatgtcgtactggtggcgggtaaaggtcatgaagattatcaattagtaggcaaccgccgtttagattattcagatcgtctgactgttgcacgtctgctgggggtaattgcatga

SEQ ID NO: 469 - DNA, 1776 bp, Xenorhabdus bovienii
  Coding sequence Name=Xb4151_4152.C411.gene12.dna; Position on contig =12534..14309bp; Strand=-
atgaaagctgcacgctctttaaagttgaagaagcaagaagataaagccagttttgtaagctggcgctttgctttgctgtgtgggggcatttcgtttgctttgttcgggcttttgattcgtgttgcttacttgcagattatcaatcctgaccgtttgctaaaagaaggtgactcccgttccttacgtgtccagtccattccgactactcgcggtatgataaccgatcggaatgggcgccctctggcggtcagcgtaccggttgatgcagtttgggctgatcccaaagaaatctttgaaaaaggcggcataacggatgatacgcgctggcaagcgttagctgacacgctttccataccgcttaatcaactgacccgtaaaattcaggattatccacaggggcgttttgtctatcttgcccgtcaggtcaatacctccattggtgattatgtcgaaaaattaagattacctggcatctatttgcgccaagaatcccgccgttattatccggcagggcaggtgaccgcgcacattattggcgtgaccaatattgacgacaaaggcattgagggagtggaaaagagcttcgacaactggctgacgggtaagccggggagccgaattgtccgcaaggatcgcaatggacgggtcattgaagatgtttcgttcactgacagtcaggctgcccacaatctggctctcagcattgatgagcgtctccagactttggtctaccgtgaattgaccaaggcagtaatacttaataaggctgagtctggtacggccatattgattgacgtaaaaaccggcgaagttctggcaatggcaaacaacccatcctataacccgaataatctggcgggaacgccgaaagatgcgatgcgtaaccgtgccatcacggatatttttgaacccggttctacggtaaaaccgctagtggtgatgagtgcgttgaaccttaacattgttaaagaaaattcagtgctggataccaaaccttatcgattggcttatggagcgcgttcgcatcaaatcaaagacgttgccccgcgttctgaattaaccatcactgggattttacagaaatcgagtaacgtgggtgtttctaaactggcgttagcgatgcctgcctcggaactggtaaatgtttattcccgctttgggatgggaaaaccgaccaatttggggctggtcggagaaagtagtggcatatatcccaaaagagaacgctggtcagatcttgagagagccaccttttctttcggctacgggctgatggtaacaccgttacagttagcgcgagtctatgcaacgataggcagctttggtatctatcgcccgttgtcaattaccaaagtagaccctcctataccgggaacccgcgtatttcctgaacccattatgcgcacagttgttcacatgatggagagtgtggcactacccggcggcggcggggtacgcgccgcaataaaaggttatcgtatcgcaatcaaaacgggaacggcgaagaaggtcgggccggatggaaaatacgttaataaatatctttcctataccgcagggattgcccctgcaagtaatccacggtttgcattggttgtaatcatcaatgatccacaagccggtaaatattatggcggtgcggtttcagcgcccatctttggcactatcatgagtggtgttttacgtacgatgaacgttgaacccgacgcactgcctgcggatgataaaaaagaatttgtgattgataataaagaggataaaagtggcagatcgtaa

SEQ ID NO: 470 - DNA, 318 bp, Xenorhabdus bovienii
  Coding sequence Name=Xb4151_4152.C411.gene13.dna; Position on contig =14337..14654bp; Strand=-
atggcaggtgagcgtcatggattagtgggggtcattggcagggatttaatccgcaatgccaagatcccactggttttgctgatagcggtaatcatttcggccattagcgttgtgacggttgcccataaaacccgcttattgatagcggaaaaagagcgctcggcgattgattttgattctctggatattgagtggcgtaacctgcttcttgaagagaatgccctcggtgatcacagtcgcgttgaaaatatagcgactgaaacattgcatatgcaacatgttgatccggcgcaagaaaatattgttataactcaataa

SEQ ID NO: 471 - DNA, 945 bp, Xenorhabdus bovienii
  Coding sequence Name=Xb4151_4152.C411.gene14.dna; Position on contig =14655..15599bp; Strand=-
atggcaaatagtcattataagcataccagtgtattactggacgaagctgtcaatggactgaatatccgagaaaatggaatttatattgacggaacattcgggcgaggagggcattctcgcctgattttgtctcaattaggggcagatgggcgtttaattgcgattgatcgcgatccgcaggcaattgaagcggcgaaagccattactgacccgcgtttttccattactcacgggccattttccgaattggctacctatatagaagaagcgggactggtcggaaaaattgatggtgtgttgttggatttaggggtttcctccccacaactggatgatcctgaacgtggtttttcatttatgcgtgacgggccgctggatatgcgaatggaccctacccgagggcaatcggctacagagtggctgatgaaggccgaagctgatgatattgcatgggtactgaaaacctttggggaagaacgttttgccaaacgtatcgcgagagccatcgtagcccgcaatcaggaagggcaaatcacccgaaccagagaactggcggagttgattgctcaggcaagcccggttaaggaaaagcacaagcatccagcgacgcgcagttttcaggctatcaggatctacattaacagtgaactggaagaaatagaacgcgcattgaatggtgcattgcaggttctggcaccgcaggggcgattatcagttatcagtttccactcgttggaagatcgcatcgtgaagcgttttatccggcagcacagccgggggccacaggttccagccggtttacctctcactgaaacgcagttaaaagctcaggggggacgcagcctgaaatcaattggcaaactgaagccttcagaggacgaagtggtaataaaccctagagcgagaagctctgtattgcgatttgctgaaaaggcaggtgagtaa

SEQ ID NO: 472 - DNA, 459 bp, Xenorhabdus bovienii
  Coding sequence Name=Xb4151_4152.C411.gene15.dna; Position on contig =15602..16060bp; Strand=-
atgtttcgtggagcaacactggttaatctcgatagtaaagggcgactcactgtacctgcccgatatagggaaaagctgaatgaggaatctacaggtcaaatggtttgtaccattgatctccatcagccgtgcctgttgctttacacattacccgaatgggaaatcatcgaagaaaagttatctcgcctatccagcatgaatctagccgaacgtcgcgttcaacgtttgttattggggcacgccagtgaatgccaaatggacagtgcagggcgccttttgttagcgaatacactgcggcagcacgcagggttaacaaaagaggtcatgctggttgggcaatttaataaatttgaattgtgggatgagcaagcctggtatcagcaagtacagaatgatattgaggctgaacaatccacacaagaacctttatcagcaaggctacaggatttatcactataa

SEQ ID NO: 473 - DNA, 1008 bp, Xenorhabdus bovienii
  Coding sequence Name=Xb4151_4152.C411.gene16.dna; Position on contig =16709..17716bp; Strand=-
gtgaaactggatgagatcgcccgcttagcaggggtttcacgtaccacggccagttatgttatcaatggtaaagccaagcagtaccgggtcagcgataaaacagtagaaaaagtgatggcggtggtcagagagcacaattaccatcccaatgctgttgccgccggtcttcgggcggggcgtactcgttcaattggcttagtgataccggatttggaaaacacgagctatacccgaattgccaactatcttgagcgtcaggcacggcaacgtggataccagctattgatcgcatgttctgaagatcagccagataacgaaatgcgctgtgttgagcatcttctgcaacggcaggttgatgccattattgtttccactgcgttgcctcctgaacatcctttctatcaacgttggacaaaccgttcactgccaattattgcgcttgatcgtgcattggacagcgaacactttatcagtgttgtgggggatgacctcgaagatgcgaaaatgctggcacaggagctgcgtcaatttccgtcagaatctgttctttatctgggagcattacctgaattatcggtcagtttcttacgtgaacaggggtttcgtgaagcatgggaaagtgatcagcgtgaagtgaactacctgtatgcgaacagctatgaacgtgaagctgcggctgaagtctttgcttcatggctggaaaataatcctgtacctcaagtactctacacaacctcattttccttgctgcaaggcgtcatggataccctccttaagcgcagtggtcggttacctgagcagttggtcattgctacgttcggtgatcatgaattacttgattttcttgaatgtccggtgctgtccgtcgcacaacgccaccgtgacgtggctgaatgtgcccttgaactggtattggccagtttggatgaaaaaaagcggccagagccaggaataactcgaatgcgtcgtcatttatgccgtcgtggaagcctgagtagaaaagcttga

SEQ ID NO: 474 - DNA, 492 bp, Xenorhabdus bovienii
  Coding sequence Name=Xb4151_4152.C411.gene17.dna; Position on contig =17805..18296bp; Strand=-
atgcgccggattttgtctgtattacttgaaaacgaatcgggagcgttatcccgcgtagttggcctgttttctcaacgtggttataacattgaaagcctgactgtggcccctacggaagatccaactctgtcacgtatgactatccagaccaagggtgatgctaaggtattagagcaaattgagaaacaactgcataagctggtggatgttctgcgggtcagtgaattgaccgcaggtgctcatgttgagcgtgaaatcatgctggtgaaattgcaggccagtggctatggacgggaagaaatcaagcgcagcacggatatattccgtgggcagatcgttgatgtgacgtcagcactatacactgtccaattggcaggaacgagtgaaaaactggatgcgtttcttgatgccgtgcgcgatgttgctgagatcctggaagtggcacgatcaggcattgttggtatcgctcgcggggataaaattatgcgatga

SEQ ID NO: 475 - DNA, 1728 bp, Xenorhabdus bovienii
  Coding sequence Name=Xb4151_4152.C411.gene18.dna; Position on contig =18299..20026bp; Strand=-
atggagatgttgtcaggagccgaaatggttgtcagatcgttaatcgatcaaggcgttaaacatgtattcggttatccgggtggggcagtactggatatttacgatgccctgcatacggtgggaggaattgaacatattctcgttcgtcatgaacagggtgctgttcatatggcggatggatattcccgttcaacgggaaaagccggagttgttctggtgacatccgggccaggagcaaccaatgctatcacgggaattgcaacggcttacatggattcaatcccaatggtggttttgtctggccaagttgccagctccttgataggtaatgacgcgtttcaggaatgcgatatggtgggaatttcccgtcccatcgttaaacatagttttctggtgaaaaaagcagaagatattccaaatacgattaagaaagccttctatttggcgacaactggccgtcctggtccggttgtcatcgattttcccaaagataccgtcaatccggcactgaaatttccgtatgtttatccggaaaaaatcagcatgcgttcttacaatcctaccgttcaggggcataaaggacagattaaacgggcgttgaaaactctgctggatgcgaaaaagccggtgatctacgtaggtggcggcgccatcaattcggcatgttcatcagagttgctgaaattggctgaatgtttgcacattccggtcgtcagttcgttgatggggctgggcgcttttcctgccactcatcgtcagagtctgggaatgctgggaatgcatggcacgtttgaagctaataaagcgatgcacaattctgatttgatttttgcggtgggtgtgcgttttgatgatcgcacaaccaataatctggaaaaatattgtccagaagccattgtactgcacattgatatcgatccggcctctatttcaaaaactgtgtcggcggatattcccatcgttggggatgccaaacagatactcggccaaatgctggaattgatgaatactctggaagacactcaggatccggatgcattgaaagactggtggctttccattgaacaatggcgtagccgcaaatgccttggttacgatcgcaccaccgcgaaaattaagccacaggccgtgattgaaacgctttaccgtctgactgaaggcaaggcgtatctctcgtcagatgtaggccagcatcagatgtttgccgcactgtattatccctttgatgagccgaggcgttggatcaactctggtggtttgggcacgatgggatttggcttgccagccgcgcttggggtgaagctggcaaagcccgatgcgacagtagtgtgcgtgacaggagatggcagtattcagatgaatattcaggaattatccactgcattgcagtatggcttgcctgttctggtgctgaatttgaacaaccgttttctgggtatggtgaaacagtggcaggacatgatttacgcgggtcgtcattctcaatcctatatggaatcgctgcctgattttgtcaaattggcagaggcttatggtcatattggtgtttccatccaaacttacgaagaactggaaaataaactggctcaggctttgcatgaagtcactgaaaaccagcggctggtttttgtcgatgtcaccgttgatgaaacagaacacgtttatccaatgcagattcggggtggagcaatggatgaaatgtggttaagcaaaacagagaggacctga

SEQ ID NO: 476 - DNA, 1803 bp, Xenorhabdus bovienii
  Coding sequence Name=Xb4151_4152.C411.gene19.dna; Position on contig =20220..22022bp; Strand=-
gtgataacagattccctgcattcctatcacctgattaaccggttgcaacagcaatccattgaatatcccgaaaagattgcattcaggcaatggtcaccatcagagcagcttgaaatgagttggcaagacgttacttatagaacggaatccatcgcaaaagctttgttgtcactgggtgtagaaattcaggagaaagtcgctatttttgcgcataactgtattgcatggtcattggctgatttggccgttcttcagttacgtgcggttacagtccctctttatgcgaccagcagccgtgatcaggctaccttcattctcaaggatgccggtgtgcgggtactgtttgttggtgagcaagaacaatataatgttgcgatgacattgctggaattgtgccctcaactcaatcatcttattgtgctggacgagtccgttgacttgaagagctgtccgcaggcgcagtatttatctgccttcattgtcaatgcgcacgcacaatatcagccagagcttgataaccgcattgcagggcaggatttaaatgatcttttcaccttgatctacacctccggtacaacgggagagccaaaaggagtgatgctggattaccacaatatcgcttcgcagctttacttgcatgatcagcgtctgacactgaccaaagaagatgtatcactcagttttttaccgttgtcccatatcttcgagcgcgcatggagttactatgtcatgcatacaggggcgcttaatgtctatttaactgacaccaattctgtgcgcgaggcgatggctgaagtacgtcccactgttatgtgcgctgttccccgtttttatgaaaaagtgcatagtgctattcttgaaaaagtttcccgtgcgccatttttgcgcaggctgattttccgctgggcgataaagcggggggagaaccgctggatgcgtcagctacagaataaaaaagcgtgtatcttctctctctgtagtgatcaactggccgacaaactagtgttgagcaagctccgtaacatatttggagggcgagtgcgtttcttacccgtggcaggagcacgtcttgacgatgctattgcccggttttttctatccgccggcattaatatcaaatatggttacggcatgacagaaacttgtgccacggtatcttgctgggaagagaaaaactatctcccaggctcgattggcacaccattgccgagtattgatgtgcgcatcagtgccgaagatgaaattcaggtacgtggccctattgtgatgaaaggctatttcaaccagccggaagaaacggctcatgcttttaccgaagatggatggctgcgtacgggggatgcagggggattggatgaaacaggcaatttgttcatcactgagcgcctgaaagatttgatgaaaacctcgacgggaaaatacattgctccgcaaatgcttgaggggactttgggacaggatcgtttcattgaatatattgcggttattgccgattcccgtaattttgtttctgcgttgattgtccccagttatgatgcattagaagattacgcaaaatccatccatcttcattatcgtgatcgtatcgagttgctgaacaatcgtcagatcatcgaactgtttgaacaacgtttggcggaactacaaaaaaatattgccaaataccatcaggtaaaacgcttcatcctactgccagaagctttctccatggaaaaaggcgaattaactcctacactgaaactgcgccgtaaggtgatttcgcaacattatcacgatgaaatcgaatccatgtatcgagattaa

SEQ ID NO: 477 - DNA, 948 bp, Xenorhabdus bovienii
  Coding sequence Name=Xb4151_4152.C411.gene20.dna; Position on contig =22378..23325bp; Strand=-
atgactgggtataattcagtaacaacaagaagaaaagaatcatgtgaagtgcaattgcgtagtgtggatctcaatttgcttactgtgtttgatgctgtaatgcaaatgcagaatattacacgtgcggctcaggcgctgggaatgtcacaaccggctgtcagtaatgcggtagcccgcttaaaaactatgtttgatgatgagttatttgtgcgctatggccgaggcattcaaccaacggcaagggcaaaacagctctttgggccgctccgacaagcacttcagattgtccataatgagttgcctggtgtggggtttgagcccgataatagtgcgagggtatttaatctctctatttgcagcccgcttgatattcgtttagctgcccaaattgttgggggaataaaaaaacattcgccaaatatcgaagttgtcattaaaacacaaatcaatggaaatattgagaaacaattaaaatatcaggaaatagaattcgttatcagttatatacaattagatcagcctgattttcataattctccattgtttaatgatgaattggttttggcagtttccaaaacgcatcctcgaatcagtaaacgcattaatcagcagcaattgcaggaagagaggcatgcaattgtggcattggataatgtggattcattcagtaaaccttactatgaaagtaatgaattgttgcgttctgtttcttatcagggaacggacttaaatagtgttctcaatatcgtgtctcagacttatttagtcgctattgcaccgaaatggatggttgagcattattctgaacagttaaatatacgtgcgatacccttgcccaacggacgaatctcccgcccctgctatttgatatggcacggttcgacaaacagagataaaggtcatcagtggatgaaatcgttactgagcaatcttggtgaacaggaatag

SEQ ID NO: 478 - DNA, 1593 bp, Xenorhabdus bovienii
  Coding sequence Name=Xb4151_4152.C411.gene21.dna; Position on contig =24308..25900bp; Strand=+
atgagccagcaagttattatcttcgataccacactgcgtgatggcgaacaggcattacaagctagcctgagtgtaaaagaaaaactacaaatcgcttatgcactggaaagactcggggtagatatcattgaggcggggttccccgtttcttccccgggagattttgagtcggttcaaaccatcgcccgtgagatcaaaaacagccgcatctgtgcattatcccgttgtgttgataatgatattgatgttgccgccgaatccctgaaagtcgcagaagccttccgcctgcacctgtttttggcgacctctagcctgcacgtcgaacataaattgaaaaaagaatttgacgatgttgtcgaaatggccgttcgttccatcaaacgtgctcgcagatacaccgacgatattgaattttcctgcgaagatgccggccgttcgaatatcgacagcttatgtcacattgttgaacaggcaatcaaagcgggcgcaaccaccattaatattcccgataccgttggctataccacgccttatcaatttggcggcattatccagaatttatttgaccgagtccccaatattgataaagcgattatttctgtccattgccatgatgacttgggtatgtccgtggcaaactcgattacagcggttcaggccggagcccgtcagatcgaaggcaccatcaacggcttaggggaacgcgcgggaaactgttcgctggaagaagtgatcatggcaatcaaaactcgccaacaaatattagacgttcacactaatatcaaccacaaggaaatttaccgcacctgccaattggtcagccagatctgtaataccccaattccggccaataaagcggttgtcggcagtaatgcttttgcccactcatcaggcattcatcaggatggcgtcctgaaaaaccgcgaaacttacgaaatcatgacgccggaatccatcggactgaaagatacccaattgaacctgacctctcgctctggccgtgcagccgtgaaacaccgaatgtctgagatgggctatcaggagcaggattataatctggataccctgtataaagctttcctgcgtctggcagacaaaaaaggtcaggtgtttgattacgatctggaagcactggtattcatcaatcagcaacaacaagagaatgaatattaccgtctggattatttcagcacccagtccggtacccacatcgtaccaacggcaaccgtgcgtctggcctgcggggatgaaatcaaatctgaagccgctacaggcaatgggactgttgatgctatctatcaagctatcaaccgcattaccgggtattcactcgaactgatctcctatcagttgtccggcaaaggacatgggaaagatgctctcggtcaggtcaatattatcgtggaacattctggacgccgtttccacggaatgggattggaaacagatatcattgaatcctctgccaaagccatgatccctattctgaatagcatctggcaggcagaacaggtcgaaaaagaaaagcagcgcatacaaagcaatacctcccaaaataatttccctaataacgatacaaaggaaactgcataa

SEQ ID NO: 479 - DNA, 1122 bp, Xenorhabdus bovienii
  Coding sequence Name=Xb4151_4152.C411.gene22.dna; Position on contig =25903..27024bp; Strand=+
atgacaactccccctactatacacaaacaagactctggcagttatcacattgcggttttgcctggtgacggtattggccccgaagtcatgagacaagcctataaagtattggatgcaatccgccagcgttttaacctccacataacaaccagcgaatatgacatagggggcattgcgattgatcgtcatggttgcccgttgcctcaaacaaccatcgccggttgcgaaaaagccgatgcactcctatttggttccgttggcggccccaaatgggaacatttgccccccgcagaacaaccagaacgtggtgcgctgctaccactgcgcaaacacttcaaactgttcagcaatttacgcccggcgcgcttatatgcgggtttggaatctttttgcccacttcgccaagatatcgcggagagaggttttgacattttatgcgttcgtgaactgacgggtggcatctattttggtcaacccaagggacgggaagggaaaggaaaatatgagcgggcttttgataccgaaatctaccatcgtttcgagatagagcggatcgcccgtatcgcttttgaatctgcccgtaagcgtcgtcataaggtcacatcaattgataaagcgaacgttttacagagctccgtactgtggcgtgaagtcgtcagcgaagtcgcaagagcgtactctgatgttgaaatccagcacatgtatattgacaacgccaccatgcaattgatcaaaaatccggctcagttcgatgtcctgctatgctccaatatttttggtgatattttatccgatgaatgcgccatgatcacgggttcaatggggatgttaccttccgccagcctgaatgaaaaagggtttggcttatatgagccagcgggcggatcagcgcctgacattgcaggcaaaaacattgccaaccccatcgcccagattttatctaccgcattgttactgcgttacagttttgagcgtgatgatgctgcaaacgccattgaacacgccattaaccatgcactggagcaaggctatcgaacaacagatttagcaggtaatgacaaagcagtcagtacggatgaaatgggcgatatcattgcacgttatattgccgaagaaatttaa

SEQ ID NO: 480 - DNA, 681 bp, Xenorhabdus bovienii
  Coding sequence Name=Xb4151_4152.C411.gene23.dna; Position on contig =27871..28551bp; Strand=+
atgtactttacaccgcccagtccacctgaaaatgaacaacaactactcgaacgagctaatgctctggctggtttatcaatgggtgagctggctgcgcaggccaatctgcccattcctcccgatctaaaacgggataaaggttgggttggcatgttgcttgagtattatttgggcgcaagtgcaggcagcaagccagaacaagatttcgaacatattggcattgaactaaaaaccatccctgtagataagaaaggctcaccattggaaacaacttttgtctgcgttgcacctttaacgggcaatagtggcattagatgggaaaattgccacgtcaggcgtaaattatcccgtgtcctgtggatacctgttgaaggggaaagggcaatctcacttgctgaacgccgtgtcggttcaccactgctctggagccccgatccgattgaagaagagctattgcgacgtgattgggaagaattaatggatttgatcgtattgggcaaagttgagaatatcaccgcacgccatggggaagtattgcaattacgccccaaagccgccaatagccgagcgttgacagaagctattggagaatttggtcaacccattatgacacttccacgcggtttttatttgaaaaaaaacttcacagctcccttgctggctcgtcattttttcttatga

SEQ ID NO: 481 - DNA, 429 bp, Xenorhabdus bovienii
  Coding sequence Name=Xb4151_4152.C411.gene24.dna; Position on contig =28605..29033bp; Strand=-
gtggctggaaaaagtaatattgcattttatcggcaacccaattttactatcagtttgaatttgatagatacaactgacgctaaggttggcgcctatttgatgatacttgatgctgaagggatcaataacgcgcaggttttctcaagtaagcgtggaagtgaaatggaatatgaatatattccatcaacggcttgtagtaaccaacttacatgctctatttatatcaaaaaaacggacaatggcagttatccgttggttggcactttctatcttagttatcatccggtatctgggcttgttgacattaccgaagtgaaaatatcgccgggagccttgttgaatttggaagtagatagagtagataacactaaatttcacttcacactgcaagcgaagcaatgcaatcaggctattacatcaatatcatga

SEQ ID NO: 482 - DNA, 189 bp, Xenorhabdus bovienii
  Coding sequence Name=Xb4151_4152.C411.gene25.dna; Position on contig =29282..29470bp; Strand=-
gtgaaagtggaagcattggatcgtcatggcaaggctatggtggtggaaagtgaagattttctatcgattgttatgcaacatgaaattgatcatttgaatggcattgtttttattgattatttatcacccttgaaaagacaaatggcgctgaaaaaagtaaagaaatttttgagtaataagacaagttag

SEQ ID NO: 483 - DNA, 1050 bp, Xenorhabdus bovienii
  Coding sequence Name=Xb4151_4152.C411.gene26.dna; Position on contig =29557..30606bp; Strand=+
atgattgcgcccatgaaaattaatctaacagatgcccaaaaagacgccctcgaattgatgcatgatacgactcgcgatggacgagtacgtgaccgcatcaaggccgtgcttttggcctcagaaggctggactgcccagatgattgctcaggctttgcggatccatgaaagtacggtgagccgccatctgaaagattacttctctgaggaaaaactcgcccctgaaaatgggggctctgaaagccgtttgtctgccgaacaaacaacagaattagttgagtatctgatggcaaatttgatgcacactaccgcacaaattgtggcctatgttcgggcacgatggcaggtgactttcactgtcgcaggaatgacgaaatggcttcaccgtcaaggtttcagctacaagaagccaatgggtgctccgcataaatttgatgcggataaacagcaacagtttattgaaacctacaacgcgctgaaagaagaatgtggccagaatgcgcctattttatttattgatgcggttcacccgaccctgtccacaaaattaagttatggctggatgaagagcgggcggaagcacgtcaaagtggttgaaaccacaggcagtcgtactcgactcaacatcatgggtgcccttaatttacaacggattgaagagactattgttcgtgaatatccgacgattaacgcgaaaaatgtcgtcctttttttcggctcaatccgggaaacctatccactttcgcaaaaaatccacattattctggatggtgcgggttatcaccgttccggagtcgtccaattttttgccgaggttttgaatattgagttgcactacctgccgccttacagccctaatctcaacccgattgagcgattatggaagtatgtgaatgagcaggtacgaaacaatgtctattttccggataccaaaacattccgtgaaacgctgcgccacttttttcatgtcacattgccagaaaaagcgaaagaactcaccactcggttgactgataacttccagattttaaaacccgcatcttcaagttaa

SEQ ID NO: 484 - DNA, 768 bp, Xenorhabdus bovienii
  Coding sequence Name=Xb4151_4152.C412.gene1.dna; Position on contig =101..868bp; Strand=-
atgaacagtaacttcagacattatgtgttgggtctgtcgttattggttggcgtagcggctccttgggccgctaccgcccaagcgccaatcagtaatgtcggctcaggctccaccgatgagcgcctctctcaattagagcgtatttccgatgctcacagtcaattgttaactcaacttcaacaacagcttgctgattctcaacgtgatattgatacactccgtggtcagatccaggaaaaccagtatcaattaaatcaagtcattgagcgccagaaagatatttaccaacagttggataaaatcactaatccatcatcaggtacagaaggcggtaatacagccacgccatcggcaaaaaccgatggtaatccacctgctgctccgacaagtacggggagtgaaaaaggtgattacgatgctgcggttgctttggcgattaataccaaagaatatgataaagcaatctctgcgtttcaaacgttcgttaaaacctatcctaagtcgaaatatttatcgaataccaattattggttagggcagctgaattacaacaaaggcaagaaagacgacgcggcttattatttcgctactgtcgtgaaagattatcccaaatcacagaaaagcagtgattctctgtacaaagtgggattaatcatgcaagaaaagggacagaaagttaaagcaaaagcagtttatcagcaggtagtaaaacaatatcctggcactaattcggctaaaatggccgagaaaaagattgcggggatgtaa

SEQ ID NO: 485 - DNA, 504 bp, Xenorhabdus bovienii
  Coding sequence Name=Xb4151_4152.C412.gene2.dna; Position on contig =878..1381bp; Strand=-
atgcaactgaacaaagtgctaaaagggctgatgttagctttaccaatcatggccgtagcagcgtgtagtactaacaaaaatggcaacaatgatcagtctggtgtaggtactgttgataattctgctaaagcaggtctgtctgctgaagaattagcacgtcagcagatgcaagagctgcaaaacaacaatatcgtatacttcggtttcgataagtatgacatcaacagcgatttcgctcagatgctggatgcacatgcggtattcctgcgcagcaacccatctatcaaagtgaccattgaaggccatgcagacgaacgcggtacgcctgagtacaacatcgctctgggtgagcgtcgtgctaatgcagtgaaaatgtacctgcaaggcaaaggtgtttctgctgatcaactggctatcgtttcttacggtaaagaaaaaccagctgtacttggccatgacgaagcagcatactctaaaaaccgtcgtgctgtaatcgtatactaa

SEQ ID NO: 486 - DNA, 1260 bp, Xenorhabdus bovienii
  Coding sequence Name=Xb4151_4152.C412.gene3.dna; Position on contig =1428..2687bp; Strand=-
atgatgtgggcagcgcttgctcatgcggaagttcgcattgaaatcacacagggtgttgattctgcacgtcctattggagtcgttccatttaaatggacaggtgcaggcaatgccccagaagaaattggttcaattattgctgcggatttgagaaacagtgggaaatttaatcctattgatccaaatcgtatgccacagcaaccctcaactgcttcagaggtaacacctgctgcatggtctgccctcgggattgactctgtgattgttgggcaaatccagcctgctgcagacggcaattatctggtttcatatcagctagtggatactgctggcgcgccaggaacggtgatggctcaggatcaatttaaaattgagaaaaaatggctacgccatgccgcccatactgccagtgatcaagtatttgaaaaactgacgggtattaaaggggcattccgtacccgtttggcttatgttgtcaagaagtcgagcgtgggtaaatacccatatgaactgcgtgtttctgattatgatggttataaccaatttaccgtacaccgctcacctgaaccattaatgtcgccagcatggttgccagatggttctcaacttgcttatgttacgtttgaaagtggtcgctctgcgctagttattcaaacactggcaacgacagcagtgcgtcaggttgcttcgttccctcgtcataacggagcgcctgcattttctccagatgggactaaacttgcatttgtactatctaaaacaggtagtttgaatctttacatgatggatttggcttctggtcagatccgtcaggtaactgatggccgtagtaacaatactgagccaagctggatgccggataaccagacactggtctatacctcagatcaaggtggccgtccgcagttgtacaaaattgatattaatggcggtgctccacagcgcctgacttgggaaggttctcagaaccaagatgctgatgttagctctgacggtagttttatcgtgatggttagctcagcaagtggcagtcagcatatcgccaaacaagatctgggaacggggtctgtccaaatgttgacagatacgtttctagatgaaacgccgagtatcgcacctaacggcactatggtgatttatagctccactcaagggttggggactgtattgcagctagtttcgaccgacgggcgtttcaaagcgcgtcttccggctaccgatggacaggttaaattccctgcctggtcgccgtatctgtga

SEQ ID NO: 487 - DNA, 987 bp, Xenorhabdus bovienii
  Coding sequence Name=Xb4151_4152.C412.gene4.dna; Position on contig =2905..3891bp; Strand=-
atgcaaaaaacagaaatggggggcggaggagctggtggtactgtcattgatgctgttatggtcgatccgaatgcagtcgttcagcaatacagtcagcaacagcaacagcaggctaatgcaaaattggctgagcagcagcggaagaaaaaagctgaacagcaggcggcggaattgcgggtaaaacaggctgaagagcaggaacgtctgaagtcggcagaagaagagcgaataaaagcacaacaggcgtctgaagaacagaaaaaacaggcagatgccgccgcttcgaaagcccgtgaggaacaaaaacttgcggaagaagctgctgctaaggcaaaagcagaaaaagaaagaattctacaggaacaggcagaggctcggcagaaggcagaggttcaggccaagaaagaagcggaagaaactgcgaaacgcaaagccgcatctgaggcgaaggttaaagcagaagccgaagctcaggccaaagcggaggctgaagccaagaccaaagctaaagcggaagccgaatctaaggcaaaagcagaagccgaggcagaaaccaaagcgaaaacagaaactaaggccaaagccaaggccaaggcagaagcgacaaaacaggctcaggaagttgatgacctgctgggtgggttaacgtccagtgcacctaagcagggtggggcatcggcggctggtcaaggtggtggcaagaaaagcggcccttcacagtcggatatcaataattacaaggggcaaattcagactgcaatccagcagaagtttcatgatccgagtttgtatctcggacgtacttgtgagttacggataaaactggcaccggatggcctgctgattgatattaaggctggtgcgggtgatcctgcgttatgcagggcagcagttgcggcggctctccagactaaaattccacgaccaccgagtaaagagatttatgagcatttcaagaattcctcactggatttcaagccccagtaa

SEQ ID NO: 488 - DNA, 432 bp, Xenorhabdus bovienii
  Coding sequence Name=Xb4151_4152.C412.gene5.dna; Position on contig =4029..4460bp; Strand=-
atggcgcgcactcgtagtcgcaggcgtgagctaaaatccgagatcaatatcgtccccttactggacgtgttgctggtgttgctgcttatttttatggcaacggcaccgattatcacgcaaagcgtagaagttgacttacctgatgcggtggattctaaggcagtgtccagttctgataatccaccggtcattatggaagtttctggtattgggcaatacaatatgatcgttaatcaggaacgtctggaattgttacctgaacagcaaatcattgctgaagctcaagccttgatgaaaatcaatcctaaaacagttttcctgattggtggttctaaggaagttccttatgacgaaatcatcaaggcgctgaatatgcttcgtcaggcgggtgtaaaatcggttggtttaatgactcagcccattggggcctga

SEQ ID NO: 489 - DNA, 690 bp, Xenorhabdus bovienii
  Coding sequence Name=Xb4151_4152.C412.gene6.dna; Position on contig =4485..5174bp; Strand=-
gtgactgacatgaatatccttgatttatttctgaaggcgggctttttagtgcagttgatcatgttaatcttgatcggcttctctattgtttcttgggcaatcattattcaacgaacgagaattcttaatgctgccacccgagaagcggaagcatttgaggataagttttggtcgggaatcgaattgtcccgtctttataaagaaagtcagtcacgccgggattcgttaaacggtactgaacagattttccattctggttttaaagaatttgctcgtttgcatcaagtgaatagccatgtaccagaagctgttatcaccggggcttctcgtgccatgcgtatttcaatgaaccgtgaactggaaacagtggaaaatcacattccatttttgggaactgtgggttccatcagcccttatattggcctgtttgggacggtttgggggatcatgcacgcttttatcgccttgggtgcagtgaagcaggcaactttgcaaatggttgctcccggtattgctgaagccttgattgcaacagcaattggtctgtttgccgccattcctgcggtgatggcctacaaccgtctgagccagcgcgtcaataaactagaacaaatctacgataattttatggaagaatttctggcgattttgcatcgtcaggcttttactcctaataccaataagtcgtaa

SEQ ID NO: 490 - DNA, 396 bp, Xenorhabdus bovienii
  Coding sequence Name=Xb4151_4152.C412.gene7.dna; Position on contig =5171..5566bp; Strand=-
atgttgttccgttggcctatccgtgtttattacgaagacacagatgctagtggtgtggtctatcacgcgcaatatttagccttttatgaaagagctcgtactgaaatgttgcgtgaaaaaggcttccatcaaaagtatatgctggatgagcagattggctttgttgttagtcgcatgactgttgactaccggaaaccagctagattggacgacttgctggttgttgaaagcgaaattacgaatattcgtggcgcttctctgacatttactcaacgaattgttgattgtaatggtatagctatcagcagcgcagaatctctggttgtctgcgtgaattcatctcaaatgaagcctatcgcgcttccaaagtctattgtcgcggagtttaagcagtga

SEQ ID NO: 491 - DNA, 117 bp, Xenorhabdus bovienii
  Coding sequence Name=Xb4151_4152.C412.gene8.dna; Position on contig =5988..6104bp; Strand=-
atgtggtattttgcttggattctcggaacgctcttagcttgtagtttcgctatcattgcagccttggcacttgagcagagcgaatcaaaaaaagcgactgagagtggcgaaaaataa

SEQ ID NO: 492 - DNA, 1140 bp, Xenorhabdus bovienii
  Coding sequence Name=Xb4151_4152.C412.gene9.dna; Position on contig =6117..7256bp; Strand=-
atgcttgattatgatgtattacgatttatatggtggctgctgattggtgtgttgctgatcggtttcgcagtgactgatggtttcgacatgggagttggtgttctgctgcgtgtcattggtaaaaacgatactgaacgccgcattatgattaactcgattgctcctcactgggatggtaatcaggtttggttaattacagccggtggtgcgctgtttgctgcatggccgatggtatatgctgccgctttctctggtttttatgttgcgatgatcctcgtattagctgcactgtttttccgtcctgtcggctttgattaccgttcaaaactggaaaatagtcaatggcggaacatgtgggactggggaatagttattggtagctttgtaccgccgctgattattggtgttgcatttggtaacctgctgcaaggtgtaccgctggcgatagattcctacatgcgagtgtcctatgaagggtcattcttcgggttgttgaatccttatggcttgctggtgggcatcattagcttgatgatgatcgtgacacaaggtgctacttatctgcaaatgcgtacaaccggtgagttgcatctgcgttcgcgcactgccacacatgtttgcgcactggtaacggcagtcgccttcctgttggcaggcgtatggttgatttatggcattgatggttatgttgtgacaggaggattggatattaatggcccatctaacccactgcataaagaagtcgcacatcaggcgggggcatggctgattaactttaataaatatccggcgctgtgggcaataccggcattgggtgtcactcttcctctgctgactatgctggcgacacgaatggataaaggggggtgggcattcctgttttcatcattgaccgttgcctgcatcattctgacttcgggaattgcgatgttcccatttgtgatgccatcaagcattgatccgaatatcagcctgactatgtgggatgcgacatccagtcagtggacattgcaagttatgtttgttgttgcacttatcttcgttcctcttatcttgttgtacaccacttggtgttactataaaacttttggacgtttggataagaactacattgaaaacaacaaaaattcactgtactaa

SEQ ID NO: 493 - DNA, 1572 bp, Xenorhabdus bovienii
  Coding sequence Name=Xb4151_4152.C412.gene10.dna; Position on contig =7271..8842bp; Strand=-
atgtttgatattgtcgaactgtcacgattacagtttgccttaactgctatgtaccatttcctgttcgtgccattgacgctcggtatggcgtttttgcttgcgatcatggaaacggtatatgtcctttctggcaaacagatctacaaagatatgacaaaattctggggtaagttatttggtattaactttgctctgggtgttgcaacgggtttgaccatggagttccagttcggaaccaactggtcatacttttcacattacgttggtgatattttcggtgcaccgctggccattgagggcctgatggcgttcttcctcgaatctacattcgttggtctgtttttcttcggatgggatcgtctgagcaagaaacaacatctggctgttacttggctggttggactgggctctaacttctccgcattgtggattctggttgcgaacggttggatgcaaaacccgattgcatctgatttcaatttcgaaaccatgcgtatggaaatggtgagtttcagcgaattggtgcttaaccctgtggctcaggtgaaatttgtacatactgttgcggcgggttatgtgacaggcgcggttttcgtcttgggcatcagcgcttactatctgctgaaaggacgcgatattccgttcgctaaacggtcttttgcgattgcatcaagttttggtattgctgcgatactgtctgtcattgttctgggtgatgaatctggatacgaaatgggggacgtacagaaaaccaaactggctgccattgaagctgaatgggaaactcaaccacctccagcttcattcactctgattggtattccagatcaggataaaatggaaaataaatactctattcaaattccttatattctgggcctgattgccactcgctccactgatacgcccgttgtcggcctgcgtgacttgatggggcagcatgagcagcgtatccgtaacggcattaaggcgtacgaattactggaagagttgcgttctggcaatattgatccagcagttcgcaatgcatttaatgaaagtaagaaagatcttggttatggcatgctcttgaagcgttatacccaagatgtggcaaatgcgacagaagaacagattaaatccgctgcgaaagattctatcccgcgtgtagcgccactctactttgcattccgcattatggttgcttcaggttttctcatgttgctggttatcggtctggcattcctgagtgttatccgtaatcgaatcggtcagcagaaatggttgcttcgtgctgctctgttcagtatcccactaccgtggattgctattgaagcagggtggtttgttgcagaatatggtcgccaaccgtgggcgattggtgaagttctgccaaccgcagttgctgcttcgacacgcagtgttggtgatctgattttctcaatggtactgatttgtggtctgtacactttgttcttgatcgcagaaatgttcttgatgttcaaatttgctcgtctgggtccaagtagcctcaaaaccggacgttaccactttgaacagaaaactgcgtcttcagccaacaatattgagtaa

SEQ ID NO: 494 - DNA, 876 bp, Xenorhabdus bovienii
  Coding sequence Name=Xb4151_4152.C412.gene11.dna; Position on contig =9491..10366bp; Strand=-
atgtctattttaatcgataaaaacaccaaagtgatctgtcaggggtttactggcagtcagggtactttccattcagaacaagcgattgcttacggtactcaaatggttggcggtgtaacaccaggcaaaggtggtactgagcatctggggctgcctgtattcaataccgtacgtgaagcagtggaagcgactggtgcgacagcctcggttatttatgttcctgctccattctgtaaagactccattctggaagcgattgatgcaggcatcaaattgatcattactataacagaaggtattccaacgctggatatgctgacagtgaaagtaaaactggatcaagcaggtgttcgtatgatcggtcctaactgtccgggtgttattacgccggatgcgtgtaagatcggtatcatgcccggacatatccacaaggcgggtaaagtgggtattgtatcccgctctggtacattgacttatgaagccgttaaacagacgacggatgcaggattaggccaatctacctgtgttggtatcggcggtgacccaattccaggctcaaactttattgatattctgaaactgttccaagaagacccgcagactgaagctatcgtcatgatcggagaaattggtggtacagcagaagaagaagcggccgcttacattaaagagcatgtaactaaacctgtcgtcgcttacattgccggtgtgactgcacctaaaggcaaacgtatgggtcatgctggtgcgattattgcgggtggtaaaggaaccgcagatgaaaaatttgctgcactggaagcggctggagtgaagacggttcgtagtcttgctgacatcggtgatgcagtaaaagttttattagcaggcaactag

SEQ ID NO: 495 - DNA, 1167 bp, Xenorhabdus bovienii
  Coding sequence Name=Xb4151_4152.C412.gene12.dna; Position on contig =10366..11532bp; Strand=-
atgaatttacacgagtatcaggcaaaacaactttttgcacggtatggtttaccagcacctgctggttatgcctgtactacaccgcgcgaagcagaagaagcagcatccaagattggttcaggtccttgggtcgttaaatgtcaagttcacgcagggggtcgcggtaaggctggtggcgtgaaagtcgtcaacagcaaggaagatatccgtgcttttgctgaacaatggctgggtaaacgactggtaacttaccagactgatgcacagggtcagcctgttcatcagatcttggtagaaggagcaaccgatattgccaaggagctctatctcggtgctgttgttgaccgtggtacacgtcgtgtagtgtttatggcctctaccgaaggtggtgtcgaaatagaaaaagtggcggaagaaacgcccgaactgattcataaagcaatcatcgacccactggctggccctatgccgtatcaaggccgtgaactagcgtttaaactgggtttaaccagtaaacaagttggtcagttcactaaaattttcatgggattggcaaagctgttccttgagcgtgatctggctatggtcgaaattaaccctctggttatcacaactcaaggtgatcttatctgtctggatgggaaactgggtgcagatggtaacgcgatgttccgtcaggctgaattgcgtgaaatgcatgatccttcacaggaagatccgcgtgaagctcaggctgcacaatgggaactgaactatgttgctcttgatggcaacattggctgcatggtgaatggtgctggtttggcaatgggaaccatggacattgtcaaactgcacggtggtgccccggcaaacttccttgatgtgggtggtggtgcgacaaaagaacgtgttactgaagcattcaaaattatcctgtcagatgaaaatgttaaagctgtttttgtgaatatttttggtggcattgtccgctgtgacttgattgctgacgggattattggtgctgtggaagaagttggtgttcacgtaccggtagtggttcgtctggaaggaaacaatgctgagttgggcgcgaagaaactggcagacagtggtttgaacatcattgcagccagcagtttgacagacgcagctaaacaggcagttgcagcagcggggaataaataa

SEQ ID NO: 496 - DNA, 1215 bp, Xenorhabdus bovienii
  Coding sequence Name=Xb4151_4152.C412.gene13.dna; Position on contig =11695..12909bp; Strand=-
atgagtagcgtagaaattctggttccagaccttcctgaatctgttgcagatgccactgttgcgacatggcataaaaaagcaggtgacactgtacaacgtgatgacgtgttggttgaaattgaaactgacaaagtcgttttggaagtacccgcgagtgaagccggtgttctggaagctattttggaagaagagggtgccaccgtactgtccaagcaactgctcggtcgtatccgtttgagcgatagcacgggtattcctgctgaagtaaaagaaaaaacagaatcaacaccagcgcagcgccagactgcttctttggaagaagaaagcaacgacgtattaagtccggcggttcgtcgtctgattgcagagcatgatttagatcctgctgcaattaaaggcagtggcgttggtggccgtatcgttcgcgaagatgtggaaaaatatatcgctgcgcataaaaaagagagtggcaaagtggctgaagctgcaccagcacaggcttctcagctgccacatcgtagtgagaaacgcgttccaatgactcgcctgcgtaaacgtgttgcagaacgcttgcttgaagcgaaaaacaatactgcaatgctaacgacgttcaacgaagttaacatgaagccaattcaagaattgcgcaagcagtacggtgacgcgtttgaaaaacgtcatggtatgcgtctgggcttcatgtccttttatgtgaaagcagtcgttgaagcactgaagcgctatccagaagttaacgcttctattgatggcacggacgtggtttaccacaactattttgatatcagcattgcggtatctacacctcgtggtctggttacaccagtactgcgtgatgcagatgcactgggcatggcggatattgagaagagcatcaaagagctggctattaaaggccgtgacggtaagttgaccgttgaagaactcactggtggtaacttcacaattaccaacggcggtgttttcggctctctgatgtctacaccgatcattaacccaccacaaagtgcgatccttggcatgcacgctatcaaagatcgcccaatggcagtgaatggccaggttgagatccttccgatgatgtatctggcgctgtcttatgatcaccgtctggttgatggacgtgagtctgtaggcttcctggtgaccatcaaagaaatgctggaagatccgacacgtttgttgctggatgtatag

SEQ ID NO: 497 - DNA, 2808 bp, Xenorhabdus bovienii
  Coding sequence Name=Xb4151_4152.C412.gene14.dna; Position on contig =12923..15730bp; Strand=-
atgcagaacggcgcaatgaaggactggctggactcgagctttctggctggtgcaaaccagtcttacatagagcaaatctatgaagactatataaccgatcctaactccgttgatgcaagttggagagaaatattccaacaattaccggatatagggcttagcggggaacaacttcactcacagacgcgcgattacttccgtcgtctggcaaaagatgccacgcgttatcacacttcagtcagcgatccagcaatggatgcaaaacaagttaaagttttgcagctcattaacgcattccgcttccgcggccatcaaagtgcgaatcttgacccattgggattatggaaacaggaacctgtacccgatctcgatcctgctttccataatttaacaaaagcggattttgaagaaacgttcaatgttggctcgtttgccattggcaaagaaacactgaaactggctgatctatatgacgccctgaaacgcatttactgtggttcaattggtgcggaatatatgcatatcaccaatacggaagaaaaacgctggattcagcagcgtctggaatccattgcggtaggttcacagttcagtgcggatgaaaaacatcgtttcttggcggaactgacagcagcggaagggttagaacgctatttgggggctaagttcccgggggcgaaacgtttttcccttgaaggtggtgatgcgcttatcccaatgctgaaagaactgatccgccatgcgggaaaacagggtacccgtgaagttgtgctgggaatggctcatcgtggccgcctcaacgttctggtcaatctctttggtaaaaaaccagctgatttgtttgacgaatttgcgggtaaacataaagagcatctcggtacaggtgacgtaaaataccatcagggcttttcctctgatttcgaaactgaagggggattggtacatttggcgttagctttcaacccatctcaccttgaaattgtcagccctgtcgttattggttcagtgcgtgctcgccgtgaccgtcttgatgaaggccgaagcaacatggttctgccagtaaccattcatggtgacgctgctgtaatagggcaggggattgttcaggaaaccctgaatatgtctcaggctcgaggctatgaagttggcggtactgttcgcatcgtgattaacaaccagattggtttcactacctctaatccgaaagatgcccgttcaacgcaatattgtactgatattgtgaaaatggtgcaggcaccgattttccacgttaacgcggatgatccggaagccgttgcctttgttactcgtctggcgcttgatttccgtaataccttcaaacgtgatgtgatgattgatctggtttgctaccgtcgccacggtcataacgaagctgatgagccaagtgcaactcagccactgatgtaccagaaaatcaaaaaacagccgacaccacgtaaaatctatgcagataaactcatagcagaaggcctgctggcagctaacgatgttactgaaatggccaatctgtatcgtgatgcgctggatcatggtgagtgcgttgtgaatgaatggcgtcctatggggttgcactcatttacgtgggagccttacctgaatcacgaatgggatgaggactacccacataaagtggatatgaaacgcctgcaagatctcggcaaacgtatcagcaccattcctgctgaagttgaaatgcattcacgggttgcgaaaatttacggcgaccgtgaagaaatggctaacggcaataagctgtttgactggggtggtgcggaaacattggcttacgctactctggttgatgaaggcatccctgtgcgcctatcgggtgaagatgcgggtcgtggtacatttttccaccgtcatgccgttatccataatcagccgaatgctgctgtttatgtccctctggaaaatgttcacagtagtcagggtgtattcaacgtatgggattctgtactgtcagaagaagcagtactggcgtttgaatacggttatgcaacgacagaacctcgcgctttgacgatttgggaagcccagttcggtgatttcgctaacgttgcgcaggttgtgattgaccagtttatcagctccggtgaacagaaatggggccgtatgtgtggtctggtcatgctgttgccgcacggttatgaaggtcaaggtccagaacactcatcagcacgtttggagcgctatctgcaattgtgtgcagaacagaatatgcaggtttgtgtaccatcaactccggctcaggtttatcacatgctgcgccgtcaggctctgcgtggtatgcgtcgtccgctgattgtcatgacacctaaatcactgttgcgtcatccattggcggtctccagtctggatgaactggctaacggtaaattcgagcctgtgattggtgaaattgacgccttggatccaaaaggtgttaaacgtgttgtgctttgttccggtaaagtttattacgatctgttggatcagcgtcgtaagaacgagcaggctgatgttgccattgtgcgtgttgaacagctatatccattcccgcgtcagaacttgcagtctctgcttgagcagtatgctcatgttcatgacttcgtctggtgtcaggaagaacctctgaaccaaggtgcttggtattgcagtcaacataatttccgtgaagtgatcccatttggggcttctttacgttatgcaggtcgtccagcatctgcttccccggcagtgggttatacgtctgttcaccagcagcagcagcaagcgctggttaatgatgccctgaacgttgaataa

SEQ ID NO: 498 - DNA, 717 bp, Xenorhabdus bovienii
  Coding sequence Name=Xb4151_4152.C412.gene15.dna; Position on contig =16062..16778bp; Strand=-
atgaaacttgaattttcgatttatcgttataatccggatgtagataacgcaccccgtatgcaggattacacgctggaagccgaggaagggcgtgacatgatgctgctggatgcgcttatccagttaaaagagcaggacccgaccttatcattccgccgttcttgccgtgaaggtgtttgtggctctgacggtgtgaacatgaatggtaagaatggtctggcttgtgttactcccgtttcggtactgcgccggggtaataagaagattgtcattcggccgttgcctggtttgcctgttgttcgtgatctggttgttgatatgagccagttctacacgcaatatgagaaaatccgtccttatttgattaacgatggtaaaaacccaccagcgcgcgaacatctacaatcaccggaacagcgtgaaaaactggatggcctctatgaatgtatcctgtgtgcctgttgctcgacgtcttgtccatcgttctggtggaacccagataagtttattgggccggcaggtcttttggctgcgtaccgtttcctgattgacagtcgtgatactgaaacggcttcacgattggatggactgaatgatgcgttcagcgttttccgctgtcatagcatcatgaactgtgtcagcgtctgtcctaaagggttgaacccgacaaaagcgattggtcatattaagtcgatgctgctgaaacacagcgcataa

SEQ ID NO: 499 - DNA, 1767 bp, Xenorhabdus bovienii
  Coding sequence Name=Xb4151_4152.C412.gene16.dna; Position on contig =16816..18582bp; Strand=-
atgaaattgccagtaagagagtttgacgcggttgttattggtgcgggtggcgcaggtatgcgtgctgcactgcaaatttcacaaatgggtttatcttgtgccttgatctccaaggtattcccaacccgttcacataccgtttcagcacagggcggaattacggttgctctgggcaatacccatgaggataactgggaatggcatatgtatgacacggtgaaaggctccgattatatcggtgaccaggatgccattgagtacatgtgtaaaactggccctgaagccattctggaattggaacacatggggctgccattttcccgtctggataatggtcgtatttatcaacgtccatttggtgggcaatccaagaattttggtggcgagcaggctgcccgcactgctgctgctgctgaccgtacgggtcacgctttgttacacactctgtatcagcaaaacctgaaaaataacacgacggttttctctgaatggtattcactggatctcgtcaaaaatcaggatggtgctatcgttggttgtactgccatctgtattgaaacgggcgaaatcgtctatttcaaatccaaggcaaccattctggcaactggtggcgctggtcgtatttaccaatccacaaccaatgctcatatcaatactggtgatggtgttggtatggcgctgcgtgccggcgttcctgtacaagatatggaaatgtggcaattccacccaacgggtattgcgggtgccggcgttctggtaacagagggctgccgtggtgaaggtggttatctgctgaataaagatggtgaacgcttcatggagcgttacgcacccaatgctaaagatctggcaggtcgtgatgtggttgcacgttccatcatgatcgaaatccgtgaaggccgtggctgtgaaggtccttggggacctcatgcgaaactgaaactggatcatctggggaaagacgtattggaaacccgtctgccgggcattcttgaattatcccgtacctttgctcacgttgatccggtgaaagagccgatcccggttattccaacctgtcactatatgatgggagggattccaaccaagatcacgggtcaagcgctgactgtcaacgaaaaaggtgaagatgtcatcattccaggcttgttcgctgtaggtgaaattgcctgtgtatctgtccacggagcaaaccgtctggggggtaactcattgctcgacctggtggtattcggccgttctgctggcttgcacctgaaagagtgcctgatggagcagggaaccagccgtgacgccagtgagtctgatgttgatgcagcactacaacgcctgaaccgctggaataatacccgttctggtgaagatccggttgaaatccgtaaggcactgcaagcgtgcatgcaaaacaacttctcggtcttccgtgaaggtgatgcgatggcaaaagggctggaagagctgaaagtgattcgtgaacgtctgcaaaatgcccgtctggatgatacttcatcagaattcaatacccagcgcatcgaatgtctggaactggacaacctgatggaaaccgcatactcgaccgcagtgtctgcgaattatcgtacagaaagccgtggtgctcacagtcgttttgactacccagagcgtgacgatgcgaactggctgtgccatagcttgtatttaccgcgaactgagagcatgactcggcgtgaagtaaacatgcagcctacgctgcgtgaagctttcccgccgaaagtgcgttcttactaa

SEQ ID NO: 500 - DNA, 348 bp, Xenorhabdus bovienii
  Coding sequence Name=Xb4151_4152.C412.gene17.dna; Position on contig =18583..18930bp; Strand=-
atggtaagcaacgcatccgcattgggtcgcacgggtattcaggactggctgctgctgcgtgcatctgcaatcgttattgttttatacgtcctttaccttgttggttttgtagcaacaacgtcagacatcacctatgaagtctggcgcagtttcttctcttcatctctcactaaagtgttcaccgtgctggctctgctttctatcctggttcacgcatggatagggatgtggcaggtgctgacggattatgtcaagccactcgcactgcgtttagtgctgcaactggtcattattgttgcgttgttggtttatttgatttacggaacaattgttgtgtggggtgcataa

SEQ ID NO: 501 - DNA, 390 bp, Xenorhabdus bovienii
  Coding sequence Name=Xb4151_4152.C412.gene18.dna; Position on contig =18924..19313bp; Strand=-
gtgggcaaaattgtgaaaaaacaaagacctgtcaacctcgatctgcggacgattaaccaacccgtctccgcgataacttcgatcttgcaccgtatctcaggcgtcatcacctttattgcagtcggcattctgctgtggttgctggggatgtcactgtcttcgcaagagggcttcctgcaagcatctgaaatcatgactggcttcttcgctaaatttatcctgtgggggatattgacggcgttggcttaccatatttgtggtggtattcgccatgtattgatggattttggtttcttggaagaaaacctcgctaccggtagtgcttctgccaaagtagcaatagtaatcgcggttattctgtctattctggctggggtattattatggtaa

SEQ ID NO: 502 - DNA, 1284 bp, Xenorhabdus bovienii
  Coding sequence Name=Xb4151_4152.C412.gene19.dna; Position on contig =19940..21223bp; Strand=+
atggctgataaaaaagctacgttgaccataagtggtgcagctgctatcgaactagacgtactaacgccgaccctaggttctgaagtgattgacgttcgtaccctcggctcaaagagtttctatacctacgatcctggctttacttctacggcctcctgtgaatcaaaaatcacctatattgatggcgacgaaggcattttgctgcaccgtggtttcccgatcgatcagctcgcaacgggatcaaactatctggaagtctgttatatcctgctgtatggcgaaccacctacgcctgaagagtatgaaacattcaaaaaaacggtgattcgtcatacgatgatccacgaacagatcacccgtctgttccacggtttccgccgtgattctcaccctatggccgtactttgtggtgtgacaggtgcactggctgccttctaccatgatgcactggatgtccataaccctcaccaccgtgaaattaccgcttaccgtctgctgtccaaaatgccaaccgtagcggcaatgtgttacaaatattccatcgggcagcctttcgtttacccacgtaacgatctttcttatgcagccaatttcctgcacatgatgttctctacaccttgtgaagaatataaagtcaatccagtgctagaacgtgccatggatcgcattttcattctgcatgcggatcacgaacagaatgcttcaacttcaacggtacgtaccgcaggttcttctggtgctaacccattcgcctgtattgcagcgggcatcgcatccctgtgggggcctgcgcacggtggcgcaaacgaagcctgtctgcgtatgctggaagaaatccagactgtcaaacatattcctgaatttatcgctcgtgccaaagataaaaacgattctttccgcttgatgggctttggtcatcgcgtttataaaaactatgatccacgcgcgacagtaatgcgtgaaacctgccatgaagtactgaatgaacttggcctgaatgacagcctgctggaagtcgcgatggagttggaacgtatcgccctgaatgatccgtacttcattgagaagaaactgtacccgaatgtcgatttctattccggtattatcctgaaagcaatgggtatcccatcctccatgtttaccgtgattttcgccattgcccgtactattggctggattgcacactggactgaaatgcacgatgaaggcttgagaatcgctcgtccacgccagctttatactggccatacccaacgtgatttcaaaagtcagttagagaaataa

SEQ ID NO: 503 - DNA, 786 bp, Xenorhabdus bovienii
  Coding sequence Name=Xb4151_4152.C412.gene20.dna; Position on contig =21326..22111bp; Strand=-
atggcctggctgcgacaaagtgatcattttgatcctgatggtttgaaatatagttcgaatgtgtccgtgataggtattgcggcagagatggggcagtacgattcaggctttcatcagcatgatatggggcaactgttgtttactcagcaaggttgtatcaagatcacgttggcaaatcagctctctatcctgcctccgaccagagttgcatggataccgccaaagacactgcatcgggcggaaatgcgtggctccatagggtatcgctccatttatctggatatgtcagggatagaatggatttcgaagcagagtgaaatattggaaaccacaccattgctacaggcgattttagaacgtattgcaatatctccttttgatactgattggcgtcagggaaagggagcgcatttattggcggtcttttttgatgaaatgagagaggcaggtaaagagccgactttattaccgttaccttctgatcgacgtctggcgcgtttgccgtttgatcaattgcctccgccattacaaatgcttgccactcatattggcgccagtgagaaaactatcacccgaatatttctgcgtgaaacgggcatgaattatcaacagtggcggcagcaatggcggctgataaaagcaattgagttacttgctcaggataaaactctgtcttatgttgcacaggagctgggatttgctaatgatagtgcgtttgtgacattttttcgcaaaaatatgggaaaacctccgagggagtatatggccggtgcttgtcggcgataa

SEQ ID NO: 504 - DNA, 1164 bp, Xenorhabdus bovienii
  Coding sequence Name=Xb4151_4152.C412.gene21.dna; Position on contig =22186..23349bp; Strand=+
atgctaatctttcgggctataaatagctcatcagaagaaaatatcatgcacaccagaccatcactttggctcgctatcactttaatgatgtttccacagatcgtggaaaccatttatagccctgcactaaccaatattgccagtggattttctgtcaatgcaacacaggcctcccaaaccctgtcattctatttctttgcttttgccatcggtattgtcgtatggggtcgcatgtgtgatgttattggcaggcgtcctaccatcattgcaggattattactctacggtgcagcttccttgctggcactgctaaccgaacacttctggctattactggctaccagaatgttatccgctttcggtgcatctgtcggttctgtcggtacgcaaactattatgcgtgatacttaccgcagcgaagaattgtcgcgtgttttttccatcatggggatcgccttggccgtcagccctgcgattggcatgatcagcggctctatactaaatcattttgggggttataaagcggtatttgccgggctggccattctggctgttatcctgatgagctggtctgttattcgcttaccggaaacccggccagtaaatgtgccaaaaattgccctatttggcaccgccgtcaccatgttcaaagatatttcgatttggcgaaatgcgtttctcatcgcatttttcaatatttgtctgttcagctattaccagttagctccctttcgctttcaacaattcggactatcacaggcacagttcggttataccggcctgctattcactttcggcgttgggctaggttcactactgaacaagcatctgttaaaaaaacagtggctatcggcaaaattaatttctcttgccgcgatgattgtttttctgagcgggatcggcgtttacctgctcgaaaatagctggctatttatctttcccatgctgggcattgttaccgcttacggccttgccattcccaatattttagcatcggcgctgaacaactatgccgatcggctgggtacagcaggcgccttactggggctattgtattatctcttgctgggcggcggtttggcgctggctggctggagccaggcattgggcagcatactgatctgctgtggcgtatcaaccgtgcttttaacaagaaaatggtga

SEQ ID NO: 505 - DNA, 777 bp, Xenorhabdus bovienii
  Coding sequence Name=Xb4151_4152.C412.gene22.dna; Position on contig =23440..24216bp; Strand=-
atggcgaaagcgctaaatgatgggggaagtgtgatgaacaatgttgaattggaacatgtgcttaatacggaactgaatgttcgtgaatttcaggattatgcccccaatggtttacaggtggaaggccgtccccatgttcagcggattattaccggtgtgacagcatgtcaggctctgttggatgaggcggttcgtcttaaagctgatgcggtcatcgttcatcatggatatttttggaaaaacgaatcacctgttatccgtggcatgaaacgccgtcgtctacaaacactgctcagcaatgatatcaacctgtatggttatcatcttcctttggatgctcatcctacattgggtaacaatgttcagttggcgcgtcagatgggggtaaaaatcatcgggcagattgaccccttgcttcctcatggcgcatttgaccaaccgattacccccacagaattgactgagcggcttgaaaaaagattagaacgcaaagtactgcattgtggcgataatgcaccggaagaaattcgtacattggcatggtgtacgggaggtggacagagttttattgagcaggcggctgagtttggtgtcgatgctttcgtgacgggggaagtgtcagagaaaaccatccatgttgcccgtgagatggggctacatttttatgcggcagggcatcacgcaacagagcgttatggtatcaaagtactcggtgaatggctggcaaatcattatgggttggatgtcacttttgttgatattcctaatccagcttga

SEQ ID NO: 506 - DNA, 210 bp, Xenorhabdus bovienii
  Coding sequence Name=Xb4151_4152.C412.gene23.dna; Position on contig =24431..24640bp; Strand=-
atgtctacatatcgtgaatattcttggcatcaggttctcttgcggcgtactggcgctgtaacattgggcgtcattgcacttcctgttatgctatttcgtcaggatcgtgcccgtttttacagctatctgcgtaaggtatggataaaaaccagcgataaacccgtatggctggagagttcggaaatggccgcaggtattcgaaaccgctaa

SEQ ID NO: 507 - DNA, 1254 bp, Xenorhabdus bovienii
  Coding sequence Name=Xb4151_4152.C412.gene24.dna; Position on contig =25068..26321bp; Strand=+
atggtagcctccgcttttttgctgattaccagtttcttggtcattctctttatattgagcagacccctcggcagtctgatcgcaaatctggtcgaaggagaattaccccgctggctgacaaatgcagaaaccagcctgtggcgttgctgtggcttgcaaaagcccggcggcaacgtcaaagagatgaactggtggcaatatgctctcgctatcatcacattcaacatcatggggttgctgctactctttatgctgttgataagccaagaacatctgccactcaatccacagcattttgccggtatgaaatgggatctggcactcaacaccgcaatcagttttattaccaataccaactggcaggcctacagcggtgaaaacaccctcagttacttaagtcaaatggcgggtttgactgttcagaatttcctgtcggccgcaacgggaattgcagtggctttcgccttaatgcgggcattttcccgtcagggcgtgaaaacactgggcaatgcctggatagatattacacgcattacactctatctattgctcccgctgtcgatcatcattgcacttatcttcgtcagtcagggcgttatccaaaatttctccccctatgtacttgtccacacccttgaaggacaacaacaactgatccccatggggcccgttgcctctcaagaagcaataaaattattgggtacaaatggcggagggttctttggggcaaactcagcccacccctttgaaaacccgaatgccctcagtaactttgtgcaaatccttaccatattcctgatcccctgtgcactgtgtttcgcgttcggtcttgtggtcggggataatcggcagggacatgctttactatgggcgatgacgattgtctttatcatcgccgttacgattgtgatctatgccgaaatcatgggtaatccccacttcatccaggctggtgccagcagtaatctgaacatggaagggaaagagtcccgctttggtatccttgcctcctcactttatagcgtcgttacaactgcggcttcctgtggggctgtaaatgcaatgcacgattccttcaccgcgctgggtggcatgataccactctggttgatgcaaattggtgaagtcatctttggcggtgtaggctccggcttgtacgggcatgttgctatttgtcctactggctgtgtttattgccggtttgatgattggccgcgctccggaatacttgggcaagaaaatcgatgtccatga

SEQ ID NO: 508 - DNA, 546 bp, Xenorhabdus bovienii
  Coding sequence Name=Xb4151_4152.C412.gene25.dna; Position on contig =26230..26775bp; Strand=+
atgttgctatttgtcctactggctgtgtttattgccggtttgatgattggccgcgctccggaatacttgggcaagaaaatcgatgtccatgacatgaaaatggtcgcgctggcaattttggttacgccctcccttgtcctgttaggaaccgctctggcaacttcaatcgatgcaggacgcgctgcgatcatgaaccccagcgcccacggtttcactgaagtgctttatgctctctcatccgctgccaataacaacggtagtgcatttgctggtctgaatgccaacagtgtgttttataacctgctgttaggggcaatcatgtttctagggcgctttggtgtgatttttccagttctggccatcgctggctccatgattagcaaaaaacgccagcctatcagcagtggaacactgccgactcacggctctctattcactggattactgattctggtggttttgctgatgggtgcactcacctttattcctgcgctggcgcttggccctgtcgcagaacatttacaactttggcaagcaccacgataa

SEQ ID NO: 509 - DNA, 2067 bp, Xenorhabdus bovienii
  Coding sequence Name=Xb4151_4152.C412.gene26.dna; Position on contig =26796..28862bp; Strand=+
atgaaagacaaacatcaagcattatttgaacccgctttaatacgccatgcacttatcgacgcagtgaaaaaatgccatcccgctatccaatggcgtaatcccgtcatgtttgtcgtctatctgggaagctgcctgaccaccgtgttgtggcttgggatgttaacagaacagcttaccggtaatgcactttttaccggctccattgctttatggttatggttcactgtactgttcgctaattttgccgaagcactggcagaaggccgcagccaagcccaagcgtccagtctgaaaggcgtaaaaaaaaccacgtgggcgaccagactggcttccgccagccatgatgcagcaaaggaaaaagtcacttcagaccatctacgcaagggcgatattgtgttggtggaagtgggcgaaattatcccctgtgatggtgaagttcttgaaggaggggcttccgttgatgaaagcgccattacaggagaatcggctcccgtgatccgcgaatctggcggtgattttgcttcagtcactggcgggacacgggttttatcggattggctgattatcgaatgttcggtcaatccgggagaaacctttttagacagaatgatttcgatggtcgaaggtgccaaacggcgcaaaactcccaacgaaattgctctcactattttgctcacggcactgactattattttcctgctgtcctgtatcagtctactgcccttttccttgttcagcgttcaaaccaatcaatcaggcgatcccatcagcatcaccgtgctggttgccctgttagtctgcctgatccccaccaccatcggcggattactttcagccattggcgttgcaggtatgagccgcatgttgggtgccaatgtcattgctaccagtgggcgcgcgattgaagctgccggcgatgtggatgttttattactggataagacgggaaccattactctcggtaatcgtcaggcatcacagtttttacctgcaccgggtgtaaccgaagaacaactggccgatgctgcccaactttcctcactcgctgacaaaacaccggaaggacgcagcatcatgattttggcaaaacagcgcttcaatatgcgcgaacgcgatcttcgcgcactcaacgcgacattcattcctttctcagccatgacgcgcatgagcggcgtcaatataggcacccgtatgatccgcaaaggcgcagtagatgccatccgacgttatgttgaggccaatcacaatcaatttcccgatgccattgatctattggtgcagcaggtcgccagtaaaggtgcaacaccattggtcgttgcggagaatcagcgtgttttgggtgttgtcgctctgaaagatattgtgaaaggcggcatcaaagagcgtttcagtgaaatgcgcagaatgggaatcaaaacggtgatgattacaggtgacaatcacctaaccgccgctgcaattgcagcagaagccggtgttgatgattttctggcagaagctacgcccgaagcgaagctcgccctgatccggcaatatcagtctgaaggatgtctggttgctatgaccggtgacgggacaaacgacgcccctgcgctggctcaggcagatgttgccgttgccatgaattcagggacacaagccgcaaaagaagcgggaaatatggtggatttggactcgaatcctactaaattgattgaagtggtgcatatcggcaaacagatgctgatgacccgtggctccttgaccacatttagcatcgccaatgacattgctaaatattttgccatcattcccgccgcatttgcggtcacttatccccagcttaatgccctgaacatcatgcatcttcattcaccggaatcggcggtgctgtctgccgttattttcaacgcgataatcattatcgttctgcttcctttggcgctaaaaggcgtcagttaccgcgcgatgaacgcactgtcactcttgcgccgaaatctttggctatacggccttggtgggttgctcatcccctttgtcggcatcaagctcatcgacatgttgctcactgttctggctttcaaataa

SEQ ID NO: 510 - DNA, 579 bp, Xenorhabdus bovienii
  Coding sequence Name=Xb4151_4152.C412.gene27.dna; Position on contig =28873..29451bp; Strand=+
atgatctggttacgcgcctccatcgtcctactaacattcctgactctaatcactggcatcgcctatccgttgctgataacaggcatcgcaaacgccttgtttccccatcaggccaaaggtgccttgattgaacataatggcaaatgggttggttcggaattaatcggtcagtcatttacccaagccatctattttcatggacgtccgtctatgacgctggaacacccttacaacgccctgtcatctgggggaagtaattttgcaacaaccaatcccgccttgactcaccagatataccagcggattactcaggtacgtttattcaatcattcagaaaacagtgccattcctgtcgatctcatcaccgcatccggcagtggtttagatccccatatttctcccaatgcggctgaatttcaggcccaacgtgtcgccacagcccgccacttatccataaatgtgattaataaattgattcaagcttatactgcatacccgccactgaaatatatgggtgaacccgtggtaaatgtactggaacttaatctggcactagataacctgaaaccacaaggctga

SEQ ID NO: 511 - DNA, 2718 bp, Xenorhabdus bovienii
  Coding sequence Name=Xb4151_4152.C412.gene28.dna; Position on contig =29458..32175bp; Strand=+
atggatcagattgaacccctgcgccccgatccggatgacctgctggcactagcaaacgaaaaaccccgtggcaaactaaaaatatttttcggtgcctgtgcaggagtaggtaaaacttatgccatgttacaggaagcgcagcggctgctgtctcaggggctggatgttattgccggcgttgtcgaaacccatgaacgacaagaaaccgcggcactgctgacaggtttacctcaattgccactgaagcatattcgctatcatgaacgcaggattgccgcatttgacattgatgcagctattgcccgttatcctgccattatcctgatggacgaactggccttcagcaatcctcacagcagccgtcatcccaaacgttggcaagacgtggaggagttgctggaagcgggcatcgatgtcctgaccaccatcaacgtgcaacatctggaaagcctgaacgatgtggtcggtgccattaccggcattcgcgttcgcgaaaccattcccgatcacatatttgatcatgccgatgacgtcgtgctggttgatattccaccggatgatctgcgccagcggcttaacgacggcaaagtctatatttccggtcaggccgagcgggctattgagcatttcttccgcaaaggaaacttgatcgcgctgcgtgagttggcattgcgccgcacggcagaccgagtcgatgatcagatgcgtgctttccgtgatacacggggaaaagaaccagtctggcacactcgggataacctgttgctgtgcattggctgtaatgctggcaatgaaaagttgatccgaaccgcagctcgtctggcggcaaagctgggttgtgaatggcatgccgtttatgttgaaacccccaaattacaccgactgccagaaatcaagcggcgtaccatcctgaaagcactgaagctggcacaggagctgggggctgaaactgccacgctttccgatcctcatgaagaaagagctattctgcgctacgcaagagagcacaatctcggcaaaatccttgttggccgctatcatggctcacattcgacttcatttagtgataaatggcttggttttaaatggcgccctgatttcgttgaacgtttaggaaaactggggcctgatctcgatctcatcattgttgcactggaagacaaaaaacgctgggataaagaacaacgggataaccgggcattccatgaaaaatggcgcatccagatccacggcttcctcatagcgattatactctgcaccttaatcaccctgttctcgcatacctttttactcacccttgataaagccaatctggtaacactctacctgcttggcgtcgttattattgccctgttttatggccgctggccttctgtctttgccgcctttatcaatgtcatcagtttcgacattttttttgtccagccgcgatggtcactggctgtcacagacatgcaatatctgcttacctttaccgtgatgttgatcgtaggggtggtcgtaggaaacttgactgcgggtatacgctatcaagccagagtggcccgctaccgtgaacagcgaacgcggcacttatatgaaatcacgcgtgagctcagcagagctttgaatgaagaagacgttgcccgcatcagctatcactttttatccaacagctttcaggcaaaaacaggcttgttgctgccggataacaacgcacgtttatatcaggtgaagtccaataacggcggacaaatgcagatcgatgaggcaatagctaaatggagttttgacaaaaaacagcctgctggggcaggaaccgatacattacccggcgtaccctatcagctatttcctatcgccacggcttcacaggtatttgctgtccttgctatcgaatcacctaacttgcgccaattattagtaccggaacaacaacggttattacaaacgtttaccgggcttatcgccaacgcactggaacgtttgcacctttcccgccgtgcggaatccgctaaactagaaaccgaacgggagcaattacgaaactcactactggccgcactttcccacgatttacgcaccccgttgactgttctgtttgggcagacagagatactgatgctggatttatccactgaaaattcgcctcatacccaacaggttaaccaaattcgtcaacagatcctcagcacctcacgtctggtcaataacctgctggacatggcacgtattcaatccggcggtattcagcttaatcttgagtggcattcactggaagaaattgtcggtagtgccctacgctcattggaatataccctcagccgctacacggtagaactttccctgtcagccaacttattactgcattgtgacgcatgcttactggaacgagttttcatcaatctgctggaaaacgccattaaatatacccatgagcagacaccactaggcatacgggcaacgactgaatacaaacaggtacatattgaaatttgggatgcaggctccggtattccacaaggacaagaacaagtcattttcgacaaattctcacgcgtccgtaaagaatccgccattcccggtgttggattagggctggcgatttgccgtgccatcattgaaattcacggtggccatatatgggcagctaacaataaaaaaggtggagccagtttccactttgttctaccgttagaagaggtgcccaaaattgaagaagtcattgaggaaatgtga

SEQ ID NO: 512 - DNA, 666 bp, Xenorhabdus bovienii
  Coding sequence Name=Xb4151_4152.C412.gene29.dna; Position on contig =32199..32864bp; Strand=+
ttgatcgttgaagatgaaaaagagatcaggcgtttcgtcagattggctctggaaggcgaaaactggcgagtatttgaatgtgacacactgaaacgaggtttaattgaagcagccacccgcaaacccgatttgctaatccttgacttgggattgcccgatggtaacggcattgatctgatccatgatatccgccaatggagtagcattccaatcattgtgctttccgcacgcaataatgagcaggataaagtcgcggcgctggatagcggtgctgacgactatctgagcaagccttttggtatcaacgagctgcttgccagagtcagagttgccctgcgtcgcgccaccaaagccaatcagcccgatccgatgattcattttgccgatatcagtgttgacttaatcaatcgtcgggtcttaaaaagccagaaggagcttcatcttacgccgacggaatatcgtctgctgaccgaattgctgaccaacagcggcaaggtgctgacccaacgctatttgctcaatcacgtctgggggccacattatatcgagcataaccattacctgcggatatatatggggcatctgcggcaaaaactggaagaagaccctgcccgtcccaagcatttactgacagagactggcgtaggttatcgatttatgccctga

SEQ ID NO: 513 - DNA, 2895 bp, Xenorhabdus bovienii
  Coding sequence Name=Xb4151_4152.C412.gene30.dna; Position on contig =32885..35779bp; Strand=-
atggaatctcagttttggaaaaaggcttacctgatcctattaggcagtctattttctctactacttacaagctgtgataacaaaaatgatttacccaaaatcgccgaggaaccgatggctcatatcccgaacaaaataccaactgaagccactattgctgacgatcttcaggcttcagcacattgggtcgataaacggacgctattatggccagagggagcagataagcctcatgtccgtttatattacaatcggtataacaaagtagaggtgaatgacgaaggaaactttactgatagttatctggtgctgacaccgacgactctgagcaaaaagacagccgaaagattccctcatttagcggagctgcccgcattccaattgccagaaaacacggatgttgatcggctaatcaccggtgaactggtggcattggcgaccaatgaagaaggcttgttattatcggcgactcaagtacaaattgccggtgtgttggacgaccgctttgccggcactgcggaaacactggaatatggcgcactgataaacgacacagaggtgactttccgcttgtgggcgccgacggctcaaaatgtgggtctggttatttataatgaaaataaacaggccatcgccaatcatataatgaatcgtgatgcggcgagtggctcttggtcatggcagggtgatacaaatttgatcggggcttactaccgttatgctttaaccgtgtatcatccgtattcccgcaaggtggaacgctatgaggttaccgatccctattctcacagcctgtctacgaattcggaatatagccaggtcatcaatctggatgacgaagcactgaagccacaaaactgggatgatctgagcatgccgcatccgcagaagacaccggcagatattgcacgtatgaccctctatgaagcgcatatccgggatctctctgttgcggacaacacagtgccacaagcttggcgtggtaaatatctggctctcacggctaacagcagcgatatgttcaaacatctaaaggcactgagtcaggccggaatgacccatatagagctgttgcctgtgtttgatatcgcttctattgatgaatttagtcgtaatgtggctgatcttaatcagtccttcaatcggttatgtcaagtcaacacaacggtgaaaaatagccgcttcgctgattattgcaatcgttccatgaccgtgagggaagtattgcaggcgttacaacgcggtgatagtgccagcaatccgcaagtacaagagttaaataaaatgcttgcagaaactgattcttataactggggctacgatccgttccattactcagtaccggaaggctcttatgccactcatgcagaaggctcagtacgtattaaagagtttcgtaccatggttcaggccatcaagcagcaactggggatgaatgtgatcatggacgtcgcgtataaccataccaatgccgccggccccacacaccgaacttcagtactggataaagtcgtgccctggtattatcaccgtttggatgaaattacgggtaatgttgaaaataatacctgttgctctgataccgcaccagaacaccggatgtttgccaagctcatcgaagactcattagtgacttgggttaagcactacaaaatagatgcattccgatttgatttaatgggctaccatcctaaggctcagattgtctcggcactggcaaaagtccgtgcaattaatccatcggtctattttttcggagagggctggaattccgggcaggatgatcgatttgagacggcttcacagattaatcttaaaggctccggtatcggtactttctcggatcgattgcgagatgcagtacgcggtggtgggccgtttgattctgctgataatattcgtattaatcagggaatgggcaacggtgcgggaacattacctaacgaaattgcccgattagatgcgaatgaagctcgtcatttggcggatctgattcgtctagggatggcgggtaatctggctgactttgccatgatcgataaagatgggaaagtgaaagcgggtcgggaaattaactacaaaggtgtcgctgcgggttatgccgctgatcccattgaagtgattaattatgtttccaagcacgataaccagacattatgggacatcatcagctacaaagcggcatacgaggcagatctggcgacaaggctccgtatgcaggcaatctctctttccacagtactcctcgggcaagggctggctttcgatcagcaagggtcggaattactgcgctcaaaatcgtttactcgtgattcttataatgcaggggattggtttaaccgtgtcagttatacctacaaagataacaactatgatgtaggtatgccggggaaacgggatgacggtggaaattatgcgctgattcatcgagtgaaaaatcaggtgaaaaaaccaggccaaagtgagttattacagatgatggctttctatcaggaactgttacgtctgcgtcaattttcacccttgatgacccttggtaagggggaatccgtcaagcaacgtatcgattttcgtaatgtggggccacatcagcaactcggattactggtcatgactattgatgatggtaacactaccgatgatgatcgtgatttgcggtttgatggtttagtggtggtgattaatgctgcgtcaaaatccgtcactgtaagagatctcaatactcatggtttgaaattaaatgatattcaaagcagattagggaatgcatctttagctgccgggatcaaaataaccgaagatggcatggtgacaatgccagcttggtcagccgcggtgctggttttaccacagaaaggtatccgaggtacgggtttacctgtccgtagaaagtaa

SEQ ID NO: 514 - DNA, 174 bp, Xenorhabdus bovienii
  Coding sequence Name=Xb4151_4152.C412.gene31.dna; Position on contig =35812..35985bp; Strand=-
atgttgctgcggctttttgcttccggtgagtggggttatcccaaagcaaccattaaagcccccgcagtaaaactccgcctattttctcctccctccctttataaactagggaggatgcttaatcgtttgagacagcatttaatatctcatctcatttttttaaccctaaaatag

SEQ ID NO: 515 - DNA, 1641 bp, Xenorhabdus bovienii
  Coding sequence Name=Xb4151_4152.C412.gene32.dna; Position on contig =36024..37664bp; Strand=-
gtggcaattcatccaagagccgggcagcctgcccagcagcatgatttaatcaatattgcacagctcacatcccagtattataccctacagccccatcccgaaaatccggctcatcaggtcaagtttggtacttccggtcatcgtggcagttctggccgcaacagttttaatgaagcgcatattctggcaatttctcaggcgatagtggaagtccgtgcacagcaggggattactggtccatgctatgtaggcaaagatacccacgcactttctgaagcggcctttatttctgtgctggaagtcctgatcgcgaatggtgtggacgtgattgtgcaggaaaataatggttttacgccgactcctgctatttcccatgctattttgtgctacaaccgtcaggggaaaaaccgggcggatgggattgtgattacgccatcccataatccgccagaagatggcggtattaaatataaccctcctaatggtgggcctgccgatactgatttaacttccatcattgaaaagcgtgccaacgcattactggcgaatgacctgaacggggttaagcgtctgccctatgagcgggtactgaaaagtgaatatctgcatccacagaatctggttgatccttatgtgacatccttgggggatgttgtggatatggcggccatacagcaggcagggctgaaaatcggtattgatccgctgggtggttcgggtattgcttattggcagcggatcggtgagtactacaatctcgatttaacgctggtcaatgataaggtcgatcagacattccgtttcatgacgctggatcatgacggtgtgatccgtatggattgctcatcacgctgggcgatggccggtctgctggagctgcgcggtaagtttgatttagcttttgctaatgaccctgattacgaccgccacgggattattactccagtcggtttgatgaatcccaaccattatctggcaacggctgtggattatttattccgccatcgtccacaatggtctgaaaaagttgctgtgggtaaaactttagtttccagtgccatgatcgatcgcgtagtcgcggatctgggacgcgagctgctggaagtgcctgtcggctttaaatggttcgtcgatgggttatatcgaggcgagctgggctttggtggtgaagagagtgctggcgcctccttcctgcgttttgacggtacgccgtggtcaacggataaagatggtattatcctctgcctgttagcggcggaaatgacggcgactaccggagagaatccgcagcagcgctatgacaaactggctgcacgtttcggtacgccaagttatagccgtattcaggctccggcgagccatcagcagaaagccctgctgtccaaactgtcaccggaaatggtcaaggcgaacacactggccggcgatcccatcactgcacgcctgactaccgcttccggtaatggtgcttctattggtggcttaaaggtgatgagcgacaacggctggtttgcagctcgcccttcaggtacagaagaagcctacaaaatttactgtgaaagtttcctcggcgcagaacatcgcgagaagattgagcaggaagcgctggaaattgtcaatcaggtgtttaccgccggttga

SEQ ID NO: 516 - DNA, 534 bp, Xenorhabdus bovienii
  Coding sequence Name=Xb4151_4152.C412.gene33.dna; Position on contig =37755..38288bp; Strand=-
atgaaaacgatagaagttgatgaagacctttaccgctttattgcaagccaaaccctgcatatcggtgaaagtgcatctgatattttgcggcgcatattgaaagtggacgccgggcagccagtacaaactacaccgcctgtcagagaatctgtctctgtcagcaaagtgccggctgcacgctcccgtgatgttgttcgcgttgttcgtgaattattgctttctgacgagtatgctgaaaagaaaaaatccgttgagcgtttcatgtcgattctgtccactctgtacagcttgaacagcgaaagctttgcgaaaacaacagaagccatgcatggtcgtacccgtacctattttgcgggaagtgagcagaccctgctggccagtggtaaacacaccaagccacgtcatatccccggcacacctttctgggttatcactaataccaataccggccgtaaacgcagcatggttgaacacgttatgcaggatatgaaatttccggcaaatgtgattgaaaaagtgtgtggcactatttaa

SEQ ID NO: 517 - DNA, 780 bp, Xenorhabdus bovienii
  Coding sequence Name=Xb4151_4152.C412.gene34.dna; Position on contig =38549..39328bp; Strand=+
atgaactcaaataatcaattaaattatcattttcacacgccggaaaacccacagtcatcaacccccattgtcttgattcatgggctttttggcgatttgagcaatttagggatattggggcgtgatttgcagcaacattatccggtcattcagattgatgtgcgtaaccacggtatttctccgcagatggaaaacatgaattaccgcgatatggcacaagatgttttatctctccttgatgaactgaatgtggcaaaagccattattatcgggcattcaatgggaggtaaaatcgctatgaccatgacggcggttgcaccggagcgtattgaacaaatcgtagttatcgatatagcgccagtgacttacctgactcgccatcacgacagcattttttctgcactgaaccaagtcaaagaagcaggagctcagactcggcaggccgcgacggaagttatgcggaaggatattcatgaggatggcgtgattcaatttctgctgaaatccttccgtcaaggagaatggaaattcaacctaccggttttgcgcaaagaatatgaaaaaattatcggctgggaagcgattcctgcatggcccaaaccagcgctgtttattcggggcggaaattcggattacattactgaagcctaccgcgaagatatcatgcgccaatttcctcaggcaacagcatgggtgatagcgggttgcggacattgggtgcatgcagaaaaacctgaagcggtactcagagcaattcatcgttttttagcaaaaaaataa

SEQ ID NO: 518 - DNA, 144 bp, Xenorhabdus bovienii
  Coding sequence Name=Xb4151_4152.C412.gene35.dna; Position on contig =39388..39531bp; Strand=-
atggaattctatctaaatagagttattagattttttattgcattatttattttattattatcatctttcgttctaaatgcttttgctggaaatgaagcaccttatgcgctgtatatcaaaaagacaagttttgttattccctga

SEQ ID NO: 519 - DNA, 276 bp, Xenorhabdus bovienii
  Coding sequence Name=Xb4151_4152.C412.gene36.dna; Position on contig =40566..40841bp; Strand=-
atgtcaaagggatattttttaacagtcagcgataaaacaacttgtggtggtgaaatccttacgggaaccagcagcattaaattttatggacggcaggctgcaattgaaggctccacagttacctgtgggagatactcaggaaattatgtcattgtaggaggagtgggttcttttttagataaggggacgaaactggcagggactttggatagtcaaagtacttgtccctgtaatgctagtcttatttgttccattcctgatagctatcagaaatag

SEQ ID NO: 520 - DNA, 561 bp, Xenorhabdus bovienii
  Coding sequence Name=Xb4151_4152.C412.gene37.dna; Position on contig =41093..41653bp; Strand=+
atgacctataaacaactgaccgaaacagaaagatatcagattttcagcttgaaagaagccggtttttcaccacgggagatttcaaagtcactcaatcgaaacccatcaacgattagccgggaattgagacgaaatcaggaggcaaagaaatatgcgcctgaacaggctcaacttaaggccgtagcgcgccgacattgttctacaaaagcagtaaaattgaaaccagagatagaaatgtggatcaaacagttaattttgcaagatttaaatcctgaacaaacggtcggttatctcaaaagggaaaatatcatatctttgcatcatgaaacagtttatcgattgatttataaggataaatttaatgagggtgatttatggcaacatcttaggattacgaaaaaaccgtatcgtaaacgttatggaagttatgagcgccgaggaaaaattaaaaacagagtcagtattgataagcgccccaaacttgttgataaaaagcagcgtattggtgattgggaaggagatactctcgtgggtaaagatctcataaaagtgcattattga

SEQ ID NO: 521 - DNA, 213 bp, Xenorhabdus bovienii
  Coding sequence Name=Xb4151_4152.C412.gene38.dna; Position on contig =41772..41984bp; Strand=+
atgacctttgataatggcctcgaatttgtcgaacacgaactgatcagtaaaaatgtagagccaaaaatttatttttctcatccatattccccctgggaaagagcgataaatgagaacactaatggattaatcagagattacttcccaaaaggaactgattttaataaggtatcagagctggagattacctcccagggcgcaagcatagtttga

SEQ ID NO: 522 - DNA, 207 bp, Xenorhabdus bovienii
  Coding sequence Name=Xb4151_4152.C412.gene39.dna; Position on contig =42015..42221bp; Strand=-
atgacctttgataatggcctcgaatttgtcgaacacgaactgatcagtaaaaatgtagagccaaaaatttatttttctcatccatattccccctgggaaagagcgataaatgagaacactaatggattaatcagagattacttcccaaaaggaactgattttaataaggtatcagagctggagattaacctcagggcgcaagcatag

SEQ ID NO: 523 - DNA, 960 bp, Xenorhabdus bovienii
  Coding sequence Name=Xb4151_4152.C413.gene1.dna; Position on contig =562..1521bp; Strand=-
atgtttatgatagttgtaccaatatttcttattatttttatcggatatattttcgggcgcttacgccctgacagtggaaaatctgataaattaatcaatgaatatgtgctttatatcgcactccctgctttattgttccttgctattgctcgggcagatattaatgagctacaacaatggggattcataactgccagtttgtctggaattggtgccgcatacattttaggaatattagtagcaaaatttatggggattagtttaccgcaatcgtcgattttaagcatgggtgcatgttatggtacaactgggtatatgggtgttccaatcctaatttcagtctatggtgaatccgccgcgcttcctgccgctatcgccactattttgcataacattcctgcaatcatggctgttatcatcacttatgatattttttctacacaccaatccggcaacaaaatatccattagtcaaagtctcgttggggcattaaagacaacattgagcaatcctctgactatttcagttattgctggattggttttcgtttttttaggtattcccgttcctaactttttacgttcatttgctgaatttctgggtaatgcctccggtccaacagcactattcgctttaggactgggattatctcggcttaaaatcaaagagcatatcaacagcgatgcgctaaaattagctatgccaatgttgtgccttaaattaggaatacagccattgattacgtttctctgtgcctactatctatttggtatgcaacaaactgataatatctggctaattgctgcgattgtcatggctgcacagccaataggagcaggtgtttatgttttttccaataagtatggttttaaacaggaagtcatttctctctccattattatttccctgcttattgcattggttaccatacctactattctccaattactacctatctaa

SEQ ID NO: 524 - DNA, 5061 bp, Xenorhabdus bovienii
  Coding sequence Name=Xb4151_4152.C413.gene2.dna; Position on contig =1993..7053bp; Strand=-
atgcttaaaaaacaacgcaagcagtggacaacacaacaacggctcaggcaggtcgcttgggtgaatatctttgcccaggttgcctttccggtggccggcgttttcacgcccgccgtcgccgccgacaaaacccccgggcattcacaggcgacccggccacagacattacagactgaatcttaccgactggccgcgggcgaaagtattaaatccgtcgccaagcgtcatggcctgaccgtaacggaattgaaaaaactcaaccagcttcgtaccttccacaagccctttacggctctgggcgcaggagatgaaattgacgtgcccaaatctccgtccggtcatttactggctgagagtctgacacaagccgccgccgccgaatcgccggcaggtcatactgaaaataataccgaacgctggctggccagtaccgtttcccgcgcggcaggcatgctgaaaggcggtcatgtgctggacagtgccaaaaatcagttacgcggtatggcaatgagtgaagccaatcagaccgtgcaaaactggctgcaacactacggcacggtcaaattacaggccaatgtggatgaccgcgggcgcttagacggcagtcagttcgacatgttgttaccgctttatgacaccgaaaaacagatggcctttacccagttcggcctgcgccatattgacagccgcaccaccgccaacttcgggctgggtcagcgtcacttctttgataccgggatgttgggctataacgctttccttgaccacgacataacccgtgaccatacccgctttggcctcggcgctgaatacgcccgtgattttatgaaattcggggcgaacggctatttccgtgccagcggctggaaagacggcaagaaactgaaagactacgaagaacggccggccagtggttttgacctgcgtgccgaaggttatgtgccttcctatccacagctgggcggcaagttaatttatgagcagtactttggtgatgaagtcggtttgctgagtgaagatcgccggcagaaagatccggccgcctttaccctcggcgccagttataccccgatcccgctggtgacgctgggtctggatcgccggcagagtacctccggcggcggtgaaaccctgtttaatctggggctgaattatgaaatcggtacaccgtggtcaaaacaggttgatccggatgccgtggcctttaaacgcaatctgcaaggcggacgttatgatttggtggagcgtaataatcagattgtactggaataccggaagaaaaatctgatccgcctgatgatggaaaaccggattaacggacgcggcggcgcggtgatcccgctgaatgtcaatgtcagtgcccagcatggcctgaaagagattgtctgggataccgccggtctggtggcggggggcggcaaactcgacagcgtaaatgcaccgacacgggcagaaaatctggcagcggagccggttcgcgggggcacccgttacctgctgaccctgccgccgttccatgacaagggtaacaacacctacaccctgtccggcatcgcttatgacactcagggcaatgcctctgaacggatggaaacgctgatacaggtggtttcttctgccgtcaatcccgacggttccggctttgaacccgctgagaaatcgatggtggcggacggcaaaacccaaacggttatccgcctgaaactgaccgacaaagacggcaagcctgtcagcggcgtggcgggtaacctcaaattaaccgacgataaaacgacactgaccggcgacggtaaagatcctgagctgggtacggaagtcagggaagttccggaaggcagcggcatctatgaaatcaccgcgactgccggcaccaggcacggtaaatggaaaatcacgcccacgatcgatggtcatgagctgacaccgactgttattgactttggctcttcattggcggagatgatagataccgatcgcaccgagtttaagccggaaaatggcaacctgaatcaggaaggcgacagtacagacctcgtcctgaacctgaaagacaaggacggcaacccgatcacgggagcggcggataaaatcaccctgaccgatgataaaaatgaactgtacggccagaaccccacgccctcactgggcgcggtaagagaagatccgccgggcagcggtatttataaggccaaggtgacggcaggtcagaaaaaagggacatggaaaatcaccccggcggtggaaggcaaaacgctgaaaccggccgtcattgccttcgggcaatcactggccgatgtgctggatacccagagctccaccgttgagccggcggatggcagtagcccgctgcccgcggatggcgtttccaccaaaaccctacgggtggtgctgaaagataaacagggcaaacccgtcacgggggcaaaagacagcatcagggtcaatgccgccggtcaattatcgggagaaggccaagatccacaaatcggcgatgttaaagaagtgtcggacggggtgtatgaaatcgtcgtcaccgccggccagaaaaccggccactggacgctgaccaccaccgtggatggcacggagatgaagaaggagacggtgattgagtttgatgaaaacaacgcgccggccgtgaacaatctgcaactgaatggcattttacatatcaatgaaaccctgcatgcccgctatcagtttaaggacaacggcggtaatacggctgaccgttcgttctatgtctggggagataaaggcactaccgcgaaacaagtgatggcactggcggatgccgccggggtgaaagaaccggtactggcgcagaaaaacggcgaaggccgggtaaccgccggcgcggcggataatgaaaaagtgaagtatgttattgcgcgcagcgatgccggtaaggtactggaagtgtccatactggcggctaacggggcgaacctgcgggccaaagcgccggtgaccacggatatagccgacccggcagccaaccggggccttacgggcgggaatggcaaaggcggtgtggcagatccggatgccaaacccggtatcgacaagattgtcctgagtggtgatttggaaatcaatcagccgcttacggccgaatatacctttaacggtaatggcggtgacgccaccgacctctcccagtttgcctggcatgacaaggggactccggcagccgattaccagcccgtaccggacaacggcaagaatgctcaggacaaaacaggcaaggtgaccagaacgctggagcaagcggatgcagggaaaacggtggcgattaccgttaagcccgttaacggaaacaacgaagtcggtgaagccaaaacggtagatattggtatgacggacaccaacatcaaccaaaccacgcccaaaggggcaaaaccgggcaccattcttgaccctaatgccattccttccattaagaatgtagtcttgcacgggtaccgatctgtaaattcaaccctgaaagccacttatgagtttgagcccaataacggttatgtggaagataaaactacctacacctggaggcgggtcgcaacaataggcggcacgccggaagacatcagtaaacagggcgctacaggcactgtcgatggtcaagggggccagatcgaatcttataagctgagtgacgacgatattgataaatttgtggaaattgttttgacgcccaaaaatggcagaagcaaaccaggaactgatattttgaagaacagcggtcagaatgaaggtaatgaacttcagggcggtaatacgatagggcagattattgacccctcccggggccccggcattgcagatctgaaaatccacggtaagttagcggttgatgaggaactgactgcaacgtataaatttgaggctaaaggcggacatgaccaagataactccctctttttatggggtatcaaatatcccgcaggagaccctgattacaataagtcccccgagtttctggtggaacaatttaatagtgatgacaaggatcatattgtcccgccaaataacaccaataccatccccggataccgtctgaaaccggaagacagtggccgagtcatccaagttgcgatacaagcccgttcgaaactggcgcgtggcaaatcatataacagagatacacggcaggaagctgatgaaggcaataatttagaaggcaacctggatggtacggtgaaaggcgtggcgagtgacttcacgataacgccggataaacctgagaaggatgcggatggcacgatggcggttaaggttgaaagagataaaaccattacgctcacggtcaaaactgagaacggaggtcaagccgttgggggtgtccctgtgacaattaagatgacggcgattaatcgtcagaagaaagctgacacagtcacagtaaacctggaggcgaaagaaggtgtactggcgggtaaagaggatacttaccgcggccatactgatgaaaaaggtcatctcgttatcaatgtcactgaccctaacggtattggcacaagaaccaccctgtcggtagaggtgcatgacggagccaaccagacgttgaccaaaacatgggatgttatttttaccgtgattaccagcccggatacaccactggctaattattgggggcatatggaagattacattacagttaacggaaaaaaatactcgcggcctccattacattctgaggctccattacattctgaggaaagggatgatattcctgatacaataaaccgcgaattatgggtaaccccacaatggcgtgtagcggcagattactgcaataaattaggagagttacccactagcgatcaattaatggatatacataatgcttatccaaatgggactctttacaacagttatgggtggcctgttaattattttgataataataacaataacattggtaacttttggttctggtcatctaatattgtgggggaaggatatgaaacaaagaatatagttgtagatattaataacggtgacgtttggagattagaaactggtcattatttccatattatttgtcgcattaaaaactag

SEQ ID NO: 525 - DNA, 189 bp, Xenorhabdus bovienii
  Coding sequence Name=Xb4151_4152.C413.gene3.dna; Position on contig =7202..7390bp; Strand=+
atgaggaagtcgcagaaaaacaaacccgctaaagtgaacattttggaggatacgtctttcgaatttgaacaaagtacaggattagaaaattatctaggaagatcagtaaaaaaagacgtgaacaacgcgggtgggggtattctcagaagggggatttatttagggtttactatcaataaattagcgtaa

SEQ ID NO: 526 - DNA, 705 bp, Xenorhabdus bovienii
  Coding sequence Name=Xb4151_4152.C413.gene4.dna; Position on contig =7357..8061bp; Strand=-
atgttaaaacgtaagtacctgacgcaatctgaaattgaaatgttgctgactgaatcaggcaaacatgctcatgcggcacgcaatatctgcatgatgtttatgggatttattcatgggtttcgggtgtctgaactcctcagtctaaagctgtcagatgtggatttggacagccgcagcctgcgcgtacagcgcctgaaaaatggcttttccaccattcatccaatggtctcccgtgagattcaactgctacgtcagtggctaaagggacgcccgaattatttgccagggacaccacaggccaacagcgaagtctcagactggttattcctgtcccgtagcggccagcggatgtcacgtcagcaagtgtataaaatcatccgccagaccagtttaaaggcaaaattgtcgatttgcgcgaatccgcacatgctcaggcacgcctgcggttatgcactggcagacaatggcgtagacacccggctgattcaggactatttagggcacagaaacatccgtcataccgtgcgctacaccgcgagtaatgcgggtcgcttcgagacggtatgggacgggaaaggaaaacgaaaacagttgacaattagtaccaaactgtcaactcacttaaacaggcttattttaaccgtagttaattttttccttccccgcaaaaattacgctaatttattgatagtaaaccctaaataa

SEQ ID NO: 527 - DNA, 990 bp, Xenorhabdus bovienii
  Coding sequence Name=Xb4151_4152.C413.gene5.dna; Position on contig =8146..9135bp; Strand=-
atgaaacaattagctatcacagctctggtattttctcatacctcggtgacatcggttgctatgccgattgaaatactcaccatcgccgccaatgccattggcggccccattccccatgtccgcattatctcgccagcaaaccaggaaatgagcgggacaaacagactgttgaccgaacccaccccgacttcccattccgatctctatcacggccaacaacccgatattattctggttggttctctgggtttcccggtatggcagccgcaatactgctcaccggaaataatagagtggctcaaagcgatggataagaagcacattcctatcgtttcagtctgctcaggcacattcatccttgccaaagccgggttactgaaaaccagcgcaaccattcaccctcatttttcccgcgaattcaaagatctatttccccatatttccctgtataccgacaaaaaaatcacccgtgacaataaccgtttctgcatttccagtgcctatggatgcagcaaaagtatgatgagtattgttgaattgatttacggacaatatgccagagaacaatgttcacaattcttgtttggcgaacatgaccccaaagtttcgtctgattccatcagttttgccccttatcgtcaacattcagattctctcatccacaaactgcaagattggatgcacacctcaccttccgaaattttatctgtggctgatttagccaatagaatccacctttgtgaacgacaaatgaaacggcgcttcaaaatcgccacaggaaaaacccccatccagtatatccagcagatacgtttgtcacaggccaagcactggctggaaaagtcccagaaaaccatcgaagaaatcagccatgaagtgggttacgaagatacccgttatttcagagagttattcaaacgctacaatggcctgacgccgaaagagtatcgccaaaaaaatcaccatagtgggaatttttctgcgggctga

SEQ ID NO: 528 - DNA, 2163 bp, Xenorhabdus bovienii
  Coding sequence Name=Xb4151_4152.C413.gene6.dna; Position on contig =9247..11409bp; Strand=-
atggttgacgcattttcctttacgagtgatacagacacggaagatcacaccaataatcacgcactggattgtgtcgcctatctgggaacacaatttcataaggttgcctccgtcagacaattgcatcatgcgctgggtctggattccctgacgctgacagactggcagctacgcgaagctatcgatgccgtaggcctgcacagcaaatttgatcgtctgacagccgataccgcagccacgttgcctttaccggcactgattgaattgggtcaatgctggtgggtgctgctcgaagtcagcccagatcagtttaccgtgctcaatcccatcacggaaaaacaagaaatacgcccattgcacggcacacaggcgacacctgacgaagctaaacacagtgagtataaaatcctgctggtggcagataaatcgctgaccaaacagcaagtcaaattcggcttgagctggttttatccttcgattttcaggcagaaaaatcagttgcgggatattttcctgttcgccattgtgctgcaactttttgcgctggcatctcctttgctgtttgaaaatgtcatcgacaaagtactggtcggacgcagcttatccagcctgcatgttcttggtctggcgatgctggcgctggccgtggcagaacccctgtacggttttctgcgcaataccgtgttcggacatatggcaagccagatcaacgcggaactctccggcaggctttatcgccatctggtgggattacccctgccctatttcaagcaacgccaaaccggacaaattatcgcgcgcgtcagagaaatggcacaaatccgccaatttctgaccggctccaccctgatgttgctactcgacctgatcttcatcatcctgtttcttggcgtcatgttccattattccactctattgaccgggatcgtaatcagttcgctggcactctatttcctgctttggatcgctattggacctctcatccgacgcaaagtagaaaccgaatatgaagccgatgcccatgccaccagtttcctgacggaatccgtcatgggcatcgaaactatcaagaccaccgcaacagaaaaacgctttctgcgccagtggcaaaaagtgttaagccagcaattgatccggcgtttttccgcccagaaaagtgggcttgcggccggacaggggatcgcgttgatccagaaaatcgtagcggcattactgctatggtggggggtcagaagcgttcttaacggcgaattatcccccggagagttaattgccttcaatatgctggcaggacacgtcacccagccgatcttacggctggcgcaagtctggcaggatttccagcatactttgatcgctttgcgacgggtcggcgatattcttgatgagccaatggagagtagcaaacaggggctggcagcttcccctgaacttgccggccagattgagttcaggaatattcgcttccgctatcacgcagatacgcccgaagtactggcaaatctgtcactgaccatcaaagcgggcgaatttattggcataacggggccatcgggttcaggtaaaagtaccctgacccggttgttacagcgcctgtatgtgccgcagcatggtcaggttctggtcgatggtatggatttggcgatcgccgatcccgtatcactccgacgtaacatgagcgtggtattgcaggaaagcatactgttttccggcagcattgcggacaatatccgtctgtgtaaacccaatgccagcgatgaagaagtctaccgggcggcgactttggcgggtgcaactgacttcatcaatgaatttccgcataaatttgcccattctgtcggggagaaaggaagcaatctttccggtgggcaacggcagcgtatcgcattggcaagagccttgttgaatgatcccaaaatcctgattctggatgaagcgacttccgcgctggattatgaatccgaggcagccattatgagcaatctggacgagatccgccacaaccggacggttatcagcattgcccatcggctgaatacgatccgccatgcagataaaatttttgttttagatcaaggaacaatcgtcgaatctggctcccatgatgacctattgcaacaaaacggactgtatgcacaactttggcatcaacaaacagaatga

SEQ ID NO: 529 - DNA, 1356 bp, Xenorhabdus bovienii
  Coding sequence Name=Xb4151_4152.C413.gene7.dna; Position on contig =11412..12767bp; Strand=-
atgtttaaggccatcttacgcaaagggattaaaaacctgcgtactccttcgccccattatgattttttacccacacatctggccttgtcacaacgtcctccttccccgttcgcccgttatacggcgatcaccttgagtatcggggtactggtggtactgctatgggcgtatctgggaaaattggatgtacaggcaaccgccaccgggcgtctgatcgcttccggccgttcccaagtcattcaggcttatgaacaaagccgtctgctctctattcatattcaaaatgggcagcacattgaaaaaaatgcccctctgcttatgctgaatacgctcggcgttaatcaggacgttacacgactacttgaacaacgtgaatatctgatcgaagagaaaatccgctatcaggcactgctcgggaagcatgatcccgaatcactgcctctctttcagcagcagactctctcccaacaggaaaaaatccagacgcattacgagcatgaaaaacatgaattcgatgccattatcaccaatctttacgctgaaatgaacgtcaatctctcttctcaaaaagccaaaaacggggatattcaggctctgaccaacctgcgtcaaaatatcaatcagcgcttgcaggcacgaaaaatattgagccaaaagcaggtgattagccgagtggagtatctggagcaggaaaaagaattgctggaaacagaacgggtgatcacgcaacaaaaagcagaactaggcatcttgatgacccaatacaagagtctggaagagcggttaaaggggatcaacatgcaaaaagagcgggaatggtttgagaaaaaaaagcaggcagagatgcaactgggcgtgctgaaacaagagctttccaaaatgcaggagcgagaagcccttgagatcgtgcgttcccctgtggcgggtacggttcagcaattgagcgtccataccctcggcgcggttttacagcctgcacagaatttgatggtgattgtaccggatgaccatgtgcaactcgcggaaatccagatcctgaataaagatgtcgggtttgtccgccccggccagcatgtgacggttaaggtagatgccttcccttatacccgctatggcaccatcgaaggcgaactgctcagtatttcacgtgactccacgacggatgggcgtctgggtctggtttttccagcgcaaatcagcctcagacaaaacaatatcatcgttgatggtaagcctgtcgaaattaccgccgggatgtccatcaccgcagaaatcaaaaccgatcaacgacgggtgattgattacctgctcagtccgattcaggaatatcagtctgaagcgttgagggaaaaataa

SEQ ID NO: 530 - DNA, 2058 bp, Xenorhabdus bovienii
  Coding sequence Name=Xb4151_4152.C413.gene8.dna; Position on contig =12760..14817bp; Strand=-
atgatatctaatggtaaacccattatcatacccgataaaaacataaataataatgatgattatctttttactttaaataaattaaagaaagaacatcatgtttccattaaaaataaacgttcagtaaataagaagttaaacacattatctttacccgctattctgttcgatgataatgggcatccctttattttagcaaaacatgatgagcaacgagtattgattcaaaaacctaatcaggaagcgcctgaaatattggataaagaaagctttatccgtttatggagcggacgctggataaaaataaaacaaaaaagtaaccaattcaatatccgttggtttattcccgaatttatccggcaaaggaagaatctgactgaaattctgctgttttcgttcattttgcaaattttagcgttgatttctcctttggtcgtgcaggttgtcatggacaaggtactggttcatcaggcgttatccaccttagatgtgttgatttttggtctggtggctgcaagcctgattgaagtggttctacgtgggctacgcgaatatcagtatgcccatacagccaatcgcattgatatcaaactgggcttaaaactggttcggcacctacttggcctgcctttgctgtttttcaaatcccgccaagtgggagcaattgtgacgcgggtacgtgaactcgaaaccgtacgggagtttttaaccggttccatgttcaccctgtgtattgatgtcctgtttatgttcgtattcatttacgtgatgagcctgctatccggcacactgactttgctgtttttggctaccatccctttctatggtctgctggcatggtgggtcacgcccaaaatcgagaaagcagtcgaaaagcaattcattcatgctgcgatcaatacctctttcctgaccgaaaccgtcgccggtgccgagacactgaaaagcctggcagcggaaccccgctttatccggcgctgggatagccagaccgagaatatggtgagtaccagttatgatgtgcagcaatgggataaccgctccagccatcttgtgatgctgttacaaaaagtcaccagtgcggtcattatctggcttggtgcctccgaagtactctccctgcacatgaccatcggccagttgatcgcgttcaatatgatggtcagccatacccagcaacccctggccaagttggtgcaactctgggggcaatttatccgctcacgtattgccattgataaactgggggatatgttgaatctgccgacagaacagcagtcaggcaaagagcgagtctcattgcagggtgctatttcattctctgatatcgtatttcgctatcagcccgatctctccccaaccatcaaccgttttacgctggatatccgggcaggagaaacgcttggcgtagtaggaacatccggttctggaaaaagtaccctcgcgcgcctgttacttcggctttataccccggaacatggcaccatcacactggatggcattccattgcaggagttcaatattgaatctctgagacagcaaataggcatcgtgttacaagaaaattttctgtttaataaaaccgtacatgaaaacattgcccaatcacgacccgatgctcctctgtctgatattattgaagcggccagactggcgggggcacacgattttattctcaagctgccgatggggtacgacactatcatcgcggaaggcggccaatccctctccggcgggcagcgacagcgtctggccattgccagaaccctgctgtctgatcccaccattctgatccttgatgaagccaccagcgcactggatgatgagtcacaatcgattattcaatccaatatggcggacattgcgcagggcagaacggtcattaccatcgcccatcgactctccacggtacgccagtgcgaccgaatcattgtactgcaccaaggtcaaattattgaacaaggtagccatgaacaactgctacaacagggcaagcagtatcgaaaactctggcaattgcaacaggaactgaaacaggaggtgacttcccatgtttaa

SEQ ID NO: 531 - DNA, 384 bp, Xenorhabdus bovienii
  Coding sequence Name=Xb4151_4152.C413.gene9.dna; Position on contig =15361..15744bp; Strand=+
atggataatgatatgtctgaaaaattcgttcaaaccatttcaagtgttaattataacaaaggcgtgttctctctttattttgttggacaagagcctaaccgaatggcaaatggcatactggctgaaaacgatcaggaattacaattaaagcaagtgattcacatgcctgcatccggctttatgtatatggtttccatggtgaaaagtatgcttgaagaccctcggatggaagccgaaatgaataagctgatcgcagccggattcttgcctgtacctgaaatgagtgaaggtgaaatgccagccccagccgagccggaaactgcggttgcagagaccattgagcctaaaaaacgcccagcccgcgatacggaaaaatcaaaataa

SEQ ID NO: 532 - DNA, 462 bp, Xenorhabdus bovienii
  Coding sequence Name=Xb4151_4152.C413.gene10.dna; Position on contig =15786..16247bp; Strand=+
atgatgatcacacatcaaccggcaacgctgagtgacactgaaatacaagcaatgataggtggggtgatgttgctttgtcagcattcacctttacaccgacgctatttagttgctgagtggcaacagcgtatctttccttcattccagctcaatcagttttgctattacgaagatgaacaccaacgcccagttgctttttgtaattgggcttttttgtctgatagcagtcgggatgcgattctttccggtgaacgggagatttcgcaggaagactggcgctcaggacagcatatcttttttccggaaatgattgccccttttgggcatgcgaagagtatcgcccgtgatcttcgccggcgtgtctttgcagcatggaaggggcaaaaagcctgtactgtccggggaatgctggacacacaaaatgaccactgtatccgtcgggtacagtggtttaccgtttaa

SEQ ID NO: 533 - DNA, 14151 bp, Xenorhabdus bovienii
  Coding sequence Name=Xb4151_4152.C413.gene11.dna; Position on contig =16275..30425bp; Strand=+
atgggaaaatcatccaaccgaagtgcagcatatgcctttaccggtaaatatgaagatgataatgatggaaatacaatacacgccatcggcattggcggtgtcattaacgcctatggcggaaatgattacattgtcgtgggttccgttggtgcaaccgtcaatacaacatgggggaacgatactgtcgtgggggcggccgggtatctgaatattaacgatacaagcggtactctgacggtaaaaggaggttcaggttatacctccatcaataaaacaagcgatggcacgatagattttgctggcgctgccggtggactgaaaatcaatcacacaggtgataagggtcgaatcgattattctggcgcgtctggctacaatggcatcacccgcaagggatgggaaggcgatttcacttttaagggcgcaggggggtataacgaactctggcatgaaaccaatcagggaaatttctactttgctggcgtggggggtggaaacaagattgatcgcacatggttcgaccgttatcagggatctcacggcgatctgacctttaacggcgctggtgcggcaaacatcatcagttccagagttgaaagtggtgatattgtttttgcaggcgcaggagccgctaacaatcttgtccgcaggggaaaaaccggcaacgtcaccttaacgggtgcaggggcttctaaccgtattgaacgtacccgccagaccgatgacgtctattctgaaaccaaaggtgatatcaagtttgaaggcgcgggcggttataacagcctgtattctgatgttgcacacggtaatatccgttttgcaggagtgggggggtataaccatattacccgcaagggaacggccactgacttcgataacgaaggcatggaatatgccaaagccgaagatatcgtgttgaaaaatgccaccatgagtggtgactggattggctacaacgtgcaggtgacaggtcttaaatcggcacgggaatcgaacacttatctgtttgcgtttgctgatggcatgtataccaaaatcaacaaagttcagctccgcaatgatcctgaaaccggcaaactgatctatcactcgacgtcttggtataaggaaggaaaccatctcaagacgttagataaacaggatatctctgttcagggtggttttaaggatgtcaagattgacggtgcttacaccctgtcaaacttgacggttgaacaccagcaatctgttaccgttcacgctgttgaggaaaaactggctgaagaccaatggatgaatcatggcgatggcgtgctggttgatgtggcagatgtcacattatcaaatgccaaaatgggtggctatgcgattgacagtaaaggaagcaccgctgatgtacaagtggtgaaatccaaccataaatcgaacacttatatctatgccaagcgaatcgataaatacaccaaaatcgtggttattgaactgaggaacgatccaaaaacaggcatgctgcaatataacgcacaggcttggttcagtttggaagatcgcatggcgaaactggcgaacgaagatatttcttctgctaatggttatcaggccgtgccagcgggtatctatactctgagtgatcttcattacagtaccaaggcagtacgtacagcttcagggcgcgtatctggcatgcacgaataccgtgatctggcgttattcaaatcggcgaccggcagcggtgaaagctccggtgatgtccggtatacaggcgcgggtggcggcaacgttatccaatcgaacgtaacccgaggcaatgtctattttgatggagccggtattgccaatgttattgaacatacttctgagtttggtaacacggaatttaatggcggcggagcggcgaacgtcatcgtcaaaaaaggcaaagaaggcaacctgaccttcaacggtgtcggcattgccaacgtactgctgcatcaaggcttgcgtggcgacatggacgtgaatgcgggtggtgcggctaatatactggttcgcgtcggtgatggccgctatcttgcccatcttttggcggtcggcaatatctccattcacaagggcaacggcaacagccgtatctcaatgagcggtggtttcaatacccacacacaaatcggtcatggcgacgcattctggtctggtgtcggtggcttcaatgtcttgactcaaatggggaaagggcatgtttcctcaattctgctgggcggcgccaacgttctgagcaaagttggcgaaggcgatcttgaatccggcatgttaggcggcgccaacatcattacccatatcagcaatgatcgtgagacgtccaacacgaaagccatcgcactgggtggtgccaatatcctgactaaaaagggcaaaggagacgtattgtcggtcatgggcgggggtgccaacgttctgacccatgttggggatggcaaaaccaccggtatcctgctgggcggcgcgaacattctgactaaagtcggcaacggcgataccacgggcatcatgttgggtcttggtaacattctgactcatgtcggtaatggacagacgctgggcgtgatggcggcggcgggtaacattttcaccaaagtgggagagggtacaaccatcgcggctatggtgggtgcaggtaacattttcactcacgttggtcagggaaatgcctgggcgctgatggggggtattgggaatatcttcaccaaagttggcgatggtgacgcactggcattaatgttggctgccggcaatgtgttcacgcacgtgggtgatggtatgagcgtggctttgatggttgccaaaggcaacattgcgactaaagtcggccatggtgaaatgctttctgccatgattggcgagggcaatatccttactcagattggtaacggtgacacctttgccgccatgctgggtaaggcgaacattctgactaaagtcggcaatggtctgacagccgcgttgatggtgagtgaagccaacatttatacccatgtgggtgatggaaccagcatcggcctgtttgtgggttctgtcaacgtgatgaccaaagtgggcaatggaaccacccttgcggctatgtttggcaaagccaatatcatgacgcatgtcggcgacggtttgactggtgtccttgcattgggcaaagccaacatcatgacaaaagtcggcaacgatttcatgggggttgttgcggcttctgaggctaacgtggtgacccatgttggtggtggcaccacagcagccctgctgcttggcaaaggcaacgtgctgaccaaagtgggcgacggaaccaccgtgggcttactggtttccaaaatcggcaacgtcatgactcatcttggtgatggaaccaccatcgggttcgccaagggtgaagccaacatcattaccaagtcgggtgatgggttgggcatcaatgccgcttggggcaaggccaacatcatgacccatattggtgagggtgatcgctataactttgccaaaggtgaagcgaatatcatcactaaagtgggtgacggacaggaaattaccgtagtccaggggcaagccaacattgtgactcatgtaggcaatggcgatgattacacgggtgcctggggtaaggctaacgtgatcaccaaagtgggtgacggacgtaatgtcgtacttgccaaaggcgatgccaatatcgtgacccagatcggtaatggggatagtttcaacgcactgtggagtcagggcaatgttgtcaccaaagtcggtgatggcatgcaggtcacggcagccaaaggtaaaggcaacatcacgacgaccgtaggcaatggcctgagtgttaccaccgtccacggtgatctgaatgtcaataccaaagtgggtgatggcgtttccgtcaatgtggcctggggcaaactcaacgtcaatacccgagtgggtgatggcctgaatgtttccgtcatgaaaggtcaggcaaatgccaatatccgtgtgggtgacggcttaaacattaacgcctcttatgcccgcaataacgtggcgattcaggtgggcaatggcgatttctatagccttgccgttgcagaaagcaataccgagagtaataagctgagtgccttgtttggcaacgtgaagcagacactgcttggtgtggcaggcagtcagggtatcagccatctggttaatggagacgaagccaacacatcgggaactcataagggacgcggtgcaattgatctgcccgaagtttctgcgctgaatggcttccagttgactgaagtgaagcaggtcacatctgatttgcagcaaagcctgaaaggttcggtgacaggcgttgatactccagacattggcagtatccagaataccttgggcaatgaaaaacggttgaagtctaatcaatcgcgcaatctcattgtcaatggagactttgagcagggcgcagacggctggcaggccaccaatggtattgaagcctcttatgctgcacaggcctatggccttagtaatgagggtcatggcgaacgcgtcagtgaactcgatgctgatacccatgctgataaggattctaataccagtatttatcaggatattagtgatctcactgcgaatgaatccatcacgctgagttttgattttgcaaaacgcgccggtatttctgcggacaacggtatggaagtgttgtggaacggaaaaaccgtgttctcgatttccgcaggtaacgcggaatggcaaaacaaaacattgtcattaaccgcacagacgggcagcaaccggctggagtttaaaggcacaggcacaaatgatggtctgggctacattctggataatgtcgttgccaaatctgagcagccagacagtgctattgctgaccatgtgcagcaggacgccgccgcacagaatgcgttacaggataaagaaaaagccgaagcggatcgccagcgtctggaacaggaaagggatacacaactggccgcagtttctggctctcaggcacaattggaagccacggatctggaggcgctgaataggaatggacaagaccagcgcgatgcaataaatcatgaagcccaagctattaccaaagaattgacggaacaagctaaagggttgtcagcgctcgatagccacagtaaacatcatggaaaatccggtgaacagtggcgagcccaatttgcggagggtttgttaggacaggttcagacacaactgaatagtgcagacgaaacagcacagcagcagttggatcgctcacagcacgcggcttcagaacgtttcggtgatctcagagacgcagtggccaaatcagaagccggagtcagcaaaggcgagcaaaaccagcagcagtctcaaaaagagattgaacagacccgcaccaatgccgaattcaggaagcagcaagccttaagccaaaagacacaggctgaacacgctgaaagtaacgctaaagccgcagtgcagaaagccggacagcgtggtcaacatgaagtttctgaggcagacagccagacagcacgggtgcaatcggatgccaaagccgcaaaacagagtgacaactacaaaccgaaccgcacgggtgcagcaggcagtggtctgtcaggctccgcctatgagtccaatgccgctgaaaaccagcctgagcgggtaaaaacggataatcctatcggttttgcaccgaaaaatgagacaaataccgggttcagtaaggaattacaatatctggatgaagacctcgacgagttggctgaggcaaaagaagcattgaatcgcttacagatcaatgcaacaaaacgcggtaaaaataccggggctaccctgatatcggcttatacagaaacgtctgtcggtcagccggtcagcaagaccgcagatgtgtctaccgaatgggtcagaaacacgccgaaaatttccggtctggatctcagtggcctgcaagcactgggtgaaacccatgttcagcagggatctgccgatgcaccagaaatgtctgctactgccatcagagcgcaaaaagttgcagatgtttaccgttggctggacagtgacaacaacattgctacagatacttatattccggtgcccgggtttgagcgtggggatgctgatattcccgagaacatcagacagaaactggtgacctttattgaaggataccttgagggaactgacaatagtgtgccgaaagatcaagtcgccccgttggcgaaactgttcgttgatgccacgattgattgtaactgggataagcgtgtcgaatttgtctcaaaactggaacaatatggctatagttttgagcctgtccatggcgataaaagcatcgtgtcgttctggtctggcaaaaacttcaagcaataccgcagtgttcttgatgccgtgcagaccgacggcaagaaagtggtttacgatattgatgtgaaaggcaactcttttgccatcgaactgaacaaaaccctgatgcgttggggcaacgtatatctcgattctgacaatgccgaacataacgcattacaaacggccattaatacttcggcacggagcaacaccgggttctggagctccctctatgccaccggatcacgcgatgatgtgtatgtgatcgcagaaggtggcctgcgtcttggcaactacttctggaatgttgaactgccggtattgcgccaattgcagcgtgaagggctggtgggagaaatccgtctgctggataaacctgcccgtgaatatcagggtgcggcaccggaatctattggtcgcaggctgacggaagccggcgtctctgtgaaagcacgttttgattctctcagcattggcgaacaggaaagattgcttacgctgaatccgactgggtataagccggatacactgattgatctcgacataaaactgagcgccatcgacaacatgttgaatcaggcattgccattctacggactgcggacagagcgcaacctgctggtacgtgaagctgatgatgaaggctttgaagtgcgccggtggccgggtcatgatggtgatgacttcaagacgatcattgtggaagatgcgggagatccggctcagatcagggccattgagcgtttcatcctcgccaactacgacgattacggaaaactgccggatgctttgtatttggtggcagaccagattgtttcccacgagcaggggcgtacccgtatcgtggctaaaaaagcggatggcagttggaactacaaaccgaagactgacttgatgtctgccagtgagtttaaggatgcggcttacgttaaaggtaaaatcctcggtgacagttaccgcaacgtactggaagcgttcggcagttacgaaaaagccctgcaaaacggcgcagactatgatctggatgtcgtggagaaactcatcagcctgcatcagcaagttgaaggttatctattggggcatcctgattcaaaacgcttacccgccatgacaaacctgttgtcacaaatcaatgtgcgcatggaagaatcgcgggtactggcggaacctacattgacaagtgtgggtaagggcaatttcagtgagttgtataacaaactcggcaatgccaacctcaaagattcaaaacatctttatattgatgagcagggtgattttgttacccgtggtaaatctaatattcagatagcgatgaaagcggaaggagcggaaaaagcggtcgagcagatcaaagccgccgtgaccagagaatatggtcaggaagtagcagaaaccgtcttttcaaacctgaaatcccgtgatttgtcaaaagatggcaaaggcattgatgtgtctggcttgagaaaggtgcatcaggcaattgaacagcaactgtctccggtcagtgccactctgtttgtctggaaaccgagcgatcacagccaactgggacatgccgccctgcaaattgggcaagggcgttttcaggttagcgcagaagatgccgaaggcttcaatgagaaaaactatgtgagctggtggccgaaaggcggtaaatcgaccagccctggacacatttttaatgtttccactgaggaaaacccagacgtgagtctacgttggcgtgatctcagccagccggcttctcagaatgagacgctggcatttgatgtcggctctgaagaaggggataactttggcttgaaggatgggacatacaagctggagaaatttattgaaaaactacaggctgccaaaggcgttgatgcaaaattcgaggatatcagcgagggctttgccatggctgcgctggctaaccctaacctgcttaaatcagccggtatacctgagcatatttcccgaccgtttatcgaacaatgggaaaatggcaacattgacatgcaggacattggccgagattttgccgaagcactgcggacagccgcgaaacagaaagtcacgcctgagctgactgaaaaacgcatcactaatatcattcgtcagtttgccgaacgtgagttgagcgacattcaggatttcaaggccagcgaagccgatcagggacgtgtattccgcatcaatctggcaggtttggatactgcggcaatgcagacagaatggaacaaaatcagccagaaccctgatgcccgctatcaaatattgaacggtaactgttcaagtattgtagccaaagtgctcaaggcaggtggagccgataaagtgatcggtcatacatggcggccaaattttggtatctggaccccaaccgaattattcaattatgcacagaaactgcaagaagcgcagattgagataatagccaataagccgaaacgcattgtgggtgaagatctggaagcgctcggccagccggataaaaaagacaacgtgctggaaaaagttgccattgacaacgacggcaaaccaccgcgtgacagagagcccttcaatccggtaacccgcttcctaaacaatgagctttacggcgctaaggaagaacgccgcaatgtgtatgattacactcaaacggcgctggacacggctgtgaccaacggcacggcggataaagtcacgttacggggcgacgcagggcgtctgaccggttattaccatcagggcgaacagaaaactgatgcgtcagccgaaccgaatacagcgaaaaaagtagtcctgttcattcatggttctggctcctctgcggaagaacaagccagtgtcatcaagaatcaataccagaagcagggtatcgatatgctcgcagtgaacctgcggggttatggttccagtgatggccgtccgagcgaaaaagggctgtatcatgatgcccgcacgatgttccgttatttggtcaatgatcgcggcgtcaggccggaaaatatcattattcatggctattctatgggcgggccaattgcggctgatcttgcccgttatgccgaacggaacggacacaccgtttctggcctgctgctcgatagaccaatgccaagtatgaccaaagcgattactgctcacgaagtgccaaacccagcaggaatgacgggcgtactggcaaaagcggtcaatggtcagttctcagtagagaaaaacctgcaggggagctcgaagcaaaccccaatcatgttgttgaccgataatgaaggcttgggtgaagcgggagaaaaactgcgcgctaaactggttattgatggctatcaggtatcgggtgaacataccttctatagtcatgaggccagcagccggttgatgaaccaatatgctgaacagattgtgacaggtttgtttgatgtgaagcgtcagccggatgaatcaacggcacttaaaggtctcaggagtgatctgaagcgctatggtgaagcgctggaacctcagaaaagtgcaccgggtaaaacgaaagatatccgtgcgacgcaagactttcttaccggttatcagcaagggcatgcagagcagaccgttgatggtttccgttcagacatgaatatcaaacaactggtggatctgctggttaaaggtaactggacagcagaacagaaaggctcactggcctgggaaattgagagcagagccttgaaggtgaccttccagcctcaggcggagaagcacaatcggctattcaatgacgttgtttcgtccggggtggctgataccaaagcgagcaagcatcttgcaccacaattgttgttattgaacctgtcgaatgacggctttggcggacgttgtgacccattgtcgaaactggtgctggttgcgaaacaactggaaaacaatggtcaggatggcgttgcccgtaaactgctggaaaaaatgtattctgcggctgcggtacttagcaatccaacactgtattcagacactgaacgcggcaatgccaacaaactattgggttctctggctgcccttcatgcccggaacccgatgcatgacacttccataaaggtgtggcaggagaagctggaagataagcaggccttgaccgtcaatggcgtgattgggaaagtgactgccgcaaatgccgatggcaaacctgttttgcttgagctggatgcaccaggccatgcgatggctgcatgggcgaaaggcagtggtgataatcgcgtttatggtttctacgatccgaacgcgggtattgtcgaattttcatctgcggagaaattcggcgattaccttactcgtttcttcggcaaatctggcctgaacatggagcaaagctacaaactgccaaaaaatgccgcgggtgaaattatcttcaaacgtgtggtggtgatggatggcagcgtactggcgacttacaacccgacaagggctgacaagaccaccatgcagggtatccttgatctgaatatttttgatgagacgccaataaaaacccattcagatgtggaaattacccatgaggtgaaagtccccctcaaggacaatctaccggaaggcgttgaccgtgtggttaacaacgagaatgtcgaacattgggagccggcttttgtcaaaccacaggcagaagggggtgacagtcgctttaacagtcaggtcatcatccagacggaaaatgatcctgtcgcagctaaggctgccgcacgtctggccggtaaacatcctgattcaagcgtgattgtgcaacttgatgccaatggccgatatcgagtggtgtatggtgatcctgcgacgttgtccggcaaactgcgctggcagatcgtcggacatgggcgtgatgaatcagtacagcaccacactcgtatgagtggctacagtgctgatgaactcgcgttgaaactaaaacagttccgtaccgacttcaagcaggccggttcgcctgatcatatcagtcttgtcggttgttctttgatcagcgatgataaacgcgatggctttgcccgtcactttatctcagagcttgataagcagggcatccgaaccacggtatctgcccgcagcagcgaggttgcggtagacagcattggtcgtaaatttacacgtaatgccgaagaacagtgggttcataagctcatggacaacaagattgttctgggctggaatgacaagggagagctggaaacccacgctgaacggatccgccgtggcatctctgaaaacgacattaatttgtcccgtatcggtcacatcgatactgatgcgaaagcgaaaggcgcgattgcagaaaatgcagaaacattccacgccccggaacagcacaagaaggtgaatgatgatgcatcagccacgtcatcggcgaagtcatccaacaataaactgagctattccggcaatattcaggtacaggcgggtgatggcgaatttaccgtcatcaactggggaacgaccaacgtcggtatcaaagtcggtacaggtggcttcaagtcactggcttttggtgataacaacgtcatggttcacctgggtaacggtgatagcaaacacagcgtcaatattgccggttatcaggcactggaaggcgcgcaactctttatgggtaaccgaaatgtcagcttcaatatgggacgcagcaacgatctgatcgtgatgatggataaatccattccaactcccccgttggtcaatccatttgatggggcttcccgtatatctggtgtcttgcagaacattgccggctcctttgagtcaccagattggctgaccgcccaagatcagcagtggacactggagagtgcgaaaaaatacgtcagcgatctgtcaggtctcgatctgaccagcagtgttgattacaacactctgaccgatctcgatacggagaatgaaaaaagcagtcgtggcctgaaaagtgatatcgaaaccacactgaacaagaaatacaatcagtggttgggcaggaacggtaatgctcgtgaaatgggtaacgtcagtcgggcggataaattccgtcaggagaatgaaacgctggcctttaacttcgccgttggcgggcagggtgctgatattcaggtaacaacaggtaactggaactttatgtttggtgacaatatccaatcgatcctggataccaacttgggttcactgtttggcctgatgacacaggaatacacttccacgggtatggctaaaaccacgtttactttcagtccgaaggacttaccacgccagcttaaaaacaagctgctcggcaatctggcgggtgtcagtgcagatacgacactggcagatatctttggtgttgactacaccgcggatggtcatattgtttcccgttctggtcaatcggttgatggtgttgcgattctgcgtgaaatgctggaagtgatcggtgaattcagtggtaatcaactacaggcatttactgatccggcaaaactgctcgacagcttggaagccgggctgaatacaggggcagatggtgttaaatcttttgcggaaagccacggcctgcaagcaaaagcgcctgaggaaaacaaagaagggcatgtgtcaatcagtacagagggtaaacctgttcaggaagtcgcagaattaccatcagatcgtgcccttggctttaacctgccaagcctgttcacaaccttgttcaagcagaataaacaggttgagatggcatcactggtcgctgatctgaaacagaatctgaccgctgatttgctgaacatacaggacaaaacgtttgactttctgcgtaacagcggccatctgcaaggtgacggtgatatgcatgtctctctcggtaactataactttaactggggcggagatggcaaagaccttggcgcttatctgggggataacaacaacttctggggcggtcgtggtgatgacgtttattactccgtaggaacctccaatatcttcaccggtggtgaaggtaatgatatgggtgttctgatggggcgtgagaacatgatgtttggtggtgcgggcaatgacgttgctgtactggccggacgcattaactacgcctacatgggcgacggtgatgatcaggtctttgtcttcggtgaaggtggtgtgattgagggcggcaaagggcgcgactatatcgtggcttccggtaatttcaatagcatccatgcaggagaaggacaggattatgttgttgccattggtaacaacaatcaggtgagtttgggggaaggcgacgactttgccaccgtattcggcaactataacaacattgatggcaacgccggcaataacgcgatcaaactgatgggttatcacgcggtgatcaatggcggtacgggtgacgatcacctgattgccaatgtagcctccaagttcagccaattgaacggcggcgatggcgatgacctgctggtactgggcggataccaaaacaacttcaagggtggcacgggcgttaatagctttgtggtcagcggggatgtgattgacaacgtggttgaagatatcaaacgcggcgacaagatcattttcaacaacctcaactggcaaaagctgtggttccagcgcagcggttacgatttggttctgctgactggccgtgatgtgacagacacctcagcacaagggaagtttgaggcgataggttctgtgaccttcaacgattacttcaatggcaaccgtgcggatattgtcacccaaatgggagacaaagatacacagggtgaacgtgaatatacggcgctctctgccaattcggtggattcgttggttcaggcgatgagcgggtttgcaccaaatatgggcgacaccggctttattgatacacttgatagccagacgaaatcgactattgtgaccgcttgggcggacaccacaagcggaaaatccaaactggcctga

SEQ ID NO: 534 - DNA, 1746 bp, Xenorhabdus bovienii
  Coding sequence Name=Xb4151_4152.C413.gene12.dna; Position on contig =30847..32592bp; Strand=+
atggatcaatttgaacgctatttccaacgggaactggcctacctgcgggaacttgaaaagtgtgtacgtgaggaaaaaccccatctcaatgaagtcctcggtggccgcgatcccggtgtggaaaaactgaatgaaggatttgctgctttagcggcaccgatcagccagaaaatcgacgatgctttcccggaactgacccagccgctgctgcaacggctcaaagtgcagcccgtcaggggtattcctgccacggctatcatgcaacttgacggtggtgagggcgctgatgttgcgttttcactgcccgcaggcacgaaaattcagaccgtcagcgagcaaagttttatcacaccccgtcagtgtgacgtcctgccattgaccctgctgtcacgggaaatcacccatcagactgatgaaaccctgattatcctgacctttcaatacacaggtaaagatggctattgggatacccaacccatagagctgttcctaagccacgatgaatcggtggcggatgctctgctattgggattatgccgtttttgtggcgacggcgaactgtaccacaacggacaaacctatgtgatggataccctacggtttattccccacgctggcgagtcgcggctggtgttgtcacccccggcagcggccggtaactgggcaccgcagatgttgacggaatccctctacctgcctcacatccatcattttctgacgctggatatgccgtatccggtgaaatcccgacggctgcccatgacggaaagcaacgtattcagcctgacactgaaattgaacacccttctgcccttgtctgaggcgcagatagccgagtctttcctgctgcattgtgtaccggtggtcaatctgcaactggaacggctgagtctgccgtttatagcggataacgtccgttatccgctgcccctgcccgcccatcaggggctgctgaatatcctcgatatcaccctgaagggcgagccgaatgaacaggggcagtcacggggagaggccgggcgcttctgtccggtcagcgaactgacggcgatgtcccgccatcagccggaatacgagaatgcctggttctatgcgctggaggtcacccgcgacgcactgggtagactgcggtacacgctggctttctatgacagccattcccggccattggaaaacccacccaaacgccagtttacctgttactttgtcggattttcccaggcaccaatccagctggccgtcggcgaaacctgtcgcgccgaaagtctgcctgaccgttttcagatgaaaaacctcacccccgtttcaaagagttaccccccggtgattgacgatcagcggcactggcaactgttgtcgcattattccatgagcagctacgtactggtctctgctgaatcctttagacaggtactgaaagactacaatttttatggtgagacggatcggcaaactagccgtcatctccagcggatgattgatggtattcaggccatccaatccactccgggcgattggctggagcggggacagcctttccgctgcctgcatgttgaaatcacactggatgaaaccgcctatgccagtccgggagaaatgttccggtttgccaacaccctgtaccagtttctgccgtttttcctcagccatgacatgagaatgcggatggacgtcaccggccagccttccggtgaacaatggcgcctgttcccgcttcccctgcggggatatcgtcccattatgtaa

SEQ ID NO: 535 - DNA, 1965 bp, Xenorhabdus bovienii
  Coding sequence Name=Xb4151_4152.C413.gene13.dna; Position on contig =32605..34569bp; Strand=+
atggatggattagtctttacctgtcagataggcaggctacccggaacgacgtttcaggtggcggatttcagcctgcgggaagcgttgtcagaactttatcacctgacacttacggtggtcagcgctcttgataatattgtactcagtgaacagttgggaatgtcagcctccctgactatcacccgtgatggcgtagtggaacgtaccattaatggtatcgtggcaggggctgaacagggcaataccgacggacgccgcacgtggtacagctttaacgttcgccctgagatgtggcgaatgacactcaatcaggatagccggctctttcaacgccagtcggtgccggacattctcaaacaattactgaaagagcaccgtatccggtcagacagcaaattctatgaggatgaagggcatcacccggtgcgggaatatactacccagaagcgtgaatcggcttatgatttctggtgccggctggcggcggaagagggcatcactttttggtttgaggaagataagctctttttcagcaattcccacctcggcatgctggcggggatttttctgacctataaccctcagccggaaactgacaataccgacgcttccgcatggcagtggcgttacggtgaatttttgtgtcctgatgaatttacccacaaggacaacaatttcctgcgtccctcctacccgttacagcatcaggcgatgtcggaaccgggatacggtcatgccgtgtttgaaagttacggccgtttccagttggatgctgagggtaaacccctttccatgctgcggctcaaccagctgaacagcgaaagtaaacgagggacggccaccaccaactgcattcagctccggccgggtaaaatctttattctcagccatcacccgataacggccatgaatgaccgctggcaggtggtcagcgtcagtcaccacggtgcccagccacaggcggctggcattgctggcgaaggtactacgctaaccaatgaagtgacctttattccgggcagggataactggcggcccccttatcgctacaaaccgcaggccgacggcgatgaagtcgccactgtggtggggccggaaggtgaggagatttttgttaacgaacacggtgccatcaaagtgcatttccactggaaccgatatgacgcgccgggggatggttcctcctgctgggtacgggtcgctcagggctggaacgggcacggtttcggctttatggccattccgcgcatcggtcaggaagtgctggtttcctacctcaacggtgatatcgaccgccccatcgtgacgggctgtacctacaacggtcgcaaccgcccaccgctgaacttaccggccgagaaaacccgcactaccttcagaacccagacccacaaaggacagggcttcaatgaattgcgctttgaggatgccaaggacagcgaggaagtgtatatccacgcccagaaagacttcaccggccagattgaacacgatgtttgctggcacatcaaacacgaccagaaacagagcattgatcataaccactacatggatattcagggggatgagcactcacaggtgatgggcagccgcaaatacagcacggaaggggatatttctcagcgaattacgggctcgcagcatattcaggccggagacgcactggtcagcgaaagcggtcaggaaactcaccacaagagcggcggcaaaatcgtgctggaagcggccaccgaaatcactctgaaagtcggcggtagctttctcaaagtcacacaggccgggattcagtcctccgcgattaatgtcggtcagggatcaggcggcagcgggcggggcgtttcgctgcaattgccggaaggcatcccgccgctgcaggcggtcaaattttcggtcaaaaaatactgtgcacttcaggcacaggagcaggccagttgggtaattaagccacagggcggtcaatcatga

SEQ ID NO: 536 - DNA, 771 bp, Xenorhabdus bovienii
  Coding sequence Name=Xb4151_4152.C413.gene14.dna; Position on contig =34566..35336bp; Strand=+
atgacagtctgttggataacatggctccatgcgcaggaaaaagcgccgatcttctttatcgtcaatcaacttgccatccccaatcccgttgacaccttttacgccaacggctgggtggaacaggcttttccgctctacaacggcactccgctggcccacctgatggagcaggggccgtggctgatccagccgacagcggacagtctggtgccccttggccgtctgctcgaccgccatgccctcagtgattccagttggggctgggcgtatcgcagtgacgccacatggcaggcgcagttgcaccattggaaacgccatcagcttgccactctgcgcggggagtcggtggtttttcgcctgatggatacacggattgcccgtaccctgatgccggccatgcagccgaccgactggacttccttgctcaaccccgtcacggagttgatgctcgatttgctggtacccaccgttttcagccgtccggctgattgcccacccagtctggtggaacggccctttgtattggagccacacctgatagccgcctgggagcagtccgatttggcactggaaggctatgccgacaccctgacctatgaactgtgggaagcgcagggcgcattggccttgcaactggatacacccaacggagcgctgcaacaacggcttacacagtggctgacacagcgcagtcggcagggttcacgtcttcaggcgctgaccctgcgtgattttctggcagacagcggccttgataccctgcgggcttaa

SEQ ID NO: 537 - DNA, 1539 bp, Xenorhabdus bovienii
  Coding sequence Name=Xb4151_4152.C413.gene15.dna; Position on contig =35356..36894bp; Strand=+
atgaataatacaggaagattagactgcgctccctgcgatgacattttcaagcactggctggagttccagcttctagacttgcagggtacacctctgactggtattccctaccggctaagaagccgggatgggataattgatgcccggggggttaccgatggtcaggggctattgcgtgaggaaaatttatcgccgttgccgatgaccctgcacgtcgatgggcaggcactggcggagcaactgaccgaaaaactcctgacagagaaccggatctccacgcagggcggcacccatcaccggatccagccgggcgacgtcagtgacgccctgccggatctgcccggctggacaagggaaaacctgactgcctcccaattttaccccgatcctacgtttggcggatttcaggtcatgccgtctcataaccgtcggcacgtactggaaatcgcccgtatcgtggagccggtgtttgccaaatcctgcctgcaatccgccggttgtaccgatgccggaacggacacggagccgcatacccattttggggaaacatcgatattcatgccattctctgcttctcagccccaggagcaagcgcaaaagccggctcaagcgggttttttcctgcttcctcagatgatgacgcaaagtactaccagcgcattgggagtgggagccggagctgctgcaaataaccagaaaacggaagggacaccgccgcttctctctcgcaacgaaaagcaggtcttgaatggggcatgggacagggcatttccggattatcagctgatgagtactatgcagacggtactgggggtgatgatacggggcatatggaatggcagtgatggcgatttactgacccgtgataatttgacaaaaattgccgacgtaaaaggcaccgcgcctacccgtgtgcgctaccgttttgtggaagatgctcggacagggcaattaaatgcagtgggataccataccagcaaggaaagtgggctggatcaggtgaaagttcgtaatatgtcccataataaggaactgaaccggtacgaattttgggcagatgaaaatgcgaatgaacccaccctgatatggtacccggataatccgggttttattgcacccaatagtacgggtaatcagcaagttttggatctttccagccgcccaactgtcttgccaataccggaagatacaggaatccaaatagaaagctatccgatgccagaagagcggagttttcaggattatattctggtgttcccgatctcgaatatcccgccgatttatgtttatttgagtgcatcactcaaaggtaaagaagccactgacgcggctaaaaaattgggatatgatcaacgaataccagcacaaaaagcaccttttaattctcatggacaaactgtattttttaataaaaaaacaaaaacttatattactccggatgtggatgggcataatgttaataatggttggaaaatgatggataaaaaaggtaaaaggataggaacttatgatagcgagcttaatagacttaaggattaa

SEQ ID NO: 538 - DNA, 444 bp, Xenorhabdus bovienii
  Coding sequence Name=Xb4151_4152.C413.gene16.dna; Position on contig =36898..37341bp; Strand=+
atgtttaatattgtaacaaaagattctgccgttaaattttttggcgaattaactttaccatcatcaataatcattgatgattttaaagaggagtttcacttaccaatcacttattggagtttaattgattataaaaaaagttggtataatgccttaaaggaaggattgcataaaaaaaatcatgctgcattagctgtttctatgtatgatccaattagtgttaattttatttttatatggataatatattttgaaggggaagatgtatttttgcagaatcaaacgctatttatagaagattgtcaaaatttttctccgagtaaacttaatgattttattgatcctcgttatacagagactgaaaatggagatagagtatccgaatggagtacagatataaatagtatattagaattttataaagaactagaaaattcaatttaa

SEQ ID NO: 539 - DNA, 735 bp, Xenorhabdus bovienii
  Coding sequence Name=Xb4151_4152.C414.gene1.dna; Position on contig =156..890bp; Strand=+
gtgggtgttgatgttgttgcggaagcaaccggtattttcctgaccgacgaaactgcacgtaagcacatcgctgctggcgcgaaaaaagttgttctgactggcccatccaaagacgacacgccaatgttcgttatgggtgtcaaccacaacgcctatgccggtcaagagatcgtttccaacgcatcttgcacaaccaactgccttgctccactggctaaagttatcaatgacaaattcggtatcgttgaaggtctgatgaccactgttcacgcaacaactgcaactcagaaaactgttgatggcccatcagcaaaagactggcgtggtggccgtggtgcagcacaaaacatcatcccatcttctactggtgccgcgaaagctgtaggtaaagttatcccagaactgaacggcaaactgacaggtatgtctttccgtgttcctactcctaacgtttctgttgttgacctgactgctcgtttggctaagccagcaacttacaaagaaatctgtgatgcaattaaagaagcctcagaaggcgaactgaaaggtattctgggttacaccgaagatgatgttgtttccactgatttcaacggcgaaaaactgacttctgtatttgatgcaaaagcaggtattgcgctgaacgataactttgtgaaactagtttcttggtatgataacgaaacgggttactctaacaaagttctggatctggttgctcatatctctaaataa

SEQ ID NO: 540 - DNA, 873 bp, Xenorhabdus bovienii
  Coding sequence Name=Xb4151_4152.C414.gene2.dna; Position on contig =1034..1906bp; Strand=+
atgcttgataaaattttctcattaccgattgtagaacaaatatctccttatattagccagcgaaatattgaaggatttccgttgattgttctgtcacacccaaaagtacgcggcgcaatcagtattcagggggcacatcttattacatggcagcccagtggtgaaaaacctgtattatggttaagcgataacactgaatttaatacaggtacagccattcgtggtggcattcccatctgttggccctggtttggttcgacaagcgctcccagtcacggttttgcacggatcttaccttgggaattcagggcacaccatgaaaatgaaaacggcgtgatcttgacatttacactacaagataatgccgagacacataagttatggccgcacgagttcacactcattgcccgttttaagttaggggaaacctgcgaaatagagctggagtctcacggagaatatcaaacaacatgtgctctccactcttactttaatatcagtgatgtcaatcaaatccgtgtcagcgggcttggtgctcactttatcgataccgttgccgataaaaaacagtacgttcaccaagatctgacttttaaaggacgaattgaccgcatttatactgaaccagaagatttcagtctactcagtgatacaccgtggaaacgaactattgaaattcaccattatcaccatagtgatgtagtttgctggaatcccggtgccgaactttccagcagtatgaaagatatgagtaaagaaggttacaagaatatggtttgcatcgaaactgcatgtatcaactccccacaactatccagaaataacaaccctgccaggctttctgtggttatccgttgccgtaaaaatccttga

SEQ ID NO: 541 - DNA, 747 bp, Xenorhabdus bovienii
  Coding sequence Name=Xb4151_4152.C414.gene3.dna; Position on contig =2004..2750bp; Strand=-
atgactaataaggtgtttattgcagtagtggggctttgcctgtcttcttctgtggcatatgctggcgaatggtctattgggttgtcggcattgtatgaagctaaaccttacaagggattgaaaacaaaagataagatactgccggttcccatggtatcttatgagagtgaaaacttttattttcagactctggcggcaggttattacctctggaaccagccaaaggataagctttctgtagatctattctatgctccacgagctttccaccccaaggatagtacagatgagcagatgaaaaaactggatcgtcgtcgtgacacggttatgggtggtttcacttataaacatcatgaagactgggggagcctgcgtgcctcattagctgccgatatactgggcgaaagtaacggtatcagtgctgatttcgcctacttatatagtttcaagcaaaacggctggttattggaaccagggataggcattgtctgggatagcaaaaaacagaaccgttatagttatggcatcaaaaagaacgaatctgttcgcagcggtctggctgaatatacaccgggcgatagctggagtccttatcttgaattatctggttattataccttcgataataattggactgctttcatgatggggcgtgtagaacatttaccaagcgaagtgaaaaacagcccgatgaccaatcgctcatactccggtactatctggtcgggtattacttatactttctga

SEQ ID NO: 542 - DNA, 1068 bp, Xenorhabdus bovienii
  Coding sequence Name=Xb4151_4152.C414.gene4.dna; Position on contig =3027..4094bp; Strand=-
atgccacgtcctattttggcgacgatccatctcgatgcattccgccataacttggcggttatccgccagaaagtcggtgacagcaaaatctggtcagtagtgaaagctaatgcatatgggcatggattggacagaatatggcagtcactcatgcaaacggatggattcgcgctgcttgatatgaatgaagctatttatttaagggaacacgggtggcaagggccaatcctgttattggaaggttttttcaaactttcggatttgcagctcattgatcaatatggcctgacaactacagtgcatagttactggcaactcaaggcaatagaagaagccagactgaataaccccattgatatctatttgaaaatcaatagcggaatgaatcggctgggttttacccccgaagaatattcacaagtggtctcaatggcgaattgcataaaaaatatcaagtcagtcacgttgatgactcattttgctaattcagataatgagattggtattgatgagcaatttgcggttgttgaatgtctgaaaatggacttacttcctcgctgtctagccaattctggtgcagttttgtggcatccgaagacacatggtgattgggttaggccgggtatcatcctgtatggtgcatccccgagtggaaaatggcgtgatattgctgatgtgggtttgaaaccagcgatgagtttacacagtgaaatcattgcggttcatgacctacccaaaggggcaaaaattggctacggcagccgttatacaacccagtatcctacccgtataggtacggtggcatgtggttatgctgatggttatccaaggcacgcctcaacgggtacccccatccttgttggtggtgtccgtacacagttactgggtgccatatcgatggatatgatgacggttgatttgacgccgtgtccacaaacagaaataggtagtaccgtggagttatggggggaaaacttgccagtggatgaagtggccgaatccgcaggaaccattggttatgaactgctctgtgctttagctatacgtgttccggtagttgttaactga

SEQ ID NO: 543 - DNA, 1302 bp, Xenorhabdus bovienii
  Coding sequence Name=Xb4151_4152.C414.gene5.dna; Position on contig =4111..5412bp; Strand=-
atgaaagtccttattttaggcggtggcgttattggtgtcaccagtgcgtggtatttggcacaggaaggtcatgaagtgactgtggttgatcgccaggatagtgccgctgaagaaacgagtgcaggtaacgccggtcagatctcaccgggatatgcaacgccatggggagcaccggggataccactgaaagcagtaaaatggatgtttcaacgccatgcaccactggctattcgccctgatggttcactatttcagctacgctggatgtggcaaatgctgcgcaactgtgatgctgaccattacgccatgaataaaagcaggatggtgcgattggcggaatatagccgtgattgcattaaacagttaagggcagatactggcatccaatatgaagggcgtcagggaggaactctgcaattatttagaactgccagacagtttgataatgccgccaatgatatcgcagtattggaacaagaaggtgttccttaccaattattgaccgcagaacaactggcatcagtggagcctgcacttgcccatgtttcccataaattgacaggtgggttacaactgccgaatgatgaaacgggtgattgtcagatatttaccaaagcgctggcaaaaatggcagaagaggcgggagtcaagtttgtgtttagcaatcaggttaaacagattctggtggatggaaacaaaatcacgggtatccggtgtgatggtggcatcatgacggcggataactatgtggtggcgatggggtcttattctaccaacatactgaaagaattcgttaaaatccccgtttatccgctgaaaggctattctctgacgatgccgattatggatgaagcaagagcgccaacctcaactgtactggatgaaacttacaagatagctattactcgttttgataaccgtattcgcgttggtggcatggcagaaatggtcggtttcaatatgaatgtaccgaataatcgctgtgaaacgttaaaaatggttgtgcaggatctctaccacagcggtggcaatattgctgaagctgcattttggacggggctacgcccaatgacgccagatggtactcctatcgtcggcccaaccaaatatagtaatctctatttaaacacaggacatggaacgctaggctggacgatggcctgtggttcagggaagttattgtctgatttaatttctggcaagacgccggaaatcgcggcagatgatctctcggtatttagatatatcaatggattcaatacaaaagtgcttcgagtgaagcatcgtttacatactgcataa

SEQ ID NO: 544 - DNA, 723 bp, Xenorhabdus bovienii
  Coding sequence Name=Xb4151_4152.C414.gene6.dna; Position on contig =5949..6671bp; Strand=-
atggtaattaaggctcaaagccctgcgggtttcgcggaagagtatatcattgaaagcatttggaataatcgctttccaccaggttccatgctgccagcagagcgtgaattatctgagttgatcggtgttacccgtactactttacgtgaagtgttgcagcgccttgcccgtgatggctggttgactattcagcatggaaagccaacaaaggtcaataacttctgggaaacatctggtcttaatattctggagacgctggcacggcttgatcatgatcgcgttccccagttaattgataatctactggcggttcgtaccaatatcgccgcgatttttattcgtactgcatttagacataatcctgaaaaatcattggaagtattggcagaaaaagagagtgtggaagataccgccgaatctttcagtgccgtggattatgatatttttcgtgggctggcttttgcgtcaggaaatccaatttacggtttgattatcaatggattaagagggctttatacccgcgttggccgctattatttctcaaatcctgatgcccgtatgctggcactgaatttctatcagcaattgagtacgatgtgtcgggaacaatcctatgacaaaatcatggattgtgtgcgtagttatggtaaagaaagtggaaccatttggcatgacatgcaaagtgttatgctgaatgatttaacagaagcacgtcacagctga

SEQ ID NO: 545 - DNA, 1551 bp, Xenorhabdus bovienii
  Coding sequence Name=Xb4151_4152.C414.gene7.dna; Position on contig =6908..8458bp; Strand=+
atggaaatcagtattcgacatgcagtggtgaaaaactttctcggcaactcgccggattggtacaaattggctatcattgtttttcttattatcaatccactggtttttttctttgtcaatcccttcgttgcagggtggatgctcgttgtcgagtttattttcacgttggcaatggcgttaaaatgttaccctttacaacccggaggattactcgctattgaagcggtcatcatcgggatgacttcgccaaaacaaataagtcatgaaatttccaacaatctcgaagttattttgctgttgattttcatggttgctggcatttatttcatgaagcaactgctactatttgttttcacgaagctactgttaactattcgctctaaaaaaatgctgtcactcgcgttttgcctggcgagtgcctttttgtctgcgtttctcgatgccttgaccgttattgccgtcgttatcagtgtctcggtagggttttactccatttatcaccatttcctttccgccagccaaaataacaactctgacctgaacgatgatcagtttattgacggcgaagataagaagcagactctggaacaattccgggcatttctgcgcagcctgatgatgcatgcaggtatcggtacagctttgggtggtgtgatgaccatggtgggcgagccacaaaacctgattattgctaaacacgttggctgggatttcgtaacgttctttattcgtatgtctcctgtcaccataccggtatttgtctgtggtctgctggtctgcttgctggtcgagcattttaaattatttggttacggcgctgaattacccgttcatgttcgttcggttttagaagattacgataaaaaaaccagtgaaaaacgcactcggcaggaaaaaactcaacttgccgttcaggcattaattggtatctggctgattttggcactggctttccatttagcagaggtcgggctgattggtctgtcggtaatcattctggctacggcattctgcggtatcaccgaagagcatgatttaggtaaagcgttcgaagaagctcttccgtttactgcactgttaaccgtctttttctctgtcgttgccgtgattattgatcagcaattatttacaccatttattcaatatgtgctgcaatcttcgccagcctcacaattgtcattattctatttgttcaatggattgctttctgccgtttctgacaacgtattcgtaggtacggtttacattaatgaagcgctaattgccttgaagaatggtttaatttcacagcaacaatatgaatttctggcagtagctatcaatacaggcacaaacttaccgtcagtggcaacaccaaatggacaagccgcatttttattcttactgacatctgccctgtctccattgattcgtctgtcttatggccgcatggtggtgatggcgctgccttataccattgtaatgaccttggtcggcttgttgagtgtggaattctggcttgttccagcgactgagtatctgatgaaactcggtctgatcactccgctttaa

SEQ ID NO: 546 - DNA, 393 bp, Xenorhabdus bovienii
  Coding sequence Name=Xb4151_4152.C414.gene8.dna; Position on contig =8758..9150bp; Strand=+
atgtgtatttatgagcggattgcactatttggcattttgggagcggctctgctcggtgccattacaccaaaaacgccactacgttggctggcaatcctgctatggctgtatagtgggtggcagggattacaactggcgtgggatcataccatgatgcagctccatcctaccccttttaatacctgcgaattttttgtcagattcccgtcatggctacccttgaatgaatggctgccttctgtgtttcaagccactggtgattgttcggtgaaacagtggtcatttctgactctggatatgccacaatggttaattggtatttttgctgcttatttggtagtgggtgttttggttctgatcagtcagttttttattatccggggtaagaactga

SEQ ID NO: 547 - DNA, 249 bp, Xenorhabdus bovienii
  Coding sequence Name=Xb4151_4152.C414.gene9.dna; Position on contig =9359..9607bp; Strand=-
atgggatgggtattagcgggttgcagtgggcaacaaactgatcattcatctaaacgccataaaaattatcagtattctgatctgggaatcaatctgagtgaaaatgccagtatgaactgttttgatgcagggggaattctcgcgagggcaatacagattaatggaaatcaaacgccggtttgccaattagcgaatgggcggcgctgtgatgaacgagccttgttggatggtggctgtacgtctatttga

SEQ ID NO: 548 - DNA, 915 bp, Xenorhabdus bovienii
  Coding sequence Name=Xb4151_4152.C414.gene10.dna; Position on contig =10170..11084bp; Strand=+
atgaataaccataaaaatcaatataatttcaataaattacaaaaacgcctgcgtcgtgacgcgggtcaggccattgcagatttcaaaatgatcgaagaaggcgatcgtattatggtctgcctttctggtggaaaagatagctatacgcttctatccattttgcagaacctgcaaaaaagtgcaccagttaatttctctctggtggcagtgaatctggatcaaaagcagccaggattccctgaacatatcctgccagcctatctggaagagctgggcattgagtataagattgtcgaagagaacacttacggtattgtaaaagagaagatccctgaagggaaaacgacttgttcgctctgctctcgccttcgtcgtggtattttgtaccgcacggcaactgagttaggggcgaccaaaatagctctgggccatcaccgcgatgatatcttgcagaccgtatttttgaatatgttctatggcggtaagttaaaaggtatgcctcctaaattgatcagcgatgatggcaagcatattgttatccgcccacttgcctattgccgggagaaggacattgaacgttatgccgaggccagagcgttcccgatcattccttgtaatctgtgcggctcgcaacccaacttacagcgtcaggtcattaaggatctgctgcgtgactgggacaaacgttatccaggacgaatcgaaactatgtttcgtgccgtgcaaaatgtggttccatcacatctcagcgattttaatctgttcgatttcaagaatattactcatggcagtgaagtgattgatggtggggatttggcctttgatcgtgaagaactgccctcgcagccagccgttgaatcagatgaccaacttgattttcaagcagatcgtctggatgtggtcgaaataaaatag

SEQ ID NO: 549 - DNA, 984 bp, Xenorhabdus bovienii
  Coding sequence Name=Xb4151_4152.C414.gene11.dna; Position on contig =11360..12343bp; Strand=-
gtggaaacgatttatggctcagtttttaaagattccgacgctgtgtattcctgccagttgaatggcaagggaggtatcatggcatttggggaaaacgaagccgcaacagcagaacagccattctggcagcaccttgattataaaaatcaggctagccagcgatggatcatgggtacggctttgctgccgacctcagtgaaagaagggttgtcaggtgaaagtatccgaccaaaagtgcttcgcactggcgaaggcacgatgatcaccttgcggacagttaatcgcaatgaaaatgcacgtcctgatcacttggtctcgttccgcatctatatcaatgacagaatgattatttccagccgtcaccggaaagttcgttgtatcgatcaagccatggatgatttacataatggcgttggtgccaaaagtacgggtcattggctggttgaaatagccggggccattaccgatgaaatgaacgattttattgaagagctacatgatagcctaataggttttgaggacgatattctggagcagaaagtccccggacgcggagaattagtgttattacgtaaacaattaatcgttttgcgtcggtatatggcaccacagcgtgatgtattcctgcgtttggccagtgaacggctaccttggatgaatgatgaggatcgtcgtctgatgcaggagatcgctgatcgtctcgggcgggggctagatgatcttgatggcagtatagcgaggacagcagtccttgcagatgaaatatcgtctatgatggcggatgcgatgaatcgccgcatttatatgatgtctttgttgacgatggtattcctgccaacgacctttttgacaggtttgtttggcgttaaccttggtggaatacctggcaatgagtatcggtttggattcggcatattctgtctcttactattcatactgataactatttttgcttggtggttaagacgaaccaaatggttatag

SEQ ID NO: 550 - DNA, 1617 bp, Xenorhabdus bovienii
  Coding sequence Name=Xb4151_4152.C414.gene12.dna; Position on contig =12356..13972bp; Strand=-
atgcataattttaagttgcttccctctgtattgctgatgactggactttctttttctgtttctgccgctaatgtacctattggaactcaacttgacggccgtcaggaactggttcgtcaattgaaagatgaacctgcatcattggatcctattaaatcctttggcttgacagaagcacaggtgctgcgtgacctgcttgaaggattggtgaatcaggatgtttatggagagcccatccctggcgttgctattgattggaagacaacagacaaccagacgtgggtatttacgttacggcagaatgcacactggtctaacggtgacaaggtcacggcatctgattttgtttatagctggcggaggttggttaatcctgctaatgcatcctctttttcttggtttgcggctttatcaggcattcagaatgcacaggaaattattgatggcaaattaccatcagaaaagttgggagtggaagcgattgatccatatacattaaaagtcagcctagatcgtcctgttccttattttcctaatatgacaaccaattttagtctttatcccgttcataaacagagtgttgacaaatatgggaatgattggacaagggtcggtcatttggttggtaatggcgcatttatgcttacgggacgtgttgtaaatgaaaaaattgttctgacaccaaatccttattattgggaccataaaagtactgtattgaaaaaagtcacttttttacctatcaatcaggaatcccacgcgaccaagcgttatttggcaggggatttggatattactgaatctttccctaaaaataggtatcagaaactattgcgggatatcccaggagaagtattcacgccggatcaactaggtacgtattattacgcattcaatacacagcgggcacccaccaatgatattcgcgttaggcgagcgctttccatgacgatagataggaaactgattgcaggaaaaatcttgggaacgaacgaaaaacctgcatggcgctttacacctgatgtcactgctggattccagccagaaaaaagccagcatgaagttttaacccaacaggaattggatgatcaggcgagaacattactgaaagaggccggatatggcttcggtaatccattaaaactttccctgctttataacaacttagaaaataaccaacggatcgctattgcaataagttcagagtggaaaaagaaactgggtgttgaggtgaaattagttaatcaggaatggaaaacctatgttgataatcgtaacaccggtaattttgatgtcgtcagagcatcttggactggggattacaatgagccatcaagttttttatctcttttgacttcaacgcatagtggcaatctcgctaaattccacaattctgcctatgacacattgctaaaagaagctagtcaggaaactgatgaaatggcgagaaaccgtgattacaatcaggcagaaaaaataattaccgaacaagcgccaattgctccgatttatcaatataccaatggccgattgatcaaatcatggctaaaaggatacccgatcaccaatcctgaagacgtggcctatagtcatagtatgtacatcatcaagcactaa

SEQ ID NO: 551 - DNA, 504 bp, Xenorhabdus bovienii
  Coding sequence Name=Xb4151_4152.C414.gene13.dna; Position on contig =14139..14642bp; Strand=+
atgacacaaacagtcaagtttcaaggtagcgatatcaccattaatggagattttccacaggtaggccaaacaacaaaagaattctcactggtagctaaagatctcgccgatgtgacactgagccagtacgcaggaaaaagaaaagtactcaatattttcccaagtattgataccggtgtttgtgccacatccgtccgtaaattcaatcaagttgccagcgaactgaataatactgtcgtgctttgcatttcagcagacttaccttttgcacaatcccgtttctgtggtgctgaaggtttgtcaaatgtggtgatgctttctacattacgtggtggtaaatttcacgaagattacggtgttgcgataagccaaggcccattagttgggttaactgcacgtgccgttgttgtcttggatgaaaataatcaggttatttatagccagctagttgatgaaatcaccaatgaacctgactatgacagcgcattatcaatactaaaataa

SEQ ID NO: 552 - DNA, 477 bp, Xenorhabdus bovienii
  Coding sequence Name=Xb4151_4152.C414.gene14.dna; Position on contig =15549..16025bp; Strand=+
atgttgtttcctttgcttgatgctatcgatacgctccaccaagcaggatatctgcactgtgatatttctctggataatattcttattcaagatgatcagttacccatattacttgatttaggctctgccagaaaagcaacggaacgtttgtcagatgaaaaggaagtgaccataagtcctggatttacggctgttgagcaatacaccgtcaacgaagaagggcaacaaggtccttggacagatatttactctctaggagcggtattgcataccttgattgtcggaacccctcccccagtcagtattgtgcgaaatattgaagataactatctgccattgagtaagctttgtcctgcgggatattcttcatcatttttacatataattgaccgtactttgaaaataaaactatcagaacgcccattgtctataacagaactaataacgcagataaaagcgtcgactataaagacatga

SEQ ID NO: 553 - DNA, 1584 bp, Xenorhabdus bovienii
  Coding sequence Name=Xb4151_4152.C414.gene15.dna; Position on contig =16203..17786bp; Strand=-
atgcgattggaagttacttgtcaggatcgaattgggttgacacgcgagctacttgatttattggttttacgaaatattgacctgaaaggaattgagatttctcctgcacgtcgtatttaccttaattttactcaaattgatttcaacacctttcgcttattgatggcggaaattcgccgtattaacggagtaatagatgtcaggacggttgcttttatgccgtcagaaaaagagcacagggcaatgtggacattgctggagtctgttcctgagcccatattttctattgatatgaaaggaaatattgatctggttaatccggcatctttagtattatttggtctcaacaaagagagaattggtcaaaaaaacattggccaccttatcagtaattacaatttcctccgctggcttgagagtgaacatcatcaacctcattcggcaaatttagtcatcaaaggtcaagattactgcatggatattattcccatgcaattaacggatgaaaatcagtctgttaaatgtgtgggagctgtgattatgcttcgttcaaccacgcgtgttgctcttgtcccatcgcgtaaaaagtttactgtgagcgatgacagtgcttttgacaaaattgttgctgtcggcccgaaaatggttcatgtcgttgagcaaatacgtaaaatagcgatgctggatgcacctttattgctgattggtgatacaggaacaggaaaagatgagtttgccaaagcttgccacctgcggagttcaagaagaaaacagccttttctaggattgaattgtgcttccatgccggatgatgttgcagaaagcgagctgttcggttatgccgcaggagcttatccgaatgcactggaaggtaagaaaggtttttttgagcaggctaatggcggcacggttttgttggatgaaattggtgaaatgtcgccacaaatgcagatcaagttactgcgttttctcaatgatgggacgtttcgtcgtgttggtgaagatgatgaagtcaaagttgatgtcaggattatctgcgctacccaaaaaaacttggtcgagctggtgcagaagggggaattcagggaggatctctattatcggcttaatgtattgactatcacattgcctcctttgcgggaacgtcaggcggatatcatgccgttggcggatttttttgttacccgctttgctgaagaacaggggttagaaaagcctaaattcgctcatgaactggaacactttttgtgtagttatcattggccgggaaatgtcagacaattgcgcaatgctatttatcgggcactaactcagtttgaaggtcaccagttacgccctcaggatattcagttacctgaattagagacagaggttgcattcagtgacgatattttgtcaggctctttggatgaaattagtaaacgttttgaacgttctgtactcattcgcctttaccgtcattatccaagcacccgaaaactggctaaacggctaggagtttctcacacagccatcgcgaataaattacgtgaatatagtttaagcgggaaaaaacagatggccgaacatgaagatgatgagtag

SEQ ID NO: 554 - DNA, 1089 bp, Xenorhabdus bovienii
  Coding sequence Name=Xb4151_4152.C414.gene16.dna; Position on contig =17916..19004bp; Strand=-
atgactgatcccttgaaaccgagaattgatttcgacgattgtttaaagacccagtcggaaccctcattgaaatctaagaaagaattcaatggacaggaaaatgagttttgtccagtcgcgcctgaacgggaagcagaagagcaaaaaagcgagtttgaaggcgcagtcaatgccgctctgaaaccaaagcgtagtttttggcgaaaagttttttctggtgcggttctgttgttgggtattagtgtggttgcgcagtttattcaatggatataccaatcatggcagcaacacgattggatttcgctgggggtggccgccgcaggcagcatgattgtttttgcaggcataggtactgtaataagcgaatggcagcgtctttatcgtttgcgtcaacggacagaagagcgcgatatagcgaagtcattattgcaaagtcatggcataggtaaagggcgtcaattttgtgagaagctggcggagcaggctggaatcgggcagcagcatccggcattgcaacgttggcaggctgcggtacatgagacacataatgatcgtgaaatcgtcatgctctacagcaaacatgttcagcctgttttggatgttcaggctaaaaaggagatcagccgctcggcagcagaatcggctttaatgattgctgtcagcccactggctatcgtggatatggcctttattgcatggcgaaacattcgccttattaatcgcattgcggcattatatgggatcgaattgggctatttcagccgtattcgcctgttccgattggttttgttgaatatagcttttgctggtgcatcggagctggtcagggaagttggtatggattggctgtcacaggacattgctgcccggctttcggcacgtgccgctcaaggtattggtgccgggttgctgacggcacgcttgggtatcaaggcaatggaactgtgccgtcctttaccgtggattgatagtgataagccaaaactgggggatttccgtcaccagttgatcactcagcttaaaagcacgttaccgacgaagatgaaaagtgcagtaaaaggaacagagaacagcgcagtaatcaaatag

SEQ ID NO: 555 - DNA, 1398 bp, Xenorhabdus bovienii
  Coding sequence Name=Xb4151_4152.C414.gene17.dna; Position on contig =19001..20398bp; Strand=-
atgaaacggttgcaaaacgaattgaaatctcttgttaatcgtggagtagaccgtcatttgcggctggcggtgacaggattaagccgtagtggaaaaacggcatttattacttctttggtgaaccagcttcttcatgtccacagcggggctagattgccgttgttttctgctgtgcgggatgggcgtttacttggtgtgaagcgggtgcctcaacgggattttggtgttccccgttttgcttatgatgaaaatattaccgcattgcacgatacacccccttattggccaataccaacgcagggcgtgagtgaaatccgtctggctctgcgttatcgctctgaagattccctgctgcgttatctcaaagaaacttccaccctgtatctggaaatcgttgattatccgggggaatggttactggatttaccgatgttggagcagaattatctggcatggtcacgacagatgaacggtatgctgaaaggggaaagggcagattgggctaaaccatggctcgaattatgccaacagtgcgatcccctggcacctgccgatgaaaatttgcttgccagaatcgcacaggcttatacgcattatctgcatcaatgcaaagctcaggggttgcatttcattcagccgggtcgtttcatattaccgggtgatctggcaggggcgccggcactacaattttttccgtggctggatattaacggcatcggggagtcacaactggccaaggcggataaacataccaatattggtatgttgcgggaacgatttgcctactactgcgatcacattgtaaaaggtttttataaagagcactttcttcgttttgatcgacaaattgttctggttgattgtttgcagccattaaacagcggtccaccggcttttaacgacatgcgtctggctctggcacagctcatgcagagttttcattatggtaagcgaaccttatttcgccgcttattttcaccttgcattgataaattgatgtttgcagcaagcaaagctgatcacgtgactgctgatcaacacgctaacctcatatctctcttacagcaattagttcaggaagcgtggcagaatgcggcttttgaagggatcagcatggattgtgttggtttagcatctgttcaggctactgaaagtggtattgtgcttcacgatggtgaaaaaatccccgctatcaagggaaatcggttgtcagatgataaattgctgacgtttttcccgggagaggtgccacagcgtttaccgaacaatgacttctggcaaaaacaagggtttaattttgaatcttttcggccaaaacaagtaaatgtagatacaccgttacctcacatccgtatggacagtgcgatggagtttttattgggagataaactaacatga

SEQ ID NO: 556 - DNA, 363 bp, Xenorhabdus bovienii
  Coding sequence Name=Xb4151_4152.C414.gene18.dna; Position on contig =20552..20914bp; Strand=-
atgtcgaatacttatcgccggaaactttaccgtcttccagagcaggggatggtgaaaggagtttgtgctgggttggcgagttattttaatgtaccggttccgctcatgcgtaccatcacggtattatcgttgttctttggattatttggcttcacggtattggtatatattatcttgacctttgttatggatcccgcgccagcgggatatcaggcagaggacataaataagaggccatcgggacaaaagatactggatgaggttgattaccaactgagggcaggtgaaatgcgcctgcgtcagatggagcgctatatcacctctgatacctacagtgtgcgcagccgttttcgtcagctttaa

SEQ ID NO: 557 - DNA, 222 bp, Xenorhabdus bovienii
  Coding sequence Name=Xb4151_4152.C414.gene19.dna; Position on contig =20914..21135bp; Strand=-
atgggctatatatttcttggaatcccgctgatcctcttcgtgctttttgttttacccatctggttgtggttgcactatagtaaccagagtcggggtcagttagggagcaatgaaattcagcgtttggagcaattggcagagaatgcacggcatatgcaggagcgaattaaaacgctggaagagatacttgatgcagagcatccaaactggaggcaatcataa

SEQ ID NO: 558 - DNA, 672 bp, Xenorhabdus bovienii
  Coding sequence Name=Xb4151_4152.C414.gene20.dna; Position on contig =21168..21839bp; Strand=-
atgggtattttttctcgttttgctgatatcgttaacgccaatatctcttccctgctggataaagcagaagatccacagaaaatgatccgcctgatgattcaggaaatggaagatacgctggtggaaattcgttcaacatcggcccgcacattagcagagaaaaaacagcttttgcgtcgtatcggtgttggtgagaatcaaatagaaggctggcaagaaaaagccgaactggcgttaagtaaagaaaaagaagatctggctcgcgccgctttgattgaaaaacagaaaatcagtaatttgatttacgcgttgaaaaatgaactgtctattctggatgaaacccttggacgtattaaaggggaagtaactgaattggaaaacaaactgacagaagcgcgtgcaagacaacaatcactgaccctgcgccatcaggccgccgcatcttcccgtgaagtacgccgccaactggacagcggtaaaattgatgaagcgatggcacgtttcgaacagtttgaacgtcgaattgatcatatggaagcagaagcggaagctattgggctgggcaaacagaaatcactggagcagcaattcacagaattaaaagcggatgacgaaattagtgcacaattggcagccttgaaagctaaaatgagtgtcaaagattcacaatga

SEQ ID NO: 559 - DNA, 1020 bp, Xenorhabdus bovienii
  Coding sequence Name=Xb4151_4152.C414.gene21.dna; Position on contig =22049..23068bp; Strand=+
atgcatcaattcattgataacctattaggcgaagcaaactgctttattgaaattctggagcaagtctctgcacttgcaaaattaaataaacccgttttggtgctgggagaacgaggaaccggcaaggaattgattgcacgtcgtttgcactacctttccccacgctggcaaggctcttttatttccctcaattgtgctgcacttaatgaaaacctgctggattctgagctgtttggccatgaagctggggcatttacgggtgcacgttcaaaacatcaaggacgttttgaacgtgccgatgggggaacactgtttcttgacgaactggctaccgcacctatgcaggtacaagaaaagctactgcgggtaattgaatacggttaccttgagcgggtgggaggcaatcaatcgctacaggtggatgtacgattgatctgtgcaaccaacgaagatctacctgccatggctgcccgtggaaaattcagagctgacttgctcgacaggctggcatttgatgttgttcaaattccgccactacgccaaaggcagcaagatatcatgttactggcacaacactttgccattcagatgtgccgagagttgaacctgtcgttcttccccggatttaccgatgaggctaagcaacagttacttacttatcactggcccggaaatattcgtgaattgaagaatgtgatagaacgctctatttatcgacacagagataatgaaaaagaattagataccatcattatcaatccctttgcatcatcacaaatattttcttcacaaatgtctattcctgcgtgtaatcataacgaagtgatgccttattccctcccctgcttaccttttgatttaagacaatggcaaaatgacagtgaaaagcagttgattatacaggcattggaagaaagccagttcagccagaaaaaagcggcagggaaactcaacctgacctaccatcaactgcgtggattaatcaagaaacaccatatcaacattcatgtcatggattaa

SEQ ID NO: 560 - DNA, 1716 bp, Xenorhabdus bovienii
  Coding sequence Name=Xb4151_4152.C414.gene22.dna; Position on contig =23359..25074bp; Strand=+
atgcgctatttgatttactggatcatattattgctttcagcatccacactggctgctgacaatgctattccagaaacgactaaagctactcaccaagcgattcctgacgacacattggataatttatcctatatgtcggctgccttgcggcagaatggttttatttattgcgttaacggcaatctgaatacttttaaccctcagatggctatcagcggcctgactgtggacactctggctgcccagatttatgatcgtctcttaggtgttgaccctctgacctatcgtttgataccagaactggcttcccgctgggaagtgcgggacaacggggcaacataccgtttttacctgcgccataatgtcgctttccaatcaacggactggtttacgccaacccgcaccatgaatgccgatgatgttgttttcagcttccgtcgcttattcgataaaacgcactattaccattatgtcaacggtggggattacccctattttgatagtttgcaatttggtgattctgtactgagtattcaaaaaatcgataaatatacagtcgaatttcgccttaatgcacctgatgcgtcgtttccctggcacttggcaactcactatgcctcaatattgtctgaagagtatgggcaaaaactgcataagataaatcggcaggaacaaattgattggaaaccagtcggaacagggccattcatgctggaagattatcgggcggaacaatttattcgacttatccgtcatgataagtattggaagggcaagccatacatggaacaggttgttatagatgccggcgccggcggcacaggcagaatttctaaactgctgacgggggaatgtgatgtattggcctatcctcccgcgaatcagttcagtgtgctgcatgataatccgaacctgcaccagacattacgctcaggtatgaatatcgcctatcttgcgttcaatactagcaaaccaccgctggacaagctggcagttcgtcaagccattgcatatgccatcaataatcagcgactgatgaaatccatctattatggcacggctgaaacggctgcctcaattttaccacgcgcatcatgggcttatgataatagtgcggaaataaccgaatataatcccgaaaaatcacgaaaaatgctaactgaactgggattaaatggattagaactgacattatgggtaccaacggcttcacaatcttataacccgagcccattgaaaatggcagaactgattcaggccgatttggcacaggttggtattaagatgtctatccatcctgtcgaaggccgtgctcaggaaaaccaactgatggataaaacccatgacatgactctagctggctggtctactgacagtaacgatcctgatagttttttccggccactattgagttgtgcagccatcgcttcccaaaccaatttgagccattggtgcgactcagcctttgatgatgcactccatcaagctttattaaatcagcaacttgcatcacgtattgaaaactatcatattgcccagaaaatccttgcccagcaattacctgtactaccattagcttatccaacacaactacagatatttcgttataacattaaaggattagtattgagcccatttggcaatagctcctttgctggagtctaccgcgtacaggaaacgaccacgcctactggaaataaaaagggaagcaaatga

SEQ ID NO: 561 - DNA, 966 bp, Xenorhabdus bovienii
  Coding sequence Name=Xb4151_4152.C414.gene23.dna; Position on contig =25071..26036bp; Strand=+
atgattatttatattctgcgtcgtttattgcttctgcttgtgacgctgttttttctttcattaatcagtttcagcctgatgtatttcacgcctcatggacctttgagcggtgcatcattgactgatgcctatgtgttctatctccacagcctgttacagtgggattttggcatttccagcattaatggcgaacgtattattgaacagttgtacagcgtttttcctgcaactatggagctttgtattctctctttttctatggcgttattaatcggcattcctttggggatcattgctggcgtctggcgcaacaaaaaggcagatacaatcatcagtacatttgccctattgggtttttccattcctgttttctggctggccctgttactcactctcctcttttcactgtatttgggatggctgccagtctcaggacgatttgatttactgtatcggatggagcaagtgacaggttccgcactggctgatgcctggctgtccaaagaaccttatcgcaatgaaatgatcgtgaatgtcattttgcacatgatcttacccgtcatcacactagccgttgcacccatgaccgaagtcattcgtttaatgcgcaacagtgcagaggaagtctccgcatcaaactatatcaaatcggcagccactcgcggactgtcacgattgacgattattcggcgccacttgttgcataatgccctgcctcccattattcctaaactgggattacaattttcaaccatgctcacgctggcaatggtaacagagcaggtattcaactggccgggtttgggacactggctcatcatcgccattcgccagcaggattattcagccatctcggctggcgtgatggtgatcggagctttggttatttcagtgaatgtgctgactgatattattggcgcgatagctaatcccctgaagcataaggaatggtatgcccttagataa

SEQ ID NO: 562 - DNA, 888 bp, Xenorhabdus bovienii
  Coding sequence Name=Xb4151_4152.C414.gene24.dna; Position on contig =26023..26910bp; Strand=+
atgcccttagataatttctaccgtgaaaagaaaatgccttctccactgaaagttatctggcgttttttctatgctgatatactggcaatgacgggtttttatggggtactgattttaattgcattaagtcttttgggtggacaaattgccccctatcaacttgatcagcaatttatgtaccagcttatgcccccgtcatggtcacaccacgggaatgtcgcctttttccttggaactgatgatctcgggcgagatattttcagtcgtttgctgattggcacgtcttccacatttggagcggcattaattgtgactgccgcagcggcaattgctggattagctatcggtagccttgctggtatgactcatggactgagatctgctgtcttgaaccatattcttgagacattactttcaattccctcactgttactggctatcattgtcgtggcttttgtaggagccagtctgcaacatgcaatgattgctatctggctggcattactgccgaggatagtgcgcacaatttatactgctgtacacgatgagctggataaagagtatattatcgcagcacgtctggatggtgcttcaaattatcggattttgcgatatgccgtctttcctaatattacagcggcgatagtcagtgaattaacccgcgcactctctatcgctattcttgatattgctgcattaggctttctcgatctaggtgctcaattaccatcacctgaatggggagccatgctggggaattcattagaactcatttactctgccccttggaccgtcatgttacccggtgctgccattacgctcagtgtcttactggttaatttactcggtgacggactgcaccgcgccattaatgcaggagtcgaataa

SEQ ID NO: 563 - DNA, 996 bp, Xenorhabdus bovienii
  Coding sequence Name=Xb4151_4152.C414.gene25.dna; Position on contig =26910..27905bp; Strand=+
atgcctctgctcgatatccgaaatctcaccattgaatttatgacgtcagaaggccccgttaaagtggttgaccgtatgagtatttcactgacagaaggtgaaatactcggattagcgggtgaatcaggatctggtaaaagtttgattgccaaggcaatctgtggtgtcacgaaagacaacctcagcgtcaccgcagaccgttttcgtttcaacgacattgacttattgcgcctgacgttaagacaacgtcggaaagtcatcggacacaacatttcgatgatttttcaagagcctcagtcatgccttgatccatcagaaagtattggcaaacagctcattcaatccatcccgggctggacctataaaggtcgctggtggcagcggtttaattggcgaaaacggcgtgccatcgaactactgcatcgagttgggattaaagatcactatgccatcatgcactgttatccttatgagttaacggatggagaatgtcagaaagtgatgattgccattgcactcgccaaccagccacgactgctgattgcagatgaacccaccaacgcaatggagccaacaacacaagcccagatattccgcttactatcgagcctaaaccagaacaacaacatgacaatcttgctgattagccatgatctgcaaatgatgagcaaactggtcaagcgcattaatgtactgtattgcggtcaaacagtggaaagtgccacacccgatgaattgctagtgacacctcatcatccttatactcaggcacttattcgctcaattcctgattttggcaacaatccattgcctcataaaggccgtttaaatactttatcaggggctattccatcactggagcatttaccgataggatgccgcttgggacctcgttgtccctatgcccagaaaacctgtattgaaaccccacgtttgcggggagttaaaaatcattccttcgcctgtcatttccccttgaacatggaggaacagtaa

SEQ ID NO: 564 - DNA, 810 bp, Xenorhabdus bovienii
  Coding sequence Name=Xb4151_4152.C414.gene26.dna; Position on contig =27906..28715bp; Strand=+
ttgattgagacattactggaagttaaaaatctgactaaaacattccgctaccgaaccggactgtttcgccatcaccaccttgatgctgtaaagcccgtaagctttactctgcagcccaaaaaaacgctggcaatcattggtgcgaatggctccggtaaatccacgctggcaagaatgctgtcaggtgttatcgaacccacttcgggcgatattctgattaataaccatcaactggcctatggggattacagttatcgcagccaacgtatccgcatgattttccaagatcccagtacatcattgaatccccgtcagcgtattgggcagattctagatgtgccattaatcttgaatacggagctttcttcttctgagcgagagaagcaaatcaaccagacgttacgtcaagttggtttgctgccagatcatgcctactattatccgcacatgctcgcttcaggtcagaaacagcgcgtggcattggcacgggcgctgatattacaaccacagattattgttgcagatgaagcattggcttctcttgatatgtccatgcgttcccaaatcattaacctgatgttggaactacaagagaagcacggcattgcctatatctatgtcacccagcacctcggcatgatgaaacacatcagtgatcaggtgctggtaatgcatcagggagaagtagtagaacgtggcaatacagcggaagtattggcctcaccattacacgatattacgcgtaaactgatatccagccattttggcgaaccactgtccgccgaagcatggcggcaggatatcacttaa

SEQ ID NO: 565 - DNA, 789 bp, Xenorhabdus bovienii
  Coding sequence Name=Xb4151_4152.C414.gene27.dna; Position on contig =28907..29695bp; Strand=+
atgggtttcatgaccggcaagcgcattctcattactggcgtagccagcaaactgtctatcgcttatggaattgccaaggcaatgcacgatcaaggagctgagctggcttttacctaccagaatgacaagttaaaacttcgtgtcgaagaattcgcggcatcattggattcgaacatcattctgccatgtgatgtggctgaagatgaaagtattgacgcattattcgctgaactaggtaaagtatggcctaagtttgacggctttgttcactctattggttatgctcctgctgagcagcttgatggtgattatgttaatgccgtcaaccgtgaaggtttcaaaattgcacatgatatcagtgcatacagcttcgtcgctatggcgaaatcatgccgcaacatgttgaatcctaactcagcccttctcactctgagctatctgggtgcagaacgtgcaatccctaattacaacgtaatgggtctggcaaaagcttctctggaagctaacgtgcgttatatggcgaatgcaatgggtgctgaaggtgttcgtgttaacggtatctccgcaggcccaattcgtacactggcagcatctggcatcaaagatttccgcaagatgctggcacactgcgaagcggtaacacctattcgccgtactgtaacaacagaagatgtaggtaatgcagcagcattcctgtgttctgatcttgctggtggtgtgacaggcgaaattatgcatgtcgatggcggtttcagtatcgctgccatgaatgagctggaattgaaataa

SEQ ID NO: 566 - DNA, 879 bp, Xenorhabdus bovienii
  Coding sequence Name=Xb4151_4152.C414.gene28.dna; Position on contig =30231..31109bp; Strand=-
atgaaaaatgttctttcaattcagtctcatgttgtttttggtcatgctgggaacagtgctgctgtttttccaatgcgtcgaatgggagtgaacgtatggccattgaatacggttcaattttccaatcatacccaatatcctcaatggcgtggttgtgttatgccgccagagcatttggctgaaattgcccagggaattggtgaaattgataaattagtttcctgcaatgcggtactgagtggttacattggttctgcggaacagggaaaccatattcttgatattgtaagacaggttaagcaagccaatcccgaagcatggtatttctgtgatcccgtgatgggacatccagaaaaagggtgtattgtcgctcctggaattgcagaattcctctgtgagaaagcattacccatcagcgatatcattgctcctaatttactggagctggaaacgttgagcatgcggaaaatcgaaaatgtagaacaagctatatccgcagcccgcgcattgtgcgaaaaaggcccagagattgttttagtcaaacacctcaatcgtgcaggctacagagcagatcgctttgaaatgcttttggtgactaaagaacatagttggcatattagtcgtccattgattaatacgggtgaacgtcaacctgtgggtgttggtgatttaacgagtggtttgttgctcgtcaatttactgaaaagtacatctctaacagatgaagcattacaagcggcgctggagcatgttgcatcagcagtctacgaagtgatgctggagactcaggagagaggggaatatgagttacagattattgccgctcaagataaaatggtcattccaacacatcaattcagtgcggcgcaaattgactga

SEQ ID NO: 567 - DNA, 1287 bp, Xenorhabdus bovienii
  Coding sequence Name=Xb4151_4152.C414.gene29.dna; Position on contig =31242..32528bp; Strand=-
atggagccattgatgtttagcaataacctgataaaacaactgcaagatcggggccttgttgcccaggtaacggatgaagaagcgttagcagagaggctggcgcaaggtccggtttctctctattgcggcttcgatcctaccgctgacagcttgcatttggggcatctggttcccttgctgtgtttaaaacgattccaactgaccgggcataagcctatcgcgttggtaggtggtgcgacaggtttgattggcgatcccagttttaaagcaactgaacgcaaattaaatacagaagagaccgttaaagagtgggttgaaaaaattcgtaaacaggtttcaccattcctcgatttcgattgtggtgaaaaccgtgcggaaattgccaataactatgagtggtttggggaaatggatgtgcttactttcctgcgtgatatcgggaaacatttctctgttaatcagatgatcaacagagaggcggtaaagcagcgtctacatcgtgatgatgttggtatttcgtacactgagttttcttataacctgttgcaatcatatgactttgctaacctgaatggaaaatatggtgttgaattgcagattggcggttcagaccaatggggcaacattacttcaggtatcgacttaacgcgccgcttacaccagaaacaagttttcggtttgacagtgccactgatcactaaatctgatggtactaaattcggtaagacagaaggtggtgcagtttggttagatccaaagaaaaccagcccgtataaattctaccaattttggattagtaccgcggatgcggacgcttatcgcttcctgaagttctttacttttatgagcattgaagagattaatgctttggaagaagaagataagaacagcggtaaggctccgcgcgcccagtatgtattggcagagcaagtgacgggtatggtacatggtgaagccggtcttgctgcggcgaaacgcattactaatagcctgttttctggcattgttgcagatttgactgaagaagatcttgctcaattggcgcaagatggtatgccagcgattgaactggaaaaagacgctgatttgcaacaagctctggtcaccgctgggctggtaccttcccgtggtcaagctcgtaccatgatcggttctaatgcggtttccatcaatggtgaaaaacaatccgatgctgaatatacgttcgcggacagcgatcgtttgtttgagcgttatactttgttacgccgtggtaaaaagcattattgccttatcaactggaaataa

SEQ ID NO: 568 - DNA, 654 bp, Xenorhabdus bovienii
  Coding sequence Name=Xb4151_4152.C414.gene30.dna; Position on contig =32645..33298bp; Strand=-
atgtcagaacataatgaaacgggtatcgcagacctgcgccgcgaatatatacgtggtggattgaggcgaaaggatcttactaaagaaccgattgaactttttgaactttggttgaaacaggcttgtgaagccaaacttattgaccctacggcaatgtgcattgctacagttgatgaacacggtcagccttaccaacgtattgttttattaaaacattttgatgcccgtagcttggttttttataccaaccttggtagccgcaaggcgaagcatctgacccagaataaccgaatcagcctccattttccgtggtaccagcttgaacggcaggtcagtttccttggcaaagctgaacgcttatctcctacagaggttgtgaaatatttccatagccgcccaagagatagccaaatcgctgcatgggtgtcacaacaatcttcccgtatttctactagaggcattctagaaggtaaatttctggagttgaaacagaaattccagagtggagaagtgccgctacccagtttctggggaggattcaaagtcgaattcgattctgtggagttttggcagggaggcgcgtatcgccttcacgatcgttttttataccagcgggaaggcgaagagtggcatattgatcgccttgcaccctaa

SEQ ID NO: 569 - DNA, 1113 bp, Xenorhabdus bovienii
  Coding sequence Name=Xb4151_4152.C414.gene31.dna; Position on contig =33340..34452bp; Strand=-
atgaagtcaggacgttatatcggtgtcatgtctggtactagcatggatggagttgatgttgttctggcggagattagcgataagattgttgcacagcaagtgagttattctcacccatttccacaagagcttaagcaaaaattgctttccatctgtcaaggtcaacagacgacattatctatggtcggccagtttgactatgaacttggaacacttttttccgaagcagtaaaaggcctgatgaataaagctgggctaaccgcaagcgacattacagcagttggctgtcatgggcagacagtatggcatgaaccagacggcgaaaaaccctttactatgcaaatcggtgataataatcgtgtcgctgcattgaccaatattactactgtgggcgatttcaggcggcgtgatatggcttatggtggtcagggcgcacctttagtacccgcatttcatatggcggttctcgggcatccaacagaaagacgcattattctgaatattggcgggatcgcaaatatctccgcacttctgccagattctgctgttaaaggatatgatactgggccagggaatatgctgatggatgcatggatatggcggcataagcagttaccttatgataaggatgctcagtgggcgaatgaaggaatagtcaatcaacgcttgctccaaaaaatgatttctgatccttactttgcacgtattgcaccgaagagtacggggcgtgagtacttcaatatggcatggttggaaaaacagttggcagattttcccgacgtctcatctgtagatattcaggcaacgctggctgaactaaccgcggtaagtattgcacaacaggtcatcttgagtggtgggtgtgagcgtttgcttgtctgcggaggtggagcacggaatccacgtgtaatgagccgcttatctgatttattgccaattactgaagttgctacgaccgacagatatgggttgagtggtgacgatatggaagcactggcatttgcttggctggcattccgcactatgtctggattgtcgggtaacttgccgtcagtaacgggtgcggacagggaaacgattttaggggcaatttatcctgttgccagcagataa

SEQ ID NO: 570 - DNA, 474 bp, Xenorhabdus bovienii
  Coding sequence Name=Xb4151_4152.C414.gene32.dna; Position on contig =34790..35263bp; Strand=+
atgttcaaacgtttcctggttggtgcagttgtagtaacaacattgtctggttgcgcagacatgggagcactttctagtgatacctactctattgatcaagccaaacaagttcaaaacgtaacctacggcactattctgtctgtacgtcctgtgtatattaaaggtgctcaggctggtaaccaaaatatgctgggtttgattggtggtgctgttttaggagggttattgggtaacacagtcggtgatggtacaggccaaagacttgctacagccgcaggtgctattgctggtgggatggctggccaggggattgaaggggccatcaataaaacgaaaggtgtcgaattagatattcgcactgatagcggaaggaatatcgtcgtagtacagaaacaggatcaagtcgtcttcagcaaaggccaacgtgtcaagatcgctgacggtggaaattcgactacagtatcgccactctga

SEQ ID NO: 571 - DNA, 432 bp, Xenorhabdus bovienii
  Coding sequence Name=Xb4151_4152.C414.gene33.dna; Position on contig =35351..35782bp; Strand=-
ttgacattgggatcagacctagcacgtttagttcgtgtttggcgcgctttaattgatcatcgtttgaaaccgttgaaattaactcagacacattgggttactctatacaatattagtcagttaccaccagagcagtcacagatacaacttgcgaaagctattggtatcgaacaaccctctttggtgaggactctggatcaattagaagaaaagcaactgattacacgtcacacatgtgctaatgacaggcgtgcgaaaagaatcaaattaaccgaggaatcggaaacttttatcagagaagttgacagtgttattggctctacaaggaaagatatcttggagggaattactcatgatgagttaattctgcttgcttctgtaataaaaaagattgagaagaatattagccaattgcataaacaggtaatataa

SEQ ID NO: 572 - DNA, 408 bp, Xenorhabdus bovienii
  Coding sequence Name=Xb4151_4152.C414.gene34.dna; Position on contig =36989..37396bp; Strand=+
atgcgtttactccataccatgatccgtgttggcaacatgcagcgctcgattgatttctatactcaagtgatgggtatgcgtctacttcgcaccagcgaaaatccagagtataaatattccctcgcttttgtcggttataccgatgaaagccaaggtgcagtcattgagttaacctataattgggatgttgaaagctacgaaatgggaaccgcatttgggcatattgccttgggtgtggacgatgttgcggcaacttgtgagcgcatcaagctctctggtggaaatgtgactcgcgaggctggacctgtcaaaggcggaacaacagtcatcgcgtttgttgaagatcccgatggctataaaatcgaattaatcgaaaaccaaagcggcagtagtgcattaggaaattaa

SEQ ID NO: 573 - DNA, 651 bp, Xenorhabdus bovienii
  Coding sequence Name=Xb4151_4152.C414.gene35.dna; Position on contig =37521..38171bp; Strand=+
atgtctaataaaaaagatcaaaacatgctaagtggacgttttcgtggctactatcctgttgtcattgatgtagaaaccggtggttttaatgcacagacagatgctttacttgaaatcgcagcaattactttaaagatggatgaagagggttggctgatgccagctgacacactgcattttcatattgacccctttgaaggcgctaaccttgacccagcagcgctggcattcacagggattgatccgaccaatccattgcggggagcagtcagtgaatacaccgcattacatgccattttcaaaatgatccgcaaaggtatgaaagacaataattgcaaccgcgcgattatagtcgcccataatgccagttttgatcacaactttgtcatggcagcagcagagcgttctggtttgaaacgtaacccatttcaccctttcgccacttttgataccgcagctctgagtggtttggtgctcggccaaacaatcctggccaaagcctgtatcacagcggaaataccatttgacagcaatcaggctcatagcgcgctgtatgatacagaccggactgccctgctgttctgtgaactcgttaaccgctggaaacgactaggcggctggccattaccttccccaaataacgaatcctga

SEQ ID NO: 574 - DNA, 384 bp, Xenorhabdus bovienii
  Coding sequence Name=Xb4151_4152.C414.gene36.dna; Position on contig =38237..38620bp; Strand=-
atgagtattgagaaaaacgaacgcccggttgaagaaacaacgactattggaaaaatagaacgccagatcaaagaaaatccaatcttgctgtacatgaaaggttccccaaagctgccaaactgtggtttctctgctcaggcggttcaggcgctgtctgcctgtggtgaacgttttgcttacgtagatatcctgcaaaatcctgatatccgtgcagaattgcctaaatatgcaaactggccgacatttcctcagctttgggtagatggtgagttggtaggtggttgtgacattctcattgaaatgtatcagagtggtgaattacaagcgttgatcaaagatactgctgacaagtaccgtgaacaggcaggctgcgatagcgaataa

SEQ ID NO: 575 - DNA, 579 bp, Xenorhabdus bovienii
  Coding sequence Name=Xb4151_4152.C414.gene37.dna; Position on contig =38987..39565bp; Strand=+
atgtcttttgaattaccagcattaccttatgccaaaaatgccctggaaccacacatttcagccgaaactctggaatatcattacggcaaacatcataacgcctacgttgtgaacctgaacaatctggttaaagataccgaatttgccggaaaatcactggaagaaatcatcaaaacatccgaaggcggcatcttcaataacgcagcacaagtctggaatcacactttctactggaatagcctgtcaccaaacgggggtggtgaaccaactggaaaagttgcagacgctattaacagtgctttcggctcttttactgagttcaaacagcagtttactgatgctgcactgaaaaattttggttcgggttggacatggctggtcaagaaagctgatggtagcgtggctatcgtcaatacttccaatgccgcaactccattgactggtaaagataaacctgtactgacagttgatgtttgggaacacgcatattacatcgattaccgtaatgcgcgccctcaatatctggagcatttctgggctctggtcaactggaaatttgttgaagaaaatctggcttaa

SEQ ID NO: 576 - DNA, 1026 bp, Xenorhabdus bovienii
  Coding sequence Name=Xb4151_4152.C414.gene38.dna; Position on contig =40040..41065bp; Strand=+
atggcaacgattaaagatgtggctaaacgcgctggtgtttcgaccacaaccgtatcccatgttatcaataaaacccgtttcgtcgccgaagatacaaaaatcgcagtttgggctgccataaaagaattaaactattctcccagcgccgttgctcgtagtttgaaggttaaccacaccaaatccatcggattactggcaacttcaagtgaggcaccttattttgccgaaatcatagaatccgttgaaaatagttgctatagcaaaggctatacgttgattttgtgcaattctcacaacaatctcgacaagcagaaagcttatctcgcaatgctcgctcaaaagcgtgtggatggtttactggtaatgtgttcagaatatcctgaacaacttttgggtatgctagaagattatcgcaatattcccatggtggtcatggactggggtgaatctagaggagatttcaccgatgcgattatcgataacgctttccatggtggttatttggccggccgctatcttattgaacgcggtcaccgtgatattgcttccattcctggaccattagcaagaaatacaggtggcgggcgtcatcaaggttttctcaaggcactgaaagaggcaaatattgacattcggaatgaatggattgtgcagggcgattttgagcctgaatctggctatcaagctatgtatcagatcctgaatcagaaacatcgccccacagccgttttctgtggtggcgatgtgatggcaatgggtgcaatctgtgcagccgatgagctaggtttacgtgtccctcaagatatttccatcattggttatgacaatattcgcaatgcacgctacttcacgccagcgctgacaaccatccaccagcccaaagaacgcttgggacagatggccttctcgatgttactggacaggatcatcaataaacgtgaaaatgtacaaactatcgaagtgcatccgcgtcttgttgagcgtcgatctgttacagatgggcctttcatcgattatcgccgttga

SEQ ID NO: 577 - DNA, 909 bp, Xenorhabdus bovienii
  Coding sequence Name=Xb4151_4152.C414.gene39.dna; Position on contig =41069..41977bp; Strand=-
atgtggtctgaatactcgctggaagttgttgatgctgtagccagaacaggaagtttcagtgcagctgcatcagaacttcatcgtgtcccttctgctatcagctatacggtaaaacaactcgaagaatggttggctgtacctttatttgagcgtcgtcaccgtgatgtagaattaacggaagcgggaggtatttttgttaaagaagctcgttctgttatcaaaaaaatgcatcacactcgccatcaatgtcagcaggtggctaatggttggagagggcagttcagcattgccgttgatcaagttgtaaaacctgaacgaacgctccaacttattctggatttttaccggcattttccagatattgagttgcttatctatcctgaagtttttaatggtgtgtgggatgcactggtagatggacgggttgatgtcgccattggtgccacccgcgcttctccggtcggagaacgatacagtttcagggatatggggtttatgccgtggttatgcgttgctagccctgcacatgaactggtttcgatagcagaaaaattgcatgacgaccagatgcgagcttattccagtttatgcctggaagatacttctcgcagcctgcccaagcgtgatacatgggctttggataatcaacggcgattgattgtgcctgattgggatattgggttggcttgcctgatggatggtctatgtgtaggaatggtgcccaagcatcgtgcattaccacttatccgccgcggaaaattgatcgcacttgagcttgaacaaccattgcctgatagcccatgttgcttggcatggtcgcaaaaaagccattcaccagcattaagctggttgcttgattatcttggagatagtgaaacacttaatgctgaatggttgcaggaggactga

SEQ ID NO: 578 - DNA, 1182 bp, Xenorhabdus bovienii
  Coding sequence Name=Xb4151_4152.C414.gene40.dna; Position on contig =42101..43282bp; Strand=+
atgacaacaaataaaaattccatttcattcatgttttatctcgctggcctgagtatgctcggctatttggctattgatatgtatctacctgcttttggagtaatgaaaacagagttaaatacatcagaaagtgctatcagtgcgagtctcagcatttttcttggcggttttgcctttgctcagttgttatgggggcaactgtctgaccgattaggaagaaagcctgttcttattatcggcttatctctgttttccattagctgtctaggtatgctctggataactgattccactcaactgcttgtattgagatttcttcaagcggttggagtctgctctgcggcagtttgctggcaggctttagttgtcgatcggtatgatcctgaacgtactaaacgtgtttttgccatgataatgcctctggttgccctttcccctgcactcgctcctttggtcggtgcatggctattgtcacacgttggctggaaaatcattttccttgtcttgatggctgtaacacttttactgctgatacccacatttttcctgaccaataaacacaaagctatcgataccgactctgataaaaagggagtttctttctttaccttattgaaatccccaatattcagtggaaatgtactaatttatgctgcttgcagtgctggtttttttgcttggctaactggctcaccaacaattctggccgatatgggttatgatcctacagatatcggcttgagttatattcctcagactctggcatttatggtcggtggatatggttgccgtattcttttggaaaaaaccaaaagtgagacggtatttccattcttactggcaggttatgccgtcagcatggtgatcatttatttaatttcccaattctatgaaccttcatttatggctattctcatccctttctgctttatggcagcaatgaatggtgcttcttatcctattgctgtagcaaatgcactctctgtttaccctaaaaacagtgggaaggcagcagcattgcagaatgccctgcaattagggttctgttttgtcgcaagcctgatagtctctgtattcatgaaaaaccctcttttatctaccacaacagtgatggtttctactgttgctctgatggcaatagggtattggttgcaaaagcaaaaatatgacaagaaagattaa

SEQ ID NO: 579 - DNA, 1152 bp, Xenorhabdus bovienii
  Coding sequence Name=Xb4151_4152.C414.gene41.dna; Position on contig =43602..44753bp; Strand=+
atgagttcatcttgcattgaagataaaaaaataattactgatccgtggcatagaatcgccagtgagttgcttcaagaagctgatattgagatcaacggcaagcgccctttcgatatacatgtcaaaaatccaaatttttataaaagagtgttaaaagaaggctcccttgggctgggtgaaagctatatggatggctggtgggattgtgaacgtttggatgtattctttcataaaatactgcgagctggtctggagtaccgcattcccaaaaatgccaaggatattctgaaaatcattaccgctcgcatatttaacctacaatcacccaaaagagcctgggttgtaggggaagaacactatgatttaggtaacgatctttttactcgcatgctcgaccctcacatgcagtactcatgtggttactggaaagattcaaacacactagaagaagcccaaaccagtaaactccgcctgatttgcgaaaaactacaattatcttcaggtatgacactattggatatcggatgtggatggggtggtctggctgcctatgccgcaaaaaactatggtgtatccgtcactggcgttactatttccgcagagcaacagaaatatgctcaggaacgctgtaaggatatggatgtgaaagtcatccttgaagattatcgcaatttgaactttcagtttgataggattgtctctgtcggtatgtttgaacacgttggccctaaaaattatgctagttatttcaatatcgtgcgcaaaaatctgaagcctgatggcctgttcctgcttcatactatcggctctaatcgtgataaattgaacgtcgattcatgggtgaacaagtatatttttcccaatggttgcctaccttcggttgcaaagatagccaaagccagtaatggaaaattagtcatggaagactggcacaactttggggcggattatgaccgtacgttgatgtcatggtatgaacatttcaccgcaagctggagcgagatagaacataattacagcccacgctttaaacggatgttcagttattacttaaatgcttgtgcaggtgcattccgtgccagagacattcaactgtggcaaattatgtttagtccacgaggaattgaaaacggcctgagagttcctcggtaa

SEQ ID NO: 580 - DNA, 648 bp, Xenorhabdus bovienii
  Coding sequence Name=Xb4151_4152.C414.gene42.dna; Position on contig =44833..45480bp; Strand=-
atgtttacaggcatcattcagggaaaagcgccgatagttgcgattgatgaaaaagcgcattttcgaactcatattgttaagtttccggctgaattattacccggaattgaaacgggagcctccgtttcccacaatggttgttgcctgacagtgaccaatatcgatagcaatctgattagttttgatttgatgaaagagacgctgcgcttgactaatctcggtgatcttaacgtaggtgacttagttaacctggaaagagcagcaaaatttggtgatgaaattggcgggcatctgatgtccggtcatgttattacgatggctgaaattgccaaaattttcacttcagaaaataaccatgaaatttggttccgcattcatgataagcagttgatgaaatatattctgcacaaaggatttattggtattgatgggattagtctgacgattggagatgttgtgaataaccgattctgtgttcacttgatccccgaaacactgggacgtacgacactgggtaaaaaacgccttgggcagaaagtcaatattgagattgacccacagacacaggcaatcgtagataccgttgaacgggttatggcgcagaaagaacaagaaaaagtattgtcacagacggaagaagaagaataa

SEQ ID NO: 581 - DNA, 1374 bp, Xenorhabdus bovienii
  Coding sequence Name=Xb4151_4152.C414.gene43.dna; Position on contig =45719..47092bp; Strand=+
gtgcagaaatacttaaatgaagcgcgtagtttgctcgctctggggatcccaatcatcatcgcacaattttcacaaactgcgatgggtttcgtcgatacagtcatggctggtaaagcgggtgctgtcgaaatgtctgcagttgccgtcggtacgtcaatctggttaccaactattttatttggtcagggtttactgatggccctaacgccgattgtggcacacatgaacggttctggtcagcgaaaaaatgtggcagttcagatccaacaaggcttctggctggcaacttttctctctattttagttatagctgttttgtataactgccgattcattatagaggcacaacacaatgttgatcctgtgttggcacaaaaagcaataaactttatccatgccattatgtggggtgctcctggctatctgttctatcagaccctacgcgggcagtgtgaaggattgtcgaaaaccaaacccgcaatgattatcggcattgtgggattactggttaacattcctgtcaattatattttcatttacggtaaatttggcgcaccagaattaggcggtgtgggctgtggtgttgcgacggccacggtctattgggtcatgttcctgttactacttgcgtatgtaaaacacacgccttcacagaaagatatccatacgttcgataattttaccggccctaattggcgtacacaaaaacatattgtgttacttggcttacctatcgcactggccctgttctttgaagtcacactttttgctgttgtttctctgttggtatctcctctcggagtcgctgccgttgctggacatcagatcgcactcaatttcagttccatgatgtttatgtttcccctgtcatttgggatcgcagcaaccatccgcgtgggctataaccttggaaaaaaatcgactgaaggtgccaaaatttcagcttacacaagtcttgctgtcggtttgatgatagcctgtatgaccgcggcttttacaactttgttccgcgaaccgatcgcacttatgtataacgataactatgaagttgtcactcttgcatcccatttgatgctgtttgcagccatttatcagatttctgattcagttcaggttattggttccggtgtattgcgaggatataaagatacgcgttccgtcttctttatcacctttattgcttattggatcttaggactacctagtggttacattctggcgctaacccattatgtcactgaaccaatggggccacagggtttctggattgggtttattatcggcttaaccgcagccgcggtcatggtaggtctccgaattttgtggttacaaaagcaaccaactcactttgttctggaacgctctgctcattaa

SEQ ID NO: 582 - DNA, 1410 bp, Xenorhabdus bovienii
  Coding sequence Name=Xb4151_4152.C414.gene44.dna; Position on contig =47934..49343bp; Strand=+
atgaaaaaaaccaaaattgtttgtactatcgggccaaaaacagaatccgaaacaaaactgaccgaattgcttaatgcaggcatgaatgtcatgcgcctaaatttttctcacggtgactacgaagaacatggccaacgtattaaaaaccttcgtgcagtcactgcgaaaacaggcaaaaaagcagctatcctactggataccaaaggccctgaaattcgtaccataaagctggaaggtggtaatgatgtctctctcactgcgggtcagactttcacttttacaactgataaatcggttgttggtaatcaagaatgtgtcgccgtcacttatgctggtctgccagcagacctgaaaccgggtaataccattttggttgatgatggtttgatcgccatgacagtaaaaaacatcaccgagactgaagtcatctgtgaggtattgaacaacggtgatttaggcgaaaacaaaggcgtcaatctgccaaatgtcgccatcaacttgcctgcactggcagaaaaagataaacaggatcttattttcggttgcgagcaaggtgttgatttcgtcgcagcatctttcatccgtaagcgttctgatgtactggaaatccgtgatcacctgaaagctcacggtggagagcacatccaaatcatctccaaaattgaaaatcaggaaggcctgaataattttgatgaaattatggaagcttcagacggtatcatggttgcccgtggtgatttgggtgttgagatcccagtagaagaagttatcttcgctcagaagatgatgatcgaaaaatgtaatgcagcacgcaaagttgtcatcactgcaacccaaatgctggattccatgatcaaaaatccacgccctacccgcgctgaagcaggtgacgttgccaatgctatcttggatggcactgatgccgtgatgctttccggtgaaagtgcaaaagggaaataccctatcgaagcggtttctatcatggcaaccatctgtgaacgtacagatcgcatcatgaacagcagaattgaaaatatcaaaacccagaagctgcgcgttactgaagcaatctgccgtggtgcagttgaaattgcagaaaaactggaagcccccctgattgtcgttgcaacctatggtggaaaatctgcaagatctatccgtaaatatttccctaacgcgcctattctcgctctgactaccaatgaaatcactgcccgacaattgctgttggtcaaaggtgtttccacacaaattgtcaaagaaatcgcctctaccgatgatttctatcggattggtaaagaagcagcactggcaagtggtatcgccaataaaggtgatgccgttgtaatgatatctggtgcgttagtaccaagtggtacaacaaatacttcttcagtccacgttctataa

SEQ ID NO: 583 - DNA, 237 bp, Xenorhabdus bovienii
  Coding sequence Name=Xb4151_4152.C414.gene45.dna; Position on contig =49887..50123bp; Strand=+
atgaatcgtactaaagttatatttggtgcagtaattttggcttccactctgttagcaggttgttcaaacgcgactaaagttgaacaacttgccactcaggttaacactctgggttctaaagttgaccaattgagaaatgacctcagcgctgttcactctgatgttcagtcagccaaagaggaagcagctcgtgcgaataagcgccttgataatcaagtgcgttcctacaagaagtaa

SEQ ID NO: 584 - DNA, 951 bp, Xenorhabdus bovienii
  Coding sequence Name=Xb4151_4152.C414.gene46.dna; Position on contig =50232..51182bp; Strand=-
gatacgattcgagctcggtccctatctgatgatgccctttcgctggaagccattgccgccaaataccaaataggtttgctggccatgctggaggctaatcctggcgttgatccttatctgccgaaactaggcgctaagctgattattccatcacagatgctgcttcccgatactcttcgtcaaggtattatcattaatctggcagaatttaggctctattatttccccaaagggaaaaactatgttgtcgtctatcccattgggatcggtcagcttgaacgtgatacaccgacgatgacaacgtctgtcagccaattgattaaaaatccaacatggacaccaactaccaatattcggaaagattatgcgagccgagggattattttgccaacggtagtacctgccggagcggataatccgatgggggattttgccttgcgtttggctgctggccgtggagaatatttgattcatggtacgaatgcaaattttggtattggcatgcgtgtcagttcgggctgtattcgtttgcgtcccgatgatattgaaaatttgttttatagcgttccacgaggaacccgtgttcaggtaattaatgaaccaatcaaatatacagtggagccaacggggaaacgttacgtggaaattcatcagccactttcagataaacaggccgatgaccctcagactaggccgattcagcgcacaaaagggttgataaaatttattgataatcgtgaaacagacgctgttcttgttgatcaggcgatcattcgacgttcaggaatacctgtgcgggtaaataaaggtattgctttatctaatcaggaagagcaagaagtttcaaggccgattgagactcacgaagaagccattcacagtgttagcccagttaaattaccgccattaaatcagcctagtcccatttatcagactgaacccttatcctga

SEQ ID NO: 585 - DNA, 3690 bp, Xenorhabdus bovienii
  Coding sequence Name=Xb4151_4152.C415.gene1.dna; Position on contig =776..4465bp; Strand=+
atgacattgcatattatcgagggcgccaaaggcggcggcggcggcgggggcggcggacatacaccttatgaaatgcccgataacattcaatcgacggccacggctaaaattctggtggccttgggtgagggtgagttcgtcaatgatctgacggcaaaagatatctatctggacggcacacccttgcagaacgacaacggaaccattaattttgcaggcgtgaaatgggaatttcgccccggtacccagcatcagaactatatcaaaggcatgagcgcggctgaaaatgaaatccgtctgggtacagaaataaaaaccgctgtgccctggacaaaatacatttccaacaccaagttatcggccgtccgtgtccgtctcggctggcctgcgttgagaatgcaaaaagaaaatggtgacacggtgggctttcgcgttgattatgccattgaattgtccaccgatggcggcagctatcaggctgtgtttgatacccatattgatgccaaaacaaccaccctgtatgaacgctcataccgcattaatctgcctgatgccaaaacgggctggacggttcgtgttgtcagaaaaacgccagacagcaccagtgagcggatcaacgacaaaatgaatatcatggcgttcactgagattgttgacgccaaattacgctacccgaataccgcgctgctgtacgttgaatttgacgcccggttattcaatggcaataccccgctgatttcatgtaagcccaaggggcgcattattcgcgtacccgccaattacgacccggttaaccgcacgtacagtggcatctggaacttaaccttcaaatgggcgcacagtaataacccggcgtgggtgctgtacgatatactgctaaacgatttatgcggccttggcgacaaaatcgaccgcacgcaaattgatgaaatcgaactgtatcgcgtggcgcagtattgcgatcaattggtccctgatggcaaaggcggtggtggcatggagccgcgctttacctgcgatgtttacatacaatcacgcgaagaggcacataaagtgctgaccgatattggcgccatattccggggttcagtccactggggagctaatcagttcgtggcagcggcggatatgccggatgacattaaatatattttcactcaggccagcgttatcaatggcgactttgtctacagcggcggcggcgagcgtaaccgcagcacggttgccatggtgagctggtcaaatccaaacaatcattacaatgatgaagttgaagttgtttcagacgataatttaatccgacgttatggtatcaaccagattgatatttccgctattggctgcacccgtcagagtgaggcgcaacgccggggaaaatgggcaatcctgaccaactcacgcgatggcatgatttcatttcgtgtagggctggatggtcaaatcccgatgcccggtcatattattggcgtggcacataaaaaccgagccgggcgcactatcggtggtcgcattcagtcggtgaacgatcgcaatatcacactggacagaaaacctgatgtgaaggcgggtgatcgtctattggttaatttaccgacaggaaaatcagaaggccggacggttcaggccgtcaatggtaacattgttaccgtaacgacgacttatagtgaatcacctgtatccggtgctggctgggcggtggatgcccatgatttatttattcagcaatatcgcgttgtcggcatcaaagataacaatgatggcacattcgaaatcaatggcctttaccacgatcccgacaaatacgaccgtatcgacacgggtgccagaatcgacgaacggcctatttccattattccggcgagcgtccagcagccaccgaattcaatcaggattgagagtttttcgtttgttcagcaaggcatttccaccactaccgtgcggattgcatgggagaaagcggaaggggcggcggcctatgtgggagagtggcgccgggatagcgggaactggatttccattccccgtaccgcatcgctgggttttgaaatacctaatgcttactccggcagatatcaggcccgcatcaaggccatcaactcctttgatattcccagcttatttatctcctctgaagaggtcaatatcgttggaaaacaaggtaaccctccggcaccgctggggttcagaacaaccccgatcatcttcggtatccagattgactggggttttgcgccccagaccgacgacacgctgaaaactgaaatccagtacagcaggacgaatgacggcgagggtttactgttgctggccgatattccctatccccagcgaatgcacacaatgcagggactggcggcaggcgttgcattttatttccgtgcgcgtctggtggacaagtccggcaatcaatccccgtggacggcgttcgtcaggggagaatcgtcttcggatacgaattggatcattgatgcagcaggcaaccagttcctgaccgccgaagccgggaaacgattacaggagcaaatggattatcagtcggagtccatcctcatcaacggtacagctattcagcaaaatagccgcgaattactcacccgtgatggtgagaacaaagcggaaatcaaacgactcgatcgtgtattcgctgatgaaaaaaccgcatgggcacaatccattaaggaagtaaaatccagcgtcggggaaaaccgttctgctgttcaggaaaaccagaaatccattaacaaactggattcatcattagctgagagcgagcagcgtgttcaggctcaattcaaacatcaatcggccctcattgataccaaggcaaccactgtttttgaccatataggcggttctgcgacgtacacagtgagggcaggtattaaagacgctaatgggaattatcatagtgcggggatggttattggtgctcagatggtgaatggccaagtgagaacggatattggttttaatgccaataattttaccttcgtcaatcccgcaaatgacaaattcgaaccctttgtggcggctaaaaatggccagttgtttattcgggatggatttatagaagatggcagtattaccaatgccaaaattggcaattacatccagtctggaaattatattgctggccgggcagggtggaaaattgataaagggggtggggcagaattcaaccatgttactgttcgtggggagatacatgcaaccagcgggacgttcaccggaacaatcaatggcgctgatggccgtttttccggcgcagtatatgcaaccaaaattgtaggtgacgttgtgtctgttactttggggaatgtatcattaggcaaccgtgacagcattttttttcataaaaggctaacggaagctatgccgtttgatcgggtttttatttatggaccgataatgactcagcgttacgtcggatctttgggtggttcgggggaggcatccgtttcggtatacgttaataatgtgcatgtggctgggcaaaactttttcatggagtcttctgatcgcggcccgcagtgcatctctggtacgttgttttcaccccctataacaattcccgccaatacaacgccgaccattaaagttgttctcgtaacccacggcgcgggcattacataccctactcccggtattggtatgctgtttaaggctagtagtcagtggtctaacatgtaa

SEQ ID NO: 586 - DNA, 447 bp, Xenorhabdus bovienii
  Coding sequence Name=Xb4151_4152.C415.gene2.dna; Position on contig =4564..5010bp; Strand=-
atgattgtaaaaaaaacagcaaagtatattttatattttatgctgatcatacttttcttatggtggttttttttatcacatgttacttttttgaaagaaagtgacacgctgagcgaagttaactctggtgaaagtgactattacgccaaatattacaagccggaacctattaatttatttgggatttatctaaccataatggagaaagagcctatttttgtggttttatatgataaagaggataaatatataggccaaacgtcaccttttaagatgatgaatatgtactcattttttgaaggaaatcctacattaccagaaaaaaacccacaagatatattggacacacacttttatattgtagtcgttggagattttgaaagtgcttatgacatagatataaaccataaaaaatggtggagcaaagtactgcaatatttccattaa

SEQ ID NO: 587 - DNA, 840 bp, Xenorhabdus bovienii
  Coding sequence Name=Xb4151_4152.C415.gene3.dna; Position on contig =5007..5846bp; Strand=-
atggcaattttttcagctaagactgttaagggtggcgcagttacagatataaatgtagatattttcatgttaaatgaaattcctaactcaatggaaaaaatgggttgggaaatggcacctaaaattatgcgccactggtttgaaagacctaaaattgagtttactcaagaagaaaaagtcagatatataaaagaaatagattccatagatataccaaaagacagagtcaatgattctattgtaaaaatggaatgggctatgaatttcaatcaagtaaaagaagctaccgaggaacttgtacagaaatgggcatcccctaatggaataaaattattaaaaaaaagacttaacgtaaattcaaataaaataggatattctgattcagcaattgaattagatacatatgcacaagtaaactataaagaaattggctctttgacggataccatcgatgattattttggcgctataggtaaagcaacattaaaattagcggtgagagggcatgcagataaaataaaaacaaaaaatgtatttattacagagggattgggtatttacttaaaagatagctatgacttttttaaccctgatgaattccttggggtctggagcagggatggagttttaagtaaagtaaaaacagctgtatacatgggtttttataacgataatatgtggagagagttagcgacaggggaatattcaaagcacgtccctgtatataatagaaatttcagagaatggcaaaagaaacacaataaaggaggggattttattgttttttcagatgttttatggatttctccgctgccaaaggatagagtgatttatttatga

SEQ ID NO: 588 - DNA, 738 bp, Xenorhabdus bovienii
  Coding sequence Name=Xb4151_4152.C415.gene4.dna; Position on contig =5849..6586bp; Strand=-
atgtcatatttaatttatttgtcgttaaaaggtaagaagcaaggtttaatttcggcagggtgttcaacccctgaatctatcgggaaccggtatcaggcaggacgggaagatcagatacaagtattaagtctgaatcatatgatgacccgtgaccagaacatcaatcaccaccctgtcagttttgtaaagcccatcgataaatcctcccccctgttagcaatggcaatagacggtaacgaattactggatgctgttttcatgttctaccgaatcagcccaatgggacagttggaacgcttttatgaagtcaaactcaccagtgccacccttgttgatttctcctgccattatccccactcgatagacgacaatgaccagataccgtctgaaacagtgctccttgattacaagtccattacatgtagccatctcgcagcgggaacgacaggctatagtatttcgcaattgcaggggcgtgaagaggaaaggccgctgctttcggggttttcgtctattctgcctttagcggaaactatcacagctttgtttagccatcagttcaagctaaaaaatcaacagaacggcgataactgtcaacatatcgcatatggcgtgaaaacaaataagggaccggtagaaggtgtctgtcaaacatctggtgtgacaaagcaatttgacacaaaacaagaagaaaacctcaatgtagaatatttatttcaaacaaagatagggatttga

SEQ ID NO: 589 - DNA, 978 bp, Xenorhabdus bovienii
  Coding sequence Name=Xb4151_4152.C415.gene5.dna; Position on contig =7241..8218bp; Strand=+
atgcaagataaaaattctgagacaaagggattagacgacagcagccttgtgactgttaccacaccggaatatgtcaaagattcaatcaaagaagcgatagaaaaacatgccctaagtcgcaaccatccagatgcaacgctacaagataaaggatttgttatcctgagtaatgatgtcggtagtgatagcgagactaacgcagcaacaccaaaagcaataaaaacagcatatgatttagccaatacagccaaccagaacgccaacaatgcaaatagcaataccaatacccgcttagcgaaagaccagaacggagctgatattcctgataaagacgattttgtaaacaatctcggattacgagatacagtcaatcaggcagaaaatgccttgcaaaaatcagctattgttcaacaaactggaatatctaatgatcttgtaatgagccagaatgtgacaactatgctgattagtgagcgcatcaaaaaagaagatgctgagttgttggcagttcccatcggtggcattttaatgtggggcagtgatctaccaccccccaataacttcctgccgatggagggcgggcaaattgaccctgataaatatcctgaattactcaaacactacccttcgggacatttaccagattggcggggttatgtgcctcgtggatgggataaaactggaggagttgactcggaggttgggagggcgctgggatcatttcaggctgacgctatcagagatatcacgggagtaattaggacaggtggccgtaaaacagatgagatctccgataatacaacgggagcattcaccaccatcgaccaaggtagaggaagtcacgtttactctgacgcgtttggggataatggctacgtttacgaggatcgagaatttcgtgcatctgccgttgtcccgacctcggttgaaaataggatgaaaaacgtggcagtgctatttttagtaaggggaaggtga

SEQ ID NO: 590 - DNA, 732 bp, Xenorhabdus bovienii
  Coding sequence Name=Xb4151_4152.C415.gene6.dna; Position on contig =10206..10937bp; Strand=+
atgcgaaatcgtcaacaagcgcagttaattgcagagcagatactaaaagaagatattgttatattagatacagagacaacaggattaaaaagcgatgatgaaattattgaaataagcattataaacgctgatggtaatgttttactagatacacttattaagccccaaaaaaagatacctcctgatgcgacaagaatacacagaataacaaatgaagatgttcaacataagccattatggagtgatgtctataaaaaatacagagagatagttgaagggaaaacagttgtcatttataacaaatcttatgatactaaaataattagacaaacatgcaaaaaatatgaattgcctacgccaagaataaaatcagaatgcgcaatgttgttatacgctaagtatgaggggattataaataaaagaacatgtgaatataaatggcataaactgacagatgcaatttataaaaataatatccaagtcactggagaggctcaccgggcactcactgacgccagaatgaccctagaattgttaaagtttatggcttgcgcagaagtgaatgtatcaccaagagttcatatgaatgattctgttcattacaaaaaaaacaagccatcaaattcaatccaacctaccaagaaaaaatctaactttcagaaaattattttgaaattcttcgttgtagtgatcttttttctcatgctcaatatgatatggcctcttttttaa

SEQ ID NO: 591 - DNA, 186 bp, Xenorhabdus bovienii
  Coding sequence Name=Xb4151_4152.C415.gene7.dna; Position on contig =11323..11508bp; Strand=+
atggaaaaaattttattatcagaatatgtgaagaaaaatggccaagtgaaagctgcaagtctggtcggtgttcatcaaaccgctataagtaaggcgttgcgagcgggtcgtaaaatatttttgatccgtcaggaagatggcagttacaaagccgaagaatgccggccatttcccagtcagaaatag

SEQ ID NO: 592 - DNA, 180 bp, Xenorhabdus bovienii
  Coding sequence Name=Xb4151_4152.C415.gene8.dna; Position on contig =11903..12082bp; Strand=+
atgatcacaaaggatagaagggggcagtggatgggattttccattgcgatgtttatcttaaccatagcgactgtttttgcgttcaagggtgaaatgttatttgcaggaacgctaattactattgatctggttgggctggcagccgtgtttgccatagggcgtaaatcaaacatcaaatga

SEQ ID NO: 593 - DNA, 276 bp, Xenorhabdus bovienii; identical to SEQ ID NO: 154
  Coding sequence Name=Xb4151_4152.C415.gene9.dna; Position on contig =12242..12517bp; Strand=+

SEQ ID NO: 594 - DNA, 291 bp, Xenorhabdus bovienii; identical to SEQ ID NO: 155
  Coding sequence Name=Xb4151_4152.C415.gene10.dna; Position on contig =12646..12936bp; Strand=+

SEQ ID NO: 595 - DNA, 648 bp, Xenorhabdus bovienii
  Coding sequence Name=Xb4151_4152.C415.gene11.dna; Position on contig =12945..13592bp; Strand=-
atggatatgctcataaaatttatacgattagttgttcgtgtgctctttagagtcacggtagaaggtgatgataagcagttcaaccatcccaaatgtattattacacccaatcatatttcttttctagatggtcttctgattgggctttttctgccagtgaagccagtattcgccgtttattctcatcttgcgacccccgcttttctcagattgattaagccttatgcggatgttgtccccttagatccgaacaatcctatggcagtcagaacgttggttaaagaggttgataacgggcgtcctatcgttatttttccagaaggacggatcacgataactggctctttcatgaagatctatgatggtgctgcttttgtcgcggctaaatcaggcgcaaaagtggtcccaatccgtattgatggcgcagagcaaagtatttttgggcgcctgaaagagattatgaaactgcattggtttccgaaaattaccatcaaggttttgcctgcggtcgatttccctatgccggatgcaccagattcttcaactcgtcgtcgtttggcgggggaacatcttcataccatcatgatggatgtgaggatgcagacccgtccaaaagagacgttatttggtcatgtattaaatgattag

SEQ ID NO: 596 - DNA, 525 bp, Xenorhabdus bovienii
  Coding sequence Name=Xb4151_4152.C415.gene12.dna; Position on contig =13721..14245bp; Strand=-
atgaaacagactctattcatcgtaggcgcacgaggtgctgggaagacgacaataggtaagttgttggctgaagcactatcgtatacgtttattgatactgatgaaagtattcaagccttttgtggaatgactattgctgaccttgttgaacaatatggttggacacatttcagggaattagaaagtcaaatactaaaaaatgccagtcagaataagtgcgttatttcaacgggaggcggaatgatactgtcgtctgaaaaccgccagtatatgcaacaaaatggtattgtggtttatttacaggctccagcggaagttttaatcaaacgactatcgctcaacccagaaaatacacagcgccccagtctgacaggtaaatcgatcacagaagaaatcgaaagcatcttgactgaaagagagcaattataccgtgaatgtgcaaatttcattgtggatgccaattcttcgacagaaaatatttcatctttaattaatggctatattttaaaccaaaaaatagggtga

SEQ ID NO: 597 - DNA, 1254 bp, Xenorhabdus bovienii
  Coding sequence Name=Xb4151_4152.C415.gene13.dna; Position on contig =14410..15663bp; Strand=-
atgctagagcagatgggaaaagcagctaaagcagcatcatggcaactggctcaattgagtaccagccagaaaaatcaggctctgagtcatattgctgacttgcttgaaaaagaaacagaagtgattcttgccgctaatcagcaagatatggaacaggctcgtgaacaaaacatgagtgaagcactgcttgatcgattattgctgacacctggacgattgagtgccatcgccaatgatgtgcgtcaggtttgtcgtctggctgatccggttgggcagattctagatgggcaatcattggacaatggtctgcaacttagtcgtcgccgtgttcctctgggcgttatcggcgtgatttatgaagctcgtccaaatgtcacgattgatgtagcctcactgtgcctgaaaaccggaaatgcagttatcttgcgtggtggcaaggaaactcatcataccaatcaggtcatggttaaagttattcagcaggcgctggagcaaagtggtttacctgccactgcggttcaggccatcggtaaacccgatcgtgagttagttgctgaattgctgaaaatgaatagctatgttgatatgttgatcccgcgtggcggggctggtttgcataaactttgtcgtgaacaatcgactattccagttatcaccggggggattggtgtctgccacacattcgtagacgaaagtgtcgatgttgaaaaagcgctggatgtgatcaccaatgcaaaagttcagcgcccaagtgcctgtaattccttggaaactttactgatacatgaacaaattgcgtctgattttctgccagcattgagtgccagaatgaaagagcagggggtgacactgcatgcaggagtatctgcgatggcactgctgaaagagggtccggccaaggtcgttgaagtaatagaagaagattactgtgatgaatggctgtcactggatatgaatgttgagattgtcagtggtatcgatcaggctattagtcatatccgcacatatggtactgctcattcggatgctatcctgacagagagcttgcaacaggctgattattttgtcagtcatgtggattcatcggccgtgtatgtgaatgcaagtactcggtttactgatggcggccagtttggtctgggggcagaagttgctgtcagtacccagaagttacactccagaggcccgatggggctggatgcgttgacgacttataagtggattggctatggcgattatctatcccgtcgctaa

SEQ ID NO: 598 - DNA, 1104 bp, Xenorhabdus bovienii
  Coding sequence Name=Xb4151_4152.C415.gene14.dna; Position on contig =15703..16806bp; Strand=-
atgaatggcagccaaacattggttgtgaaactgggaacgagtgtactgactggtggctctcgtcgtttgaatcgtgctcacattgtggaactggttcggcaatgtgctcaacagcatgaaaaaggccaccgtattatcattgtgacctcgggtgcgattgcagcaggacgggaacatctgggatatccagatttgcctgctacaattgcttcaaaacaattgttggcggctgttgggcaaagtcggttgattcaattgtgggaacaacttttttccatttatggtattcatgttgggcaaatgttgctgacccgtgcggatctggaagatcgtgaacgttttctgaatgcaagggatacgcttcaggcactacttgataatcatattatccccatcattaatgagaacgatgccgttgcaacagcagagatcaaagtcggcgacaacgataacctttctgcgctggctgcgattctgggcagtgcagataaattgttgcttctgactgatatcgaagggctttatactgccgatccgcgtaataaccctgaagcgaagcttattcctgaagtgcatgatatcagtgatgagttaaaaatgatggcaggggatagcgtttcaggtctgggtacaggtggaatggccacgaaacttcaggctgcgggaattgcggggcgtgcgggggtcgatgtcatcattgctgcgggtaatagaccggaagttgttgcagatgtcattgaaggcaaatcagttggcactcgttttcatggtcaggcctgcccgatggaaaatcgtaaacgctggatctttggcgcccctcccgcaggggaaatcatcgttgatcacggagcagaagccgccatccttgaaaaaggcagttctttactgccaaaagggattaaaaacgtcaaaggtaatttttcccgtggtgaagtgatccgtgtccgcagcttgtccggcaaagagttagcccgcggtgtatgtcgttacaatagcgatgccttacgcctgattgcaggccatcattcacagcaaatcagccagatactgggttatgagtatggcgcggttgctgtgcaccgtgatgatatgatcgtaagttag

SEQ ID NO: 599 - DNA, 402 bp, Xenorhabdus bovienii
  Coding sequence Name=Xb4151_4152.C415.gene15.dna; Position on contig =16921..17322bp; Strand=-
atggctttacccgtaagttattctagaaataagttgttgaagagcttttctgcattaggaccgtatatacgtgaattaaaatgccaaaatggctattttttctttgactgcctagctgtttgtgtcagtgcaaaggtggttccagaaaaaagggagttttggggatggtggctggaattagaagaagacgaaaaagggtttgtttataactatcaaataggcctatttgataaaaatggtgaatggaagtcgatgggcatcaaaaaaattgctgatcttgagcatcttgagtcaactttgcaggcatttcacaaacgtctgacggattcttttgataccttcaaactgacgttgatcccgtccaaaaataccatcgctcttcagactcaaattatggcatga

SEQ ID NO: 600 - DNA, 1248 bp, Xenorhabdus bovienii
  Coding sequence Name=Xb4151_4152.C415.gene16.dna; Position on contig =17396..18643bp; Strand=-
atgactaaacaaaacctttcagagtcgttgttcaagcctcagcttaaacagcaggaaacgtctacactggtaaaatatatccgcccacagtccacagcggccagtggtaggatgcttggtggagagcgtcgcgagcactggtatcggatgattgattggcttgcttggatctggaggggaatcaatccactggaaattcaggatgttctcagtaggattgcggtgatagatgccgaacgcagtgatgaccatttattggatactgtgatcggctatcgtaagggaaactgggcatttgagtggacgcagcaggctatgtactggcaacgggaggcgttgcgtgcggagcagacatctgaagccggtacatattggctaaaggctgcgatgctgtatagcattgcagcttatcctcatttgcgcggtgatgaactggctgagcaggccgctgtgctggccagtaaatcctatgaaaatgcggctcacagttctgactatgagttgaaaaaactggaatttaagttggaagggggcaaaagtgtcacaggcttattgcatcttcctcctaacgttcaagagccatgcccaacaatattggtttgtaccagccttgacaatgtgcagagtgacttctggcgactgtttcgtgatcatcttgctccactcggttttgccatgttgacagtagatatgcctgctgttggttactctgccaaattcaaattgacgcaggatacgtgcatactccatcagcaggttcttcagcagttgaatcaaattccgtggattgatcatactcgtgtaggcgttatgggatttcgtttcggcgcaaatattgcagtacgtcttgcttatctggagcctcaacttattaagggtgtggccgttattggtccgatagttcatacattgctgaatgacgagaaacgacagcagaatataccgtcaatgtacatcgatgtgcttgctaatcgtttgggtatctatcacgtcgatgaagctgccttacgtttagaattgagctgttattcactgaaaaaccaaggattgctgggacgtcgctgttctgtgccaatgctttccgtttattggaaagatgacgttttcagcccaagggaagactcaaaacttattgcaatgtcatcaatggatggttcgttattggcaattccttctacgccagtctatagtggttttaataaggcgttacatgaaacaagtgtatggttgaaaggtaaagccacctaa

SEQ ID NO: 601 - DNA, 462 bp, Xenorhabdus bovienii
  Coding sequence Name=Xb4151_4152.C415.gene17.dna; Position on contig =18659..19120bp; Strand=-
atgagcgaaaaatatgttgtaacgtgggatatgttgcaaatgcatgcccgtaaattagcacaacgtttacttcctgtagaacaatggaaaggcattattgccgttagccgtggtgggcttgtaccgggtgcattgctggcgcgtgaactggggattcgtcatgtcgatactgtctgtatttccagctatgaccatgataatcagcgtgaattgacagtcgttaaaaaagcggaaggtgacggagaaggttttatcgttgtcgatgatttggttgataccggaggtacagcgcaggcaattcgtaacatgtatcctaaagcgcatttcgtgactattttcgctaaaccggctggccgtcctttagtggatgattatgtgatcgatattccgcaagatacatggatcgaacaaccatgggatatgggtgtgatgttcattccacctatttgtaataagccgtaa

SEQ ID NO: 602 - DNA, 1461 bp, Xenorhabdus bovienii
  Coding sequence Name=Xb4151_4152.C415.gene18.dna; Position on contig =19382..20842bp; Strand=+
gtgtccgcattatcaacattatcccctcaaccattatgggatatttttgcccagatttgttccatccctcatccgtcccatcacgaggaagcactcgcgttccatatcattgaatgggccaagagcaaaaattttcatgtcgaacgggatgaagccggtaatattctgctcagaaaaccagccacaaaaggtatggaaaaccgccagtcagtcgtgcttcaggctcaccttgatatggtgcctcagaaaaacaatgatacacaacacgacttcacaaaagatcctatccgtacttatattgatggtgactgggtaactgctgaaggtacaacactgggcgctgataacggcatcggtatggcttctgctctggcagtactggcagatgaatccgtcaaacacggcccactggaagttttactgactatgactgaagaatccggcatggatggcgcattcggactgcgatcaggctggttacaggctgatgttctgatcaataccgattcagaagaagaaggcgaaatttacatgggctgcgcaggcggcattaattttgtctcaaccctgctactttcccgcgaaacattgcctacgggttaccaaaccttgcaactgacgattaagggattaaaaggcggccattctggtggtgatattcatttgggattgggcaacgccaacaaattgctggcacgtttcctcgccgcacattcagatgaattgaatctaaaattgattgatttccaaggaggaactctgcgtaatgcgatccctcgcgaaggttctaccgtcattgcaattccgacaactcagctcgaaaaactgcaccaattgaaagatgactatctggatacgttgagaaacgaatatgcggtcgttgaagcaaatttgatcgtcctattggatgaaatcgaaacttcctcacaggcactcactacagattgccagactcgtttcctatccatgttgaataccatacctaatggtgttatccgtatgagcgatgttgctgaaggcgtagttgaaacttccctgaacgtaggcgttgtcactatggaagaagataaagtcgagattatctgcctgatccgttcattgatcgacagtggcaaggcttacgttgttgatatgctaaattctctggcaaaactggcagatgcagaaacagcaaccagtggcaactatccaggctggcagccagatgccaactcgccagtcatgcatttagttcgtgaaacctatcagcaattattcgacaagatccccaatattatggtgatccacgcaggtctggaatgtggtctgttcaaaaaaccgtatccggatatggacatggtttccattggcccaaccattcgtggcgcccattcgcctgatgaaaaagttcacatcaagagcgttggtcaatactggcagttgttaaccgctatcctaaaagcgatcccggttaaagagtaa

SEQ ID NO: 603 - DNA, 1113 bp, Xenorhabdus bovienii
  Coding sequence Name=Xb4151_4152.C415.gene19.dna; Position on contig =20907..22019bp; Strand=-
atgaagctgtatatttatacagttattttggtgtggaaagaggcatgcagaggtgaaatgcgcaaaattattcatattgatatggactgcttttttgctgccattgaaatgcgggataatccatcactccgcgatatccccattgctgttggcggtagcgctgatagacgaggggtgatcagcacggcaaattatcctgcccgcctttttggcgtacgcagtgctatgtccactgcaatggcattgaaactttgtcctcaattgaaagtcataccggggcgaatggcgtcctacaaagaagtttctcagcatatccgccagattttttcccgttacactgaactgattgaaccgctttcactggatgaagcctatttggatgtgacggactgtcaacattgccacggctcggcgacgttgatcgcccaacagatccgtcaggtgatttttgatgaattgcaactgacagcctctgctggcgttgcacctatcagatttctggcaaaaattgcgtctgatatcaataaacctaacgggcaatatgttatttcccctgaacaggttgaggtattcgtcaagtcattgccattacgcaaaattccaggagtgggaaaagtcacatccaagcgtctatctgatatgggattggagacttgtgctgatgtacaaaactatgacaaggttgcgttgattaaaaaattggggaaatttgggctggcactttgggagcgcagtcatggtattgatgaccggcaaatcagtcccgatcgcttacgtaagtctgttggtgtagaaaaaacattggcacaggatattcatgagtggcgtgattgtgttgaactcatcgaaaaactttacccagaattggaaaaacgtttaggcaaggtaaaacctgatctccgcattgcccgtcagggtatcaaattaaaatttgatgattttcaattgacgacacaggaacatattcacccattattggataaatcggatctgattcaggtggcaaaacaggcttgggaaattcgcagagaagggaggggcgtgcggttggttgggctgcatgtgacgttacagaatcctcaattggaacggcaattattactggagtggtaa

SEQ ID NO: 604 - DNA, 1191 bp, Xenorhabdus bovienii
  Coding sequence Name=Xb4151_4152.C415.gene20.dna; Position on contig =22119..23309bp; Strand=-
atgtctattacgaatattatgccatctaaaatccccatcagcgtgtatctcttgggcttaagtctgtttgcgatgggaagttcagagtttttaatcgcaggtgtgctgccaaaaattgctgaggatctgcaagtctcgttaccctctgcggggatgttaatttctgcatttgccgttggtgttctgttcggagcgccctcgctggctgtagcaacattgcgttggcccagacgagcaacattattgttgagtcaggctctgtttgttgccgctaccgccattgggatgttgtcgcccgattattggccgttattgattgcccgcgttgtcagtggtatcgcttacgctggattttgggcagtcgctgcgacgacagcagttaatttagtaacccaggatcgcacggcaagggcattggccgtggttgtcagcggattgagtctggcgatggtagtgggcgggccattaggaacggtgattagtgatatagcggggtggcgtgccggtttctgggcggttgccgcagcaacatcagtcacggcaatagcattgtggtttatgttgccggagatacaaccgggtcagggagaggctccggtattagatacggaattaaaaaccatggcacaaccgaaattatgggtagcttataccactactatgctgacaaccgccgcttatatggcgacattcggctatttgggggcattattgattgatatcagcaagctggcggtggtttgggttcctgcggtgcttgcactgtttggtatcggtgcttttatcggattgactataggtgggcggacagcagacaaatatccattcaagacgctgatgattggcactcttggtatcattgtgtcttctattgcgttgacttttttagctgaaaacgtgatcacaacttgtctggtatttctgctcggagtgtctggtttcgttgttaaccctgccgtcatgaaccgggtctataccattgccgcaaatgcgccgacactggcaggtgcaactaatgtatccgctttccagctcgggattacattagcccccttgctggctggctttgcaatcggggcaggctacggcttatcttctgtggctggagtgggagcattactggcaattattgcacttgtcccaatactgattgacgcgcgtttacaccataaaaattgtcacaacgattaa

SEQ ID NO: 605 - DNA, 387 bp, Xenorhabdus bovienii
  Coding sequence Name=Xb4151_4152.C415.gene21.dna; Position on contig =23527..23913bp; Strand=+
atgagaatccgtgaatatttcgaacgcttactccatgatactccagacaatgctaatgccattgagtacgaacataattggtggacatggggtaaaagtcgcacaaccgttacgctcaatgcactacagccagtaacacggctcatagaagatattcaacggttggatatcaaaattcttatcgggagtaagtggggggagttagtcaaagcaactgtagttcttgtaccaaaagccacagtggaagccgccgaactgattaactggactaaagagcgaataggcactgtatttgcaccaaaagctatcgacttcgttaattctattccaacaactgaaaatggcaaacacgataaatcagtattacgcacatctcacagtcgatga

SEQ ID NO: 606 - DNA, 2043 bp, Xenorhabdus bovienii
  Coding sequence Name=Xb4151_4152.C415.gene22.dna; Position on contig =23998..26040bp; Strand=-
atgaacacaccagacagtccaaaaaacactcagaaggatactcttaattctgtcgtttttttcacctcggcagggctgattatcgttttttctttattcacgatttttttcactgatgcgacaagtatctggataaaaaatacgctggattgggtgtccaaaacattcggttggtattatttgctggccgcaacgctttacattgtatttgttatttttgttgccgcttctcgttttggttctatcaaattggggccggagcaatctaagccggaattcagtttgcttagttgggctgcgatgctgtttgccgcagggataggcattgatttgatgtttttctcagtggctgagccagtcacacaatacatgcggccgccaacgggtgaaggagaaactattgaagcagctcgtcaggcgatggtgtggacactgtttcactatggcctgacgggctggtcaatgtatgccttgatggggatcgcactgggatatttcagctatcgttataatctgccattgaccattcgttctgcactttatcctatttttggcaatcgaataaaaggctctattggtcatgccgtggatattgcggcagtgataggtacgattttcggtattgcaaccacattgggcattggggtggtgcaattgaattatggtctgaaagtgctgtttggactgcctcaaggtttgggggttcagggtgggttgatactgctgtcggttgtgatggccattgtttctgtcacttctggcgtgaacaaaggtattaggtttctgtccgagttgaatgtactgctggcactgggcttgatcctgtttattctgtttgtaggaaatactgagtttctgcttaatggattagtgcaaaatgttggagattacatcagccgtttcatgggaatgacactcaatagttttgcatttgaacgcccgaccgaatggatgaataactggacgctgtttttctgggcatggtgggttgcctggtcaccgtttgttggattattccttgcgcgtatttcccgtggcagaactattcgtcagtttgtgatgggaacgctgatcattccgtttgtctttacgctgttatggttatcgatttttggtaacagtgtattgtatgaaatcctgcatggtaatcgtcaattggccgaaacggtattggagcacccagagcaaggtttttatggcttgctggcactttatccggccttcacgttcagcgcctctgttgctacgatcacgggattgctgttttatgtcacatcggcagattcagggtcgttggttctggggaatttcacctcaaatctcagtgatatcaataatgatgctcctaactggctacgtgtcttttggtcagtggcgattggtgtattaacactgggtatattaatgacggatggcatttctgctttgcaaaatatgacggtaatcatggggttgcctttcagctttgtgattttctttgtcatggcaggattgtataaatctttgcgtgtggaagatttccgcaaagccagttcattgcagaatacctcgccaacattggtacatgacaatggttcgttgaactggaaacaacgtctgagccgcatgatgaattttccgggcacgaaaagtacccaacgaatgctggatatggtttgtcgtcctgccatgcaggaagtagcaaaagagttggaattacgtggcgcgaaagtacagtttaatacgctgccatcagaaggggacgaacgactgagcccgcttgaattaattgtcgaactgggggatgaacaaaactttgtgtaccaggtttggccgcggcgttattccgtgcctggatttacctatcgtgccagatcgggtaaatcttactattaccgattggaaactttcttgatggaagggactcagggcaatgacttgatggattacaccaaagaacaaattatcagcgatattctcgatcactacgaaaagcatctgaactttattcatctgaatcgcgaagcaccgggtcagacattgattttcccgaacggggggtag

SEQ ID NO: 607 - DNA, 597 bp, Xenorhabdus bovienii
  Coding sequence Name=Xb4151_4152.C415.gene23.dna; Position on contig =26250..26846bp; Strand=+
atgccaaaaattggaatgcagtcgataagaaaacagcaactcattgatgcaacattagccgtagtcaatgaggttggaatgcaggatgccagtattgcgcaaatagcccgaaaagcaggcgtttccaacggtattatcagccattatttcaaggataagaatgggttattggaagccaccatgcgttacttattacaccaactcggaatggctgtagcacggcggttacggctgctcgataatgcaaccccagcccagaggctgaaagccattgttgaaggaaattttgatgccagccaaatcagcagtgcagcaatgaaaacctggttagctttctgggcaagcagcatacaccaacccaatctataccggctacaacaagtgaacgaacgtcgtttgtattccaatatttgtatcgaattcaggcatgtcttgccaaaagcagaagcccgactggcagcacaagggctggctgccctgattgacggtatctggctgagaagtgcattaagcagcaagccttttgacataaaaagtgcgttcactatcaccttcgattatatcgaacagaaactcggaacaccttacacagcctga

SEQ ID NO: 608 - DNA, 1479 bp, Xenorhabdus bovienii
  Coding sequence Name=Xb4151_4152.C415.gene24.dna; Position on contig =26867..28345bp; Strand=+
atgactcgttttggcttacaaaagctttatatccacggcacttacgttaatagcgttaatcccgataaaaatacttttgatgcgatcaatccagctaatggtgaggtcatcgctcaattacaatctgcgacagagcaggatgttgagctggccgtcaaaagtgctcagaaagggcagaaaatctgggcagcgatgactgctgtagagcgttcacggatcttactcaaagcggttgatatcctgcgcgaacgcaatgatgtactggctgagctagaaacactggatacgggcaagccactgtctgaaactcaatatgttgatattgtcactggtgcggatgtactggaatattacgctggcttgatccattctctcgaaggtcagcagattccactacgagaatcatctttcgtctatacgcgccgtgaaccacttggcgtcgttgcaggtatcggggcatggaactacccaattcaaattgccctctggaaatcagcaccagcactggcggccggtaatgctatgattttcaaacccagtgaagttacgtcactcaccgccctgaaattagccgagatttatactgaagcaggcgtgccagatggggtatttaacgttctgactggcgcaggtcatgaagtggggcacactctgacagtacatcctgaaatcgccaagatgtcgtttacgggtggcattgtcacaggcaaaaaagtcatggcaaatgcatctggatcaaacttgaaagaagtcacaatggagctgggtggaaaatccccgctgatcatttttgatgatgccgatctggatcgtgctgctgatatcgccatgatggcaaactttttcagctccggtcaggtctgtaccaatgggacacgagtttttgtcccgaaaacactggctccccaatttgaagccaaaatcgttgagcgcgttaaacgcattcgcataggctctcccctcgatccaaataccaactttggccctctggtgagctttccacatatggaatctgtattgcgttacatcgaaagcggtaagtcttcccatgcacgactactgtgtggcggtgaacgtctgctggaaggtgaattagcgaaaggtgcattcgttgcaccaacggtatttagcgactgtacagatgatatgctgattgtgcaggaagaaattttcggccctgtgatgtgtatcctgacctatgaaacggaagatgaagtgatcaaccgcgccaataacaccgattatggtctcgccgcaggattagtgacacaaaatttatcccgtgcacatcgcgtgatccatcaactggaagcagggatctgctggatcaacacatggggagaatctcaagcagccatgccagtaggtggctacaaacattctgggattggccgtgaaaatgggctggtcacattgcaaaattacacacaaaccaaatcaatacaggtggagctgggtcattttgaatccctattttaa

SEQ ID NO: 609 - DNA, 1692 bp, Xenorhabdus bovienii
  Coding sequence Name=Xb4151_4152.C415.gene25.dna; Position on contig =28373..30064bp; Strand=+
atggtatttgattacattattatcggagctggttcagcaggtaatgtgcttgcaacccgtttaacggaagatagcgatgtcactgtcctgctgctcgaagctggcgggcctgattaccgattcgacttccgtacccaaatgccagctgcgctggcatatcccttgcagggaacccgttataattgggcatatgaaaccgaccctgaaccccatatgaacaaccgacgcatggagtgtggccgtggcaaagggctggggggttcttcactgatcaatggtatgtgctatatccgcggcaatgcgctggattttgacaactgggcaacgctatcaggtctggaagactgggcttatctcgattgtctgccctacttccgtaaagcggagactcgggacatgggggcaaatgactatcacggtgatgatggaccagtcagcgtcactacgcccaaaccggtcaataatgaactttttcatgtgatgatagaagccggtatccaagcaggatatccacgtactgacgatctgaatggctatcagcaagaaggttttggcccaatggatcgtactgtcacccctgaaggccgtcgtgccagcactgcccgtggttatctggatcaagcacggtcgcgctcaaacctcaccatcattacccacgccttgacagatacgctcgaatttgagggaaaaatggccgtcggcgtcaatttttatcaaggtaacacatcgactttaacgcaggcaaaagcacgtaaagaagtattactttgtgccggcgcgatcgcttccccacagattttgcaacgctcaggcattggccctgaagaaatcctgaacgagtttggcattccggtggtacagatattagcgggggttgggcaaaatcttcaggatcatcttgaaatgtatttgcagtatgaatgcctcaagccggtttctctctatccagccttgaaatggtacaaccagccaaagattggcgctgaatggttattcaaaggcacagggattggggcgagcaatcaatttgaagctggtggatttatccgtaccagtgaaaaatttacctggccaaatattcagtttcattttttgcctgttgccatcaattacaacggcagcaatgcagtcaatgaacatggctttcaagctcatgtcggctcgatgcgttctccgagccgtggtcgagtcaagatcacttcgcgtgatccacgccaacatcccagtattctgttcaactatatgtcaaccgcgcaggactggcaggaattccgtgatgccatccgcattacacgtgaaatcatggcacaacctgcactggcttcctactgtggccgtgaaatcagtcccggcactgacatccagacagatgaacaattaaatacctttattcgtgaacgagccgaaaccgcctttcatccatcctgtagctgtaagatgggtactgatgaaatggccgttgtggatggtcagggacgtgtgcatggtgtcaaaaacttacgtgtgattgatgcttcgatcatgccggaaattattaccggtaatttgaatgccacaacgattatgatcgcagaaaaaatcgccgataaaattcggggtcgtaatccactaccacgcagtcaggcaaaatattatgttgccaatggcgcaccagctcgcaaatcggcacagaatacgccatcagtgaattaa

SEQ ID NO: 610 - DNA, 438 bp, Xenorhabdus bovienii
  Coding sequence Name=Xb4151_4152.C415.gene26.dna; Position on contig =30232..30669bp; Strand=-
atggaaataaaatacagcgtaggaagagaaaatccagaattaattcagccagcttttgccattcgtaaacaagtatttactgatgagcaaggatttgatgcagaaattgatattgatgaatatgatgatattgctctgcatgtcctgatatttgatggtgaaaaaccaatcggagtattacgtgcagtcccaatggacaacaatatgcttaaagtaggacgtgtcgcggtattgaaggcgtatcgcggcaaaggcattggtcgtaaagtaatggagtttattgaagactatgggcgtaaaaatggaattgtaggcatcggtttatcctcgcaatgccatgcccagccattttatgaaagcttaggctatcaagcgcgtggggaaatctatttggaagaaggtgcagaacatatttttatgacgttggatttagcataa

SEQ ID NO: 611 - DNA, 171 bp, Xenorhabdus bovienii
  Coding sequence Name=Xb4151_4152.C415.gene27.dna; Position on contig =30727..30897bp; Strand=-
atgccaataagcaggctgatgattttatcaatagtttcaaaagtgacggcaataaaacagaagaaagttaattctgcgattcaatatcctgtcagtaaaaataaattaatactaaagggcgacctgaaaaaaggttgcccttatttttcctctgttatcaacttgacttag

SEQ ID NO: 612 - DNA, 522 bp, Xenorhabdus bovienii
  Coding sequence Name=Xb4151_4152.C415.gene28.dna; Position on contig =30827..31348bp; Strand=-
atgaagaaaaagattctcagttctctgattcttgcaggtctcgtagcattgcttgctggttgtgatgatggttctccaaaagtggaagactctgcccgacaagctgaagaaagtgctacccagatgaaaaatgacgctgaacaaaaaaccactggaatagtggatagtgccaaggaaaaatcacaggaagtgaaagaaagtgccatacgtgaaggtcatagtctggtagataagtctaaggaagtacaaaatcagataagtcattctgccaatcatctggccgatcagatgaaatccaaagcggcagatgtgaaaaatgaagttacgaagtctgtgaatgatacgctggataaggtgaaaaccaaaacggatgatatacagcatcaggccaccgataaggttaatcagtttaaagatgatgtgaaatcaaaggcggaagaaataaaatctgatgccaataagcaggctgatgattttatcaatagtttcaaaagtgacggcaataaaacagaagaaagttaa

SEQ ID NO: 613 - DNA, 2316 bp, Xenorhabdus bovienii
  Coding sequence Name=Xb4151_4152.C415.gene29.dna; Position on contig =31688..34003bp; Strand=+
atggcaaataatagtcaaaatttaggaaaacgcccaattatggccatcattcgaaaaattttaagaagtacattctcaggtacattagtgttgggtagtgcattgtccagccaagttttagccgctgaaaatccatctgaccagaaatctgaaaagcaaaatgaggtggttaaattaccatcgctttcagttgtaggtagtttacacaacagcaccagtgccggcagctcatcgctaaaaaaaaccgatattgaacgcactcaggcagataatgttgctcagttgctggatcaattgcctggggtttctatgtctggttctccacgtcccggtggacaaactttgaatatttggggcatgggtgagtcagaagatatcaaaatcacgctggacgacgccccaaaagggtttgagaaatatctgcagggttccatctttattgagcctgaattaatcaaacgtatagatgttgataaaggcccgcacaatttgttgaatggcaatggtggatttggtggctccgttaagattgtaactaaagatgccggcgatttattacgtcccgatgaaaattttggtgggctgttgaaatacagctatcacacgaatgacaggcaaaatatttacagtggtgccatttacggcagagatccagatggttttgccgatgcgttgctgtatgccagcaaacgcgacggtggcaatattaaacgtcctgatggaacacattttgagtattcacagaataatcagacttcttatttgctgaaaactaatttttatctcaatgatactcatacgctgagtttttcagccatgcgatctgaatcggatggatggcagccctgggccgctaagcgagataagatgaatgttccatcagaatgggacatagagagatatggttgggaaggagcatggcagagaaaattggtctttcgcaatcagattgatcaaaactacacagccaaatggaatattgcaccagaggagaatccgtggctgaatctgacactaacctctgcctattctgtaaccaaacaaaacgatcgccgcccagaaggaaaagatgtaacgctgacttcagcaagcctaatgggacaaaaaagttgggttaaatacatcgatacgatggttgatatcaacaataaaagcgtattttcaacaggcagtatagaacacgaatttttgctgggaacacgctggcataagaatgatcgtgacacattaatattcgataaaaacacggttaataactctgaatttaattatggttattaccagccttattatatgcccgccggagaacagcaaacttacagcatatatatgcaggactccttaaaactgggaagtattaccattactccaggcgtccgttacgatcatataaagaatattggcgaagaaaataaagcgcctaggtataacaacaaattgcctgaaataaaccatgattatagtggtgtaacctatactggctggtctcctcacttgggtattctgtggcagacaaacaaaaatctttcgctctttgctgatatcagccgtacatggcgggcgccagtggtcgatgaacagtatgaagttcagtcagatagaaccagccttccgggttccagccgcaatcttgaagtagaaaaaatgacgggtatacgcctgggggccattctcgatttcgataacctgatgcttgagaatgacagcctgcaaattcgtaccacgctgttccgtaaccgtggcaaagatgaaattttcaaaactcgtggtgtttactgtaaagctcaggctgacggtgcatcatccacctcatgtgaaaaaccgatagcaaatcatcgtaatctgccgggatataccattgaaggactggaaatagaaacattctacgatagcaataagttattcgggaaactttctttctccaccatgcgcggtcagcgtgatgcttctatgcgtgatccgtggataggacaaaaaacctggattgcagaaatcccacccacttctgcacatgcaatgttaggatttaagatcccacaatggcagatgtctatgggctggaaaggtgattttatccgcaaacaggatcgttcccctgtagatggggatccaaaagcgagttattggtctctgccaaccagcaagggttatgccctgcacgggttgtttgccagctggcgtcctccttatatgaaaggcttcgaagcgagagtcactgtcgataatctgttcaaccgtgattactatccttatttaggcgaaacgatttcagggattggccgtaatttcaaattcagtatttcacagcagttctaa

SEQ ID NO: 614 - DNA, 291 bp, Xenorhabdus bovienii; identical to SEQ ID NO: 155
  Coding sequence Name=Xb4151_4152.C415.gene30.dna; Position on contig =34542..34832bp; Strand=-

SEQ ID NO: 615 - DNA, 276 bp, Xenorhabdus bovienii; identical to SEQ ID NO: 154
  Coding sequence Name=Xb4151_4152.C415.gene31.dna; Position on contig =34961..35236bp; Strand=-

SEQ ID NO: 616 - DNA, 513 bp, Xenorhabdus bovienii
  Coding sequence Name=Xb4151_4152.C415.gene32.dna; Position on contig =35366..35878bp; Strand=+
atgcgtctgaccgtattgaaacaatatgccagaggggtatcaaaaaacgcccctgaacttggtgcagaattattggactctttaaccagcacaaaatggtatctctggcatggaaatgcgattaaggcattagaacacctggatgattgtgcggcaatgtgtgatgaggacatattgcattatggtaataataaatcattgttaaaacatatagatgaaatgtatacctatattgaaaataacagcatgatgatcccgaattacggtgaaatgtaccgatatggtgaagcaatttcctcttcatttgttgaatcgacgatcaatgaagttatcgctaaacggatggtgaaaaagcagcagatgcaatggagccagcaaggtgcacattacttactccagacacgcacagcggtactcaatggtgatttaaaaacccaatttgagcactggtatccgggtataaaattaggtgacaaaacggatcattattggacagaggcagttgctgcataa

SEQ ID NO: 617 - DNA, 327 bp, Xenorhabdus bovienii
  Coding sequence Name=Xb4151_4152.C415.gene33.dna; Position on contig =36254..36580bp; Strand=+
atgtacaaaggaaacatggaaaaattaatgatagaaagtggctttacacctaaagatattaaatttctcgaatctataaataaaaaaaatggcactaatcttatggataatataattgatcttgataaaagattttataagttaatattcattgtacctcttattttttttgggttcgctttcttatttttaatagcggatgatgtaaatgttgtagggtttattatatccacaattataacaatccctcctattttatttatgctgtcattcagaatgtcttatagagcgtctatatttatgaaaaaatataaacgcaaggaataa

SEQ ID NO: 618 - DNA, 801 bp, Xenorhabdus bovienii
  Coding sequence Name=Xb4151_4152.C415.gene34.dna; Position on contig =36581..37381bp; Strand=-
atggatatatatgcaaatagagagaatgattactttgctacaatgggaatgctaactgctagaagcgtaacagaatcggcattaagtgtttctattttcctaaataactttcgtataaaggcatattttaaatcagaaataaaaaaattcactgacaataatttaaacataatactaagcaagtcatcaacgaaagcatctaaaatgcaggcaatacaagacctaaaaaaagaaaaactatatttatcacaacaagaaaatattataagaaataatatacttgaaaagtacgctgtcatagaaatcaagaaagagctagatttttttacgtatgttttgaagggatttggcatagttgccggaggtgctcagataattactggcgcggctatggtaacagctacaagccaaacagtagtcggttatgtcgcaggttcagcactcatagttaatggtatgagtaatatagaagaaaatttaaattccttattaaagaaagatcctgattataagggatatctaagaagaggatacgaacatgcttttttatttatgggatctgataaaaagaccgcaaatttagtttatggaggtgtagatattgctttatctggttatggtgcatttagaaatgtgttaaaacctgattcttggcgattatttaattatgtaaaagatgattatgtcaccagctataaattaatgagtggttatgctcttacatttgaggtagtagctgatggggtcacattaaaatcaacttatgattcttataatgaccctcaaaataatagtaaataa

SEQ ID NO: 619 - DNA, 480 bp, Xenorhabdus bovienii
  Coding sequence Name=Xb4151_4152.C415.gene35.dna; Position on contig =37384..37863bp; Strand=-
atggctaacattatttatctaacaattaatggaaaaaaacaaggtttaatatcatcaggatgttcatcagaaaactccattggaaatctctgtcaaaatggtcatgaaaataaaatatacatatacgagttaaatcattcgttatctagagaacaaaacgtaaatcatttcccaattacaataaaaaaacctatagataaatcaactccattattaggaatggcaatatcagataatgaagaattagaatgtatatttgatatttatagaacagataatagcggtggccttgtgcttttttttactataaaagtgacaaatgcaaccataagtaatattgatattatttgccctcattctttaactcataatgatgctcagccgcaggaaagtatttctttaaaatataaaagcataacatggcagcatcacaccgcaggaactagcgggtatagtatttgggatgacaggatttattaa

SEQ ID NO: 620 - DNA, 276 bp, Xenorhabdus bovienii; identical to SEQ ID NO: 154
  Coding sequence Name=Xb4151_4152.C415.gene36.dna; Position on contig =38198..38473bp; Strand=+

SEQ ID NO: 621 - DNA, 291 bp, Xenorhabdus bovienii; identical to SEQ ID NO: 155
  Coding sequence Name=Xb4151_4152.C415.gene37.dna; Position on contig =38602..38892bp; Strand=+

SEQ ID NO: 622 - DNA, 876 bp, Xenorhabdus bovienii
  Coding sequence Name=Xb4151_4152.C416.gene1.dna; Position on contig =72..947bp; Strand=-
atgagacagcgtatggctatcgcaccccaggccgagaatactttctcactggaagctacaacttctgatttacctaaaaccgcccgaccaacgattctaatttttgattcaggtgtgggcggtttatctgtataccaagaaattcgacaattattgccggagctccactatatatatgctttcgataatgaagcatttccttatggagaaaaaacggcggaagtgatcattgagcgggtcgttcaagttgtcgatgaaattcagaaaagacaccccctggctattgtcatcattgcctgtaatacagctagcacggttagtttgcctgcattgcgcgaacgtttttcttttcccgttgttggtgttgtgcccgcaatcaagcctgcggcaaagttgacttgtaaccgagtaataggattattggcgacacgggctacagtcaatcgcgactacaccaaagaattaattgcaagatttgccacggattgtcaggttcattctataggttctgcagaattggtagagttagccgaacgaaaactgcatggtgagaagatcccactggaaatattggaaaaaattctcaaaccgtggttgagaatgaaagaaccgccagatactgtcatcttaggttgtactcacttccctctgattgcagaagagctttcacaagtttttcctgatggcacacgattgattgattctggagctgctattgcgcgtagaacggtgtggttggtgaagaaccaaaatagtttatttttaacaacggcggataatttggcttattgcacaaaaatagacctaaatagcgaggctctgcgacccgtattacgagattatggcttccttacgctggaaaaactggcaacttaa

SEQ ID NO: 623 - DNA, 1851 bp, Xenorhabdus bovienii
  Coding sequence Name=Xb4151_4152.C416.gene2.dna; Position on contig =880..2730bp; Strand=-
atgacaaataacaaacgtatccttttatctgctgcttctgtggcagtgttttctagctggagccattttgcagttgctgataatcaagagccactggtggtgaccgcgaaccgctttaaacagcctgtttcttcagttttagcaccaatgacggtggtaacccgcgaagagatagatcgctggcaatccagcagcttggttgacgttctacgtcgcctacccagtattgatattgcgcagaatgggggaatagggcaacacgcttctttatttgttcgaggtacggaatcacatcatacattggtgctaatagatggtattcgcttaaatcaggcgggtatcacgggtgcggccgattatagccagataccgctttcaatggttcagagaattgagtatatccgcggtgctcgctctgccgtatatggttctgatgccattggtggggtaatcaatatcattaccaagcgagagcaaaagggaacaacattgaatgcaggtatcggctcgcacggataccagaactataatggttcgacccaacagaagctcggcgagaataccttattgaccgcagcggctggatatacctataccaaaggattcgatgtggtggctggtggcggtacgggcgggtatcgtcagccggatcgtgatggttttatgagcaaaatgctgtggctgggcgttgaccataaatttaatgatcagttcagtgggtttgctcgtgtgcatggattgaataaccgaacggcttatgatgcctattatgatagttataatcagatgctgatagatactcgagagctattcagtcgtacttatgatgcaggccttcaatttacacagggaatttattctgcacaatggattaccagttacagccatgtcaaagattacaactatgatcccaaatatgggcgttatggcaaaggctccagcctaagtaactccaaacaatacaatgtgcaatggggaaattcatggcaagtgagtcatggcgcaattagcggtggtgttgactggaaaagagaatcggttgcggcaggttcgaataatattcctgtacaaaaagacgtagataacactggcctgtatttgacgtcacagcaaaagattcatgatgtcacgctggagggtgctgttcgttcagaccgtcattctgaatataattggaataccacatggcaaactggaatgggttgggaattcattgatggctatcggttgatcgtctcgtatggaaccgcatttaaggctccaacattgaatcaactctatagcaaatggggaaatgaaagtctcaaaccagaaaaaagtaaacagtgggaaggtggaattgaaggattaactggggcactgaattggcgcttatctgtttatcataatgatattgaacaactgataaattttgccaataaccgctatgagaacattggtaaggcaaaaatcaaaggtgttgaatggacaggaaccatggataccggaatattccagcaccaattgacattacagtatgttgatccgcgtgatggcaataataagcagctagctcgcagggctaaacagcaggttaaatatcaattagattgggaattatacaatattgattggggagtaacctatcaatatatcggtcagcgcgatgatgcagattatagtgtttatcctccgaagccccttaaattgggtggcgtcagtttatgggatatcagcgcatcatacccaatcactaaccacctcacaatccgtgctagaatagccaatctgtttgataaaaattatgagacagcgtatggctatcgcaccccaggccgagaatactttctcactggaagctacaacttctga

SEQ ID NO: 624 - DNA, 1101 bp, Xenorhabdus bovienii
  Coding sequence Name=Xb4151_4152.C416.gene3.dna; Position on contig =2919..4019bp; Strand=+
atgcagaatgtcttgccaacggaagattatgaaaatcaattgatggaaaaggtccatcgtctgaaaggaatgatgatgccatttagtgcacctgagcctgaggttttccgttcccctgcatcacattacagaatgcgcgctgaattccgcatctggcatgagcaagatgatctttaccacattatgtttgaccagcagaccaaacaacgtattcgtattgatcaatttccggttgccaatgagctgattaaccagatgatgcagtcaatcattgcgggcgtgaaagataattcactcttgcgtcataaactgtttcaagtggattatctgtcaaccctcagtaataagattattgtctctctgctttatcataaaaagttgaatgatgaatggcgcgagcatgccatcacactacgtgatcaattaaaagcaaatggatttgatgttcagctgatcgggcgagcgtcaaaaaccaagatcatactcgaccatgactatattgatgaagaactgccgattgcgggtaaaacgatgatttaccgtcaagttgaaaacagtttcacgcaaccgaatgccagcatcaatactcatatgttggaatgggcagtgggtattacaaaaggcgccaagggagatctactagagctatattgtggtaatggcaatttttctctagcattagcacagaactttgatcgcgtactggcgacagaaattgccaaaccttcggttgctgccgcgcaatttaatattgaagcgaaccaaattgataatgtgcaaattatccgtatgtcagcagaagagtttactcaagcaatgaatggagagcgggaatttaaccgactgcatggcattgatctaaaaagctatcaatgtgaaaccatttttgttgatcctccacgcagtggattagatgatgcaacagttaaaatggtacagggatactcacagattctttatatttcctgtaatccagaaacactcagccagaatctggaaacactgacacaaacccataaaataagccgactggcactctttgatcaattcccttatacgcaccatatggagtgtggtgtattactggaaaaacgtatttaa

SEQ ID NO: 625 - DNA, 378 bp, Xenorhabdus bovienii
  Coding sequence Name=Xb4151_4152.C416.gene4.dna; Position on contig =4116..4493bp; Strand=-
atggaacaataccgccaagataaaagcactatgttgctggctcttatcgttggattggcaacacacggaactttctcagcatttttcaactcgcttgtgcctttttcaattttcccgattattgcactggtattatctctgtattgcctccatcatcgttatttgaattatccaatggcagatggattaccaaagttggtggctggctgctttttcttaggaatcttcatttacagcgccatcattcgggtggaatatccagaaattggttctaatttcctgcctgtcgtgattgatgctgctttagtattttggatttacagaaagatcaaagggcgtaaacaacaagctatactcacttcagaaagccatggctga

SEQ ID NO: 626 - DNA, 651 bp, Xenorhabdus bovienii
  Coding sequence Name=Xb4151_4152.C416.gene5.dna; Position on contig =4519..5169bp; Strand=-
gtggtgagtaacgtaactggtgtcagagcgaaacagaaagaaaaaacccgtcgttccctgattgaagccgcattcagccaactcagtgctgagcggagtttcacaagtctgagcttacgggaagtagctcgagaagcgggtatcgcgcctacttcattttatcggcattttcgggatgtggatgaactggggctgacaatggtggatgaaagcggcttgatgttgcgtcagttaatgcgtcaggcgcgtcagcgtatcgcaaaaggcggcagcgtcatccgaacctctgtttcaacgttcatggaattcatcggtaacaatcccaatgctttccggttattactgcgcgaacgttccggtacatcggctgagtttcgtgcagctgtcgcacgggaaatccaacattttattgcagagctggcagactacctcgaacaggcaagccacatgccgcgtcattttactgaaattcaagctgaggcgatggtgacaatcgtattcagcgcaggtgcagaagcgctggatattgatgaggaaaaaaggcgtcgtctcgaagaacgtttagttttgcaactccgcctgatttccaaaggtgcttattattggtatcggcgggaacaagaaaaaaagactgtccctaaaacctcttga

SEQ ID NO: 627 - DNA, 198 bp, Xenorhabdus bovienii
  Coding sequence Name=Xb4151_4152.C416.gene6.dna; Position on contig =5377..5574bp; Strand=+
atgcaatatactcattttgatgccattgtgattggctctggtcccggaggggaaggagcagcaatggggctggtgaaacaggaaaaaaacgttgcagttatagaacgttacaatagtgtcggtggtggctgtacccattggggtaccaattccatcgaaagctctccgccatgctgtcagtcgtattatcgaatttaa

SEQ ID NO: 628 - DNA, 1284 bp, Xenorhabdus bovienii
  Coding sequence Name=Xb4151_4152.C416.gene7.dna; Position on contig =5492..6775bp; Strand=+
gtgtcggtggtggctgtacccattggggtaccaattccatcgaaagctctccgccatgctgtcagtcgtattatcgaatttaatcaaaaccccctctatagtgataactcccgcattcttcgttcctcattttctgaaatcctgcgccatgctgacgttgtcattagccagcaaaccaaaatgcgtcagggtttttatgaacgtaatcggtgccaaatgtttgcgggcgaggcagcattcattgatgaacatcgtgtgagtgtccgttatgctgatggtagtgttgatatattaagtgcagataagataatcattgccactggttcccgtccttactgccctcctgatgttgatttcactcactcccgtatttataacagcgacaccatcctgcaactggatcatgaaccacgccacgttatcatttacggcgcgggggtgattggctgtgaatatgcttctatcttccgagggctgggcgttaaggtggatttgatcaatacccgtgatcatctgctgtcttttcttgatcaagagatgtctgatgccctgtcctatcatttctggaatagtggcacggtcatccgccataacgaagaatatgaaaaaattgaaggtcttgatgatggcgtgattgttcatctgaaatccggcaaaaaggtcaaggcagactgtctactgtatgccaatggccgcaccggcaatacagataagctagggttggaaaatgtcggtctggaaacagacagccgtggtttactgaaagtgaatcgcgtctatcagagcagcaatgagaacatttacgccgttggcgatgtcatcggctatccgagtctggcttctgctgcgtatgatcaggggcgcattgccgcaaaagctatcatgaccggaagcgccaacctgcatctggtggaagatattccaacagggatttataccattcctgaaatcagttcaatcggtaaaaccgagcagcagctcactgcgatgaaaatcccgtatgaggtagggcgcgcccaattcaaacatctggcaagggcgcaaattgccggcatgaatgttggcagtataaagatcctgttccatcgtgaaacaaaacagattctgggcatccactgttttggtgaacgtgccgcagagatcatccatatcggccaagccattatggaacaaaaaggagaaggcaatactatcgaatatttcgttaatacaaccttcaactatccaacaatggcagaagcctaccgtgttgctgcactcaatgggttaaatcggttattttaa

SEQ ID NO: 629 - DNA, 918 bp, Xenorhabdus bovienii
  Coding sequence Name=Xb4151_4152.C416.gene8.dna; Position on contig =6767..7684bp; Strand=-
atgaatatccgcgatctggaataccttgtagcgcttgccgaatatcggcatttccgccgagccgctgattcttgtcatgttagccaaccgacactgagtgggcaaatccgtaaacttgaagatgagttgggcgtgatgctgctagagcgcaccagtcgtaaagtgctgttcacgcaacagggaatgttgctggtggaacaggccaaaacggtattgcgagaagtgaaagtcttgcaggaaatggcgtatcttcaaggtgaaagcatgtctggtcctctgcatatcggccttatccccaccgttggtccctatatcctgcctcttatcattcctgagttgcacaagctgttccccaagctggaaatgtatttacatgaggctcagactcagaacctgttggcgcaactcgatagcggaaaactcgattgtgtcattctggctttggtaaaagaaaccgaagcgttcattgaagtgccactctttgaagaaccgatgaaactagcaatttatgaagggcaccgatgggcgaataggacgcatatcaaaatggaagagcttgctggcgaaaaattattaatgctggaagatggacattgtttgcgtgatcaggcgatgggtttctgttttcaggctggagccaaagaagatactcattttagggcaaccagtctggaaaccctgcgtaatatggtatcagcaggcagtgggattacattgctgcctgatttggctgtgccaaaagagaaaaaacgcgatggtgtctgctatctggaatgtatcgaaccagagcctaaacgtacgattatcttggtttatcgccccggctcacctctgcgcagtcgctatgagcaattggcagaggcgattcgagctaaaatgggtgactatttcgaagtttttggcaaaacattaaaataa

SEQ ID NO: 630 - DNA, 1380 bp, Xenorhabdus bovienii
  Coding sequence Name=Xb4151_4152.C416.gene9.dna; Position on contig =7920..9299bp; Strand=-
atggcactttggggcggacgtttcagtcaggaagccgatcagcgattcaaacaatttaacgattctctgcgttttgattatcgcttggcggagcaggatattattggttctgttgcatggtcaaaggcgctggttacggtgggagtattggtttccgaagaacagcaaaaactggaactggcgctgaatgagttactgggtgaagtgcgggccaaccccaaggccattttgaaaagcgatgtggaagatattcatagctgggtggaaggtcaacttatcgcgaaagtgggcgatttggggaaaaaacttcacacaggtcgtagccgtaatgatcaagtcgcaactgacctgaaactgtggtgtaaggatcagatagccgatattcagcaggcacttgtggaattgcaacaggcgctggtgattacggcggagaataatcaagatgcggtgatgcccggttatacccatttgcagagggcgcagccagtcactttcgctcattggtgcctcgcctatgccgaaatgctggatcgtgatgagagccgcctgcaagatgcactgaaacggctggatgtcagcccactgggctgtggcgcactggcgggaacagcctatgatatcgatcgtgaacaattagcatcatggctcggttttgcctcggcaacacgtaatagtctggatagcgtttccgatcgggatcatgttctggagctattgtcagatgccagtatcagcatgatccacctttcacgctttgctgaagacctgattttctttaacagtggagaagcgggttttattgagttatcagatcgggtaacttccggctcttccctgatgccgcaaaagaaaaaccctgatgcgctggagcttattcgtggcaaatgtggccgggttcagggcgcattgacgggcatgatgataacgctgaaagggcttcccctcgcttataacaaagatatgcaggaagataaagaaggtttgtttgatgcactggatacatggcgggattgcctgcatatggcggtgctggtgctggatggcattcaggtgaaacgcgggcgctgtgaggaagctgcaaaacagggttatgccaacgcgactgaactggcggattatttagtggtaaaaggagttccattccgtgaagcgcatcatattgttggtgaagtggtaattgcggccatagcggaaggtaaggcgctggaagaactgtctttgtttgaactgcaaaaattcagcgaagctatttcgctagatgtgtatgacgttttatcgctgcaatcctgtttggataaacggctggcaaaaggcggtgtatcacagcaacaggtggcacaggcgattgcagcggttaaacagcggttaacgatagattag

SEQ ID NO: 631 - DNA, 1212 bp, Xenorhabdus bovienii
  Coding sequence Name=Xb4151_4152.C416.gene10.dna; Position on contig =9347..10558bp; Strand=-
atgactaaaagcattaaaaaaatcgttctagcatattctggtggtttagatacatctgcgattattccttggttgaaagaacattatgacaattgtgaagttgtcgcatttgttgctgacgttggtcaaagccgcgaagatttagaaggtgtggagcagaaagcgttgcgatctggtgcgtcggaatgtcacgttatcgacctgcgtgaagagttcatcaaagagtatgtttatcccgtactgaaaacgggcgcattgtatgaaggcagctatttgcttggtacatcaatggcacgcccaattattgccaaggcacaggtcgaactggcgctgaaagtgggcgctgattctgtagctcacggggcaacgggcaaaggtaacgatcaggttcggtttgaaagtacttatactgcgttagcgccgcatctgaaagtggttgctccgtggcgtgaatgggatctgcgttcccgtgaggctctgcttgattatctgaaagtccgcgatattcccaccaccgccacgctggaaaaaatttacagccgtgacgaaaacgcatggcatatctcaaccgaaggcggggtattggaaagtacatggaatgctgccaataaagattgctgggtgtggacagcagagccagaagatgcgcagaatgagccagaatatgtcaccgtcacggttgaaaaaggtgaggtggttggcgtgaatggtaaggggttgtcaccctatcaatgtcttaatgcattgaatgaactgggagccaaacatggtatcggccgtatcgacattgtggaaaaccgtttggtaggcatgaaatcccgtggttgttatgaaacaccgggtggaaccatcatgatggccgcattgcggggaattgaacagttggtgttggatcgcgacagcttcaaatggcgtcagcaattggggttggaaatgtcctatgtcgtctacgatggtcgttggtttgcaccattgcgccagtcgattcaggctgctgcggaaacgttggctgacagtgtcagtggggcagtggtcttaaaactgtataaaggccaggtgaccgctgaacagaaaaaatcgacatacagtctctattctgaagagttcgctacttttggagaagatgaagtctacgatcaccgccatgcagaagggttcattcgcctctattcgctttcttcacgtattcgtacactgaacagcaaaaaataa

SEQ ID NO: 632 - DNA, 774 bp, Xenorhabdus bovienii
  Coding sequence Name=Xb4151_4152.C416.gene11.dna; Position on contig =10627..11400bp; Strand=-
atggaaccgttagttatcaaattgggtggtgtgttgttagacagcgaagaagcgctggcgcggttattttccacattgcagtcatatcggaagacgcataagcgcccgttagtcattgtacatggcggtggctgtttagttgatgaactgatgcagagattgcagttaccgattgtgaagatacagggcctgagggtaacgccagcagatcagattaatatcgtgacggggacattggcaggaactgctaataaggcactgctggcttgcgcgataaaataccgattgcctgcgattggattgtgtctgggagatggtggtgtggtgcaagtttcccagtttgatgaggaattcggccacactggaaaagctcatccgggtaaacccgatctcctgaaaattttgctggatgtcggttatatgccaattatcagttctattggtatcaccgaaaatggtgagctgatgaatgtgaatgcagatcaggcggcaaccgccattgcgcaggtgttaaatgcggatctggtctttctgtctgatgtcagcggtattttggatggaaaaggccagaaaatcccagagctaacagcggaaaaaatagaacagctcattgagcatggcatcataactgacggcatgattgtgaaagttaatgcggccttagaagcggcaaaaacgctgaagcatccggttgatattgcaagctggcgacataccgaacaattaattgcattatttaatggcatacccacaggtacgcgaatttcggcgtaa

SEQ ID NO: 633 - DNA, 1005 bp, Xenorhabdus bovienii
  Coding sequence Name=Xb4151_4152.C416.gene12.dna; Position on contig =11438..12442bp; Strand=-
atgttgaatacgctgatagttggtgccagtggctataccggagcagagttagcagcatatctacaacgtcatctccatgtccacctttctggcttaatggtttcgtctcaaagttcagatgcggggaaatgtttttcagatctctacccgcagtacaagggcattgttgatttacctttacagccgctgactgatgtggctgaagcagtgaatggtattgatgtcgtcttcctcgccactgcccatgaaatcagccatgatattgtgccgatatttctacaagcaggttgcacagtcttcgatttatccggagcctatcgcgtacaaaatacacaattttattcaaaatactatgggttcgagcataaaaatacggcttggcttgataaggcagtttacgggctggcggagtggcaggcggaaaaaatcaaaactgcccagttgatcgcggttcccggctgttatcccactgtttctcagctttcattgaagcctttgctggaaaaaaatctgctggatactgaacaatggcccgttatcaatgctgtgagtggtgtcagtggagcaggccggaaagcaaccattaacaacagcttctgtgaagttagtttgcagccttacgggatttttaatcatcgtcatcaacccgagatcgcgacacatttaggtactgaggtcatttttatccctcatctgggtaatttctcgcggggtattctcgctacgatcacctgcaagttgaaatcaggtgtaacagaaaagcaaattagggaagcctaccagctggcgtatcatgataaaccgttggtgcgtctatacacggaaggtatgccggcattgaaagccgtcgtgggtttgccattctgcgatattggttttgctgtgcaaggacagcacctgattattgtcggtgctgaggataatttgttgaaaggcgcggcagcacaagcagtacagtgcatgaatattcgttttgggtttgcagaaactcaggcattgctttaa

SEQ ID NO: 634 - DNA, 1158 bp, Xenorhabdus bovienii
  Coding sequence Name=Xb4151_4152.C416.gene13.dna; Position on contig =12545..13702bp; Strand=+
gtgaatattaaattaccatcatttattagattatatcatcagctcattgctacaccttccatcagcgcaaccgatgctgaactggatcaaagtaatgaaatattaatcaacctgctggctggctggttgaaagaccttggttttaacattgagattcagcccgttcctgaaacccgtggcaagttcaatatgctggcaacattgggtagtggttctggaggtttattgttatgtggtcatacagatactgtgccattcgatgagggacgctggacacaagatccattcacactgagcgaacgcgatggcaagctttacggactcggtactgctgatatgaaaggcttctttgctttcatcattgatgctctgcgggatgttgatcccagtaaactaactcatccgctttacattctggccaccgcagatgaagaaacatcgatggcaggcgcgcgttattttgctgccaataccgccattcggcctgatttcgccattattggcgaaccaacatcgttacagcctatccatgcgcataagggacacttagctcatgttatccgcattgagggaaaatccggccattccagcgatcccgcacgtggtgtcaacgcacttgaactcatgcacgaatccatcacgcaattgatggaattacgcactaccttgcaggaacgctatcacaatccagcatttgttattcctcatccaactatgaatttcggccatattcacggtggtgatgcggcaaaccgcatctgtgcctgctgtgaactgcatatggatattcgcccgctgcccggattgaccgtgcaggatatggacgaattactgcataaagcactagagccggtgaaacagcgctggccgggacgtttaagcgttactcctctccacccccccattccgggttatcaatgcctgaccgatcacaaattggttggcgtgatcgaaaatttgttgggagcgaaagcagaaaccgtcaattattgtactgaagcgccttttattcaggaattgtgtccgacattagtcttgggaccaggatcaattgaacaggcacaccagcccgacgaatttttaggtatggaatttattgagccgaccagaaaattgatttctcagctgattgagcatttttgcctgcaaacccattaa

SEQ ID NO: 635 - DNA, 888 bp, Xenorhabdus bovienii
  Coding sequence Name=Xb4151_4152.C416.gene14.dna; Position on contig =14066..14953bp; Strand=+
atgagtttttttcacgctaatcagcgagaagcgctgaatcagaatttggctgagcttgaagggcagattcgtgtttcttttgagttctttccacccagcacgactgcgatggagcaaaccctgtggaattccattgagcgcttaagcaaactgaagcctaaatttgtctccgtaacctatggtgccaattccggtgaacgcaaccgcactcatagcatcatcaagggcattaaagacaaaaccggccttgatgctgcccctcacttgacttgcattgatgccaaccgtgaggaactgcgtaatattgctcacgattattgggagagtggtattcgtcacattgtggcattgcgcggtgatttacccgagagcaacggtaaaccggaaatgtatggtgccgacttagttgagctcttaaaaaaagaagcggattttgatatctccgttgctgcttacccagaagtgcatcctgaagcgaaaagtgctcagtcggatctgattaacctgaaacgcaaaattgatgcgggagcaaatcgcgccattacccaattcttttttgatgtagaaagttacctgcgttttcgcgatcgctgtgttgcaacgggaattgatgtggaaattgtaccgggaattctgcccgtctcgaacttccgtcagttacagcggtttgccacaatgactaacgtccgcatcccaagctggatgaccagaatgtttgaaggactggatgatgatccggaaagccgcaatttagttggtgcatccattgcgatggacatggtgaaaattctcagtcgcgaaggggtgaaagattttcatttttatactctgaatcgggcggaattaagttacgccatctgccacacgctgggagttcgtccttgttga

SEQ ID NO: 636 - DNA, 150 bp, Xenorhabdus bovienii
  Coding sequence Name=Xb4151_4152.C416.gene15.dna; Position on contig =15319..15468bp; Strand=-
ttgcaggatagtgaagcaatatgggaatatcttgttactaaaaatccagtggccgccgtaaaaatggatgagttattcgaaactgctgcggaacggttgattgaatttccttatatgggacatgccggtgaaatttcagggacattgtaa

SEQ ID NO: 637 - DNA, 2637 bp, Xenorhabdus bovienii
  Coding sequence Name=Xb4151_4152.C416.gene16.dna; Position on contig =15751..18387bp; Strand=-
atgaatcaacaatattctgcaatgcgcagtaatgtcagtatgcttggtaagttattgggtaacactatcaaagaagcactgggagaaagcattcttgataaagttgaaacgataaggaaattatccaaatcatcccgtgcaggaaatgaagctgaccggcagcaacttttatctacactgcaaaatttatccaatgatgagttattgccggttgctcgggcctttaaccagtttcttaatctggccaacgttgccgaacaatatcacagcatttcaccgcatggtgaagcggctagcaatcctgtagcgctagaggctttgttcaatcggctgaaagataaaaaattcagtaatgatgacttgatcaatgcagtcaatgaacttgccattgaattggtcttgacggcacaccctaccgaaattgcccgtcgtactctgattcataaactggtcgaagtgaatgcctgtctgtcacagcttgaccatgatgatctggcggattatgaacgcattaatatcatgcgccgtttacgccagttgattgcccaatcatggcataccgatgaaatccgcaaaattcgccccaccccgattgatgaagccaaatggggatttgcggtggtggaaaatagtttgtgggaaggtgttcctgcatttctgcgtgaattcaatgagcaattggaagaatccattggctatagcttacctgtggaagccgtaccgattcgtttcacttcttggatgggtggcgatcgtgatgggaaccccaacgttaccgcagaaattactcgccatgtattgttgctcagtcgctggaaagcagcggatctatttttgaaagatattcaggtgttagtttctgaactctctatgtcggagtgtacacctgaactgcgccagcttgcgggtggtgatggggtgctggaaccttaccgtgaaatcgccaaacaattgcggacgcaattaaatagcacactgacgtatctggagaaacaccttaaaggagagcgagtcctgccacctgtgggtttgctgctgcataacgaacaattgtggcaaccgctgtatgcctgctatcaatcactgaaaacctgcggtatggaaattatcgctaatggccaattgttggataccttgcgccgcattcgctgctttggtttgtcgttggtgcgtattgatatccgtcaggaaagcacccgccacaccgatgccattgcagagctgacccaatatctggagctcggagattatgcgagctggtcagaaacggagaaacaaacttttctgctgcgtgaattgaattcaaaacgtccgcttattccgcattgttggcagccgagtgaagaaaccctagaagtcttcgaaacctgtaaggtcattgccgaatcgccacaagatgcgattgcagcctatgtcatttctatggcgaaagttccctcggatgtactggccgtgaagttgctactgaaagaagcgggttgctcactgaaattgcctgttgcaccgttgtttgaaacccttgatgacctgaataatgcggaaagtgtgatccagcaattactgggaattggctggtatcgcgagctgattcaggataagcagatggtgatgattggctattccgactctgccaaagatgcgggagtgatggcggcatcatgggcgcaatatcgggcacaggatgcgttgatcaaagtgtgtgagcaggaaagcgtaacgctgacgctgttccacggacgtggtggtacgattggccgtggtggtgctccagcgcattccgctttgctttctcagccgccgggcagtctgaaaggtgggttacgtgtgacggagcagggcgaaatgatccgctttaagtttggtttaccacaggtgacgattagcagtctggcgttgtatgccagtgcaattttggaagcaaatttactgccgccgccagagccaaaaccggagtggaagcaagtcatggatacgctctctgatgtttcctgtgacatgtatcgtgattatgtccgtgagcagcccgaattcgtaccttacttccgagcggcgacgccagaacaggaattggcgaaattgcctttagggtcacggccagccaagcgtcgtccgaccggcggtgtagaaagcctgcgtgcgatcccttggatattcgcttggacgcaaaaccgcctgatgttgccagcatggttgggtgcgggagcagcgctgcaacatgtgattgatgcgggtaaactgtcggtgttagcagatatgtgtcgcgactggcctttctttaatacccgcattgccatgttagagatggtatttgccaaggccgatttatggctggcggaatattatgatcaacgcttggtggataaaaaactgtggccgttgggaataacgctgcgtaatcagttggcagaggatattaaaactgtgctgacgatttcgcaggatgagcaattaatggcggacttgccgtggattgcggaatccattgcgttgcgtaacgtctataccgacccgctgaatgtgctacaggcagaactattacagcgttcccgtcagcaggaacagccagatccgcaccttgaacaagcattaatggtgacgattgcgggggttgcggcagggatgcgcaataccggctag

SEQ ID NO: 638 - DNA, 2439 bp, Xenorhabdus bovienii
  Coding sequence Name=Xb4151_4152.C416.gene17.dna; Position on contig =18754..21192bp; Strand=-
atgagtgcactggcaacagcgggggcggaatttggccgccagttacataaatttggcggcagcagccttgccgatgtgaaatgctatcagcgggttgcagaaattatggcgaattatagccagccgggtgatttgatggtggtatcggcagcagggagtacaaccaatcagcttattgattggttgaaactgagccagagtgaccgcatctcagcacatcaagtacagcaatcattgaggcgttatcagcaggagctgatcagaggtttattgcctgaagtgattgcggaagaactcgtagcacattttatctcggacctggaaaaattaagtgtattgctggacaaaccgattactgacattacgtacgccgaggtggtcgggcatggtgaaatctggtcagcccgtttgatggcggctgtgcttgagcataagggtatttccagtgcatggctggatgcacgccaatttctgcgggcagaacgcgctgcccagccgcaggttgatgtgaacttgtcccagcctttactgagccaactgttgatccaaaatcccagtaagcgtttggtggtcacggggtttatctccagaaatcagaaaggagaaaccgtactgctgggacgtaatggcagtgattattctgccacacaggttggtgcactggcaggcgccaaaaaagtgacgatttggagcgacgtagcgggtgtttacagtgctgatccgcgtaaagtaaaggatgcgtgcctgttgcctttactgcgtttggatgaagccagtgaactggcgcgtctggcggcacccgtccttcatacccgcactttgcagcctgtttccgtcagtgatatcgacttgcaattgcgttgcagctaccagcctgaacaaggatctacccgcattgagcgggtgctggcaacaggtactggggcgaaaatcgtgaccagtcatgatgatgtctgtctgattgaactgcatatttcttctgcccatgatttcaagcagatttacaaggacattgattcattgctgaaacgcgcacaaattcggccgttggcgacaggtctgcacgctgactgtaatttgattcagctttgttatacctctgaagtcgtgaacagtgctctcgatgtgttgcaggatgcgtctttgccaggaaaattgtctttgcgagaaggattggcgctggtggctttggtcggggcgggagtgtgcaagaatccgttgcatagccaccgtttttatcagcagcttaaagaccagcccattgaatttatctggcatgcggaagagggtatcagccttgttgctgttctgcgcctgagccagacttcacatttgattcagggattgcaccaaagtctgttccgggcagaaaaacgcattggtctggtgctgtttggcaagggaaacattggctcacgttggctagaattgttcgctcgtgaacagaagaatatttctgcccgcagtggttttgaatttattttggcggggattgtggacagtcgtcggagcttgctgaattatcaggggcttgatgcgagtcgagcattggcattctttggtgatgaagccactcaacatgaagacgatgcgctgtttttgtggatgagagcgcacccttatgacgatttggtggtgttggatgtcactgcaagcgaggagttggctaaagactatattgatttcgccagctatggctttcatgtcatcagcgccaataaaattgcaggttcttcaaacagtaacacttatcgcatggttcgcgatgcttttgcaaaaaccggccgtcattggttatacaatgcgaccgttggtgcagggttgccgattaaccactccgtcagagatttgcgggaaagtggcgataccattctgtctatcagcggtattttttcagggacgttatcatggctgttcctgcaatttgatggctccgtacctttcagtgatttggtggagcaggcgtggcagcaaggattgacggagcctgatccccgtatcgatttgtccggtcaggatgtaatgcgcaagctgattattctggctcgcgaggcgggttatgagatagagcctgatcaggtgcgtgttgaatccctcgtgccagtagaggccagaaccggttccatcgaagacttctttgaaaatagtgccgttattaatgagcaaatgctccagcggttggaagcatcacaggaaatgggcatggtactgcgttatgtcgctcgctttgatgccaccagtggtaaagcaaaagttggtgtcgaagccgtgcgtgcagatcaccccttagcttcgttattaccgggggataatgtctttgcgatagaaagccgctggtatcgtgacaatccactggtgatccgtggtccaggcgctggacgggatgtgacggcaggagcgattcaatcagatttgaaccgtttgtcacagcttctttaa

SEQ ID NO: 639 - DNA, 1161 bp, Xenorhabdus bovienii
  Coding sequence Name=Xb4151_4152.C416.gene18.dna; Position on contig =21202..22362bp; Strand=-
atgggatgcaaacaagcaacagtcgcggttcaaagtggtgcaaatattgatgaacaatatggttgtgtagttccgcctatctatctttccagcacatataatttcactggtttcaatgagccaagggcacatgactattcccgacgtggaaatcccagccgggatgtcgttcagcaggttctggctgagctggaaggtggagcgggggcagtcatgaccagcagcggcatgtcggcgattcacctgctgtgtaccgttttcttgcaaccgggggatttattggtggctccccatgattgttatggcggtagttaccgcctgtttgacagtctgagtaaacgtggggcgtacaacgttatttttgttgatcagtcggataatcaagccctgaaacaggctctggcgcaaaagccaaaactggtgctgatagaaacgccgagtaatcctctgctgcgcattgttgatattcaatatatctgtgggttggcgcataaagttggagcactggcggttgttgataacactttcttgagtcctgtattgcaaaagccattggatttgggcgctgatttagttgttcactcctgtacgaagtacctgaatgggcattccgatctgattgcgggggcgattatcgccaaagatcccgtgatcgcagaaaatctggcgtggtgggcaaacaatattggtatcacaggtgccgcctttgacagctacctgctgttgcggggtattcgtaccctgtctgcacgggtaatgctacagcagaataacgcagcggctattgctgagtacctgcaacaacagccacaagtgaaaaaactctactaccctgctttgaaaaatcatcccgggcatgaaattgcccttaaacaacaaacaggctttggggcgatgctgagttttgaacttgatggtgatgaacaaaccctacgccattttttatctgcgttaaaattatttactctggctgaatctctcggtggtgtagagtcgttgatttctcatactgcgacgatgacacatgcgggaatggcggcagaagcaagggcgcaggcagggatcacggattcacttcttcgtgtctctgtaggaattgaagatagtcaggatttaattgcggatctggacaaagcgtttcaggcagcagcaacgaggtaa

SEQ ID NO: 640 - DNA, 318 bp, Xenorhabdus bovienii
  Coding sequence Name=Xb4151_4152.C416.gene19.dna; Position on contig =22653..22970bp; Strand=+
atggctgagtggaatggtgagtatgtcagcccttatgctgaacatggcaaaaaaagtgaacaagtcaaaaaaattacggtttcaattccattaaaggtcttgaaaatactgactgatgagcgcactcgtcgtcaagtgaataatctgcgtcatgcaacaaatagcgaattgctgtgtgaagcgtttcttcatgctttcactggacagcccttgcctaatgatgatgatttacgtaaagagcgtcatgatgaaatcccagaggcagcgaaagacataatgcgtgagctcggtattgatcctgaaacatgggaatactga

SEQ ID NO: 641 - DNA, 216 bp, Xenorhabdus bovienii
  Coding sequence Name=Xb4151_4152.C416.gene20.dna; Position on contig =23055..23270bp; Strand=-
atgagaaaaggtattcatcctaaatacgaagcaattactgcatcttgctcttgcggtaacgttatcactatcaactctaccgttaatcacaacctgaatctggacgtttgtggtgaatgccacccgttctacacaggcaagcagcgtgacgttgcgaccggtggtcgtgttgatcgcttcaacaaacgtttcagcgttccaggctctagtaagtaa

SEQ ID NO: 642 - DNA, 2199 bp, Xenorhabdus bovienii
  Coding sequence Name=Xb4151_4152.C416.gene21.dna; Position on contig =23498..25696bp; Strand=+
atgacagttgttcaggttgcgctgcctgtacccttaacccgctcttttgattatctattacccgaaggattaccgttgcccatgacaggtgtgcgggtgcttgtgccgtttggcaagcgcaatgcaataggcattgtcactggaaccgcaggcaacagccaaattccccttgaacagctcaagccacttgccgcgatccttgatgcacaaccgcttttccctgacgacctttggcaattgctccagtggtcagcctgctattatcactatccactgggagaagtattattccatgccatgcccgtcttactgcgacagggaaaacccgccgaatttactccactttggcaatggcaggttacagaagcaggccatgaattccctctggagcagcttaagcgttccgttaaacagcaacaagcgctggcttcgctacgcctgaaacccatttaccgtcatcaaatttctgaactggaattcagcgaaagcgcactgcaatcattgaaaaagaaagcgctgattgatctgcatccgatacagccggaggcagaaaactggcatgagcagtttcagattattggtgaacgactacaactcaatacagagcaggccaccgcagtcggcactgtccgagcagaagatcagattttttctccatggttgcttgcgggtattacgggttcaggcaaaactgaagtgtatcttagtgtgctggaaaatattctcgcacagggaaaacaagcgctgattttagtcccggaaattggtctgactccgcaaactatccgccgattcagagaacgtttcaatgcacctgtcgatgtcctgcactccgccttaaatgacagtgaacgcctgtcggtatggctacgagccaaacggggagataacgcgattgtcattggtacgcgttccgcattgttcaccccctttgcccatctgggcgtcatcattatcgatgaagaacatgacagctcctataaacagcaagagggctggcgctatcacgcccgtgatttggccgtgttccgagccaagaaagaaaacattcccatcatgatgggtacagcaacgccggctctagaaacgctgttcaatgtgcagcaggggaaatatcgacaattgacactgacccaacgagcaggtgaagccaagcctgcagttcagcatttgctggatttgaaaggcttgccattgacagtcggtttatcccagccgctcatcaatcgcattggtgagcatctgaaagcggataatcaagtcatcctgtttctgaaccgccgtggttattcccccgctttgctttgccatgaatgtggctggatagcggaatgccaacgctgcgatcactactacactctgcaccagagccatcgccatctgcgttgccatcactgtgacagccagcgtccgatcccgcgccaatgcccccagtgtggcactactcatttaattcccgtcggattaggaaccgagcagcttgaagatggcatcacaaaattgtttcctgatattcccgttacccgtatcgatcgggacaccaccagccgcaagggagcattggaacaacaactggcggcagtgcaccaaggtggtgcccgtattttaattggtactcagatgttggcgaaaggccaccatttcccagatgtcactttagtcgtcttgcttgatgttgatggcgctctgttttctgccgatttccgggcggctgaacgtttcgctcaactgtatacccaagtctccggccgcgcgggacgggcgggtaaacgaggggaagttgtccttcagacccaccatcccgaacatccactcttgcaggtgttgctggaaaaaggttatgacgcatttgcccgtcaagcgatggaagaacgtcaacaagtgtttctgccgccgtttgccagccacattctgctccgttcagaagaccacgacaatcagcaagcccctgcttttttgcagcaaatgcgtcaattatttgaacatcacgctctgcgtgatgagcatttatggatcatggggccagttcccgcattacaggccaaacgtggtggccactttcgctggcaattactgattcaacacccttcacgtatttttctacagaaaatgatggcggcaatttatccgcaaatcaccgcgctcccacaggcacgcaaggtgaaatggaacattgatgttgatcccacagaaggctga

SEQ ID NO: 643 - DNA, 1026 bp, Xenorhabdus bovienii
  Coding sequence Name=Xb4151_4152.C416.gene22.dna; Position on contig =25989..27014bp; Strand=+
atggaaaaaaagaatggcacattagcaaccatgaaagatgtcgccaatgtggctggtgtttctaccgcaactgtatcaagaacccttatgaatcctgacaaggtttctgcccgtacccgtcagaaagtagaaagtgccgtactggaagtaggctactatcctcataaccttgccaaaaatttaagacgcaatgaatccagagcaatcttggttattgttcccaatatcagcgaccctttctttaccgaagtcattcgcggtattgaagaaacagcagcagagcatggctatctggttctgattggcgactgtaagcatcagcagcaacaagaacatgcctttatcaatcttctgattaccaaacggattgacggcatggtgctgcttggctcaaacattcctttcgatgtttccaaagaagaacaaaaaaacctgccaccaatggttatggccaacgaattcgcacctgatctggaactaccgactgtccacattgacaatctgacttcagctttcaacgctacctatcacttacaaaaactgggacacaagcgcatcgcttgtattacagggccagaaacgatgccactgtgccattaccggcttcagggctacattcaggcattgcaccgtacgggggaagcgatccgcgaagattatattgtcaggggcgattttacccatgaaagcggagcggaattggcagagatcctacttaacctgccagagccacccagcgcgattttctgccatagtgatatcatggctattggcgcaatgtggcaagccaagaaaatgggattaaaattaccagaagatctgtcagttattggctttgataatttaaatctggcgcaatacagcgagccaccgctaacaaccgtggcacagccatgttatgagattgggtattattcaatactgttgttgctggagcagcttcaaggccgcatggtttccaaaggttcacgattattggatgcagaattgctcattcgtgcgagcacttgttcgcctaaaagctag

SEQ ID NO: 644 - DNA, 789 bp, Xenorhabdus bovienii
  Coding sequence Name=Xb4151_4152.C416.gene23.dna; Position on contig =27089..27877bp; Strand=+
gtggcacaacgagattatgtaagtcgcgggcgttctaatccccgtcagaaaggcactggtaagaaaaaaaatcaggctcaaggattacccaaaactacattagccgttgccgtggccttggtggtcatgtttattggtggcctttatttcatcgcacacactaagaacgatagtgcacaaaatacaccaccacccgctcatcatgccaaaaaccagggactaccgccaaaaccggaagaacgctggacttacattaaagagttggaaaaccgtcctgttggacttccttcgacacaggaaccgacttctgctaatcaaccaaccaaccaaccagcaaaactaacgcaagaacaactccaattacttgcacagatggaggcagatattcgccagcccccaacgccattaaaagaagtgccttacaacagtgaacctgttcctcgctcacaggtcattatcaccttgcctgaacaaaagccgtttgttgcacaagaaaagaccccgccagcacaatctctggcccccaatgaaaccaataaatcaccgaagcctgcgataaatgaatccaagctgatgctacagtgtggctcatttcgaacaacagagcaggcagaatccgttcgtgccagcctcgcattcgcaggcattgagagccagattacaacaaaagacaattggaaccgggttgtagtagggccttataaaaacaaggaatccgcggaaaaaatgcgcagccatgttacagatgcgggtgtacctggctgtattctccgcccttccgggggttga

SEQ ID NO: 645 - DNA, 531 bp, Xenorhabdus bovienii
  Coding sequence Name=Xb4151_4152.C416.gene24.dna; Position on contig =28015..28545bp; Strand=+
gtgactacaatcgtaagtgttcgccgtaatggccaggtcgtcatcggtggtgatggacaagcaacaatgggtcataccgtcatgaaaggcaatgtccgcaaagtacgccgcctatacaatgacaaagtcatcgcgggttttgccggcggcaccgcagatgcatttactctgttcgagctgtttgaacgcaaactcgaaatgcatcaggggcatctgaccaaagcagccgttgaacttgccaaagactggcgaacagatcgcatgcttcgcaagctggaagctcttcttgcggtagcagatgaaaatgcttctctgatcattacaggtaacggtgatgtgattcaaccagaaaatgacctgattgccattggttccggtggttcatacgcacaggcagccgcccgggcaatgctggaaacgaccgaactcagcgccagggaaatcgcagaacgcgccctgactattgcaggcgatatctgtatctacaccaaccataatcacaacttcgaagaactgccttcaaaagcgtaa

SEQ ID NO: 646 - DNA, 1332 bp, Xenorhabdus bovienii
  Coding sequence Name=Xb4151_4152.C416.gene25.dna; Position on contig =28557..29888bp; Strand=+
atgtctgaaatgactcctcgcgaaattgtcagcgaacttgacaaccacattatcggtcaggataaagcaaaacgcgctgtcgccattgctctgcgtaaccgctggcgtcgtatgcagttggatgaaacactgcgtcatgaagttaccccgaaaaatattttgatgataggcccaaccggtgtcggtaaaaccgaaattgcccgtcgtctggcaaaactggccaacgcgccttttatcaaagttgaagcgaccaaattcacagaagtcggttatgttggtaaagaagtcgattcaattatccgtgatttgactgatgcggccgtaaaaatggtgcgtctgcaatctattgagaaaaaccgctatcgtgccgaagagttagccgaagaacgcattctggatgttttgctcccaccagcgaaaaacaactgggggcaaacagaaacccaatccgaaccttctactgcccgtcaagcattccgcaagaagctgcgcgaagggcagttagacgacaaagaaatcgaaattgacgtcgcatctgcacctgttggcgtggaaatcatggctcctccaggcatggaagagatgaccaaccaactgcaatctatgttccagaaccttgctggtcagaagcaaaaaacacgcaaaatgaaaatcaaggatgcgttcaagctgctggtggaagaagaagccgcaaaactggttaatcctgaagagctgaaacagcaggccattgatgccgttgagcagcacggcatcgtctttatcgatgagatcgataaaatctgtaaacgtggccagacttccggcccagatgtttcccgtgaaggcgtccaacgcgatctgctgccactggttgaaggctgcaccgtttctaccaaacacggcatggtaaaaaccgatcacatcctgttcatcgcctccggcgcgtttcaggtttccagcccttccgacctgatccctgagcttcagggtcgtctgccaattcgtgttgagctgcaagcgctgacaacagaagactttgaacggatcctgacagaacctaacgcttcactgactgaacagtataaggcgttaatggcgacagaaggcatgaatatcgatttcacaactgacggcatccgcaaactcgccgaagccgcatggcgagtaaatgaaacgaccgaaaatattggtgcccgccgtctgtatactgtgcttgaacgcatgatggaagatatttctttcgacgccagtgaacgtcaaggacattcggttgaaatcaatgccgattacgttaaagagcatttggatgagctcgttgcagatgaagatctgagccgatttattttataa

SEQ ID NO: 647 - DNA, 918 bp, Xenorhabdus bovienii
  Coding sequence Name=Xb4151_4152.C416.gene26.dna; Position on contig =29999..30916bp; Strand=+
atgaattcaacaacgtctatcagtcagatgcaggcatggttggaaagcttgcgccccaaaacgctcccacttgccgtggcagctgtcgtgagcggttctgcccttgcagcatggacaggccatttcaagtggcctgtggcgttgctggctttattgactgctgccctgctgcaaatcctttccaacctcgccaatgattatggtgatgtcgctaaaggcagcgatacagaaaagcgtattggcccgatgcgtggtatgcaaaaaggtgtgattacggccgaacagatgaaaaccgccttgaagatcactgtgctgacctcctgtttatcggggattgctctcatcaccgtcgcctgtaacagcccaagcgatatcatcggctttctggcgctgggagtactggctatcgttgcggccatcacttacaccgtgggaaccaaaccctatggctatatggggctgggcgatctttccgtcctgattttttttggctggctgagtgtcattggcacctattacctgcaagccaatacttttgatctgagtaccgtgctgccagcaaccgcctgtggcttactctccgtggcagtcttgaatattaataacttgcgcgatatagaaagtgatcgccaaaatggtaaaaatacgctggccgtcaggctgggagcaaaaaaagcccgctattaccacgcagctctgctgatctgtgccatcctctgtcttgccgcctttacactcctgcacctgaagagctggtctggctggttattcctgctcgccgttcccctgctgttgaagcatatgtggaaggtactgcacgatcagacatcagaaggcatgcgcccaatgctggtacaaatggtcaaagccgcattattgactaatgttctgttttccatcggattggtatttaattaa

SEQ ID NO: 648 - DNA, 504 bp, Xenorhabdus bovienii
  Coding sequence Name=Xb4151_4152.C416.gene27.dna; Position on contig =31025..31528bp; Strand=+
atgaaatatgatacttccgaactttgtgatatctatcaagaagatgtgaacgtggtagaacctttattctccaactttggtggacgtacttcatttggtggtcaaatcatcacggtgaaatgctttgaagacaatggcctgctttatgatgtgctggaagaaaatggcagtggccgtattttactcgttgatggtggcgggtctgtccgcaaagcgctggttgatgccgggctggctcagcttgccgtcagcaatgagtgggaaggcattgttgtctatggtgcagtacgtcaggtcgattcccttgcagagcttgatatcggcattcaggcgatggctgcgatcccagcaggctctaacagtgaaggcatcggagaaagtgatatcagggtgaattttggcggagtgactttcttttccggcgattatctctacgctgataatactggcatgattttatcagatgtcccgttggaaattgacgaagaagatgatgaagtatga

SEQ ID NO: 649 - DNA, 243 bp, Xenorhabdus bovienii
  Coding sequence Name=Xb4151_4152.C416.gene28.dna; Position on contig =31606..31848bp; Strand=-
atgtcatttgaagtttttgaaaagctagaatctaaagttcagcaggcgattgataccataactctcctgcaaatggaaattgaagaactgaaagaaaggaacgcagcgttgtctcaggatatccaaagtgcggcaagtagccacgactcgttggtgcgtgagaatgaacagttcaaacaggaacaactggcgtggcaagaacgtttgcggactttgctgggtaaaatggaagatgtgcagtaa

SEQ ID NO: 650 - DNA, 798 bp, Xenorhabdus bovienii
  Coding sequence Name=Xb4151_4152.C416.gene29.dna; Position on contig =32159..32956bp; Strand=+
atgagccagaccaccacaccaacattatcaggtcaatgcatttcagaatttttgggtactgcattgctcgttttcttcggcttaggctgcgttgccgctgcccgactggcaggtgcacaactggggctatgggaaatcagcattatctggggcttcggtgttgccctcgctgtttatctgactgccggaatttcaggtgcacacctcaatcccgcagtcaccatcgccttatgcctttttgccagttttgacagaaaaaaagtgctcccttacatcattgcccaaatgctcggcggatttgccgctgccgccattgtctatatgatgtattacaaccttttccttgattatgagcaagttcacaacattgttcgtggttcacaggaaagccttttcacggctggtgtattctccacttatcctgcgtcacagctatctgtattacacgcgtttattgtcgagattatcattgcagctgtcttactttgcctgattctggcactgacagacgatggcaatggcattccgcgcggcccaatggctccgctgttaatcggcattttgattgccgttatcggtggttcatttggttctttgaccggatttgctctgaacccagcccgtgattttggccctaaactagtcgcttatttagctggctggggagatattgccctgacaggaggcagagacattccttattgtcttgtgccgttggtagcccccttcattggtgcaattctaggcgcactcggttatcgaaaactgattgcccgccatttaccgcgtgcggtgtaa

SEQ ID NO: 651 - DNA, 1524 bp, Xenorhabdus bovienii
  Coding sequence Name=Xb4151_4152.C416.gene30.dna; Position on contig =33026..34549bp; Strand=+
atgacaatagaaaatatcactgaaaaaaaatatatcgtcgccctcgatcaagggacaaccagttcacgagctgtcgtactcgatcacgatgccaatattgtctgtatttcacagcgtgaattcccgcaaatctaccccaaaccaggctgggtagagcacgacccaatggaaatctgggccagccaaagctcaacattggtcgaagtgctggcaaaatctgatatcagttcagatcaaattgccagcatagggatcactaaccagcgagaaacaacgattgtctgggaaaaagaaacaggtaggccagtttataacgcgattgtatggcaatgtcgccgaacagcagatatttgtaccaaattaaaacaaaaagaaggattagaagaatatatccgccacaatactggcttggttgtcgatccttacttctccggaacaaaaataaaatggattctggataatgtagaaggcatccgccatcgtgctgaaaatggcgaactgttattcggtacagtcgatacctggctcgtctggaaaatgactcagggtcgtgtgcatgtgaccgattacaccaatgcttcccgcaccatgctattcaatatccacaatctcgattgggatcagaaaatccttgatgagctggatattccccgcattatgctgccaaaagtgtcatcttcgtcagagatttatggtcagaccaatattggtggtaaaggtggcacacgcattcctatcgcgggtattgcaggcgaccagcaggcagccctgtacggccaattgtgtgttcatcccggcatggcaaaaaatacttacgggacaggctgcttcctgctgatgaatacaggaacagatgcagtacgttccagtcacggcctgctgaccactattgcctgcgggccacggggtgaagtgaactatgcactggaaggcgctgtcttcgttggcggcgcgtctatccaatggctacgtgatgaattgaaactcatcgccgatgcggcggattccgaatatttcgccactaaagtgaaggacagcaatggtgtgtacgttgtaccagcctttactggcctaggcgcaccttactgggacccttacgcccgtggcgctattttcggcctgactcgtggtgcgaacagcaaccatattattcgcgccacgctagaatctatcgcttaccagacccgtgatgtattggatgcaatgcaggctgactccggcacacgcctgaaatccctgcgtgtagatggtggggctgtcgctaacaatttcctgatgcaattccaggccgatattctgggtactcgtgtagaacgccctgacgtacgtgaaagtacagcgttgggtgccgccttcctcgctggcctggccgtcggtttctggaaagaccttgatgaagtgaagagcaaagcgacaatcgaaaaagagttccgtccgggcatcgaaaccactgagcgaaaccataaatataatggctggaaaaaagcggttgcccgcgctcaggaatgggaagaccgcgcttaa

SEQ ID NO: 652 - DNA, 1188 bp, Xenorhabdus bovienii
  Coding sequence Name=Xb4151_4152.C416.gene31.dna; Position on contig =34641..35828bp; Strand=-
atgagaaaaatagaacactttaatttattagtgatgttgattgctctggctgcggtgggtcagatgacacaaacaatttatgtgcctgttattgcagatatggcgagtgattttggtcagcctgctggcgaagtacaaagagtcatggcggcatacttgttttcttacgggatttcacagattttttatgggccgttatccgataagattggtcgccgcccagtgattttggccggaatgaccctttttctggtggcaacaacctgcgcattgtttgcctccagtttgctggtgctggtgattgccagtgtatttcaggggctgggaacgggggtggcgggggttatggtgcgcaccatgccgagggatttatataccgggacgtcgttgcgttatgctaatagtctgctaaatatggccgtgctggtcagccctttgctggcaccgatgataggtggcatggttggttattattttggttggcgtgcctgctattggttcctgctatcattgggggcaacagtagccttctttttgttccaacacttgccggaaacccgccctgtgcagacaaaacagagcaccatgctggtttctttccagcaattactctccaatagtgcttttgttgcctacctgattatgctggttggtggtctggctggcgtcgcggtttttgaagccagtagcggtgtgttgatgggcgctgtattgggattggatagcttaacggtcagtatcctgtttattttgccgatccctgccgcatttttgggtgcgtggtatgcggggcgtgatggcaaaacgttttatcggctgatgtggcattctgtcatgtgctgtttgctggcaggcgtattgatgtggctgcccggctggttcggtattatgaatgtctggacactgctgatccctgcaactttattctttttcggtgccggtatgctgtttccattggctaccactggtgctatggagccatttccttatttggctggagctgcgggggcgctggtgggtggattgcagaatgttggttctggcgtgacgacatggttgtcggcgatgttgccgcaaaatagccagttcagcgtcggtatgctgatgttttccatggcactgcttattttgttctgttggttacctatttcccagcgcgttcagcgccaggagcatacggcctcataa

SEQ ID NO: 653 - DNA, 747 bp, Xenorhabdus bovienii
  Coding sequence Name=Xb4151_4152.C416.gene32.dna; Position on contig =36207..36953bp; Strand=+
atggcaaactgggttacaggaaaagttaccgacataaccaattggacagattcactattcagcatcaaagttcatgcaccgattgaaagatttaccgccggccaattcgcaaaattggctctcgaaattgaaggcgaacgtatccaacgcgcttattcttacgttaattcccccgacgacaatagcctggaattttatttagttaccgttcctgaagggaaactcagcccccggctcgcagaattaaagaatggggaggaactcctcgttacagaacaggcagcgggtttttttgtccttgatgaaatccccgattgccaaaccctatggatgctttcaaccggtacagccattggcccttacctttccattctccaacaaggggagaatctggaacggtttgaaaatattgttttggttcatgccgtgagactggaacaagatttgagttatttgccgatgatgcaacaactagaaaaaaagtttcaaggcaaattaagaatccagaccattgtcagccgtgaaaaatgcccagattcactcatgggcagaattccggcattaattgaaagtggcgagctggaagctgccgttggtttaccgatgcaggcagaaaacagtcacattatgctgtgtgggaatccccaaatggccaaggacacccaacagcttctgaaagaacaacgcaatatggcaaaacacctgcgccgtaaaccagggcatatcaccagcgaacaatattggtaa

SEQ ID NO: 654 - DNA, 687 bp, Xenorhabdus bovienii
  Coding sequence Name=Xb4151_4152.C416.gene33.dna; Position on contig =36977..37663bp; Strand=-
ttgtatttttcccgaaatacaggaatggtttcctcgaaagtgggggaatcaggcagtaaatacatcaactgtgagcgcgtgtccggtgtgacagaaggctcgcctgctaaagcggataatggcaaactgataccaaaagcgattaatattgtcatcagaagtttattcatgcctgttttcatgttgtactcgttgagtgtaaataccggaaaaacagcatccacaattggaaaagaatacatgacattacaacaatggggattctcattcaaaggccgaattgggcgacgggaattctggatcggtatcggcatctgtttcgccctgatatttatgcttttgaccttgcatggcctgaacaccctccccatgcattatgctacagcgggtatcgctttgatcctgtacccgacagcagcgattatagcgaaacgtctgcatgaccgaaataaacgtggtggatggatgttactgctggttttggcctgggtattgctttcccttgattggagcgcaatgacacctatctggcaatgggggattggtcgtttcattccaacgctgattttcgttatgattgtgctggattgcggtgtatttcgtggtatggaaggatcaaaccgttttggtgagatggcagaaacggttgagtatatttctgccagtgaaccagccccaaaacgctga

SEQ ID NO: 655 - DNA, 681 bp, Xenorhabdus bovienii
  Coding sequence Name=Xb4151_4152.C416.gene34.dna; Position on contig =37422..38102bp; Strand=+
atgtattcttttccaattgtggatgctgtttttccggtatttacactcaacgagtacaacatgaaaacaggcatgaataaacttctgatgacaatattaatcgcttttggtatcagtttgccattatccgctttagcaggcgagccttctgtcacaccggacacgcgctcacagttgatgtatttactgcctgattcccccactttcgaggaaaccattcctgtatttcgggaaaaatacaacaaaaaataccctgaaatccccctgcatgaatataaagtgattgtaagtaaagatatctccctgcctttcattcgtgccgccagcaagattaacgaaaaaatttattcttcggcagtactggaacgaggcagcgaaaaaattaaaagcctgcaaattaccctgctgccaccacaaagcgaacctgagaaagaacacaatctcgcactgataaaacagtatattactgcgctgatcagccaattcgagcccacgctttccccagaacaagccaacaaacaattagaaagacttttacaggctgcgcaaagccaccgatttttcagccaaaaaatcggtgcgatacgttatgtcatcgtaaacagcagcgaaaatataatgaccttcgcaattgaaccgattaagctatcgttatctgacgcacccgcgagcaaaaattag

SEQ ID NO: 656 - DNA, 768 bp, Xenorhabdus bovienii
  Coding sequence Name=Xb4151_4152.C416.gene35.dna; Position on contig =38242..39009bp; Strand=+
atgcgacatccattagttatgggaaactggaaattaaatggcagtacccacatggttaacgacctgattgcaggcctgcgtaaagaactgagcaatgttgacggctgtggcgtcgctatcgcaccaccaacagtttatgtttctctggcaaaaaatgcactggctggcagccgtatcgctctgggtgcacaagatgttgacgttaacctttctggtgcattcaccggcgaaacatccgctgaaatgctgaaagatgtgggcgcgaaatatatcattatcggtcattctgagcgccggacttaccataaagaaagcgatgagctgattgcgaaaaaattcaccatcctgaaagaacaaggactgattcccgttctgtgcattggtgaaaccgaacaggaaaatgaagcaggccaaaccgaagccgtatgcgcacgccaaatcgatgctgttctgaatacactgggtgccgaagccttcaaagataccgttatcgcatacgagcccgtctgggcaattggtacgggtaaatcagcgactcctgcacaagcacaggctgttcataaatttatccgtgatcatatcgcgaagcaagatgcagctatcgctggacaggtcatcattcaatacggcggttccgtcaatgccggcaacgcggcagaactgttcacccagccagatatcgatggtgctctggttggtggtgcatccctgaaagccgatgctttcgccgttattgtgaaagccgctgccgaagcgaaaaaggcataa

SEQ ID NO: 657 - DNA, 159 bp, Xenorhabdus bovienii
  Coding sequence Name=Xb4151_4152.C417.gene1.dna; Position on contig =3..161bp; Strand=+
aaatgggcattctggcagaaatcggatagctggatgcgtaatgcctggcatcggctggcgtttgcgtgtgaagctaaggcgtttctgtgtttacgtgattttgccaaattgatccatgatgttgctcctttcttttgtcaaagaatagactccgtttga

SEQ ID NO: 658 - DNA, 468 bp, Xenorhabdus bovienii
  Coding sequence Name=Xb4151_4152.C417.gene2.dna; Position on contig =267..734bp; Strand=-
atgacggatatgctgaacatgtcggcggaacagttcacgtttgaagaagtaaaacgaccgaaaccacagggaaaatgcacacctcagttacaacagtgcattaatgatttttttaccggagtcaagcaagatcgcacagatgaaattatggctttaatcaggtctcccatggatgaaaacgaagaggaaaatattctttatcttcgtaaactgtactacggacactatgaaagcccatatcagagagatgatttagttaaaagtgaaatacataaaacagtggtatcggagatctacaactactttgaatcgctcgataaaactagaaaacttgagaatggccgggatctttttccctttctttttagcccaaaaaaatatgatatcagcaccattgtgcctaaaaatgtgagtttatgcgaagtttttatgaatatgatccatattcaggatgagaaactcatgtga

SEQ ID NO: 659 - DNA, 186 bp, Xenorhabdus bovienii
  Coding sequence Name=Xb4151_4152.C417.gene3.dna; Position on contig =818..1003bp; Strand=+
ttgtatgaaggcaaacgacatgatctaatgagacttattttccttcttacttgcttacctatgactctgattgaacatttatccgttgtgaaagaaacccgctctgacattaatcgtcaatacgatctggttgatattattttcctcgttgtcagtgccattatggcgggagccgaaggttggtaa

SEQ ID NO: 660 - DNA, 639 bp, Xenorhabdus bovienii
  Coding sequence Name=Xb4151_4152.C417.gene4.dna; Position on contig =1325..1963bp; Strand=+
atgttggatattcttaatctaaaaggcagtattgtgacgcttgatgccctacattgtcagcgtgaaacagtggaaaaaatcagtgaaaagaaagcgcatatggttgttcaggtaaagaaaaatcagcctaagttatgggctgctgtccaattacaatttcaggcggtgtttgatgtaggtaaagaacaaattgtcactgaagttaagcaagaagcgcatggacgtagggaagagcgctatgttttccagctcaaacctcaattttcccctgaaatggcagaaaaatggccaacaattcgcagtatcatcgcggtcgaacgacatcggtcagaaaacggcaaagacacggtagatacgtcttactatatcagctcactttctccccgacacaagtccttagggcactacatccgacagcattggcggattgaaaatagtcaacattatatccttgatgtggtttttaaagaggatgattcacgtattgttctggacggagccattgaaattttggcgttattccggcgtatcgtattgaatatggtaaaacaatgtaactgtggtgctcccagccaaagaaataaacttaaaaaagcaggctggagtgatgattaccgtgcacaagtgttctttggatag

SEQ ID NO: 661 - DNA, 807 bp, Xenorhabdus bovienii
  Coding sequence Name=Xb4151_4152.C417.gene5.dna; Position on contig =2174..2980bp; Strand=-
atgaaaactacattaaaattactaacaatattaccgattaccttgttcttaacaggatgtgaatttatatccaatgctatttcaagttattggcaaacttataacgataagtctgaaccattctcaccgcctgaaaataatcaatggatcactgttgaaggcattgctcccccaaacactaaacctaatttagttactacttatgcttcaaatagatgtcttgctactcataatactgcaagtggaaaactctatcacctcccaagatatcactggaacaagtttaatatctcaacagaccctgaaacgggttcttttaaggaaaaagtacctttccacggaggggggtggtgtcaatggaaaatcaataccgtcacagtatcccttgtctacaatgaagttaatcagttaataaaaggagccgttccttatgatggtactggtataaaagcttttattaatggcgcagaaaaacctaaagagatgaaagaatttttaaatattattgactatagaccaactatttatccttttttaagaagagattatgatgatggtgataaaataggattatatggaaaaagtggagggttgtcatattttggattaaggcttatagaaggaaatgattggaaaatcaattacacgcctattttagatgagagcaaaatgccaaaaattattatctcagaaaatccgcctggtgtatatcctagaggaagtgcaagggttgaatacccagatggaaaagtggatttaaacagagattctattgattattggaaaataaataatacatctcaatga

SEQ ID NO: 662 - DNA, 1875 bp, Xenorhabdus bovienii
  Coding sequence Name=Xb4151_4152.C417.gene6.dna; Position on contig =2990..4864bp; Strand=-
atgagtaatgctaattcgatttattgtcatgattgttcgggaatgttaaagaacaaaatagaaattcagcttgttgatgaacataataaacccatcaccaatatgccttacacattgaaaaaccataaaatggctcgtgaaggaatcaccgatggcaatggtatgatccatgaagaacacttgacttcgagtcctcttagattatttctcgatggacagaaattggctgatgaaatggaacaacggccattgagacttaagcgataccatgagtacacacgctctactgagtctatggccaaaatttcagccgtttttgcagaaagccaaaaatcaggccgtcagtatcgttatgcaaaaattggagaactggttgataaaattccggtcattgagggatggaaagaagaagatcctcttccaagctaccattttccagatagtgaaccgatgggcatcgaagtcatgcccactgcattcgaacgctatcgttatgtaattgaagtctgcccatttagggcatggtctttagtactgcatcatcaaaaagactattctctggttaatgcctataacctttcactgatgagtatattgacttattccaatgacaacagtgggcattggggttcagttacacacttttttaataaacagttgctcgatttatcacgatcaccttatcaggttaatgatgagcgttttatgcctgttgtttatgatgttccattcagtgagcgctatactaaggttgtctatattgattcaaaagtacaaggaaatacagggcatactcaactcttctacgccgcaaacaagcaggagattattgttggttggcgtggtactgaaatgacggaaacacaagatttgatgacggatggaaccttccaaccgatagaattaggaagcacagctaatggtgtatcaagtggctttagcgaaaaagggaaagttcataagggtttttgggatgcctttcatctaattacagaaatcaaagtttctgaagggaatgataaaaaaacagtatttgaagaaatcattaaattaacagaaagtaaaaaactatttgtctgcggccacagcttgggtggtgccctcgctctgttacatagtgcacagctcaaatcttataatccttgcctctatacctacggtatgccacgtttgttcactcaaagtgcagtgcaagaactcactgaaattattcattatcgtcatgttaatgaaaatgattttgttccctctgtgccttttaacaaggatatggataatgttgcttttcaagcaggtcgtaaatttctaggatacgcaatcgaagtatttgatgcagctggttctctcgaagcaaaaattattaaatcgaacaatagtgataacgatccctttttacaccacggtaaattagtttatttttatgctctccctgattcggaatcaaaattttatttactcccagagctaaatgaggaaaccataaaaacaacccaaaaatttataaaaaaacaaaaaaacgtagatagatatataatgcaagatatacattcattctttcaaggtaatgaaaaccctacaggtaaacgtggaacaggtctttttgaccatagcagcaccttatatgctgaatatattgacaagagattgcgagagctatgttctctttcaccggataaaaaattgcaaaggaagccggaagatctttcatttcttgaaagccagcctaattctattcgagctatattccaaagggcaaaaacggaagaatattttttcttaagggaaattgataatcaattggcaataacattagaagtaacccaaaaagatgaaagaggtccaagagccttgaaacgatattttgaaaaacgataa

SEQ ID NO: 663 - DNA, 795 bp, Xenorhabdus bovienii
  Coding sequence Name=Xb4151_4152.C417.gene7.dna; Position on contig =4880..5674bp; Strand=-
atggaaagagctatcactatggagagcacaggatctgcaataagttggcaagtctggctgaatgaacccagtaaagcgcctgtattttttattctcaactcgctggcaaaaccgaatccaatagagtcattttaccatcatgactgggttgagcaggcatttccgctgtatagcggaaccccgatgcgcaatatgttgaagcagagtccgtggttggtgcaaccgaaggtgaatcacctcactcagataggggcagcgctggatcgctatgaacttagtgacaacagttggggttgggcttatcgcagccatacaccgtggcaagaacagcttaaacactggcaacagcgacaatgggtgatgatgaatggcgaaccggtgctatttcgcatgatggatgctcggatattgggcacactaatgcccgccttcacgcccagcgattggtcactgatgctgactccagtcacagaattgatggttgacacaccgcaaccggcacgattttcccgtcccgaaggctgcggagagggtaacagcgacatcccatttacgctgggcgagcacctgctggccgtctggttacgttctccctatggtctgaaagtcttaaccagctccctttataacgatttatgggaaaaccatggtgcaatggcgaagcaatgggatcaaccagaaggcagtttagaaccccggattgagcagtggttgaggcaaaaactggaagccggacaacggattgaaaaaatatccagtcaggattacctgctggcaatggaacaagaaaaataa

SEQ ID NO: 664 - DNA, 2067 bp, Xenorhabdus bovienii
  Coding sequence Name=Xb4151_4152.C417.gene8.dna; Position on contig =5680..7746bp; Strand=-
atgatgaagaatatcattgacaggctgcccgccgccaaaagtggattgcggtttacttttcaggtcgcggggcttcccgaagatacgttcagcgtgggggagttttccctgctggaagggttatctgagttgtttaccctgaacctgacactggtcaaaacccatagcctgaatccgttcaagccgttagacgaggtggatttgaccgctttactgatgcaggaagcggagttgcaaatctttcacggcgtacaggtgcagcgtaaaatcaccggtatcatctctcacgctgactgggccggcaccgacggcaataaaaccctttataccctgaccgttcgcccggcactctggcgcctgaagctcaatcaggagagccggatattccatcagcaaaatgtgcccgctatcctgaatggtctgctgaaaaagcacaaagtgcgggcggattcgaagctctatgacccccatcaggaccgggaatacgtgacccagaaacgcgaatccgattatgggtttttcagccgattagctgcggaagaggggatcagtttctggtttgaggatgaaacgctgtttttcagcgacagccatctgggcatgaccgccggcctgccgctggcctacaacccacaaccggaaaccgcccacgggctggataccatttatcaggtgcggttaggcgtcgggatgagcccgcagcgcagtctccacaaggattttaactacgacaatccgcgttatcacctctcccatatggccagcagtgaaggtttccgcgatttcggcagccaaaccccgtataccgtgtttgaaagctacgggcgtttccagaaagacgctgccgccaaaccgtttctcaaataccgccacgaagcgctggataaccagaaaaagaccggcagcggcaacagcaactgcatcaaactgatgccgggcaaaatcttcgaaattatcagtcacccacatctaccgctcaatgctcgttggcaaattgtcggtatcagccatcacgggcgctgcccgcaggcgctgggcgataacagcggtgaaggtaccacactcagcaaccatttcagttttatcgacggcctcgccgactaccgtccgccgttccattacaagccactggccgatggcgatgaaaccgccacggttgtcggccctgagggggaagaaatcttcgtcaataaagacggtgccatcaaagtgcatttccactggaaccgttacgacaaggcggatgacggcgcatcctgctgggttcgcgtcgcacagggctggaacggcaacggctttggttttatggcgatcccgcgcatcgggcaggaagtcatcatttcttacctcaacggcgatatcgaccgcccgattgtcaccggctgtgtctacaacgggctgaaccgcccgccgctggatttgccggcccagaaaacccgcaccaccttcaagaccaaaacccataaaggcaaaggctttaacgaactgcgctttgaggatgcgaaaggcagtgaagaaatctatttccacggccagaaagattttacagctcatatcgaaaacgatgccctctggcatatcaaacacgaccagaaacaacgtatcgataacaaccgttatcacgacatccgtgccgatgaccatcatcaggttgccggttcccgcaaaatcaccaccgaaggcgatgtttcccaccggattgcgggcagccagcatacccagaccggtgatgccaccgtgattgacagcgggcaggaaatccacctgaaaagcggcggtaaagtcgtgctggaagcggcatctgaaatcacgctgaaagtgggcggcagttttctgaaagtcaccccggctggcattctctgttcaccgattaatgtcgggcagggttcggccggtaacgggcgtgggctggcactgcaattgccggaaggggtagagccactcccacaagtagggaaactcccgatggcggaagcactcccggtaactgaatttccggtgcaaccggcttgtgcagaactggcgcagcaggatgccagtttagtcattaaacctgttaaagagtaa

SEQ ID NO: 665 - DNA, 1758 bp, Xenorhabdus bovienii
  Coding sequence Name=Xb4151_4152.C417.gene9.dna; Position on contig =7783..9540bp; Strand=-
atgaaaaacaacaaggagtctatgtacctgcgggaaagagcctacctgcgggaactggctcaacgcgtggcgaaagactcgccgcatttgtccgattttctgaccctatcccatgatcccgatactgaacgtgttttcgaagcgtttgccctgttgattgcccgcttacgggataaaattgaggatgatctccccgaaattacccacggcattctgtcccgtatctggccgtcagccctgagtcccattccgcccacaacagtcatgcagtttcatcccaccgacggcgaacatcagggcaccgttgacatcccggcaggcacaccagtttccgccgatgtcaacgggcagttactcacctttaaaacctgccgttccctgcatatcgaaccccttatcgtgcgggacaggacagtgaagaaaaccggcacacacagtgagatagtgctgacgctttgccagacaggcacgccttcccctgtctggcaaagcggatcactgtcttttttcctcggtacggataatgaacgggcagcacaattaactttgtggctggatcagcatatctgtgatatgcacctcagaacgcagggagaacaacgcaaactgaatagtttcccttatggctggcataacctgttcgatgctctcctcctgccgatgggaaatcgcacttatgccggactgcaattactgctggaatattatgcactgccccacctgtatcactttatgacggtggatatcagtgacagttgccgggacgttccgttaaatgccgacggcagctttgagctggtttttcgttttgaaggtgagttgccgctggataatgtcgacgatgcttttatgctgggctgtgttccggccattcatctggaaaccctgaccagccttcccctgccgctgaatgaaggcaatcatcgttatcccctgcttcttggcgagtccgtgcagttgttccggctgcgcgatattcaggtggttcagcaacctgatgaaacacagcaacggggttcgccctaccgttatctgcccatcggccagtttacgccgtcatcgcccagtctggcggaagacggggagccggagacgctttattatttgctccagaacgagcgtgatttactgggcaggctcacgcaccagctgcatttttttgacctgaccggcaaaccggctcaacacctgcctgtcctgtccgtcgtgggtgatattctgggctatcacacgcaggccatcaccttaaaacccggtgaaatcaccctcacgcaggaaggttccccggcccatctcaacgtacacaatattctccccgtctccgccgattacccgtccctgttgcaggacaattccggctggccgttgctttcctgcctctccagcccgccggtgttgttatttgccaccgacagcctgaaacagttgctccgcctgtttgacccttaccccgaactcaatcgcccgctgagccgccatatccgccggcatatcgacggcattgtccgggtggaagagcacctcaccgaccgcatgaaacggggacgtcctgtccgcgggcaccgggtggggctcacactcaaccctgactgttaccacaatccgggagaaatgtaccgcttctgccggttaatcaatgaagccatggcgtgttttatcagccagtccaccttcgtcaggctggcggtttatacctcaaacaacagcggcgtcttgtgggcatttaaggaagtctatggaacgcgcagagagatgtaa

SEQ ID NO: 666 - DNA, 399 bp, Xenorhabdus bovienii
  Coding sequence Name=Xb4151_4152.C417.gene10.dna; Position on contig =9845..10243bp; Strand=+
atgaaaaagccgggtttactgctcctgatgggatggatggtatcactgtccgccggagccaaaactgtgatctataccgacagtcagcacccgccggttaatttgccccctgaggcacaggtcatttggctggatgcaccggagcaacagcaaaggcagatctttgcacgccttcccgcagacccacaacaggcggcaacccaagcccggaccatacttcagtctcctcagtggcgcgggcaggaacagcaacttatcaacgcttaccgtgctgttgtccatgcccggcaagccggtgtgcgcaaatacccggcggtggtatttgatgatcgtgacgtggtgtatggcacggccgatgttgccaaagcgacggcgctcagggagcagtatcagccatga

SEQ ID NO: 667 - DNA, 969 bp, Xenorhabdus bovienii
  Coding sequence Name=Xb4151_4152.C417.gene11.dna; Position on contig =10240..11208bp; Strand=+
atgaatacgtcacgcctggcttttccggtggttatcacgctggccgcggcatgtgcgcctgtcacacaagccgccattaataccgcccaaatcgtggccggcagtctctcgcccgcctgtattcagtggcaggtcagtggcatttgttactggctgttttgttcctggcacggctgtacggtgaaaacctcggtcaaagtgacccatttcctgccgcaggcggtggtctccacctatcatgcgcccggcggcaacccgtggtctgaaatggctcacatcagcccgttatccggcggactggaaaatgcggtaacgggggcgttatccggcctgaccaccggcggcggtaatcacacggttcaggttgccgggaagcgcagtccccgtctgcgtttcaaatacgccgatgctatcgggcatcccgctactacgctgattggcggacaaatcccggggtattcctgtcgcagtgcggccacaccgctgatgccctattttctcagcacactggatactgtcgcgtggcgcagcggactgccggagtcgctttatcctgaagcgcttgttcccggtctgcgtgaactgggcagccagccggtgggcaatatgtggggcaatctctacccccgttccggttttgtcacgcaggctgatgaggataaagccgctgccgtggtggcacagcgggtggcggacattatcacccgtaccgggcagccccatgtttatcagccactggccgggcaacgccgtgacggctactggccaccagagccgatgcaagaaaataccggcacgaaaaatcaccaatggcaacggttgtcaccacagttaagtcagtcctgtgcagtattcccggatggccgccacacagcggcggcagacagcaatcaggcgtatgccctgtggcagccctacagctgttgccagcggcgcgggcaacgttttctcggcagtacggcaatataa

SEQ ID NO: 668 - DNA, 1434 bp, Xenorhabdus bovienii
  Coding sequence Name=Xb4151_4152.C417.gene12.dna; Position on contig =11221..12654bp; Strand=+
atgagaagaaaatcggtgctgctgatagcgggtgggctggtcgttgcctcggtacaggggcagacatcggggctgtcggtggccttaccggccgtcagtcacagtgcactgggctatggtgcacagagcagcggggcagtctccgatacgctgttttataccctggggggcggctcggtgatttctgagccggccagtcgcgcggggtcaacccggctggccgggctggaactcggctggagttcggatttgatgtgcggaaattttgacctgaaaaccacggtcagtaatcagctcaacggtatcacggcgggcatgaaaaacctgatgagcgaagtcattcagggggccaccggagcggttgccagtctccctgccatgataattcagcgagccaacccagggttgtatgacatgctgaccaacggggtattgcaggccaatgtggcgtttgataaagcccagttcaattgtcagaacatggcgaagagaatgatggattttgcgcagaacaacaaatggagccaatcagcggcgttgcaggagtacaaaaatcaggttaacggcggggatggtgatgctgtgcgtgtcaataatgccggaaccaaagcgaccggcgctggcgggcactcgtggattggcgggcaacgacaaggcgggaaggggcagaatgccattcgtccgacccgtgatttagccagtgccggctttaatatgatgaatcagttgccggtactgagccagtcatcggtcagcaccttcaattgcgagggcagcgcctgccgtaaattcagcacggcgcgggaagcggccgaggcggtggtcagtgtactgggcgatcgggccatccgcacctgcgctcacgcggcagaatgcagcagcgggggtgaacaacaccagccggggacaacggtcgcgggaacggggtttgccccgatgctggaagcccataccaaaacgaacgccgaacacctggtgaaactgatcagcggcacggagaaacccacgcgggtgaatctcaccaaactgaaaaccggcagtctggccgtgacgcagggggtcattcaggcgttgcagcgtgaccccgataaggccgccctgactgcgcgtctggcgggggagctggcgatgagcgagaccattgaaaccgcgttactgatgcgccgaatgctgatcaccggcatgtccgaacccaatgcggcagcacaatcggaagcgctggcagaaggcgaccgccggattgccgcactggacagggaaattaatgccctgaaaaatgaaatggagctgaagcaggcgctttcccgtaattccattctgaccattattgagcgtgatacgcagcgtattcacgctcatccgcaaaaacaggtcgcggacagtcaggatgcccgtttttatcagttggaagcccccaaccgtgaggtcaggtaa

SEQ ID NO: 669 - DNA, 336 bp, Xenorhabdus bovienii
  Coding sequence Name=Xb4151_4152.C417.gene13.dna; Position on contig =12663..12998bp; Strand=+
atggcaaaaaaacgtgcaaggttaaaacgaggaatcggattatcactgattatcgctttggcgatggctgtgacgttagctaccggctgggcagggatgaattatcccgacaccctgtctgccttaaatcgcgggatggcaaggcatcaatcgctttggctgttgtggcggttaagcctttacggcgggctgctctggggcggttggaaaatctggcaaagagtgaaacatcaggcggaatatcgcacaacgctgaggcggatgatggtggtcagcctgttgtttatcctgctgggtgaatacgccctgtcagccagtcagggaagtgtgtcatga

SEQ ID NO: 670 - DNA, 1515 bp, Xenorhabdus bovienii
  Coding sequence Name=Xb4151_4152.C417.gene14.dna; Position on contig =12995..14509bp; Strand=+
atgaccacgaacagttatctggaatatttcctgaccctgctcggttgggtggtgaataatggcctgtggcatattctgattgccacggggttgtttaccctgccgttagtggtcaaagtgattgccatttggctgaaagtgcgggagtgcggggaggaagaaggccccaatggattgcagtcactggcccggattgaaaatacgctctacagtgcgtttttcgtcatggttttctgctgcgtgccgttggtgaatgtcagcttcagcaccctccagtatgataccgcccgggccaaaagctgtggcacctggacacccggtgcaccggagaacagtggttatgcgccggtgatatccagcctgaataatcaaacggcggcagtgccgatttggtgggctgtggtgcatcggttatccaaagggctgacgcaggcggcggtggccgccattccctgtcggccggatttacggcaactgcgttttgacgtgcaacatacccgtatcaagagcccggcattggcggccgagttgcaggattttacccacgattgttatgcgttggcattgtaccagtggcaacaacgcgatccggaacacaccagcgacccgattatcctgaatgatatcggctggctgggcagccgtacatttttagccggcgattaccggacgctgcaatcgcgcacgccccgggctgatttcccatggcaggagagtcgagacaacggccggccgtataccgggcagggcggctatccgagctgtcaggtctggtggtcagccgccaacatcggcctgaaagatcgggtactggcgcaggccgacccggggttgtggctgcgtctgtctgcgacactgaaaatgttgggtaaaaacacgcccgcttatcaggaagcggtgatccgccgtctggtcagcccggtgaacctgacggtatctcaagccggccaggtgtatgccggttatgggggtaatgccgatcccacgttgtgggatggatcgacccggataggggcctctgctggcgcactgttggggggcttactggcatatccaatgttcgatgcggtacgccaggccctgccgatgatgcaggcggtgattttgatggcgttgtatatcttaatcccgttgctgctgttggtggccgcgtatgagtttaagaccgtgtttaccctgacctgtgtgatttttgcgttgaatttcctgaccttctggtgggaactggcgcgctggctggacagccatttgctggacgccctgtacggctcagacacccacagcctgtttaatctggcgggcatgcagaacacctcggatgatttaatcatggggctggtgatggggacgttgtttattgtgctgccgatgatctggctgggggcgctggcctgggccggcgtgcggatgggcgacgtcggcggcctgatgagtcagggcgtgggacaggtcagacaatccgctgggatgtttgggcagatggtgatgcagaagatgatgtcgaaaggaaagtag

SEQ ID NO: 671 - DNA, 423 bp, Xenorhabdus bovienii
  Coding sequence Name=Xb4151_4152.C417.gene15.dna; Position on contig =15080..15502bp; Strand=+
atgcgtgatattgataaaaatcataaaaataagaaagttaaaaaacaatccgatcattttattccttacaaaacgacgtatgatttgcggttaacaaaaagagaacccaatttaatcaacatactgatgcaagttcaggggtatgaatatggtttttttacggtgttaggtgtccgccctttatcacaacgcggtaacccgaaaagcacatccatttatgtcgtgcggtgccgatgtggtaaatacgccgtcagatcactcagggccatcagaaacccggcgaatatgaatgatatgtgtgagcattgtcgtcacctgtacaacctgagacgcagaaaccactttcttactgaagggaaggatgttgatttgtcagaattaaccggcattaccgataaaaagcccctggacattaaagaataa

SEQ ID NO: 672 - DNA, 918 bp, Xenorhabdus bovienii
  Coding sequence Name=Xb4151_4152.C417.gene16.dna; Position on contig =16303..17220bp; Strand=+
atggcgcagaaatcgacacgttcaaaagttgagttgttcaggaaagaatttattgcctgtgcccgaaacgggcacggaagttttgcgacggtggcggatcgtgagcggattgcccggcagtttcttcactttctgaaagaaaggggcattaagctccggcagatggacagccttaaaacaaaatatattgagcactacattgcacagagaaaggctgaccatatcagccaccgaaccctgcaaaatgagatggctgcgttgcgaaccattttagcgcaggccggaaaacacaagctggcggcagccgataatccgcgtctgagcaaccgggtactgggtattgctaatacggatcgcaggggaacaaaaatggcgttaacaccgacgggatttcaggcggcttttcagcaggtcgagcgaaaagatcggggtgtggcagcggtaatgcagctggcgtatgtgttggggctgcgtaccaaagaagcggtggaagccggtaaatccttagccacctggaaaaaagcgctggagaacggtcatacctccgtgcggatagtattcggcaccaaaggcgggcgcccgagacagacggtcatactcgatcgcgtagcgttgcaccacgccattgattatgctgagcgcgaacaggcaggccgcagcggcagattaattgataagcccacgatctatcaggcgatagaccgttaccgttacgtggtcagacgtgccggactggtaggtaagcaagcgccacacagcatgcgatatcattttgcccaacaatctggcgcacattataaagcacagggtttcagtgagcgggaagcgctggcactggtgtcaatggatttggggcacggagatgggcgcgggcgttatatccggcaggtgtattgccagaatattgaggatgaataa

SEQ ID NO: 673 - DNA, 156 bp, Xenorhabdus bovienii
  Coding sequence Name=Xb4151_4152.C417.gene17.dna; Position on contig =17452..17607bp; Strand=-
atgtggtctggattattactaagtgcggcgatggcaaagctggtaccggcatactacgctgacgttattggcccatgtggtgctggcggttttgcggatacaggagaaaaaaacgtcggtggaactgacagtcctgagtgtattggaattgcgtaa

SEQ ID NO: 674 - DNA, 1482 bp, Xenorhabdus bovienii
  Coding sequence Name=Xb4151_4152.C417.gene18.dna; Position on contig =17802..19283bp; Strand=+
ttgattgagaagccacgtgtactaatttgctggataggcaataaagatatagagtccgccgaaaatgatgagattggaccgattctggcgacgctacaagattctgaatttgaccgctgttatcttatctattcttatcctgagcggcgtgttacgccttatcttgcatggcttcgcaaacagactaaccttcctgtcaccgcgcatttcgaagcgctcagttcaccagttcactttggcgaaatttatgaggcggcaaataaacatctacagcatattgttgcctccggctcggagttatgcgttcaactgactcccggtacacctgccatgcaggctgtatgggtactgcttggtaaaacacgttactcagcgactttctaccagtcatcgcctgagaaaggcgtagagaaggtggacattccgttcgaaattgcggccgaatatattccggcggcaaataccattagcgatgaaaagatagtccagctttctgcttatggcgtagcggtgaatactgccttcgacagtattattacccaaagtaaacggatgttaagactgaagtcgcaagctcaaattttagccaccaaacatgtgcctgtacttatttatggcgaaacgggcacaggtaaagagatgttcgcgagggccatttgtaatgcaagtccgcgcactagcgccccatttattgccatcaactgcggtgcgattccccctgagttggtagattctacgctctttggtcactgcaagggagcatttaccggcgcggtatcaaacagcaaaggtgtttttgaacaggccgatggcggcaccctttttcttgatgagtttggcgagttaaaacccgatgtgcaggttcgcttgttacgcgtgttacaggaaggagtcattaccccggttggtgcgagtgaaccagttaaagtgaatgtgcgtcttatcactgcaactcacagcgatttgatgcaagaggttggtaaagggcgtttcagggcagatcttgtttaccgtattgcagtaggtgtactgcatcttccgcctttacgtgaacgggaaggggacatcttactacttgcagataccctcctacagggcatttcggaacaagatcaatcgctacaaaataaacaactttctgttgaagctaaaaactttatcctcaggtgtccatggcgcggcaacgtacgtgaattgcattcaacgctgttgcgcgcagcgatctggagtccggatgcggttatcactgccgatgatattaaggaggctttgtttatgatccctgaggaacaacaaggtacatcgctggttgatattttggaggggatagatttgcaaaaagtcatctcaaaaattgccaacgattatttatatcgtgcacttgaagtcaccggaaataataagactcatgcagcgcagttactggggttaaaaagccaacaaacctttacgaactggctaaaaaaacatcagatagaataa

SEQ ID NO: 675 - DNA, 672 bp, Xenorhabdus bovienii
  Coding sequence Name=Xb4151_4152.C417.gene19.dna; Position on contig =19554..20225bp; Strand=+
atggcagagcttaaaaaatttcagattcaaactgcacgtccgctcccagttattgtgctggcggataccagtggcagtatggcttccgatggaaaaattgaagcccttaatcaggggctgaaagatatgctgctcagtttcaaagacgaaagcagattgcgcgctgaaattcaggttagcgtgattacctttggcaataacaaggctgaagtaaatttaccgctggcgcctgcacatcttctgcaagactttattcctctgagcgcagaaggttcaacgcctcttggcggcgctctgtcgctggccagccagatgatagaggataaaagcgtcattccttcccgagcatacaaaccagttgtggtgctggtttctgatggttatccaaatgatgactgggaaggcccgttctcgtcatttgccagtggtgagcgttcttccaaagctacgcgttttgccatgagcatcggtggggacgcggatgaagatatgctcagtgagtttgcaaatgatcccgaagctcctctgttcagagctgagaatgcgagcgacattcgccggttcttcagggcggtgaccatgagcgtaagcgtgcagagccggtcagcgaatcccacgcaatcaacaccactccagatttctgccgctgacgatcaggattgggaattctga

SEQ ID NO: 676 - DNA, 693 bp, Xenorhabdus bovienii
  Coding sequence Name=Xb4151_4152.C417.gene20.dna; Position on contig =20225..20917bp; Strand=+
atgcgcctgtccgcaggtggtgcttctgtgacaggtccagcgcatcttcagaatggtcttcctaaccaggatgctttgtccattagcggcttacgcggtggctggagtattgctgttgctgacggcttgggtagtcgacctttaagtcatatcggttcacgtaaggccgttcatctaatcaggcatttggcccagcgggggcaaaacttacaacacagcaacattgctcagtggttatgtcgcgactggcttgcgcattttggcgatgagtaccaagcctatgaaacaacctgtctctgggcatgggtagacgcgaaaggtcatggcgtggcggggcaaattggtgatggtttggttttgataaaaagccagggaatttttaacgtgctgtctggtgtccgagctggattcggcaaccagacggcaactcttgctcaggctgccccttccgagtgcagaagccaacggattgagttaacccaatccggcgatggcgtactgatgatgactgacggtatcgccgatgatctggttcctgaatcgctggaatcctttttcgatgtgatttatcaacgccaactccgcagcaataaacgccagatgcgtacatggctgacaaaggaattgcagaactggtcgacgccccagcatggcgatgacaaaagcattgctggtttttttagaatggactga

SEQ ID NO: 677 - DNA, 1416 bp, Xenorhabdus bovienii
  Coding sequence Name=Xb4151_4152.C417.gene21.dna; Position on contig =20923..22338bp; Strand=+
atgacttcgacaacgaaaacaagcaagaaacccgaagtgcaggatacaaaaggttcgttttatgagcttaaaagggaaatgagccgcgggggacagggcattatctaccgcactcagtttccgcaaacactcattaaagggtttaccaataaagatgagctggctcgccagcactggcgaaatcagatcgcatggctaatcaggcaagatttgagtgatttgaaattagcgcgtcccgttgcgctgctggcggagcctcgctgcggttatgtaatggagctaatggatggtctggtgcctttgcagagtcttcttgacagctttctcaacgccggggaagagtcgctggccgactatcttcaggcgggtgggttgcgtcgacgcgtgagaattttgagccagctggcgagaacgcttaatcagcttcattcgcgtggcatgctgtacggcgatctttctcccggtaatatttttgtctcggatgacccgaaacacgctgaaacctggcttatcgattgtgacaatattagcctgttcacgcacagtgggctgacgtttcatacgcctgattatggcgcgcctgaagtcatccggggggaggcgcttttgtccagcctgacggacatctggagctttgcggttatcgcttatcagttgctgacgcataatcatccctttaaaggagaggtgattagcgacggcgagccggaactggaagaggaagcgctgcgcggcgagcatccatggatcaatgacggacaggatgagtcaaatcgctgttatacctgcctgcccatgcagctgattgaacacagtcggctgccagaactgtttagccgttgctttgaacagggaagaattcgcgctagcgacaggccgactatggctgaatggctggcggcattaacagaaatcgatgagcatttgtacacctgcaaacactgcggtggcgatactattctccctgctgatctccccgctgaagatgtcgcgtctcatgacacgctctgcttcttttgtgatgaaccggtggaaagcgagctggtgctgttcgaggagttcctctccgtcgtagaaggcagtgaggatcagctcagcgagcaggttaactggatcccgactgggcgtaaagtatggttgcaagtgggggatcgcaaagaattaaaacgtctgttacctacctttagctacgatcgctggccggaagatcatgttcgtcttgaatataccgaaaagggtctgggcatccatgctttgccgcaggggcagttgcacctgcaacagggcaaaaccattaagcagttagcccgctatcaggggctgaaagcgagtctgcgcggacaaaatgctacggcgtttcagcttcatatcggtgagttgaacgcatcgcacgtgctttggcaattcaagtggtga

SEQ ID NO: 678 - DNA, 3399 bp, Xenorhabdus bovienii
  Coding sequence Name=Xb4151_4152.C417.gene22.dna; Position on contig =22345..25743bp; Strand=+
atgaatattaacgatttcccgatgatgtccgaagatattctggtgctgtctacggatgagagtacggatggctttgaggcggaacaggcgatttttatccggcctgatgagcagaaatggttggccgttcagggcaataagtacattagcattacctgcggtcctgccgatcatgagttattcagtcgccttgtgctgtgcgatcaggttcgctggcggctcaccctccttcagcaaaagggaaaactatgggtgcagtattgtacgccggttgaagtatccgctatgcagcttgaattgggtgttgatgaattcattgctgatgatctgtacggaaaacaggagattgccgataagcgtattgaccttgcctgcgaatggtttgctgaaaattttgtggttagtgggctgaaagagggggactggctcacgattgctcggttcagtaataacagcatagcaggcagctttcagattattggcaaaggctggcgtgctgatgtagagcgcaagagcgacggtgggcttttgataaaacgtgttacgcgccacctgcgtagtgacagcgctttttcgttgctggttggccagttttctttctgtgatacctctgttgcggtagtactcaaaaaaagtgccagccagcaagcattactggatgcggctctcagggacaataccagttacctagagttgtggaatctgtataacgaaaaagagtggcaaaacgagttgagacgtgctgaatccctgcgttcgctgcgctttatcgattgtgtgggggtggatgaggggcaagacaatgcctggcgtttgacgccgaaatcgctcgatgactaccgggagttccaaaaacggttgcgtgaactcgaactgcctgcggatacgcaatatgacctaggcacggttgctccagattgggcagaggaactttcgatggatgagagcagagcggcggccaatattccgcgtggcatgctacgttttgaagctgattatgtcttcttcaaacccgcgtctaaccgccgtgatattcgtccgaaacaacctgacgggtggctgtatctctctttggcgggctaccgtactgcgggtaaacgccgtctagccgcgaaacaaaagatcgattcgggcaaacggatgccgcaattaaaatggctgttagaaggtattcctgtgcctgccgcccggtacagaaccatcccgggattgacgccctacgcaaaagaaattttcaaaggcggcaagccgacagaaatgcaggaacaagcgctggatgcggctctgaatacgcctgatttggcaatcattattgggccgccgggaaccggtaaaacacaggttatcgcggcattacagcgtcgtctggccgaagaagcgcaaaaccagaatatcgcagggcaggtattgatcagtagctttcaacatgatgctgtcgataacgcgctcgagcgcagcgatgtgtttggtctgcctggcgcacgtgtgggcggcaaacacagagcggatgacgatgagtcgttgatcgattcctggctcgaacagcagaccatgcatttgcacggcaaagttcgggatgaacatgccagatacccggagcttgagttcttcaacaggttatccatcaagctggcctttgcccgcttggctggcggcccgaatagccgccgtgctgaggagttcagcgctattttgcaggatctggaagaactggaaaaaatcggctcaattccgttatccatgcttaaaagccagcttgaagattacattgagcaattgcgcaaacaagcgtcggatacaaccgacagtgcaatcgataatcaactgatacagcgaattcgtgcgttacgtgttgacgctgtttcattcaacgacgatggttccgatcgcgcttgggatcttttgcgctggatacagcgttatgacttggattgcgctccagaacgggtgtcgctgttacaggcggcggcagataacctttcattatcgacgtcagacttccatgaactttctatgtggcgggagcacttactggagcaatttttaccggattaccggcctgtggcgctaaaaaatcaggctgatccggcagggttggcgctacttgatgacatcgagcggcatctcgacggtaagttgcgccagcgcaagcaaggtgtggcctgggttctcgagcaattggctgatagcctgacggttgacagacgtgctgcgcaaaacgtggtgaatgagtactcaatggtggtcggtgcgacctgtcagcaggccgccggacaacaaatggcgaatttgaaatccgtcgctgggctggatagtagcggaattgagtttgagaccgtcgtcgttgatgaggcggcgcgcgccaatccgctggatttgtttgtccccatgtcgatggcccggcggcgcatagtgctggtcggtgacgacaagcagctgccgcatatgctggagcccgatatcgaaggacaattgcaggaagaacatcagcttaccgaggtgcaacgggcggcatttcactccagcctgttcgaacgtatgcggttaaaactgctggagctggaaaagagagatcagtggccgcgggtcgttatgctggatactcagtttcgtatgcatcctgtgctgggcaattttatcagtaagcaattttatgaatcagcgggcatgcgagaggtgaaatccggtcgggatgtggcagattttgcctttgatgagaaaatgttaaatgcgcttggggagttggaaccttacttccgagatcgcgtttgtcagtggattgatctgccgcggtctgagggaaaagataggactcacggatccagccgtgtgcgcgagatagaagccacgcgtattgcacaggaagttgaacggctggtaagagcgggaggggaaagcttctctataggcgtcatcacattttacgcggcgcagcgggatttgattatggagaaactcgcccaggtgcgtattgacggggttcccttaatggaaccccgtgatggcagtttcgagcctcatgaagattttcggttagcgcgaaaagtgcggggcgatggctccatcagctatgaagagcggctgcgcgtcggctctgtcgatgcgttccaagggaaggagtttgatgtggtgttactgtcatgcgttcgtacctttgatccatctaagccagccttaggggctcaggatgatgcagccgcgcgggaagcccagttaaatcgccggtttggttttcttcgtttacccaatcgtatgaacgtggccatgagccgccaacgtcaaatgttgatctgtgtgggtgatgctgtgctggtaactaatccggatgcaaaagaagcggttcctgcgctggcggcactctaccaactttgcggaggcgtgtatggcagtgttcgctga

SEQ ID NO: 679 - DNA, 1494 bp, Xenorhabdus bovienii
  Coding sequence Name=Xb4151_4152.C417.gene23.dna; Position on contig =25727..27220bp; Strand=+
atggcagtgttcgctgagaccggtacgtatatggcgttcagttctcatccgtatgggaagaaggagccgcttctgtggccggtgatggtgcatcgcgttttatacccggacgcaaaacgcccacagctcaatattttccagcgagcggtgctggggcttattcgggcccgcgtaacccgtcctgaaaccatggcggagttgactggactccattccagtttaattaacttgatattggtgcaaagcgccagccacgggtggcttgttgataacgcagacgctctcaccgcttcaggagaacgtctgctggatgatgaggacgatgatgcagcttcttttaaatccggttacctgttgcaggatgctgtcactgggcaattttggccgcgtctgattactgagctcaaacagattgaacccgtgaacgcgttagccaagtatcctgaattcatcactgagagaaagaccggaaaaccgctgcgtccctatgtggtggcctccaacaaaggtcgtttagcgcaattggatcctgacgtgcttatgaaggcgtataaaaactatagcaatgattttcgtgccagccgacagctcgatcagttacggttagagccggaaattcgactacagggcgtacagcgtttggatgataatcctcaatccgctcgggtacttatctgggttacgcccgacaagcgtggcgcggatctctggtcggtaaaagacccttttgctttgcgagaaaatgcgccatggctgcaagaggcattgcggcaggtcattgagcgtgacgcgtttttgcttagaaggcttgaaccgctggttgagatccctcaagccgaaaaccaaagtgttaccgagtggcttgcggctgttcagcgaaatattgaatttacattgctcacggaatacccgtgggccgagaagcagcctgatatcaagcgttacatgacggcgctgttgatctaccgagaaaaaattcagcatgctggcgccaacgaacacgaactggaagctgcaataacggagtgccagaaattactggaagtcgtcatgcaatggttgattcgtaccttcccggcaaatgtggggctgttgccaaagtataaacagggaaataccagaaatgcgatcaatcaggttatccttgagaaactgaacattccgtccttcactcaggacgtcattcgcatactctccggacaacatttcgacaaagttgagcgagcctgtcgccagccgacggattcacttaaggcgctcctttttgccgctgcaattggagcctacaacacaccacagcatccgctcaacgtacttgaagatcgggaattgcaactaacaaaaatgctggaactcgccaggttgcgtaatcaaagcggccatggacagagcagctacaccggcaaaaccgcagttaaactcacttcccagagtgtactggagagtattcagtatgccctgagtgttacggaacgatttgaggaatggatgtaa

SEQ ID NO: 680 - DNA, 1587 bp, Xenorhabdus bovienii
  Coding sequence Name=Xb4151_4152.C417.gene24.dna; Position on contig =27220..28806bp; Strand=+
atggctaagaagaatcaccaaaataggaaatacaatgcgcctaaaataccgccgcaaaaaatgacgccgccgcttgccgcggcagaaaaagctaacaccgatgtcgccctgagcgcgtcttttgtttctgcatcagacctcttcgcatcctttggtatgacactggatatcgatatgagcggggaatgcttggaaagtatcaaggcgcgtacccaaaaagaaggtgaagagtcgtttgcccggtggcttatgcaatttttccaggcgtgcgaagcgatgaaaacgctcaaagaaaagctggaagaagaacaaaaggaggttagccaacggttactcagccacgatgaaaagtcgcagagacttgctagccaacagcaacaacttgaagacgaaaagcatgcgttaaaacttgccagagatggggttgagcaggaaaaagtcagtattgtaagcaaacgcgctgaactgacagagaaagagcgcgtaatgaatgaacgggagattaacgcgcagtttggttttgccgaacagaacgcgctgaccatgcgccagcttgaaaaacatcaggctcaacaacttagccagcatcaagagcaacttcagactctgctgagcgaaaagcgccagctggaagaggagcgtcatcgcgcatccagtgaactggacgcgatcaaatatcgttgcactgaagctgaagctgagcgcgtacgtgcgctggacttgcgcgagcaggatattgaacaacgtatcaaagcagtagattgcgagaaggtacgactgaaacggtgggaaaaggagctggatgcggaaaaaaacgatattcagaaacgcgttagcgatgaaattgaacgggaattgggccggcacagcagcgaagtaagccgaatgcagcggaagttgcagaaagcctacgatgattatgacctgctgaaaaatgaacatgcagactttcaggatttgaagcatgccatggggaacacgcctgtcgccgcagtgctggagcggcttgagcgctttcaggcggagaacaacgagctgattcgtaaacagcaaagctcggacatggacgaattattacgtgagaaagacgcactcagcaaaagcaaatataacctcgagaggcaatgctatgcattaagagtggaattagatgaaacgaagcgtgagctgagtggcaaacgtgttgccgccaccgaactgcaaggcatcgcgcttgagaaacgaacccttgagtatcataaaaatgcgctggaattacaaatcaatgaactggcaaacagtatcgagcacctctctaatgcgcaaaaaacacaaactccgttcccggcgatgtctctgatggatagtgacacacagtatcgagcaagaacggagcttgagactgttgacgatctcaaccagttcgccacggagttgcagcaccgtattgcccaagctgaagagcatgtcgaactgttttatccgctggaagagatccaagtattactcggcggcctggcgatgagccagttacatattttccaagggattagcggaacgggtaaaaccagtctcgcgaaggcgtttgcaaaggcgatgggcggttaa

SEQ ID NO: 681 - DNA, 1005 bp, Xenorhabdus bovienii
  Coding sequence Name=Xb4151_4152.C417.gene25.dna; Position on contig =28873..29877bp; Strand=+
atgcaaaacgttacgcttattggtattgatctcggcaaacattctttccacgttcactgtcaggacaaatcaggaaaggccctgctgcgtaaaaaatttacccgcgccagactgatggagtttttagcgggatcgccatcagcgactgttgtaatggaagcctgcgccggtgctcactttatggctcgccggatcgctgcttttggtcacgaagcgaagctgatttctccacaatttgttcgtccttttgtaaagagcaacaagaacgattttgtggatgctgaagccatatgcgaagctgcatctcgtccctccatgcgatttgtgcaaccacgaacagaggcgcaacaagctatgcgcgccctgcatcgggtcagagaatcactggtcagagacagggttaaaaccactaatcagatgcacgcttttttactggaatttggcatcagtatgccgatcggaaccgccgtgataaaaagactttcaaccgtcttggcagagaacgaacttcctccctatctggcacagttgctgatgcgcttacatgcccattatctttatcttgtcgaacagctcaccgagcttgagacggcactggagcaggagctgagacgtgatgaaacaggacagcgtcttcagacaatactgggcgtgggtccgataactgccagcgtcttatcatcgcagctgggcgatggtaagcagtatggctgtagccgggattttgctgcttcaaccggtctggtaccacgccagtacagcacgggtggcaaaaatacgcttttagggataagtaaacgcggagacaaaaatctgcgacggttacttgtccagtgcgccagagtctttatccagagaatcgattatcagtcaggaaggctggctgaatgggtaaaggctcagcttgagcgaaaacactcaaatgttgtggcctgtgcgctggccaacaaattagcccggatagcctgggcaatcacaacacggcaaactgtgttcgaaaggtaa

SEQ ID NO: 682 - DNA, 606 bp, Xenorhabdus bovienii
  Coding sequence Name=Xb4151_4152.C417.gene26.dna; Position on contig =30137..30742bp; Strand=+
gtggggaccatagattttgatgcttctggctcaatgtctatcagtgtggatgtcactccacaagaattacagtatttgttgcaaagaaaagccttcgaatacatcgagcgagaacccagccgtattactctggccaagaagtcggcgaagaagattatcgataaattgccttcagatatgaatatcagtctggtggctgcgttcgattgcaggcatgtttccgcgtcattacctttttcgcctacgcagcggccagtattgaaacgggcgattgatcgtattactccggatggaaaaactccgctggcactggctttggaaaaggctggggctctagtggatggtgtgaatcgcgatgcgataatcttattaatttcagatggtgatgaaacttgtggcggtgatccctgtgctgtcgcccgtgcgttgaaagagaacaaaccccggctacaggttaatgttgtcgatatcatgaatagcggtgcgggaaactgcattgccagtcaaactggtggcaaagtattcacagcgaataatgccaatcaattcaatcaggtaataaatcaagcaatgcaggattatattccggaaaattgcaatgagtaa

SEQ ID NO: 683 - DNA, 1386 bp, Xenorhabdus bovienii
  Coding sequence Name=Xb4151_4152.C417.gene27.dna; Position on contig =30916..32301bp; Strand=+
gtgaaaaaaacttttttacgtggtgataaactcgaaagttatctgccgctgggagaaaatggtcaggctgtgcatctctccgcattacagttgcgagaaaccttgcgcctgcggcagctctctgatgttgctaattcactggcaatcccacaaggcaatgagcagggtgatcggatagattggtatgccggcttttcaggtaacgtcgttccctggtcggccgcaacgtatgatgaacgtcagtcagcattgcggcaactggaagctcatcaggctgctatcgaacagctcagtgcacaaatgatccagcaaaaggcgcatgaaatgcgtctttttggcgctttgctgagtaaaactatccagttccccgatcaggagcacatctatttggtcgatggcaaacccgtggtgactttttggggatttgtcaatgcgaagcagcaggctcgccccaatcctcttgaatgcttaaggacagtacgttctgtgacgccatcggttgcaccaaccgaatctacggttgaaaccgtggttgcaacgccgccgcctgtatccaaacgttctcggcgttggctattgcctcattggttgtggtggcttctgcctctgttattgattttactcgctctgttgttactgcgtggttgcctaccggatgtccatatttgggggatgacaccttccacccattctacaccgccacttcaaggtgaaataatctcgaaagaggggaaacccgtaccagaacgatcagttccagctctatcagtgagtgaatctcatgctttacctcttgtgcaaggaatgagttccgtcaatggcacggcttctgttaatagtactgagtctgttaatggaacttcccctgtttcaccagaactgaatccgattgaaccgatgctcccaactcagccgataccgccagttgcggatggagtatccaatggcacgccgaaaccttccctgcccgagattaatgttcctccagtaaaggtttctccgcctgctgaggcgctcacaatcccagatatcgcagtgcagcagggcaccactgattttttcaatggtagctggcacgcaggtgccggaattcaggatagtcgtactggcaaaccacttagtctgaagtatcagattgcagatggtaaagggcaggttgaaatggcgcgcggtgacggtgttcattgtcaggctcccgttaaggcagtgatgaattcaggtgcgctgcaactggataatattggtgaagcgaagtgtagcgatggttcggtttacacgatgcctgaagtggtctgtcaatcaggcagcgaaggcacagcagagtgtcaaggacgttatgacgaaaaaactttatttcccatgtcgatgaagcgagaggcaaattaa

SEQ ID NO: 684 - DNA, 3021 bp, Xenorhabdus bovienii
  Coding sequence Name=Xb4151_4152.C417.gene28.dna; Position on contig =32306..35326bp; Strand=+
atgctggcaacgattaccgatttcaaagaaaaagtgacattgattcgtgacagtggcattcagtttctggattttgctttcgcgttacccaaaaaaaaagaatacggtgaatttttactgactgaggaagataacccggtcattcgtctggtatataacgaaagagatgagaattttcttgtaccttcagcgtcaggttcgtctgcattcgctgcggactccgattactcgctggtactggagaaatcccttgaaatatacaatgacatatggttaccgctgcccttcttccgttttaactcgtcacggagttttgcacaggggccgactaactggtcgcgagtgaaatttcacgcactggatacaccggatgagcagggaaatacctggcgggtgactttggcttttgataccaaagtgtctccagataggcgaaatacccagtatctggagcctgtcgatgatgatgtgcgttccggtgtgagctttgcactggcagagactcatcatgagatgggcgattttctgttgctgaaatgggtggatgactggctgcgggaaacctataccgaacgtgccaccacattgtggcgtcaatatcatgaagatactgaaaactgtttgaaccggaaggaacatcaagcgcattatctcaatttgattaatgcacttaatgtgttgttgcaggttcctgaaattcagctcaacgatgttaaacttcaggataaccccattaatgtcgatttagtgctcgatattggtaactcacgcagttgtgggatcttaattgaagaacaccgagatggtgatcaaggtctgtcaaatctctatcagcttcaattacgtgacctgagtgaaccgcagtatatttataccgatccttttgacagccgtctggagttcgctcaagccgaattcgggaagcaggatttttctgtcaaaagcggacgcagcgatgcgtttacttggccgacgattggtcgtgtgggtgaagaagcgtttcgtatggcctcacagcgtttgggtacagagggctcaacggggctttccagtccaaaacgctatttgtgggatgacgcaccttactcccctggctggcgtttcagccgcgcctttgtgaaatcggatcgtgaacctcaggcgacggcgccgccgatgacctacatgatcaatgacaaaggcgaggcgctttatgcacttaaaccttctgagcgtatgccggtgtttacgccggaatatagccgcagtaccttgatgaccatgatgttgtctgaagtattggcacaggcattgatgcaaattaacagtccggctcaacgtttgaaaatgcgtcatgccagtacccctcgtcagttaaaaaatatcattctcaccgtgccgccggcgatgccaaaacctgagcgcgcaattttccagaaagcaatgacacaggccatcaggctggtgtggaaagcgctggattgggaagatatggatcagggtgttgatgaaaacggtcgggaagataaaaacgtctcccgcaaacgtaccttgcctgacgtgcatgtgaaatgggatgaagcgacctgtggtcagttagtttatctgtacaatgagacacaaaactattttggcggccggagtgaagagttttttgcagccacagtgcggcctgataataaacgggaagcgggtaatgatcgcacgttgaaaattgcctctattgatattggtggtggcacaaccgatttggtgatcacccgttataccctggatgaagggaacggcagcaatgtgcgtatcgttccgacacagctattccgtgagggatttaaagttgcgggtgatgatattctgttggatgtgatccaactctatttgcagcctgcattcgaagccgcgttgctcaatattggctatcaagatttagatgctgaagcattaatgtcgcgcttattcggcagtgaagcgttggaggcaggcaaacaggtgctacgccagcaattgacactgcaaatattcgcgcctgtggcacttgctattttgcatcgttatgaaaaatttacgccagaggcgggtgagcaagttattagtgcaacgttcaatgatctgctttctcatcaaccgacggataaagtttgtgaatatgttgatgaagaagttaagcgtagtttaccggcgggaatagaaaacccattttccattcttaatgtgccgttaaacatcaatttgatgaaactgcataacgaatttatcgatgcccgtcataaccgcatcaatatttgcggtagtttacgcgggttgtgcgaagttctctggcactacaactgcgacattttgttgttaaccgggcgtccttcccgtctgccgggtattcaggcactgatccgccacttacagcctgtaccgcctgcacgggttctccccttgcatggttacgaaacgggcggttggtatccgttcaataaaaaaggattaattgacgatcctaaatccacggcggcggtgggtgcgatgctttgcctgctggccgagaaatcacgactgagtaacttctatttccgtacggccaattttaagccttattcgactatccgttatttcggcatgctcgacagtaataatctgctgaaagacagcaacgtattttatcgagatattgatctggacacccctggattccagttggataaccagcaatattttgagtctcgtggcgaaatgcggcttggcttccgtcagcttgacaatgaacgctggtctgccacgccactatacactttgaaaattccgggaacgcgcttagcaacagctttatctggtgatgcggtattgcgactgaaactggaggtggaagaagggcgtgggcaagaagctgaaactaacggaagtcctgaaaagttccgtatcagcgagatggatatcgtcgaatctacgcagaacccgcgtccacaggacgtcagtttcaaattgaatactctggtcgggagcggcttgggtgaaactcattattggctcgacagtgggagcattaaaatctga

SEQ ID NO: 685 - DNA, 2682 bp, Xenorhabdus bovienii
  Coding sequence Name=Xb4151_4152.C417.gene29.dna; Position on contig =35326..38007bp; Strand=+
atgaaacattttactcccgaacaattaaaacaagcgtggcttgacgtggcgcaaggggcaggtcaggcgattgaatgggttgaagaggttcgtgggaatgccccgcgtctcaacacagaagcggatcggttgaaactgaagctgcgccgtagccggaataccgcgcagagattggccaaagcggctactcatcccatgaccattggtttttttggtttatctcaagcagggaaatcttatctgatctcctcattggcagccggggagaacggccgtctggaaacccagatggggtcgtatcagcttgattttctcgaacatatcaatcccccgggtggcggaaaagaagccaccggtctggttacacgctttagccgtcacgtgcggccatctaaccctgattggccgattgagctacaactgttcaacgaagcggagattgccaaaatcttcgctaatacgtttattcatgatttcaatcaggagaaaatcgactggaattatgatgaaaaacgcatcaatacgctgcttacttcactgaacgagcgacgtcaggcgtataaagtaccgggggtggcggaagatgatgtggtcgcgctatgggactatctgatccgtcatgcagaaaagagccagagcaaaatggctttgcaatactggccagcggcggtagagctggcaccttggttatcgattgatgatcgtgctcagttatttggtgaattatggggcaatatccatgaattcaccgaggcttatcgccgatttgcacatacgctacaacgtctgggaggtgccagcgttgtcagagcaccacttaatgtgttggtcactgagcagaatggcaggttggtacaaactaacagcattatgaacgtcgatatgctggagcgcctgaataagagcaacgatttgcagattacggtgtgtccggaacgagagaatgggctggccgcaccggtatcagtttctctggcagaactcactgcactgactgtggaattgcatgttccgttactttcctccacgcgagaacggttatttgaggaagtcgatttgctggacttccccggttatcgtggtcgtctgggggtggaatctctgaattatctccagaacacggctgaaagcgacgacagcaatccactggcacagttaatcctgcgtggcaaagtggcctacttatttgagcgttacaccctcaatcaggagatgaatgttctggtggtttgtacgccttcgaatgaacaatccaacgtgaaagatgtgggaggtgtactggatgaatggatacgttatagccagggcgctgatgctgacagccgcgcacgtcgcccggcaggattggtctgggcaatcaccaaactcgatttacgtattactcaggagctgaccaaatcagaagatatgctgcgtgaagtctgggggcagggcgggatgatcaaaatcgccatgaccgaacgtttcggccattttccctggatgcaggaatggcagcccggtcgtgcctttaacaatgcatttctggtgcgtaaaccgtgtcaggccacgccattcatcacaatgaaagagggctgcgaggcggagttcagtcaggaaactgcttccaagctgaccttgatgaaaaaaactttcctcgaagatgctgcaatccaacgccatattgcctcacctgagcaagcctgggatgccatgctgcaattagatgatggtggtatgcgccggttagcggattatttaggcatcgtcgcccagcgtgaaatgaagttagagcgcattactgaacagttaaatgaaacgcgccatgaactggtgaaaggaaatttacacgcttggtatcagcctgatggcgcagaagaagtggagaaaaaaaggcttatctccgaagatatcctgaaggcattacagaaccgtgccggaaggcatggcgaactgctggcgggtttagttcctcaacggaaagcactgcaagagctttatatgcaggaagctgaacttgatttatccatagaaggtaaagatgaaaacgaatccatcgctgccttcgggattggcagtgattttgatctcttcagtgatacgccggatgaaaccgtctcggctcacagccatgaacaggaatttgctcatagagtgatcaaactgtggatcaattacttgcgcactgtacctgaacaaaccagtatgacggattttatcgggctttcccgttctattgtcgaaatgttggtggatgaattaatcaccgcgatccagcggatggacgtcgaaggtgagctgatggcggtgctggcgaatactgagcaggcgggtgtacggcgggaaaaaatgatggagcgtcaggtatcccgcgtgatgcacatcatgaatgatttcattacgtggttgggctatcagaatatactgagtgagaaacgcccggcgagccgcattaacaaagggcaacctatttttgcccgtccggacaaaaaagatcctgccttgtggaaaggtgacgagcgcctttatcggctgacaaacgaacaactgaactacagtgccctatttatctatgactggttgttcggcttcggagaaataatcaaagaaaacgcggggcattctgcgggacgcgaaattaccgccgttcagaatgaacggttgggcaccattattcatcgtattcaactgtcgtcggagtaa

SEQ ID NO: 686 - DNA, 1002 bp, Xenorhabdus bovienii
  Coding sequence Name=Xb4151_4152.C417.gene30.dna; Position on contig =38014..39015bp; Strand=+
gtgattaaaccagagctgaggccttatgaaccggttgaacccggatatgctgtgttgcgcattgaggattggcagggagctactgaaggcgtcagggtatccatccagcgtaatcaggatcgctgttttctgaatggtcaggggcagtgggttaacaatgaagagtggctgatcttgcctgagttgcaggaagtcgatggtgcggtagaagcccgtgttggccctgaattggttgatgcgctgctggcggaacgtcaggtggcgtatcgcgttacggtaatagacgatatacagcgtgaggttggcgggctgaaaattgccaatggggttttaagttccttagccaaaggggagcataccccttctgacaacgtgagtgaacatgtgcctccggctcaggaaccgccagtctcaatgccgacggaaaccgcctctgttgaatcagtcgttgaacttactgtatcaaaatcccatgagctgccggagcctcagccaatacctgtcaatgaacggattgacgcagcagcatctgcatcagccaaaaaatcgaacaaaggaatgctgattgttctgactttgctggttgttgccggtgtactttggtggttgctgaaaccgcaggaaaagccggagcctgtcatatccagtgcctcagcaactgctccttgtgcgatggaaaatatgaccaaaggcaacgggctggagtttgttaaaagttgtctgcgcagccagccttccagcctgcaagtacaggaaattatcagtcaggcgaaaaatgcgggacagtgtgatatcgcacagcggctttatgcttataagtcgcagtcgggtgataagcaaatcgcgctgcgttatgcccaagaatacgatccgaaaacggcgacaaagaagggttgttttgttgcagatgcgcaaacggctatttattggtacgaaatcctgattaatcaggatccgcagaacagtgaagccaaagcccgtttagcggcactgaaaaaatag

SEQ ID NO: 687 - DNA, 1992 bp, Xenorhabdus bovienii
  Coding sequence Name=Xb4151_4152.C417.gene31.dna; Position on contig =39025..41016bp; Strand=+
atgaaacaccttaactggctgaaggcggttttttccgccttggtgttgatggcatcggcaggagcattggcagcacagaaaccgcttttacaggaaggaaagcaaacactctatcagcgcgtactcacctatccaggctgtgagctgtcggcgaaggtcggtgaaaaagggaagatacaacctgctttcagccgtttttacgtctaccagcgcgaaaaacagggtagcgaagaatggctatgggttggtcctgatagctatggaaattcccgtggctggatgaaagccaactgtagcgtagattggaaaatgcagctcactttggcttttaccaacccttcaggtcgtaacccgatgttgttcttccgtgataaaacggatgtggaaaagatcctgaacacggcgaaaccggcaacacaattacagccgttactgaatgatctgaaagcgggcaaatccgttccttctgtgctggcgcgtgaaccggattatatgattgatcagcagaaaaacttttatctgctgccgatgctgggttccgatgatatttttactgacacgggctatcaggttcgggtacttaatgtcgcttcggtgagcgaagccggcaaaacagccagtgtattatcaggtaaaaacgccagtacctctcccgataaagaaaaaaacatgatgaaaggcttctcggcatcggttgtttttgtgattgattccactatctcaatggggccttacattgatcgcactaagcaggcgattgaaaaaatctatcagcgcattgaacaagaaaacttacttggtcaggtgaagtttggtctggtcgcttatcgttcaaacgttactgctgtccctgatctggaatatgacagcaaaatgtatgttgatcccaatacggtcaaagatggtaaagattttctggctaaagtgcgcgaccttaaacaagccaccgtttccagcagtaaagtgaatgaagatgcttatgccggagtcatgacagcgctggataaagtggactggacaaaattcggtgcccgttacgtgattctggtgacggatgcgggagcgctggaaggggatgataaattatcttcgactcagttggacgccactcaggtgcgtttggaagcaacctatcgcggcgtggcactgtatgcgctccatttgaaaacaccttcaggacataaaaaccacgcttctgcggagaatcagtaccgtgatttgacgctcaatgctttcttgcacaagccgctttattatccgattaactccggtgacgtgaacagttttggcacgatagttgataaccttgccaatgccattaccagccagattaaaacagcatggcggggtgaagagaccgtaggcagcgcgctgggtgccaacgaatcctatatgggtaaaaaaacggagttatccaaagagcctctattacatgatgctgcgttgttgggacacgccatgcgattagcgtatctgggagacaaacagggaactcaagcgccgcctgtatttaaatcttggatcagtgatcgcgatcttgtgcatcaaaatattccggcgacagaggttaaggtgctgctcaccaagagtgagttaagcgatctgagcgaagtcatgaagaaggttgttaatgcagcgaatgaaggtttgatttcgccggatgatatgtttgccagcctgcgttcattagccgccacgatgggaaatgatcctaaacaggcaaaaaataaacaggcaaccaaactgggtgaaatgggattactgggtgaatacatcgaaggtttaccttatctcagtgaagtgctgagtctggatgaagatacgtggaaaagttgggatggtctggaacaagagcgctttatccgccgtttgaatactaagctgaattattaccagcgctataacgaagatgtagatcgttggatttccttggcgccagacagtgatccgcgggataacgtctaccccgttccgttagaaaatcttccgtaa

SEQ ID NO: 688 - DNA, 678 bp, Xenorhabdus bovienii
  Coding sequence Name=Xb4151_4152.C417.gene32.dna; Position on contig =41034..41711bp; Strand=+
atgcagatacaacgcgggcaggcagatcaaggttttaccgtcagcctgccccggttgtcgctgaatgcaggagaaatcgctgcgttaacagggccgagtggctgcggcaaaagcactttgctggagatgatcggcggaatactccggcctgacagtttggaatgttaccagttgggaataccgccgcgtgatattactgcctctctgctggagggtgaggaaaatcagcttgcccaagtgcgtgccaaggatctcggttttgtgttgcagcatggcgggctgcttccttggctctcagtcgaacaaaatatccagttgccccgccaaatagccgggctggtggcgcgttctgagtggctggatacggcgattacccgtttaagtattgccggactgatgaagaaaatgccttctcaactttcgattggggagcgtcagcgcgtggcctttgcccgtgcgattgctcatcagccgcaactgttactggcggatgaaccgactgcggcactcgatcctcacaacgccgaaacgcttttcagcctgatagtggaaatggtgaaagcactcaatttagttgccattattgtgagtcacgactggcagcgggttacggattttggccttaaacgctacgccgctacagtggatggaaaacaaagtgtctttacaacctgttaa

SEQ ID NO: 689 - DNA, 1182 bp, Xenorhabdus bovienii
  Coding sequence Name=Xb4151_4152.C417.gene33.dna; Position on contig =41749..42930bp; Strand=+
atggcgctggctgatttaattcacgatcgcaaagttgcgctttgtattattttttcgctgattgccgtgatcacgcctctgttactactgttcgggctgaaaaatggcatagtgagccagcttcgtcacaccttgctggatgatccacgcacacgggaagttcgtatgctgggtaatggtaactataaccacacatggttgatgcagcttgcggctcgtcctgatgtggattttgtcattccgctgactcgttccctgaatacgcaggccgatctggtcagagatacccagcgttttgtcagcaatgctgaaattattccgactgctttacatgatccgctgttggtgaatgccaaagagccacaaaatgaacagcaggttgtgctcagtgccagtgccgcagagcgtttacagataaaaacaggggatagcctgcggttagtaattgcccgtaaacgggatggtataaacgaacacgtacaacatacgctgacggtcattgatgtgattgatggagcaaaattcggccggccagctgctttcgtcacgctgctccttctggtggctatggaagattaccgtgatggttatcaagttaccttattcaaggtacatgatggtacgccaacccgtgaacgcaccacttttgccaaagcgcggctatacgcaaatagcattgatagcgtggcggaattggcagagtggttacaacagcaacacatcgaaacgataacacagcaggcggaaattgaatctgtacgtgctattgatcatgttctcggtctgatttttactgttatcgcctggatatcggccactggctgtattgcttcattggtaggggcttttatggcaaatatcgatcgcaaaagaaaagatatggcggtactcaggttattgggtttccgtcgtcaggctgtggtgctgtttgttttaattcaggcgttgcttcttactggcagtgcctggggagtgggtttactgctctattttgtcgccagtcagttatttaataacgtgctgggcgcttcattacctgaaacggcgtttgtgtgtcatttggaaccctggcacctgctgatggccttattaagtgttctggtagtcgcactgggtgttgctgcggtgggagccttacgcgcgttgaaaattgaacctgcggagagtttacgtgagatttaa

SEQ ID NO: 690 - DNA, 1551 bp, Xenorhabdus bovienii
  Coding sequence Name=Xb4151_4152.C417.gene34.dna; Position on contig =42920..44470bp; Strand=+
gtgagatttaatcatggtttgaatatagcattggcagggctttttctggcaatactgccgttttctgccagtgccgtctgggaagaaaaatactacaatcccaagccactacccgatgatgtaatattgccgatgccctgtgagggcgcgatggcgtttcgtaaagtttcgattccccttagtcagccgttgcaggattacagtattacccttggcggtggggcaaatgacgaatggggttatttagaacaggcacgtgcggaacatattgcgggtagttttgccgaaggtaaatccggcaaggggcgttatttcctgatggcgaagtacgagctgacagatttgcaatatcaggcactgacaggccagtgtcctacaccgaatatgaaactgcgtttgtccaaagtgaacataggttgggttgatgcgatgaattttgctaatcaatacaacctttggttgctgaaaaaccagcctaaagcgctgccggttgaagatggcaaaccgggtttcctgcgcctgccaaccgaaacagaatgggaatttgctgcccgtggtggtttggctgtttccacggcggaatttcgcgatcaacgtttcccgatgccggaagggataaccagctatgcgtggttttctggcactcaatcctccaatggtaaacttcagcttgcgggattgcttaaacccaatccgctgggtttgcatgatatgttgggtaatgcttctgaaatgatgtttgagccttttcacttaaataaattggatcgccggcatggtaaagcggggggatatatcgtcagaggcggaaatttcctgacgccgcaaagtgatatacgtagctcactgcgcggagaagaaccctattacaccgggcagagtgataataagaataaaaccctcggatttcgtctggtgctggtttcgccgacattaacttcgcgcgatcgtatcaaagaaatcgccgaggagtggaaagcattaggcacagacaatccgcaagttaaagagaaaaaatcacctgattccattgataacttaggcagcatttcagctcaagtaaaggatacggcgttaaagaaacagttggaacagttgcgtgccgatctacgggcgaatgcacaattgcgtgacgaacaacgcgatcaggcgattcgcacttccctgcaacttggggcatttttgtgtacaaaattaaaggatgatggtgaattttacgatcggttgaacgggttgtatgaaaaaacctgtaaggcgggcagtgagctggatgcgaattgttcccgtcgacaatcacagttagatcagcataaaaaagtgctcaattttattgtcaattattatgctgacaccttggtggatatgggcgttacctataacgcggagcttatttccccacaaattcgtgttgttcagcaacagatgtccgcccgaggaaaaacgaatctgaatggttatctcaatacttactggaagaatcttcaggagtactggaagaacggaagagttgcacgggatagttggctggagtcatgtaagaagaataattaa

SEQ ID NO: 691 - DNA, 708 bp, Xenorhabdus bovienii
  Coding sequence Name=Xb4151_4152.C417.gene35.dna; Position on contig =44507..45214bp; Strand=+
atggtactgcaatccatgcgttctatgatttctctctgcatgatttttctactggtcgcctgccaaacgccgcaaggcccttccgcgcagacgggaaaagtcgattcccgtctgactcagagtcaggacgttgagttttttaataaatcaggctggcaggcttgtgcggcgggcgcggcggcaggggcacttgcctgtctgctcatcaatggcgaccatcaagcgatatgtattgcggccgccgctattgtgggctgtggcgtaggggtaggtgccaacgcctatctggataaccagcgcacaaaatatgccagcaaagaacaactactggccgcctcaattaatgatgttaaagcagaaaatcaacgtattaaaaacgtgactgctacagtcaaagaggtgattaagacagataaactcacactggcacagattaataaggacatagcggcgaaggtcgtgaaaaaagatcaggtgcaaaaacaactgaagggtcttgatgccaatattgtttatttgcgcaacaccattaaagaaatgaaggaacatgaaaatcagtggcagaatgtttctactcagatcgcgaaagacggaactaaaaccaaggatctgaataaccaaattgtccaaatgcgcaaaaatatcggctcgctgcaacaagagctggatagtctgtatgaacaacgtaccgcgattaaagtgagctga

SEQ ID NO: 692 - DNA, 483 bp, Xenorhabdus bovienii
  Coding sequence Name=Xb4151_4152.C417.gene36.dna; Position on contig =45227..45709bp; Strand=+
atgcgtatattgatgatgttagtaattagcatggcactgaccgggtgtgtcactaatgcacaagagtgtgatcccacggcaggggatatgagtattattacgaaatttaattgtaattactctgggacttgggatcagagagtcgttgataaagaaaaagtgctacagcatgaacagacactgaataaagaattcaaagcggtttatgacgctatcgagcgcgagaaaaaagcaggtcagacgaatctggaaagtagaaaacgctctcaggtcgcattgcaaaagtcgttgaatcgcctgtttagtcaattgaaaactaaagccgcaggcaaagtgaaaatggaaaaacagatcgctgaactggaaaaacgtatgcgtgaagcgcagcagaagccatcgcaatctgaaatgcaaaaacaactggaattacaacagttgcagaaccagcttaatgaacttcaggacagcctgatgataccataa

SEQ ID NO: 693 - DNA, 282 bp, Xenorhabdus bovienii
  Coding sequence Name=Xb4151_4152.C417.gene37.dna; Position on contig =46084..46365bp; Strand=+
atgaaaaaaattatattaccactactattatctatgtttttggttgggtgtggtggcgaaccaacatttgatgcttcgaatgatgaagcgatgaaagcctcggctgaaaaaatggcgaaaaatatgtcacctgaagaaatggaaaaatttgaaaaagcgtttttgaaactctccatgcagtctgttttggttgccaaagatggagatgatgcgttaacgcttatgaaggaaaaacttaacggcaaaacggcaaagcaaattattgaaatggcagagaagtaa

SEQ ID NO: 694 - DNA, 291 bp, Xenorhabdus bovienii
  Coding sequence Name=Xb4151_4152.C417.gene38.dna; Position on contig =46658..46948bp; Strand=-
atgtatcaaagcggatattttgtcacagcagaaattaaagccagagataatgttaatctcaatatcgttgtcaaagcacttaaatcactacaagaaaaaacattattggaacccggatgtgaaatattttccatacagcaatccaatgaaaatccagccatatttgttatgtgggagaaattcattgaccgtgatgcattaaaaaaacactatgaatatgaacatactaagtattatttttcattaaacttcactgatgtcgtacaaatttttaccgcagacaccatttga

SEQ ID NO: 695 - DNA, 561 bp, Xenorhabdus bovienii
  Coding sequence Name=Xb4151_4152.C417.gene39.dna; Position on contig =47105..47665bp; Strand=-
ttgttaccattagaaaattttagttggtcattaccatcaaatacagatcatcttcctaattcctttattgaaatagaaaaatccttcttacgccccgctgggtttcaattcagtgccattccctaccaagaaaaagagagccatgaatacagtgctatacgctttggaattaatggtaaaacgatagttttccgccaagcaaaaacaacaccgaataaaatggggcaatttgtcacactatggaaacgacctactcctgactcagaaattatgccctttgagcaaagggataatatcgatttctgcatgattgcaacacactctggtaaccaaaaaggtatttttttgttcaacactcatattctgattaaaaaaggcattttttccactcaggataaagcagggaaaagagccatacgaatttacccatcttgggtatcccctatttcaaaacaagcgattcaaacgcaaaaatggcaatcttcatattttatcaatctggataaccaaataacagctttcgaacaattccataaactattttcttatcgttattattaa

SEQ ID NO: 696 - DNA, 186 bp, Xenorhabdus bovienii
  Coding sequence Name=Xb4151_4152.C417.gene40.dna; Position on contig =48025..48210bp; Strand=+
atgaaacgaaaatcaccccaaaaatttaccgataactttaaaagagaagcggtcaatctggttgttgaacagagctatacagtcccacaggcagctgaaaccttaggtattccaacaaaactcctgtatacgtggcggaaacattatgttgagcaatctaaacccagtgctttaaccccccgatga

SEQ ID NO: 697 - DNA, 276 bp, Xenorhabdus bovienii; identical to SEQ ID NO: 154
  Coding sequence Name=Xb4151_4152.C417.gene41.dna; Position on contig =48286..48561bp; Strand=+

SEQ ID NO: 698 - DNA, 1560 bp, Xenorhabdus bovienii
  Coding sequence Name=Xb4151_4152.C418.gene1.dna; Position on contig =808..2367bp; Strand=+
ttgatcccggacgtatcaaaagcattgtcatggctagaggcaaatcctactgtattgaacggtatttgtcgcggtattgagcgtgaaacattgcgtgttactccagacggccatttagctatgacagggcatccagaaccacttggtgcttctttaacgcataaatggattacaactgattttgctgaatctctattggagtttattacccccgttgatagtgacatagaaagaacggtcgctttccttaaagatttacatcgttacactgcccagaacttgggcaatgaaaaaatgtggcctttgagtatgccatgctttattgacaaagaggaaaacatcactctggcacaatatggcacgtccaatgtggggcggtttaagaccttataccgtgagggattgaaaagccgttacggtgcattgatgcagaccatttctggcgtacattataacttctcgttgccaataagtttctggcaggcatggttaggcatcaaagatgcagaaagtgggaaagaacagatttcagacggatattttcgtctgatccgtaattattatcgttttggatgggtgatcccttatttatttggtgcatcacccgcgatttgttcttcgttcttacgtgggcgagagacaacactcccttttgaggaaactgaaaaagggacttgttacctgccttatgcaacctcgttgagaatgagtgacttggggtataccaacaaatcacaaagtgatctgaatattacctttaataatctccattcgtatgtagaaggtcttaaaaaagccattcataaaccatctatagagtttgcggctttgggaagcaaaaaagatggtaaacacctgcagcttaacactaatgttcttcaaattgagaatgaactgtatgcaccgattcgtcccaaacgagtcactcaagagagcgaatcgccctctgatgctttgctgcgtggcggtgtagagtatatcgaagttcgttctctggatattaatcctttcacggcgattggcgtcaatgaaattcagatccgctttcttgatctatttttgatatggtgtgctttggctgatgctcctgaaatgagtagcaaggaacttgactgttgtcgtcaaaactggaataaggtcattttggaagggcgtaaaccagggttgaatattggcattggttatggtatagagcagcagccacttaaaacagttggtcaagaattattcaaggatttagagcgtgtagctgaagtcttggatacctgttctggaacacaatatcaatcagcttgcaaagagttggttggtatgtttgaaaatccatcattgacattttcagcccgtgtactgggcaatatgaaagctcaagggattgttggttttggattggaattggcaaccaagtatcatcgtgaattgcttgaagaaccgtattcaatcctgagtgaagaatgtttttctgttgagcgtcatgcttcgatagaacggcaaaagagcttagagcagcaagacagcatggattttgaagattacctaaaactacatgctgggtattaa

SEQ ID NO: 699 - DNA, 516 bp, Xenorhabdus bovienii
  Coding sequence Name=Xb4151_4152.C418.gene2.dna; Position on contig =2531..3046bp; Strand=+
atgcctttattagatagttttacagttgaccatactcgtatggaggcacctgctgttagagttgccaaaacgatgaaaacacctcatggtgataccatcacagtatttgatttacgtttttgtgttccgaacaaagaagtgatgccagaaaaagggattcataccctggaacatttgtttgcgggctttatgcgtaaccatttgaatggtgatggtgttgaaattatcgatatctctccaatgggatgccgcactggtttttatatgagcttgattggtgaaccagctgaactgagggtagccgagtcttggaaagcagctatggctgatgtactgaaggttaaagatcagaatcagatcccagaattgaacatttatcaatgtggtacttatgagatgcattctttgcaagaagcgcaggacatagctcgccatattcttgatgcagatgttcgagtcaacctcaatgatgagctagcgctacctgaagataaattagttgaacttcaagtgtag

SEQ ID NO: 700 - DNA, 273 bp, Xenorhabdus bovienii
  Coding sequence Name=Xb4151_4152.C418.gene3.dna; Position on contig =3657..3929bp; Strand=+
atgaaattaaagtaccttagttcaggaataattataactgctttaatattaactccagcaatatcagcggcaaacgaagttgaatctagatataaacaacctataaaaacattatcaatacagcaagaaaatacaacattaccttatatactcaccactggtgacgctaatggaagtaactgtggtaatggcaataactcttctgggaaaggagggaatggtggcaaaaatggaaatggaggtggtaaaggtggtggtaagggtaaagcataa

SEQ ID NO: 701 - DNA, 408 bp, Xenorhabdus bovienii
  Coding sequence Name=Xb4151_4152.C418.gene4.dna; Position on contig =4020..4427bp; Strand=+
atgaaactaagcacaattatcataatgacatctatattaagttttcctttttcatcattacatgctgaatccgaaaacaaactcagtgtaaaaacatccgactgcaataaattaaatggagaacccggccaaaatggtaaaaacggaatacctaacagtaattgcaaggatggaggcaaaggtggagacgggaaaaattcgggacaatcaggtggtaatggcggtaacggtggtaacggtgcacctgatggcggtaacggtggcgatggaggtgatggtgcgtcaggtggcagtgatagcaatggtgatgctaatggaggcaatggaggcgatggaggcgatgctgggaaaggtagaaaatcgggttcaaacggcgggtatgatggacaaaggggtaagaatggataa

SEQ ID NO: 702 - DNA, 408 bp, Xenorhabdus bovienii
  Coding sequence Name=Xb4151_4152.C418.gene5.dna; Position on contig =4599..5006bp; Strand=+
atgaataagaaatcaatagcccaatggttcatttctgatgaactctggcagaaaattgaacccttactccctccacataaaacccatcaccctttgggctgccatcgccgccgtgtcgataatcgggccgctatgaatgctatcttttttgtgttacgaaccggatgccagtggaatgccctcaatgccacagggatttgttcttcaagcagtgctcaccgccgttttcaggaatgggtggcgggaggcgtctttgagcgactctggcaaaatggcttactcgccagtgaaaaaataggggctatcgactggggcaaattggcactggatggctgtttgactaaagcgcccctggccggctcaaaaaaacaggccgcaacccaacagaccggggaaaacaaggcgtaa

SEQ ID NO: 703 - DNA, 402 bp, Xenorhabdus bovienii
  Coding sequence Name=Xb4151_4152.C418.gene6.dna; Position on contig =5015..5416bp; Strand=+
ttgctcacggatggacagggcttgccattagcgattgccgttgcgcccgctaatattcatgatatcagacttgttatagccaccctggacggtttacagacaggacgccggggttatggaaccaaactccatctggataaagcttatgaggcggaatggctggaaaaagaattaaaaacccgtggatacgtcccctgcatacaatcaagaaaagaagaacaagatgcgctggccgaacaatatgattttaaagtgaaccgttgggttgttgaaaggacacacagttggcttaatcgttttcgtcgtattctggttcgttgggaaaaacgggttgaaaattatgaagccatgcttcatttggcttgtagtttaattgtctggaatataatcctattgggatag

SEQ ID NO: 704 - DNA, 759 bp, Xenorhabdus bovienii
  Coding sequence Name=Xb4151_4152.C418.gene7.dna; Position on contig =5527..6285bp; Strand=+
atgatgcgatttgaaaataaagttgtcgtgattaccggtgcgggaagtggtatcggtgaagccaccgcgaagcgtttttctcaggaaggcgctattgttgttttggtgggacgcaatgttgataaacttaatcgtgtgtacagtgagctgtcatccagttatgcacgggtcattcaggcggacgtgtcggatcaggattccgtcaagatgatgattgatgagaccatcgaacatttcggcaagatagatattctcgtcaataatgccggattgtatattcccagtacgatattggatacttcgctggatgatggcaaaaaagtgttggcggccaaccttgatggtgttatttattgcagccattttgccttgcctcacttactcaaaagcaaaggatgtattgtcaataatgcctctgtatcggggataagggctgattggggcaatgcttattactgtacggcaaaaggggcggtggtcaatctgacccgtgccatggcattggatcatggctcacagggaattagggttaacgcggtgtgcccaagcctgatcatcacaccaatgaccgagtatatgtccgatgacgttctgcaaaaattcgattctcgcatctcaatgaaaagagcgggaactccggctgaagttgcatcagccattgcatttttagccagcgaagatgccagctttattaatggtgttaacctgccaatcgatggtggtgttacagcatcaaatggtcagcccaattttagttaa

SEQ ID NO: 705 - DNA, 783 bp, Xenorhabdus bovienii
  Coding sequence Name=Xb4151_4152.C418.gene8.dna; Position on contig =6313..7095bp; Strand=-
atgatcccgtttgatagcgaaatgctctctcgtcttgtcagtgattttttctggccactggtacgccttttggcgctattcagcacagcgcccattttcagtgaaaaacaaacgccgataaaagtcagaatgagtttggcgctggcgatcaccttcttgttggttcctaacataccctctccgcaaattccggtattttccgttgcgggggtttgggtcatgatacaacaggtgttaattggtgttgccttgggattaaccatgcagattgcttttgcagcaatacgtcatgccggagaaatactcggcttacagatgggactttcattcgccacattttttgatcctaccggtggcccgaatatgccgattttggcgcgtattctgaatttgctgatgatgttgatgtttctggctttggatgggcatttatggttactgagcattcttgccggtacgtttgattcgattcccattcaaccaatgcaactgaatcccaaaggttttctgctgttagcccaaagcgcccatttaatctttatcaatggcatgatgctggcaatgccgctgattaccctgctgttggttctgaacttcgctttggggatgctcaaccgcatgacgccacaactttccgtgttcgtcatcggctttccgctgacgctcactgtggggatctttacactttctctgttgttcccgatgctggcgccctttactgaacggctaatggccgaaatattcgatcggctggcagtgattatcggggaactggtgttataa

SEQ ID NO: 706 - DNA, 270 bp, Xenorhabdus bovienii
  Coding sequence Name=Xb4151_4152.C418.gene9.dna; Position on contig =7098..7367bp; Strand=-
atgactccagaatcggtaatggctctcggcatcgaagcaatgaaagtggcgctggcgctggccgccccgctgcttctgtctgccctgatatgtggtttggtgatcagcctgttgcaggcagcaactcagataaacgaaatgaccttatcgtttattcctaaaattctggctgtttttgtcactattgttatcgctggtccgtggatgctgaacttactgctagattacatgcgcgtgttatttagcagcattccaaccattattggttaa

SEQ ID NO: 707 - DNA, 789 bp, Xenorhabdus bovienii
  Coding sequence Name=Xb4151_4152.C418.gene10.dna; Position on contig =7446..8234bp; Strand=-
atgaccggcactccaatgactggcaagaaatttgtttctctcctccggcctgtgcatttagcaaccctgctgatggcgcttttgttgccgctattccccatgaatgccgcggccgcattgcctggcatcatcagccagccgatggcaaatggtggacaaagctggtcactgccggtgcaaactctggttttcatcacggcactgggttttattccagccgctttgctgatgatgaccagctttacccgcatcattatcgtgcttggtttactgcgtaacgcactggggacaccttctgccccacccaatcaaatcatgattggcttggcgctgttcatgacttttttcattatgtcacccgtattcgataaggtttatcaagatgcttacctgcctttcagtgaggacaaaataagtctggaagctgcactggataaaggtgcccagcctctgcgtcagttcatgttgcgccagacacgccaaaccgatctggcactgtttgcccgtcttgcggatcaggatgcttttgaaacagcggattccgtccccatccgggttctggttccggcatttattaccagtgaattgaaaaccgccttccagattggttttacgctcttcattcctttcctgatcatcgatctggtcgttgccagtgttttgatggccttggggatgatgatggttccacctgccaccatatcgctgcccttcaaactcatgttgtttgtcttggtggatggctggcaattgctgcttggctcattggcacaaagcttttatgtctag

SEQ ID NO: 708 - DNA, 498 bp, Xenorhabdus bovienii
  Coding sequence Name=Xb4151_4152.C418.gene11.dna; Position on contig =8245..8742bp; Strand=-
atgatggcgaaccagccttccctttatgcttcttttcaacatggtgcagcatctgatgctgcaccggttaacgcaaaagctaataccctatctgcaaacacggtgaaacccgcagccagtccagaacccctccccgccagtcagacactgatgcaggtcagcagtgcgctagggggtatcctgctgctgatttttgtcatgacatggctgattcgccgtctggggcttgctcctgccaagaacaaaaatcaccggttgctcaatgtgaaagcgagttgctctcttgggccaaaagaacgggtcgttgtgctggagatcgaagacagttggctcgtattaggcgtgacatcccaacagattaatgtcttgcatcagatgcctgtaccgtctgataacgcggaaaaggaaactgcactcaaaacattacccttcagccaaatgttaaaaaatacgctccagcgaaaaagcaaaaacgacaaggatgacgatgaaaaatag

SEQ ID NO: 709 - DNA, 408 bp, Xenorhabdus bovienii
  Coding sequence Name=Xb4151_4152.C418.gene12.dna; Position on contig =8745..9152bp; Strand=-
atgagtgatgctaaacaacccgcagaagccagactgactgaagatatgtgggcagaagcactggaacaacaggccgcacagcaaacctctgacagcggcgcgtcaatatttgagaaccttgagccgcaggatgcactcgctcagctttctgatattgacctgatcatggatattcccgttaagctttctgttgagctgggacgtactaaaatgactatcaaacaactcctgagactatcccaaggctcagtggttcctcttgatggtcttgccggtgagccactggatattctgatcaatggctatttgattgcacaaggggaagtggttgtcgtatccgataaatacggtatccgtatcacggatatcatcacgccttctgaacgcatgcgtcgtttgagtcgttga

SEQ ID NO: 710 - DNA, 1008 bp, Xenorhabdus bovienii
  Coding sequence Name=Xb4151_4152.C418.gene13.dna; Position on contig =9145..10152bp; Strand=-
atgagtgacaatattctttcacaggcagagattgatgctctgctcaatggtgacagtgccactgctgatgacatagaacccactgcgtcaggggagagtgagattcgaccttacgatcccaatacgcaacgtcgtgttgtacgcgaacgtttgcagtcactggaaatcatcaatgaacgttttgcccgtcaattcagaatggggctgtttaatatgctgcgtcgcagtccagatattacggtcggcgccattaaaatccagccctatcacgaattcgcccgcaatctggccgtgccaaccaacctcaatctggttcatctgaaacccttaaggggaaccgcattattcgcttttgaacccagtctggtttatatcgccgttgataacctgtttggcggtgatggccgttttccgacgaaagtcgaaggccgtgaattcacctataccgaacagagagtcatcaaccggatgctgaaactggcactggatgcctaccgtgacgcatgggattccatctttaaaattgaagtggaatacgtccgttccgaaatgcaggtgaaattcaccaatatcaccacctcaccgaacgatatcgtggttacgacgccgtttcaggtggaaattggcgcactgtgcggagaattcaacatttgtattcctttcgccatgattgaaccgctgcgcgaacggctgaccaatcctcctgtagaaaatgtacgtcaggaagaaggccagtggcgtgaaagtctggtgaagcaggttcagcattcagaattggaactcgttgctaactttgttgatattcccctgcgactgtcaaaaattctccaactgagacgcggcgatgttttgccgattgagagaccggaacgccttatcgctcacgttgatggtgtgcccgtgctcaccagccaatatggaacactgaacgggcagtatgccctgcgtgttgaacatctgattaaccctgttttaaatgctctggatgaggaaaagcccaatgagtga

SEQ ID NO: 711 - DNA, 477 bp, Xenorhabdus bovienii
  Coding sequence Name=Xb4151_4152.C418.gene14.dna; Position on contig =10158..10634bp; Strand=-
atgtctgattatagctacgagcgtaaacgcacaaatccaatttggataatactgttaatactgattgccgttcttagtgccgccatcggcgggtatagctggtggacaatgaagcagccaaccaagaacagcaccgaaaaagccaaagtcatcagtactccggtatttatgacgctggaaaattttaccgtcaatttgatcgacaacgaagaccatattgaccgtgttttatatgttggagtgacactgcgtctgcctgatgaaaaaacccgtcagcgcttccatgattatctgccagaagttcgcagccgtatgctgctattgttatcccgtcagaaagcaatagatctggcgaaaaatgacggcaagatgcgtttgatggccgatatcaagcagacgctgcacccaacgatgatacccggtgagccagatcaagtggtcaccgatgtgttgtttaccacgtttattctgcgataa

SEQ ID NO: 712 - DNA, 1365 bp, Xenorhabdus bovienii
  Coding sequence Name=Xb4151_4152.C418.gene15.dna; Position on contig =10838..12202bp; Strand=-
atgaacctcactcttttgcctactgatataaaactcacagaaaaaagtcagccgacattgaatgatcccctgacccgtaacaattcgtctgaatttgggcagcatctcaatgcagaaatagcctctgtgcggaagacggcgattgaggctgataaaaatggtctgaataatgagaagtgctccggtgataccccaattgaaggtgaattggcacccttgctggctgtagcggacaacacggtaatacgtgttgacggtaaaacgctggctggaggcaaactattgacagaaacctccacgctggaaagcgatattgatttcgctgtgttgaaggatgaagatctcttatctgctgaagctctggtggctgcaatgccaatccaactcgccggattgatcaacgctcagtcgattcctgcggatggtactgaaaacacagacgaactgctacgtggtgaaaataccggtgcggagactttactgggtcagcatgtaaaatctggcaagaatgcaaaagtcgatgctgcactgagcactacagatcgtactgaccacaccaaagatggcgaacaagataaaagtatccggtctttcgccacacaagagactaccctgagcaacaacgcggaacaatcaaccaaaacacgcccaactctggctaccgctgccgggcaagtgaaactcgccatcaataataaagcagaacaacactccgcttcccaaaataacggaaaagagttgaaccagttccagacagcgattcaggggatacccgcactggtggcggtcgcggctgaaactttccagccagaatcacctgcaataccggctgcctctcccctgcttccggcgggacagcaaacaaccggtcaatttcagttaaacagcactcctactccgttactgagcgcccatattggcagtgaagagtggcaacaacaactcaaccaacatgttctgttctttaatcgcaacgggctgcaacaagctgaattgcgcttacaccctcaagaattaggcgcactgcatatccgcatgaatgttgaagacaatcaggctcaactgcattttgtctcagcacaccagcatgtccgtacagcgctggaagcagcgttacccgggcttcgccatgcattggcagaaaatggcatccaattagcacaaagcagtgtaggtggtgacactcagggaaactggcagcaggaacagacgagcaattcaccgagtcattcccatcattctgccaaggctcagggacagaattcaaccgccgtgacacagatgccaacgactcatgaatcagccatcaaaataacaccgcagcagctcgcttcaattcgcggaggtgttgatattttcgcctga

SEQ ID NO: 713 - DNA, 447 bp, Xenorhabdus bovienii
  Coding sequence Name=Xb4151_4152.C418.gene16.dna; Position on contig =12199..12645bp; Strand=-
atgcaacagcactcccctctcgtgactttacgtgaacttgctcaagatgcggcagaaaaagcggcaaagcaacttgcacagatccggcagagtcatcagcaaatggagcaacaactcacggcgttgacaaattatcaggatgaatatcgtacacgtttaaatgacacactcagcagcggcatgtccagctcaacctggcaaaactatcagcagttcatgaaaacgctggaaatggcgattgaacaacacaggttacagcttacccaatggaaaaatcggcttgagcaggccatgtcacaatggcaggacaaacagcagcgtctgaacgccttcgacacactgcaacagcgggcagagcacaatttgaagttacaccagaatcgcatggagcaaaaacaaatggatgagtacgcacaacgtagtgcacaacggagaatgaaacaatga

SEQ ID NO: 714 - DNA, 1365 bp, Xenorhabdus bovienii
  Coding sequence Name=Xb4151_4152.C418.gene17.dna; Position on contig =12724..14088bp; Strand=-
atgactgcacgacttgggcgctggctggcaacgttagattcactggaaaaacgtctggaaaaaaccccgagagtccgccgttacgggcgtctgacccgcgcgaccggtttagtactggaagctactggcatacagatgcctttgggtgctacctgtctgatcgaacggcagaatggcagtacggttgaagaagttgaaagcgaagtggttggtttcaatggtgaaaaactgttattgatgccattggaagaactggaaggcatagtaccgggtgcccgtgtctatgcccgttcttacggtgaagattcggctggcggacgtcgtttgccactggggactgaattgcttggcagagtgctggatggctctggtcgccccctcgacggcttccctgcccccgatacaggttatcgtgccttgttgactactcccccgatcaatccactgcaacggacacccatcagcgatgttctggacgttggtgtgcgagccatcaattccctgctgaccgttggacgcgggcaacgcatggggctgtttgccggatcaggcgtcggtaaaagtgtgctcctcggtatgatggcccgctatacccaagcagacgtgattgtcgttggactgatcggtgaacgtggccgtgaagtcaaagatttcatcgaaaacattttaggtgtggaagggctggcacgttcagttgtcgtggccgcacctgccgacgtttcgccactgctgcggatgcaaggcgcttcttatgccacccgtattgccgaagatttccgcgatcgcggcaaacatgtcctgctgatcatggactccctcacccgctacagcatggcgcaacgcgaaatagccttggctatcggcgagccgccggcaaccaaaggctacccaccttccgtatttgccaagttgccggcactggtagagcgagcaggcaatggcgtcagtgatggcggttcgattactgcgttttataccgttctgacagaaggtgatgatcagcaagatccaattgccgattccgcccgtgctattctggatggtcatatcgtgctatcgcgttcactggcagaatctggccactaccctgccattgacattgaagcgtccatcagccgcgccatgacctcgctgattgataacgaccattatcgacgggtacagcagttcaaacagttgcttgccagctaccagcgcaatcgggatttaattaatgtcggcgcttacgccgcgggcagcgatcctttactggacagagcgattcagctttatcctcatatggcccagttcctgcaacagggcatgagtgaacgtagtgagtacgatgcggcatgtattcagcttcaacaattattgccaatatag

SEQ ID NO: 715 - DNA, 705 bp, Xenorhabdus bovienii
  Coding sequence Name=Xb4151_4152.C418.gene18.dna; Position on contig =14088..14792bp; Strand=-
atgtctgataagtcaaataagggaatttggcagccgtggcagccaaatgaactgactcagtgggaaacactgcgggcaaaactgaagcccaaggacgacgaatcggagcctagcgagcaggagcgtctgctggatcaggccagaatgctggacgcgctgaaagaacaagcgcgtcagaccggccatgaacaaggttttacggcaggccaggcgcaaggttatgaacaagggatacaggaaggccgtcaggcgggtctggagcaagggttgcaggaagccagacaacagcagcagattgttgttgaacagtggaaagccttgctggaagattttagccattcactggatgggctggatacggttatcgcttcacgcctgatgcagctttccctcacagccgctcagcatattctggggcagcccgccgtgtgtgatggcactgccctgctgaatcagatccgtgaatttatccagcaggagccaatgttcagtggaaaaccacaactgcgagtccacccacagaatatcccgctggttgaacagcaactgggggaaattctggcattgcatggctggcgtctgattgccgataacaagctgcatccgggcggctgtaaagccagtgcggatgaaggtgatctggacgccagtctggcaacgcgctggcacgaaatgtgtcgtctggcggcgtcaggagaattgtga

SEQ ID NO: 716 - DNA, 993 bp, Xenorhabdus bovienii
  Coding sequence Name=Xb4151_4152.C418.gene19.dna; Position on contig =14785..15777bp; Strand=-
atgagcctgaccggaacagaaagaagtgccgtcatgttaatgaccctgggagaagatcaggcggccgaggtgtttaagcacctgaattccagagaagtacagcaactgagtatcgcgatggcgggaatgaggcaagtctccaaccagcaactggctgaagtgatggcagagtttgaagaagatgcagggcagtacgcggctctcagcatcaacgccaacgactacctgcgcagcgtcttggtgaaagcgttgggcgaagaacgtgcttccagcctgcttgaagatatccttgaatcccgcgataccacaacgggcatcgagactctcaactttatggagccacaaatggcggctgatatgatccgcgatgaacacccgcagatcattgccaccattctggttcacctgaaccggggtcaggccgccgatatccttgccctgttcgatgatcgcctgcgtaatgatgtcatgctgcgtattgcaacctttggtggagtacagccgtccgcgctggctgaattgaccgaagtactgaataacctgctggatggccagaaccttaaacgcagtaaaatgggcggtgtccgtactgcggctgaaatcatcaacctgatgaaaaaccagcaggaagagagcgtcattgaggcagtgcgtacctatgatggtgaactggcgcagagaatcattgatgaaatgttcctgttcgaaaacctcatcggtgtggacgctcgcagtatccagcgcttgttgcaggaaattaccaccgattccctgcttgtggcattgaaaggctgcgatcaggcattgcgcgatcacttcctcaacaatatgtcgcagcgtgctgctgaaatcatgcgtgatgacttggcgacccgcggcccggttcgcatgtctcaagtggaagccgaacagaaatccatcctgcttgtggttcgtcgtttggcagagaacggcgaaattatcctgaatggtggtgatgatacctatgtctga

SEQ ID NO: 717 - DNA, 1710 bp, Xenorhabdus bovienii
  Coding sequence Name=Xb4151_4152.C418.gene20.dna; Position on contig =15774..17483bp; Strand=-
atgagtgcagcaacaaccgacgttgagaaccaaaataaaggtttcagcgctatcatcagcaggataaaagctgatcccaaagttccattattagttgctggctctgctgccatcgctatcgtagtcgcccttttcctctggatgcgcagccctgattaccgggtactttacagcaatctgagtgataaagatggcggcgaaatcgtcacgcaattaacccaaatgaatatcccctaccgttttgctgaaaacagctctgcgctcatgatacccgccgataaggtgcatgaggcccggttgaaactggcacaacaagggctacccaaagggggagcggtgggttatgagttattggataaagaaaaattcggcatcagccagttcagcgagcaggtaaattacaatcgcgcaaaggaaggtgagttaagccgtactattgagtcccttgaccccgtcgagagtgctcgtgtcattctgtccatccccaagccttctctgttcgttcgtgaacaaaaatctcctacagcttccgtaacggtaagattactgcaaggccgtactctggatgagggacaagtcaacgccattgcgcaccttgtttcaagcggtgtggccggtttgccgccaagcaatgtcaaaattgtggatcagtctggacgcctgctgactcaggccgatgccaacgggctcgatttaaacaccactcagttgaaatacatccaggaagtcgaaaagcgtttccagcatcgtattgaaaccattctgacgccggtggtcggccgtggcaatgttcatgctcaggtcacagcccagcttgatttctctcgccgcgaacaaacggcagaagaatataaacctaatcagccacctaatgaggccgctgttctctctaaacagagcagttccagtgagcaaagtggtgggtcattggtgggtggtgttccgggtgctttatcaaatcaaccgagtgcagcaccaagcgcaccgattgagaagcccaatccagacacgaaaggcaaaggtgacgaaaaatccgatcagaatcgcaatagcacctataacaattatgagcgtttggtgaacaacagccgcaataaccgccatgacgaactgattaactatcaagtcggtaaaaccattagccacacccaattgcaggtaggcgcagtagaacgcctttccgttgccgttgtcatcaactatgccactactcagggagaaaatggccctgaaacaaaagcactgacaccagaacagttatcccagatcgaagcactgactcgtgaagcaatgggcttctcaactaaacgtggcgatagcctgaatgtcgtcaacacaccgttcaacgatacggctgaagtgatagaacccctgccgttctggcaacaccctgtcctgctggaaaaaacattagagttaggtcgttggttactgttggcactggttgcatggctattgtggcgcaaaatgatcgtgcctcaaatcgccaagaaacgtgcggcggaaaaagccgcacttaacgcgcagaaaaatcaacagaagcagcaagcgccagagtccaatgcggaactggatgaaaaaatgcgccgcaagctggctcgccaacgagtcaatgccgagattcaaagccagcgtatccgtgaacttgcagaaaaagatcctcgcgttgtcgcgctggtgatccgccaatggatgagtaacgaacaatga

SEQ ID NO: 718 - DNA, 312 bp, Xenorhabdus bovienii
  Coding sequence Name=Xb4151_4152.C418.gene21.dna; Position on contig =17768..18079bp; Strand=+
atgtcaattcaggcaattgaaggtgtactgcaacagatgaaggcacaggcattacaggcaacgaacattgccaatcccatgccagtacagggaggttttgccagccaccttaccgctgcagtagaaaaaataaatcaaacccgtctgtcggcgactaagttgtctcaggattttacgttgggtgtgccgggtgtggaattgaatgacgtgatggtcaatatgcagaagtcgagtatttcattgcagatggggattcaggtcaggaataagctggtcagtgcgtatcatgagattatgaatatgcaggtgtaa

SEQ ID NO: 719 - DNA, 252 bp, Xenorhabdus bovienii
  Coding sequence Name=Xb4151_4152.C418.gene22.dna; Position on contig =19271..19522bp; Strand=+
atggacgtatctgcgcgtaaaaaattagtgtctgaatacctgtgcaaacttgctggcaagcaggatttagacgattcggtcaatatcttcgaaacaggcttggttaactctttggccgctatccagctaatctcctttctcgaaaaaaacttcaaaatcaaagtcgaaattgatgaccttgataatgccaatttttccagcattcaggctgtctgtaactttttggacagaaaggtggcggtaaatgcttaa

SEQ ID NO: 720 - DNA, 1164 bp, Xenorhabdus bovienii
  Coding sequence Name=Xb4151_4152.C418.gene23.dna; Position on contig =19515..20678bp; Strand=+
atgcttaatcgctttttgtcacctttgcaaaacgagtggttacaggtatttgagcaattttcagcgactgaaattgcgccttatgctgacgaatgggatttggcagaagcgatccctgcaacggttgtgcaaaaacttgcacataacggttggttgggtgggttggcgaaacccgaaaatggtggtctggggtttgatgtcacgaccttcggattgctgaacatggctatcggcgcagggagtggttcgctcacggggttgctgaatgtacacgccatggtgttgaaaactattgaagattggggttctcaagatcaaaaacaacgctttctggcaccgctggtaaagggtgaaatcattggtgcattcgcgcaaacggaagtgtccgctggcggagattccaagaatctgtcgacgcagtttgcagaagacggaaattatctcagggctaatgggcaaaaatcttggatcacttttgcccagattgcggatttatttctggtattcggtaaatatcaggggctggataccgcagtgctggttcctaaagatactccggggctaaaagtgaccgccaaaaaaaatatgctgggcttcaagagtgcatatttggcagtgttggatttcaaagattgtcgggttcctaagaccaatattgtcggaaaacccggatttggacaaaacctaatctctaacaatgccttggactatggccgcatcagcgtggcctgggcggcgctcggaatacagcaggccgcattggcggcatccgctcgcagggctaattcccgcatcacctttgatacgttacttgcggatcaaggtatcattcgcggctatctggcggaaatgtccagtagcctgctggcctctcaactcatttgtttatcagcgacaaaagccaaagaaacaagggatgaagacgctcttgagcagatccttcaagccaaacttttctcatcgcatgaagctggcatcgcagcagcgaaagcggtacagattcacggtggtcacggttgcgatgaaagcaacggcatcagtcggctctatcgggatgcgaaaatattgcaagttgttgaaggcagtaatgaacttcaaaaaatgctgatcggcaaggcagtatgcaatcggtatcgccataacgccgcacagactattccgtaa

SEQ ID NO: 721 - DNA, 1629 bp, Xenorhabdus bovienii
  Coding sequence Name=Xb4151_4152.C418.gene24.dna; Position on contig =20816..22444bp; Strand=+
atggcaactggtcgatttattactgattacttcgaaagtacggcgagagataaccagaatccggcgatacggtggggaaaaggaaacgctttatcttggggcgaattatacgaaagagcgcaacgactggctcattatctggtgagtgagcgcggtatatgtcagggcgattgtgttgctattggccttgagcgcagcccggaatttctggtggcggcatatgcggtactgcttgctggtggtgtttattttcctgtagaggcgaaaacgcctgtcgctcggttagcatccatgtttgcgacggctcaatgccgtatcgctttttgcaatgtggcacagggaagtctgtttactcaggccaaacccggactggaactgatcgggcgtgaatttctgacagaaatctccacctctcattgtctggatcaccgctgccttaattttcatcaatcagaaaacacgggcaaaaaagcgcgtcaacgacaggctaccgatccggcttacttaatcttcacttccggcacgactggcattcccaaaggtgtgttagttaatcatggcgctttcattaaccgattagagtggcatcaggctcacagtgagatgacggattcggacatcatcctgcaaagaacggcgctgacttttgatgtgtctttatgggaactctttttacctgccctgaatagtgcgagcaattatctgctgcaaccgggattggaagcattccccagaggcatagtcgctgcattggtaagcgaaaatattacggttgtccacttcgtccccagtttgctgaagcccgtactgcaagaactacaagagcttcaggatgacagtgttgaaacgccatcattatcggcgctgcgcagggtgtatgtgagtggggaatcattgccggccagtctggtgacgcaatttcagaaaatattggcttcgcgctgcctgttgaccaatttatacggccccacggaagcggccattgatgtcagtttttatgactgcgtggaaaccgtgccggacgctattcccattggacagcctcttactggatgccagttatatatcttggaaccagacagtctgacgttaaaagcggattcggaagaaggcgaaattgccatcggtggaatatgtctggcagagggctactacaaccgaaaagatctgacggataaggtattcatcttccatccagaacttcagcagcggctatatctgaccggtgatcttgggtggcatgagaaaggacggggctttttctgtcagggacggaaggatacgcaagtcaaattacgcggattgcggattgagttgggagaaatagaacaccatctgctcaattaccctgctattaccgaggccgttgcttgcgtggttgaggatgaagatcaggaacagtggctggtcgcggcgattgttgcaggcgaaagggagcttaatgagcaggatattcgccaatttctcgctgcgcaggtgccggcttacatgttacctactcgttattggcaagcccgaaatctgccgaggtctggctcaggaaaacttgacaggaaaacgatagcccaaaatatgcgggatctgtttttcaccgatcatcacagaggtgggaacttaagccatgaataa

SEQ ID NO: 722 - DNA, 4662 bp, Xenorhabdus bovienii
  Coding sequence Name=Xb4151_4152.C418.gene25.dna; Position on contig =22437..27098bp; Strand=+
atgaataaaccgacttttgagctatcgcggtcacaacaggccgttttcaaaatggaagcgtttcatctgtccggctacccattttatttgggcggtgtggcacgattgagtggaaatgtgtcgttagatcaacttgtgcgggcggccgaaactgtcaggaatacgcaggatgtgtgccatatcggcttcgtcaacgatcctttagaaacggttcatccagaagttgttggttgggaaatattatggcgtggaattcggcacaacacgcctcaggccgccgtggaacgagtggacttcagcagacatccagaccccggttcggcttttgaaagttgggtggagcgtcaactgctggtggaagaggacttatcactcacgccgatacggatttttgcggtgcgtttccgacaggaacaatcgggatggtttgtgaaagcgcatcatgctgcggtggatggtgcggcgttggcgatattactagagcgtctggccgatgcattggtgcagaggtcggggaaggtgaattcccctttgtactctattcacgccgagagagagcgggattacgagaattcccggcgtatggcaagggatgcggcgtattggcggacggtttttggtgaaccaaatacttatggtgatacggcgtcagtcagcgccaccaaaatctcctgccgctacccaataggggattatcgtagttcgaaaccgcacacgatgcgtgtacggatcgctttgagcgaagcgcaaaacgagatgctgcataaattcagccatcgcggaggttcagtttttcggctgtttttcgccgcagttgcctatacacaaatggtgattgaagatggcaatggcgcgttattacaggcacctatgctgaatcgttggcgtgaagacgaaaaacagtcagtgggcatggcggtggctcccgttctgatcccggtatttcgtgaggcaggggaaaccgtcgcggattgctatcgtagcctcagaaaacatctgcaaaaagcggtgatgcactcacggtatgctccgggcgcccgttggggagatttcgcatcgcaggaatggagacagattgtgccggctttcggcgtttcctatcaaacaggcgtgtttcagaaaaccgtctcaggtgctgaaatagagattgatcatattcaggcagtggaggcgttgtttgccactgtgcacatccatgatcgctttgagggcggtgacttcaagattgaagccgattttcgcaaagtctggtcttccgaccaatgtcacgcattcctgcaaaccgtcattgattatgcactggaagctgccgctgaagtgatggggcaacaagaaaccacaaggcaaacaaaagaagtcaacgtacagactgattgtctcgcagagccgatcggcgttcatttatgtgacgcttttcagcgttatgccgataactggctgttcaaacaggaagccggtgagggagtgggtaatctgacctaccgtcaaggatggcaatggatttgcaagtttagtgcgcaattgcgtgacaggcgggatcgacgtttcgaacaccatccggtggtgattctgggaaggcgctcgcctgaaatgacgctcgcctatttgacctgtcttattgaaaatgtgaccgtggttcctgtttgtcccaccacgccgttggcgagattatcaactatcgtccgtaattcgggcgcgtctctctgtatttatacgggaacggatcaagaccttgcggaggcgctgaatttgcctctgttacgcgcttcgctggataaagatttatgtgacgcgggcttgcatccggaaatccagccagaattcatacatcccgaacaagcccggtcacaacaaacaggcagcaatcctgcttatatcctgtatacctcagggtcaaccggagagccaaaaggtgttgtcatttcccctgttgcactggcgaactatgcactggcagccaaaggggaatacgcttctgaagcgccgtttaatgcacctttgtttacttcctttgggtttgatctgacgcagacagcgattctgatcccggttttatcgggggggtttatacaagcccacgaacaggacattcgcgataacccggaactactgcgaacccttctctccgatgaggcattgacgggagtgaaatgcacaccatcccatctctcattattgattgagcatagcgtccggagacggaatccgctgacctttatcgttggcggcgaaaatttgtccgtcgctttggtgaacagagcgcttggcttctttccttcaggcagcagagtgatcaatgaatatgggccgacagaggcgacggtagggtgctgtatttatttgatgaacgaaagttcgatgagcgaatctgatgagaatgacagagcgagcaccgtgattgcgcctatcggtaaagcgctggggcaagcggagatgtcgataagagacgcttgggggcaaaatatgccccgtggatttaaaggagaaatagggatcggcggttcagtgctggcggatggatatatcaacaacagcgcgcagacggaggcgcagtttgtatgcagcgccgacgggcagcatcgttggtatcgtactggcgatctgggcttgcaggatgaacagggaatattttattgccttgggcgcattgacgatgaattcaaagtgcgtggtcatcggattcaccctgcggaaattgagaaagctgtggcagaagctctggcggatcttggacatgacgatgaccgtcgggagttgaaagcgctgaaactggccattgatggatatgaaacggtcgctttgtgcagtagtcaatctgtgccatacgacaactctgcattccagaaaaacctgaaaaacacaatccctgacgcttggctgccgggtctctattgtactgtgcagccttggccgatgaatgccaatggcaaggttgatatggccgcgctcactgttgcggctaaagcaaagctggcggcagccgatcctgctcagtttcgtgcaactgacaggcaaggtcagcgagagccggaagcttattcactcccgacatggctggacggcgagtttttaaggccgatttggccggaaaccgtggatctgaccgcctcatttctggcgcagggaggtgactcaatcaaagcaatccgccttgtcgcattactcgccagacaaggcgttcgggtcggcgcaagtgaactgttaacgtcaaccgccttaggggctgtgcttgaaagagtttgttcggaaaaaccagacgttgctgtcaccgactcgactgttttggaagcgccggaagcaaactgggtgaactatttacccagtgtccgctggtttcaggaacatcactttaaatacggtgaacggctgcaacagggtgtggtgcttgagttaccgtcatccatttgcgccgggcgtataaatagcgcggtggcagcggtaaaagccagacataaaattttcgctttgagatcgaatcggagtttgagtgagttttatttttcgtccttggagccagagcaacatgacggcgatatgttattgcaggatcaagtgttggcgcaagacgaaagccttgagggcagactgcacagattgcaaggcgaagtgtgtctggaaaataagccgagtgtgcatgaagtggtatgtgatccggctgcgaacaaaaattatctgatctgggtttgccatcatctgatctgtgatgtccattcatggattttcttactggatgaattggatcaggtgctgaacgaatcggcggttctgctcaacgttgataaagctaatgtcgataaagccagcgctgttgttgagcagggtgcattcctctgggggaaatggctgcgggatcacgtctcttatgctgaacctgcaccacatgaccatgccttttatccgccggcagccgttcccgtcacgctggcgctatcagttaccggcgaggatttccggctgatggaacaacgctacaaagctgaacggacgcagttgattgccgctgctttgctggagattgtgcaggataacggcatgttaccggaacagcctacggtgctgtttgaaaaccacggacgcttattctctgaggcagagacgcccgctgtctggcatgcggtgatggcgaattccgtcggttggtttactggcttcaatcaactgaatctccacgttccctctggctatcaaagcggttttttgcccggtttctttttacgaacattgaaatcacaacggtatgaagacagcccagactggaaagaacaactgggattgaatggtgtgcggacgcggccgctcatctgcatcaacgatattggtttcggactgagcgaacacggaacatggcgccattttaatctggttgattccctgtcgggtggttttcggcatcccgatgaaaagagcgtggctgactttgatgtgcttatttacgacgatcgcgaatccggttctgtttttgttgagttgagactgggcattcccgaagctggcgacgtggatgccaaacgctacctgatgcaattaaacgaaagactatccgattggaacgatgcgttacatcgcgcacaagtggaacaggcgttaattccggcagattttcccctttgtcagctctcacaaccggagctcgatctcattattaatggagcctcagcatga

SEQ ID NO: 723 - DNA, 1245 bp, Xenorhabdus bovienii
  Coding sequence Name=Xb4151_4152.C418.gene26.dna; Position on contig =27095..28339bp; Strand=+
atgagaacggttaccgactcagcgaagacggtatttttatttcccggcgtgggcgcacagcaacccgatatgtttgccgcattcagaacctatcccgaatatcgagcctgtctggaagaagtgtcggagctgtctcaggtcgatctatttagtgttattcatggcgaacagcgcgacaccttgaaacaagtgcgcattgcccaactggcgctcacggcgactacggtcgccattgcgggcatattacgtacgcgctgtgggcttgttcctgagtttatgatgggacacagtctggggcagtatccggctctgtgcgctgctggctatcttgatctggcgacgttgaccaaagtggttaacctgcgctcggaagtcgtggaagcctgcgcccgtcgttacgaacagggcgacatgtgttgggtattgcaccttcctgccgaggttgtggtacaggcagtggataaagccagaaaagacgatggtatagaattgtatgtatccgccattgatgcgtttgatcaggtgacggtttctggcgttatggcagacattcgacgctttgcgccgcgtatggaagcgctgggcgggttgctttatccattgaaaatcggtggcccgtttcattcgcctttaatgatggaagcgcaagagaaattggcggcattgcttgatttcctgcctgacacagacaagcaggggacgctgctctccagactggtctgcaacgtcagtggcgcagagttacctgctgaggatctcaaaccatcaattttacagcatctgacttctcccgtgcagtggctgcggagtttgcagtatgccgcgcaaaacggtgtcacccgctatctggaaatttccccgaaaacagtactgagttatctgaatcagcgcgcgggattgcccatgcaacctttatgcgaaccggatgaaattttcactttcgctgaggcactaagcaccgcagagagccgattggagcggtttttcaggcactgttatttccatctttatagctccagattgcctgacatcaaggatgcggcagcgatcgcacaactgcgtcaaatcagggatgcagtaacacaaaggataaaaggctcacatctgccctttgaagactgcggctttcttcatcagcacacacagcaatggctggaaatgattgaaggaaggggagacacctctttatctgtggaaaagatgaagttgcaaagcctctttgatgcagtggggcgcggagtatga

SEQ ID NO: 724 - DNA, 3345 bp, Xenorhabdus bovienii
  Coding sequence Name=Xb4151_4152.C418.gene27.dna; Position on contig =28336..31680bp; Strand=+
atgaagcagctcaatgattccaacaaacccaattatatcgaagaattattacaggtaacgccgcaagcaaacggcctgctgtttcacgctttgaaagatggtaacagtacctatcatattggcgtggcattcagcctgaaagcggatgtcagtgaggaggagatcctcgatgtctggtatcagatacagcagtcacagcctgctctgagggcggtttttgtctggaaaggcattcgtgttccccatcaggcggtatacgcattaccacggataccgcttgaatatatccgcgttgattcaactaccccggaggcgtcgctaaaacaacgcgacctcgattggctggcacagtcgaaagcgacgccatttgagctggatgccgaggtgtttcggatcatttgtttccacgatattgacgcgggaatcttaaggatcgctttctcttttcaccatattctgatggatggttggagtagctcactactgatttcgctctggttacagggattgcgccagcaaaaaatcgttcctctggctgtacgactttattcgcagcaactctggaaagggctaagtcaagaagaactgaggctcagtcgtgaacactggcatcgtgttttccaatacctgccagacggagaaacttcggcgacgacaaaactgctggccgaaccgctgttccgttctgccgaacataccgagattaagcataaagcgggagaaaaaataacagatgaaaaagtcatcgcgaaccgcatatgggataaagaacgtaaagcggcgatagagttgatttgtcgctgtgcaggtgtcactccggcaagttttatctatctgtgctgggcgctggtactggccaagttgactttccaaaaaaccgttacgttcggttgtacattttccggcaggggagcggcgttgacacaaaacgtcgaccgccaacctctgggactgtttacgaatacggtgccgctgatcctgacgctcgacggaaaatggcgtctggaagtagcattacgcgcggtttttcaagcgctgcaacagactcatcaacatgaaaaaacgccacccctgttgataagagaagagacgggaatacgtgacgaactctatgactctattgtcgttatcgataattacccgatcgataccgagttacagaacgctgattgtggtgcatttctgacggatttgcacagtgaagagacgacgcattttggtttgactctgacggtttccggtgtggatcaatggacagttgagttaagtgcgggggaaacttttgcaagtgatcctgacgcggtaaatagggtgtttaacgcgtttgaatctttggcagcggatctgattaaggggtctgtggatgtacggattgaagatctggtgttaaaactcaacccagacggcgctgaagaagccgctttggtcatgggagaacacaatgcacagacgccggatatcaatgcgttgctgctgtgcatttatcagcggcttaaccagtcaccccaagaaatcagtctgattgaaggccagcatcggatcagtaatcgcgaactattgcggggcgtttttgccttgcaggaacggttacggggagcgggattcgttccgggcgatagagtggctgtccatctcgaaaagggactgttatccactcaagcgattctggcgatattgttcagtggcggcagttacttctgtataaacccgaaagatccacggcaacgtaaaaaaaatctgttggcgttggcgaattgcggcattgtcttatgtggtgcctccttgaacggggaacttgatgctgacatcgggcgttacttgctgctggatatcgaaacagagataacatggccggagtccactggtgaaccaacgttatggcgcaatcggcggtctgaagatgagttttacttcatcttcacgtcaggaacgaccggagcacctaaaggcatctctatccgtaatgaatcagtggcaaacttgctggattggtttgtccgggaaacccaccttacgcctgcggatcgggtacttgggctgaccgacctgaatttcgatcccagcgtcgaagatctgtttggcagtcttgttgccggagctacgctgatttatccatcatccaatgtattgttggagcgacagacgtttatcgatctgctgcgggatgagtccatcacgctgattaactttattccgggcgccattgcacagcttattcagggcgctccttttttcccggctatgcgcttgtggatattcggcggtgaagaattacctcaatggctcagggatgatttgctgcggcagggttacgccgtcagcaatcattatggtccgagtgagacgacggtggactgcctgactgccagacagtctctctctgcggacgtttctatcggctggccaattcaaaacgtcattgcctgttgcgcggacgtcttcggtaaacctttgcctgcggggatacggggcgagctttggattggggggcaggcggtcgctcacggttacgccaccaatccggttgagtccgataaatattttgtcaaatacagtaagcaggctttttatcgcacaggtgacgcggtcactttttctcatcagtcaggctttaagtatctgggacggattgacgatcaagtgaaagtgaacggcgttcgcattgaaccgcgtgaactggaacgtgccgttgagacattggaggaggttaaggcttgttgcctgttgtctgcaacggggcgggaaggaaaacggcaatggcgtcttttcatcgatagctgcgaatcgtctgccatgctggagtcccgtgtgcgagaacatattcgtcggcattttccagagtcgtggattcctgcgcttattgtggttatagacggttttgaacgcaccattaccggtaagatcgatcgtcagcgactgctggaacgcgaaatgcagcgattgccaatacaaactgccctggatcatgcgccgttgaccgatcctgtcgaagcgaaagtacaggctgtctggagcgcggttctggaaactccggtggttgatgcaaacgtgaattttttcgatgcaggtggtgactcaataaaaataatcgcgctgcaatcccaaatgcagcgggcattcaaccagaaaatcggcgttgccgtcttattcgaacaccccaccatcaccgccttcgcaaactggatcaaacagagcaacttgtctcccgaaaatgaggaagccgaggtgatgctatccgattctggcaagcaactatcccaagaaaatactctgtcgtcggctcgctcaggtaaaaacagactggcggacaggcggcgtaaagtgaaaggaagttcagtatcatga

SEQ ID NO: 725 - DNA, 6498 bp, Xenorhabdus bovienii
  Coding sequence Name=Xb4151_4152.C418.gene28.dna; Position on contig =31677..38174bp; Strand=+
atgaagcgtgaatatacgggtagtgaagtcgctattattggcatttcttgccggtttccccaaagtcccgactggcaaagtttttggcgcaatctattggcgggacacgaacttgtgtcatttttttcgcgggaagaactcttagctgccggtgcgccgtctgagattatcgatcttcccaattacgtccctgccaaagcctcccttgaggatgctgagtgttttgattatgaatttttcggctactcgcagcgggaagcgcggaaaatggatccgcaactgcgggtattgcacgaagtcagtttcaacgcttttcttgatgcaggtttgcctgttggcgagtcgatgttaaaggcgggagtgtttatcggttccacgttgaatctggcacgactggagcaatttgcgggcgctagtcaggatatctcagaaatgttcgatgtcggcaactataacgatccggcttcgttcgctgcgcaaatcgcttatcgcatgaaattgaatggcccggcggtgcacgtacaatccgcctgttcgacgtcattatccgctgtccatctggcttgcaaggcgcttttggcgggtgagtgcgaaatggcgctggcggggggcgcatgtatcactgatccggtggcaggcggttatttacatcaggatgggatgatcctgtcgccggacgggcactgcaaaacgttctctgatgacgggaaagggacggtgaacggcaacggcgtggcagtcgtgttgttaaaattgctggaagacgcactcgcggacggtgaccccattcatgccgttatcgtcgaatctggcatgaacaatgacggcgatagaaaagtgagctttgaggctcccagtgtgcaggggcaggcagaagttatctcacaagtttatcggctggcggatattccgttttcgagtctgggcatgatcgaagcacacggcacggctaccgtccttggcgacccgatagaaattcaggcgctgaataatgttgcgcgggaactgctctctccggacgaactgcaacaattccgctgcgccgtggggagtgtcaaatccaatatggggcatctggatgccgccgccggtattgccgggctgataaaagccgctttaagcgtccgttttggtaaaattccgccttcgttacatttcaataaaccgaatccccatctggatctggacaatacccccttctgggtacccactcaaatcaccgactggccggcaaagcaggcgatccgacgtgccggcgtcagttcattcggcataggcggcaccaatgttcacgttttgcttgaacagccgccggaaaccgtcgataaagacgcttctcaccggaaatccgcacaaatactgccactctcggctaaatctcccagtgcgctggcgcgattggcagagtcttattccatccacctcagcctgattaatcagggattcgccgaagaggaaacatcaagccttgaagtgatcgcccggcagctacaggaaaaccgaaccgaatatccttgtcgtgctgcttttgttgccaaccatcgcgatgactggaaacagcagcttgataactggacgctgatggatggcgcttatgcgtcaatggcggagttaatttggctgtttccggggcagggttcgcaatcgccggcaatgggtctgcgtctggcggcggaatatccggagttcggtgacatttatctggggttgttagataaagccgcagcactgttatctgttcaaaaagcggtattgattgataaacagacattaattgacagcattaagcgacctgaacaactgtcaactctttatctccagcccattttatatgcagttcaggcggcattgggtgtttggctacagaggcttggctgtaagcctacggccttgttagggtttagtctgggagaattcgctgcggcagctatcgccggtgtgttcagcatcgaagaaggaatggagctggtggtcgcacgggcggaattaatggattccatgccaaaaggcgcggtttttgccgccagtcgcaaaagcaaaaatagcaaggaagactttgacggtgattttccggcgatgctttggtgcatatcagaactcagcccgggaacgtggacactggcgacagaggaaggattggtcgcagacgcagagaactggctgacgcagcacggctttgctttcaagcgggtggcggtatcccacgccttccatacaccaatgattgagccagcggcgaaagcgtttggtgagctgctgaaaagttatgatctgcaacccgcgcagtgtgctgtttattcaaccgctttgggacggaaaattgaagcggatgagatgcgtgacccgcaatattgggtcaatcaaatgctgtcccctgtgcaattgggtgctgctttaaagcagatggctcaggaacatcccgcgtcactcttcgcgcaaataggggttggcatggatttgttgcagcacacgcgtaaatggctgcatctgaatggggagagatgggttccgactttaggctcgggcggcgcggatcacgaggtgaattcaacgttgcagttcattgccagggtctggatacagggcggtggcattgagtggaacagaattcatccgcagacatccatcgaacgtaccataacgaaaacgcacctgcccggccacgcttttgaacgtcgggtttgtctgccacaagcgatcacaaaagcggctcaggcaatatcatctctgtttttcggctcgcattattacgggctggagtgggaaaaaatcaacccatccacgccggagaacgctgcccaatcaggggatacgccgacaacctggataatctgcccacaggttcaggaaagagaacgtcgtctggctgaaacgctggcactgaataaccgtcaactgacgtttattgagtgtgcgaactggcggggcagcgatgccaacctttatgccgagctggaaagttggctgttgcagcaagggctggcagtgtccgccgctatggatattattgttaccggattactggatgatctggacactcggcaggcgcagttctgggcgttctggctgccgactgttctggcgagatggagcgcaactcagcgttttgcaccgaaaatacggttgttcttccccacaaccgaaatggcggcatggagtggttcggagacgctgaatgcagaaaaaaaccagcttctggggtcgctgctgatcctgccggaagaataccccaacattaccgccctctgtgtggatttagagaattcggaagtagagaacgttgcccgtggattacagccctggataaatcaggactggcatggcggtcaattctactgtttccgtcggaacgatttttggcagcggagcgtgacgtcgcaagtgcaaaaacagccattgacgcacccactgccggacatcagccgcaacagttgggtgcttgttactggtgccaatggcggcatgggcgcggctatcgccgaacatttagcgcaggtttatcattgtaatctcttattgttggtgcggaaatctctgccgaaaaagcgggattggctgacggagattgaaagcaacggttcccacgcagaatttttgcgctgggtgctgagccttgaggctaagggaagccggatagagttgttgcaggcggatttgggcgatggtgaatctctggcgcaggcttttgctcccgtattccaaatggtcgcgcggggggaggggatcgattacgtgttccataccgccggtcgcggagagggcgcgatgttgcagatgcgttctgaggcggaatccattgcaacgctggctcctaaagtgacgggaacccgcttcctctgcgataacctgagtaggcttggcaatccggcgctgttgttgttttccagtctgggtaatttgctgcccaaggaaaagatcggccaaatcgcttatgttgccgccaatgccggtctggaagcctacgcggatcaaatccgcagcaaaggcggcaaagcgctggcgattgcctgggatgattgggctgaatcagggatggcaacccgctccgcacaacaattggatcgtgcacttaaaaatccggcacaggacacggcgcccgacgccccaatctggcgacgtcggctgtgtgccaaggacgactggtggcttgacgagcaccgtattgatacagagactgccgtgatgcccgcgatgggaatggtggttctggtacatcatgcgttgattgagtggcgaacggtggcggcagaggcattctcattacaggagatcgccattgaaaggccgttggtagtggctaacgacgcggagcttgatgtcgccgtgatctttgcggacgacttgaactcttttgagctattttccggcaatggcaagttttcccctgagatctggcttaaacatgccagcggtaaaattaaataccgtgacggccatactgcacgttctggcgaaaccgtttccttaaaaacccttccttcccagccaccgttcctgaacctgtttagcgccaaagataacatcggcgtcagcccgaaaggcgcgctgacattcggtccccgctggcgaaatgtgatcgccgttgaccagaccggagtcaatgaagtgttgaatctgttacagctcccctctgcctatcggggtgaagcagaaacatccggtcttcacgtcgcgttgttggacacggcaaccctcattgcctctccagaacacgaagatggacagtttgcgcctgtctcgataggggctttcactcaattcgcgcctatgggtgacagagtgaaaagccacgtccaaattcaggatctgggtgccaacaagttgttgcaggtgaatatttattctgaggaagacaacctgttagtgacaatcagtgatttgttactggttgatgcgtccgctgctttgcaacacaccgtcatgcgtttgaatgccagagaagccggaagcgtcgatttttcttttcgctcacaatccgaaacacgcaaagagcctggcccgctggaggtagaaattcaggttaaggcggcggggctgaattttaaggatgtgttgattgcgctcggcgtattgccggctcctgccgacccgaccatgacttttggtcaggaggcggcagggattgtcacccgtgttgggcggcaggttaacggtatccgcgttggtgatcgcgtgatgtgtgcgggacatagctgtctggctgaacacgttattatgccgcagcgtgttgtcgcacctattccacagacacttggctttcaacaggctgcggggattccggtggcttttaccactgcatggattgctttgaaacacgcggccaatttgaaaaagggtgaacgcatcttgattcattccgcagcggggggtgtcggcatggcggcgatgcagattgccctgtatttaggcgcggaagtttgggtgacagcgggcagtgaagaaaaacgtcgattgctcagagaaatgggcgcacaaggcgtagcaaactccagaacgcgggaattcggcgatagtttccgccgtgatctgggtgagcgacctttcgatgtgatcctcaatgcgctggcaggagaactgctggaagaaagcctctctttattggcgccgcaaggccggtttctggagcttggtttacgggatatcctgcaaaactggtcactggggctgtcaatttttgcggaaggcggcagcttccacgcggtgcaggcgggcgccgaacatcccgcctatcaggaggcttgggctgaggtcgcagcactgttggaggacgaaatccttaagcctttgccgacaaaagtttatcccgccaaagagatcactgaagcatttcagttcatggctcaggggcggcatatcggcaagattgtcatcgcgatggaagaacgcagcaaaacactcagcttcgtagaaaagctgaaagcagagggattatccaatttggaaggaacgcagatagcggtggcgatggcagcacttgtcggtcaaaccaaattgccttatatcgctgtttctaaacttcccatcggctcagtgttagaaaagcaacgacatactcagcaaatgctgttcagttctggctcaacgcggaatgtaccagccgccatcgatggagacgcagacggatcgcttaagggcgcaaatgcggatgatttattgcaggccatgcgtactattctggaaggatttctgggtgttgacgatctggacgtggacgccagtttcttctctttgggggcaacctcgctggatcttattcaattcgccaaaaaactggaacaacggctggaacgggatataccggtagcgctgttgtttaaggctgcttctttgcgggaattgagcaaagaactggcaccggaacaatccgttgcagaagaaccgcagatgccgcaacaagaactgggagataaacgtcgcacgttgcaggctcgacgcaaattacgcggcgttgtgtccggtcaggaaagatccagtcaggggagtgaagacaatgaataa

SEQ ID NO: 726 - DNA, 3186 bp, Xenorhabdus bovienii
  Coding sequence Name=Xb4151_4152.C418.gene29.dna; Position on contig =38167..41352bp; Strand=+
atgaataatactggattgatccgcataggcatttttttagtcgccatctatctcgcgctggtgggaagtgtgttcgctgacacgattgaccagaaacagattatcagccagaagcaagattctgatctggagcagatagtcagtgagttgagccgtcgttgggatattgagcaagttcccactggcggactgagtgtcatcgtcggcgataaagtccgtacatggcgactgggcaaggaagaggcagggacattcgaactcgcttccagttccaaagctttcactggattactgattgcgctgctggaacaggaaggtgtactcaaccagcaggacgcgattacacgatggatacccgagctggcggaacatccagaaatgggctactccgccgtgctacttaaaaacctgctgttccataccagcggtatttcaggcgacacaatcgatttgctgcaaccctatgatgcacctgatgctctggcgaaactgccggtattgctgcaaaaaattccgctggcctatcccgtcggtgctaaagaggaatacgctacgctgaattacagcctgttgggtctggcggctgaacgggcgacggggaaatcgttcgcaaccctgatgcgggaaaaaatctttctgcctttaggaatgaagaatacaacggtagagggcgaccggtcggtagaggggagtgccgctgcatctgcgcgtattccggggtataaaatcagttttacccgcgctcggccgtatgatgcgccccgctatctgcaaaatacacccgcaggttatgtgttcagtactccgcaggatatgggtatttggttacagttcttactgcaccggcagcctttaagtaacaacaaaggtgatggcgatgaacagcggtctgcgttatacgcggcactggagcaggcaaagcgcccttacggtggcaatggtgacgcggggtacgcttatggttgggatgtgaaaaccgatataaccacgagctggagtcatccgggtcagaaccccaatgccacagcctatgtcgcgtttgatccgaaagctggcgtggctgtttccctgttaggtaacagcaacagcccccaagtgattcaattagggcaggcaatattcgaacacctgcgtggtgcttctgcgaaaggtttgccggaaaatttccccgttgatgatggggactggatttccacggtggcggctgtgattttctggctgggtgggatactgcttttcgtggcggttatgtataaaagggagaacagggataaaggcggtcgcgatggagcaagtgttctggcgagtcgtgtggagacggcgatcatacaagagagttttgtccgatccgcagaaagcatcgctgaaaaaccggtctggcgcgcttttctcagtcggcttatcgtgcagaacgtggctcttgtgtccgtgctggcgattacaccgccgttattgttggggttaagctggacaaatctgcgggtttgggggccgttaagcctgcccgtggctgccgtggggctgctgttcttggtcaacgcggtcagcctgttcttttttctgctgacgcagcgcagcggcagatataccagcaagactttttcctcgttgatgattgcgaaagtcgtcggtctgacggtcatttccgggctgctcaattccgcattggttttattcatcattcaggctattgatagcccgcctgcgtattttctgtacagtgctattctgctgttcagctgtatttacttctacatttccgcccgtaaagcagctgaacagcagatcatgcgctttggacatgccttcgtgcagggctggcggatggagatcatccggaaactgctggcgtcggattacaaaaacatcgaacagctatcttcggggaaaatacagtccgtcgttggggaaaattcgcaagaattagcgaaaagcgttctggctttcgtgcctttctttgccaacttactgacgatcatctttttgttcacttatttgatggtgtttaagtcacctgtagccacttctgtgctgttggcctgcgctttgcccatgatcgtgctttattactgcatttctgaacgagccaatcgcattatgcctcaagcattaagtacccgtagcgaatttatggataccgtggaggatttgcagaaaggctataaaggactgcggcgtgaagcggtaaaacgcagtttctatcgccatgctcagggcgtgtcggatcgttttaaggcattgaggattcagtacgatctcggctttttaaatgccttctttatcggagagtcattgctcaccattttactggttgcggtggcgttgatgttcccgctcctgatcccccattttgacggtaatgtatcgaaagaatatctgatcattctgctgtacctcatcgggccgcttaacgcggtaatgtcggccatgcctgaactcatcaggctgaaaagcctgatgaataatatggtgatgttcagtcagtcaattcaggccgattctccggcggaggtgatgccgaaaattcaggatgtgaaaacgctcgaactgtctgcggtgtattttcactatccggcgacgggaggagagtgcttcggtgtagggccaatttcattgaaagcagaaagtggaaaaagctattttctgaccggtggcaatggctccggtaagagtacgctggctatgattctggcgggtttgtacgcacctgagcggggaacggtcaggataaatggtgaagaggcttcccagcatcagttgctggaacaaacacgggcgatcttcagcgacaattggttattcaaacgggtttatgaccctgcgttattgccgttgcgggaggctgtcaaccagaacatcgcgttgttgggattgacgcaaaaagcaacacttctgagtgatggtgctttcgacaacatcaaattatcaacgggtcagcgcaaacgtctttcgttggccatgctgttggccgatcccagccctctggtcgttctggacgaatgggcggcggatcaggaccctcgttctaaggcccgattttacaaggaatggcttcctatgttgaaagcccagaatcgtatcgtgtttgtcgtgacccatgatgacgaatatttttcggaagcagatgttctgatcacaatgaaaaatggtcagctcattgagttaaagggagagagttatgcttaa

SEQ ID NO: 727 - DNA, 6540 bp, Xenorhabdus bovienii
  Coding sequence Name=Xb4151_4152.C418.gene30.dna; Position on contig =41345..47884bp; Strand=+
atgcttaatcagttgctgtcagaaaatcattttgatcattccaaccagagccgggcgccaaaggacactatcctgaattgttgtattcatgaactgtttgagcggcaggtagaaaaaacaccggatgcggttgccgttcgattcggggagcagtcactctcttatgcagaattaaaccgcagagcgaaccaactggcccgattcctcagagacgatttgcacgttggcccggatacattggtcggtgtgtgtgtggagcgcagcatagaaatggtggttgcgttgctggcggtattgaaagccggaggagcctacgtacctcttgaccctcactatcctgctgaaaggctcgactacatgctgcatgacgctgccccccgtgctttgttgtctcatggcgcggtgccggctggggttcgcgcgctgctggatcaatacgcgatgagcacaaatgtcagcgtgatcgatttggaggccgatgtctcgcagtggtccgggcaaaacagtgataatttgcatccggcggataacgggctgacttcttcccatctggcgtatgttatctatacctctggctcaaccgggcggccaaagggtgtgatgaaccagcacgttggcgtcgtcaatcgtttggtatggatgcaaaaggcctatcggttgaatgcgagtgatgccgttctgcaaaaaacaccctttagtttcgatgtgtccgtctgggagttcttctggcccctgatgtacggcgcccgtctggtggtggcaaaacctgagggacataaagatccggcttatctgagcgcgttgattcaagaacatcggataactaccctgcattttgtaccgtcaatgttatccgcctttttggatcaggctccgtcagaagttgacgattgcctgcaacgcgtgttttgcagcggtgaagcactgccggcgcgcagtatgcatcggtttcgggagcgttttgctaaggtcgaattacataacctgtatgggccgaccgaagcggccattgacgtcaccgcctggaattgctgccttgatgaaacggatagcttgatcccggaaaatgtgatcccgataggtaaaccgattgataacattcagatttatatcctcgatgctgacggccaaccgtgcccggtcggtgtggcgggtgagcttcacattgccggtgtgggcgtggcgcgcggatatctgaaccagcccgaactaacagcggaaaaattcatcaaaaatccctttagtccggcattaaatggcgtcatgtaccgaacgggggatctggctcggtatttacccagcggcgacattgaatatctgggacgtaatgactttcaggtcaagttacgtggcttccgtattgaactgggtgaaattgaagcacgtctgatgaagcatccggccgtacgcgatgccgttgtgctggcgcagggcgagagtgcggaagataaacgcttggttggatttgtcattgccgcggaacgcgccttacagcgccagtccagagagagcgtgaaagagagtattcaacggcttatcaacgatacggtgcccgattacatgaggcttgccgctattgttattgtcagcggatttcctttatccgccagcggtaaaattgaccgcaagtcctttccggtgatcacttttgatgaattcacagcacaagacgttgaaccgccgaaaaatgcgttggagcaaaccttggttgaggtgtggagtgagctgctcggcgttaaaaacatcggcagaaacgcccacttttttaacttgggcggccactctctactgtctctgaaaatggtactggcgctgcgtcgtcgtggactctttgtggatggctacacgctgtatcagtatcccgtattgtccgaactggcgacacagttgcaggtgtccgatccacaggaaacccgctctgacatggcggaatgctctatggtggaagcgtccgcctgggcgcaactcagccaaaaagaaatcgacgttctgactgccgccattcccggaggcctcaccaatatccaagatatttatcctttgggggcattgcagcaggggatgctctatcactatctgacgaatttggcgggagatccctatgtgctttggcaggtcgtccgtttccgcaatgcagacttgctgcacgcttatgttaacgccctgcgcggcacgattgcccgtcacgatacgtttcgggtcagcgttcattataaaggacttagccagccggtgcaggtggtttggcgggacgctgaattgacggtggaagagctgaaacccacgatggattgcgatgatccgttggtcatcttgaaacagcattgcgatcccgccatgctgcgttttgatatcactaaagcacctttgcagcgttgtctttattgctatgacccgaaacgggacgaatgggtattgctgcatttgatccatcatatgacggtggatcacacgacggtagaaaagatgcagcaggaaatagaagcgcaactgagttcagaaccgcctgctccgattgtgcccatatcgttcaggcaggtgaacgcggatcttgtccgtgcaactggcgcggaagcgcaaaaagcattctttgacgctatgttgcgggattatgagccgactccggcaccgtttggtgccggtgaatacttagggggcaacgcggtggtggtggaagcctggcgaccgctgcaagaacgtttatgtagtcagatacgccaacaagccaaagcacacggtgtcagtgcggccgcagtttttcatctggcttgggcgaaagtgatcgcctgcctgaccggatgcaacgatgtcgttttcggtactgtcttactggggcgcatgtttgcaggtgaaaacgctgaaaacatcatggggccgtttatcaatacgctgccgatccggatacgtctggataaccttgctgtttttgagtgtctttggaatgctcaggatactctgacgcagctggtcaggcatgaacaggcgtcattagcgctggcacagaaatcagtacagacacagggaacagcgcctctgttcacttcattgctgaattatcgtcacagtgaagtgcgcaatattccttcggcagatccttttcaggcaatgaatccttcctccataaatggagtcagttattccggcagtatggagagaacccattatccggtttccgtcaatattgatgatttcaccaacgattttgttattaatgcacaggccgaacaggggcttgatcctgaacttatctgtgactacttgcagacagcgttacaggaaattgtcaccgcgctggaaagcgcaccagagagaagaattggtcggattcatgtcttgccggcgcaggaaaaagataaattgctgtggcaatggaatcagaccgaatctgattttccgcgacagacttgcctccataccctgattgaggatcaggtgcgtcggacgccggatgctattgcggtggtgttcgaagaccaagtgctgagttatgtgcaattgaaccagaaagcgaaccaactggcccgattcctcagagaagatttgcacgttggcccggatacattggtcggcgtgtgtatagaacgcagcatagaaatggtggttgcgctgctggcggtactgaaagccggaggagcctacgtacctcttgaccctcactatcctgctgaaaggctcgactacatgctgcatgacgccgctccccgtgcgttattgtctcatggtgcggtgccggctggggttcgcgctctgctggagaaatatgcgatgagcgcgaatatcagcgtgatcgacttgaaggcagatgcattgcaatggtccgggcaaaaagctgatgacttacatccaactgacagcggactgacttcttcccatctggcgtatgtgatctatacctctggatcaacgggacgaccaaagggcgtgatgaaccagcacgttggcgtcgtcaatcgtttggtctggatgcaaaaggcctatcggctgaatgcgaatgatgctgttctgcaaaaaacacccttcagtttcgatgtgtccgtctgggagttcttctggcccctgatgtacggtgcccgtctggtggtagcaaagcctgagggacataaagatccggcttatctgagcgccttaatccaagagcaccggataactaccctgcatttcgtgccgtcgatgctgtccgcctttttggatcaggcaccgccagaagtgggtgattgcctgcaacgcgtgttttgcagcggtgaagcactgccggctcgcagtgtgcatcggtttcgggagcgttttgccaaggtcgaattacataacctgtatgggccgaccgaagcggccattgacgtcaccgcctggaattgctgccttgatgaaacggatagcttgatcccggaaaatgtgatcccgataggtaagccgattgataacattcagctttatatcctcaatgcttacggtcagccgtgcccggtcggtgtggcgggtgagcttcacattgccggggtgggcgtggcgcgcggctatctgaaccagcccgaactgacagcggaaaaattcatcagagatccctttagtccggcattaaatggcgtcatgtaccgaacgggggatctggctcggtatttacccggcggcgacattgaatatctgggacgtaatgactttcaggtcaagttacgtggcttccgcattgaattgggtgaagtggaagcggcgttgttatcgcatgacagcgtgaaagagtgtgtggtgctggtgcgtgaggatgtgccgggcgatgctcgtctggttgcctatgcgacccctgcttccggctacgtcgatcaggttccggaggagcggagtcaaacgctgagaatgcacttacagacgaatctgcccctatttatggtgccgtctcacttgctttggcttgatgcgtttcctctcactgcgaatggaaaactggatcgtaaagcgttgccatctcctgctgatgccccgatggggcaaacaataaccgtacagcctccacaggaaggaacggaaactcaattagcccagttgtgggccgagttactcaatctcaatcccaatgcgatcggacgtcaatctcacttttttgaagccggagggcattcattactggctgtcgctcttatggcgcggatacagcaagcgttcagcgtgtcattgctgctgagtgcgatagtggaacacttggatttggcttcgcaggccgagcttatcgagactgaaatagaaaaaggaaacgcagcaagggaaaacggggagcgagcgcatttaaccgagccaatcgaaccgacgcctgtcgagcagatccgggcgttaccaacgcaaaaagccatatataaagcagtaaaacttaatcctcaagacttaagcaataacagttttctcgcgttgtcgttcgacgatgatgtggagccggatcttaaacaactgcgtaatctattgcagtcggtactttcccgtcatgaaagcctccgggcgcaatttgttcttacaggcgatgaactctatttgcgccctgccaagcgttttttattccggctggagaaacgtcaaactcttggcgctctggaagaagatctgcgcgattttatccgcccgttctcgctggaagatggtatgaatgttcgcggtcggtgggttgttgatgggcggcatccgcttttgctgttggatttttcccacgcctgtattgatggttctggtctgatgcaaatactcagcgagttagccactgaaaatgaccctgctccttcgggaacccgtctggcaacttattctgagcttttctacagccgtgaatttaccactctgcgacaagaacacgcggacttctggcgaacgcagttacaggagtggtcgccccttgtgcatgcgcaggacaccgagtcagtcacgcacacttgcctgattacgctcgacacagggcttaaagggcagattgaaacgctcacgtcacgattaaagatcagcgttcctgaattctttatggccgcattcttgttgtttaaagcccgtctggattatcagcccgctcaacgcaatccgcacgatcaactgacgtccatgatctttcatggtcgggacaggttggatcaacagacggtcatcgtgccattgatgtcggttctgcccgtgcgggtaaggttgcggggcgagacgatggaaccggagatgcttcatgaagtgagcatagcggtgcgcgcggcctgtcgtcattacctgtttgatgccgaagaattgacggtacggtatccggcgctggctaaacaggtattatcccccacgtcttttttcggttacttccagaaagagggctttgacggccgtattgcaggccggctctgccggcagctggaaacgcccaatgttgcaggcgggcaatcgcactggaatctgacctgcgaaattgccgagcataccacgggctttgacgttcatctggaagcgctctcgttcagtacaggaagcgacgcaggaaattgggaagcgctgtttaagtcgattgtgcaaagtgcgctgagtgtcgggtga

SEQ ID NO: 728 - DNA, 6543 bp, Xenorhabdus bovienii
  Coding sequence Name=Xb4151_4152.C418.gene31.dna; Position on contig =47913..54455bp; Strand=+
atgcacactaatgatcccattgtgatgaatgcaagaaaacaagcattaaaagattatgttcgccaacaactggatgccggatatcagggatgtcccttttttgtgtctcggctggcggcctcggggatgaacacagaggttgtcacgacgtcattcactcttgccgaaccactgaacagcagaattttcactatggcggcgtctccgctgcatcgtttgtcgctgttttccgcctgcatcaagtatctcgcctttttgcacagccgggagccggaagggagcttgatttgggcgatcggggcgcaagataggtcgggcaacggaacaccggcggttttgtccaatgaccctcccgccggagtttatctcgtcccagctaaatggcatctgacggaaacggagctgacacaaccggtaaaacggctgtttggtgaggagcttgcgcaatggaagcgaatagccgcgttgacgtccggcatgcctttgcaatcggcgtcttctgttatgtcgcaatcgccgcaagtgttggtaggttactctgaaacacagacaccctttgagggaacagatacggcgcattattcactgagtatctggatcgaagcctgtccccaaaagacctgtctgcatatgagattcgattcgcagagggtggacgcagaactgacatcgcttctgatggatcgcttgaccttgttattgaacagcatggtattcgagccaaactccccgctcgcgtcgatgccctggatgccggtgcaagagcgggagagaatcgctgcgctgtccgcccccgtacccgcgcagccactgaggtacaaaaatgtggagcaggccatgaccgcctccatgcgcgacagagctgaaacccagtttctggaggtcggtgatcagaccgttaactttaaacagttggagcagtacacggctattttgttgaccgatcctaatttgccacaatgggaatcgttaggcgactgtgtgcttattgtcggcgccaagggagtggaaatcacactcgccgcaatggcatgtatgcgtatcggtaagccgttctgcctgcaatcccacagcgcgcctgaaagccagttattggacatcatcgagctgcataacaccaaggtggttctgctacaggaaagttgcggtgagatggccgaactctttcgcgctcagggctgtcaggtcgttatgctgccttattatgtaccggatgcgccagtcaggctgacgcatcgaacggagatgtctgttctggcggcgttgctgcgcaaaggtgaggcagtcaatcccgacgacccattgtgtgtggtgatgacctccggcagtgagggcaaaccgaaaggctgtatcaatactcacaaagccttacttaatctcagtgctgaaaaacaagccctgtatcacaccgccggctccagagttgcctccgtagcgaatcatacttttgattatttcgtactggaatgtgtgcagtgtctgactcaggacatcgtgctggtcatgccgccggaagaagcgcgttcagacgctggaaaatgcgtcagatttctgcgggaaagccgcatcgatttattgttcaccacgaccgtgctggcggaatacatcatggagcagggagatattcctaacttgcggcaattgtattttggcggcgaaagtctgagaacgtttcaaaaaaataattacgagctgtttaatgtatacggccccagtgaaaccggcgttctgacaacttatttatccatagtgcgtaatgaccagaaagtcactatcggtaaaccgttcggcggctgccagtgtgttgtggtatttcccgataccttagaaccctgtcctatcggtgtatcgggtgagttgttgataggaggagccggcgttggggcgggctacataaatcgccctgatctcactgaaaaggcgttcatagatctggatacggaatggttgaaggggaaatattatcgcagcggtgatctctgttgctggaatgttcagggtgagattgaaattgaaggaaggcgtgatcgccaactgaaagtgaacggtttccgcatcgaattggatgccattgaaaaaaacatcttagatctgccgacggtggctcaaacggcagtgattggcatagaagaccagcgggggcacactcacgtaggtgcttttatcgtaacgacggacagtggggtcacggaacaaaacgtcagagaggcgttattaagccggatgcccgcttatatggtgccaagtcaggtgattctggtagcggaattaccgctgacgcgcaatggcaaactgaatcgacaagggctaaaacaggcgtttggcaaggcgatgaacggtaaagttgtccggcctgacggggcaacccaagaatggctggcagcctgttgggcgcggtatttggagttggatgttgacaccttgtcggtagacaaaagttttttctctctggggggtcattcgttacgggctgcaagggttctggcggagattcaacatgaatttgggcaggctgtctctttgttggaattttttcaaaacgatacgattgaggcacttgcgaaaacaatcgacgccagacgaaccggcggtgacagcatggtgacggagagtttctcaaatctgctggaaaccgcacctcagtttgcggttgacgggcgtgggccgttatcggcacaagaagttcggctttatgcagaatatcgtctgcatccagaatcacaggcttatattttggcgctggagatcccgctatcccatgacctctttcctgatgcagtgaaacaagccctacaggctctaattgaccgccacgatattttgcgtacccgatatcgtattgatagtgaaggtattccctatgctgagatattaccgtctctgccggttgacagggtactgatcgatgatcggaatcagtggttgcagatgcggacgcaggctttcgagttgggagaagcccctttgttgagaggctgtctacaggaaataaacacagagcacgcctgtttgcagttacagatccaccatattttagtggacaaaccttcgttggagatcctacagcgtgagtttcagcaattgctggcgcacgaatcgttgtcttgcgtggcactgagttacaggcactacgcaatggcattagcggatgcccgtcaacgcccggtctggacacaggctgaggcattctgggtagactatcttgaagggctggaattcgatccgttcggacatggcgcggtggatgcaggtggcaaggtgaaaaccctatcctggcatctatcggccgcagatatggcagcagtgaaacatctttgcggagccgtcaacgtgactccggccatgtttttcctgtcggtgtgggggcttactgtggcgcgcgaagggggaagtcatgccttttccatttcagtggcgaatgcatttcgcccaaaaaatgcgctggagaccgtgggtatgttcgtctcgttatccccttgcgcgtttcgttttgataagccgacagcaacctttgaccgatttattaagaaattggccgatgagcagtggcgtatggtggatcagcttttttttccggttgaagaggcttttgcattgctcagccgtgatcccaggatgtttggcagcaatccactgcttaatgtcgcttattcctatcttgacgcagcagatcatgaagcgccggatgcagacgatttatcgctggaagcgcatgggccgctcaatcttaccgtcagccatcgtacgcaaggtatacaaaagacacaaagttgccgattgacactggaatatcagatcgaggctttccctgattcacaaatagaagccatcgcaaccggctatcaggaaattttgcggcagatcttgagtcacgctccttccattttgcagattgatgagctgatggtgtctgctgatgcagttaaaaaggcctttcggccagtacaacgacgtgcgtcgtatcgccaaatcgatgccatgctgattaatgggtttctgacattgaccgaccgtcccgcagtgattgatgaagaaggcatcatgacttgggaagaattcgctgcattaaccgctgcatatatgcaggttctaaatcaggggacgattcgacgggcactcattttaggacgtcaggggcgtcaattacaggcatttctggcggcgtgtttcctgacgcataccacttatctggcactcgaaacggggacgccggaggagcgtattaacgaagtgatccgccatgcagagccggatcttgtgatcatgcacggagcggaaattgacgcggcggcggtgtcagagatgggtgtgcaattgcaggataataatctgcttgctcctgtttccattaattggcaaggctttcacagcctgaagtcctgcgacgataatcctatcgcatggatattgtacagttccgggactaccggcaaacccaaaggcatctgtgttgccgcgcatacggcggcgcagtatgtggattcactcgtcaataagctggggttaaagcaagaattgcagacaacgccgcagggattgcggattgtgcaacagttctcgcccagttttgacggttatcttgaagaagttctgctcgcttgggcgttgcagggaacaagtgtggtcgctgaccgttacagtttattggatgaacgcaaggtgagggcgtttttacttcgctactgccctgatgtcatttctgcggctccggctcttttctcagcctggaaccgtatgccagagttggcacctttgcccaagatctgcattagtggtggtgattttctcgctgccggagatatcagccaattactcgaacgtacacagatttggaacagttatggccccacagagacctgcattgctgtatcgatggtgaactgcactcagttggcgtcaggcgcggcactttccatcggagaacccttcgaacatgccgcttttgccgtgatcgatcaggatggcggccggcttcggatcggtcaatggggagaactggtcatttatggggattttgagcgtcacggttatctgaatgacccggcgctgactgcaagtaaatttggccgggacgttcagggaacgttcttccgtaccggcgatttagcgatggcggacaaaaacggcctgttttacctcagagggcgaatggatgatagctgtaaagtgcgagggaatttcatcggcttgggcgaattggaaaaccgagccggacagtatcctgatgtgattgcggcgggtgccgcagtggcgttcgccggaacaccggaggcctgtctggtactggcgattgaaggaaaagagaatatacagtcggatctgcaacagtatctggcgcgacattatccccgttcccacttgccgtcggcgatatttccgctggcgtctttgccgcgaaccgaaataggcaagctggatcggcagcggatcgtggcacggtttctggaatggcgtgaaaacacgcaccaaacacaggaggagcaggtagcaacaatgagcgagggagtgcaaaaattaatcgcctgctggaggacatgtttgggatataaaggggagttgacacaggattctgacttctttctggtatccggatcatccctgagtgccgtgcgactggctaatcaactggaaacgctgttcaacgtgacattcagccccgtcgatgtgttccgcaatgccacgatcggcgggcaatggtcgctgatcaacgcacggcagggagcggatgacacaatgccagtgaaattgttacaagagcgttttctgaacgccgatgatcctaacattgccaaactgatactgttgccgccggcgttagggggattgattgaattgcaggcgctggcggacaaattggccggtcgcgtcaccgtgtctgttttaacaacggaaccccgcgatgttgaaaacctgtcagtgcaggaatttaaacaggcgttgctagatgctctgacatcgcacattaaagcgcagggcatacacccgtcacgctcactgtggttgggcggctattcccttggggcggagatgctggtggcattgctggcgcaacaagcggaactatcgcagccatcgcagcatttttcccaatacatagacaaattggtatttctcgatcctaacctgcgcaccgatatttttgcgggggatgagctgtatgcagagttcgttgagttctttcgcgatgttaatcggttggcttttgattgtgcaggttttgatgccgatatggatgttgaaacattgcggcggcagtttccttcgctctatcaggagtggcgctattaccaattacagcatcagatccttgaaaacaagacattttatgagcggattctggctctgccatcagaaaatctccctgtcgcgatgttcttttccgacgatgcagacgaagccggtattgatggacttacgcaaaaaatgaaagggtgctgcaccgtccggcgtaaaagcggtgatcacgctgaattcgttaagcaattaacgtccgatgactttatcgatctggaacagggtaagacattatgcgtacagaaataa

SEQ ID NO: 729 - DNA, 5010 bp, Xenorhabdus bovienii
  Coding sequence Name=Xb4151_4152.C418.gene32.dna; Position on contig =54440..59449bp; Strand=+
atgcgtacagaaataagagaagatttggatatcgctgtcatcggtttatcaggccggtttccgggagcagggaattacagtgagttctggcgaaatttactgatgggcgtggatgggatctcccgctttacggcagaagaattgcttaaagcagggcatgatgccggcaagatacgtcataaagacttcgtgccggttaacggagtactggaaggtgcacagtatttcgatgcggagttcttcggctacagtcaggcagaagcggcgcttttggatccgcaaacccgtttgatgatggagtgcgtttggcatgctttagagaacgccggcgtcgatccggacaaacggagtcgtaatatcgggctgtttctgggggcgcgtagttcggtgcagtggacgatgcaggcgatgttgtctgaacaggttgagaatacaggcggctttcttgcctcccaattgtccaataaagatgcgatgagtacgctaatctcctggaagttaggactggaaggccccagtttcaccttgcagaccgcctgttcaaccagtttggtcagtgtccatcaggccgtgcagagcttgttgagtggtgaatgtgatttcgccgttgccggcggagtcagcctgctgttaccgcagcaaaacgggcatacctatcaagacgggatgttattttcgaaagacggcaagaccagagcgtttgacgcggaggctaccggcagcgtgttcggtagcggactcggcgcggtagtattgcggcgggcgggagatgctattgcggataacgatcctatctgggcgatcctcaaaggctctgccattaacaacgatggtgcccgcaaggtaggctacaccgcgcctagcgttaaagggcaggcggaagtgattcgctctgctttgcagatggcagaggtagacgcggcggatctggatttcatcgagtgtcatggcacggcgacctctttgggagacagcatcgaatttatggcgttgcgtgaggttttcaacgaaagaggatcttccgccagtgcagaggagacactcaatcaatgtgcattgggtaccgttaaaaccaacatcgggcatctggattctgccgcgggtatcgcgggtttcattaagatggtattggcactcagacatggcatgataccgcccacgctgcatttccaacggccgaatcctcaattggaatttgaacactccccgttttatgtcaatacccgcgctgaactgtggccgtcaaaccaagggaaattgagaaccggtggcgtcagcagttttggtattggcggaaccaatgcgcatatggtgttacagcaatatgtgctccctccgcagaccatgaagacaagcggcggtgacaaagtacccggagtctgtttttttccgttttcagcaaaaaacagcacttctctggcacggcaactggaatcagtatcccagtggttggtttcacagcccgatccggatttatccgcgctgtcccataccttgggcaaacggcacagttttccgtatcgagccgtgtttgcggcagattcgaagtttgctctgatgcagcaaattgaacgctatctggcaccggatgaacagacggagagtctggcgctggttcggcaagtcctggaaacgacatcgccggatagtctctcagagaattttgctgctatcagcgactgggtatccggtcagacaaaagagcttgagaaatgtcttttcagccccggtaacggacaaccgttgatggatgtccccggatacgctttcattcgcgaggagcatggaatcggacacattacagataaaatctggtcgcagattgccgatatcgtcgcggcacctgatggcaaagatctgtctaaaaatacggcgggtctgctaacaccattctggaaacctctacgcttgccggcacaaccgatgtcggaggtgaagccggataccgtgctgctggttgaccagacgttagcgtctcttgcgagcgggttggcagacaacagtcagattgaggttgtcagtctggatatgctgtgtccggtacggatgcggaacgttctggcaaaattgtctagtggttcgcaaataacaggttcgcaaaagaacccgtctctggtgttgtcgctggcgtttccgacagagggtttttcttttgcgccagcgtcactccaaattttatctgaattaggccgggcgcttgcggagactgatttctccgtgtttacttccgtgcatatttatttgatcgcgcccgctttctccatgaccggcgataatggatatctggctgaatctgtattgacggtggcggctcttaaagcgttagcgttagtgatacctcaggagattcccggtgtcagttgtgcgtttctgagcattcagaatcccagtacagattggacgcccgccgcgctgaccagactgctgcaaactccgttgcacgggcctctgaaacttaatgatgaggggttgtttgttgaagatttccgttgtccggatgcggaagaaaatgacgtgttggatgcggcgtatttcagcggaaaaacttacgtcattacgggtgctggcggcaggatggccaaggcgatggcacgggtgatcgcacgacgttttcagggacggttggcactaatcagtcgccagcctgcggactctcctgccatgaggagtttacaggaagagttgaaggacgcgggcgctgaggcggtggagatttttccgtatgcactggaatcggaagccgacgcattggcgctgtttgagtccattcgccgtcgttttggggagatcaacgtggttcttcacgccgctggcgtcacggatggtgattccttttcccctctggttcaactcaatgccgaccattattgcacgcaactcgcgccaaaagctcaggtggcggcagtactcgccaacgtattcgaaagcattcccgttgaatattgcttcgtgacatcttcgatgtcggcgtttttcggggggattgcccatgcgccatacgctgcggccaatctgtttctggatggttgggggcagatgcaaaacagacggttgacaggaacgcgttgggttgttgtgaactgggaaacggttcatttcgacgaagatcgtcgggctgatgcactcgtctggggtgccaatgaagttgctctctctggcgctgagtttcctgctctgtttgaacgcagcttgcgtgaatatgatcacgaaaaccagaaaattttctctgccggccagtttatggatagattgtatgcctggggaggaagacgtgctgccaagatcgatcacagaccgcaggccggagggaacgtcaaattgaagcccagaccgaaaacgctgacttccgtttatcaatcgcctgccaatgagatgcagaaggaaatcgccgctatatggagcagtattctcggtattgacggtatcggcattgatgaccgatttatggaactaggcggcgacagtctgaagaccattgtgatggcggaaaaagtgtataaaaaactcggtaagcgagtttctattcaggactttttttcacagcccacattacgggagattgaacgacagttagtcaacgaccaaaacgcttctcatcctatcttgccggccatcgacccgtctgagccaattatcgccagcgctgatcaggaattgttgtatatacatcaaaccacgtttaccgacgccagttataacatgccaatggctttccaatgcccggcggcgatcagtgcgatcgccatcgctacagcgatagaacaagttgcagaccggcatccggtcttgaaatgtctgtttaaaaggcaggggactaatttgatgatgctgcctcagcttgacgctaaagtcagcttggccatatttgaggctgaacccgcgcaggaggaaaatcaggctcgcctcgaacagtttgctaaagccccttttgacctgcataccgaactgccaatgcgcgccatgatgataaaaggtacggatgccggccagttccatcaggtgttgatcgtcgtccatcacatcgtatgcgatgcggtttctctgggcatactcgcccatgattttcagaataggcttgaggagcgtccgttacctgagccggagtacagtttcgcggcctatcggcgctataggctggagtttgagaacgaagatcaggtgcggaaaaataaagcctattggctcgccaatctattgcctttacctgcgtcgctggtattgcctacagtagatgattatgacggacatatcgacgccgacagccatcggggagtaacgcgggttaaaagtctttctgcgcaaaccagcgaagaaatcaggtgtttttgccgtgatctggggctccctgtatttacctttttcctcgggacattcggggtgctgatgacgaaaatcgcccgtgccgaatcctttcttctcggtgttcccgtcaccggacgcacacagccggaagaattggcgctggtgggctatcttgtcaatatgctggctctgaaaattgagccggatacggattttgccatgacggattatcttctggagcttaatgcacagtggtctgaaagcatcccttatcagacttatccgatgagcgcgctgctggatgatctgagtactgagcatgacttccaaaaccgtcaaggcaaacatccgttgttcgacgtggttttcgggtatctgccactgagtctgagcggtgcggatgaatccgcgtggcgtcccggattttcccgactggaactgacgtcagatacggccaaatttgatttggtgatggaaatatccgaaacccaagagacatttgattgcacgatacaatttcgtgaacgcatgtttagtgaagccatcattatggcggtgtttgagtacttcttcgcgttgatagaggaagtactcaccgatcctgatacggaaatacaggaattactcaagaaccttagcggtgagcctacgccggaaatgtccgctcagacgagcggccagaatgtggattcagagtttaatttttag

SEQ ID NO: 730 - DNA, 1098 bp, Xenorhabdus bovienii
  Coding sequence Name=Xb4151_4152.C418.gene33.dna; Position on contig =59463..60560bp; Strand=+
atgagtctttttggtaatacatggaatgcgctcggtgatgtcgcgatgtgggcgtttgaagaaatgagtatttatcggcgcaggcaggggacacagcgagaggttggcaacaacgatgcactggcgcactttgaggcggctgaatatcgcaaggtggagaaagtttcggacatttctgtcgctgagttcagcgaacgctacttaatgaagaaagaaccggttattgtcactgatggtttgagaggctggcgagcgaagcaaatctggagctttgattacttttgtcaggagttcggcgatatgtccgtacgattgcaggatgcgggattcaaaccgaaagaccatgttgagttgcgcacctatttgcgggaaatcgcgtcattgcctgccgttgaactgggcgaaatgggggacaaccttagctatctgcgatacacctacgattcattttttaaacacctgctgttcacttggggatttggtcacagggtgaaaaccaactcgttcagttttctggcgtttcaacgcattcaggagcattggcgcagaccatattttctgccggatggcggttataagatcccctgggttcagataggatctctgcaccccaacaagcggatgtgtcaggattggggactctatttttctgctccgggagcgtgtacccgtttacatgtcgatggtatgcgaaccaatgcggtgttgtgtcaggttgcgggcagaaaagcaggctggatcttttctgcttcgcttgaaaatgtggtcagagatgctgctgaaagtcgtattgctttatcacccgtcgcctcccaaatctccggtagaaaaaatcaggcagattcaccacacagcaaagattgcatatggcaattcgatttgctgccgggtgagattatgctgatccccaaagggttagcccatgaagtgcataccttatcgccgagtatttctttgacttataactttgtcactaattcggaatatcgtgattacttcaatttcaaacgcgagcgcggccatggctggatagcaaatgcaccgattgccgctgttccagaattcgcccgtatttaccagcgtaaccagaggctttag

SEQ ID NO: 731 - DNA, 729 bp, Xenorhabdus bovienii
  Coding sequence Name=Xb4151_4152.C418.gene34.dna; Position on contig =60744..61472bp; Strand=+
atgcctttattttcacaaacaataactgatttttggcagaccccatttttgaacggagacgttctctatagtgatggaacctttacggtcactgtcaaccctgatctgaacgaagatcgtcgggtcatggtgctggaaacttccgacggccgagtgatggcggttctgacgcctgcactggctgataaggccggtctttatcaacagcaagagctgtctgaatcgattttccgccagaaattgactgaagcgggcgtcacgctgcatggtgcagattatattttttatttttcagaagtggataagaacgttttgctgcaagagagtccggcaggtgtcttgcgtcagttaacagagcaagatgaggcggttttctccgaattcgaatcatcttcctcagaacaagacttggatgacgcttatgtagaattggatcactgggcggtgttcggctcttttgaacagcatcgtctggtcagcgcggccagtatgtatccgtgggagaatgcgcaaattgcggatcttggtgtattaacgctgacatcttttagaggcaaaggccatgccagcaaagtcgtgcgttcaatcagtcaatatgcctgtcatcagggctatgaacctcagtaccgatgccagctcgataactatgcgtctacgtcattggctaaagcggcgggattgacgctgtttggcaagtgggaagtgatttctcctgattctactgagtga

SEQ ID NO: 732 - DNA, 852 bp, Xenorhabdus bovienii
  Coding sequence Name=Xb4151_4152.C418.gene35.dna; Position on contig =61543..62394bp; Strand=+
atgtcaaaacttaaaatagctgtggttggtggcggaaatattggttctagtcttgctttcgattgtgcgttgcacgggcatgatgttgttgttatcgaaaaagatgttcttgcctgcgaacagagcagggaacgcgtcacggaaacggcgggttatgcacctttgttcagtccgctcgctaaaggaaaaacaaccgaggagatactgctcaacatcgtctggtcgcaggatttgcaagctgtgtcggattgtgggtttgtggtggaaaacatcacggaaaatatcgagcttaaacaggcattatatgcccgtatgtctgagtttattgcaccccacgcggtattggcggcgaacacttcctgcatccctatcacaaaactgggatcgtttcataaaacgccttctcaagtgattggtgtgcattttatgaacccggtttatctgaagcataccgtcgaagtgattgtcggtctgaatacttctgagcaaaccaaagcgcgatgtctggaaatcttggggatgttgggtaaaaacgccgtcgtagtgaaagatggtcccggtttcgtctctaaccggatttcccatttatttatgaatgaagccgctttcaccatacaggatggcgttgctcaacctgcggatgtggacgctatctttaaacaatgcttcggccataaaatggggccgcttgaaacagcggatctgatcggtattgacacagtggttaattccctcgatgtactttaccagatgtttcaggattcaaaatatcgggtctgtccgctgatgcggacaatggttgatgcgggacgtttgggacgaaaatccggccggggtttttacacttattaa

SEQ ID NO: 733 - DNA, 189 bp, Xenorhabdus bovienii
  Coding sequence Name=Xb4151_4152.C418.gene36.dna; Position on contig =62515..62703bp; Strand=+
atgacgacgctatgtaagaaactatgtaatttaacctgggatcggtttaagccattacttgaagtcctgttttctcggtatttgagagattcagtgatggcttttttggcttcaaacaataggcaatcaaaccggcagtgtcgcgttaacggcggcaagttagcaaaagtggtgttgccggttatttag

SEQ ID NO: 734 - DNA, 696 bp, Xenorhabdus bovienii
  Coding sequence Name=Xb4151_4152.C418.gene37.dna; Position on contig =62700..63395bp; Strand=-
atgtccctgatccgaaacgcgtttaaacgcctccattatcctgtcgatatcatggcccaatgtgtccgttggtacctcgcttatgccttgagtctgcgcaatctcgaagagatgatggcagagcgcggcattgaggtcgaccatgccacaatacatcgttgggtgttacgtctggtgcccctgctcggcaaggctttccgacctcgcaaaaagcccgttggctcccggtggcgaatggatgaaacgtatatcaaagtgaaaggtcagtggaaatacctttaccgggcggtcgataccgacggtcagacggttgacttcctgctgaccgctcgccgcgatgcaatggctgcccagcgttttttccgtaaagcgatacgcctgcacggcagacccgccgtcgtgactatcgataaaagtggggccaatactgccgcgctcactctcctcaatgcggaaggatcgcctcagcaggggattgaaatccggcaaaataaatacctgaataatctggttgagcaagatcaccgcaatatcaaacgtcggatacgacagatgctggggttcaaatcgtttcgccgggcacagacgctcctggccggcatcgaactgattcacatgatacgcaaagggcaatatcaacatccacaaagtgatggattatcacccgcggaacaattctatttgctggcggcctaa

SEQ ID NO: 735 - DNA, 276 bp, Xenorhabdus bovienii
  Coding sequence Name=Xb4151_4152.C418.gene38.dna; Position on contig =63534..63809bp; Strand=+
atggctaaagtagaagttgattgtcgttattgtcacaaatcagaagatgtcaaaggacatggaaaaggtcatagaggttatccccgctaccgctgctatgcctgcagtaaagtctttcagttggcatacacctatcaagcttgcaaaccgggagtcaaagagcagattattgatatggcgatgaataacagcggcatccgtgacacggcccgcgtattgaaggtggcaacagctactgtaatgaaaacgcttaaaaactcaacccccggaacgtga

SEQ ID NO: 736 - DNA, 306 bp, Xenorhabdus bovienii
  Coding sequence Name=Xb4151_4152.C418.gene39.dna; Position on contig =63806..64111bp; Strand=+
gtgacgacgcttcctcttgacggggatgacattcatcttatctgtgaagtggatgagcaggggtcgtttgtagggagtcagaaaaatcagcgctggctctggtatgcctgggagccgcgtatgaaacggatagtggcacatacttttggggatcgcagcagaaaaacatgggaaaaactactggcactcttgtcacccattaatatccggttttactgtacggatgattatgccgtttatgattgtcttcctgaagaagcccatcttactggaaagatatttacccaacgtatggtcatgtattaa

SEQ ID NO: 737 - DNA, 276 bp, Xenorhabdus bovienii
  Coding sequence Name=Xb4151_4152.C418.gene40.dna; Position on contig =64156..64431bp; Strand=+
atggctaaagtagaaattgattgtcgttattgtcacaaatcagaagatgtcaaaggacagggaaaaggtcatagaggttatccccgctaccgctgctatgcctgcagtaaagtctttcagttggcatacacctatcaagcttgcaaaccgggagtcaaagagcagactattgatatggcgatgaataacagcggcatccgtgacacggcccgcgtattgaaggtggcaacagctactgtgatgaaaacgcttaaaaactcaacccccggaacgtga

SEQ ID NO: 738 - DNA, 423 bp, Xenorhabdus bovienii
  Coding sequence Name=Xb4151_4152.C418.gene41.dna; Position on contig =64428..64850bp; Strand=+
gtgacgacgcttcctcttgacggggatgacattcatcttatctgtgaagtggatgagcaggagtcgtttgtggggagtcagaaaaatcagcgctggctctggtatgcctgggagccgcgtatgaaacggatagtggcacatacttttggggatcgcagcagaaaaacatgggaaaaactactggcactcttgtcaccctttaatatccggttttactgtacggatgattatgccgtttatgattgtcttcctgaagaagtccatcttactggaaagatatttacccaacgtatagagagaaccaaccttacccatcgtacccgaataaaaaggctgaatagaaaaacaatcggttattccaaatctgaagaaatgcacgataaagtgataggcactttcattgagagtgaaaactatatttag

SEQ ID NO: 739 - DNA, 192 bp, Xenorhabdus bovienii
  Coding sequence Name=Xb4151_4152.C418.gene42.dna; Position on contig =64828..65019bp; Strand=+
ttgagagtgaaaactatatttagtgagcattctaactatttaatacacgacccaaaatacggaagtctggctgtggcccataatcgaaaacctactccaacgggcgtggtcggaaacctgtttttggctggaaaaagcccaagcgtatttatgtcagaacgcgttcaaaacaccacaaagaaaatcatgtaa

SEQ ID NO: 740 - DNA, 282 bp, Xenorhabdus bovienii
  Coding sequence Name=Xb4151_4152.C418.gene43.dna; Position on contig =65534..65815bp; Strand=-
gtggaattgaatgttcaaatagatcatgtgcatcttttagtaaaaattccgccaaaattatcagtatctcaagtgcttggtcatctaaaaggccgaacagctattcgtctatttaataaatttccctatttgagaaagaaaaagttgtggggaaatcatttttggtcaagaggctactgtgtagataccgtaggtataaatgaagaaatgataaggaagtatgtgaagtatcaagagaagcacgaacatgaggacaatcaattatcgttgaaagggatgtga

SEQ ID NO: 741 - DNA, 660 bp, Xenorhabdus bovienii
  Coding sequence Name=Xb4151_4152.C418.gene44.dna; Position on contig =66400..67059bp; Strand=+
ttgattaatgttttgttagttgatgatcacgaactggttcgcattggcgtgaaaggcatactcgaggatgtaaaaggaattaaggttgcaggagaagccggtagcggagaagaggcggtcagatggtgcagatcaaacagtacggatgttgttattatggatattggaatgccgggaataggtggccttgaggcagccaaaaaaatcattcgctattcgcctgatacgcgggtaattatgctgactatccatacggaaagctccttgccagcgaaagtgatgcaggccggagtcagaggatatttgagtaaggcagcaacacctcaagacatgattaatgctattcggacggtttatgcaggtcagcgttatatctctcctgatattgcacagcagatggcactcgaccagttatccccaccaaaagaaaacccactggctgaactctcagagcgggagttacagataatgacgatgatcactcagggccgaaaagttaatgagatttccacgttacttaaccttagcccaaaaacagtaaatagctatcgctatagaatgttcagtaaactaaatatcaagggtgatgtagagttgacccatatggcgatacgttgtgggttgcttgacgcacagaatatggtaaaccatagtggatga

SEQ ID NO: 742 - DNA, 1767 bp, Xenorhabdus bovienii
  Coding sequence Name=Xb4151_4152.C418.gene45.dna; Position on contig =67146..68912bp; Strand=+
atgtatgacaccactggctcggtgatttatgttggtaaggccaaggatctgaaaaaacggctatccagttattttcggacacaagttggcagccgcaagacagaatcactggtaaaaaatatcgtccagatagatgtcacggttacgcatacagagacggaagcgctcctgctcgaacataactacatcaaactttatcaacctcgctacaatgtcttgttgcgggatgataaatcctatccttacattttcttgagcggagatacccatccgcgtctgaccctgtaccgtggtgccaaacatgcgaaaggcgagtatttcggaccatttcctaactcccatgctgtgcgtgataccttagctctcttgcagaaactttttccgattcgtcaatgtgaggacagcgtatatcgcaatcgttcaaggccctgtctgcaatatcagattggtcgctgtcttgctccttgtgtcaacggttttgtgacgaatgaagaatatcagcagcaggttgactatgtccgtctgtttctgtctggcaaagatcagcaggtactgacagagctggttggcagaatggaagcagcaagtaaacaactgcaatttgaagatgcggctcgctaccgtgaccagatccaagccgtgagacaggtaactgaacggcaatttgtttctggagaaggggatgatctggatgttatcagtgttgcttttgatacaggaatggcgtgcctgcatgttttgtttatccgtcagggaaaaatcctgggcagtcgcagttactaccctaaaattcccgctgataccaaattggatgaagtagtacagacttttctcggccaattctaccttcaaggcagccagaacaggacattgccggcggagatcctgctggatttctcgttgcctgaaaaagaacttttggaagcatccctttctgaattatcggggaggaaagtgcatattcaacctcgcccaagaggtgacagggcgcgttatctcaaattggcacgtaccaatgctgcaatagcattgaccacgaaactatcccagcaatcgactgtccaccagcggttggcatcacttgctgaatttgctggcattaaaaaagttcatagaatggaatgtttcgatatcagccatacgatgggagaacagaccgttgcatcctgtgtcgtttttgatgggaatggtcctgtgcgctctgaataccgccgttataacattgcgggaatcacaccgggagacgattatgcggcgatgaatcaagttttacgccgccgatatggcaaagccattgagcagaccagaattcctgacatcatctttattgatggaggtaaagggcaattagcgcaagcgctggaggtttttggctcgctggatgttgaatggaataaaaaccatcctaagctaattggagttgcgaaaggtagtgatcgcaaagcgggtctggaaactctgtttttcgaggcagaaggcgggggaaaggcactttcttcggattcaccggcgttgcacgttatccagcatattcgtgatgaatctcacaaccatgccatcacaggacatcgccagcggcgggataaagtgaaaaagaccagcacattggaatcaatagaaggtatcgggccaaaacgcagacaaatgttgttaaaatacatgggtggattacagccgttacgcaacgcaagtgtagaggagatcgcaaaagtgccttctatttcgtattcgttagcagaaaaaatctataatgcgttgaaacactaa

SEQ ID NO: 743 - DNA, 343 bp, Xenorhabdus bovienii
  Coding sequence Name=Xb4151_4152.C418.gene46.dna; Position on contig =69065..69407bp; Strand=+
atgctgtgcgctattatctttgttattgcggctgcgacagattggtttgatggtttccttgctcgtttatggaagcaaacaacgcgctttggggcatttcttgatccggttgcggataaagtcatggttgctagtgcgctggtgttgatagctgaacattatcatgcatggtggattacgttaccggcagcgaccatgattgctcgagagattattatatcttctctgcgggaatggatggctgaattaggaaaacgcagtagtgttgctgtatcctggctggggaaaataaaaacgacagcgcagatggcagcattggttgctttactgtggcgtcccagcc

SEQ ID NO: 744 - DNA, 1242 bp, Xenorhabdus bovienii
  Coding sequence Name=Xb4151_4152.C419.gene1.dna; Position on contig =145..1386bp; Strand=+
gtgtctaagcgtcgagtagtcgtgaccggactaggcatgttatctcctgtcggcaatacagtagagtcttcttggaacgctgtttgtgccggacagagtggtatcagccttatcgaacattttgacaccgctaaccatgcaactaagtttgctggtgtggtgaaaaattttaatcatgaagatttcaatatttcgcgcaaagatgcgcgaaaaatggatctgtttattcagtatggaattgctgctggtgtacaagctatcgaagatgcaggaatcgaagtaacagaagccaatgctagccgctttggtgctgctattggttctggtattggtggtttgggtcttattgaagaaaaccacagtacattgctttcggcgggacctcgcaaggtcagcccattctttgtaccttcgaccatcatcaatatggttgcaggccatctgagcatcctttatggtcttcgtggtcctagcatctccattgcaactgcttgtacctctggcgtgcacaatatcggtcatgcagctcgtattattgcgtacaatgatgctgatattatgctggcaggtggtactgagaaagccagtactacatttggcgttgcagggtttggtgctgctcgtgcattatcgacccgtaatgatgatcctcaaggtgcaagccgcccttgggataaagatcgagatgggtttgtgctgggtgatggtgccggtgtactggttcttgaagaatacgaacatgccaaaaaacgtggtgcaaaaatttacgctgaaatcgttggctttggtatgagcagtgatgcttatcatatgacatcaccacctgaagatggagcgggtgctgcgcttgcaatggagaatgccctgaaagatgcggatatttccccagaccaagtgggctacattaatgctcatgggacttcaacgccagttggtgatcttgcagaggctcgtgcggtagaatctgtttttggtgaaggcactaaagtattggtgagttcaaccaaatcaatgacaggtcatttgctgggtgctgcgggagcgattgaatcaattttcactattcttgctttacgtgagcagattgttcctccgaccattaatttggaaaatcaggatgaaaactgccgtttggatcttgttccaggcgaagcacgtaaagttgaagggatggaatacgcactgtgtaattctttcggtttcggtgggactaatgggtcactgattttccgtaagatataa

SEQ ID NO: 745 - DNA, 873 bp, Xenorhabdus bovienii
  Coding sequence Name=Xb4151_4152.C419.gene2.dna; Position on contig =1510..2382bp; Strand=+
atgtctgaggttatcacgccttcttatcgaaaattagaaaatgaaatgatgtattggattaatggcaaaccgtgtaatcaattacctgttaatgatcgtgcggtacaatttggtgatggctgttttacaacaataagagttgagcaaggtcaggcagctttgctacctttgcacataaaacggttacaaaaaggcgttgaaaaactgtttatgccagcactggattggttgcaacttgaggatcacattaagcaggtggctaccggttgtgaatcaggtgtcctgaaaattattctctccagaggagttggtggtcgtggttatggtattagtgatgctatcgagacaaatcaggttctctcgttgagttcatatccagaacagtatgctatccagcgtaaaaatggtgtttcactcgttcttagcccaattatgatgggtatcaatccccatttggcaggtattaaacacttgaaccgcttggaacaggttctgataaaaagattcattgagcaggcaaggtctgatgaagcactggttcttgatagtgatgggttattggttgagtgttgtactgctaatattttctggcggaaaggtaaaaacgtttatacgcctgatttgaatcaatgtggtgtagaaggggtgatgcggcagaagattatgcaattattggcagaaagtgattataacctgtcatgtgtcatgcgttatcctgaggtattggctcatgctgatgaggtgattatctgcaattccttgatgcctgttatcgcagtaaaccaaattcaggcgcacaaaaatcagcctgcatggaaatatcaatcaagagaattgcatgagtatttattgcctggatgtttaaggctgtag

SEQ ID NO: 746 - DNA, 1023 bp, Xenorhabdus bovienii
  Coding sequence Name=Xb4151_4152.C419.gene3.dna; Position on contig =2428..3450bp; Strand=+
atgaaacttaaaaagcgtattttcattttacccagcttgattattattgtagcaatcatgtttttttcttttgtgaaaaaaatagaaagctttgctaatcagaaaattaatcttaatcaagaaatgatatttactgtaccggcaggaacagggcgtgccgggctgggaatattgttggttcagcataacttaatcaaagatcaccaattgttgccgtggctattccgattaaaaccagaattggcgaaatttaaggctggcacttaccgtttgcaacaaggcatgtcattgagagcaatcttgcaactattttccagcggtaaagaagtgcaattttctatccgtttcgttgaaggaagtcgattgtctgactgggagaaaatattacagaatgcgccatacttaaaacatgaagcagagggcaaatcaccaaaggaattgactgacgctttagacatgaaagcggaagaaccactggaaggttggctctatcccgatacttacctgtataccgcaggaaccagtgatgttgaattgctaaaacgtgctcatcaaaacatgaacagggcactagagcaagagtggaaaaatcgcgaaaaaaatctgccatataagaatgcttatgaaatgttgatcatggcatccatcattgaaaaagagacagcaatagactctgaacgtacaaaagttgcttcggtatttattaatcggctgcggttaaagatgagattacaaactgatccgacagtaatatatgggttgggggataagtatatgggttctattttccgtagtaacctgactgcttttacgccatataatacttatatgattgaaggattaccaccgacgcctattgctatgccaagcctggcttcgattaaagctgcggcacaccctgctgtgacagggtacttatactttgttgcaaatggtaatggcggtcatacatttacggtgaatctggcagaacataatagggcggtaaatctttatcgtcagagattaaagcaggataaatga

SEQ ID NO: 747 - DNA, 642 bp, Xenorhabdus bovienii
  Coding sequence Name=Xb4151_4152.C419.gene4.dna; Position on contig =3447..4088bp; Strand=+
atgaacagcaaatttattgttattgaagggcttgagggggcagggaaaacgactgcaatccgaacagtggttgaaacattgaagcagtatggcatttctgatctgatttttacccgtgaaccgggtggaactccgttggcagaaaaattacgtcaacttatcaaacagggtgttgaaggtgaatcactgacgaataaggcagaagtattgatgctatatgcagccagagtccaattggtagaaaatgttatcaagccagcactggaaaaaggaacttgggtggttggagatcgtcatgatctttcctctcaggcatatcagggcggtggccgtggcattgatcagaaactgatgacatcattacgcgaatcggcactcggcgatttctacccggatttgactatttatctcgatttgccaccagaggttggtttacagcgcgctcgtgaacggggtgaattggatcgcattgaaaaagaatccttggattttttccaccgtacccgtgaaagatatctcgagcttgtggcacaagatgacaccatcaaaaaaatagatgcgacacaaccgctggaaaaagtgcagggtgctattcgtcagaccttattacagtggttgaaacaacaggacgtgcaggcatga

SEQ ID NO: 748 - DNA, 999 bp, Xenorhabdus bovienii
  Coding sequence Name=Xb4151_4152.C419.gene5.dna; Position on contig =4085..5083bp; Strand=+
atgaactggtatccgtggcttaaccatgcatatcgcctgttgattgaatcccatcaacaggagcgtggacaccatgcccttttgcttcatgctcatgaaggaacgggtgcaggtgcgttattgtatggattgagccgctggttgatgtgtcaggacaaacaaggaatgaaaagttgtggcaagtgtcacggttgtcatctgatgctggcagaaacgcattctgactggcatgctcttgcccctgaaaagggaaaaagtactattggagttgatgctgtgcgtcagctcaacgaaaggctttacgaatattctcaacaaggtggagctaaaattgtctggctaccttctgccgagtctctgaccgatgctgcttccaacgctttgctgaaaacattggaagaaccccctcaaaatacctatttcctgttgcagtgccagcgtccagctcgcttgctggcaacgctgcgcagtcgctgtttttactattttctacctgtgcctgaacagcgtgtagggctttactggctgcaacatcaactccctgcaatatcatctctggatgcgcagacggcgttaaaactttcacaaggtgcgcctcttgctgctgaacagttgcttcagactgaaaaatggcagcagagaaatgtgttttgtcaggcaattgaacaggcattgcataactgtgataccctgtcacttttacccttattgaatcgtgatgatgcacagcaatctttgtattggctggttagcctgttatccgatgcggtgaaatggcagcagcaggcgcaggattactgcgtcaaccaagatcagcaggctttgatccatcatctggcttccactcaaagtgtgggaaaattattaagtacagttgatgattgggtacattgtcgtcatcaattactctctgtggtgggcgtcaatcgggaattattgttgacaggacaattactcaattgggaaaagcagctttgttccacacggaaactcatttag

SEQ ID NO: 749 - DNA, 786 bp, Xenorhabdus bovienii
  Coding sequence Name=Xb4151_4152.C419.gene6.dna; Position on contig =5097..5882bp; Strand=+
atgtttttagttgattcacactgtcatctcgattgccttgattatgaaactctacacaagagtgtggatgatgttgtggctaaggcagcagaacgggatgtaaagtatatgttggcggtggcgactacgctgccgggattccagcaaatgaagaatttgattggtaaacgtgaaaatatcgcgtattcctgcggtattcatccactgaatctggatgaaggctacgattttgatgaacttgcccggcttgcagcggacgatgatgtcgtcgcaatgggagaaaccggtctggattattattatcaaaaagacaatgcagagttacagcgaacttcctttcgtgaacatatccgcattggacgtaagttaaataagcctgtcattgttcatacccgcgatgcaaaggatgatacccttttggttttgcgagaagaaaaagtacaggaatgtggcggtgtgctgcactgttttacggaagataaagacacggcgagagctttgctggatctgggtttttatatttctttctctggtatcgtgacatttcgcaatgcagaacagatccgtgaagcggcaaggtttgtcccactcgatcgggttttggtagaaactgactcaccttatctggcacctatacctcatagaggcaagcagaatcagcctgcctatgtacgtgatattgctgaatatatggcagtattgaaaggggtgactcttgatgaattggccgcagtgacaaccagaaatttttgtaacctgtttcatatcaacatcccagaaaattaa

SEQ ID NO: 750 - DNA, 351 bp, Xenorhabdus bovienii
  Coding sequence Name=Xb4151_4152.C419.gene7.dna; Position on contig =5967..6317bp; Strand=+
atggcagaagaaactatttttagcaaaatcattcgtcgtgaaattccttctgatattgtttatcaggatgatctggtgacagcattccgtgacattacgccacaagcgcccacccatattctgattgtgccaaacgtactgatcccaacggttaacgatgtcacttcagagcatgaacttgcattggggcgtctgttcacagtggcagcgaaaattgcagaacaagaaggcatcgcagaagatggttatcgcctcatcatgaactgtaatcgccattccgggcaggaagttttccatatccatatgcatatggtgggtggacgtccattggggccactgttggtaaagtaa

SEQ ID NO: 751 - DNA, 567 bp, Xenorhabdus bovienii
  Coding sequence Name=Xb4151_4152.C419.gene8.dna; Position on contig =6368..6934bp; Strand=+
atgaaaagaattctctttgttatattatcagcgatgtttctggcgagttgtaacttaccaatacagccgcctgctccggttacacctgtgaagccagagaaaaaaacggaaccacaagtacagccatcggataaagttcctcagccacccaagattcagtcgattaattggaatggcactgttcaaccgttggttgcgcagatggttaaggccaatggtgtggaaacgggaaaagtattacttgtcgatactgttaaaaacaacactaatggttcgctgcgagccctgcaagtgactgatatcattactgatgctgtaagtcgtaaacagctttttcagattgtaccgaaaaaacaagtgcgtagcgctcaacaggcattgggattgtcatcggaagatagcttgggattgcgcagtaaatctattggcttggcacgttatttgagcgctgattatgtgctctattccgtggtttcgggtagtaacaatcaacgtagtatagaaatgcagctgatgctggttaaaacgggtgaaatactttggtcaggtagcggtgacgttaactag

SEQ ID NO: 752 - DNA, 831 bp, Xenorhabdus bovienii
  Coding sequence Name=Xb4151_4152.C419.gene9.dna; Position on contig =6954..7784bp; Strand=+
atgctatgtcagcaatggcctggcattccagtaaaaaattgggaaatcaggcaattaaatgggctgacacagggaagtttctctattacagatggtgtgcgccagatggttgggcgcatacaaacacagaatagtgaaacactgggtgtggatcgtcagcgggaaaatcaggttttacgcaggttatcttccactggcatcgctcctaaagtaatagccatgaacggtgattggctattgctggaatggttttcgggaacaacaataactcacgaaacgttgaacttaccattattgcagcagttactggcacagatacttgccactcttcataaccatcaccgattgggttatcccctccaactcaaaaagcaaattgcatctcagtggcagcagattgaccaaagccgcttatctcctcgctggctgcgtttgcagaaattttttatggcagccagaacgccaacaaccctgaaaatagcacctgctcacatggatattcaccccgataatctacttatgactgtagagggattaaaattgattgattgggaatatgccgctgatgtcgatattggtttttcattggctgtgttgtttaaaggcaatcagtgggatgagatacagcaacagatttttttagattattattgtaattacgcatcaggatacgcggatatcatattattgcagcagagaattaaacagtggggaccgtgggtcagatatatgatgctgatgtggtatgaagtacgttggcagcagacgaaagatccacaatttttagcattagcgaaccctctgcgccaggggtttaaattagagcattaa

SEQ ID NO: 753 - DNA, 1020 bp, Xenorhabdus bovienii
  Coding sequence Name=Xb4151_4152.C419.gene10.dna; Position on contig =7875..8894bp; Strand=+
atggggccagtaatgttagatgttgttggttatgaattggataatgaagaacgcgaaattctgcaacatccattagtgggcggtttaatcctgtttacccgcaacttccaggatacgcaacaattgcgtgaattaattcgccaaatccgcgctgcgtcctaccaccgtttggtgattgcggtcgatcaggaagggggacgtgttcagcgttttcatgaaggctttactcgtttacctgccgcacagtcttttgcctgcttgaatgactcgcttatgggaacgcatttggcgcaagaatcgggttggctaatggcatcagaaatgattgcaatggacattgatatcagttttgctcctgtactggatttaggacaccagtgcactgcgattggtgagcgctcatttcacggagagcttgaactcgcggtgatgatggcagaaaaatttatcaagggcatgcattccgcagggatgaaatcgacaggtaagcactttccggggcatggagcagttgtagcagattctcacaaagaaacgccaagggataatcgctcgatggatgccattagttgtcatgatatgcatatttttcgcgattttatccagcgtaacctgcttgatgcaattatgcctgctcatgtggtttattctcaagtagatgatcgcccggccagtggttcaccttattggttgaaatctattttgcgtcagcaactgggatttgaaggtgttattttttctgatgatctgtcgatggaaggtgcggctatcatgggcagctatgccgagcgaggaaaagcctcattggaagcgggttgtgacatgattctggtgtgcaacaatcggcagggggcaatcagcgtgctggataatttgccgatgatcagatctgatagggtagcacggttatatcatcagggcagtcaatacagtctggaagagttgaagaaatcagaacgctggcaacaggcaaataaagaattgaatggcttgtgtgaacagtggttaaattatatttaa

SEQ ID NO: 754 - DNA, 1305 bp, Xenorhabdus bovienii
  Coding sequence Name=Xb4151_4152.C419.gene11.dna; Position on contig =9309..10613bp; Strand=+
atgacaacgccaaagacaagaattgtcattattggtgggggcgctggtggtttagagctggcaacgcgtttagggcacaaattggggcgtaagcaaaaagccgaaattactttggtggatcgcaacaacagccatttatggaaaccattattacatgaagtagcaacgggctctcttgacgatggcgtcgatgcattgagctatttagctcatgccagtaaccatcattttcacttccagttaggcacgctcacgaatatcgatcgtgatggaaagaaaatcactctggcggaaatccgtgatgaaagcaatgatttgctggtagcggagcgagagctgacttacgatattcttgttatggcattgggtagccagtcgaatgatttcggtacggcaggtgtaagggaaaactgcattttcctcgataatccacagcaggcacatcgtttccacaatgaaatgctgaatttgtttctgaaatattctgccaaccaatgcacggaagaaaaagtcaacatcgcgattgttggcggtggtgcaactggcgtagaactttcggcagaactgtacaatgctgttaagcagtttaatagctatggttttgaaagtttgaattcagacgcgctgaatgtcactctggttgaagcgggtgagcgtattcttcctgcattgcctccacggatttccagtgcggcacatcaggaattgaccaaactcggtgtcaaggtgttgaccaagactatggtgaccagcgcagatgagcatggcctgaataccaaagacggagagctgatcaaggcttccctgatggtatgggcagcaggaattaaagcgcctgactttatgaaagacattggtgggctggaaacaaaccgcattaaccagttggttgtgaagccaacgttgcagacgacgttggatgcttatgttttcgccattggtgattgtgcatcatgcccgaaaaaagagggtggatttgttcctcctcgtgctcagtctgctcaccaaatggcgagtcgttgctatgataatattctggctttattgaatgaaaagccattgaaagaatatgtttataaagatcatggttcattggtttcattatctaagttcagtacagttggtagcctgatgggcaacttgatgcgcgggtcaatgatggtagaaggccgtattgcacgtgtggtttatatctcgttgtatcgtatgcatcaggtagcactgcatggatatataaaaacaggtttgatgatgctggttggtggaatcaatcgtgttattcgtccgcggttgaaattgcactaa

SEQ ID NO: 755 - DNA, 468 bp, Xenorhabdus bovienii
  Coding sequence Name=Xb4151_4152.C419.gene12.dna; Position on contig =10913..11380bp; Strand=+
gtgggtaatttaaagataagacagtatggaataggctctataattgctattgctgccattggcactgccgcaacactttattttgaatccccacaacccaaagttgcgcaagtattatcttcagagcctatcagaataacggttcctgctcctcatcactattgccatgaggcagtattcgtcattcctattagatcagaagatataacaggaggggtctttacgggatatgaataccgtatattgactctttttgacaatttaaaagcaagcagagaatatcttgcattcaaccattcagcattaaaaaactgtctgatggtttatgtgagggagcaccgcaccgttgggtatgatgttgtttatactattggggataaccctggaaaagtgcgagtgacgtacaaaccggagcaaaccattccgttaaatgaaaaagggcaattaattctccagccatatttgtag

SEQ ID NO: 756 - DNA, 3441 bp, Xenorhabdus bovienii
  Coding sequence Name=Xb4151_4152.C419.gene13.dna; Position on contig =11453..14893bp; Strand=-
atgtccgcaaaataccgttatcaacttcctgaacgtcgcggtgatatccgccagttgggtcatttgactggtgccgcctgtgcagtcgaatgtgccgaaattattgaacgtcactcaggtccagtgctactggtgacacaagatatgcagaatgctttgcgattgcgtgatgaaattctgcaattcacccacgcaccaataaatatgctgtcagattgggaaacattaccttacgatagtttttcaccccatcaagaaatcatctcaaatcgcttatccacgctttatcacttaccgttcatgacgaaaggtgcactgatcctacccgtcaatacgttgatgcagcgtgtttgtccacatgaatatctcaagagacatgccttggttatgttcaaaggtcagcgcctttcacgggataaactgcggacagaactggaacagtccggttatcgtagtgttgagcaagtacttgaacacggtgaatttgctacacgcggcgccttgtttgatatgttcccgatgggaagtgaacatccttaccgtattgatttttttgatgatgaaatcgatagcctgcgtactttcgatatagatagccagcgaacactggttgaagtggaaacaatcaatttattgccagctcatgaattcccgactgatcaagaggcgattgaattattccgcagccaatggcgtgagcagtttgaagttcgccgcgatgctgagcatatctaccagcaggtcagcaagaaaatgctgccggctggcattgagtactggcaacccctgttctttgaacagcccctgcctgcgatttttaattatctacccgaaaataccctgctcattacacaggatttagtcagtgcagcagagcgtttttggcaggatacagcacaacgctttgaaagccgaaaaattgatccaatgcggccattactatctcctgagcagatttggctacctgtcgataaattattcgctgaattaaaaaattggccccgcattcaggttaaaaatgaagcactccctcaaaaggcaggaaacaccaaccttgcttatcaggctctccctgatttatcggttactgcacagcacaaaacacctttggataaggtgcgccgttttatcgaacagttcaatggcaggatcattttctcggtagaaagtgaggggcgccgggaaaccgtacaagggctgttgtcacgtataaaaattagcccgataaaaataaaacagttaatagatgccaataaatctggctgcttcttaatggtaggagcggcagagcatggtttcattgatgaagataataaactcgcacttatctgcgaaagtgacatgctcggtgagcgcgtaagccggcgccggcaagatagccgacgtaccatcaatactgatattttgatccgcaaccttgctgaactgcgtcgcggtcagcccgttgttcaccttgaacatggtgttggccgttatcaggggttgatgatgctggaggcgggtggcattcaggcagagtatctgatcctgacctatgccggagaagacaaactgtatgtgccagtctcctctctgcatctcatcagtcgttatgctggcggtgctgaagatagcgcaccactgcacaaattaggtggagaggcatggaataaagcccgtcaaaaagcggctgaaaaagtacgtgatgtcgcagctgagttactggatgtgtatgcgcagcgtgccattaaaccgggctttgcctgcacacaggatcccgagcaataccaactgttttgtcaaagttttccgtttgatacgacaccggatcaagaacaagcgatcaatgcggtactggatgatatgtgccaacccgttgccatggatcggttagtgtgtggtgatgttggatttgggaaaaccgaagtcgcgatgcgcgccgcttttatggccatcactaataacaaacaggtagccgttctcgtgccgacaaccctgttggcacagcagcattatgataatttccgggatcgctttgcaaactggcctgtgcatcttgaagtactgtcacgctttcgcagtgcaaaagaacaacagcaggttattgatatggccgctgaaggcaaagtcgatatcatcatcggtacccataaacttctacaaaatgatctgtgctggaaagatattggtttattgattgtcgatgaagaacaccgttttggggttcgccacaaagaacgtatcaaagccattcgtgctgatgtcgacgtcctgactctaaccgcgacgcccattccccgcacgcttaatatggcaatgagtggtatgcgtgatctgtcgatcatcgccacgccacctgcccggcgtctggcggtcaaaacctttgtacgtgagtatgacagtttagtcgttcgtgaatccatcctgcgggagattttgcgtggtggtcaggtttattacctctataatgatgtcgaaaatattgagaaggccaaaaatcggctggaagaattagttcctgaagccagaatcgtcgtcggccatggacagatgcgtgaacgtgatctggaacgggtcatggcagatttccatcaccaacgttttaatgtactggtatgtaccaccattattgaaaccggaattgatatccccagtgccaatacgattatcattgaacgcgctgatcactttggattggctcagttacaccagttacgcgggcgtgtcgggcgttcccatcatcaggcatatgcttatctgctgactccaaatccaaaagccatgactaccgacgcccaaaagcgcctggaggccattgcatcccttgaggacttaggcgcagggtttgcactcgccactcatgatctggagatcaggggggctggtgaattgttaggtgaagaccaaagtggtcagatggccagcgtcggttttacactctacatggaactgctggaaagtgccattgatgcactgaaaaacggacgtgaaccatcacttgaagatctcaccagcagccagaccgagattgaactgcgtatgccggtatttttgcctgatgattatatccctgacgtgaatatgcgcctgtctttctataagcgcattgccagcgcccacaatgatgctgaactagctgaactgaaagttgaattgattgaccgatttggtttactgcctgatccgggtcgccagttattgcaatctgcctcaattcgtctgaccgcgcagagtttgggtatcaagcgcattgaagcgcatgagaaaggtggctttatcgagtttagtgataacaataaagtcgacccaaattatctgatcggtttattgcagacacagcctaacatttatcggctggatggcccctcgaaactgaaatttattactgatttaaccgagagatctacacgtttgtctttcatccagcaattattagaagccttcgttcagcatcagatataa

SEQ ID NO: 757 - DNA, 1164 bp, Xenorhabdus bovienii
  Coding sequence Name=Xb4151_4152.C419.gene14.dna; Position on contig =15491..16654bp; Strand=+
atgcgcggacgagcggtcgataaattcggccgttttgtctcttggttatcggccattggtattacgctgggtgtggctgcacttattactgtgttgtcagtcatgaatggttttgaacgttcattggaaagcagtattttgggttttatgccgcaggcaatcatcacatcagaaaaaggctctatcaatcctgatgagcatccgatgaatcagctttcgggtctaaaaggagttaaccgtattactccgattgtacaaagcgatgtggtgctacaaagtgcccgtaatgttggtgtgggagtcatgttgggtatcactcctgatgaatatacgccactggcggcgcatgttgctgataccgatcgtactcagttacaacccggacgttatttcgtcattttgggggagaagttggctataaagctgggtgttaaacgaggtgatcagatccgcgttatcgtaccaagtgccagccagcttacgccgatgggtagaattcccagccagcggttattcacggtgattggaacattttttgccaatagtgaagtcgatgacacggaaatgctggtcaatcaacaagatgcggtgcgcttattccgttatcccatggataatatcactggttggcgtctgtatctcaatcaaccgctgacggtggatgtattaagccagcaaactttaccggaaggattagtgtggaaagattggcgtgaacgcaagggcgaattttttcaggcggttcggatggaaaaaaatatgatggggttattgttgagcctgatcatcgcagtcgctgcttttaacatcatcacttccctctctttattggtgatggaaaaacagggtgaaattgccatcttgcagacgcagggactaacccgccgtcaggtaatggcgatcttcatgatccaaggggggagtgctggcatcattggtgctttgttgggaacggggctgggtgttctgctttccagtcagttaaacagtttaatgcctcttgttggcctgttgactgaaggtatccaattacctgttgcgattgatattacccaagtggtgcttattgccaccagtgccatgttgatctccctattatcgactctatatccttcctggcgcgcggctgccattcaacctgctgaggctttacgttatgagtaa

SEQ ID NO: 758 - DNA, 702 bp, Xenorhabdus bovienii
  Coding sequence Name=Xb4151_4152.C419.gene15.dna; Position on contig =16647..17348bp; Strand=+
atgagtaatcaacccttattgctgtgtcatcatctgtgcaaaaaatatcaggaagggcaggtttccacagaagtgttaaagaatgtcactttttccatacggcagagagaaatgatggcaattgtcggcagttcgggatcgggtaaaagtacacttctgcatttgcttggcggactggattcgcctacgtccggagaagttctttttaaagggcgatcattgaatgaaatgtctgcctctgtacgagccgagttacgcaacagtgaaatcggttttatttaccagttccatcatctgttgcctgatttcagtgcgttggaaaatgttgctatgccgttattgattggcagtaaaaagcgcaaggcttcacaaaaagcgctggaaatgctggcggcggttggattggaaaagcgggcacaccatcggcctgctgaactgtccggcggtgagcgccagcgtgtcgctattgcccgtgcattggtgaatgaaccatcactggtgctggcggatgaaccaacaggcaacctcgaccagcgtaatgcggacagcatctttgaaattttgcaggaattgaatcaacgccaagggactgcgtttctggtggtgactcatgatctgaaacttgctggccgattggctcgtcaggtcgaaatgcgcgatgggtttttacaggatgagctcgttctggtgggagagaggtaa

SEQ ID NO: 759 - DNA, 1248 bp, Xenorhabdus bovienii
  Coding sequence Name=Xb4151_4152.C419.gene16.dna; Position on contig =17348..18595bp; Strand=+
atggcgaatttgcctcttgcattatttaccgcattacggtttagccgaggacgtcgtcgtgcaggaatggtttctctggtttctgtcatttcgacattaggcattatgcttggtgttgcagtgctgattatcggcttgagtgccatgaacggttttgaacgagaactgaaaaaccgggtgctttctgttgtaccacatgggcagatctacacggtagagcagccttttcagcattgggaacaggcacttgagcgagtaaaacagacagtgggtattgttggtgcttccccttatattgaatttaccggattgatggagaaaggcgaaaaactccacgctgtacagatacaaggtgttgagccgaccaccgaagctgatgtcagtgctttgcctcaatttgtcggtgatgatgcatggaaagcgtttcatgctggcaaacatcaggtgatcttagggcagggtgtggcgcattcgctgcatgtgaaacaaggtgactggctgacggtcatgatccccaatagtgatccgagtttgaaacttttgcagccgaaacgcattcgcctacaggttgctggaattttccagttaagtggcatgctggatcatcgtctggctttggttcctttatctgatgcgcaacaatatctggattatggtcatgctattacgggaattgccatcaaagctgataatgtttttgccgcagaacagcgggttttggatgctggcaaatcgacagaaaagtatgtctatatcagtacatggataaaggactacggatatatgtacaacgatatccagatggtgcgcggcatcatgtacctagcaatggttctggttattggagtggcttgctttaatattgtttcaacactgattatggctgtgaaagacaaaagcagtgatattgctatcttgcgtactctgggggctaaagatggtcatatcagagcgatttttttatggtatggattactgactggcatggtcggcagtgttattggcacgatagctggcatcttcacatcgctgaatctgacgactattatcaaagggctggaaaagctgctcggtcatcaattcctttctggtgatatctattttattgattttctgccgtcagaattacatgctatggatattttctatgtcctgttaacggcattgatattgagtctgttggccagttggtatccggctcgtcgggccagtaaacttgatccagcacggattttgagcggtcaataa

SEQ ID NO: 760 - DNA, 711 bp, Xenorhabdus bovienii
  Coding sequence Name=Xb4151_4152.C419.gene17.dna; Position on contig =18881..19591bp; Strand=+
gtggtcgtgctgacgggggcgggtatttccgctgagtcaggcattcgaacatttcgctcttctgatggcctgtgggaagaacatcgtgttgaagatgttgctacgccagaaggtttccaacgtgatgctgaattagttcaggcattttacaatgcgcgtcgaaaacagctccagcagccggaaattcagcctaatgccgcgcactatgccttggtagagctagaacagcaactgggtgataattttctgctcgtgacacaaaatatcgataacttgcatgaacgagcaggaagccgtcgtgttttgcatatgcacggtgaattgttgaaagctcgctgttgccagtctggtcagatgattgaatggaagacagaattgacaaccgaagaccgctgccattgttgccagtttccatctccactacgtccccatgtcgtatggtttggtgaaatgccattggggatggagcagatttattctgctttagcggatgctgatctttttattgccatagggacgtctggtcacgtttatcctgccgcaggttttgtgcatgaagctaagttatctggcgcacttactattgagttgaatctggaacccagccaggtcgaaagcttatttgatgaaaaacactatggtcatgccagtaaaattgtcacgcaatatgttcagtcattacttcagcaaatgaagacagataaaagctga

SEQ ID NO: 761 - DNA, 1122 bp, Xenorhabdus bovienii
  Coding sequence Name=Xb4151_4152.C419.gene18.dna; Position on contig =19771..20892bp; Strand=-
atggattatcagctaaatctggactggcaatcgtttttgcagaactattggcaaaaacggccactgctgattaagcagggtttccagcaatttatcgatcccctttctcccgatgaactggcgggactggcgatggaaaatgaaatcgatagccgtttggtcagtcagaaaaacggtcgttgggaagtttcacatggtccatttgaaatttatgaccatttaggcgaaaaggattggtcattacttgtacaagctgttaatcactggcatcttccttcttctgcccttatgaaaccatttcgtatgctgtccgactggcgaatggatgatctgatggtctctttctctgtatcaggcggtggtgtcggtcctcaccttgaccaatatgatgtctttatcattcagggacagggacgccgtcgctggcgtgtaggcgaaaaaataccaatgaaacagcattgccctcaccctgatttattacaggttgatccttttgaggcaatcattgatgaagaaatgttgccaggggatattctttatattccccctggattcccgcacgaaggctacgctatcgaggattcactaaattattccgtaggcttccgcgcacccaatgcccgtgaactcttcagtggttttgctgattatattctggcaaatgaattggggagccatcgttatagcgatccagagctggcattgcgtgataatccagcgctaattcagtcaaatgaactggatactctgcgaataatgatgcgcgatctgctggaacaaccaacaacttttcaaaattggtttggcgaatttatctcccaatcacgccatgagttggacattgccccaccagaacctccttatgaaagcgatgaaatttatgaactgctgaagcaaggtgaaagtttgaatcgcttaagtgggttacgcgtcctgcgagttggtgatcaatgttttgtcaatggcgaattaatagatactcctcatatccatgccgctgatgcgctttgtcagcatgatcgagtggatgcgggtattctgggtgatgccattgatgatgttcgttttatcagcctgctagctgcgttggtcaatagcggttactggtattttaatgattaa

SEQ ID NO: 762 - DNA, 1410 bp, Xenorhabdus bovienii
  Coding sequence Name=Xb4151_4152.C419.gene19.dna; Position on contig =20989..22398bp; Strand=-
atggcgacgtcggccattatccttgcgctgacgctgtcatatggccttgtcgccattattgggtatttagtgagttttgataaaacaatttattccatactccgtagccaaagtaatttatttagtactttggctaaatgggatggtagcaagctggttattaaaatcccccccaatttatccatgactaatcgttctctggctctgatttatgacaatcaaggtcgtattctctggcgccaaagttatacgccagaattggaaaaaaaaattcctggggaatggctgaaaaaagatggcttgcatgacttatctatctcttttaaagataaggaaggttttctctaccctaaaacaccgactcagtcagacaattcaaccaaaaccaactggagcgataataatgagttattaacctattctgtagcagtcaattcttatgctaagaccgataagctgcctgcgatgacaattgttattattgatactatcccacaagatatgcagagttcagtgaaagtctgggcatggtttggatatgtattgcttgccaacctgattttaatcatcccattaatctggcttgctgccgactggagtctgcgtccaattaaatttgtaattacccaaataagctctctggaaagaggtgaacgtgaaaaattggatgaagagcctcccaacgaattaaaaggtctggtcagaaacctgaatgcattattaagcaatgaacgtcgacgttatactcgatatcgcacgacactttctgacttgtcacatggcctaaaaaccccattagccgtgttgcaatccaccctactttcattgcgctcaggtaaacaaatgtccattacacaggctgaaccaatcatgcttgagcaaatcaaccggatgtctcaactggttgactactacctacgtcgtgccaatatgcacagcgatcataacctactcttgagacagatttcttccgtctcaattttgctggatagactgatcatcgcactgacaaaagtttatcagtacaaaggcgtcgatattacactgaatgtttcttccgaaatcaattggttaggcgaaaagaatgacttcttggaggtgatgggaaatgttctggagaatgcctgtaaatattgtctggagttcgtcgaaatcaccgccttaatgggagataattctgtcactattattgtcgatgatgatggcccaggtgtaccgccagaaaaacgtaacatgattttcgaacgtggtctacgtgcagatacattacgctctggtcaaggattagggctgtcaattgctgctgaaattgtcatgcaatatgacggaagcatcagcgttgaagatagcccacttgggggggctagggtaaatgtagtattccgctcacagcaaagcagtgaatactga

SEQ ID NO: 763 - DNA, 684 bp, Xenorhabdus bovienii
  Coding sequence Name=Xb4151_4152.C419.gene20.dna; Position on contig =22439..23122bp; Strand=-
atgcgtatactcattattgaagatgaggcgatacttcgccatcatttgacagtacagctccgagaactcggtcatcaggttgatgcggctgaaaataccaaagaagctgattattatctgaaagaaaatcatcctgatattgctatcgtcgatctggggttacccggagaagatggcctcagcatgatacgacgttggcgcagcgatcaggttaatttaccgattttaatcctcacagttcatgacagctggcaagaaaaggtcacagtactgaatgctggagcagatgattatgttaccaagccttttcgtttggaagagattaacgcgcgcatacaggcattaatgcgacgtcatagtgggctagcatctcaactcgttgaattatcgccattcttaattgatctctctcgcaaagagttttcagttaataaaaacagtatcaaattgactgcgttcgaatatacgattattgaaacgctgatgcgtaataatggcaaagttgtcagtaaagaatcactgatgcgccagttataccctgatgctgaattacgtgaaagtcatacaattgatgtattaatgggacgcttaagaaaaaaaatatcgaatgagtggtcagacgaagtcattgttacagtccgaggccaggggtatcgtttcgatgtgaaacaacatgatatttaa

SEQ ID NO: 764 - DNA, 144 bp, Xenorhabdus bovienii
  Coding sequence Name=Xb4151_4152.C419.gene21.dna; Position on contig =23310..23453bp; Strand=+
atgggagtagatgactttgcttctatttatgttttatgtaattttgcgcatgtttttttccggcatggacaggaaaatttcctgtccatggggagatatatgaaaaatttttattttaattcatcgactagtgaagtggcatag

SEQ ID NO: 765 - DNA, 1371 bp, Xenorhabdus bovienii
  Coding sequence Name=Xb4151_4152.C419.gene22.dna; Position on contig =23420..24790bp; Strand=-
atggaattatcctcactgaccgctgtttctccaattgatggccgttacggcgacaaagttagcgcactgcgcgctatttttagtgagttcggcttactgaaattccgcgtacaggttgaagtacgttggctgcaaaaactggccgccacaacagaaattagagaagttcctgcgtttgatgcaaacgcaaacgcttacctggatgaaattgttgcaaatttcaatgaacaggacgcattacgcatcaaagaaattgaacgcacaaccaatcatgacgttaaggccgttgagtattttctgaaagaaaaagtggcacacattcctgctcttcatcaagtcgctgaatttattcattttgcctgcacatcagaagacatcaataatttgtcacatgcattgatgctcaaaaccgcccgtgaggagattctactgcctcagtggcgtcagttgatcgacactatcaagcgtatggcccacgactaccgtgacttgcctttgctgtcacgtacacacggacaacccgcaaccccttctactgtcggtaaagaatttgctaacgtggcttatcgtatggagcgtcaattccgccagcttggacagattgagatcctcggtaaaatcaacggagctgtcggcaactacaatgctcatctgtctgcctatccgcaggtgaattggcaccagttcagcgaatcattcgtcacatctctgggaattcagtggaatccatataccactcaaatcgagccacatgattacattgcggaactgtttgattgtgtagcacgttttaacactatcctactggattttgatcgtgatacctggggttatattgccctgaatcatttcaaacagaaaaccgttgcgggtgaaatcggctcttctaccatgccacacaaagtcaatccaattgattttgaaaattctgaaggaaatctgggattggcaaatgcggttctggggcatcttgccagcaaactacccgtttcccgttggcagcgtgatctgacggattcaacggtattgcgcaatctgggtgtcggtctgggctacgctctgattgcttatcaagccaccatgaaggggctgaataaattggagatcaacaaacagcacctgttggatgagctggagcagaactgggaagtgctggctgaacctatccaaaccgtcatgcgccgttacggtatcgaaaaaccctatgaaaaattgaaagaactaacacgcggtaaacgtattgatgccgaaggtatgaaaaccttcattgatggccttgagcttcccgaagaggaaaaatctcgtctcaaatccatgacaccagcaaactacattggctatgccacttcactagtcgatgaattaaaataa

SEQ ID NO: 766 - DNA, 627 bp, Xenorhabdus bovienii
  Coding sequence Name=Xb4151_4152.C419.gene23.dna; Position on contig =24814..25440bp; Strand=-
gtggctaaaaattattatgacattacactggcactggcaggcatctgccagtcaggccatctggttcagcagcttgcccatgaaggccagtgtgatgacgatacttttgaagtgatgatcaacagtgtcctgaacatgaatccgtcatccacacaggatgtctttggcaataatgcctgcaacctccgcattggccttgatgccattcagggcatgttcaataacactcgcagtggtatctctgctgaccttacccgctatatgctgagtttgatagtgctggagcgtcggctcagtaaaaatcaagcggcagctaatgaacttgctcatcgtattaaccagctagaacgccaacaaacttactttgaacctatgtcagaaggtatcttcaatgcccttgcaggtatctatgtcgatgttatcagcccgctagggcctcgtattcaagtcacaggttcacctgacatattgcgcaatacgttgatacaggcgaaagtccgagcagcattactggcaggtatccgcagtgctgtattatggcagcaagttggcggtagtcgcctgcaaatcatgttttctcgtcagcgcctgatccgacaggaaaaagacattcttgatcattgttaa

SEQ ID NO: 767 - DNA, 1104 bp, Xenorhabdus bovienii
  Coding sequence Name=Xb4151_4152.C419.gene24.dna; Position on contig =25443..26546bp; Strand=-
atgttagataacagccagaaaaaagtcattgtcgggatgtccggcggtgtagattcatccgtttccgcctaccttctgcaacagcagggttataaggtagctggtctgttcatgaaaaactgggaagaagacgacgatgaagaatattgctcggctgccgctgatcttgcggatgcccaggcagtttgtgacaaactgggtattgagctgcataccattaattttgcagctgagtattgggataatgtatttgaacatttccttgctgaatataaagcgggcagaacgccaaatcccgatatcctctgtaacaaagagattaaattcaaagcatttctggaatttgctgctgaagatttaggtgctgattacatcgcaacaggccattatgtccgccgtcgggatgtggatggtatcagccagttacttcgtggactggatggtaataaagatcaaagctactttttgtataccctgagccaccagcaaattgcgaaaagcctgtttccagtcggggaattggaaaaacccgaagttcgccgccttgctgaagaaatcggtctggtaactgccaagaaaaaagactctacaggtatttgctttattggtgagcgtaaattccgcgattttctggggcgctacctgcctgcccagccaggttctattattacggttgatggacagaccatcggtcagcatactggcctgatgtaccacacactcggccaacgcaaagggttggggatcggtggaaccaaagatggcagcgaagaggcatggtatgttgtcgataaggatgtcgaaaacaatacgctgattgttgctcaaggccatgatcatcctcgtctgatgtctgtcggtttgattgcacaacagcttgattgggttgatcgtcaggcgttaaaaacagaaattcgctgcgtggtaaaaacgcgctatcgtcaacatgatattccctgcacagtcattcccttgagcgaagacaaaattgaagttcgttttgatagccccgttgccgctgtcaccccaggtcaatcggccgtattttatcagggggaaatctgtctaggcggtggcgtgatcgaacaacgtatacaggagtag

SEQ ID NO: 768 - DNA, 453 bp, Xenorhabdus bovienii
  Coding sequence Name=Xb4151_4152.C419.gene25.dna; Position on contig =26656..27108bp; Strand=-
ttgtttaatccacacatcacagttgcctgcattgtgcatgcaaaaagcaaatttttgatcgtcgaagaattcattaatgatattcccctctggaaccagcctgccggtcatcttgaagctagcgaaacgttgctggaagccgctgaacgcgaattatgggaagaaaccggtattcgtgccaagccacaggcattattgaaattacatcagtggaatgcccctgatggtacgccttttatccgttttctgttcctgattgaaatggaacaaatcgtagataccgaaccacaagatagcgatattcactgctgtcactggctaaatgcagaagagatcctcagcagcccacagttacgatcaccgctcgttgctgaaagtatccgctgttatctggaaaatcagacttacccattatcaatattagatagctatgggccacctttcaccaaatga

SEQ ID NO: 769 - DNA, 630 bp, Xenorhabdus bovienii
  Coding sequence Name=Xb4151_4152.C419.gene26.dna; Position on contig =27101..27730bp; Strand=-
atgacaaatatctcttttaaaaaacgtaaacttaaccgattcagccaaagaaaaaataaagatactctaaaaaaattaacaggccctcgcagggtactgatctttaacaaaccttatgatgtgctcccacaattcaccgatgaaatggggaggacaacgttaaaggattttatcccatttcctgatgtttatgccgcaggtcgtctggatcgcgatagcgaaggattgctaattttaaccaacgatgggaaattgcaggccaagttgacgcagccccataaaaaaacagctaaggtttattatgttcaggttgaaggaattcctgatgagagcactctgaacaagctacgcaatggcgtcacattgaaagatggcccaacactttccgctggtgccgagttggtagaagaaccagagtggctctgggaaagaactcctcctattcgggaacggaaaaatattccggtaagctggcttaaaattaccctttttgaaggacgcaaccgtcaggtacgtagaatgactgcccatgttggctttccaacgttgcgcttaatccgtttcagtataggttcgttacaattggggcagctatcccctggagaatggagggaaattgattttgtttaa

SEQ ID NO: 770 - DNA, 1254 bp, Xenorhabdus bovienii
  Coding sequence Name=Xb4151_4152.C419.gene27.dna; Position on contig =27872..29125bp; Strand=+
atggaaagcaaagtagttgttccggcggaaggtaaaaaaattactattgatgccaaaggtaaattaaatgttccgaataacccgataatcccttatatcgaaggggatggcattggtattgatgtaacgccggtcatgctgaaagttgttgatgctgcagttcagaaagcttacagcggtgagcgcaaaatttcttggatggaaatctacaccggagagaaatctacgcaggtttatggcaaagatgtctggttaccagaggaaactctggatctgatccgtgactaccgtgttgctatcaaaggccctctgacgacacctgttggtggcggtatccgttctctgaacgtggctctgcgtcagcaattagatttatacgtctgtttacgtccggttcgttactatcaaggtactccaagcccggttaaacaacctgaattaactgatatggtcatcttccgagaaaatgctgaagacatttatgcgggtattgaatggaaagcaggttcagcggaagcggataaagtgatcaaattcttgcaggatgaaatgggtgtcactaagatccgtttccctcaggagtgtggtattggtgtgaaaccatgttcggaagaagggactaagcgtctggtacgtgctgcgattgaatatgccatcgataacgaccgtgaatcagtgactttggttcacaaaggcaacatcatgaaattcacggaaggcgctttcaaagactggggttatgaactagctcttacggaatttggtggtgaactactggatggtggtccatggatgaagatcaagaatcctaagagtgataaagacatcatcattaaagatgtgatcgcggatgctttcctgcaacaaatcctgctgcgtccggctgagtacgatgttatcgcttgtatgaacctgaacggtgactacatttctgatgcattggcggcacaggtaggcggtattggtattgcaccaggggcaaatatcggtgatgaatgcgcattgtttgaagcgacacacggtactgcacctaaatatgccggtcaggacaaagtgaacccaggctctgtaattctctctgctgagatgatgctgcgccacatgggatggtttgaagctgctgatcttattgttaagggaacggaaggggcgattgctgccaagaccgtaacttatgactttgaacgcctgatggaaggcgctaagctgctgaaatgtagtgagttcggtgatgcacttatctctcatatgtga

SEQ ID NO: 771 - DNA, 312 bp, Xenorhabdus bovienii
  Coding sequence Name=Xb4151_4152.C419.gene28.dna; Position on contig =29249..29560bp; Strand=-
atgctaacagagagggatcgtgtccttagcccgtatttaattcactattttcacaccacatcacaatctaaacgaggcgaaaaagtaacagcgaatacattgacaacaaatttcaaaaaagcacgagacaagatagatatagattggggagaaggaactccagcaactttccacgaacagcgctcactatcagaacgactgtaccgtgagcaaggtataaacacgaaagatttattgggccataagaaccaacaacagacagacaaatatcatgatgatcgcgggaaagattggataaaaatcacactctaa

SEQ ID NO: 772 - DNA, 276 bp, Xenorhabdus bovienii
  Coding sequence Name=Xb4151_4152.C419.gene29.dna; Position on contig =29775..30050bp; Strand=+
atggaaaatatcactattttacctaaaggcggtcgtttgagttccaaaatgagtcgtcatctggaacgaggaaatttaatgactcgccgccgtttagaagaaaatattcgccagtctgaaataaaagcgcttgaaaatatgatcgatcaggcatttggattggagaccgaaccgcgcaaggtattaaccatccagcgtaagccacaaaatgatggcgttaacgtaatagccaatctgattgttcaggccaaagggcttgctaatgagccacaataa

SEQ ID NO: 773 - DNA, 273 bp, Xenorhabdus bovienii
  Coding sequence Name=Xb4151_4152.C419.gene30.dna; Position on contig =30129..30401bp; Strand=-
atggatagaaataaatggaaaaaggttgttggtttgctgggtaagcaagctaacaaatcgaattttgctgcattggtttgcggcctgttagtcgcgtttaggcttgagccactcgaatcatggctacgcgaacacgttcctgattttcagccagaaaccgtaacttatttcgttacgatgtaccttatcagcgcggctatagtttatatttcatcgatgccgattaaatatctgagaaagaaaatctcaccccctcgccgtaacgccgcctga

SEQ ID NO: 774 - DNA, 210 bp, Xenorhabdus bovienii
  Coding sequence Name=Xb4151_4152.C419.gene31.dna; Position on contig =30544..30753bp; Strand=+
atgaatatagaattcaccaacgaaattcgggcatcaatgaaacgtgaccgtcagtctgctattaggtacgtaattgaatgtaaaagaaattatctagattttcgtcaatgggctatggatcatgagccacgttctactaatcatcgtgcattgaatagattagcttggcaacagcgtaaattctaccgtaagtgggcggctctcagttga

SEQ ID NO: 775 - DNA, 927 bp, Xenorhabdus bovienii
  Coding sequence Name=Xb4151_4152.C419.gene32.dna; Position on contig =30917..31843bp; Strand=+
atggcgattagtgatcgtgtagcaaaaatcaagggtaaagagattactgttaatacttggttggataaatactggaaaattcaggaggaacgtttagaaactaatgatatcaaattcaacacatttaaacaaaagcggaagcctgtagatttaatgcgacaggctcttgctatgaaaccgttgcccgctgttgatgctcgtgacattgcaggtattttggacgaatataaaaccgcaggtcagccgcgcatggcacaggttgttcgctcagttctgatagatgtattcaaagaggcgcaacatgcaggagaggttccccccggctataaccctgcattagcaactaagcaacctcgtagaaaaattacccgccaacggctgaacttggaggaatggaagcagatattcgaaattgcaaactcgcagcatcgatatatgggtaatgccatgctattggctattgtgaccggacaacgattaggtgatatttcagaaatgaaattttctgatatttgggatgatcaccttcatatttctcaggaaaaaacaggagcaagattagccattcccttagcattacgatgcaatgcacttaatacttccctcagagaagttgttgcacagtgccgtgatcgtgtccttagtccgtatttaattcactattttcacaccacatcacaatctaaacgaggcgaaaaagtaacagcgaatacattgacaacaaatttcaaaaaagcacgagacaagatagatatagattggggagaaggaactccagcaactttccacgaacagcgctcactatcagaacggttgtaccgtgagcaaggtataaacacgaaagatttattggggcataagaaccaacaacagacagacaaatatcatgatgatcgcgggaaagattggataaaaatcacactctaa

SEQ ID NO: 776 - DNA, 165 bp, Xenorhabdus bovienii
  Coding sequence Name=Xb4151_4152.C419.gene33.dna; Position on contig =31967..32131bp; Strand=-
ttgctgcgccacatgggatggcttgaagctgctgaccttattgttaagggaacggaaggggcgattgctgccaagaccgtaacttacgacttcgaacgtttgatggatggcgctaagctgctgaaatgtagtgagttcggcgatgcacttatctctcatatgtga

SEQ ID NO: 777 - DNA, 171 bp, Xenorhabdus bovienii
  Coding sequence Name=Xb4151_4152.C419.gene34.dna; Position on contig =32644..32814bp; Strand=-
gtggaattttctcaccttttaattcaatccttccgtttcaaacggaatgcctactttggttttatactcgcgggtgagggtatggggatttccaccataccttttgctttcatatttatagggttacttaatgtaactgagtggctaacgacaaatctgacggcagagtaa

SEQ ID NO: 778 - DNA, 276 bp, Xenorhabdus bovienii
  Coding sequence Name=Xb4151_4152.C419.gene35.dna; Position on contig =33270..33545bp; Strand=+
atggccaaagttgatgtctattgccgttattgccacaaatcagaacaggtcaaaggacatgggaaaggaaatggcggacatcctcgttatcgctgttatagctgctgtaaggtctttcagttggcgtatacctatcaggcctgcaaacccggcgttaaagaacagattgtcgatatcgcgatgaataacgggggaattcgtgacaccgctcggatcctgaaagtcgccaccgccaccgtcatgaaaacattaaaaacctcagactccgaaacgtaa

SEQ ID NO: 779 - DNA, 291 bp, Xenorhabdus bovienii; identical to SEQ ID NO: 352
  Coding sequence Name=Xb4151_4152.C419.gene36.dna; Position on contig =33674..33964bp; Strand=+

SEQ ID NO: 780 - DNA, 747 bp, Xenorhabdus bovienii
  Coding sequence Name=Xb4151_4152.C419.gene37.dna; Position on contig =34256..35002bp; Strand=+
atggatgaaataatgcatcacggagagaataatattgatgtttcaattattcttcctaggtataatgaaaattatttagttatagaaaaaaccatacagcgcattaaaaatattcaagaagtattgaaagtacaggtcattataattaatgattcaaataaaaatactttccatgatatagatattatcaaggtaaaaaaacagtaccctgatgttgaagttgtctctaactgtggtaactatggaaaaggatatagcattagacgaggcgttgatttagcgaaaggaagatatattttttatactgatattgatttcccgataaaagagagtgatttttttagtgcatatcaaaaaattgaaacatccaatgttgatctcgttattggagagcgattctcaaagagtaaatcaaaagcgaatctatatcgaaaaataacaagtaagttttttttaaaaattgttaacttgatactaaactgtaaagtatctgattctcagtgtccattcaagatgttaaagtctgatgtggcaaaagaagtattttctaagcaaaggattaaggggtatgcatttgatgctgaaattatttaccttatgaataggctttcgaagacactatatcaatttcctgttatttgggaggatacaagggaaaactggagtttgatgaggacgattattaattatagcattatgattttaggggttttttctattaaaatttactggattatacgcaattaa

SEQ ID NO: 781 - DNA, 1050 bp, Xenorhabdus bovienii; identical to SEQ ID NO: 483
  Coding sequence Name=Xb4151_4152.C419.gene38.dna; Position on contig =34999..36048bp; Strand=-

SEQ ID NO: 782 - DNA, 156 bp, Xenorhabdus bovienii
  Coding sequence Name=Xb4151_4152.C419.gene39.dna; Position on contig =36079..36234bp; Strand=-
atgaaagagattattgctgcgataattttctttggggtaatttttggaaacgctaatgcggccgaatttacttgtcagttagaaaacaataaatatgtaaatgtatcagtggagcaaggaaagacgcctgtttatagatatacccgtcgtcattga

SEQ ID NO: 783 - DNA, 531 bp, Xenorhabdus bovienii
  Coding sequence Name=Xb4151_4152.C419.gene40.dna; Position on contig =36588..37118bp; Strand=-
atgaaagaagtaaccgttatccctccattcgattttcaagagatggtaacagccgtacaagataaggtagtgacaaccagtctcaaaatagcctcatattttggcaagcgtcatgacaacgttttaagaaagattcgccaagttagagatgagtgtcctgataattttgccgccctcaattttgaggaggctgatttcattgataaaaatggcgatgtacaaccgatgttcaatctaacaaaagatggttacatattggttgtaatgggctttactggtaaagcagcgatgctaatcaaggttaactacattcaggccttcaattggatggcggagcaaattgacagatggaaagacctaggcgaagaggcgcaacatcgtcatgctctgaaagttgcgaaatccgaaatcaaagctcgaatgggtagccgattgatgaacgatagaaagaaagagaaaaagttgctggaattggaatatgaacaaattttatctttgacgcagccaaaattacttttcgatgaggattaa

SEQ ID NO: 784 - DNA, 315 bp, Xenorhabdus bovienii
  Coding sequence Name=Xb4151_4152.C419.gene41.dna; Position on contig =37678..37992bp; Strand=-
atgagaacagaagttgatctggtctactttgagaaagacagaaccgagcgaacgcagctcagtaaatactatgtattgcatgacaatttagaaacaattcttgaccaaacactcctcattaacaaagaccaattcggtgaatacactgcaaaaatggaatttgaaaactttccgagactggagtcagagaaagaagcggcgttaagactcgcggactggatgcgacgcatgagtgaagcgatagaagatcactggcaggacaagaaacagtctccagaggccgttcagtttattggagaacctcagagtaagtga

SEQ ID NO: 785 - DNA, 474 bp, Xenorhabdus bovienii
  Coding sequence Name=Xb4151_4152.C419.gene42.dna; Position on contig =37989..38462bp; Strand=-
atgaaactcacactgacccactacacgatcattgttctgtttgttactacaggcataacctcattcggaagctaccattacagtactgagtatgagaaacagaaagaggctaatgggcgtcaggcaactgaaatccagcaactgaccgacaccctaaactaccagaacacgcacattgatatgctgcatgagatggacaccaagcacactcaggaactcgacaatgccaaatctgaaattgatactcttagggctgatgttgccgctggccgtcgcaagttgcgcatcaaagccatctgtcccgtgcctgaaaccacttcctcccgcagcatggtcgatgcaaccaccgtcgaactctctggagaaactggatcaactgttctcgatatccgagaagacatcatcaacgacctcgcaaaattaagatatttgcaggattacgttaatactgaatgttatgaggtgaagaaatga

SEQ ID NO: 786 - DNA, 435 bp, Xenorhabdus bovienii
  Coding sequence Name=Xb4151_4152.C419.gene43.dna; Position on contig =38459..38893bp; Strand=-
atgaaaatcagcaataaaggactggaattcattcagcaatgggaaggcctgaaactgaaagcctaccctgacccggcaacaggtggcatcccgtggacgattggttatggccatacgaaagatgtgaagcccggtcaagtaatcacagagcagcaggccgaagctttcttgcatgatgacctcatacccgcttacgccacactggagcgattggttaaggtgccactgactcaaggtcagtttgatgccttgtgctcctttatcttcaattgtggtaccggcaatttctccggttctactttgctaaagaaaatcaatgccggtgattatgcaggcgcagcggcagaatttccccgatggaataaggcggctggtaaggtgatgaacggcctgactcggcgtagggcatctgaacaacagatgtttttgtcatga

SEQ ID NO: 787 - DNA, 333 bp, Xenorhabdus bovienii
  Coding sequence Name=Xb4151_4152.C419.gene44.dna; Position on contig =38877..39209bp; Strand=-
atgaaagagaatcctgatgtatgggtacacctcggagagtggctcatatcggtaagagagcaaggcatttgggcaactcttgccggaacgatggcattttttcgcggtcgctataacggtggcggctgggtaaaggtttcaatcgacgcttttatgtgtgccatgttcgcctggttcattcgtgacgtattaaatttcatgggtctgaatcctgacctggcctacatcggcagtgtggtgattggctatctcggtacagacttcatcggtcaattgctgcgtaaggcggcagagaaaagagcgggggtatcctctgatgaaaatcagcaataa

SEQ ID NO: 788 - DNA, 195 bp, Xenorhabdus bovienii
  Coding sequence Name=Xb4151_4152.C419.gene45.dna; Position on contig =39811..40005bp; Strand=+
atgaacacgaacgcatacaccctgattggacgcgctatctgtcagttattggatgacaatacgccgatttataaaacgactatcggtgaggcgatgtcggatatttttaacgccgaatatcgcggcgtctatgatgaacactgcgaggcattcaacgatgcgctgaaattactgatgaataaaaatgaaaattga

SEQ ID NO: 789 - DNA, 477 bp, Xenorhabdus bovienii
  Coding sequence Name=Xb4151_4152.C419.gene46.dna; Position on contig =40148..40624bp; Strand=-
atgctgatgctatggggggctgataatcagggggatgatttgccggatggtgggaatatcaatgtcattggccgcctgatggtgagggatacgtgggatgatggaacgactaccgcaattaaactggttatgatcaattatgcgaagttaggctacaccggaaaagaattactggaaaaagtgaaagaagtcattatgcctcatcagtcaacactcggtgcacttcgcctcgccaaagaaaaagatgacgccgagtttgttgagaaatgcatgaccgaaatattcactattgataatccaattcgcgatgtagttattaaacgatacaagaagtgcaaaagctcgcaaaacattttagaagcgctttctcataagacgggtattgatattgattctgccaaaaggcgtatcaggtgggctaacaaggctgctgaggatatgatttattccattatgtcagaaagaaatagtaattaa

SEQ ID NO: 790 - DNA, 288 bp, Xenorhabdus bovienii
  Coding sequence Name=Xb4151_4152.C419.gene47.dna; Position on contig =41444..41731bp; Strand=-
gtgaaacagaaaacctaccgcagtaaaaaatggctggcagcagttggtcaaattgaatgctgtgttagatgtgggagattcggcattcaggtagcccaccggaacgaaggaaagggaatgggattgaaggttgatgatagtctcacggcagctctgtgtcctgaatgccatcatgctatcgacaatggaaccgacatgagcagagacgagcgtagacacgagatggacaggtctattgttcttaccgtcaaggaactgaccaggaggggattaattggagcattatga

SEQ ID NO: 791 - DNA, 669 bp, Xenorhabdus bovienii
  Coding sequence Name=Xb4151_4152.C419.gene48.dna; Position on contig =41801..42469bp; Strand=-
gtgaacgaaatcagaaatggaaattacctgaaaatcaatggggatcgatatcagagtatttttgtagtcggcgacctccacgggtgctatcagttactgacggataaaatgcaacagattgattttaattatgaaaatgatttgttgatatcagtgggcgacctgattgacaggggggatcgaaatgtcgaatgcctcgacctgataactcaaccgtggttcagggcggttcggggtaatcatgagcaaatggcgatagatgcgctatttcacaatggcgatagtgacctctggttccaaaatggcggtcactggtttctctacttggattatgagcaggaaatactggcaaaagcgctcttagcgaaagctgaacagctgccgttaattatcgaggtcaacgcaggacacaagaaaatagtgatcgcccatgccgactaccccgatgacgaatatgagttcggcaaagaggttgactggtttgatgtcatctggaaccgaggccggatttacaatgctggtgttgatatcagtggagaaattacaggggctgacctgtttatatttggccacactcccgctgcaatcccagcaaaacactggaaccagctttatatcgacacaggcgcggtatttgggcatgggctgcatatggagcaaatcaaatga

SEQ ID NO: 792 - DNA, 444 bp, Xenorhabdus bovienii
  Coding sequence Name=Xb4151_4152.C419.gene49.dna; Position on contig =42466..42909bp; Strand=-
atggagtgtaattttctattccatgaatcaaccaaacacaccgcatggcaacaactcaaagaagttctcgcaacaaaccaacctcaccgcattattatcaaaccgtggaaaaacacccgctcattatctcagaacgcgaccgcacatatgtggtttggcgagattagtcgttttctgaaatctaatggcgctaaattctcaccggatgaagtcaaggaaatgatgaaacacacatttttgggctatgaggcagtggagcggattgatgccagaactcaggaaccagagcgtgtcaggacactgcgccagacctccaaattggacacaggcgagatgtttcgattcatggagcaggttgaacaatgggctgctggattaggttgttttgtgacaattccgcatgacagcgagtatatgaaactcaaagaggagcaagaacggtga

SEQ ID NO: 793 - DNA, 450 bp, Xenorhabdus bovienii
  Coding sequence Name=Xb4151_4152.C419.gene50.dna; Position on contig =43079..43528bp; Strand=-
atgaaactaaaaacgagtgagctgactggtcgggcgttggatttttccgtagctaaagcgacagatatggatatttatatttttggccgccctagtgatgctgaatatggatggattggtaataacaacgtcacaatggagtcatttttaacgtccatagttactattgatttttgtgggaaaatgcgtattgagttcaacggtgaagcaaaatcttactctccatcaactaactggtctcagtgtggcgagttgattgagaaataccatattgaattgtattttaattcagtaaacgaagtctggtcggcatacatatttaattatgaaaagtttgaaagtgtaattgaagatggcagcaccccacaaatcgccatctgtcgcgcggtagtggctgctaagttgggtgatgagatagagataccagatgagctggtggagggggtatga

SEQ ID NO: 794 - DNA, 276 bp, Xenorhabdus bovienii
  Coding sequence Name=Xb4151_4152.C419.gene51.dna; Position on contig =43525..43800bp; Strand=-
atgagtctagatctactacatgaacgtgaaaaagaaagggcagcagatgccgtcaaaatcaacaatggacgtaagccgcagtttggtgaccacatgcgcaatccgtgggcgggagaaattaacccgcatcgggatggctattttgtcagagcgcgacgtgttactggaaaatttaatcccggcttgtggtatcagatgaccgacaaaaaaggccagttttgggagattgaaggtaagtacgcaatattcattgatcatttggagggggtgaaatga

SEQ ID NO: 795 - DNA, 1371 bp, Xenorhabdus bovienii
  Coding sequence Name=Xb4151_4152.C419.gene52.dna; Position on contig =43823..45193bp; Strand=-
atgaataattacgattttgaatccagtgtgattggcggattgttgattagtggactcacacctgatgccagtgatgtattggcaacactggagccagaggcgtttgctaccccgttctaccgagaattattcaaaaccattcgctcacaggccaaaaccagagggttaattgattctctgatggtggctgatgcgatgggtgaaaatcatttcgccaatgtcatgatgactgccaagaactgccccagcgccgctaaccttactggctatgcgaacacagtttcagccaactatgagcgcaggctcatgattgagttaattgatgaggctaaggaacgcattctgagtggcacggttgagaatgcagcggagtctatggactggtttatttcccaagttgcagaggtgcgtaagccacgcgatgagatccgtccgctgcatgtttctgagttactggatgattacactgaggttttggagaaacgcctcaaaaatggcgagcaatcagacacgttgaagaccggcattgaagagctggacgagatcaccggtggtataaaccccgtcgatttggtgattgttgctgctcgccccggcatgggtaaaacagagtttgcgctgaaagtcgcggagggagtcgcaaaccagacaatcacaggaaccaaacagaaacgcggtgtactgatcttctcaatggaaatggattcccagcagattatcgaacgccagttggctggagccgctaacctgccagtatcagctttacgaaatcctgcccgactggatgatgagggctgggattgggttactgttggactgaggcgattacaaaatctggatgtatggatcattgatgccagtaaattgacggtggagcaaattgcttcaatttcacggcgccacaagaaagcacatccggcattatctctcatcatggttgattatctggggctgattgataaaccaaaggcagagcgtaatgatctggccgtggcgcatatttcttccagcttaaaacgactggcgaaagacctaaaaacgcctgttatagccctgagccagctatcccgcgatgttgaaaagcgcgcagataggcgtccggtcaacgcagacttacgagattccggcagtattgagcaagatgcggacagcatcatcatgttgtatcgcgatgcggtgtacaatgagaattcccccgcagcgccctatgctgaaattattgttacaaaaaacaggttcgggcagcttggaacggtctatcagcgtttcaaacatggtcatttcatgccgactgatcaggacgaggccgcgcggatctgtcatagcaacgataaaccacaaaagcgcttcgcgaaaggcgctaacgtttaa

SEQ ID NO: 796 - DNA, 846 bp, Xenorhabdus bovienii
  Coding sequence Name=Xb4151_4152.C419.gene53.dna; Position on contig =45186..46031bp; Strand=-
atgagtaacgttgcatacgctgattttggagctaaaaacaggcaagagaggccgacggtgacagtggcgaatcttgaagatgggttcaccagaatagcaaatgacattcttgatgccgttttgttgtctggcttcaatgcaacgcagttgcacattttgattgctatctggagaaaaacctacgggtttaataaaaaaatagactggattggtaatgatcagttcgaacgaatgaccaccaaagacagcactaaatgctctaccgcaaaaaatcagttaatcaagatgaaagtgctgatacaaaacggtcgtcaggtgggcatgaacaagaacatttcggagtgggagaccaagtttaacggattcggtaaaagttttaccaaatcggtaaagaaaagttttaccgaatcagtaaacgactctttaccgaatcagtcaaacacaaaagacaatattacaaaagacaagaaagacaataatacaccccttacccctcaagaggggaatgaggatgaggtggctaaacctaaaaagcgaaaatccactcccagcatcaactacgacgaatacctcagtgcctacaacgaggaggttggcgagaaattaccacacgctgtagaagccaatagcagacgccaaagagccttaaagaaaatcatttcaaagctagtcactcagaacgtggatggctggagagcttacgttaaggcattcgtgaaaatggctcgtccgttttattttggagaaaacgacaggggctggacggcggatattgattatttgctgagagaaacaacgctaactggcgttcgtgaaggaaaatttgtagggagagatcatgaataa

SEQ ID NO: 797 - DNA, 168 bp, Xenorhabdus bovienii
  Coding sequence Name=Xb4151_4152.C419.gene54.dna; Position on contig =46024..46191bp; Strand=-
atgaaaccgaaatttaatcacagcgcagtgcataaaaatctcacgcgcgaacgggaggctcgtttagtcaccgaacagggatgtgaaaaactgcgtgatgctctggaggatgccaaattgcggctggagcatcgcgaggaactgaccggagggaaacgccatgagtaa

SEQ ID NO: 798 - DNA, 363 bp, Xenorhabdus bovienii
  Coding sequence Name=Xb4151_4152.C419.gene55.dna; Position on contig =46251..46613bp; Strand=-
atggaagtcgcaaaaactcgcaatactcgcgttacgtgtaaaccccaagagctggaaacattttggttcaaatcagccgcggaaactggaaacagtccgttagccagagacatgggaattcacccaacgggattgagtcgggaaaagagccggatcgtaaaactggctagcaggttggttgtggaattggggttaccagaaggaagcgttgcagcgccgggatgtgaggcgaacattgttctgacaggcattgaagccagccaattgttatcagcattggataacctcagatacccaaaaagaaaaacctcggctgttcgagcaaccgaggcttctgaaatgcaacttgagatgtcgatttaa

SEQ ID NO: 799 - DNA, 228 bp, Xenorhabdus bovienii
  Coding sequence Name=Xb4151_4152.C419.gene56.dna; Position on contig =46753..46980bp; Strand=-
atgcgatctttggaagaaccaattaaaaatattggcattaccgaagtagctcatgcatgtggagttagcgaaagagccgtttataagtggcttaaaaacggatttctccccaagacagagttttttggtaagaccaactatgccgagaagatccaacaaatttctgatggcaaatatcaggcgaacgatttgttagatatcagcaggaaaaaactgctctcagcataa

SEQ ID NO: 800 - DNA, 447 bp, Xenorhabdus bovienii
  Coding sequence Name=Xb4151_4152.C419.gene57.dna; Position on contig =47061..47507bp; Strand=+
atggtacagacagaaaaaacgcgcgaacaattttcccagcggctggcgcaagcctgtgagcgggctggtctaaatgaacatggtcggggagctgcgatagtcagagctttaggggtgtcatctaaggcggtgagcaaatggtttaattcggaatctttacctagacaggaaaagatgaatgctctcgctgattaccttaatgtcgatatcgtctggctacagcatggtatagataataccagcgataacgctcgcccagagaaaacacgggaagttaaaccactagttagaaatctaactaaggaacaagaagaactattagaactatttgataggttgccggcagaagaagctaagcgttttttgaaagaaatgcagacaaaagcggcacattttgatgcgattttttcggaaatgctggcaaaacgtggcagtaaagcaagttaa

SEQ ID NO: 801 - DNA, 502 bp, Xenorhabdus bovienii
  Coding sequence Name=Xb4151_4152.C419.gene58.dna; Position on contig =47720..48221bp; Strand=+
gtggcaaaatctacagattaccttcctagtcaggcagaagttgataatgtgctttactgtaaaaagcaggttgattttactggtgttagatggggggagaaaccacccccaaataaaccttttttatggttacaaatgagcctgctcccaacagactctgatggtatacctattcaagggttatctgttcttatccagtggaaaccagatcatgaacccaaacgggaaggagatccggtttatccaaagataaatatcgtagctttttataataaaaaacgagtttttgctgttgatacatatccatttgatggacatacaaatcgttacagaatagaccacccagactttaaagagtatgtattaggcgctcattatcatatttactacgaagaagcagggcattatagtggagtaggatttccaatcaaaagcaacataaagccagatgatttgcttggatattggaattttttctgtgagaaactaaatattacttgta

SEQ ID NO: 802 - DNA, 1200 bp, Xenorhabdus bovienii
  Coding sequence Name=Xb4151_4152.C420.gene1.dna; Position on contig =19..1218bp; Strand=+
atggaacaagaagttcgtcgtcaggaagaacacattgaactgattgcttctgaaaactacaccagcccaagagttatgcaggctcaaggatctcaactcaccaacaagtatgcggaaggctatccgggtaaacgttactacggtggctgcgaatatgttgatgtggttgaacagcttgcaattgaccgtgcaaaagaactgtttggtgcagattatgccaacgtccagccacactccggctctcaggcaaatgcggcagtatacatggctctgttgaaaccaggcgacaccgttttaggaatgaatctggctcatggtggtcatcttactcacggttctccagttaacttctccggtaaactctataatgtagtcccttatggtattgatgagagtggcaaaatcgattacaacgatatccgttctcaggcacagaaacatcagccaaaaatgatcatcggcggcttctctgcctactccggtgttgttgattgggcgaagatgcgtgaaattgccgatgaaatcggggcttatctgtttgttgacatggctcacgttgctggcctgatcgcagcaggtgtttatccaaaccctgttcctcatgctcatatcgtcacaacgacaacgcataaaacactggctggcccacgtggcggcctgattttagcgaaaggcggcgatgaagaactgtacaaaaaattgaactcttctgttttcccaggtggccagggtggcccgctgatgcatgttatcgcgggcaaggcggttgcactgaaagaagcgatggaacctgaattcaaaatatatcagcagcaagtggctaaaaatgccaaagcaatggtcgatgtatttttagagcgcggttataaagtcgtttcgggtgggactgaaaaccatctgttcctgctggatctggtggataaggagattacgggtaaagacgctgacgctgcattagggcgcgctaatattaccgttaacaaaaacagcgttcctaacgatcctcgcagtccctttgtgacttctggtatccgcattggtactcctgcaatcacccgacgaggattcaaggaagcagaaacttgcgaactggctggctggatgtgtgatgtgctggataacatcaatgatgaagcgatcattgaaaacgttaaacaaaaagttttggcaatctgcgctaaatacccggtttacgcataa

SEQ ID NO: 803 - DNA, 1254 bp, Xenorhabdus bovienii
  Coding sequence Name=Xb4151_4152.C420.gene2.dna; Position on contig =1295..2548bp; Strand=+
atgggggatttgatggttgttccatcgacattttggctggggttaagttatttcacttactttttttcttttggcatctttttgccattttgggcggtctggttgaaaggtgagggaattgaaccagccattatcggaatattgttgggagtaggcttagttgcccgtttcctcggtagtatgtttattgcacctacagttaaagatccttcgaaattaatcactgcattgcgattactgtccctattggcactgctctttgctattggttttacatttggtagccattgggcatggattttctttgtcatgataggtttcaatctgttcttttcgccactggttcccttatcggacgccttggcgggaacgtggcaaaaacagtttacttttgattatggcaaggtacgggtctgggggtcgattgcctttattatcagttcttcgctaacaggtatattgatgtcttccaatggcatcaacttttcaatcagcaatttagaattgagtctttcttttgacagaataaataattgggttggaagcaatttgtttggccatcaccatatcattcttgccttcttgattttcagcctttctgtcatgttgctgggtatgatgttaaaaccatccattatgcctgcgggtaagatcaaagccgtaaatactcatatggtatcgtttaaagaactgctgtctgagaagtctgtatggcagtttttattgtgtgtcaccttattacagggagcacatgcaggttattacagcttcggttccatttattgggaaaatgcaggctattcttcagcaaccatcggttatctctggtcgctgggcgttgtgacagaagtcattatttttactttcagtaagcagttgttccgtcgttggaatgcccgtaacttactgttgctctctgctatttgtggcgttcttcgttggggactgatgggcatatcaactgaattgccagtgctgatcatcattcagctcctgcattgcggaactttcacagtttgccacttggcggctatgcgttttattggtgccagaaaagaaaatgaaattattcgattgcaggcaatttactccgggttggcgatggggggaggtattgccgtgatgagtgtgattgctggattcttatacgaatatatgcaaagtggcatctattgggtgatggcgttagtggcatttccggcgcttttcctaaggcctaaagtagaagcacgagtgcactcattacctaaataa

SEQ ID NO: 804 - DNA, 804 bp, Xenorhabdus bovienii
  Coding sequence Name=Xb4151_4152.C420.gene3.dna; Position on contig =2621..3424bp; Strand=-
atgcatccgatgctaaccatcgctatacgcgctgcgcgtaaagccggcaattacattgccaaaagctacgaaacacctgatgccgtcgaagctagccaaaaaggcagcaacgattttgtaactaatgttgatcgtgaagcagaaaggctgatcatcgatattatccgtaagtcttaccctaagcacaccattatcactgaagaaagcggtgagcacttaggtgaagaagacgatttccactgggtgatcgatccactggatggcaccaccaactttattaaacgtcttccccattttgctgtttccattgctgtgcgcatcaaaggccgtaccgaagtggctgtagtttatgatccaatgcgcaatgaactgttcagctcagcccgtggccaaggcgcacaattgaatggttatcgtctgcgtggcaccaatgcccgtgatctggatggcacgatccttgccactggtttcccattcaaggcaaaacagcacactaccccttatattaaaatcctgggcaaattatttgaccgctgtgcagacttccgtcgcactggttctgctgctctggatatggcgtatgttgccgccgggcgtgttgatggtttcttcgagattggtctgaagccttgggattttatgggcggcgaattgctggtacgtgaatcaggttgcatcgttaccgactttgtcgggggtcacaattatatcaactccggtaatatcgttgcaggtagcccacgtatcgttaaagacatgttgtctgaaatgcgtgaagaattaagcgaagcattaaagcgctga

SEQ ID NO: 805 - DNA, 240 bp, Xenorhabdus bovienii
  Coding sequence Name=Xb4151_4152.C420.gene4.dna; Position on contig =3384..3623bp; Strand=-
atggccctggcagctgaccccatgttgcccgtgtgggaagtttctaccagaataatgcggatattctctaacatgacggcttttagattcggtataagagtcgaatatcttaacacagcattagttattttgccgaactactgctatagtacgacccgatttatttcccgttctttaacatcccggtggaagataccccatgcatccgatgctaaccatcgctatacgcgctgcgcgtaa

SEQ ID NO: 806 - DNA, 735 bp, Xenorhabdus bovienii
  Coding sequence Name=Xb4151_4152.C420.gene5.dna; Position on contig =3550..4284bp; Strand=+
atgttagagaatatccgcattattctggtagaaacttcccacacgggcaacatggggtcagctgccagggccatgaaaacaatgggattaaccaacctttatctggtgaatccgctcgttcaacctgactctcactctattgcactttcagcaggtgccagtgatgtcattggtaatgcaacaattgtgaatacactggatgaagcattggctggatgtgagctcgtcatcggaaccagtgcccgttcccgtacgctttcctggccgatggttgaaccacgtgaatgtggagaacgctgtattaaggcagccggccattccccggttgcagttgtgtttggccgtgaacgtgttggcctgacaaatgaagaattacagaagtgtaattaccacctttatattccgaccaacccagaatatggctcgttaaatctggcaatggctgttcaattggccagctatgagattcgcatggcttatctcgcagttcaggaaaagtcagaacacgtggaatccacggaacatgaggtagaatatccccctgtcgaggatatggaacgtttttatcagcaccttgagcaggtattgaatgattctggtttcattcgcaaggcgcatccaggacaaataatgaacaagttaagacgtctttatacccgtgcacgtccagaaactcaggagctgaatattctgcgtggtatactgacttccatgggaaaatggtctggaaaataa

SEQ ID NO: 807 - DNA, 555 bp, Xenorhabdus bovienii
  Coding sequence Name=Xb4151_4152.C420.gene6.dna; Position on contig =4385..4939bp; Strand=+
ttgactaaaacactcaggaatgccacaatttcactcatatttcaccatggagtttttgttatgagactgacatcaaaaggacgttatgcggtaacagccatgctagatgtggcgttgcattcacaagaagggccggtgccattagccgacatttctgagcgtcagggaatctccctttcctatcttgagcaattgttttcccgcctgcgtaaaaatggtttggtttctagtgtccgtggtccaggtggcggctatttgctgggcagaaatgccggtaatattttcgttgccgaagtgatttctgctgttgatgaatctgttgatgcaactcgctgtcagggcagggaaggctgtcaaggtggtgatcgttgtctgacccatacactgtggcgtgatctcagtgatcgcatcacgagtttcctcagcagtattagtttagaagaattagttaagaatcaagaagtcttagacgttgctgatcgtcaagacagcgataaacgccgtacacctaacggcaggcctcaagagacgattaacgttaacctgcgtgcgtaa

SEQ ID NO: 808 - DNA, 1215 bp, Xenorhabdus bovienii
  Coding sequence Name=Xb4151_4152.C420.gene7.dna; Position on contig =4990..6204bp; Strand=+
atgaaattacccatttatttggactattcagcaactacaccggttgatcagcgtgtagctgaaaagatgatgaactatctgactatggacggggttttcggcaaccctgcttcccgttcacaccgttttggctggcaggctgaagaagcggttgatattgcgcgtaatcaaattgcagatttggttggagctgacccgcgtgaaatcgtgttgacttcaggtgcaacagaatcagataacctcgcgatcaaaggtgctgcaaaattttatcagaaaaaaggcaagcacattattacctgcaaaactgaacataaggccgttttggatacttgtcgccagttagagcgtgaaggttttgaagtgacttatcttgcgccgatgagcaatggcatgcttgatctgaaagaactggaagccgccatgcgcgacgatactattctagtttccatcatgcatgtgaacaacgaaatcggtgtcattcaggatattgtcaccattggtgatatttgccgcagccgtggcatcatgttccacgttgatgcaactcaaagcgttggtaaattacctatcgatctcagcaaattgaaagttgacctgatgtctttctctgctcacaaattatatgggccaatgggcatcggagcactgtatgttcgccgtaaaccacgcgcccgtattgaagctcagcagcatggtggcggtcatgagcgcggtatgcgttccggtacattgcctgttcatcagatcgtggggatgggtgaagcttaccgcatcgcaaaagaagggctggaaacagaatcagaacgtctgcgcggtttgcgcctgcgtttgtggaacggtattaaagatattgaagaagtttacctgaacggtgatttggaactgggtgcaccacacattctgaatgtcagcttcaactatgttgaaggtgaatcattgatgatgtcgttgaaagatttggctgtttcttctggctcagcatgtacttccgcgagtctggaaccttcttatgtcctgcgtgcgctgggcatgaatgatgagctggcacacagttctattcgtttctctttgggacgttttaccacagaagaagaaatagactatgcaatcaaattgattcacaacgcgattggtcacctgcgcgagctttctccattatgggaaatgttcaagcaaggtgtggatatcagcgccatcgagtggtctcatcattaa

SEQ ID NO: 809 - DNA, 387 bp, Xenorhabdus bovienii
  Coding sequence Name=Xb4151_4152.C420.gene8.dna; Position on contig =6229..6615bp; Strand=+
atggcttacagcgataaagtaattgatcactacgaaaacccacgtaatgtgggttcatttgacagtgaagatccttcagttggcagtggcatggttggtgcacctgcttgtggtgacgttatgagactgcaaatcaaggtcaataacgaaggtatcatcgaagacgcgcgttttaaaacctatggttgcggctctgcgattgcgtccagttctctggtaacagaatggatgaaaggaaaatcgctggaacaggctgaggctattaaaaatacagcgattgccgatgagctggaattaccacccgtgaagattcactgctctattctggcagaagatgctatcaaagcagcgattgcggattataaaagcaagcgcgaagctaagtaa

SEQ ID NO: 810 - DNA, 315 bp, Xenorhabdus bovienii
  Coding sequence Name=Xb4151_4152.C420.gene9.dna; Position on contig =6698..7012bp; Strand=-
gtgaaaactttccccacaaccgcactcgctggaaacattggggttattgaatttgaagccttcgttcagaccttctttagcaaaatccaactcagtaccatcaaggtaaacgatgcttttaccatcaacgatgactttcacgcccttgtcttcaaaaacttgatcttcttcgttaacggtatcagcgaattcaagtatatatgccataccagagcagccggatgttctcactcccaaacgcaaccctacccctttcccacgattatcaagaaaagccaaaatacgctgggctgcactttctgtcagggaaattga

SEQ ID NO: 811 - DNA, 105 bp, Xenorhabdus bovienii
  Coding sequence Name=Xb4151_4152.C420.gene10.dna; Position on contig =6963..7067bp; Strand=-
atgttttgcaaatacagatatttcgtaaagtgctcagtcaaaaaatgggttaaacgtgaaaactttccccacaaccgcactcgctggaaacattggggttattga

SEQ ID NO: 812 - DNA, 522 bp, Xenorhabdus bovienii
  Coding sequence Name=Xb4151_4152.C420.gene11.dna; Position on contig =7077..7598bp; Strand=+
atggactattttactttattcgggctgcctgtacgctacgtgattgaccgtgaacaattgtcgatccgttatcgggaattgcagcgtcagtttcaccctgatcgttttgctaaccagccagaacgtgaaaaagcgcaggctcttcagcaagcgtccatcattaatgatgctctttatactctgatacatcccttaaaacgtgcagaatatatgctgtctcagcaagggttcaatttgtccggcgagcagcataccatgcaggataccgcgttcctgatgcaacagttggagttgcgtgaagagcttgatgccattgagcatagcgcggagccagaaatcgcattggccgatttttcatctcgcttgagtaaaatgatcaaaacacgcagtgagcagatggaacagcagcttgatgctgcacaatggctaattgcagccgataccgtccgtaaattacgctttctggataaattgcaacagcaggttgaacaactggaagagcggttgctggatgatttttag

SEQ ID NO: 813 - DNA, 1848 bp, Xenorhabdus bovienii
  Coding sequence Name=Xb4151_4152.C420.gene12.dna; Position on contig =7655..9502bp; Strand=+
atggctttattacaaatcagtgaacctggtttatctgccgaaccacatcagcgtcgtctggccgtggggattgatcttggtacaacacactctctggttgcgacagttcgcagtggtcaggtagaaaccttggcagacagtgaaaaccgtcacttacttccttccgttgtacaatatcgcaaagatgaaactcaggtcggctggcaggcgcgtcagcaagcggcatccgatcctgttaataccattatttccgtcaaacgcatgatgggacgctctttggctgacattcagcagcgttacccaaatttgccataccagcttcaggcaagtgaaaacgggctgccgttaatcaatactgtggcaggtctggtggatcctattcaggtttcttctgaaatattaaaatcgttggcacaacgggcagaagaaaccttggatggcaaacttgatggtgttgttatcactgttccggcctattttgatgatgcgcagcgacagggaacaaaggatgctgcgcgtttagcaggtctgcacgtcctgcgccttttaaatgaaccgactgccgctgctattgcttatggtcttgattctggtcaggaaggtattattgctgtttacgatcttggtggcggaacattcgacgtttctgttctccgccttagccgtggtgtatttgaagttctggcaaccggtggtgataccgcactgggcggtgacgattttgacctgttgctggcgaattggatccgtgaacaggccgggatcagcgatagtgaccacgggttacagcgtcaactgttggatgtcgcgacgcaggctaaaattgctttgagtgatgcagatacggctgagatcaacattgcaggctggcagggcaatattactcgtaccgaatttaatgagttgatcgtatctctggtcaaacgcacattactggcctgtcgtcgagccctgaaagatgcgggtgtcacaacggatgaagttttgcaggtagtgatggtcggcggctcaacgcgcgtaccattggtacgcagcatggtgggcgaatttttcgaccgtgaaccactgacctctatcgatcctgacagagtcgttgctgttggggcagcgattcaggctgatattctggtcggtaataagcctgatagcgaaatgttactgctggatgttatcccgttatcactcggtctggagaccatgggtgggctgatcgaaaaagtcattccacgcaacaccaccattcctgtggcaagagcgcaggagtttaccacattcaaagacggccaaggtgcgatgagtatccatgtggttcagggagaaagggagttagtgaatgattgccgttcactggctcgtttcacgctgcgtggtattcctccattaccggctggtggtgcacatattcgcgtgacttttcaggtcgatgcggatggtttgctgagtgtcagcgccctggaaaaatccacgggcgttgaagcttccattcaggttaaaccttcctatggcctgtctgatgcggaaatcgcccgaatgctcagagactcaatgaccaatgcgcaggaagatattcaggcgcgtaaactggctgaacaaaaagtagaagcggcgcgggtgctggaaagtttaaccagcgcactggaaaaagatgccgacttactgagtcaggaagaacaggctgccattgatgctgccgtagaagtattaatcgagagcgcacagggaacctcttctgatgcgattgaaagtgcaattaaacaattggacaaacaaacgcaggagtttgcagcgcgtcgcatggacacatcaatccgccgggctttggcgggtcattctgtggatgagatttaa

SEQ ID NO: 814 - DNA, 336 bp, Xenorhabdus bovienii
  Coding sequence Name=Xb4151_4152.C420.gene13.dna; Position on contig =9505..9840bp; Strand=+
atgcctaaaattgtatttttacctcataacgaactttgccctgaaggtgcagtattggaagccaaagaaggcgaatcgattctggatgttgcactacgcaatggtatcgaaattgaacatgcctgtgaaaaatcctgtgcgtgtaccacttgtcactgcattgtcagagagggctttgactcattaaaggaaagctctgaattggaagatgatatgctggacaaggcatgggggctggagccagaaagccgtttgagttgtcaggccaaagtcactgatgaggatttgattgttgaaatccccaaatactccattaaccacgcgcgcgagcactga

SEQ ID NO: 815 - DNA, 120 bp, Xenorhabdus bovienii
  Coding sequence Name=Xb4151_4152.C420.gene14.dna; Position on contig =9818..9937bp; Strand=-
gtgaaacgcaccgttttggggtctaaatccggaaatttatcatacagtgcttcaccaatgtcacgactgtcagcccatttcattttccattctcctatcagtgctcgcgcgcgtggttaa

SEQ ID NO: 816 - DNA, 99 bp, Xenorhabdus bovienii
  Coding sequence Name=Xb4151_4152.C420.gene15.dna; Position on contig =9986..10084bp; Strand=-
gtgaacttgtgctatttttttcacacttcatttgactactcaaattcatctagccaaaccagcaaaatagcttctaggattttttcgttggatttctga

SEQ ID NO: 817 - DNA, 1311 bp, Xenorhabdus bovienii
  Coding sequence Name=Xb4151_4152.C420.gene16.dna; Position on contig =10207..11517bp; Strand=+
atgacaaagcaagctatatcaaagcaaatcatgccgataacactgtcttatgagccagctaacgcttgctggggtgaaaaagcgctagttagttcaagtgagcaaggaattaccatccatttggagggtaatggtaaatccggagcaatccaacgtgctggacgtaaaattaatgggcagggtatccacaacgtcgctttgacaggtgaaggttgggatctggaaaaaagctgggcattctggcaaggctttcgtggttcaaaggggctgcgtaccattgaatggccacaattacctgcggtagacaaaaaagaactggataatagaatcaaattcgttgattgggtgcgagataccatcaacatgccggcagaagaattagggccagagcaacttactcagcgagcgattgacctactgaatggtgtagcgggtgatgccattagttatcgcatcataaaaggcaacgatttacgtgagcaaggttatgttggggtgcataccgttggccgtggttcttcccgtgatccggtttttctggcgttggatttcaatccgacaaaagaggaaaacgcacctgtatttgcctgtttggtaggtaaaggcatcacctttgactcagggggttacagcctgaagccgtctaattccatggattccatgaaatcagacatgggtggctctgcaacattgacgggcgcactggcattggcgatcagccggggtttggaacagcgggtcaaattatttctgtgcatcgcggacaatatggtgagcagcaatgccttcaaactgggcgacatcattcgttatcgcaatggtaaaactgttgaggtgatgaacactgatgcggaagggcgtttggtactggctgatggcttgattgatgccagtgcggagaaagcaccccttatcattgatgctgcaactttaaccggtgcggcgaaaatggcggtaggtaacgattaccactctgtattcagttttgatgatcaattggcagcagacttgctggcagcggctgatgctgaaaatgaattgttctggcgtctgccattggctgaatttcatcgtagccaactgccatccaattttgctgacctgaacaatattgcttcaccttctcactcagcaggcgcaagtacagcagcggctttcttgtctcattttgtggaaaactacaaaaaaggctgggtacatatcgattgttcagcaacttaccgcaaatcggctgttgaacagtgggcggcgggtgcaacagggtatggtgtgcgcacaattgctaatctattgctggctaaagcaaaataa

SEQ ID NO: 818 - DNA, 120 bp, Xenorhabdus bovienii
  Coding sequence Name=Xb4151_4152.C420.gene17.dna; Position on contig =11494..11613bp; Strand=-
ttgaagttaaagactattgaaaggttcaatcatagtcttccctttttaagggagactatgaataaaggtaatcttaaatctattgggtatcgctgtttattttgctttagccagcaatag

SEQ ID NO: 819 - DNA, 432 bp, Xenorhabdus bovienii
  Coding sequence Name=Xb4151_4152.C420.gene18.dna; Position on contig =11641..12072bp; Strand=+
atgagcttatcaaatgggtctgttgccaccgaaatggaggttctcagtggaagtcgcattaccctcagtcagccagaggaacaaccaagccagcttattgacgccttgagtggtttatttaagcagcacaaacctgtgcgacgggcttttctgattatggctcacgacaaaaatctggatgagaaacccaatctattaattgggctagaattgagtgacgcaccgatagacaatgatatcaatgtgctcattcaagaggcaggggaagtggcctgtgaataccttacggaagatgaatcggtagatttttgcctgatcaatgaaaacgaaaggggtattagccattacctgattcagcatactcagcctttctaccagcgaaaattaggaagctggctgcgcgataccattcctgttgttaatcgggaataa

SEQ ID NO: 820 - DNA, 126 bp, Xenorhabdus bovienii
  Coding sequence Name=Xb4151_4152.C420.gene19.dna; Position on contig =12025..12150bp; Strand=-
atgatacttcctattttgcataaccaaagcacagaaaaaataactgaactttcatctagtacaaaatttttcctgcatttattcccgattaacaacaggaatggtatcgcgcagccagcttcctaa

SEQ ID NO: 821 - DNA, 5061 bp, Xenorhabdus bovienii
  Coding sequence Name=Xb4151_4152.C420.gene20.dna; Position on contig =12211..17271bp; Strand=+
atgtctcaacgtcaatcttggcaatggtcggcaaggaaaaagcgatatctcgcggtcatgcttgccacgttatttacgctattcgcgctatctgcatgcgatcaatccgaaagtcctgcgaaagaaaatacagaagaacgacagacatcattgtctaagaatagtgatactgccaatggtcatgcaaaatcggcagctacatcgcctgagaacaaacaagctacggcaaaaaaacaggaaccccaatcgtcagcacagcgctatgcgggtaaagacgtcacgatcctggatgcatcagatctgcaattggatggtgccagtgcgatggttgtgacattttccgttcctttagactctaatcaagatttttcacagaaaatacatctggttgatgtgaaatcggggaaattagagggtgcatgggaactgtccaataaccagatggaacttagactccgtcatttaccgcctgaccgtgaattgcagctaaccgtggacgaaggcgtgaagggtatcaatgaacgccaattggcaaccgcatatgagaaaaaattcaagactgctccaattacaccaactgttggtttcgccagcaaagggctgcttttgccaagcaaagcagcagaaggcctgcctgttctggcgctcaatgttgaccgtgtagatgtaaactttttccgtataaaagatgaggccctgccgtcatttattgctgattggcaatacagcaacaacatgaattactggaattccaaagagttactgaaagatactgagttagtctacactggccgcttcgaccttaatcctactgctaatacccgtgaaaaattactgctgccattaagtgacatcaaagagctgcaaagagagggtgtttatctggcagtcatgcagcaggcaggaaaatatacctatagtaatccgagcactctgtttaccctgagtgacattggcgtttcgatgcacagctatctgaatagggtagacgtattcactcagtcattggaacaaggttccagtctgaaaggtgttgaaattcgtctgctggatgcaaaggggcaacttctgtcaaaagccacgacagatagtgatggacatgccacactggaaaaaaatgctaaggcaaaattattgctggcgatccagggtaggctaaccagcatgatagacctgacatctcctgcacttgatctgtctgaatttgatatcggtggctcacaggggtatagcaagcaattctttgtatttggcccaagggatctgtatcgtcccggagaaatgttgattgtcaatggcttattgcgtgatgcggatggccgtccgcttaagccgcaacccgtcaaggttgatgtattgaaagcggataatcaggtcgttcgcagttttgtctggcaaccggaaaatgaactgtaccaataccgttacccaattccccgcgaggctgaaacggggatatggtcactgagattcgatttaggtgataataccccgcgttattacaaattccacgtcgaagatttcatgccggaacgcatggcgttggaaattaaaagtgcatctaataatcagtcactgctgaagaatgaaagtgttaatttcgctataacaggtcgttacttatatggcgcacctgctgctgataatcgcctacaagggcaactgttcctgcgtcctgcccgtgatgcagtggcaaaattaccgggatatgaatttggctcttcaaaagaagaggggttgagccgaacattggacgaatttgatttcacgctgaatgccgaaggaaaggctaatctttcagttagtgaggatgaatggaaacaggtgacatcccccgtgaaagttatcgttcaggccagtctgcttgaatccggtggacgtccggtgacgcgccgtgctgaacaggcggtgtggccagccgaaaaactggctggtatacgcccacttttcaataaaaaatctatttacaactaccgaacaggacatgatgaaaaccgctataacgtcgatgaaaattcactggcagaatttgacgtggtttatgcggatgccagcggtaaaaaatatgccacgaatgatttaagaacccgtctgatatatgagcgccgggattattattggcgttggtcagacagtactggctgggattcagggtatgaccagaaagatttagtcatggctgatgacactattcaaattgcggaaaatggcacagccaaagtcagtttccctgttgaatggggttcttatcgcattgaagtggtgaatccacaaaatcagctcgtgaccagcctgaatttctgggcaggttattcatggcaggataataccggaggtacaggcgccattcgtccggatcaggtcaagatgtcattagataaacccgcgtataaatcgggtgataaagtgaagttgcacatggttgcgccacaggaaggtaaaggttacttgctggtggaatccagtgatggcccactgtggtggcaggaaattgatgtaccggaaaaaggtctggatattgatgtgccaatcaatcaggaatgggctcgtcatgatttgtatctgaccgcagttatcgtgcgtccaggggataaatcccgtcaggccacgccgaaacgggcgattggggtattacacttgccgttgatggatgaagggcgcaaattgaatctgaccttgaatgcccctgataagatgcgtccaaatcaggatctcaccgttaaaatcaaagcgacttctcagcaggggcaaaaactgcctaaacaaatttatgtcctgctttctgccgtagattctggcgttctgagcattactgactttaaaacccccgacccttatgacgctttctttggacgtaagcgttacagtgttgatcagtatgatgtttatggccatctgattgaagccgaagggcgtaaggcgaatttgcgttttgggggagatggtgatgaaaatgtactcgatagaggcggtaaaaagccactgacggaagtaaaaatcatcgcagaacaggctaaaccgattactctggatgctaatggggaaggggaaattaccttacctattcctgatttcaacggtgagctcagactgatggctcaggcgtgggggggggaggaatttggtcacagtgaacgcaaaatcatcgtggctgctcctgttattactcagatgtcactgcctcgctttatggcaggtggtgatcaatcccaattggcgcttgatctcacgaatctgaccgaacagccgcaggctattaccgtgaatttagaagcgaaagggctgatcaaattacaagacccgataagcaaaaaaatcattctggagacaggaaagcgaaccaccattcaaattccggtcaaggctgattatggatttgggcagggagaagttttcctgaccattgatggattgaatttgcctgatgaaaagctgaaacagtaccaaaatagctggaaaattggcgttcgtccggcgcacccggccaaaaccattcagtttgcagatgtgattcaccaagggcaaaactggcaattaccgcagacagccactgctggtctggtactggatactctggaggggcaattattgctgaccagtcggccaccactgcaaatcgcacgttatatccgcgaattgtatgcttatccctatggctgtttggagcaaacagtaagcgggctttatccatcactctattccaatgaagctgagttgaaaaaactgggcatcgatacgcaaactgatgaaaaacgtcggtcagccattgatgcaggtattacccatctgctgagtatgcagcgtcatgatggtgctttttctctatggaaccgtaatggtgatgaagagttttggttgaccgcctatgcgacagatttcctgttccgcgcaactcaacaaggttacagcgttcctgctgatgctctgaagtcggcgaatagtcgcctgctgcgctacttacaggataaaagtgttattactgatcgttacagtggttcccgcatcgaaacacaattttctgtgcaggcctatgcgggtttggtcttggcaagtcagcaaaaagcgccgttgagcggtctgagacagctttatgaacgccatcaacaggcaggaaatggtttatctctggttcagttgggtattgcactgaaaatgatgggggataatacccgtagtcatgaggcagttcgtttagggattaataaggcccgccaatctggctatggattaggtgattatggcagcacaattcgtgataacgcattgattgtttctctactgacggagaacaaaatgttgcagaaagagcgtgatgaaaagctgctcgacttatccaatgaattgtcaactcgccattacttctcgacacaggaaagtaattcgctttatctggcggggcgttacttgattgacgcttctgagcaatcttggaaagcagagattaatcagcaaatgccaccccttcaccgtgacagtgcattgactgaaacattgacagcgaaacagatcctagaaggcatcgatatcagtaatcgtggtgacagcacattgtattcgcgcctgaatgtggtgggatatccattggccaccccagaaccttcctcaaatgttttgaaaattaagcgtacttaccttgacttagagggtcactatttccctaccgagcgtatgagaagtggtgaaatggtggttgtgaaacttgaggttaatgcgacacagtcagtgccggatgcattagttgtggatttactgccggctgggttggaaattgagaatcagaatctggcaagtagcagtgctagcctgagcgaaagtgctacgggattgcaggatattgtcgaaggcatgcaacaggcgaatatccgccacatggaataccgcgatgatcgttttgtcgctgctgttgccgtccagcctcaccagaccgtgacactgttgtatcttgctcgtgcggttgcgccgggtgtctatcaggtgcccgcaccacaggtcgaatccatgtatgttcctcactggcgtgccgtgggtgaaacaaacgaaaaactggaagttgtccgctaa

SEQ ID NO: 822 - DNA, 2337 bp, Xenorhabdus bovienii
  Coding sequence Name=Xb4151_4152.C420.gene21.dna; Position on contig =17329..19665bp; Strand=+
atgagaagattgtcttcccgcatttatctgattgcgttggttattttattcgcactccttgcggcagtgtggctggcagataaaatctggccgctgccactgcataatgtcaaaatggcgcgtgttgtggtgggagaagatggctcgccactgtggcgttttgccgacaatgagggggtctggcgttatcctgttactttggagcaggtttctcctgaatatattcaggcattgctgacctacgaagatcgctggttttacaaacatccgggcatcaatcctgtttctttgctgagggcggcatggcaggacatccgtgcaggaaaaattgtgtcggggggcagcacaatctccatgcaagtggctcgattgattgatccacatccgcgcaccttcgcaggaaaattcaggcagatttggcgcacgttgcaacttgaatggcattattcaaaagatcaaattttggaaatgtacctgaaccgtgcaccattcggtggtacgttgcagggtgttggagcagcaagctgggcgtatctgggcaagccgccgtcagaactttcgccgggtgaagcggcattattggcggtattaccacaagctcccagtagcttaaggccagatcgctacccagaacgtgcacaggctgctcgagacaaagtattacagcgactgaagcgatacaatgtctggtcagcggaaaacgtcgctgatatcaaagaagaaaatgtatggctggcgcctcgtcaggttcctcaccttgcgcctttactggtaaggcgagtggcaaatggaaacccgcaggaagtgatccagacaaccattgatacaggattacagcgccaactggaggatatggttctcaattggaaataccaactggcggacaaaacatcgattggggtgttggttgttgatcatacggatatggcagttaaagcctatattggttcggtagaccttcaggatgacagtcgttttgggcatgtggatatgataagcgcatggcgttcaccgggctccacactcaaaccttttttatatgccatggcgctggatgatggattgattcatggggaatccttattgcaggatgttccccgtcgttttaatgattaccgtccgggaaattttgacagcggctttaatgggcctgtcagtgccagtgaagcgctgacgcggtcgttgaatttgccagcagtacaacttctcgaatcttatggtgctaaacgattcaccgctaatttgcgtaatgtgggaatggtactgcgtttcccgcttggcagtgagccgaacttatcgcttattttgggaggaacggcggctcggatggatgaactggtatctgtttacagcgctttcgcccgtcaggggaaagcttcgccgttgcgctttacaccacagcagaaaattcgtgacagacaattattctcagcaggggcagcttggattgtcaggagggtcatggcaggtgaaggacgaccaaagcctgatgatagcctgtctgccgaagtccctttagcgtggaaaacaggtacgagttacggttatcgtgatgcatgggcgataggcctgaatgcccgttacaccataggcgtgtgggtcggcaggccagatggcactcccgtagtagggcaatttggttatgctacggcgatccccattatgaaccagatcaacgggctgttaatggaaaatttacgctatagctcacagcgtattcctgttgatccgcgaccgataagtgtcagtcaggcaactatttgctggccgagcggaacaatgtttactaaagaaataattgctaaaggaggcagtaattgccgtcagcgtcgcttaagctggattttggataatacaattccaccaacgttgcctgccgttgggcaagaagggatttcgggtattaacgaacagatatggatagataaaaatggtttacgtgttgcttccgattgtcctgatgcccggcctgaaaccgtagtcttgtggccgattacgttggaagcatggctaccggcaaaagaacgtcggtcgaatcggttaccaccgattaatccccaatgtccccctctgaaaatagatgtggctcccttgctcattgtgggaattcgtgaaggggatatcctgaaacgcattccggggaaaaatacgctggacttacggataacaacgcagggtggtagcggtcagcaatggtggtttttgaatggtgaacaagtttttgtgacaaaaaacaaccagtcgtggggggaaactttgtcacagcctgggaaatatcaacttagtgttttagatttgagtgggcaaatcagtgcaatcaattttgttttgaagtga

SEQ ID NO: 823 - DNA, 561 bp, Xenorhabdus bovienii
  Coding sequence Name=Xb4151_4152.C420.gene22.dna; Position on contig =19840..20400bp; Strand=+
atgcactcttcaaaatttacaagaatgacggcttgcagtttggtgatatctaaattatctttattaattattatcatattgatagtaattaatatttatagctggctggagccaaagttaatattagagaaatatgggttaggattttcgctgacaaatagaatattattgcattttaatgagaatactcttagcccgtggaaactgaccagtgggatatttatatcgacaatcccattattgttcttgggagggagcctctgggcttttcatcagttattcagcaattatcggaagagtaattatttttccaagaatacggtgaaatatttggaatatgcaggttggggggtcatcatctgggctatgttagatattctttttgaacctttattaactgtttggctcaccatgggagcgccagcgggtcagcgatttttttcattgagtctaagtcctagccatcttgttgctatttttatttcggtttgcctggctgtcatttcgcgtattctttatcaagcatgtgatatatatgacgaaaataagagcattatatag

SEQ ID NO: 824 - DNA, 144 bp, Xenorhabdus bovienii
  Coding sequence Name=Xb4151_4152.C420.gene23.dna; Position on contig =20417..20560bp; Strand=-
atggcatcaagagtagagaatcgaatccctttaatttttcccgttttcagcaaagaaaggttttgttcagtaataccaatggcttgtgctaattctttagatttaacctttcgttttgccatgagcacatctagagtgatataa

SEQ ID NO: 825 - DNA, 327 bp, Xenorhabdus bovienii
  Coding sequence Name=Xb4151_4152.C420.gene24.dna; Position on contig =20666..20992bp; Strand=+
atgaaaatttttttatatgctttgctactggggttattttacattcctgtttcttttgcagattcgtcagcaaaaggtgttgataataaaatggagaataaacaatcaggtaatcaaggagcgttgagaaaatgtacacatctattgcctgaaggtcataagtataccattagcattattggtacatcagataagacaacaaaagaggccaataagcagttcaaaggggaatttaaactatcgagtggaagtaaaaagccattggataagaaaagaaatgaagagagtaaaccttttattcaatgcgtaacagagacggttctgtaa

SEQ ID NO: 826 - DNA, 93 bp, Xenorhabdus bovienii
  Coding sequence Name=Xb4151_4152.C420.gene25.dna; Position on contig =21082..21174bp; Strand=-
ttgagacaaagcgaattaagctgttttttacaccaatccaggatattggagatcacttactttctgccaatgcataccatcctgcccgattga

SEQ ID NO: 827 - DNA, 429 bp, Xenorhabdus bovienii
  Coding sequence Name=Xb4151_4152.C420.gene26.dna; Position on contig =21403..21831bp; Strand=+
atgacgattgaacgtactttttccattattaagcctaatgctgtgaagaaagatgctatcggttctatttatgcccgttttgaaagtgcagggtttaaaatcatcgcagccaaaatgctgtatttaacacgtgagcaggctgaaggtttttacgctgagcacaaaggccgtcctttctttgatggtctggtagaatttatgacttctggcccaattgtggtacaggttctggaaggtgaaaatgcggttcagcgccatcgtgatctgatgggtgctaccaacccggacaatgcactggccggtactctgcgtgcggactatgcagatagctttactgaaaatgcggttcacggttcagactccattgaatctgcaaaccgtgagattgcttattttttcagtgatgatgaaatcttcccccgccactga

SEQ ID NO: 828 - DNA, 138 bp, Xenorhabdus bovienii
  Coding sequence Name=Xb4151_4152.C420.gene27.dna; Position on contig =21928..22065bp; Strand=-
ttgtacggtttcgttaagttgggacatttttacatcgcctcgttgttacactttcggctctgtgctgatttaatttcagcactaagttttgattcggtgactatcaattcaataaccactatatacagtgataattga

SEQ ID NO: 829 - DNA, 1179 bp, Xenorhabdus bovienii
  Coding sequence Name=Xb4151_4152.C420.gene28.dna; Position on contig =22039..23217bp; Strand=+
atgtcccaacttaacgaaaccgtacaaccttcaaccgccgctgtatctgtcactcctgaaaagaaaaacggcaagatcaatctgcttgatcttaaccgtaaacaaatgcgtcaattttttatcgatatgggggaaaagccttttcgtgccgatcaagtcatgaaatggatgtaccactattgctatgacgattttgagcagatgactgatatcaataaagtgctcagaatgaaattgcagcaggtggcagaaatcaaagcacctgaagtggcagaagaacagcgttctgcggatggcaccattaaatgggcaattactgttggtgatcaacaggttgaaacggtttatatcccagaggatgagcgcgcgacattatgtgtttcatctcaggtcggatgtgctttagagtgtaaattctgttccactgcccagcagggatttaaccgtaacctgcgggtttccgaaattattggtcaagtctggcgtgccgctaaaattattggctcgctgaaatccagtggtcgtcgcccaatcaccaatgtcgtcatgatggggatgggagaaccattgcttaacttaaacaatgtcgtgcccgctatggaaatcatgatggatgatttcggttttggattgtcaaaacgccgcgtgacgttgtcaacatctggtgtagtgcctgctttagacaaattgggcgatatggttgatgttgcactggcaatttccctgcatgcacctaccgatgatgtccgtgacgaaatcgtgccgattaaccgcaagtacaatatcgaagaatttttggcgggagtgcgtcgctatttggcaaaatctaatgccaatcaagggcgggttacggtggaatatgtgatgcttgatcacgtcaatgacagcgtggaacaggcacatcaattggcggaatgcctaaaagatacaccaagcaaaatcaacttgatcccatggaacccgttcccgggagcaccttatgggcgtagctccaacagccggattgaccgtttttcgaaagtcctgatggaatatggttttacgactattgtgcgtaaaacgcgaggggatgatattgatgccgcatgtgggcagcttgctggtgatgttattgatagaacaaaacggacactgaaaaaacgtctggcaggtgaaccaattcaggtaaaaccagtctaa

SEQ ID NO: 830 - DNA, 411 bp, Xenorhabdus bovienii
  Coding sequence Name=Xb4151_4152.C420.gene29.dna; Position on contig =23290..23700bp; Strand=+
atgatacggaaatcaataatttggtctatagtttgttttggcctgatcacgggttgtgcggaacgtgccccgcatcacggtcatcagatcgttgcaatagatactcgattacagctagggaaagcctatttagcggaacgaaatttatcggctgctaaatatcattttcaaaaggttttgctggcgaaacctcgccatccagaagcgcatttgggtatggcgttgtatgaatattatgcaggtcaacccaaagctgccgatcagcattatagaatggccatgcagtatgcggcaggaaatgatactgtaatacgtcattatgctgcttttctctgtgaacaaaagcggaatgaagaggctaaaaaattggtcacgggaaacaacacaagccactacacttgtgataaatga

SEQ ID NO: 831 - DNA, 207 bp, Xenorhabdus bovienii
  Coding sequence Name=Xb4151_4152.C420.gene30.dna; Position on contig =23609..23815bp; Strand=+
atgctgcttttctctgtgaacaaaagcggaatgaagaggctaaaaaattggtcacgggaaacaacacaagccactacacttgtgataaatgattttctgcgttcgacgcagtatgaaatgatttcgctgcacaaattaagttggatgttctatcaaattaatttgcgtaaatactttaacctgaacagtaccagtgcccttagctaa

SEQ ID NO: 832 - DNA, 972 bp, Xenorhabdus bovienii
  Coding sequence Name=Xb4151_4152.C420.gene31.dna; Position on contig =23815..24786bp; Strand=+
atgaagactgaaacttacccagaagaagccaatctgacaacgggtcagattctgcgccaggctcgtgaaaaacttgagctttctcagcaaactgtggcagatcgtttgtgtctcaaactgtccactgttcgtgatattgaagaagataatacgcagtcaaatatcgccctgacattcttacgtggatatattcgggcttatgcgaaacttgtccaagtccctgaatccgatattttaagtacattaaataaacaaatgcccgctaagtctgggaaagtttccccgatgcaaagcttttcgtcaggaaaaaagcggaaaaaacgtgatggttggttgatgaaaacaacgtggggcgtgctcattgtgctgctgggaatgactgggtggtggtggtggcagaattacaccgcgcagcaaaaagacttagcttcaatgacaacacaatctgatgcttataacgcccagacgcaaggagatgaaagtgacttgggcacttcaacaacagatctaagtcaactacctgaccatgctaaagatgataactcagttgctgcggctcaagaagaaacctcttcagtattagcaaatccggcagcgaacagcaatacatcatcgccgggcaatcaatcagttgtaaattcagtaccagcgacaactaatacagcaccaaattctgctgtgaatacattatcggctgacgtgaataataccagtgcggttaacagtaatgaactggtgatgaattttaaggcaagatgctggttacagattacggatgccaatggtaagactttgttcatgggcacaaaagataaaggcagtagtctgaaactttcaggtgccttgccttataagctgaaaattggtgcgcctacggcggttgatatccagtttcagggaaaaaccgtggacatgactcgttttgtcaaggtgaaccgtattgcccaactgaaattgccagaaaataattaa

SEQ ID NO: 833 - DNA, 120 bp, Xenorhabdus bovienii
  Coding sequence Name=Xb4151_4152.C420.gene32.dna; Position on contig =24800..24919bp; Strand=+
ttggcgaacatttataggcgaatattgaatagaaattcaagttcgcctgtgtgtattattcaccacagcatagttgtaatttttataaacaaaatacagggatgtaggggagtaatgtaa

SEQ ID NO: 834 - DNA, 1122 bp, Xenorhabdus bovienii
  Coding sequence Name=Xb4151_4152.C420.gene33.dna; Position on contig =24922..26043bp; Strand=+
atgcataatgaatcaccgataaaaagacgtaaatctacacgtatttatgtcggtaatgtgcccattggcgatggcgcacctattgcggtgcaatcaatgacgaacacacggacaaatgatgtagaagcgacggtcaggcagatcaaatcgctggagcgtgtaggtgttgatatcgtccgtgtttctgttccaaccatggacgctgcggaagcgttcaaatccatcaaacagcaggtcaatattcctctcgttgctgatattcatttcgattaccgtatcgcattgaaagtcgcagaatatggcgttgactgcctgcgtattaaccccggcaatattggcaatgaagaacgcatccgtcaggttgtggattgtgctcgtcattacaatatccctattcgtattggggttaatggtgggtcgctggaaaaggatatacaggaaaagtacggagaaccaacaccagaagccttggttgagtcggcaatgcggcatgttgatatacttgatagcttgaactttcatcaattcaaggtgagcgtcaaggcgtcagatgtctttctggctgtcggtgcttaccgtttgctggcacagaaaatcgatcaaccattacatttgggtattaccgaagcggggggcgctcgtgcaggtgcggtgaaatcctcaattggtctggggcttctgttgtctgaagggattggtgatacattacgtatttcgctggcggctgatccggtggaagaagttaaagtcggttttgatatccttaaggcattacgtatccgctcaagggggatcaattttattgcctgcccgacttgctcccgtcaggaattcgacgtcatcggtaccgtgaatgcgcttgaacagcgccttgaggatttgattacgccgatggatgtctccattattggctgtgtcgtgaatggtcccggggaagctgaagtttcaacactcggtgtgactggtgcaaaaaataaaagcggtttttatgaagatggcatccgtcagaaagagcgttttgacaacaataatttaattgatcaacttgaagcgaagatccgtgccaaggccacgatccttgatgcaagtaaccggattaacatcaatcagcttgatgaataa

SEQ ID NO: 835 - DNA, 165 bp, Xenorhabdus bovienii
  Coding sequence Name=Xb4151_4152.C420.gene34.dna; Position on contig =26068..26232bp; Strand=-
ttgccagatggcggtttcagcaggaaggcaatcgttcatgccacgaatagctgggatattttttgccacgttttatctcttattaatatttctacaatagcgtcgattataaaagcgaaagctcgcggggttcaatcagcaatcagaaacaatactggctcatga

SEQ ID NO: 836 - DNA, 1248 bp, Xenorhabdus bovienii
  Coding sequence Name=Xb4151_4152.C420.gene35.dna; Position on contig =26194..27441bp; Strand=+
atgaacgattgccttcctgctgaaaccgccatctggcaacgtgttgaatctacggttaagcgtgtgctggcaggttatggtttcagtgaaatcagaacaccgattgtagagcagaccccgttatttaaacgcgcaattggcgaagtcaccgatgtgatcgaaaaagaaatgtacacatttgacgaccgcaatggggaaagcctggccctgcgcccagaaaataccgcaggttgtgtccgcgctggtattcagcatggtctgctgtacaatcaggaacagcgcttgtggtacattgggccaatgttccgctacgaacgcccacaaaaaggccgctaccgtcaattccatcagttgggtgctgaagtttttggcctgcaagggccggatattgacgctgaaatgattttaatgactgctcgctggtggcgtgaactgggcatcgctgaacacgttacacttgaattaaactccattggttcactggacgcccgtgcgaattaccgtgaagctttggtggcgttccttgaacagcataaagaaacgctggacgaagactgtcagcgccgtatgtataccaacccgctgcgtgtactggattccaaaaatcctgaaattcaggttcttcttaatgatgcgccggcactgtttgactatcttgataccgaatcaaaagaacattttgatggggtgtgccggattctggatagtgcaggtatcaagtatcacctcaatcagcgtctggttcgtggccttgattattacaatcgtactgtctttgaatgggtaacttctgcattgggtgcacagggaacagtctgtgcgggcggtcgttatgatggcctggttgagcaattgggtgggaaatctacaccagcagtaggctttgcaatgggaatggaacgtatggttctgttagttcaggaagtcaatcctgagttcgttgcagatctggctgttgcggatgtttatctctcctcctttggtgaaggtagtcagcaggcggcattgaatctggcggagcagatccgtgatgagttgcctgaattacgcttgatgaccaatcatggtggtggcaacttcaagaaacagttggggcgtgcagataagcatggtgccaaagttgccctgatccttggagaagatgaaattcgtgcaggtaatatcactgtgaaagatttacgtaatggtgaacaagaaacgttgtcacaacaagcgattgcagcacgtttgagcgaactgttaggctaa

SEQ ID NO: 837 - DNA, 621 bp, Xenorhabdus bovienii
  Coding sequence Name=Xb4151_4152.C420.gene36.dna; Position on contig =27453..28073bp; Strand=+
gtggaagtctataccactgaaactgaacaaattgatgtgataaagcgtttttttgccaacaacggtaaatatcttgctgttggcttggtgctgggcattggggtgctggctggctggcattactggcagtctcatcagacaaaccagttgcaggatactgcagcgacgtttgaaaaattgaataaatcattggaatcgggctcgaaagaaagtgttgttgccacagaaaaattcgctaatgaaacgaataatatctatggtgtcatggccgatatggatctggcaaagcgtgcagttgagcagaatgatttggctcaggcagaaaagcgcttgttggccgcctctggcaaagccaaagacgagaatatgcaggctttggccagtattcgtctggctcgagttcaattcgcagaagataaaacggatgctgcactgaaaacgctggaacaggtcaaggggaaaggttggttggtagctgttgagaacattcgtggtgatattctgacgaaaaaaggggatattgcgggtgcgcgtgcagcctattccagggggctggaagctgatggcccacagtctttgaaaagtagtattcaaattaaacttaataatttatccagctaa

SEQ ID NO: 838 - DNA, 1173 bp, Xenorhabdus bovienii
  Coding sequence Name=Xb4151_4152.C420.gene37.dna; Position on contig =28088..29260bp; Strand=+
atgcaactgcgaaaaacactcttggttgggctggttgcttctattctgttggctggttgttcaagcgaacaggatacgctagcaatgtcaccgctgccgaaggttgaaaatcaattcaatccccgtgtaatttgggataaatcagtcggaagcggtgttgggcaatattattctcacttgtcacctgtctggcaaggttcaacggtttatgttgctgatcgcaccggtgtcgttaaagcacttgaagtagatacgggtaaagagctgtgggccacagacctgtcggaaaaagccggttttctgtcatcccgtttacctgcattgctttctggtggtttgaccgtgtcaggtgagcgcctgtatgtcggtacagaacaggcaaaagtcatcgcactggatactactaacggtaaagttgaatgggaatcaagcgttgcgggtgaagcgttgtcacgtcccgtggtgagtgatggccttgtgttaatccacacgggtaacggtttgttgcaggcattgaacgaaaccaatggttccgctgtctggtcagtcaatatggatacaccttcattgtcagtccgtggtgaatcggctccagccgtagcctatggtgctgcgattgttggtggtgataatggccgtattagtgcggttctgatgtcacaagggcaattgatttggcagcagcgtattgctcagatgacaggttcaactgaaatcggccgcctgaatgatgttgatatgactccggtcatttctaataatattatttatgccattgcttataatggcaatttggtggcaatggatatgcgttccggccagcttatctggaaacgtgatatcggttctgtgaatgatatggttgtgacggatgaccatattttcattgttgaccaaaacgaccgtattctgtccctgcgtaaaaatgacggggtaacactgtggacgcaaagcgatttattgcaccgtaacctgacagcaccggaaatgtacaatggttatctggttgctggcgattctgaaggttatctacattggttgaatatggctgatggcaaatttgtggctcagcataaagttgatggttctggcttgctgagtcgcccggttgttgccggagataagctgatggtacaggcgaaggacggtaaggtttacctgtatacgcgctaa

SEQ ID NO: 839 - DNA, 1491 bp, Xenorhabdus bovienii
  Coding sequence Name=Xb4151_4152.C420.gene38.dna; Position on contig =29418..30908bp; Strand=+
atgatacctgttgttgcgctggttgggcgcccgaatgtcggaaaatccaccttatttaaccgtttaacccgaacccgagatgcgttggtagcggatttccctggtttgacccgtgatcgtaaatatggacgggcagaggttgaagggcaggaattcatcatcattgataccggtggtatcgatggtacagaagatggcgtagaaacgcatatggctgcgcaatctttgatggcaattgaagaagcggatatcgtcctgtttatggtcgatgccagatccggaatgatgccagccgatcatgcgattgcaaaacatctgcgtagccgtgaaaaagccacctttttggtagcgaataaaaccgatggtattgataccgatactgctatccctgagttctactcactggggttgggggatatatattccatcgccgcttcccacggccgtggtgtgacacaactgatcgagcatgtgttgttgccattctccgaaaaagagaaaacggaagaagttgaattaacggaagaagaagccaatgcagcttattggtctgaaatagagcaggctgaattggaggctgctgaagaggaagagaaggaggccgtttttgatcctactactttgccgctgaaattggcgattgttggtcgtccaaacgtgggtaaatccacattgactaaccgtattctgggcgaagagcgagtcgttgtttatgacatgccgggaactacccgagacagtatttatattccaatggagcgtgatggccgcgaatatatcctgattgatacagcaggggttcgtaaacgtggcaaagtaaccgaaacggttgagaaattttctgttatcaaaacgcttcaggccattgaagatgctaatgttgttttgctgatagttgatgcccgtgaaggggtttctgatcaggatctctctctgctcggttttattctcaatagtgggcgctctttggttattgcggtcaacaagtgggatggcatgagccaggaagacagagatcacgttaaggatatgctggatttgcgtctcggttttgtcgattttgctcgtgttcactttatttctgcgctgcatggcagtggggttggcaacttatttgactcgattctggaagcttacgaaagtgctacccatcgcgttagtacttccatgctgactcgtatcatgcatatggcagaagaagatcaccagccgccgatgatacgtgggcgcagagttaaaatgaaatatgcccacgcagggggatataacccacctatcgtggtgatccacggcaatcaggtgacaaatttgcctgattcttataaacgttacttgatgaactacttccgtcgctctttaaaagtcatgggaacacctattcgcattcaatttaaagaagggactaacccttatgcggataagaagaatactttgacggccacacagcttcgtaaacgtaaacgtttaatgtcgcatttgaaaaagcgttaa

SEQ ID NO: 840 - DNA, 222 bp, Xenorhabdus bovienii
  Coding sequence Name=Xb4151_4152.C420.gene39.dna; Position on contig =31115..31336bp; Strand=-
atgcgtaatagtaaaatagacaagtacaatatcattcctccctatctactggaatatattgccaataattgtgatgaaaatgacagggaatgtgtgataaggacgttaaaacatgttaataatacaatgaaaaattcagctaaagaagaggaggcgttacatccggaagataatttatcaactgataataaaaagataaataaacctgacaagttgcaataa

SEQ ID NO: 841 - DNA, 93 bp, Xenorhabdus bovienii
  Coding sequence Name=Xb4151_4152.C420.gene40.dna; Position on contig =31302..31394bp; Strand=+
atgatattgtacttgtctattttactattacgcataatgttaaccagtttgtgtgttgttatatgtatctgttttagggtacttagatattag

SEQ ID NO: 842 - DNA, 102 bp, Xenorhabdus bovienii
  Coding sequence Name=Xb4151_4152.C420.gene41.dna; Position on contig =31555..31656bp; Strand=-
ttgctggagcaaagttgggattatcattccaacaaaataattaacaccaacatcaatataatcattaatacaatatcaattattattaaacagaataattga

SEQ ID NO: 843 - DNA, 1068 bp, Xenorhabdus bovienii
  Coding sequence Name=Xb4151_4152.C420.gene42.dna; Position on contig =31617..32684bp; Strand=-
atgaaaaataatgaaatcaacagatatagcttaatccctccatttgttttagaacacatctctagcgattgtgatgagtgctctaatcattatgtactaaaaacattagatcatgttcatcacttaatgaatatctctattggagaagagcttttacaacaggaaaatgaagtagaatttgatgatgaattaaatcgaactatctacgatgcagaatatgaagagatatttccaggtgatagggtagcacgacgcgaaggtatgcctgagagtgaggatgttgctgtcaatgaagcctatgagtatctcggtaagacccatgaattctacaaaaaagtttttggccgtaattcactcgataacaaaggcatcaagctagtcgcaactgtacattatggtcaaaactacatgaatgcattttggtctagaaaacagatggtttttggcgatggagataaaagtggaaaatatttcaatcgcttcacttctgccattgatgttatagcacatgaattaacgcatggtgtgattgagagtgaagcacgacttttttatgcttatcaatctggcgcgttaaatgaatccatctcagatgtgtttggtattatggtaaaacagtacttcgataaacaaaaagccagtgaatccgattggcttatcggaaaaggactacttggatctaagtttaatccagacaataaaccggatgttgccttacgtacatttgtaaatccgggaacggctttttccggagacaagcaagttggtcatatggatcaatataaagagctaccgttcacaaaggacaatggcggagttcatatatattctggtattcctaacagagccttttatctactggcagtggagctcggtggttattcatgggaacgtgcaggtaaaatctggtatgaaacgttactcgacgaacgtttatcttcagatgccaattttgatgattttgcagaattaaccattaaaaacgctgaaaaattatttgataaagaaatttcagatatcgtgaataattgctggagcaaagttgggattatcattccaacaaaataa

SEQ ID NO: 844 - DNA, 132 bp, Xenorhabdus bovienii
  Coding sequence Name=Xb4151_4152.C420.gene43.dna; Position on contig =32626..32757bp; Strand=+
atgtgttctaaaacaaatggagggattaagctatatctgttgatttcattatttttcatgattatcccctttattattagatgttatgtttgtgttttttgggcccgtttgaatactaactataatagttga

SEQ ID NO: 845 - DNA, 909 bp, Xenorhabdus bovienii
  Coding sequence Name=Xb4151_4152.C420.gene44.dna; Position on contig =32887..33795bp; Strand=-
atgaatatacctaacatatcccaagttaagaattttttcctctcattacaggatgaaatctgcaaacaacttgagcgacttgatggtcactccaattttatggaagagtgctggcagcgggaagaaggcggtggtggtcgcagtcgcgtattaaaggcaggcaacgtttttgaacaggctggcgtgaatttctcccatatcactggggcttcacttcctccatcagcaagcgcccaccgtcctgaattagcaggtcgtagctatcaagcactgggcgtttcccttgttatccacccactcaatccctatattccgactagtcatgccaatgttcgcttttttattgcggaaaaagaaggggaagcaccagtatggtggtttggtggtggttttgatctcactccttattacggcttcaaagaagatgccattcattggcataccgtcgccaaaacattatgccaaccttttggcaacaatgtttatcctgaatataaaaaatggtgtgatgattatttctttataaaacaccgtaatgaaccacgcggaattggtggattattttatgacgacttaaatacccctgattttgaaacttgttttaactttacgcaagctgtcggtaatggttttttggccgcgtatttgcctattgtagaaagaaggaaaaatataaactggggagaacgcgaaagagaattccaattatatcgacgtggccgttacgttgaatttaatttagtttgggacagaggaacattatttggcctgcaaagcggtggacgcactgaatcaatattaatgtccatgccgccattagtacgttgggaatataatcattctcctgagccaaactctccagaagctgaattttacacctcctttctaataaaaaaagattggatatga

SEQ ID NO: 846 - DNA, 132 bp, Xenorhabdus bovienii
  Coding sequence Name=Xb4151_4152.C420.gene45.dna; Position on contig =34107..34238bp; Strand=-
atgactttatccccggttgggttgttgagcaaactgagtcgcagtcagttgctcatcctggatgaccggagactggagagtctgactgccgaccagcgcagtgatttactggagatagtcgatcaactgtaa

SEQ ID NO: 847 - DNA, 852 bp, Xenorhabdus bovienii
  Coding sequence Name=Xb4151_4152.C420.gene46.dna; Position on contig =34313..35164bp; Strand=-
atgagtattcaaaataataagcctgagacaccatgcccttgtgactgtgatcttttcgtggtacccagtcgtaattatgtaaaagaatctattgaagaacacgcccaaagccgtaatcaccccaatgcaacactacaggataaaggttttgttgttctgagtaatgatgtcggtagtgatagtgaaactatggcggcaacaccaaaggcagtgaaagtaacgtataatttggctaatacagctaatcagaatgccagtaatgcgaatgacaatgccaatactcgtttagcaaaagatcggaatggagctgatatacctgataaaaaagagtttgttaagaaccttggaatagagccattaatggaagggttgtccttacctgtcggcgttcctgttccctggcctacagaaacaccgccagaaggctggctgatatgtaacggtaactcgtttgatatagtaagatatccgaaacttgcccttgcttatccctctggtgtactacccgatttgcgaggggagtttattcgcggctgggataatgggcgaggagtggacactgggcgacatctgctttctaatcaagcagcagatatcgctccacatagccacagaattaaccgcatgtggtccagctcaactgctggagccgagaatttaggtacagggaaccgcattttcaatagcatccaggaaaacattaactacggagctgatcctcggggattgggtattgctataggaatgggttcgggtggttatggttacatggataatgcggttgctaattcaacaggaacagaaacccgaccccgcaacatagcattcaattacatagtaagagccgcctaa

SEQ ID NO: 848 - DNA, 750 bp, Xenorhabdus bovienii
  Coding sequence Name=Xb4151_4152.C420.gene47.dna; Position on contig =35578..36327bp; Strand=+
atgaagtatcgtctgagcggggtggctcttacagcagtattattggtgggatgtgccagttcgaattcggtggaacaagggcgttctgacccgctggagggcttcaaccgtgccatgttcaactttaattatgatgttctcgatccttatcttctgagacccgttgctgtagtttggcgagattatgtgccgatgccagcacgaaatggcattggtaacttcgtgagtaaccttgaagagccggccagtatggtcaacagtattctgcgcggtgatctccataatggcgcgaagcatttcaaccgattttttttgaatacccttctgggaatgggcgggttgattgatgtcgcttcaatggcgaatccgaagctggcaaaagaagatccaatgcgttttggtagtacgttggggtattacaatgttggttatggtccttatgttgttttgcctggttatggcaatttcactctgcgtgacgatggagggaatgtcgcggatatgacttaccccgtattaagctatctcacaccttggatgtccgtaggaaaatgggtatttggaggtattgaaacccgcgcacgtttgttggattccgatggcctattgaaaaactcttccgatccatatttgatgatgcgtgaagcgtacttccagcgccatgattttatggtcaatggaggcaagcttttgccagaacaaaaccctaatgcgacggtgattcaggatgaattggattccattgattaa

SEQ ID NO: 849 - DNA, 1317 bp, Xenorhabdus bovienii
  Coding sequence Name=Xb4151_4152.C420.gene48.dna; Position on contig =36390..37706bp; Strand=-
atgagccaaaaaaacctgtttacacgttcagcattagcagtggcggttgcagtcatttcatccaacgctagtgctgccggttttcaattaaatgagtattcatcatcaggactcggtcgtgctttttctggagcaggtgtcgttgcagacaacgcgtctgagggtagtcgtaaccccgcagccatgaccctatttgatcgcccatcattttccagcggtttggtttatgtaaatccaaatgttgatatcacgggtagatctccagttcctcaactaggaactggcgttaaaaacagcactgatgctaaaaatattgccccacatgcatggataccaaacttacattttattacaccgatcaatgatcagtggttccttggtgcatcagcgacttccaattttggcttagcaaccgaattcagtaataactatgctgctggcttggttggaggcaaaacctcacttaaaaccgttaacctgaatctgagcagtgcatataagcttaatgatcaatttagctttggtttgggcgtaaacgccgtctatgcagatgccacaattgttcgtcacatgggtgaagttggtccttataacccacgagcacctattccagcaacctatgaagcttcccgtttagaaggcaaagattggggctatggctggaatgcaggcattttgtatcagtatgatgagaataaccgttatagcctgacttaccgttcaaaagtcaaagtgaagtttaaagatggcgatttcagcaatgacttaccagaaccccgtggcactggcggcaatacaattaaaggtacgctggatctgaatttacctgatatgtgggaagtctccggctataaccgcgtcgcacctcagtgggccattcactatagcttcctctatactggctggagtgaatttaaggagttgagaggtaagaataaagacaacggtaagacgctgttccaaaaagatgaaaatttccgtaatgcttaccgcgtctctctgggtacaacttactactatgatgacaactggacattccgtaccggtatcgccttcgatgaaagccctgtgcccgccaaaaaccgctctatctccattccagatcaggatcgtttctggttaagtgtgggaagcacttacgcattcaataaagacgcttctgtggatatcggtgtttcctacatgcgtggaaagaaagtacgtgttagcgaaaaattaccagaagatgctcaacaaggaccttttagtcaaccctatgagttcgattccaaaggaactgcatggttgtacggtatgaactttaactacacgttctaa

SEQ ID NO: 850 - DNA, 147 bp, Xenorhabdus bovienii
  Coding sequence Name=Xb4151_4152.C420.gene49.dna; Position on contig =37790..37936bp; Strand=+
atgacaaatcagaccagtgcaggaagtataggcctgacattagaagatgttgcaagaatgtttttaagatatgttcaaaatgattgccgaaatgggacgaacttaacaaaaaacagtcagcgcatgttaacgaattgtgatggctag

SEQ ID NO: 851 - DNA, 378 bp, Xenorhabdus bovienii
  Coding sequence Name=Xb4151_4152.C420.gene50.dna; Position on contig =37977..38354bp; Strand=+
atgccaaacagcgtaaacgctggttatcgggggttggaacaacgtaaaatcatcgataggctttcatcgcaggagaaaaaaatgcctgatacaattaaacgttgtaatgcggaagaaaccgctgcttgctgttgtgttgatgtcggtaccatcattgacaatgaaaactgcactgcctcttaccagagtgtttttgccaataatcaggaagcggaaatgatgcttaatatattgactgtaaaggcaaaatcaggagagtcagagccatgcgtaataagccataaaatcgaagcagttgacgatggggtgaaactgactatagattttacgtttagctgtcaggctgaggctctgatttttcaattaggattacgctaa

SEQ ID NO: 852 - DNA, 177 bp, Xenorhabdus bovienii
  Coding sequence Name=Xb4151_4152.C420.gene51.dna; Position on contig =38308..38484bp; Strand=-
ttgctcacctcacaagaggtcagacctgatggagcattgttaacgcaatgttggaaaatagcaaacaggaatagacgaaaaatgcgagcaaaagcaacaaaccgcgataggaaaacggttatgaagataattagcgtaatcctaattgaaaaatcagagcctcagcctgacagctaa

SEQ ID NO: 853 - DNA, 1311 bp, Xenorhabdus bovienii
  Coding sequence Name=Xb4151_4152.C420.gene52.dna; Position on contig =38537..39847bp; Strand=+
atgggtcgttcttcaacaaaagtggcacagcaaaaggagcgtgttgctattgtcagtgggttgcgccttccttttgcgaaacaggcaacgagttaccatggtatcccagctgtcgatttgggaaaagccgttgtcagtgaactggtcatcagaagcggattgtcgccagagaagatcgaccaactggtgtttggacaagtcgttcaaatgccggaagcaccaaatatcgcaagggaaattgtattaggcgcaggattaagtgttagcactgatgcttatagtgtttcccgtgcctgtgcaaccagctttcaggcgattgcgaatgtagctgaaagcattatggctggcacagtgaatgtaggcattgccggcggcgctgattcctcatctgtgttaccgattggggtaacaaaatcactggctcgcactttggtcgatatgaacaaagccaagagtttgtcacagcgcttaaaattaatcagtcgattgaaattgcgggatttactgccagtatctcctgcggttgctgaatattccaccggattgaggatgggcgatacggcggaacaaatggctaaaacctaccatatcagccgcgaagagcaggataagttggcacaccgttcccatatactggcagctaaagcctggcagcagggttgtttgaatgaggaagtggtagcggcgcattttccgccataccgagacacattgacagaagataataacatccgaaaaaattcagttctcacgtcttactccaaattgcggccggcctttgatcgtaagtacggaaccgtaaccgcggcgaatagtactccgttgactgatggtgctgccgcagtcatgttaatgcgcgaatcggtcgccaaagagcttggtatgactccgctgggttatttgcgtagttatgcgttttctgcgattgatgtctggcaggatatgctgttggggccatcctatgcgacgccgattgcgctggagcgggcgggtatcactttgaatgaactctcacttattgatatgcatgaagcgtttgccgctcaaacactggcgaacttgaaaatgtttgccagtgaaaagtttgcgcgtgaaaaactggggcgctctcaggcagtgggtgacgtagatatggataaattcaacgtattaggtggttcaatagcttatggtcatccatttgccgcgacaggtgccagaatggtcacccagacattgaacgaattgcgtcgtcgtggtggcgggtttgggctgacgacagcctgtgccgcaggtggattgggtgtagcgatggtattggaggtagaataa

SEQ ID NO: 854 - DNA, 2178 bp, Xenorhabdus bovienii
  Coding sequence Name=Xb4151_4152.C420.gene53.dna; Position on contig =39847..42024bp; Strand=+
atggctcagggcgaaaaagaaaccattatgtcagagacacaaccgaagcaatcggtattcaatttttcggtcagagatgacaaggttggtgtgattactattgatgtaccaggtgaaaaagtaaacacactgaaagctgaatttgttgagcaatttctgacagtctttgagaaggcacaacaggcttccggcttgaaagggttggtaatcgtgtctggtaagcctgatacttttatcgctggtgccgacatcacgatgatagcaggctgccaaaccgaagaagatgcgacggaactggctgaaaaaggtcagagattatttgctcagattgccaattatcctttacctgtagttgccgccattcacggtgcgtgtttggggggagggctggagctggccttggcctgtcatatacgtgtctgttctctggatgataaaactcgtcttggtttgccggaggttcagcttggattattgccgggctctggaggaactcagcgattacctcgcctgataggtgtcagcgcagcactggacataatattgactggccgacagctcaaggctaagcaggcacagcgtctgggtgtggtggatgatgcagttcccttggatattttgctggatgtggctgttcagtatgttaagaaaggcacccccaagcgtaagccattggcatggtctcagcgtattttggcgagcgctctgggcaggccattgttgttccatatggttcatcaaaaaacgcgtgcgaaaacccatgggcattatcctgcaccagagctgattattaatgtcgttcgcacaggattggaaaaggggcttaaaaaaggctttcaggcagaagccaaggcgtttggtgaactggcaatgtcaccggaatcggcagccttacgcagcttattttttgcctcaacgtcgctaaaaaatgaaaccggctcgtcggaacagcctgccgagatcaagtctgtgggaattttgggtggcggtttgatggggggcggtattgccaacgtgaccatgacacgcgggaatttgcctgttcgtatcaaagacatcaatcagaacggcatcaatcaggctttgaaatatacctgggatatcctttccaagcgagtaaaacagcgtcgtttgaaatcaagcgatcgttctcgccagatggctttgatttcgggaaccacagattacagtggcttcaggcaggtcgatattgtggttgaagccgtatttgaagatttggcgctgaaacgaaaaatggttgcagaagttgaagaacattcgaaacctgaaactatttttgcttcgaatacttcatcgttgccaatttgccagatcgctgaaatagcctctcgaccagagaaagtgattggcctccactatttcagtcccgttgataaaatgccattggtggaagttattccacatacgggaacaaatgaaaaaacgattgccaccgcagtcgcactagccaaaaaacagggaaaaacggctattgtcgtgggtgataaagccgggttctatgttaaccggattttgtccccttacattaatgaagcgggttattgtctggcggaaggtgaaccgatcgatcatatcgataaggcactggtagattttggtttcccgattgggcccattaatttgctggatgaagtcggcattgatgttggtacaaaaattattcctattctggtggcgcaattggggagcagatttaccgcaccgggcttcttggatgcagttttaaaagataaccgaaaaggtaaaaagaatggccgtggtttctattcatatggcgctaaaaagagcaaattctggccttttggtaacaaaaccaaagaggtggatgtctcgatttattccctgttaaaaattaagccacatgcaaaaatgcaaccatcagacattgcccagcgttgcatgatgctcatgttgaatgaagcagttcgctgtttagatgaaggtattatcagaagcccccgtgatggtgatattggtgcggtatttggcatcggtttccctccattcctgggggggccattccgttatatcgataggcttggcagcgataaagttgtggcaattttacatcgtctggaacagcagtacggagagagatttacgccctgtgagtatttagttcagatggctgaacagaaaaagaaattctacaaataa

SEQ ID NO: 855 - DNA, 135 bp, Xenorhabdus bovienii
  Coding sequence Name=Xb4151_4152.C420.gene54.dna; Position on contig =42046..42180bp; Strand=-
atgactaaaaatgatttatatctgattgtctcaatatcattatctcctgctattcagtgggttaaaataatcaaaaaaatatcaattatttttcataaaaaaatcggctccgatgacaagagccgatataactga

SEQ ID NO: 856 - DNA, 483 bp, Xenorhabdus bovienii
  Coding sequence Name=Xb4151_4152.C420.gene55.dna; Position on contig =42347..42829bp; Strand=+
atgtacgtttttattatgcgccacggtgatgctgccgtaaattcgatcagcgatgtaacacgggagctgactccccgtgggcagcaagaatcacaggaaatggcctgctggcttacgcaacaagagcctgatgttgattgtatcttagtcagcccttatatccgggcaaagcagactttaaaggtggttcgtgaaaacttaacgttgcccggcaatgaggaagagctggcggagttgacaccgtcgggagatgtcgcattggtggcgagttatttgcaagttttggcaacgcaaaagtacaacgctgtattggtggtttctcatttacccttagtgggatatttagtttctgagctttgccctgaacaaacgccacctatgttttcgacttccagtattgcctgtgtggaattagatcctcaaacagagaaaggtcgcctgttatggcaaacctctccggcgcagttagcagcaaaagattaa

SEQ ID NO: 857 - DNA, 543 bp, Xenorhabdus bovienii
  Coding sequence Name=Xb4151_4152.C420.gene56.dna; Position on contig =42848..43390bp; Strand=-
atgaagaagaaaaacctgatgagtgaagaagatatcagtctatttcgaacgtctgtcacgggagcccgccgcatcgttcaagacaccgttttgcactcccctcaaagaaaaaaaatgagctatattgcacctgaacgcttgatgcaagaacaagtcgatgccagttactatttttccgatgagttccaacctaatttggatatggaaggcccaacccgctatattcgagaaggtgccaatcattatgaattgaagaagctacgtcgtggtgattattcccctgagctttttctggacttacatggattaacccaactacaggccaagcaagaaattggcgctctgattgcggcctgccgtcgtgaacacatttattgcgcctgcgtcatgcatggtcacggtaaacatattcttaaacagcaaacgcctttatggcttgcccagcaccctgatattattgctttccatcaagcccccaaagagtggggaggtaacgctgcactgctcattttgatagaaatgaatgaactcatggagcgttaa

SEQ ID NO: 858 - DNA, 288 bp, Xenorhabdus bovienii
  Coding sequence Name=Xb4151_4152.C420.gene57.dna; Position on contig =43481..43768bp; Strand=-
atgctgctccagcatgccataatgatgtttgccatcaatgttgttgattgtagggttcattgtggcaagtctggcattacgccaaataacgtcagtatctttcagctcaataggcattgtatcgtcctgttatttttcttgttggtatcaacctttatgttgtatatacatttattttataaccagccaagattgtcaaataattttatgggcagggatgaatatcatgaatttttcagaagctatccgccacgatgcgaatattttacaatttacacagtcacctga

SEQ ID NO: 859 - DNA, 1254 bp, Xenorhabdus bovienii
  Coding sequence Name=Xb4151_4152.C420.gene58.dna; Position on contig =43652..44905bp; Strand=+
atgcctattgagctgaaagatactgacgttatttggcgtaatgccagacttgccacaatgaaccctacaatcaacaacattgatggcaaacatcattatggcatgctggagcagcatgatctgatcgttcggggtgaaaaaatattggcgattattccgacggctagcatgccaactcaccattgtcacattattgatgtggaacagcggctgatcacccccggattaattgactgccatactcatttggtttttggtggcaatcgggcatcagagtgggagcagcgtctcaatggcgcttcttatgaggaaatcagtgctaaaggaggaggaattaattctacggtcaatgcgacccgaaacaattccgcgcaacaattggaagtggccgcccagaagcgactcaatgctttgatcgctgaaggggtaacgacgattgagatgaaatcaggttatgggctggatctggtaaatgaagaaaaacagttgaatgtcgttcaggcactggcgcagaaaaatgccatcgaaatcagccccacattactctctgctcatgccgttccacctgaatataaacacaactctgatgcttatatcgatttaatttgtgattccattcttcctacactgtggcaaaaacaattatttgaatctgtagatgttttttgcgaaaccgtcggttttaatctcgaccagaccaaacgtgtgtttgatgcggcacaacgcctgaatattcctgtaaaaggccatgttgagcaattgtctaacatgggaggcagtgaattggttgctgattatcaaggctggtcggttgatcacattgaatatctggatgaaaaaggtattgaagccattagtcgtagcggtagtgtggccgtgttactgcccggcgcattttacttccttaaagagaaaaaactcccccctatttcgctattgcgtcaataccgagtgccgatggcaatatcgacagatttcaatccgggtaccagtccttttgcttctttgcgtctgattatgaatatggcctgcgtgcaatttgggtttaccccagaagaagcatggcagggcgtaaccattcatgccgcccgtgcattggggagagctgaaagccacggccagttggcggaaggttatatggcagattttattgtctgggatgccgagaacccggtggatatcttatatgaacttggacgtaacccactgattcatcgtatctatcgtggtgaaattacacacaatgttcaataa

SEQ ID NO: 860 - DNA, 987 bp, Xenorhabdus bovienii
  Coding sequence Name=Xb4151_4152.C420.gene59.dna; Position on contig =44895..45881bp; Strand=+
atgttcaataatggtgagagaaacaacatgaaattatggcacccgacatcagaaaacatttggcaaggacgtaatgatctcgcagaagcggataatgccctgcgtgtgttccagacaataaaacaacccgccaatttttctccggaagaatttcctcaccatattgcgttattgggatttgagtgtgatgaaggcgttaaacttaaccatggtcggccgggagcgaaattagggccggaatatctgcgtcagtcattggccaatatggccagttatgatggtcatgagcggctggtggatttgggaaatattcgcgctgatcctgaaaaattggctgaagcacagaacgtgctgagtgaagctgtctatgagtgtcaacaccagaacatgcgaacactcatttttggcggtgggcatgaaacggcatttgctcatggaatgggaatttaccgcgcgtttccgacacaacgcgtaggtattattaattttgatgcgcatctggatctgcgtaattcggcgcaacctacatcaggaactcctttccggcagcttgccgattattgccagcagcatcagcgtccgttcaattacacttgtattggagccagtttggcatcaaatactcaggctttgttggacgaagccaatcatcttgatgtcaccatcatttgggatactcaatgtattgagtcgatgctggataaagtaaaggaacaaattcaaaatgtgattaatcaagttgatataatttatatgaccatcgatttggatgtactgccaatctggcaaatgccgtcggtttctgctcccgctgctctgggagtgccgttagagcgtttgttgccgttaattcaactcatctgccaaagcaaaaagttacaggctgtcgatttggttgagcttaatcctttgtatgacattcaaggaatgggaggcaaagcagcggctcgccttacgtggcaattggtgcattggtggaatgggtag

SEQ ID NO: 861 - DNA, 732 bp, Xenorhabdus bovienii
  Coding sequence Name=Xb4151_4152.C420.gene60.dna; Position on contig =45902..46633bp; Strand=+
gtgacagtcgatttatcagatacatttgtcaaacctgtgcctttgtatgcaaaagttaagcaggcgattattgaaaaaatatatacaggagaatggaaaccccatgatcgggttccctcagaatctgaattggttaaacagtttagctgtagccgcatgacggcaaacagggcgttgcgggagttgatggcagaaggttttctatttcgtttgcaaggagtgggatcgtttgtgtctgaacccaaaggacagtccgctctgtttgaaattcacagtattgccgatgagattgcggaacgttctaaccagcatagttgtaaggtactgaaacttgcagaagtgaatgccaatataacacaggcggcagaattgggaattgtggctggtacggcaatctaccattcgattattgtgcactatgaaaatgatgtccctgtgcagattgaaaatcgttatgtcaacgctcaggctgtgccggcgtatctgcgacaagatttcaaccagcaaactacccacgattacttatcaatggtggctcccctgacggaaggggagcatattgttgaagcggttgcgggagatgtccgttcttgtcggttgctgcaaattgaggcagatacgccttgtcttttaattagccgccgaacatggtcgaaagaacatattgtctcaagtgctaaattattatttcccgggcatcgatataaattgaaagggcatttcagctcatga

SEQ ID NO: 862 - DNA, 1842 bp, Xenorhabdus bovienii
  Coding sequence Name=Xb4151_4152.C420.gene61.dna; Position on contig =46782..48623bp; Strand=+
ttgatatctagcataaaagataccatcctccaaattattgactttatctgtgtcacatttttttctattgaatctacatgtatatacaactatacaattaacaaactttataacgatgaaaaggaaaaaaccgtgacgatgcaaaataataaattcagcaacgaggtcatccgtgcccccagaggaacgcagctcacagcaaaaagttggttaacggaagccccgctccgcatgctcatgaataatctcgatcctgatgtggctgaaaatcctcatgaactggtcgtttatggagggataggccgtgccgccagaaattgggaatgttatgaaaaaattgtggaaaccctgaaaaatttagaaaataacgaaacattactggtgcagtcaggtaagccagtgggtgtttttaaaactcatgaaaacgcaccgcgtgtattgattgcaaactcgaatctggttccgcattgggcaacgtgggaacattttaacgaactggatgctaaagggctggcaatgtatggtcagatgacggcaggtagttggatttatattggcagtcagggcattgtgcaaggcacttacgaaacgtttgttgaagcgggacgccagcactataacggtgatttgaccggacgctgggtactgactgcgggtttgggcggtatggggggagcacagccgctggcggcaacgttggcaggtgtttcgtcactgaatattgagtgtcagcaaagtcgcattgatttccgtctgcgtacccaatacgtcgatgaacaggcaaccgatctggatgatgcgttggcgcgtatcaagcgatatacccaagaaggtaaggcagtatcggtggcattgtgtggtaatgcggcagaaattgtccctgagttggtacgtcgtggcgttcgtccggacatggtgacggatcaaactagtgcacatgatccactgcatggctatttgccggcaggctggacatgggaagaatattgtcgccgtgccgaaactgagccagaagtcgtgattcaagccgcgaaagcatcgatggcagtacacgtggaagcgatgctggctttccagaaacagggtgttcctactttcgattatggtaacaatatccgtcaaatggcgaaagaaatgggtgttgagcatgcctttgatttcccgggttttgttcctgcttatattcgtcctcttttttgtcggggaattgggcctttccgttgggtcgcgctctccggtgaccctgaagacatttacaaaactgatgctaaagttaaagagttactgtcagatgatgaacacctgcatcgctggctggatatggcgcgggaacgcatcagcttccagggtttacctgcccgtatttgttgggttggcttgggagaccgcgctaaattgggattggcattcaatgaaatggtacgtagcggcgaactttcagcaccgctcgtgattgggcgtgaccatttggattccggctccgtggcgagtcccaaccgtgaaaccgaatccatgaaggacggttctgatgccgtttcagattggccattgctgaatgccttattaaatacggccagtggtgcgacatgggtttccctgcatcatgggggcggagttggtatggggttctcacagcattccggtatggtgattgtctgtgatggcacggatgaagccgcagaacgtattgctcgtgtgttgcacaatgaccctgcaactggtgtcatgcgtcatgctgatgcgggttatgaacaggccatccagtgtgccaaagagagggacttaaacctgccgatgcttgatacaaaatcatcagacacaaaaaccgtcgaaacaaaataa

SEQ ID NO: 863 - DNA, 1533 bp, Xenorhabdus bovienii
  Coding sequence Name=Xb4151_4152.C420.gene62.dna; Position on contig =48638..50170bp; Strand=+
atgaaacacattactattcatcccggaaaaatgacgcttgaagagttacgccacatttatcagtatccggtgcaaattaccttagatgagcaatgcgttcctgccattgaacgcagcgttgattgtgttaaccgtattatcaatgaaaacagaacagcctatggtatcaacacgggttttggcctgctggcgagtactcggattgccgagcaggatttagaagaactgcaacgttcccttgtgttgtcacatgctgctggtgtcggtgagcctttgccggatgagattgtccggttgattatggtattgaaaatcaatagccttgcccgtggttattccggtattcgtttagacgtcattcaagcgttgatcactttggttaatgcagaagtttatccctgtattccgagcaaaggttctgtgggcgcttcgggagatttggctccactggcgcatatgagcctgttattgctgggcgagagtaaagcgcgttaccgtggggaatggctgccagctaaagacgccttggagaaggcaaatcttaaaccgattcggttggcggcaaaagaaggtctggcgttgcttaatggcacacaaacctctactgcttttgccttgaaaggactttttgcagcagaagacttacttgcctcagcagtgatttgtggcgcgatgtctgttgaagcggcactgggttctcgtaaaccatttgatgcgcgtatccatgaagcacgaggccagcaggggcaaatcgatgtagctgctctgtatcgtctggtattggaagaacaaagtggtctatctgaatctcataaaaactgtccgaaagttcaagacccttattcattgcgttgccagccacaagtaatgggcgcttgccttacacagatccgtcatgctgccgacgtgattatgactgaagccaatgcggtttctgataatccgttggtctttaccgaccaagatgaagtgatctctggcggtaacttccatgctgaacctgttgctatggcatcggataatctggctattgcactggcggaaataggtgcactgtcagaacgccgtatctctttgctgatggatagcaacatgtcccagttaccgccgttcctcgtcaataacagcggggtgaactccggctttatgattgctcaggtgacagcggcagcgttggcgagtgaaaacaaagcattggcgcatccttccagcgttgacagcttgccgacatcagcgaatcaggaagaccatgtatctatggctccggcggcaggtcgtcgtttatgggaaatggctgacaacgtgcggggtattttagcgattgagtggctgactgcctgtcagggcatggatttccgtgacggattgaagagcagcccgatactggaaaaagcccgtcatatcctccgtaataaagtcgcttattacgataaagatcgcttttttgcaccagatattgacgcagctatccaactgttgattgaacaacaactttcagcactgctacctaccggaaaattattgataaattaa

SEQ ID NO: 864 - DNA, 1374 bp, Xenorhabdus bovienii
  Coding sequence Name=Xb4151_4152.C420.gene63.dna; Position on contig =50261..51634bp; Strand=+
atgcaaaacacttcacaactcaagcgaggcttgagcgttcgccacattcggtttatggcgttggggtcagcaatcgggactgggcttttctatggttcagcagaagccattaaagccgcgggtcctgcggtattattggcatatgccattggtggggcggccgttttcatggtcatgcgggcattgggggagatggcggttcatcaccctgtggcgggttctttctctcattatgccagtcactacttagggccattggcaggttttctgacgggatggacttacgtatttgaaatgctggttgtctgccttgctgatatcaccgcatttggtctctatatgaaactctggtttccgcatgttgaccaatggatttgggtactcagcatcgtctttttcattggggcgataaatctgtgtaacgtcaaagtttttggtgaaatggagttctggctttctatcattaaagtcactgcaattgttgccatgattgtcggtggctttgtgatcatgatgtatggcttcggccaggaagcgggtcatgtcactggcctgtcaaacttgtgggaacatggcggatttatgccaaatggcattgcgggagtgattgcttcgtttacggtggtcatgtttgcattcggtggtatcgaagtaatcggtattacagccagtgaagcgaaaaatccagaaaaatccatcccccaggcaatcaacgctgttccattccgtattttgctgttttatgtactcactctgtttgtcctgatgtgtatctatccgtggaatcaaattggccaaaatggcagcccatttgtccagatattctcaagtctgggaatcgattctgcggctaatattctgaatgttgtcgtaattactgcggcgatttcagcgatcaacagtgatatcttcggctcaggacggatgatgtatggcatggcacaggagaaacaagcgccctcagccttcacgaaattaaccaaaaacggcgtaccgtggatcactgtgctggtgatgtcgtgtgtactgctaatcggtgtcgttttgaactacctgttacctgaaaaagtgtttgggatcattgcttccattgcgacatttgcaacggtgtgggtatggctgatgattttgttgtcacaattcatcatgcgccgaaaaataccggcggaagaggtcaaaaagttaaaattccctgttcccctttggcctgcagcacctattctgacgatttcattcatggcatttatcatcgtcgtattgggatatttccccagtacccgcatcgcgctgtacgtcgggatagcatggatagcattactcacccttagttatttcttgtgggtgaaaaagttgtgggtgaaaaaaacgagataa

SEQ ID NO: 865 - DNA, 141 bp, Xenorhabdus bovienii
  Coding sequence Name=Xb4151_4152.C420.gene64.dna; Position on contig =51585..51725bp; Strand=-
atggcctactgggagagttcaataaagcgcaattattttctggagagggtaagaaaaccaccctgtattcacagggtggtatatttgggcgttatctcgtttttttcacccacaactttttcacccacaagaaataactaa

SEQ ID NO: 866 - DNA, 93 bp, Xenorhabdus bovienii
  Coding sequence Name=Xb4151_4152.C420.gene65.dna; Position on contig =51727..51819bp; Strand=-
atgggaattatgtcagtgaataatgagcctatctcagtgagtacctatgttacagccagtttgtacagaaagagtacgcaaataagcaaatag

SEQ ID NO: 867 - DNA, 120 bp, Xenorhabdus bovienii
  Coding sequence Name=Xb4151_4152.C420.gene66.dna; Position on contig =51822..51941bp; Strand=-
atggtatgcagctccgcgacggcctcatccacaaaaatcttatccacaagcatctccaagccacaaaaatgtattagcgcgttattttgccatgatcccagtcacaaatcagctatctga

SEQ ID NO: 868 - DNA, 939 bp, Xenorhabdus bovienii
  Coding sequence Name=Xb4151_4152.C420.gene67.dna; Position on contig =51889..52827bp; Strand=+
atgcttgtggataagatttttgtggatgaggccgtcgcggagctgcataccattctggatatgctgcgctggtcagccagccgttttaatgccgccaatatctattacggtcatgggacggacaattcgtgggatgaggctttgcagttggttctgccaacactgcacctgcctctggacgttcctgaatccatgatggcagctcgtctgacctcaaccgagcgtcattgtattgtggaacgtgttctgcgccgtattaatgaacgtattccggttgcctacctgactaaccgggcctggttctgcggtcatgaattttatgttgatgaacgtgtgctggttccccgctcaccgattggtgaattagttaacaaccaatttgcaggattgcttccacaggagccatctactattttggatctgtgtaccggaagtggctgtatcgcgattgcctgcgcacatgagttccctgaagccgaagttgatgccgttgacatttcaggtgatgcattggcagtgactgaacagaatattgaaaatcatgggcttttgaatcgcgttattcctatcctttctgatttattccgtgatatgccaccgatgaaatacgatctgattgtcactaatcctccttatgtggacgaagaagacatgaacgatctgcccgatgaattcctccgtgaacctgaattgggattggctgcgggagttgatgggttgatactggcttgtcgtattcttgcgaatgcgccggatttcctgaccgaagaaggggtgctgatctgtgaagtgggtaacagcatggtgcatctgattgatcaatatcctgacgtgccatttacatggctggagttcgaaaacggtggtgatggtgtctttatgctgacacgcgagcaattagtcgaacatcacgaatattttcgcctgtttaaagattaa

SEQ ID NO: 869 - DNA, 111 bp, Xenorhabdus bovienii
  Coding sequence Name=Xb4151_4152.C420.gene68.dna; Position on contig =52908..53018bp; Strand=-
gtggtaacacggaaaaattgcccaatactatttccagccattcctaccctgccatcaattaattatgcgttaaagattagattaattaacaataactcactcaatgattaa

SEQ ID NO: 870 - DNA, 1086 bp, Xenorhabdus bovienii
  Coding sequence Name=Xb4151_4152.C420.gene69.dna; Position on contig =52978..54063bp; Strand=+
atggctggaaatagtattgggcaatttttccgtgttaccacattcggtgaatctcacggaattgcattgggatgtattgtcgatggcgttcctccaggaattgccattactgaagctgatctgcaaatcgatttggacaggcgacgtccgggaacctcccgttatacgacacagcgccgcgaacctgatcaagtccgtattctttcaggtgtctttgaaggagtaacaacgggcaccagcattggcctgatgattgaaaacaccgaccagcgttcacaagattacagtgcaattaaagatgtttttcgcccgggacatgctgattatacctacgaacaaaaatatgggctgcgtgattatcgcggaggcgggcgttcctctgcccgtgaaacagcgatgcgcgtcgcggctggcgcaattgctaaaaaatatctactggaaaaacacggtatccgaattcgtgcttgcctgactcagatgggggatattcattgcgaattgaaagattgggatctcgttgaacagaatccttttttctgccctgatgaaagtaaactgacccagcttgatgaattattgcgcaccctgaaaaaagaaggtgattctattggtgccaaagtgacccttgttgctgagaatgtgcctgtcggattgggtgagcctgtttttgaccgtctggatgcagatatcgcgcacgccttgatgagcattaatgcagtgaaaggcgttgaaatcggtgatggttttggtgttgtcaacttacgcggtagtgaaaaccgagacgaaattacctctcagggattcaccagtaatcatgctggcggcattctgggcgggatcagtagcagccagccgattatcgctcatatcgctctgaaaccgacgtccagtattatggtgtccggcaaaactattaatcgccagggtgaagaagtcgatatggtgacccgtggccgccacgatccttgtgtagggatacgtgctgtaccgattgcagaagcgatgatggcgattgtactgatggatcacttactgcgtcagcgggcgcaatgtgctgacgtcatctttccattgccacgctggtaa

SEQ ID NO: 871 - DNA, 117 bp, Xenorhabdus bovienii
  Coding sequence Name=Xb4151_4152.C420.gene70.dna; Position on contig =54007..54123bp; Strand=-
atgatcatgatgcctgccgcatcacccagatgcttgtatttcagacgttctcttaccgatttaccagcgtggcaatggaaagatgacgtcagcacattgcgcccgctgacgcagtaa

SEQ ID NO: 872 - DNA, 801 bp, Xenorhabdus bovienii
  Coding sequence Name=Xb4151_4152.C420.gene71.dna; Position on contig =54153..54953bp; Strand=+
atggaatggtcattattaagtccggaaatttacggtttcctgtttttggttgcgatagttgctgggtttatcgattctattgcaggtggtggtgggttgttgaccattcctgcattactgtcagtcggtgtttctcctgttcaggcgctggcgacgaataaacttcaagcggttggcggttctttctccgccagcctttattttattcgtcgtggcgcagtggattggcgctcccaacgttttgcgatagctatgactctgcttggtgccatgctgggagccttgctggttcaatttgtatccccagattttctgcgttatctcctgccggttctggtgattatcattggtctttattttctgctagtgccgaatattggcgctgaagatcggccgcgtcgcttggagcctctggcatttggttgccttgccggaggcggaattggcttttatgatggtgtatttgggccgggaacaggctcctttctggcgctgtcttatgtgatgctctacggttacaatctggcgaaagcgacggcacatgcgaaggtgctgaattttgcatccaatataggttcactgggcttttttattcttggtgggcaggtcttgtggctattgggtcttgtgatgctaatagggcaagcgattggtgctcggctaggagcgggtttagtcctgagccgagggcaaaaaatgatccgtccgatgctggtaacaatttcttttctgatgagtatcaaactactccatgaccatcatggcgatactatccgctcttggttagcattttatttttga

SEQ ID NO: 873 - DNA, 552 bp, Xenorhabdus bovienii
  Coding sequence Name=Xb4151_4152.C420.gene72.dna; Position on contig =54976..55527bp; Strand=+
atgactgcacatcactatcaacaactcattgaaatttttgataattgctttagcgatgactgtaacacccgtttaataaaaggtgatgacgagccgatttatctgcctgtagatgatcaagtcggctataatcgggtagtgtttgcccacggtttttatgccagtggtttgcatgaaatatcgcattggtgcattgcgggtaaagagcgtcgcaaacgggtcgattttggttactggtactgccctgatgggcgtgatgcccaaactcagtctgagtttgagcaagtcgaaatcaaaccacaggcactggaatggctattctgtatggcagcgggttttcctttcaacgtcagttgtgacaatcttgaaggggattgtgagccagatcgctttgcttttcagcgtaaagttcatacacaagttatcgcatatcttgaaaacggaatacccacacgagcagcgcgctttattcaaggactgcactcgttctacaatacgccctcactgacagcagaacactttccttgtccggaaaatccttttgctaactga

SEQ ID NO: 874 - DNA, 294 bp, Xenorhabdus bovienii
  Coding sequence Name=Xb4151_4152.C420.gene73.dna; Position on contig =55550..55843bp; Strand=+
atgctcgcagagtttgaaacacgcattctggcacatatagataacatggttgaacatgccagtgatgacgaattatttgctggtggatacctccgtgggcatctgacattggctgttgctgagttggaacaagaaggcgctaataccattgaacagcttcatcagcgtgttgaagagagcatccatagggcgatcagggcaggagagctggctccaccagatcaggttttggttttatcgacatggcaaaatctactggatagtgcgaaagaccaattaattgattataaataa

SEQ ID NO: 875 - DNA, 534 bp, Xenorhabdus bovienii
  Coding sequence Name=Xb4151_4152.C420.gene74.dna; Position on contig =56009..56542bp; Strand=+
atgttttttattcgtccaacacagatattagatgcaggagtattaccagcaatagaacggtcagcgagccagctatttctctcgacacctgaattggcatggattgctgatggccatacccaaacggaacagcagcatttagattatattttgcaacagaatagttgggttgccttgaatggcgataatcagcctgtcggttttattctggcaaaaccgctggatgatggcttacatattatggaactctcggtgcatagggattggcagaagaaaggtataggaaaagcgttgattgataccgttattcaggtcgctgagcagcgcggctttcaggctgtcacattgacaacttttcgtcatataaactggaacgccccattttatcggcgactggggttttttatcttagaacctcgacaaattgctggtgctttgtgtcagatcctgcaacgtgaaattgaatacgggtttgcagaaaatcaacgctgtgcgatgaagcgtttggttgttacaacagattatcacgattga

SEQ ID NO: 876 - DNA, 2052 bp, Xenorhabdus bovienii
  Coding sequence Name=Xb4151_4152.C420.gene75.dna; Position on contig =56633..58684bp; Strand=-
gtgaaaaagagtgctatcagcagcgcaaccctaaactggaatgaacagggtacacctgtttctgagcagtttgatgatgtttatttttcaaatcaagatggcttggaagaaactttatatgtttttttaaaaggtaatcattttccccaacgttttaatacgcactcccgccctgattgtattattgctgaaactggattcggtactgggttgaatttcctgacactttggcgagctttttcaaccttcagacaacaatatcctgatacacctttaaaacggcttcattacatcagttttgaaaaatacccattaacgacagcggacttgaagactgcgcatcagcgctggccagaacttcaagtattttctgaagagttatgtcagcaatggcctttacctcttgcaggctgtcacaggctaatgctgaataatggcactgtcacactggatctctggtttggtgacgtaaatgatctattaccgaggataaattcgaatttaactggaaaaattgatgcttggtttttagatggttttgcaccatccaaaaatccgcagatgtggagcgaacaactgttcactgcaatggcaagattttctcgtccagaaggaacatttgcaacatttacgtcagcgggaatcgttcgacgtggattgcagggagccggatttgatgtcaaaaaaataaaaggctttggacataaaagagagatgctgacaggggttctggctccatctgcacatttccttttttcctcatcagatactccatggtttgcccgacaagcagctaccgataccgatgatatcgccatcattggtggcggcatcgccagtgtattaactgcacttgcactattacgccggggcgcgaaagtgacactgtattgccaagataaccaacccgcacaaaatgcatcaggcaatcagcagggagccatttatccgttactgaatggccgtgacgacttactggaacgtttctttatctccgcctttacctttgcccgccgtcaatatgatcagctaattgatgaaaatgtttcctttgattatcaatggtgcggtgtcagccagttggcttacgatgaaaaaagtgacaaaaaaattgccaagatgctgcaaacatcgtggttagaagagattgcaattggaatggatcgccagaaattgagccaagcgagcggattagatgttaattatcatggtatccactatccacagggaggatggttatctccggctcaattgactcaggaagccatcaatctggcagaacggcgtggaatgctcacctatttcaaccacaaaatgactcaattagttcaagatgaatacggttggcagttgcatattgagcaccaggggcaatcactgcacaaaaaccacagggtcgttatcattgctaatggacactgcctgacgcaatttgcacaaactgaaaaactgcccgttactgctgttcgtggacaagtcagccatatcccgaccactacccgtctcagtcaactgaaaaacgtactgtgttacgatggctatctgactcctgcgaatcctcaaaatcaacatcattgtatcggtgccagctatcagcgagggaacgttgatactcagtattctcccgcagaacagcaagaaaatcgtgatcgtttattaaaatctttacccgatgtcgattgggtgaaacaagtcaatatttcagaagcgaaatcccgtcaagggatacgatgtgttattcgggatcatatgccgatggtaggcaatgtacctattttcagtcaaattatggtcaaatatgctggtttatctcaaaggataaacactgatgagacaattgaagaatctccttattatcctgatttatttgttattggtgcattaggttcccgtggattatgttctgctccgttgagcgcagaattactcgcagggcagatttttggggaagctctaccacttgatgatgaaacattggcggccttgcacccaaaccgattctgggtcagaaaattattacgaggcagggaagttaaagctggaaaaccttaa

SEQ ID NO: 877 - DNA, 96 bp, Xenorhabdus bovienii
  Coding sequence Name=Xb4151_4152.C420.gene76.dna; Position on contig =58641..58736bp; Strand=-
atgaacaccgttaaaatctcatattatttttatcaaccatacaggcattattgtgaaaaagagtgctatcagcagcgcaaccctaaactggaatga

SEQ ID NO: 878 - DNA, 120 bp, Xenorhabdus bovienii
  Coding sequence Name=Xb4151_4152.C420.gene77.dna; Position on contig =58814..58933bp; Strand=+
ttgttcggcgtacaagtgtacgctaaagtgcagggcagaaatcccgcaggtaaaaatgatgaggtaatgaatgaaacgtgcagtaatcactggtctggggattgtttccagtattggtaa

SEQ ID NO: 879 - DNA, 1215 bp, Xenorhabdus bovienii
  Coding sequence Name=Xb4151_4152.C420.gene78.dna; Position on contig =58884..60098bp; Strand=+
atgaaacgtgcagtaatcactggtctggggattgtttccagtattggtaataaccagaaagaggtgctggagtctctgagagaaggccgttccgggataactttttctgaagaattcaaagagatggggcttcgtagccacgtctggggtaatataaaactggatatatctggtctaattgatcgtaaaactcagcgttttatgagcgattcatctgtttatgcttatcttgcaatggatgaagcgattaaagattctggtttgtccgatgagcaagtttccaatttgcgcacgggtctggttgtgggttcaggtggcggttctccacgtaatcaggttagtggatcggatggtatgcgagccaaagggctgcgtggcgttgggccttatatggtgacgcgggcaatggcttctggtgtatcagcctgtctggcaacaccattcaaaatcaaaggggtgaactattccattagttctgcctgttcaacttctgcacactgtattggccacgcagttgaattgatccagcttggtaagcaggatgttatttttgccggcggcggtgaagaactgagctgggaaatggcctgtgagtttgatgcaatgggagcgctttctactaaatataacgaaacaccagaacttgcttcccgcacttatgatcaggggcgtgacggttttgtcatcgcaggcggtggcggtatcgttgtggttgaagaattagagcacgcattagctcgtggtgcgcacatatatgctgaaatcatcggttatggggcaaattctgatggcgcggatatggttgcaccttctggcgagggggctgttcgctgcatgaagctggctcttgatggtattgaaggtggcgtggattacatcaatacccacggaacatcaaccccgattggtgacttgaaggagttgggagctatccgcgaagtgtttggtgataacacccctgctatttcggccaccaaagcgatgacggggcactctttaggagcggctggtgcgcacgaagccatttacagtttattaatgctggaacatggtgttattgcaccaagtatcaatattgataacttggatgagaaagcgttaggcatgaatattatcactgaacctaccgaacgcgagctaagaacagtaatgtccaatagcttcgggttcggcggtacaaatgcatccctggtgatgcgcaaatattcgaactga

SEQ ID NO: 880 - DNA, 168 bp, Xenorhabdus bovienii
  Coding sequence Name=Xb4151_4152.C420.gene79.dna; Position on contig =60217..60384bp; Strand=+
atggaacaattattatcaataaagtggtgtttagaaattcataggaatattcactgtgaatgtttcggcacccctcatacagcattagctatacagtcgcatagatactatcgtttatggttactcctacattatttaattaagccaaaggatttagccaacccatga

SEQ ID NO: 881 - DNA, 978 bp, Xenorhabdus bovienii
  Coding sequence Name=Xb4151_4152.C420.gene80.dna; Position on contig =60348..61325bp; Strand=-
atggaaacaatattaatcaaggtattagctgttgctactttacttgcctgtaccaatacatttgcagacaatgctcccgataaaacggaatgtattgctccagccaaacctagtggtgggtttgatttaacctgtaagctagcacaaataacattattagatactaaagctatcaactctcctatgagcgtggctttcatgcctggaggaatcggagctgtcgcttataataccatcatcgctcaacgtcccgcagagcctggaaccatagtggcattctctggtggttctttgcttaacctttctcaaggaaaattcggtcgttaccatgtgaatgatgtacgctggttagctagtatgggtactgactatggaatgatagctgtgcgcggagactctccctataagactttaaaagacttaatgggtgccttccaaaaagaccctaacaagatagtattcggtgcaagtgcatccataggaagtcaagattggatgaaaacagcactactggcgaaagaagtgggtgttgatccgcaaaaaatacgctatgttgcgtttgaaggcggtggagaacctatcactgctctactaagcaatcacattcaagccgtttcctgggaactcagtgaaaccgtaccttacctcactgacgataaaatccgtgttcttgctgtctatgctgaacaacgtttgaaaggtaagctagcaaatattccaaccgcaaaagaacagggatataacatcgtttggccagttgttcgtggtttctatatgggtccaaaagtcacagatgaacaatatcaatggtggataaaaacatttaaaaaattacagcaaacagaagagtttaaaaaggaacgtgatttacgtggattatttgaattcaacatggtcggcaaagaattagatgattatgtaaaaaaacaagttgtccaatatcatgggttggctaaatcctttggcttaattaaataa

SEQ ID NO: 882 - DNA, 255 bp, Xenorhabdus bovienii
  Coding sequence Name=Xb4151_4152.C420.gene81.dna; Position on contig =61373..61627bp; Strand=+
ttgggctacaccatttatagatataaaacctttcatttacctttcattaatcagaaaaatttatttggatgtgacgttagtcactcaatttacataacacctcggataacggtgctaataaatgattaccaactttcttttgcttatgatcttgttgtagtgtgggaaaatgaaaaaaacagcaggtttcttatttatcttgccaatttatatgaggtaaacatattcagcgcactgaatatgttgaggtattga

SEQ ID NO: 883 - DNA, 666 bp, Xenorhabdus bovienii
  Coding sequence Name=Xb4151_4152.C420.gene82.dna; Position on contig =61688..62353bp; Strand=+
atgcgtctcttattagttgaggaccaccctgacttgtcacattggctgcaaaaagcattaagcagttctggatttgcagttgatattgctgaagatggaattgcggcggatcagcttttgctgacggaagattataccctgctaatcttggatgttgccttacccagattggatggaatctccctgttatcacggctgcgtaagcgcgggcaaaatttgcccgtgttgttattgactgccaaagtggatgttgccgatcgcgtgaaagggttaaattcgggcgctgatgactatgtaactaagccttttgattttgaagaattagaagctcgtattcgagcactgttacgccgtggcatgggattgccgctagggatacagcaatttggctcattggtttacgaagacgcaggttatttcttattggataatcaaccgctggcgttgactcccagggaattctcagttttaacaaccctgtttcaccgtcgtggacgccctgtctcgaaacaacaactgtttgagcaggtattttctttatctgatgaagcaaatccacaaagcatcgaactgtatgtgcatcggttacggaagaagctttttaacagtgatgtcggaatatgtacattgcgaggattgggatatcgattggaattgcaaaaataa

SEQ ID NO: 884 - DNA, 1479 bp, Xenorhabdus bovienii
  Coding sequence Name=Xb4151_4152.C420.gene83.dna; Position on contig =62308..63786bp; Strand=+
atgtacattgcgaggattgggatatcgattggaattgcaaaaataatgaaactgttcaaagccccacgctcattgtttcatcagttactcctgttctttggtgcgccattgttgttattgggcggggcttctgtgtatacccattattttagtgcggaaaatgcggcgacacttgcctatgatcggacgttacttgcatcggcaagaacagttgcggagcgtctgacagtaaagaataaacagttaaacgttgatgtgccttatatcgttttggacagttttgaacgtaatacgaatgatcgtctctactatcaggtgatatcaccggcagggagaaccatttccggttacgataatttacctcccattcctcaatatacccagcgttcgcaactgtatacggccttggtatatttttataacgcggaatatcagggataccccatccgtgttgcggccttgtatcagccgatcaacgaaggaggggtaatgggcatggcattgatactggtggctgaaactgtggattcccgccaatatttagcgcgacaattactgatttcttccctgataagccagggaaccgtagtggtattgacactgattcttgcctatttcctgttaaagcagcttcttaaaccactgcgcaggttatcaggcatgatggtgctccgttcagccaatgacttaaccccattgccggatattttgccgtggtcagagctttcaccattgcttcgggcatttaatcgctacatagaacggttaaaactgatggttgggcgtcaagcccggttcagtgctgatgcttctcatcaactcaggacacctttaagtgtattaaaaacacagatagccgtggcactcaatgataaagatccttatccgagcagaaaaatcatcaactctattaacaagaccgtagataacatgatctcactgactgatcgtctgttatatctttcacagttgaaagtgcatgagaaagaagctatccagaattatcagcccgtcaatattgtggaattattacagcaagcctgtttttcccgtttgcaacaggcggaaagtaaaaatattgatttgggttatgaaggagaaaataccttttggatcaagggagaacccgtattgttgacagaaatgtgtgctaacttgttggataacgccattaaatatacgcctgctgcgggaatggtgacggcaagagtaagtatgacagcggacaaaaaatactgttgcctcgaagttgatgattcagggccgggcatcgcgcaagaaaatattactcaatcgttgatggcgtttaaccgtctggataatgcagcggggctggaaggcgctggattggggctgactattgttaaggatatcagcctgtaccacggtgcgactctccagcttttgcccagtattgtactgggcggtttgctggtgagaattttattccgccttcctgcgggtgagaggaatacgtag

SEQ ID NO: 885 - DNA, 888 bp, Xenorhabdus bovienii
  Coding sequence Name=Xb4151_4152.C420.gene84.dna; Position on contig =63751..64638bp; Strand=-
atgataaatttcttgtttccctttattgctgttctgatttggtcaattaatgccgttgtcagtaaagcagcagccactgcaattgagcctgctgccattgctttctatcgttggttcattgcgtttctggctttaactcctttcgttttatggcctgtcctgaaacagcggaaaatggttatccagtattggtggaagttattgattctgggtactctgggcatggtacttaaccaaagtatggcctattacgctgctcatactgtgagtgcaacattgataggaatctttacttcactgattccgttgttgacggttatcatcagtatctttgccttacggattgctcccacagtaggtatcaccctgggtactgtgttttcgttgttcggcctagtgtggctggtcagcaaaggtgaacccgcttccttattagagcacggtctggggatcggcgaagtgatgctatttattgcatccgcttcctacgccttatatggggtgttgacaaaacgttgggcgatcccattacccaattggcaatcactttatatacaaatcgggtttagccttttgctgcttttgcctaatttcatgatgacaaaagatgtccagttaactagcgataacatttccttagtcctgttcgcgggcatccccgcctcaattcttgcgccctatctgtggatacagggcgtgactcgcctaggcgcgaatatgacttctgtatttatgaatctggctcctgtatttaccgccattatcgccattgtgtttctgcgtgagaaaatgcaaagctatcatctgatcggcggcggcattgttctggcaggggttatactcgcccagcgcctacgtattcctctcacccgcaggaaggcggaataa

SEQ ID NO: 886 - DNA, 276 bp, Xenorhabdus bovienii; identical to SEQ ID NO: 154
  Coding sequence Name=Xb4151_4152.C420.gene85.dna; Position on contig =64757..65032bp; Strand=+

SEQ ID NO: 887 - DNA, 99 bp, Xenorhabdus bovienii
  Coding sequence Name=Xb4151_4152.C420.gene86.dna; Position on contig =65054..65152bp; Strand=+
gtggcatccagattgtctgtgaaatcgacgagcaatggtcgtttgtcggcaataagaaaaaccaacgctggctttggtatgcttgggaaccccgcctga

SEQ ID NO: 888 - DNA, 291 bp, Xenorhabdus bovienii; identical to SEQ ID NO: 155
  Coding sequence Name=Xb4151_4152.C420.gene87.dna; Position on contig =65161..65451bp; Strand=+

SEQ ID NO: 889 - DNA, 363 bp, Xenorhabdus bovienii
  Coding sequence Name=Xb4151_4152.C421.gene1.dna; Position on contig =2..364bp; Strand=+
atacaattcgagctcggtaccccgtcatcgtttctaatcccgattcgcccattgctccacgagccattgttcggaacccatgtccgcaaacatcggttttggtgtcgtatcccatgccacgggtcatgtattaaatggttagttgctgtgatatgcttccggctttttaaggatgaagtatggccaaagttgatgtctattgccgttattgccacaaatcagaacaggtcaaaggacatgggaaaggaaatggcggacatcctcgttatcgctgttatagctgctgtaaggtctttcagttggcgtatacctatcaggcctgcaaacccggcgttaaagaacagattgtcgatatcgcgatga

SEQ ID NO: 890 - DNA, 279 bp, Xenorhabdus bovienii
  Coding sequence Name=Xb4151_4152.C421.gene2.dna; Position on contig =315..593bp; Strand=-
atgagccactattcgcttcaggcggggttcccaagcataccaaagccagcgttggtttttcttattgccgacaaacgaccattgctcgtcgatttcacagacaatctggatgccacattccgcaaggggaagtgtcgttacgtttcggggtctgaggtttttaatgttttcatgacggtggcggtggcgactttcaggatccgagcggtgtcacgaattcccccgttattcatcgcgatatcgacaatctgttctttaacgccgggtttgcaggcctga

SEQ ID NO: 891 - DNA, 291 bp, Xenorhabdus bovienii; identical to SEQ ID NO: 155
  Coding sequence Name=Xb4151_4152.C421.gene3.dna; Position on contig =585..875bp; Strand=+

SEQ ID NO: 892 - DNA, 279 bp, Xenorhabdus bovienii; identical to SEQ ID NO: 890
  Coding sequence Name=Xb4151_4152.C421.gene4.dna; Position on contig =948..1226bp; Strand=-

SEQ ID NO: 893 - DNA, 291 bp, Xenorhabdus bovienii; identical to SEQ ID NO: 155
  Coding sequence Name=Xb4151_4152.C421.gene5.dna; Position on contig =1218..1508bp; Strand=+

SEQ ID NO: 894 - DNA, 138 bp, Xenorhabdus bovienii
  Coding sequence Name=Xb4151_4152.C421.gene6.dna; Position on contig =1521..1658bp; Strand=-
atgccgggcgacagcacgagtgatggggattggcctgaataccgtgcttcgtcatttaaaaaactcaaacccaaatcggtaaagccgccccgttggctcttttatgccgacgataggataaggtcatgtattaaatga

SEQ ID NO: 895 - DNA, 117 bp, Xenorhabdus bovienii
  Coding sequence Name=Xb4151_4152.C421.gene7.dna; Position on contig =1604..1720bp; Strand=+
atgacgaagcacggtattcaggccaatccccatcactcgtgctgtcgcccggcatccatcccattcatagccatatcgacgatttgcttatgggtgccgggacgacaagcagcataa

SEQ ID NO: 896 - DNA, 279 bp, Xenorhabdus bovienii
  Coding sequence Name=Xb4151_4152.C421.gene8.dna; Position on contig =1727..2005bp; Strand=-
atgaccgtcaaggcgatcaccgaactcaatcataaaacgactcatcgccattcgccagtcttgaagtggcatcgtccattaaaggtaatcctgccgcaatatgctgctgccaatagtccgcatgttcagggttattggcgttttttaaacgctgctccagcaaatattgcgggaagtcgcttccgtcagcgcctgattttgccaatatcgcaacgggcgctcacgttctggtcatcaacgttatctctgccaatcctgccgtcatttctggcaacttga

SEQ ID NO: 897 - DNA, 807 bp, Xenorhabdus bovienii
  Coding sequence Name=Xb4151_4152.C421.gene9.dna; Position on contig =2080..2886bp; Strand=-
atgatggcgttattcaccaacggatttctttatgcaagtgaggtgagtttagaaactttgcgttttgcggcaattggcggtgatgctaaatcacaaactgatcttggagtcatgtatttccacggccaaggagtgaaacaggattatcaactagcgaagagttggtttgaaaaagcggcccaacagaattcggcggaagcggaaaattaccttggcgtaatgtatatgacaggaaaaggcacgcctgaaaacatacagacagccatcgaatggtttgaaaaatcggccaaccaaaattttgctaaggctcaaaataatctcgggcttatctatttttacaataatgagaatgataaccaaaatctaaacaaagccagagattggtttgaaaaagcagcccagcaaaatattgcaatatcacagtaccagcttggaatgatttatcttcacgggcgcggtgtagagcaaagtatcaagattgccagagaatggtttgagaaagctgcggcacaagatctacctgaagcccagtacaaactcggtgtgatatattatgggggaaattccggagtgctgcgcgattaccagatagcctggcaattgtttgaaaatgcctcccgacaaaatcacggagagtcacagtttcatctcgccatgatgtatcttcttggtcaaggggtgaccaaagactttaagcgtggcagagatatgtttgggcttgcatgtaagaatggagacatagaggcttgcttgtggtttaaggagctaactgagaataatgaggcaattaaagaattctcaaagtaa

SEQ ID NO: 898 - DNA, 141 bp, Xenorhabdus bovienii
  Coding sequence Name=Xb4151_4152.C421.gene10.dna; Position on contig =2891..3031bp; Strand=+
atgatagaggataagtattttttcactttaccttttatccttcccttagctgctgttcaatttatctcagatttagcccaatttgattgggctaaatctgttgataataatatggctacctactgtaaaactgcattctga

SEQ ID NO: 899 - DNA, 234 bp, Xenorhabdus bovienii
  Coding sequence Name=Xb4151_4152.C421.gene11.dna; Position on contig =2973..3206bp; Strand=+
ttgattgggctaaatctgttgataataatatggctacctactgtaaaactgcattctgatacaaatcccaccggtttccgtaaatatcctcaaataccaccaccacaccatattcctcctgacggggttcttcacagaaatgaacgccgttttctttcattttgtggtaatcacgccaaaagtcgtcagtttgcaggaaaaggaatactcgtccaccacactgattaccaataa

SEQ ID NO: 900 - DNA, 354 bp, Xenorhabdus bovienii
  Coding sequence Name=Xb4151_4152.C421.gene12.dna; Position on contig =3208..3561bp; Strand=-
atggaaaatatacatctcgaacctgccacctttgacgcctttatgtcgctcgatatccgtgtaggcaaaatcatcaaagcagaaaaaaacgaaaaagccattaagccagcctataaactttatatcgattttggcagtgatatcggtgaaaaacagagctccgcccagatatgccaaaactacacagaagaacaattaatcggcaaacaagtgttggcagttgtcaactttccaccaagaagagtggcaggctttaagtcagaagtcctcgttctggccgccgtctgtgacgatcaaggcaccgtactgctccagccagaacgagacgtgactctgggaacccggatactgtaa

SEQ ID NO: 901 - DNA, 159 bp, Xenorhabdus bovienii
  Coding sequence Name=Xb4151_4152.C421.gene13.dna; Position on contig =3607..3765bp; Strand=+
atgcgaaacaatattcagggcaaaatgactttcgatttatggaatgttgatcgcaatgagtcgtcctctggcaaactattcctgttaacgcactccacccgcaatcattttgacagggtgtatctgtgggtagtagtcagaaatgggtttctgacctaa

SEQ ID NO: 902 - DNA, 861 bp, Xenorhabdus bovienii
  Coding sequence Name=Xb4151_4152.C421.gene14.dna; Position on contig =3691..4551bp; Strand=-
atggctgaagcctgctgcccggcttcctgtggagaactgctgcaaggatggctattcggcggagagaaactgatctcctgtcccattaattggttcagttgtgtcgcggtcagcgagggccatgcctctgctgatgaacggccacgtatgcgccagatggtggaattgctgctggaacactggaatgaacctgctgaattatcggcctgcctgcgcattgaataccaatcgaccattccggttgccaaaggcatggccagcagcaccgcagatattgccgccaccgcacacgccacggccaaattactgggtaaatcgctgaacagcaccaccctcgcgcaactctgtgtcaagctcgaaccgactgacagcacggtatttgaatcattaacgttgttcgatcacctgaccgctcaaactcagatccccttcgcatggcagccggatatcgatattttgctgttggaaagtcggcaaactattttgacggaagagcaccatcggcgggatcgccgtcaactcttgctggaaagtgcgccgctgctccaacaggcatggcagcagtttcgcatcgcaaataaacatcatgacaactctcgtctaggggaagcctgcaccctgagcgccatcgcgaatcagccgatactgcctaagccccggttttatcaattattggatttagtcgaacaaagtggaatttacggcctgaatgtcgcccatagcggcagtatcgtcggcctgctatgcaacagccatcagcacgatatggatgacctgttctggcagttaggtcagaaacccatttctgactactacccacagatacaccctgtcaaaatgattgcgggtggagtgcgttaa

SEQ ID NO: 903 - DNA, 1074 bp, Xenorhabdus bovienii
  Coding sequence Name=Xb4151_4152.C421.gene15.dna; Position on contig =4544..5617bp; Strand=-
atgagtgaacacggcggcaatatcatcgaagttgcccaacagttcggcattccggccaacgaactcatcgatttaagcgccaatatcaacccgctgggtgccccggaacgggtgaagacgctgattaaagataaccttgcctgcatcgaaaaatatcccgacgtagaatatcgccatttgcatcaggtactggctgacgcccatcagtgcgataccgcttcggtaatagcaggcaatggtgcaacagaactgatctacgccgttgtccgttacctcaacccgaaacgcgccctgctcctcacccccggatttgccgaataccgccgagctttgcagcacgttggggctgagatcatcgcgtatccattaacagaagacgcaggatttcaacccgatctacgcctgctggatacactgacaattcttcaacccgattgtgtctttatagctacgcccaataacccaaccggtttaatgccagacagccggtttctgcaatcgctggggcaacattgtgaagagcaccgcatagcgctgattgttgatgaagcctttattgattttctgcccgataaccgaggcctgatcccgcacattgccgccacccgccacctttatgtgctgcgttcactgacaaaattcttcgccattccggggttgcggctaggctatctggtcagcggggattgcgcaggggtggcgtggatgaaaaaccggcgtgaaccgtggtctattaatgcccttgcggcgcaggtgggtgaagtcttgttggatgatcaggcttatattaccgccacccatcaatggctaaaatcacaacaacattatctatggacgtacctttcctcctgccctgaactcaccgtctggccgccttccgcgaatttcctgttctttcgctgccatcagcccaatcttgatctatggcacactctgcttgagcaccgactgctgatccgccattgcaaaaactatgttggcttggacgagagttactatcgaatcgccgtacgcagcgaatgggaaaaccgacgcctgaccgccgccatacagcacgttttcgcacatggctga

SEQ ID NO: 904 - DNA, 801 bp, Xenorhabdus bovienii
  Coding sequence Name=Xb4151_4152.C421.gene16.dna; Position on contig =5617..6417bp; Strand=-
atgaataaaggcaaagtatggctaatcggagcaggcccgggcgaagcagcgttaattactgttaaagggctgcattacattcaatctgcggatgttattgtgcatgatcgtctcgtcaatcctgagctgattgcacaggcaccagaacactgcgacatcattaacgttggcaaagaacgcaatcaccacccgatcccgcaagaagaaattaaccagattctggttaaacacgcactggacgggaaacaaatcgtgcgcctgaaaggcggtgatccctatgtattcggacgcgggggcgaagaggcagaaacgctggcacaacagggtatcgaatttgaaattattccgggtatcagttccgccattggcgggctggcttatgccggtattcccgttacccaccgcgattatgcatccggcttccatgtggtgaccggccacctttccctaggtaaggagccacagaactggcgcgcattggcgcaattggatggcacgctgattattctgatgggcatgagccgtctggccgaaatctgccagcaattgatacaattcggcaaacctcccgctacgcccgcagcggtaattatgtatgccagccagcccagacaggagatgaccatcgctacactggcaacgctgaccacagaagttgaacatcaccaactacatgcgcccgcattaattgtgattggcaatgtcgtccggttaactgagatactcgcctttacctccacccccattgcgctcagttcaaccgcagtcatgatgaatcctctcacccggctggtgacataa

SEQ ID NO: 905 - DNA, 108 bp, Xenorhabdus bovienii
  Coding sequence Name=Xb4151_4152.C421.gene17.dna; Position on contig =6414..6521bp; Strand=-
atgttaaataacgagaaaaatacaatccggttattaagtatcattcataccacccgcgttccctatacacttctatataagaaggaaaatataaagggagttctatga

SEQ ID NO: 906 - DNA, 1395 bp, Xenorhabdus bovienii
  Coding sequence Name=Xb4151_4152.C421.gene18.dna; Position on contig =7217..8611bp; Strand=+
atgcggcagaaatatgcttttgtcattgcaggtacaggcagcggatgtggcaaaaccaccgtcacactggggattatgcgagcactaatgtgccgccagttacgggttcagccattcaaggcggggcctgattatctggatggtggctggcatcgtgcggtgacgggggtagcctcccgcaatctggatgcttttatgctgcctgtccctattctgaatggcctgtttaatcaggctgtagccgataaggatgttgctgttattgaaggcgtcatggggctatatgatggctatggtgcagaccctgattattgcagtagcgcggcgttggcaaagcagcttggctgtccggtgattttagtggtggatggcaaggcggtatctacatccattgctgccacagtgatgggatttcagcactttgatccttccgtcaatattgcggctgtgctgatcaaccgggtgaaccatgatagccattttcagttgttgaaacaggcgattgaagactattgcgggcttcccgtcttggggcatattcccgtcatgccggatattgcactgccttcccgtcatcttgggctgatcccggcccaagagcgaaatagtcaatatgatgaacagtggcagcatctggcgcaccagatagaaacgacggtcgatctggacacgctgctggcgctgactccattaccggcattaccgcaaggcgatatcacttcccttgtcgatccggcgattggtcaggggttgacgctggcactggcggaagatgaagcctttcatttttattattccgataacctgctgttgctggaacacgcgggtgtggtcatcaaacgtttcagcccgttgcacgatagccagttgccggagtgtcagatgatctatctgggcgggggatatcctgaaatgtatgcccagtcactggcggccaatcacgcgatgcatgaggcattgcgtcaggcgcagcgacaaggcattgccatatatgcggaatgtggcggcctgatgtatctcggtgatgctctgaccgatgtacagggcgtccgccactctatggtgggtttgattgccggtgaaagccggatgggaaatagtctgaaacgctttggttactgcgaggcgacggcggtatgcgacacgcttttggtggcgaagggggaaaccctgcgcgggcatgagttccattattctgatttcacgtctgcccagccgccggtattccactgtaccaaacagcgtagcggcatggtgcagaaaagctggtttggcggatatcaaaacggcaatacgctggcggggtatctgcatgttcattttgcccaacgccctgatttgctccatcgctggctgacgatcgcccgcaagcagatggcaagggggcaatcatga

SEQ ID NO: 907 - DNA, 975 bp, Xenorhabdus bovienii
  Coding sequence Name=Xb4151_4152.C421.gene19.dna; Position on contig =8608..9582bp; Strand=+
atgaccgttttactttggtttgcggcgtttgttctcgatatgaaactgggcgatcccccgcattggccgcatccggtgcgctggatgggtcggctgatcaatcaggctgaacgcgttattcgtgggcgatgcaaaaccgacgctgatttgaaatggggcggggtggccttgtggctggtggtggtgggcagtgtctggctgatgagttatctggttctgtggctggcttatggtgtggcgttctggttcggcatgctggtggaagtctggctgatttataccgtgctggccggacgtagcctgagtgatgcggccaatgcagtctatcagccattgaaacagggcgatccggtggccagccgtcaacaactggctcagattgtcgggcgggatacatcacagttacaaccgccgcaaatcagccgtgctgccattgaaacggtggcagaaaacagcgtggatggcgtgattgctccgttgttcttcctgatgattggcggcgctccactcgcgatggcttataaggcggtcaatacccttgattcgatggtgggctataagacgccccgttatcgggcgctgggcatgttctcggctcgcatggacgatgtggcaaacgggatacctgcgcgtttgggctggcttttgctggcgctggcggcgaagtggctggggttgaattttcgtcaggcactgcgtatcggctggcgtgatcgctaccaacaccgcagccccaacagtggctggccggaagccacggtagcaggcgcattaggtatccggcttggcgggccgagtgtctattttaatcagcgggttgaaaaaccgtggatcggtgacgcacggcgtgaagtcacaccggaagatatcccgcagtccgtgcagatgatgagggtagcatcggtgatggcgctcctgctgtttgcgttgctgcatagtctggtcagtgtaacgccattcaacgcagtgctataa

SEQ ID NO: 908 - DNA, 654 bp, Xenorhabdus bovienii
  Coding sequence Name=Xb4151_4152.C421.gene20.dna; Position on contig =9597..10250bp; Strand=+
atgaactatcctcaacgctcgtatattcaacaacctcagcagattgagcaacatagcttcgacattatcacggggattatccgtgaatcgcggcctgattatcattttgtggatgccggacaggaagcggtgattaaacgggtgatccacaccaccgctgattttgactggctcgatatcctccatttttcaccggatgtcctgcatcgtattcgtgatgggatcttacgcggctgcacgttatacaccgataccacgatggtgttatccggcatcaataaaacccgtctggcgcaatatggcagtgaatgtcgttgttatgtcagcgatccccgtgtcgtgcaaatggcgaaagtgcagcagatcacccgttcaatggcggcggtcgatatcgccttgcaagagtcaggagagaagatttttgtttttggtaatgcccccaccgcgctgtttcgcttgctggaacatcaatccacgcccattgccgtcgtcggggtgccggtgggttttgtcggggcggaagagtccaaaaatgcgcttatacatagcgacttgagctgcattgcggcgagagggcgcaaaggtggcagcaatattgcggcggcgattatcaacgctgttttgtaccggatgccggaggtgcggcatgaatga

SEQ ID NO: 909 - DNA, 1248 bp, Xenorhabdus bovienii
  Coding sequence Name=Xb4151_4152.C421.gene21.dna; Position on contig =10159..11406bp; Strand=+
ttgcggcgagagggcgcaaaggtggcagcaatattgcggcggcgattatcaacgctgttttgtaccggatgccggaggtgcggcatgaatgaaacgttgaatgaaacaccacacacgcaggcagaaagcctcggtacggtctggcacagagggaaacagtaccgcaaaggttataccaccggctcttgtgccacggctgctgcgcgggtcgcggcgttaatgatcctgcgccagcagattatccatcaggtttccatcgtaaccccttccggtgtcacgttggccttgaacgttgaacagccgctgattgaaggtcagcaggcagtggcggcgatccgcaaagatggcggtgatgatgttgacgccacccacgggatgttgatttttgcccgcgtctccctgaatgacagcggaatcatcacgctggatggcggtgcaggggttggccgagtcacgcgggtcgggatcggtttaccaataggctgggcggctatcaataaaacgccgcggcacactattgaagaagcagtgcgagaggtgattggtcttcagcgtggggcagatattgtgatctttgcgccagaaggcgaagaacgggcgaaaaaaacctataacgaccggctggggatcaaagggggaatttcgattatcggtacgacgggcattgtcatgccgatgtcagaagagagctggaagcgttcactggcgctggaattggaagctaaacgcgccagcggattggatcggattatctttgtgccgggtaatcacggtgagcgttttgtcagtcagcagttgggcattgacggaaactatgtggtgacgatgagtaactttgtcggctacatgcttcaggaagcggtgcgtttacagttcagtcatgtggtactggtgggtcatgtcggtaagctggtgaaaatcgcagcgggtattttccatacccacagccatatcgcggatggccgcatggaaaccctgatcgccaaccttgccttaatgggcgcgcctttcgaactgattcaggccgttgatcactgtgataccaccgaagccgccatcgaactgatcgcggaacgtggctggcaggcggtgcatcagcagattgcccggaagatctgcgggcgcgttgatcaaatgctgcgtttttccagtggcaggccacagtgcgatgccattcttttctcctttgataatcaagtgttgggctgcaatcggccagtggatgagattgtggaggggttccgatga

SEQ ID NO: 910 - DNA, 621 bp, Xenorhabdus bovienii
  Coding sequence Name=Xb4151_4152.C421.gene22.dna; Position on contig =11403..12023bp; Strand=+
atgattacggtcgttggtatcggccccggcgctatcgcaaatcaaacgctggccgcgctggatgccatcaaacaggcggaaatattggtaggaggtgctcgtcatctggctgaatttccccatttccggggcgaaacccgccgtttgaatgccgatatggatggattgatgcaatggcttgaactgcgccagcatcagcaggttgtggtgctggcgtcgggtgatcccctgttttatggcataggtaaacgcatcgctgaacattttgtcggcgagccgcaaaacattcgcatcatttccggtatcagtgccattcaatacctgtgcgcccgaattctgctggatatgaatgatatctaccttaccagcagccacggtcgaaaaccggattttgactggctgctccggcacgaaaaaatcgcaatggtgacagatgaggtgattggcccccgccagattgcggaggagattttggctcgcgggcagcatcgccggatggtgattggtgaaaatttgtcacaggagaacgagcggattgtttgtctgagtgcgcaacaggtcgccggatacggtgacattaattatggcttgaacgtggtggtgatccttaatgaaagatga

SEQ ID NO: 911 - DNA, 597 bp, Xenorhabdus bovienii
  Coding sequence Name=Xb4151_4152.C421.gene23.dna; Position on contig =12013..12609bp; Strand=+
atgaaagatgaactgtttttgcgtggtcatcgcattcccatgaccaaagaaactgtcagagcgctggcactggaacggctggaactgacaaaagcccggcgtctgattgatgtcggagcggggacaggcagcgtcagtattgaagctgcattgcgttaccccacgctggatgttctcgcgattgaacgtaaggaagaggcgctggcactgatctatgaaaatgtccggcactttggctgtcacacagtccgcattcaggcgggtgttgcaccactgcccttggaggaagccgtcgatgccatttttatcggcggaacaggcgggcatttgacggaattaatcgattggtcgctgacacacctgaacccaggcgggcgtttggtgatgacgtttatcctgctggaaaactttatgcaggcattggcgcatctgcaatcttgtcaggtggtgtctcttgatggccgtgaaattcagattggggaactgaccccattggggcaggggcactatttcaaacccaacaaccccacctatttgatttcctgccagaaatttttcgaacacctgtccgagccagaggaaaacgcttatgcctga

SEQ ID NO: 912 - DNA, 795 bp, Xenorhabdus bovienii
  Coding sequence Name=Xb4151_4152.C421.gene24.dna; Position on contig =12602..13396bp; Strand=+
atgcctgaatatgttgatcccgaatcagcgtgttttgatgctgaaaaagtctggtttgtcggggcggggccgggagataaaaccctgatcaccctgaagggatatcaactgctgcaacaggcgcaagtggtgatttatgccggatcgctgattaatcgggagctactggaatattgccgtgcggatgcagaatgctatgacagcgcgggtatgacattacaggaaatcactgatttgatggcgaacagtgtcaaagccggaaaattagttgtgcgtctgcaaacgggggatttgtcgctattcggttctatccgtgaacaggctgaaatgctggccggtcagggaataggttttgtctctgtgccgggtgtcagctcttttctcggtgcggctgcgcaattgggggtggaatataccgtccccgaagtggcgcaaagcctgatcatcacccgcatggttggccgaacgccgatgccgccacgggaaacactggaagctttcgccgctcatcagacatcgatggcgatcttcctgtcggtacaggatatagccggtgtcactgttcggctgatacagggcggctatccgcaggaaactcccgtcgcggtggtttacaaagcaacgtggccggactgccggattgttcgtggcacattggacacgattgtggaacaggtacgcacggcaggtattcagaaaaccgccctgattttggtcggcgcatttcttggcgaggagtaccactactcaaaactgtatgatgcggggttcagccatgaatatcgtcaagcatga

SEQ ID NO: 913 - DNA, 1083 bp, Xenorhabdus bovienii
  Coding sequence Name=Xb4151_4152.C421.gene25.dna; Position on contig =13359..14441bp; Strand=+
atgatgcggggttcagccatgaatatcgtcaagcatgatgagcggatcgcgttgttctgcctgacattcggcggcatggcattagcgcgccgtctgcaatctcatctggccgtggattgttttacttcccctgaactggtggaaacggggttcagggctttcgatagtggctttgccaatacggtacgcaatgcgtttatccaatatggctcgctggttatggttggtgcgacggggatcgctatccgcgtgattgcaccactgcttaaggacaaactgattgatccggcggttgtcgtgctggatgaaaaaggccagtttgccatcagcctgttatcggggcatatgggcggtgcgaatgatctggcgcgtcaggttgcggatctgcttggcgggcaagcggtcatcacaactgcaacggatgtcaaccaactcgctgcaattgatatgttatcccggcaaattgacggcgaaatggcggattttcgcgccagcgtcaagacagtgaaccaaatgctggtcaatggcaaacgggtgggaatatggtggcatccggcgctgattgacgaaaaagggcagtgtgatacccgtggatttattccggtggaatcccttgatgatttgccggaactcgatgccttggtttacgtcagccaccgacgggcaacacccgtattggcgatcccgaccttcaaattagtgccacgccggattatcgcgggtattggttgccggcgcgggatcgctgctgaacgggtcgcgcagttattggatcgtcatctggcagaacatgattttgatcctctggcattaaaagccatcggcagtgtggaactgaaacaagaagagccggctttagttcaactggcggaaaaacgccgcattccttttcaaattttctctgttaaccagctcgcccaatgtgaacaggcattccctgcctctgaattcgtgcgtaaaaccgtgggtgtcggctgtgtctcccaacccgttgcctggctgatgagtcaggggcggctggttggtcataccctgcgtgagcagggcgtcactatcacactaggagtattgcagccatgttaa

SEQ ID NO: 914 - DNA, 726 bp, Xenorhabdus bovienii
  Coding sequence Name=Xb4151_4152.C421.gene26.dna; Position on contig =14435..15160bp; Strand=+
atgttaaccgtcattggaataggccccggcagtgaagccatgatgacgcaggaagcgatagccgcactgaaagccgcagatatcgtggtgggttacaaaacctacactcatttggtaaagccgctggtgggcgataaagagattatcaaaaccggcatgtgtaaagagattgagcgctgtcaggtggcgattgatctggcagaagaaggcaaaaatgtcgcgctggtctgtagcggcgatgcggggatttatggcatggcggggctggttctggaactggtcagtcagcatcaacgccatgtggaagtgcgtctggtggccggtgtgacggccagtaccgcttgcgcctcactgcttggtgctcctctgatgcacgatttctgtcatatcagcctgagcgatttgcttacgccgtgggcggtgattgaaaaacgggtacgggcagccgccgaagcggatttcgtggtgtgtttttacaatccgcgcagccgtggccgcgaagaccatctggcacacgcctttgcgttgatggcgccgtggacaccggcagaaacacccgtcggtgtggtcaaggcggcggggcgcaagaaagaagaaaaatggctgaccacttttggcgggatggatttttcccgcgttgatatgcgcagtctggtgattgtcggcaatcaatccacttacgtgcgtgatgggctgatgatcacaccgagagggtacagattgtga

SEQ ID NO: 915 - DNA, 795 bp, Xenorhabdus bovienii
  Coding sequence Name=Xb4151_4152.C421.gene27.dna; Position on contig =15157..15951bp; Strand=+
gtgaaacagccacaaatccacatttttggcggcacaagtgatgcccgccagatttgcatgatgatggacagcgctggcattgattatcgcctgtctgttgccacggccacgggagcgcagcaggcggctgatatccgcggtgacattgtgattggccggatggaagcagagggcatggtggattatctgcaaaagcagaaaacgcagagggtcatcgatgcttctcatccttatgccgaacagttgagccaaaacatcgcgcaggcctgccagaagctggatattcctctgatccgttatatccgtccgagtgacattgatgatgtcgaacatgccttgatccataaagtggcgactcttgatcaggcatgcgaagtggccgccagattaggcgaacggattttgctgactaccggcagcaagcaactggccgattatgtgacgcgtttggcaggaaaaaccgtgctggcgcgtgtcttgccgacggcagaagtcttggcgctatgtgaatcctgcggcctgtcggttgatcagatttttgccctgaaaggcccgttcagtgccgattttaatcgggcattctaccaattctgtcaggcggatgtggtcatcaccaaagaatccggtgaacagggcggtttcaaggagaaagttgagccgtgccttgcgctgggtctgccctgcatcgtgatctgccgtccggtacatccgtttaacggtgagggaattacgcaggccaacggtttggaagaaatggctcagctattggcgaatttcccggcgatagctaactaa

SEQ ID NO: 916 - DNA, 795 bp, Xenorhabdus bovienii
  Coding sequence Name=Xb4151_4152.C421.gene28.dna; Position on contig =15966..16760bp; Strand=+
atgaaaaaagcactgttggtgatcagtttcggaacccgttatcccgaaacgcgaaaaaataatattgaagcctgtgagcagcagttggcttctgtttttcctgatagggaactgtttcgcgcttttacctccggcatgattattcgcaaattgcgggagcgtgatggcatccacattgacacgcctcacgatgcgctgaccagactgtatcacgctggttatcacgatatcgctgttcagtgcctgcatatcatcaaaggtgacgagtatgaaaaagtccttcatgaagtagaacgatttcgcccgcagtttcaacgtctggtactgggcgcccctttactgaatcattttgaagactatctgcaattgatgagggcgttgcaccaccagctccccagattgggtgacaaagagtgtgtggtcttcatgggacacggcacgactcaccccgctttttctgcttacgcctgtctggatcacctgatgactcactaccactttccggctcgcgtgggggcagtggaaagctacccggaaatcgctttgattattaagggactgaaagccgaaggcatccgtaaagttcacctgatgccgttgatgctggtggcaggggatcatgccataaatgatatggcttctgatgaaagcgactcctggaaatcacagttggagaaagccggtatgacggccatcccttggttgcagggattgggcgaaaatccgatgatccggcagatgtttgttgctcatcttacggatgccatgaatgaaaatagccgggaggatgcgtaa

SEQ ID NO: 917 - DNA, 714 bp, Xenorhabdus bovienii
  Coding sequence Name=Xb4151_4152.C421.gene29.dna; Position on contig =16760..17473bp; Strand=+
atgagcggaaaactgtatgtcatgggggttggccccggagcgagtgatctgattaccgtacgtgctgcccgtattctggcacggctggatgtcatttatgccccttctggcaaaaaaggcgttcagagccttgctcactccatcgttgaagaatatctctcacctgaaactgaagtgtgcacgtaccattttttaatgaaatcagacaggggagaaaaagaagtcgtgtggaataacgtcgcacaagccttgcaagaagaagtggcgaaaggcagaaaagtcggctttatcacactgggcgatccgatgctgttcagtacgtggctatttctgctggagcggatcggcaatccgtcgtggctggaaatcgtaccgggcattacctcatttgcagcgattgcggcacgtagcgcaatgccgttggcgatggaaaatcaaaccttgtccgttatcgccggtacggcgtccgatgcggttttggagcaagccttgctcaatcatgactgcatcgtcctgatgaaagtttactcaaattttgaacggatacgcgagctgcttcagcgtcaccacctcctgcaacacgcgttgatgatggctgatgcgaccttgccgacagaacagtactggcgccatctcgacgcattggagagtggtcaggagctatcgtatttctcaacgattctggttaataaaaactggcaattaccgaggtga

SEQ ID NO: 918 - DNA, 732 bp, Xenorhabdus bovienii
  Coding sequence Name=Xb4151_4152.C421.gene30.dna; Position on contig =17477..18208bp; Strand=+
atgcaacagaaactaacgaagttttcgttatctggtgcggctatcgcactgcttttagctctggcaccgcaggaagcgttcgccatgcatatcatggaagggtttttgcccccgatgtgggcagttgcatggtggctggcttttctgccttttttggcggcaggcattatgaggctgcgtcagattgtgcaggaagacagtaaccagaaagtgttgctggcactgtgtggcgcatttattttcgtcttatctgcgttgaaaattccctctgtcaccggaagctgttctcatccgaccggggtcgcgctggcggtgatcttgtttggcccttctgtcgttgcggtactgggtgcgattgtcctgctgtttcaggcgttgctgctggcgcacggcggcgtcaccacgctgggggctaacggcatgtcgatggctgtgattggcccgctggtggggtatctggtatggcgtttctcctgcaaaatgggcgtacgcaaagatatcggtgtcttcttctgtgcttttatcgccgatattgtcacttattccgtcacctcgattcagttgggggtcgctttccccgatccacaacttggcatgggggcagccatcatcaaatttatgggcattttctgcataacccagctaccgattgcggttgctgaaggtttactgaccgtgctgatttacgatcagttggtgaaaagacaattaattcaggctcgcagtttttaa

SEQ ID NO: 919 - DNA, 282 bp, Xenorhabdus bovienii
  Coding sequence Name=Xb4151_4152.C421.gene31.dna; Position on contig =18221..18502bp; Strand=+
atgaaaaagacattaatattgctgtctctgctgattgctctgtgcgttattccatttttcattgatcacggcggggaatttggtggtgcggatggtcaggctgaagcgcaaatcatggaaattgcgcccaattataccccttggttcgaatccttgtatgaaccggccagcggtgaaattgaaagcctgttgttcacattacagggcagcctcggtactgccgtgattttctatatccttggttattatcgccgcagccgtaaagatcatgatcggcattga

SEQ ID NO: 920 - DNA, 678 bp, Xenorhabdus bovienii
  Coding sequence Name=Xb4151_4152.C421.gene32.dna; Position on contig =18489..19166bp; Strand=+
atgatcggcattgataaactgagcgaccagagccgttggcgcaataaagatcccaaggcgaaattcgccctgtatctgctgtttatggtgctggcgatggggctatctccagtatggcaggccgtactgttattcggccttgccctatttacctgctatctgctgcggatcagcctgctgcgttacctgaaatggctgttgatcccgctggggtttctcggcattggcctgattgctatcgtattgtctgccagtttgcagccggacagcctgttgtggggatttaaagtagggcaatattggctgggtattgattcacagggtgtaaacatggctaatcagactctctggcgcagccttgcaacgttggcggcaaccttctggttcatgctgaatatgccctttgagcagatgattaagttactgaaattctgccgtgttccccacctcttgattgaacagatcctgttgacatggcgctttatctttatctttgtggaggaagccgccgcgatccaccgcgcgcaatcactgcgttttggttatcgctccctgcgaacggactaccgctcactggcgatgctggtcggtatgctgtttacgcgggtgatgagccgttatcagcagatgagtgtggcgctgacactcaaactgtatcagggtgattttcatttataa

SEQ ID NO: 921 - DNA, 813 bp, Xenorhabdus bovienii
  Coding sequence Name=Xb4151_4152.C421.gene33.dna; Position on contig =19205..20017bp; Strand=+
atgctggcgacgcaggcactgtatttcagttatcaggatgaacctatcttgcaaaacctgacacttgatttcagccatcatcaagttaccggaattatcggagcgaatggttgtggtaaatcgactttgctgatgaacctttccggcatcctgcgtccacaacaaggcgctgtctggtgggataatgcaccattggattacagtaaaaaaaggttgatggcgttgcgtcagcgggtcgtcacggtatttcaagatccggatcaacagatcttttataccgacattgacagcgatctggctttcagcctgcgtaatctgggtgtggaggaggccgaaattcagcgcaggatagaacgtgcactgacattggtggatgcccatgctttccgcaacaagccgattcaatacttgagttttggtcagaaaaagcgggtggcgattgcgggtgcattagtgatggaatttgattacctgttgctggatgagccgacagcggggcttgatccttccgggcgtcagcaaatgctggaaatcatcgccatgattgctgccgggggtaaacggatcattatttccagccatgatatagatttgatctatcagatttgtgatggtttatatgtactggcaaagggtcgggtgatcagttcaggtaaaccagaaaccgtcttcctgcaaaaagatctgctggaacaggcaggtttggtgcagccgtggctggtgaaagtacacagtgaagccggattgcctctgtgcaaaacagagcaggcgctttttgctatcctgcatgcaacaaaggagaaacgacaatga

SEQ ID NO: 922 - DNA, 1542 bp, Xenorhabdus bovienii
  Coding sequence Name=Xb4151_4152.C421.gene34.dna; Position on contig =20014..21555bp; Strand=+
atgacactatctctgatgattcagggaacggcttctgatgtgggcaaaagtgtgctggtggccggattttgccggatctttttacaggacggctatcactgcattcctttcaaatcgcaaaatatggcgctcaattcgggtattactgccgatggcaaagaaatggggcgggcgcagatatttcaggcagaagcggcaggtattgagccggatgtgcgtatgaatccggttttactgaaacccaccagcgatcgtaaagcgcaggtgatttttatgggcaaagtagtatgcagcatgaatgccgtggaatatcacgaatataagccacggcttcaacagcagattctggctgcctatgacagcctcgcagcggaaaccgatattatggtactggaaggtgcggggagtccggctgaaatcaatttgcgtgatcgcgatatcgtcaacatgggcatggcagagttggcggatgttccggtcattctggtagcggatattgatcgtggcggcgtgtttgccgcgatctatggcacgctggcactcctcaggccagaggaaagagcacgggtcaaaggcgtgatcatcaataaattccgtggcgatccggctttactgcaatcaggcatcgatcagatcgaagagctgacacaagtgccgatattgggtgtgctgccgtggttggatctcgatttggaagatgaggacagcgtcgccttgcaggtcggcaaatatgctcactccggcaagcacacagaaaattggctggatatcgcggttatccagtttccgcatatcgccaatttcacggatttcaacgcgttggcggcacaacctgatgttcatctgcgttatgtctctgatccttcagcacttcacggatcagatctgatcgttttgccgggcagcaaaaatacgttgggtgacttattatggttaaagatccaagggcttgatcaggcaattatcgccgcgcaccagtcaggtatcccgattattgggatttgtggcggctttcagatgctgggaaaacagatcattgatgaagttgaatcaggcttaaaccggatggccggcctgggattactggatgctgatactcagtttgccaatgaaaaacacacggcacaggttaaaggcgttgtcatgcctgagctgacggggatgctgaattcatgcagcgagcagccgattgcgggctatgagattcatatgggaatgacacagcttggcgagcaggcatggccatttgccaaaatgcatctgcgtaatggagaggagacggtctggtttgatggcgcagttaatcagtcaggatcggtaatgggcagttacctgcatggcctgtttgatcagaatacgtttactcgcccattactgaaccagcttcgtcgccaaaaaggcctcgcaccattagaaaatgtgatgttcaattacgtccagcacaaagaaaaacagttcaatattctggctgccagtatgcgtgagcatctcgatattgatcgtatctatcagttaatgaaagagcatgaagagcatcactga

SEQ ID NO: 923 - DNA, 114 bp, Xenorhabdus bovienii
  Coding sequence Name=Xb4151_4152.C421.gene35.dna; Position on contig =21526..21639bp; Strand=-
gtgcacctcccgtcaccaaaatcattttgtgatcccaaactccgtaaagtcacaatgctcacacgatacgccttgtttttgcaatcagtgatgctcttcatgctctttcattaa

SEQ ID NO: 924 - DNA, 546 bp, Xenorhabdus bovienii
  Coding sequence Name=Xb4151_4152.C421.gene36.dna; Position on contig =21615..22160bp; Strand=+
atgattttggtgacgggaggtgcacggagcggtaaaagtgcctacacagaacggcggattgcggggcagtgtgagcaggtactttatattgctacggcgcaggttacggatgaagaaatggcggctcgcatcgagcggcatagacaggaacgcccttcacactggcggacttgggagggttatcaagacttggccagcgtgatccgccagcatcggcaacccgaagagggcgtgatacttgaatgtgtaacaacgttgactgccaacctgctgtttgacgaatcggcaggggcatcacctgatgaatgggattttccatcattggagggatttattcagcgtcagatagatgatctgatcgcggcttgcctgcattgtccggctccggtgtatttggtcacgaatgaagtgggcatgggcattatgcctgaaaatcggctggcgcgtcattttgtcgatatcgccgggcgcgttaaccaaaaactggcgcaggcggctaaagaggtctggctgatggtctcaggggttggagtcaaaatcaaatga

SEQ ID NO: 925 - DNA, 759 bp, Xenorhabdus bovienii
  Coding sequence Name=Xb4151_4152.C421.gene37.dna; Position on contig =22157..22915bp; Strand=+
atgaagctgaatctcttttgggcgacattgcaatttatgacacggcttcccgtgcctgtaaaatggacggagggggttgatttcagccagtattggcgcggcgtaccgaattttccggtgattggcctgattattggcggattggccgccctgatttcgctctcgattagtcaatccggcggcggtatgtatatcggtgccattggctatgtgctggcattggcactgttgacaggcgggttacatttagatggtttggccgatacctgtgatggccttttctctgcccgccggcgagaaacaatgctggcgatcatgcgcgatagccgtctcggtacatatggcggtctggggttaattttctgtcttttccttaaggttttcgccgtagcagagctttcttatcatccccctcttgagctatttgccttgctgacgtgcgcaccgattgtcgggcgtacggccgtcgtgctgctgatgtatgaacagcgttacgcccgtgaaggtgaaggcatgggaagcagttatattggccgaatgactccgcgatcgactgctctcacgcttttaggcggtgcggtattggttatcgcgctcggagactggcaaggattaatcgccatgatggtgacattgatcgtcatttatggattggccttctattttaattatcgtcttggtggtcagaccggcgatacgctgggtgcttcaattgaagcaggggaagtcatttttctgctggtcatgatctgggaatag

SEQ ID NO: 926 - DNA, 279 bp, Xenorhabdus bovienii
  Coding sequence Name=Xb4151_4152.C421.gene38.dna; Position on contig =22940..23218bp; Strand=-
ttgcatcaagtaaagattgaagagtcatgtgtatcatcctggctattcttcaggccgatattctgcccgtccattgaagacacgcaatgtgattatcgacgacgctataagcaccttgctgaaagggaaaagaccacatggcttctgtcggcattttgccagtcagacaaccaacgtgcccccgtccccgtcagtgacagatccgtactgccgcaaaaaacgttgttaatattggcttccgtttgcccgtgtcgaacgagaaaaagccgcattggatga

SEQ ID NO: 927 - DNA, 1065 bp, Xenorhabdus bovienii
  Coding sequence Name=Xb4151_4152.C421.gene39.dna; Position on contig =23191..24255bp; Strand=+
atgactcttcaatctttacttgatgcaatccagccgctgaatcaggcgaaaatagaaaccgcgacgcagcacattgacagcctggtcaaaccgctgggcagtttggggcgtcttgaagcactggcgatccagctttcaggcatgccggggatactggatcttcgcaatctgcaaaaagaaatcatcgtcatgtgtgccgatcatggggtatatgacgaaggtgtggcaatctcacccaagaatgtcacggcgatacaggcacggaatatgctgcaagggataaccggggtctgtgtactggcaaaaaacagcggtacccatgtcttgcccgtggatattgggatcgatggtgatccgattgacaatttactgtccctgaaattggctcgcggctgtggcaatattgcacagggggcagctatgcaatatacacaggctgaaactttgttgctggcgagtgcgcaactggtgcaacagcgtattgccgcaggggtgtccgtatttggtgtgggggagctgggtatcgccaataccacgccggccgcggcagtcatcagcgtgctgacgggcagtgatccccatgatgtggttgggcagggggctaatttgcccattgagtggctgatgcacaaaggctccgttgtgcatcagtcgattatcgtcaatcagccgaataagaatgatgcgcttgatgtattggcaaaagtaggcgggtttgaccttgtcggtatgacgggagtgattctcggagccgcggcgtcaggtgttcctgtcgttcttgatggttttctttcttatgcttctgcattggctgcctgccagatggcacctattgcacggaattactgtattccttcacatctgtcagcagaaaaaggctcagggctggcattacagcatttgcgtctgcaaccttatcttcatctgggtttgcgccttggtgaaggcagtggagcggcaattgcgatgtctttgattgatgccgcttgtgcgatttactgcaatatggggcaactggcgagcagtgggatcagtttgccggagcagagttcgaaagggatttga

SEQ ID NO: 928 - DNA, 450 bp, Xenorhabdus bovienii
  Coding sequence Name=Xb4151_4152.C421.gene40.dna; Position on contig =24177..24626bp; Strand=+
ttgtgcgatttactgcaatatggggcaactggcgagcagtgggatcagtttgccggagcagagttcgaaagggatttgatatggctgcgcactcgggaaggtatggctattacccgggcaaaaggaaaactacgaggtaaacaaccaaaattcttggataagcaacagaaagagctatgccgcatgcacggaatggcggagtactcaacgatctggctgaactgttttcagtatcgataccaactgtctatcagactcttgtatgtacaaataatatttaagagtagattatgctcagtaataataaatccaactatgatcagtttctccggagtattcatgcttaaattttattctttagttagtctattatggttatctatttctgcgtttgctcactcatcctctgcggtcggttttaaagaaattgacctagtgctacagtcgtaa

SEQ ID NO: 929 - DNA, 264 bp, Xenorhabdus bovienii
  Coding sequence Name=Xb4151_4152.C421.gene41.dna; Position on contig =24615..24878bp; Strand=-
atgcggtcaccgccctgcattttttccagatccgccctcgtgactattttgcggatacgggagaaaaaaacggcaaaggggctgatagccctcagtgtctcggaactgcgtaagttgctgtcagaattgatggaaaaaacgggggagacagtcgaacagattttacattggtcatactggcggcggcgacaccaatactatgcacaacaatgtcattatcgtcaccgagataaccctctgattacaaataaattacgactgtag

SEQ ID NO: 930 - DNA, 144 bp, Xenorhabdus bovienii
  Coding sequence Name=Xb4151_4152.C421.gene42.dna; Position on contig =24859..25002bp; Strand=+
atgcagggcggtgaccgcatcacggtgagcggtcagcaggaagtcaatcgtctgaccgtgggtatcgaccgcccggtaaaggtatttccactgaccttttactttgatataggtttcacccatccgccatcgcagccactgtga

SEQ ID NO: 931 - DNA, 183 bp, Xenorhabdus bovienii
  Coding sequence Name=Xb4151_4152.C421.gene43.dna; Position on contig =24957..25139bp; Strand=-
gtgcttatttttctcaggctgagaacggagtttttgttagaatggcaattctccaaggttacttcaacgttattggcggacggtaaggatccgtgcgtaaacaggaaggggtttggtggtagttggtcagggtggtttcacagtggctgcgatggcggatgggtgaaacctatatcaaagtaa

SEQ ID NO: 932 - DNA, 240 bp, Xenorhabdus bovienii
  Coding sequence Name=Xb4151_4152.C421.gene44.dna; Position on contig =25054..25293bp; Strand=-
atggcgggttatagagaaacagcagatcatttacccaattccaatttgatgctcactcctgatctactttcacacttacatccccgcgccataattatgcatcctcttcctcgaggttatgagcttccttatgagttagataattcagtacattgtgcttatttttctcaggctgagaacggagtttttgttagaatggcaattctccaaggttacttcaacgttattggcggacggtaa

SEQ ID NO: 933 - DNA, 660 bp, Xenorhabdus bovienii
  Coding sequence Name=Xb4151_4152.C421.gene45.dna; Position on contig =25342..26001bp; Strand=-
atgatatcagtgcaaaatttttttctaaaggataaccttctctctattaaatcattaaacttagacactataatgaatattatagatctggctcagaattttaaagtatcaaaacctgataaaaaaataaaaaaaagaaatgaagatatccttgttgcttcacttttttttcaggccagtacaagaactcgcctcagttttgaaagcgcagccaaccgtcttggtgcaagagttataggttttgctgatggtgagtcaagccgttctggttcaagctggaatgaaaaatttacggatactgcacaaatgatcaatgcgtatgccgatattgccgttatacgccacgccgaagttgagcctgtgcataactattgtataaaaagtcgccttccagttataaatgcgggaaatggtgaaggattaaatgcagagcatccaacgcaggctttgcttgatatttttaccattcatcaatctttccctcttcataaatcattaactttattattatgctgccacccctcttcccgatcagcgcgttctcttctcttctgtatcgccctgtttcacaatataaaattattactttgcactgaagaaaattgtaagctttttcaagaagacgaagcgtaccttcgtcaagcgggtgtcacctactaa

SEQ ID NO: 934 - DNA, 1050 bp, Xenorhabdus bovienii; identical to SEQ ID NO: 483
  Coding sequence Name=Xb4151_4152.C421.gene46.dna; Position on contig =26042..27091bp; Strand=-

SEQ ID NO: 935 - DNA, 2163 bp, Xenorhabdus bovienii
  Coding sequence Name=Xb4151_4152.C421.gene47.dna; Position on contig =27211..29373bp; Strand=-
gtgctaacagttttatccagctcccgtcattttctgtataacagtcacgtcctctattatatccgtatatttattgcactgacaggaacgaccctcgtcccttggttattgggggaagagcctaaaatgacaatccccctgacattaggtgttgttgctgcggcattaacggatctggatgatcgtttagttggccgcctgcgcaaccttatgattaccctagtttctttctttgccgcttctacatccatcacactgctttttccttacccgtggcttttcatggttgggctagcggtatctacctgtagttttattctgctcggtgcccttggacagcgctatgctaccatcgcctttggcgccttactgattgctatttacaccatgctcggtacgtcgatatttcctctttggtatcagcagcctttattattactcacgggtgcaatttggtataacttgctgacattaacggggcatttactgttccctattcgtcccttgcaagaaaatctggcacgctgttaccaacagctttctgcatatctctatgccaaaaccagcctgtttgaccctgattccgaagctgaagaatgtaagcaatcaatgtttgatgttgccatggcaaacagcgcattagttaccacgctcaatcaagccaaaatttctttactgagccgtctgaaaggcgatcgtgggcaacggggcacgcgtcacacactgcattattattttgttgcccaagatattcatgagcgagccagttcgtctcatgttcagtatcaaaaattgcgggagacttttcggcatagtgatattttgtttcgttgtcagcgattgctgtccatgcaggctcgtgcatgtgaacaagtctcgcaatcgataattctgcgtaagccatatcagcataactcacgttttgagaatgcgttcaactatcttgaaagttctcttgaacgcttgaaaaatcagcaaggcgctgacacccaaattatggcgttctacaatttgctgagaaatttacgggcgattgatgctcaactgtcagggctgaattctgagcaatccccacttttccaaaacacgtctcaaagtggtaagcaagaggatactcaattatccgatgaagccttaactggctggcgtgatgtctggttcaggataagcagtaatctgacgccaaagtctgctcttttccgccacgctatccgcatgtcggtcttgctgtgtaccggctatgccattattcaattatttgatctgcaacgtgggtactggattttactgaccagcctgtttgtctgccagcctaactacaacgcgacccggcgtcggctggcactgcgcgtcatcggtacactggctgggattttgattggcttgccaatcctctattttgttccttccatcgaagggcaactggtactgattatcatttcaggtgtattgtttttcgccttccgtaatatccaatatgcacatgcaacactattcattactctgctggtgttactgagtttcaatttattgggtgaaggatttgaagttgccttgccaagaattacagacacattaataggctgtggtattgctttgctggccgtcagttttatctggccagattggaaattccgtcagttaccgagagtgattaaccggaccatgatcgccaattgccgttatcttgacgctattgtcgggcaatattatcaaggcaagagtaatagcctgaattatcggatctcccgtcgtgatgcccataattgtgatgctgaattagcatccgtaatatcaaacatggcatcagagcccaaaaattaccgtgtttctcaggaagaagcctttcgcctcctctgtcttaaccatacgatgctaagttatatttctgctttgggtgcgcatcgtgacaggctcaataatcaggtcattctggatattctgaatgatgcaatttttcaggttgaatcggcattgcagcaagggcgggttgatgatgaacgcctgcaacatatttcagagcgtctggctgagagcatcaatctaatctcttctgatagcagcggcaaaatacaacttgtattacaacaaatagggttattggttgaacttctgcctgaatttgtttcattgataaaacaacttacacagtcggatatttga

SEQ ID NO: 936 - DNA, 2064 bp, Xenorhabdus bovienii
  Coding sequence Name=Xb4151_4152.C421.gene48.dna; Position on contig =29440..31503bp; Strand=+
atggaactcaaatcaacgcaaatgggccaacgccttgcccagcatccttataacagggtgcgtttacttaacgcgggtattgaagtcagcggtgataagcaccagtaccttattccatttaatcagttaatgagtattcagtgtaagcgagggattgtttggggggaactggaatttgaattgtatgacggaaaagttgttcggctgcatggcacgaaatggcagcaaacacagcacttttaccattatttattaaaagaatggcagcaatggagccttgatatgagtgatgtcagtgctgatgtgttggcggctcaactcaatgaaatcaataaaattacacagcaggatcgctggttcaaaactgcggacttgctctcattacagcagcaaattcaggaggcatttcaggcgctccctttgccattagcgcgaatcgaacaatttgagaactgtcgtgatgattatcgaatgtgtttggattggctgaatgagggaggaaaaacgattaaaactcttaaccagcaatggattgaacgcatattgcagcaatatgcagaatttttccaaactattgaaactacgccactcaatcgttctcaatgccaggcggtcgttaatggtgaaaaatctatattggttttggcaggagcgggcagcggaaaaacctccgttctaattgcgcgtgcagggtggctgttattacgtcaacaagcgcttcctgagcaggttttgctgctggcttttggccgtcaggccgctgatgaaatgaataaacgtattcaggaacgcttgggagcaaaagagatacaggcaaaaacattccatgctttggcattgcatattattcagcaaggtagccatacagcgcccaaaatgagtgaattggagacggatgcacagaagcgtcgtgattttctcatcaatgaatggcaaaaacagtgcagtgaaaaaaaagcacaggcgaaaggctggcgcgaatggttgaatcaagagctggattggcaattacctgagggggaatactggcatgataaacaactcacgattcgattatctgaccgtctggagcgttggctggagctgatgcgaatgcacggtggcagccaaaaagagatgattgaacaggcatctcctgcttatgctgacacattccaaaaacgtatacggcttatggcacccttgctgaaggcttggaaatcggcattaaaatctgagggtgctgtggacttttccggcctgatccatcaagccgtgaatattctggaaaaagggcgctttatcagcccatggaagcatattctggtggacgagtttcaggatctttcaccattgcgagcaaaattgttggcggcgttacgagtacaaaataaacaaagccatctatttgctgtgggagatgattggcaggcaatttatcgctttagtggtgcggaattaatgctaacaacagcattctcaacctattttggggaaggtgcggaaagtgcggaatgtactttggacaccacttatcgtttcaatgatcgcattggtgagattgctaaccgctttatccggcaaaatcccaatcaattgaacaaaccgctccatagcctgacaaaagggactaaaaaatcagttgtgattttgtcgcaggagcagttggaagcattgctgaataagatgagtggttatgtcacgaagcaggaaacgattctgttgttggggcgttatcaccatttcaaacctgaatttttgaaaaaagcctctacacgctggccgaatttgaatattgaatttatgacaattcacgcatccaaggggcagcaatcggactatgtcattatcttgggattgcagcagggacaagatggttttccagcgccggcaagggaatccgtgttggaacaggtattattgccgcaacctgaaaactttcccgatgcggaagaacgtcgccttttgtatgttgcactgacgcgggcgaaaaaacaggtatggttgatgcaggagccggacaatccgtcggtattcattcatcaattaacacaattgggtgtggcaatccaaagcaagctataa

SEQ ID NO: 937 - DNA, 279 bp, Xenorhabdus bovienii
  Coding sequence Name=Xb4151_4152.C421.gene49.dna; Position on contig =31419..31697bp; Strand=+
atggttgatgcaggagccggacaatccgtcggtattcattcatcaattaacacaattgggtgtggcaatccaaagcaagctataaggtcatggaatattttcttaatcagggttaccacgtcattcctgtcagccctagattggcggattttgcacagtcggttgatatggttggcgtgtaatgaagaagcgaaatcactggcagaaaatacaggattaaatgttgtgatggattgttgcccaaaaattgagattcctcgtttggccatggaaaaatga

SEQ ID NO: 938 - DNA, 321 bp, Xenorhabdus bovienii
  Coding sequence Name=Xb4151_4152.C421.gene50.dna; Position on contig =31761..32081bp; Strand=-
atgatgatcgccagcaaattcggtatcggtcagcaagtacgacataaactgctaggttatttaggtgttattgtagatattgatgctgaatattctttagaacagccacaggaaaatgatatagcatcgaatgctaccttgcggtcagccccgtggtatcacgttgtaatggaagatgatgatgggcagccagtccatacctatctggcagaagctcaattggcttatgaaacgtcagatgatcatccagaacaatcttctctagatgagttggctgaatccattcgtagtcaactacaggctccacgattacgaaattaa

SEQ ID NO: 939 - DNA, 129 bp, Xenorhabdus bovienii
  Coding sequence Name=Xb4151_4152.C421.gene51.dna; Position on contig =32078..32206bp; Strand=-
atgaggtggcagtcacatgccatcttgtttggttacaaaaaattccgtttaccgggtatgcacttgaaatttaccttactgcccttatataagaatctttgcaaggtttctttggaggtgactatatga

SEQ ID NO: 940 - DNA, 330 bp, Xenorhabdus bovienii
  Coding sequence Name=Xb4151_4152.C421.gene52.dna; Position on contig =32256..32585bp; Strand=+
ttgacgtgccaacgttcgtattatcttgtcaggagggaggacgaaataatggctataaagggtatgactatttatgtttatgggcgggtacagggagtcggcttccgttatcaaacttattgttgggcaaagaaaaataaactagtgggatatgttcgcaatatgaatgatggtagtgtcaaaattgttgcttgtagtagtgatgagcaacttaaaaagctggcacattggctggagcagggagggccaccgggagctaaggttgagcactttaaatctcagctttgtggagtggaggaggagatgactgattttagcatccgtcattag

SEQ ID NO: 941 - DNA, 330 bp, Xenorhabdus bovienii
  Coding sequence Name=Xb4151_4152.C421.gene53.dna; Position on contig =32603..32932bp; Strand=-
atgttggtatttaaagatcgtgcgatcgaaactgatgcacaaggttatctgaaaaacagcagtgactggcaagaagatatggcgtcactacttgccgaacaggaagatatcaccttgaccgaacagcattgggaagtcatacgttttgtacgtaaattctacgaagaatttaatacttctcccgctattcgtatgttagtcaaagcaatttcacaaaaatatggtgaggaaaaaggaaatagccgttatctctatcgtctgtttcctaaggggcctgcaaaacaggcaaccaaaattgcaggcctcccaaaaccggtaaaatgtatctga

SEQ ID NO: 942 - DNA, 129 bp, Xenorhabdus bovienii
  Coding sequence Name=Xb4151_4152.C421.gene54.dna; Position on contig =32983..33111bp; Strand=-
atgtcgagcactataaacatcactgttctcaatgtaaagtacttatctgttcaactgccgtcaaattactcacattactatccattggcttatttcttcagcagatttggcgatctttcttgggaataa

SEQ ID NO: 943 - DNA, 1215 bp, Xenorhabdus bovienii
  Coding sequence Name=Xb4151_4152.C421.gene55.dna; Position on contig =33377..34591bp; Strand=+
atgaagctgacagacatggcaatcaagcgagccaagccaaaagaaaaatcatatatgctggcggacggtaacgggctatctttgttagttgaaactaatgggtctaaaggttggcgctatcgttatcagttcacaggtaaaactaaaatgatatcgttaggtatctacccagttgtaactctcactgaggcaagagctaaaagagatgaggctagaaaacaggtagctaacggcatcaatccgagtgaggccagaaaagcggagaaagtcgcatcaattagccagtctgagaatacatttaaaaatatcgctctcgaatggtacgaaggtagaaaagatagatggtctgtcggttatcgtgacgacatgatggacgcattcgaaaaagatgtgtttccttatataggtgatcgcccgattgctgacattaaaccaatggaactactcgaagtgctttctgttatggaaaagcgcggcacaactgagaaattgaagaaagtccgtcagcgttgcggtgaagtttggaagtacgccattattacgggcagggcggagtataatccagcgccagatttagctagtgcctttgttcctcataagcgtgaacactacgcacatctttcagtaagcgagttaccagaattcctttcttctatagataaatatatgggaagccagattgttagagtggctttacggattcttatattaaccggagttcgaccaggtgaattaagaaaggctgagtggtcagaaattaattttgatattggtatatgggaaattccggccgaaaaaatgaaaatgcgccgccctcatatagtgccattgtctgaacaggttattgagttactgaaacagatacacccaatcagcggtagttatcaatatatttttcctagccgtactgattatagaaagcatatatctgatatggcattaaatacgatgattaggcgtatgggttatagcggtagagccacaggtcacggttttaggcacaccatgagcactatattgcacgaacaaggctacaacaccgcatggattgaagcacagcttgctcatgttgataagaacagcattcgaggaacctacaatcacgcccagtatttagatggtcgtagggaaatgctgcagtggtatgccgactacatggaaacactcgaacgaggtgaaaatgtgatacatggcaaatttgggaagagtatttaa

SEQ ID NO: 944 - DNA, 327 bp, Xenorhabdus bovienii
  Coding sequence Name=Xb4151_4152.C421.gene56.dna; Position on contig =34735..35061bp; Strand=+
atggatgttacatcgattgattttgatttaatcaattatcatgcaggagaaactcttcagttttactgggatataaggttgtgcatgttagcttctcgcacagtaagcagcgattccattgaggataaaatggaatcggcaaaaaaatgtgagaagattttagaaaagtttgcatttgatatgaaaattaatgagtcacataagattattaatgatttcatatccacaatatctattaatagagcacttgaattgcttggcatatacgcaattaacttgaagatgcgggttttaaaatctggaagttatcagtcaaccgagtggtga

SEQ ID NO: 945 - DNA, 1050 bp, Xenorhabdus bovienii; identical to SEQ ID NO: 483
  Coding sequence Name=Xb4151_4152.C421.gene57.dna; Position on contig =35006..36055bp; Strand=-

SEQ ID NO: 946 - DNA, 111 bp, Xenorhabdus bovienii
  Coding sequence Name=Xb4151_4152.C421.gene58.dna; Position on contig =36033..36143bp; Strand=-
atgtttaattgcttatatttattaagaataaacattgaaatatacccgtcgtcattgaagatgcttgatttttcatttgtatcagatcatgattgcgcccatgaaaattaa

SEQ ID NO: 947 - DNA, 1509 bp, Xenorhabdus bovienii
  Coding sequence Name=Xb4151_4152.C421.gene59.dna; Position on contig =36224..37732bp; Strand=+
atggctggaaagatagatatacttcctgcaaccctctctaatattatcaaaggccaaccctttagggtgactgtaaccgtgagtggtgagacaaatattagtgcaaatacagaaattgatattgttagttcacaaggggtacatttaataaagaaattcccaggcaccgttgttaaaactaattttatccaacaaatgatatttcttgcagacgacactgacgctgattacaaaatctcgtttaccgcgaagtcagcaagcagtccaaaaggatcggtagactataaacctgtagaaaacccagaactgatccccgatagctgcgtgctaagaggttcatcatcttatctgtatgacccgagtcccgttggcttatcaggcactcctcctacatcaagcaatccattcattctggcgtcgatcaatccgatgggagtgagcggaggttcaatttcaaaatatgatattcagattcgtgccacaggtcctgtgcggatatttactgtagacgatgttgaaattttgccttatgaagttgatgatcaaaaacagtattatgactatttagtccagaaatcaacaaaatcggctgttaaccttaaaatatacgccactaccggtattgctcaattcatcgggtttgaaacaatattcagtcggagggtatacaatcaaaaacaagttatgtttattacgtcttctccaattgctgtttccgacgacttcgatccacccatcattgaggaaacatatcagtcctccactttaacaaggccagatcaacccgattatttccatttcatgatcccgcagaataatcatttacatcccggtgatttcatcatcggatttgtgacggatgatgataaacacatttataaaaaaaacctgatcttcggggaggtagcggttgccgaagatggatattttagatttaaagtggcttatagcgatatgtataacggaaccaattttatcagctatgctgctcttgatcagggaggcaacttagttgggtccgaaccgaattacatcagttatgatagtggcggcaataacaacccaagtcctaatgaccaaagccggactttagatgcaccagaggtacatgaccagttcggcttatttattggtatatatcagtcaatcaatatccacagtatcggtaacaaaggaattgaggtctggctgccagtagccgctaccgctaatgacctgaataaaatagccgagggtgattctattacgattaaagcctatatttcatactgcgtcgatacagaaacacccgcccgtcctctaccaattgtggtcactgaaaatcacattgtacaacagaaagaaattgatagtggttattataagcacaccatcgcggccgataaacttctcggttatgacacaatacagggggattttgaaggttcgatttcaatagactatagccgtcttgcccagaatcagaaatcgcaacttttcacccgaggattcgacacggttgcaccttaa

SEQ ID NO: 948 - DNA, 948 bp, Xenorhabdus bovienii
  Coding sequence Name=Xb4151_4152.C421.gene60.dna; Position on contig =37822..38769bp; Strand=+
atgcctataaagaaaaacagccttgttgcgccttttttaccacaaagttacgatggagccattgacttatcaaaattggatcaatccatactggtgataaaaataaatcactatgaggccgtccatattggtgatgttatcattgttcatctgaatcaatatctatcgtcaattctctattatattacaaatgcaaataaagattatcccgcttatgaaataaccatacctttttctacgattcctcttggtagctacaatattttctataccgtcaccgactgtgccggaaacacatcggattcggtaaccagcagcgtcacaattataaagtcagatccttcaccatttccggtaattgcctccctgaaaacggaagttttgacgaatgggatgccggccaatgattacacaccgaatgttgtactcatcacggccttagatgaaaaaaagaagtcggtatccggtgtgccaatacacattgtctccaacgataatatgagtattgcgccgtcttcctgtatcacagatcaggatggaaaagttgttttctgttcaacttcacgtgctgatggttttttctcaatccaagtatcatcaggctctacactcaatacgactgagttgtatttctcacctacaaatgaagcaatattagaaataacaggaaaagaacaaattagcgaagaatatgaaataattacaattcaggttcacgataaacagacacttaaacaaattaaaaatgcgaccgtctattataaaatagacttggctcataatatcaatgccgtactggacattggctataaccccgatacgatacaatccatgtctacagatgaatacggacaattcaaaataaacctaaaaggtaaaataggcgggtattgtattatatcagctacggccaataattatatcggcagcataaaatacaccaaataa

SEQ ID NO: 949 - DNA, 399 bp, Xenorhabdus bovienii
  Coding sequence Name=Xb4151_4152.C421.gene61.dna; Position on contig =38790..39188bp; Strand=+
atggcaacgaaaaccctttcatttgttgcaataaaaagcgggtggtatgtctcatattactttatgaccgaagcgggttatgattatacaataacactaaccgataaaagcaccggaactatttacggtacatggacaaaaaatgaggatggcgatgcttcaatctataaatactccagctcatttgaatatacaggatcggatggagagcttatttgcgttgttgattgtccagaaagtcagaaacttgataattcctttagcgcaaatctgataacgccaagtgcgggatctccaacactgggatatacctattgtgcggcctttgaggattttggtggctcaattgattataatgacttttttgtctgtctggtgggatggacccatgaaggataa

SEQ ID NO: 950 - DNA, 4524 bp, Xenorhabdus bovienii
  Coding sequence Name=Xb4151_4152.C421.gene62.dna; Position on contig =39281..43804bp; Strand=-
atgaagatatgcaagcaagctttaatgcctatcgcgattaaattagctttgttttttcctggagtaagtgttaatgcaatagccgcttcatcatgcggttcttcaaatacaacgacgattatttctgataatgaggcagaaccctgtaatttatcaaatggcgaaaatctgactattaatcaaagtgcatccattgatattcctcaagggcagacagataactcggatagatacggcctgaaaaaaagtgcggtcaatgttggtggtaacaatgatgtggctcctgtgacgtctatcgatcacattgaaaatcacgggattttgaaaggagacagtggaattacagtaacttatagtggttctgttggaaagctgcttaatcatggtgtcataagtggcgcttcaggaggtgtgtgggtttctggccatatgaatacgttagataattatggcgtaatcaaagccgaaaatattgataccgcactctattcagtcatgctcagtcaggcgttgaaccaaaagaatggcagtcaaggaagtattgataccatttttaaccgggaggggggatcgattgatggaatatctgtcagaatggcaaaacttaatacgcttgataatcatgggacgttgacatctcaggtgaattttgccggctctacgggcggaacgctcattgttgatagtggtggtcatgtcggcacttttaataactatggatcagtgactggacccaatcatggcattgtaattacaggaggaggctatctcgaaaacgtcaataatcaggccgggagtaaaggtatcatgactgggcaggatgccattcaggtcaccgggcaagacacgtctgattcccaaaaaaaatcatccaacattaaacaaatcaccaacgcttcgttcatacgtggaaagcacaatggcatttctatcgacgataaaggaactgttgatactataacgaatttagatggtggagtgatacaaggggataaattttctataaataataagggaaccttaatcaacggcattgataatgcgggcacgattgacggcgatgttgagcttggaagcgccagcctttatatgtctggcccgaatgcaatccttaaaggcaatgtttctgggacgaaagattcggttgtcaccatagggtcaaaagatgctatgaccaaaaatcttaatctttcctttactcacaacatgaatgccggagcggttagaatattatcagaaaatgcgttaactctgggtgacggacacacaaccggaagcatcttcagtgacataaataatgaaggccgccttaatttcaaccacagcgataaaacaacttatagccatatcataagcggaacaggctcagttcatcaagtggggagtggcacaacccttttgacgggagaaaatacctataccggcgagacaaaaatcgactcggggacgttgcaactcggtgataacggaacgacaggaagtattgataaaacttccagagtggcaatcggacagtctggggtgctggcttttgatcataataacaatattaccttttccaataatatctctggtactgggggtgtggagcatgttggtaaaggaatgactattctgagtggtcagaatacgtatgttggaaaaactaatatcaaatctggcacgttacagtttaacacccgaaataatgggccggacactcgcttagttgccatcgggtctgaaggtactctggcactcaatttgaatggaacaaaccgttttgacggtgtgatttccggcaatggtcatctcgggaagattggtgctggcaccacaacactcagctcgaattcctctgactttacagggtcaacgggtgttgaggaaggaacccttatcgttgacgggaaactgggtacagctgcttcgacctttaatgtgaaaaatggaagcacggttaatggttccggcacaataggcggcactgcaacgattgaaaacgggggccaccttgtcggcaagcagggtgataccttaacatttggtcatgatcttattcttggccacggtgcaaatgtcggtatttcactgggagcggcggagacttctacgtctgcgttatttaatgtgcgtggcaacctgacattggcaggcacgcttaacgtcaccaaccttggtggtttctcagcgggtgaatacgatatcttccattatggcggcaccttaacaaacaatcgaatgacgctcactggcggagaacccggaactctctctctcgatacgagcagagacaagaaagtttacctcaccaatacgggcggcatgcttctgaactattgggatggcggagatgccggcaaacatagcaatggtgttgttgacgggggaagcggcgtctggcaggtcggtggaaggaataactggacgtcaaaaacagggtggccaaatgccagttggagcaatgccgatcagtttgccatcttctccggtaccgcaggaaaggtgcaggttgataatggcggtggccaagtcaccgtcaatggtatgcaatttggcaccgagggttataccctcaccggcgccccgctgcttttaaaaaatgacaatacaggcagtgccaaaatccgtgtcggcaccggcaatcagtcagcggcgggcagtacagccacgattgagtcaaacctgacgggttcagcgacacttgaaaccactgattacggtactctggttttaaaagggaagaacgattacacaggcggcacgaaagtgacacagggtattcttcagctcggtgacggcggcactacggggagtatctctggggatgttgtcacaggagataaaggtacgcttgcctttaaccgttcaaatacagtgacatttggcggtcatatcacgggcaagggaaatctggttcagaacgggggcggtacaactcttctgacgggcgggaataactatacaggcacgacagaaatacaaaaaggaacccttcgtcaaggcgcaaaggcggctttcagcacggtttcttcctatacaatcggacagaatggtacgcttgatatggggggatttaatacaacaatttccgcgttaagtaacaatggcagagtgctggttggcggagataatcaaactgtaggacgtatgttgacagtggcgggtgattacagtggcaataacggtacggtgagtttatcaacggcattggcggctgataactcaaagactgacaaacttgtggtgaatggcagtacatcaggtacaacgcagctcgcgatcaaaaatgtcggcggaacgggcgcaaaaacgcaggaaggtatcaaggtgattgatgtgcaaggttcatcggacggaactttcaatttagtggctgactatcattatcagggagaccccgccattgtcgcgggtgcctatgcctaccgtctctataagaatggcactgataattcggatggaaactggtatttgcgatcgtcgttaacccgtgcaaaacccaatccagaaccggcacaacattatcaggcaggggttagcgtttacgaaacttatggccggattttgcagacactgaatgcgccggaatctttgcgtgaccggattggaggacgtcaatatccgttgcctgacatagatgagttcagaagcgccgagggtaaagacagtacagacgagagtacaaacccgacgcccaatggggtatggggacggctgaccgcttctcacggtaaattgtcgccacgtgtgacaacatcgggtgctgatgcgactacctataacctgttccgtgctcagataggtatggacaaacgtttttatgaaaataaccaaggctccttggatggcggcgttttcctacaatattcgaatattgatgccaaagtcggctctgtgcatggtgaaggtgacattcgggcaaagggttacacggtcggggcgaccagtacgtggtacagcaagaatcagttctatttggatgggttggctcaggtgacctactttaataatgacctgaattcaaagacggccagccagcctttgggcaataataagtccgccctgggatatgccttgagtctggaagcaggacaagcgtttgatttgagtccgagatggtcactgactccacaagcacagcttatgttctcttctgttaatatgaacggattccatgatccgtttggtgccagaatccactttaaccaaagtaaaagtatgaaactccgtgttggcacgacaatagattaccgtcaaaagtggcacgactctctgagtaaagaggaaaaatccacccatttatatggctttatcaatataaatcaggaagttttggggcgcagtgacttgactgacgttgccaatgttggctttatcagtggtaacgaccgcacttggggaggcatggggacaggcggctcttacagttgggggaatggcaaatatctcatccatggtgaaatttcagccaattctagcctgaataattttgctgatagctacgatatgaaggccaaaattggcatcaagagagcatggtga

SEQ ID NO: 951 - DNA, 159 bp, Xenorhabdus bovienii
  Coding sequence Name=Xb4151_4152.C421.gene63.dna; Position on contig =43968..44126bp; Strand=-
atggggccttaccactatctcgcttttttgaagttgtaccgaccggtaaagaacaggtgctgccacgcaatgttagcgggagctgacgaccattttcattttgctatcaatattgccagtacctgtctacaccgtcgtctgccgttgctggggttctga

SEQ ID NO: 952 - DNA, 102 bp, Xenorhabdus bovienii
  Coding sequence Name=Xb4151_4152.C421.gene64.dna; Position on contig =44256..44357bp; Strand=-
ttgaatacacgacccaaaaaagaggggaaccatagatttttatgctctcgaacaattctatttactggctgcctaaataaccggcaacaccacttttgctaa

SEQ ID NO: 953 - DNA, 366 bp, Xenorhabdus bovienii
  Coding sequence Name=Xb4151_4152.C421.gene65.dna; Position on contig =44373..44738bp; Strand=-
atggggtcattcatcagtaacaaaaaacggcaacgctggctgtggtacgcgtgggagcctcgcttgaaacgtattgtcgctcacgcttttggcgctcgtagcaaacagacactcaggacgttgctggaaaagttatccacttttgatgtggcattctggtgcaccgataatttcggggcatatgacatattggctgatgagaaacatgtcaccggtaaactttatactcaacgtattgaacgagaaaatctgaacctgcgtaacaggctaaagcgactcaatcgcaagacgctgggttattctaagtcagttgaaatgcatgacaagatcattggtacattcatcgagcgtgagttctattattga

SEQ ID NO: 954 - DNA, 276 bp, Xenorhabdus bovienii
  Coding sequence Name=Xb4151_4152.C421.gene66.dna; Position on contig =44792..45067bp; Strand=-
atggcattagttgaagtgaagtgtcggttttgtgaccaaaccacgtctgttaaaaaacacggtaaaggagaaggtgggcatcaacgatattattgccagtcctgtcgtagaaccttccagctcgaatacacttaccgggcttgccattcgggtatgaaagagcaaatcgtcaagcttgccatgaataacgccggtattcgtgatacggcacgggcacttcatgtcagcattaacgctgttgtacgcactttaaaaaactcgcgccgcgatgtgtaa

SEQ ID NO: 955 - DNA, 378 bp, Xenorhabdus bovienii
  Coding sequence Name=Xb4151_4152.C421.gene67.dna; Position on contig =45222..45599bp; Strand=+
atgttgaatacctttccaaatcgagggaatatgcgatttttggcaaattttatttcaccattagctgctcgtattgtattaggtaggatgctgtcagaagggatcaacgctgaattgattgatgaaaatgtagtatggaacaactatatgtattcacaggcgttaggtggcgttaaattactggttcataattcagatattgaacgggcaaaaaacattattattcaaattgaacaaggttgttaccaattggatgattctaatgagaattcattagtgtcaaaaaataacgtaactaacaatatattaaatacttttttctccatcgcattatttttgattacaggtattgcgataccgtttaagccatcattgtag

SEQ ID NO: 956 - DNA, 561 bp, Xenorhabdus bovienii
  Coding sequence Name=Xb4151_4152.C421.gene68.dna; Position on contig =45623..46183bp; Strand=-
atgattatgcgatttgacaacttggaaaccgaacgactgctattaagaaaattagcttatgatgatgcccctcaaattcagcaaaaattccctcattgggaggtcgtgaagtatttagacagcaatgcagttccttggccatatccggataatggtgcaggatactttgtcaatcacattgctatgcctgaaatacaaactgaaaaagcatggatatggtcaatcagaatgaaaagtaatcctgatgagctaattggtgtgatcgggttatatgacaaaccggacaacaatcgaggtttctggctttctccagaatatcacggccgaggattgatgcgagaagccagcaaaagggtcactgattactggtttaatgagttggatcgaaccgttctcagaacactcaaagccagtattaatgaaaattcgagaaaaatttcattagcacagggaatgcgcttgatcagcaccagtaaaaagcaatatgtgtcaggtacatatgattctgaactgtgggaaataaccaaagatgagtggtgtaataagcccccttttccttga

SEQ ID NO: 957 - DNA, 816 bp, Xenorhabdus bovienii
  Coding sequence Name=Xb4151_4152.C421.gene69.dna; Position on contig =46324..47139bp; Strand=+
atgtcttatcaatgccctctatgtcattcaccattactgttcactcatcatcaatggcgctgtgaaaacaatcatcagtttgattgcgcgaaagagggttacgttaatttgctgccagttcaacataaacgctcaaaagaaccgggtgacagtgttgaaatgatgcaggcgagaagggcgtttttacattctggctactatcgggcattacaacagaaaactattcagttgcttgacaaatatttgccagagggcgccggaacgttattggatattggttgtggtgaaggctattatacggctgcggtacaggcacagttgaatctccatcgggatatgacggtatatggcctggatgtagcgaaaatagcggttcgttatggggctaaatgttatccaaaagtcaatttctgcgtagcatccagccatcgtctgccatttgctgatggctcgcttgacggaattctgcggatttatgctccttgcaaagcgactgaattagctcgtgttgtaaaaccgcatggcattgttttgacggttacacccggccctcgtcatttatatcagctgaaggaattgatttatcaggaagtgaatttacaccctgaaaacaaggaacaatgggagggatttgaattaatttcgacagaaatgctggcctatgcaatgccattgggtggtgagcaagcccataatttattgcagatgaccccttttgcctggcgggcatcagaacaggttaaaactaatttgatgactgaaaaactatttaattgtgaagctgattttacgctaaaagtttatcggcgtatttga

SEQ ID NO: 958 - DNA, 621 bp, Xenorhabdus bovienii
  Coding sequence Name=Xb4151_4152.C421.gene70.dna; Position on contig =47195..47815bp; Strand=-
atgtgtatatggaatcacccagccgaggctatgttgatgaatctctacgcaacactcattctcgcattcgcactatctatggacgctttcgctgccgcagtaggaaaaggtgctgttcttcaccgcccacgtttccgtgaagcgatccgcacaggtattatctttggtttggttgaagcctgcacgcctttaatcggttggtttctgggactttatgccagccaatatattatggaatgggatcactggattgcattttcactgctgttcatgcttggctgtcggatgattattgaaagcttgaaaattgatgcacaaactactgttgaatctactcctcgccgccatagttcaatgacattaattatcactgcaatagcaactagtctcgatgcaatggtaattggcgtcggtctcgccttcttacaggtcgatatttttcataccgccatgacaattggaataataaccatgattatggctacattaggaatgttaattgggcgctatattggtccattattaggcaaacgggcagaattgattggtggtctgatattaattatcattggattcaatatattatttgagcatcttaaattatttatgtatgcagcataa

SEQ ID NO: 959 - DNA, 189 bp, Xenorhabdus bovienii
  Coding sequence Name=Xb4151_4152.C421.gene71.dna; Position on contig =47851..48039bp; Strand=+
atggtcttgccaaccgattcagagcttatttttgttagactcttcaggcactcgtaccacgttttgttgaaaacgagtatgttgatacgaattttccaaaaatgttttggaacaggctactccccaatgactgaaagtgacaataccagatttaaaataaaaggcaaaaaatatttagttatatattaa

SEQ ID NO: 960 - DNA, 459 bp, Xenorhabdus bovienii
  Coding sequence Name=Xb4151_4152.C421.gene72.dna; Position on contig =48147..48605bp; Strand=-
atgaacttcaatgatatcatattgataatattgattttattaatgttcgcttttgcgatttatgatgaatttattattaatcagctcaaaggaaaaacgctattaaatataaaattaaaaagaaaacatcggatcgacgccttaatatttatcgttctgatttccatcgtcatttataataatgttatcgtacaaggcaatcaattaaccacctatttactgttgtttatcatcttgtttacaatatatttaggttatattcgctcacctaaacttattttcaaaaataaaggattttattacgccaaccgtttccttcaatatgaaaaaataaacgcaatgaatctatctgaagacggtattttaatgataagctttgaaaaaaataatatctatattactgtaagtaaactagatgatttagaaaaaatctatcaattccttatcaataataaataa

SEQ ID NO: 961 - DNA, 165 bp, Xenorhabdus bovienii
  Coding sequence Name=Xb4151_4152.C421.gene73.dna; Position on contig =48622..48786bp; Strand=-
gtggatcatcatgggctttttcattctgggaatcgtgggctttcgttttggtttccttggctaagtttgatttctctacgttattttcgtatttggggaggttatcctcccccatttctttattgcaagaacaaacatattctaaaaaaaccattagctatataa

SEQ ID NO: 962 - DNA, 858 bp, Xenorhabdus bovienii
  Coding sequence Name=Xb4151_4152.C421.gene74.dna; Position on contig =48723..49580bp; Strand=-
atgaacaacatgtcagatacaacaaacataggtcagaaaaagctgacacaaagtgatatccggggtgtttttctccgttctaatctatttcagggttcatggaactttgaacgtatgcaggcattgggtttttgcttctcaatggtgccagccattcgtcgcctctatcctgaaaatactgaggaacgaaaacaagccataaaacgccacctggaattcttcaacacccatccttatgtggcagcacctatccttggtgtcaccatggcaatggaagaacagcgtgccaatggtgccaatattgatgacggtgccatcaacgggatcaaagtcggcttgatggggccactggctggcgtgggcgacccgattttctggggaaccgtgcgtccagttttcgccgcccttggtgccggaattgctatgagtggtagcatgatggggccaattctatttttcttcctgtataacttagtacgattgctcacccgttaccttggtgtggcttacggctataaaaaaggcttggatatcgttaaagatatgggcggcggcttcttgcaaaaaatgacagaaggagcgtcaattcttggcctgtttgtcatgggcgcgctagtcaataaatggactaaagtcaatattccgctggtagtttctgaagtacccgatcctaccactggcgtaataaaagtcaccacagttcaaactatccttgaccaattaatgcctggtttgatgccgctattgctgactttcggctgtatgtggctgctgcggaaaaaagtcaatccactgtggatcatcatgggctttttcattctgggaatcgtgggctttcgttttggtttccttggctaa

SEQ ID NO: 963 - DNA, 666 bp, Xenorhabdus bovienii
  Coding sequence Name=Xb4151_4152.C421.gene75.dna; Position on contig =49585..50250bp; Strand=-
atgaaaaccggcatcatcatcggcggtacactcgagatgattgcccttggctggatgaatatcggtgcagcaatcgcccccgatgcagcattagcttccatcatttcaaccattctggttatcgctggtgggcaagatgttggtgcaggtattgcactggctattcctctggcggcggcaggacaagtattgaccattatcgtccgtaccctgaccgttggcttccagcacgcggcggacaaagccgcagaaaacggtaacctccgtgcaatcagcgcccttcacatttttgctttagcgcttcaagcaatgcgtatcgccctgcctgcattagtcgtggcattatcagtcggcacgtctgaagttcagagcatgctgaacgcgattccacaggttgtcaccagtggcctgaatatcgcagggggcatgatcgtcgttgtcggttacgccatggtgattaatatgatgcgcgctggctacttgatgccctttttctaccttggtttcgtcacagcggcctttactgatttcaaccttgttgcattaggtgtcattggcgttgttatggctatcctgtatatccaacttagccctaaatataaccaatcacaagcagccgcttctgccggcaatacttcaaatgaccttgataacgaattagattaa

SEQ ID NO: 964 - DNA, 297 bp, Xenorhabdus bovienii
  Coding sequence Name=Xb4151_4152.C421.gene76.dna; Position on contig =50009..50305bp; Strand=+
ttgtccgccgcgtgctggaagccaacggtcagggtacggacgataatggtcaatacttgtcctgccgccgccagaggaatagccagtgcaatacctgcaccaacatcttgcccaccagcgataaccagaatggttgaaatgatggaagctaatgctgcatcgggggcgattgctgcaccgatattcatccagccaagggcaatcatctcgagtgtaccgccgatgatgatgccggttttcatatcacccagcactaagccgactaatgtacaggcaaccagcggacggtggaattga

SEQ ID NO: 965 - DNA, 150 bp, Xenorhabdus bovienii
  Coding sequence Name=Xb4151_4152.C421.gene77.dna; Position on contig =50296..50445bp; Strand=+
gtggaattgaaattcatcaagaatggaatccatgcctgcaatacaggcaacgatgaatatcaacaaaagttgaacaacggtaatttccattgtttttctcctgtaaccaaatggaatttggttagaatttcgttattgagtaatggttag

SEQ ID NO: 966 - DNA, 957 bp, Xenorhabdus bovienii
  Coding sequence Name=Xb4151_4152.C421.gene78.dna; Position on contig =50477..51433bp; Strand=-
atgattggcacacatggggctgcggcagagcaactgcttcataccgcagagatgttgattggagaacaggaaaacgtttcttatattgacttcgtacccggtgaaaatgccgatacattgttcgacaaatacaaccagaaactggaatcacttaatacagagcaaggtgtcttatttttcgtggatacctggggtggtagcccattcaatgccgctaaccgtatcgtggttgataaaaacaactacgaaatcatcactggcgtaaacgtccccatgctggttgaagccttcatgtgccgtgacgataatccatcaatggaagaactggtttctgtggcactggaaacaggaagagaaggtatccgggcccttaaaacagaacaagctgaagaaacccaaaaaccagaaccagtcaaacccgcagcaccaaccattgctcccgcttcatcacctaccgtttcaggtggcgggcacatgaaaattgcccttgcgcgcatagacgaccgccttattcacggtcaagttgcaactcgctggacaaaagaaaccaatgttaaacgcatcattgtggtcagcgatgatgtggcacaagataccatccgctctactttgctgaaacaagttgctcctcctggcgtcagcgctcatgtgatagacgttgctaaatgtgttcgtgtttacaacaaccctaaatatgcgggtgagcgtgtcatgctcttgttcacaaatcctacagatgtactgcgtattgtcgaaggcggtgtttcgcttgaatccatcaatatcggtggtatggctttccgtcagggcaaaactcagatcaataacgccatttcggttgatagcgctgacattgaagctttcgagaaattaaattcccgcggtatagaacttgaagctcgtaaagtttccagtgatacccgcttgaatatgattgatctgcttaaaaaagcttaa

SEQ ID NO: 967 - DNA, 201 bp, Xenorhabdus bovienii
  Coding sequence Name=Xb4151_4152.C421.gene79.dna; Position on contig =51758..51958bp; Strand=-
gtggtcttcctatccattattagcgcacacaccttacctagaaaaatatccctgctgcatagcagggatatttttttggctgaaacggatcacttaagtacattattttctctattctccactaaacatcacattttttttatacaaacattaatgaaatgttaccgaaaacagttcaatgaaccattcaaacaaaaataa

SEQ ID NO: 968 - DNA, 1365 bp, Xenorhabdus bovienii
  Coding sequence Name=Xb4151_4152.C421.gene80.dna; Position on contig =51990..53354bp; Strand=-
gtgattagcgttttcgacatgtttaaggtgggtattggcccatccagctctcatactgttggtcctatgaaagcaggaaaacaatttgtcgatgatcttgtaaaccaaggagtaatgtcctctatcacgcgtgtagctgttgatgtttacggctcactttcattaactgggaaaggtcaccatacggatatcgccatcatcatggggctggcaggtaacatgcccgcgactgttgatattgattcaattcctggttttattcgtgatgttgagcaaactcaacgtttgccgctggcaaatggtttacatgaagtcgattttcctcgtgacggaggtatgaacttccgcagcgataatctgtcactacatgaaaacggtatgcaggttcatgcattcgcaggtgacgaaaaaatttacagcaaaacttactactccatcggtggtgggtttattgttgatgaagaacatttcggcaaaccctctcaagataccaaaccagtttcttatccattcagctctgctgctgacctgctgatgaattgcagcaaaacaggtctgtctgtttctggcttgatgatgaaaaacgagctggatttgcatagtaaagaagaaatcggcgaatactttgccgatgtatggaataccatgcaagcctgtattgaccgaggtctgaacacggaaggcctattgccaggcccactgcgtgtgcctcgccgtgccgcagctctgcaccgtatgctgacatcatcaaataatttttccaatgacccaatgaacgtggttgatttgatcaatatgtttgcattggcggtcaatgaagaaaatgcggcgggtggccgagttgtaacagcgccaaccaatggtgcatgtgggatcgtgccagcggtactggcttattacaaccactgcatcgagccagttacaccagatctttatatccgctatttccttgcctctggtgcaatcggcatcctgtataagatgaacgcgtctatttctggtgcagaagtaggctgtcagggcgaagttggggttgcctgctcaatggcagcggcaggtcttgctgaattgttgggtgcgagccctgagcaagtttgcattgcggcagaaattggtatggagcataacctcggtctgacttgtgacccagttgcgggtcaggtgcaggttccatgtatcgagcgtaatgcgattgcttcagttaaagccatcaatgcgtctcgcatggcacttcgccgtaccagcgaaccacgcgtttcgctagataaagtcattgaaactatgtacgaaacaggtaaagacatgaatgcgaaataccgtgaaacatcacgcggtggtttggcgattaaagttcagtgtgattaa

SEQ ID NO: 969 - DNA, 144 bp, Xenorhabdus bovienii
  Coding sequence Name=Xb4151_4152.C421.gene81.dna; Position on contig =53442..53585bp; Strand=-
ttggggattaactgcggctattatttatcggctggcacaacaagttcaaagatcggtctaacaataatcgcaaagcatcaccaaaatgtgcgttttttagccacattcatatcaattgctattataattaaaaaaaaactgtaa

SEQ ID NO: 970 - DNA, 570 bp, Xenorhabdus bovienii
  Coding sequence Name=Xb4151_4152.C421.gene82.dna; Position on contig =53525..54094bp; Strand=-
atgacatcgctttctgacttcattcatcggtttcaattgcaacttcctgcgcagccagcaaatttggcgagcaaccagcgaaatgctgctgtattgctaccgatcatctgtaagccagagccaacacttttgttaacccagcgcgctaaaaacctgcgttcacatgccggccagatcgctttccctggtggagccaccgatcccgaagatcattctctgattgccaccgctttgcgtgaagcagaagaagaagtcagcattccacatcacaaagtacaagtattggggcagctagcccccttagacagcagtggaggctatcgtgttactcccgttgtcgggttagtctctccctctctttcttttcggacaaatccaacagaagtggcaagaatttttgaaattccactttttgatgccctcactcttccccactaccaacatttagatataaaaatccgcaatcgacagcaccgggtctatttttattggtatcgtgaacaaatgatttggggattaactgcggctattatttatcggctggcacaacaagttcaaagatcggtctaa

SEQ ID NO: 971 - DNA, 1539 bp, Xenorhabdus bovienii
  Coding sequence Name=Xb4151_4152.C421.gene83.dna; Position on contig =54091..55629bp; Strand=-
atgaccataacctcaaatatacgttcacaattaacgacaagcgggattatatacccaataggttttaatagacgcttttatctcaagtcaggagtgagattctgtgataatctccaccagttaataagttatttattcgaattacccaacgccaacactggttacatcatgaagattgcattacaaaaacgacttttaccttattctcctgatcttgccacccgatattttgctcctctctcagtatcaccttgggcaatgttgttacattctggaacggctgaacatccccataaccgatttgatattttagttgccgaaccagtaacaacgcttatcacacgggacgaatcaacagaaataaactgtaatggtgacgtttcgctctctcaggaagatccattcttgttgttgaaaaagcatctgcatattcgcaatattgctccgcaattcgatcctgattacccttttcaggggggtgcattaggtctatggggatacgatcttggccgcaagattgaaaaattacctgccattgctgccaatgaactggattttccggatatggccgttgggatttacgactgggctctgatcatcgatcatcaccaacagaaagcaacattactgggttatcacaatctcgataatcgtctggcatggctagaatcgcagaaaaaaaaccgggaaacaaatttctccctgagcagtcaatggcaatctaatatgactgctcagcaataccacgaaaaaatcgcccagattcatcgctatctgcgtgatggagactgctatcaagtcaatctgtcgcagcgctttcatgccagctatcagggtgatgaatggcaggccttcacccaactcaatgatagtaaccgcgctcccttttctgcttttatccgtttgcctgaaaactgcattatcagcgtttcgcctgaacgttttttattactggaagataagaaaatccagacgcgtccaattaagggaacattaccacgattgcaagatccggaagaagatcatttacaagccaaaaaattggctaactcccgtaaagatcgcgctgaaaatctgatgattgttgacttattgagaaatgacatcggacgggttgcaacgccaggctcagtcaaagttcctgaattgtttgtcgttgaaccctttcccgctgtgcatcatctggtcagtaccattacagcgacattacctgatgaatatcatgccaccgatttactccgagcctgttttccaggtggttcaatcactggcgcacccaaaattcgtgctatggaaatcattgaagaattagaacctcatcgtcggcatggatattgcggtgccattggctacattagtttctgcggtacaatggacagcaatatcaccatacgtaccttactgacagaaaagggaaaaatttactgttgggctggaggtggtatcgtcgcagatagcattgctgaaaaagaatatcaggaaacatttgataaactggggcgcattttacctcaattaggagaactccatataccatga

SEQ ID NO: 972 - DNA, 189 bp, Xenorhabdus bovienii
  Coding sequence Name=Xb4151_4152.C421.gene84.dna; Position on contig =55622..55810bp; Strand=+
atggtcatgttttcaggtatgccggcattatcccatgaagaacagcaagttgcagtagaaaggatccatcagctaatttcagaaggtatgagcagtggagaagctattgctattgttgctcaagagctgagggagaaacatcagggcaaggagcagattcatattttatttgaggatgacgagaaataa

SEQ ID NO: 973 - DNA, 375 bp, Xenorhabdus bovienii
  Coding sequence Name=Xb4151_4152.C421.gene85.dna; Position on contig =55912..56286bp; Strand=+
atgaagtcaaaccaatttattcatcgtattggtttattgggaacaggcattctgctttccgtttcattgactattgcgtcagccgctgaaaatgatcacatggcgaagtttgtttcttgcaaaaacttaaccaaagaccaaatagcagcacaggtcaaacaagatttcttacaaaatcgtattcatcactgggataaggacaggaaacaattaggaacgtcaaagcccattgcatgggtaaatgtcaatgatatgactggcgatagaaatgcgttacaggttccgcttattgttcgtggctcccaaagagacaaaagttacaatgtcacaattgattgtcaaaaagatacaatcaattatagtgaggtaaagtaa

SEQ ID NO: 974 - DNA, 954 bp, Xenorhabdus bovienii
  Coding sequence Name=Xb4151_4152.C421.gene86.dna; Position on contig =56366..57319bp; Strand=+
atggcggaactacgaaaactctatccggcttatgacgcgtaccaaacgggatatctggatactggagatggacatcaggtttactgggaactgtgcggcaatccaaaaggtaaacctgcggtattcattcatggaggccctggtggagggagcgcaaattatcatcgacagttatttgaccctgagtgctaccatgtcatgttgtttgatcaacgtggttgtgggcgctccaaaccccatgccagtcttgaaaacaatacaacatggcacttgattgatgatattgagcgcctgcgtaatttgatgggagttgatagctggctggtttttggcggttcatggggaacaactttgtctctggcttatgctcagaaacatccgagttgtgtatcagagctggtgttaaggggtatttttctacttcgtacccaagaattgcattggtattatcaggacggtgcttcccgttttttcccagataaatgggaacgcatgatatctatcctttccgaggaagaacgtgaagatgtaatggacgcttaccgtaaacgtctgatgagtgatgatccggaagtacagttggaagctgcccgtttatggagcctttgggaaggtgagacagtaacattattgccttctgaaaatgtagattcattctcagaagataaatttgctctggcatttgctcgtattgaaaatcactacttcgttaataacggctttatggataatacacagcagttattagaccatattgatcttatcaggcatgttcctgcggcgatcattcatggacgttatgatatggtatgtcagttacagaatgcatgggatctggcaaaagcatggccggaagcggagttgcatattgtagaaggtgctggtcattcctttgacgaagcaggtattttacaccaattgatcaaggcgactgataagtttgctggaaaatag

SEQ ID NO: 975 - DNA, 231 bp, Xenorhabdus bovienii
  Coding sequence Name=Xb4151_4152.C421.gene87.dna; Position on contig =57368..57598bp; Strand=-
atggttcataacttagccaagttatctaaagatgaaatggataaggtcaatgttgatttagttgcatcaggagttgcatttaaagaacgctataacatgcctgtcattcctgacacagttgaacaatctcaaccacagcacttgagagaatatttccggcagagattaagtcattaccgcgagcaatcaaggtacttttcacgcttaccttatgaacccagaagtcgttag

SEQ ID NO: 976 - DNA, 504 bp, Xenorhabdus bovienii
  Coding sequence Name=Xb4151_4152.C421.gene88.dna; Position on contig =57932..58435bp; Strand=+
atgttaaaacaagaaatggttaagaaattaaatgagcaattaaatctggagttttattctgccaacctatatttgcaaatgagtgcatggtgtagtgacaaaggatatgaaggcgcggctgcatttttgagagcccattcacaggaagaaatgcagcacatgcagcgtctgtttgattatttgggtgacacgggagcaatgcctgttctcggtgctattcaggcccctccggttgaatttaactccatctctgatgtattcaatcagacctataaacatgaaaaattgatcacagaagagattaacaagctggctcatgtagcgatgatgacacaggattactctacttttaatttcctacagtggtacgttgctgaacaacatgaagaagaaaaactgttcaaatccattctggataaattgggtatggtaggtgaaagtggcaactcgctgttcttactggataaagatctgaaaggattgtctgtaccagcacatgcctga

SEQ ID NO: 977 - DNA, 156 bp, Xenorhabdus bovienii
  Coding sequence Name=Xb4151_4152.C421.gene89.dna; Position on contig =58491..58646bp; Strand=+
ttgtttttgtggcaggaattacggttcttttcatttttgtcctcatttttgcgtagtggttcacaggtcatgactttggccgcagattatcgcagattaaacctgttttttgatatagaatccctatttaggtatgaaaattcacctgtatattaa

SEQ ID NO: 978 - DNA, 423 bp, Xenorhabdus bovienii
  Coding sequence Name=Xb4151_4152.C421.gene90.dna; Position on contig =58624..59046bp; Strand=+
atgaaaattcacctgtatattaaagggttatctattatgtccattcttagtctccgttcattctgggctaaattatctgctctagtggttctatttgtcggaatgtcttgtcaacaggctttggctcatgcgtatttgaaagaccagacgccagcagaaaacacaaccgttgaagcaattccacaagctataactttgagcttttcagagcgtattgagcttgggtttagtaaagtaaaactgattggcccagaaaagaaaaccgtcaaaacgggtaagctagaacttgatcctgacactaagactaaattaattctgccagttgaagataaacttgtcgcgggagaatatagcgtcgactggagtgtgctctctgtcgatggacataaaacaaaaggcgcttataactttactgtaaaataa

SEQ ID NO: 979 - DNA, 945 bp, Xenorhabdus bovienii
  Coding sequence Name=Xb4151_4152.C421.gene91.dna; Position on contig =59046..59990bp; Strand=+
atgatttcgcttgaggcgttatacatactttgccgtttctttcattttgtggtagtcatgctgatgtttggcctcagtctgtttactgtcatgctcgcctcaggccgtttttcggtactgatgagagaacggttgagagtcggagtgtcaatcagcactgtgctggccttaataacttcaatagcctggtttatcatacagacaggattaatgggagatggctggcatgatgtttatcagttcgatatttggctagccgtgctgggaactgcttttggcaaagtgtggaaatggcagctgttggttgcagcacttgctgttgtgtgcttgttcttttttcatactaaaactagaaatttcttattgttggcctgctctgttattttgctgtcaagccatgctttcattggtcatgctgcaatgcatgaggggaatatcgggttgttacttcaggctaaccagattgttcatttactgagtgctggttattggtttggtggcctgtggccttttttactgtgtttgcaattcttgcggctgaagaatacattgtattttaacttatatcgcgatggtacatatagcggttatatagcagacaagctatctggtgaaagcgtagctgcaatgcggaaattttcgaattacgggcatcttgccgtttttatggtgatcaccacgggtattgtgagcagcatcattttaatcccagactggccagttttctgtaccaccatttctgagtatcaatcaatgctgtggttgaaaattgccttggttgctggcatggtgcttctggcgctgatcaatcgttatattttggtacccaggttaaatcagaaaagacgctatgaatggttgaccctgaatagctggttggagattattctgggaacatctgtactgttatgcatagccatctttgcaacggaaccccccgtatga

SEQ ID NO: 980 - DNA, 375 bp, Xenorhabdus bovienii
  Coding sequence Name=Xb4151_4152.C421.gene92.dna; Position on contig =60044..60418bp; Strand=+
atgtctatcagaggaatgataatgaaacgagtatattgggttttagcttttttgtttttctcttttcagggcattgccgcatcaatacaaactgtcagcaaattgcagtttgggaaacaatgggcctttaaccgtgaagaagttatgcttgattgccgctcagatggggcgctatttgtgattaatcccagtacattaatgcagtacccgttgaatgatcgtgcaacacagcttatggtatccaataaagtcattgctacatcgttaaataagatccttttagatgatcctgagcattccaatcaaaaaatgagtattgagccattccaaaaagcggcactagctttatgtgacaatacacgtgacaaaaaatga

SEQ ID NO: 981 - DNA, 231 bp, Xenorhabdus bovienii
  Coding sequence Name=Xb4151_4152.C421.gene93.dna; Position on contig =60532..60762bp; Strand=-
ttgcagtcagatccgtgtccttgttcatattattatgataaaacaccttatcaatatactgagggttgtttgatctccattctcttaatatatatcaggagaaaaaacaatttattgaaaaaatttccagcgctatatggtaagaaaataaaaaaaggccgagtatactcctctactcggcctatggaaaatggctctatcaaaaagccttgcgctaaaaactaccattga

SEQ ID NO: 982 - DNA, 498 bp, Xenorhabdus bovienii
  Coding sequence Name=Xb4151_4152.C421.gene94.dna; Position on contig =60996..61493bp; Strand=+
atggataagcataaattttatcaggagctatcagatagtttgatggctctattgtcaggtgaatatgatttaatcgcttctcttgccaatacaagtgcattattaagtgattatttggatgatgttaattgggtcggcttttatttggtggatggtaatactctagttttaggaccatttcaaggtaagatcgcttgtgtccgtattcctataggaaaaggggtatgtggaactgctgtggcaaaaaatagtattcagcgcatttctgatgtacatgcttttcccggtcatatagcttgtgatactgccagtaacgctgaaattgtccttcctttggaaattaatgggcaaattattggcgtattggatatcgacagcactgtttttgaacggtttgatgaaaatgatgaacagggcttgaaagcgcttgttatcaggctttgtaagcatttggggcaatgcgttgtgccaaaatatctacaacagaacgtaacttaa

SEQ ID NO: 983 - DNA, 102 bp, Xenorhabdus bovienii
  Coding sequence Name=Xb4151_4152.C421.gene95.dna; Position on contig =61528..61629bp; Strand=-
atgacttctttactactattcaacttaggttcagtttccatgaaatttcctgattacaacggttttgccaaccagcgcaggcatgaacaggcgacattataa

SEQ ID NO: 984 - DNA, 723 bp, Xenorhabdus bovienii
  Coding sequence Name=Xb4151_4152.C421.gene96.dna; Position on contig =61589..62311bp; Strand=+
atggaaactgaacctaagttgaatagtagtaaagaagtcattgctttcttggcggagcgctttccgctctgtttcgcagcagaaggtgaagcacgtcctctaaagatcgggatctttcaggatatcgttgaacgtattcagagtgaagaatgtttaagtaaaacacaacttcgttctgctttgcgcttgtatacatccagttggcgctacctttatggtgttaaagaaggtgcccagcgtgttgaccttgatggtaatgcgtgtggtgagctggaagtggagcacattgaacatgcgcgtcagcaactggcagaagcgaaagcgcgagtacaggctcaacgggctgaacaacgtgccaagaaacgtgaaaccgaaaacgcatccgacaaaaaaagtgaacatcctgtgaataaaaagacggcacctcgtcgtcaagcatcaggtgatggtgaaaaacgttcatctcgttcgcaaaatcgtctgcaacagtcacgtaaaccagcagataacgttacaagaaaaattgcacaaccaagaatttcacaacctgagttaacctcagtcacagacgtatcctctttgaaagtcgggcagacaatcaaagtaaatgtaggtaaaagtttaatggatgcttctgtactcgaaattgcaaaagatggtgtaagagtgcaattacctactggtctggcaatgattgtacgcgcagaacacttaaagttctga

SEQ ID NO: 985 - DNA, 2073 bp, Xenorhabdus bovienii
  Coding sequence Name=Xb4151_4152.C421.gene97.dna; Position on contig =62331..64403bp; Strand=+
atgaacaaactcattaatttggctttcgttttaggtctatcattttctggtatagggtatgcaaatactgctaatgtcatcggtagcagtaccgttaatgggaacaatgcgcctgttattgccctcagtcaattgccagatttaaaaccggaacaacaacattcaaccgtgagtaagcggattgtttctcgctttctgcgttctcactaccgccatttttatctggatgttgctttttcagggaaagtctttgatcgctacctgaacgcattagattatggccataatgtttttcttgcatcagatattgcacagtttgctgaacagaaagggcttttaggtaaagagcttgaaaatggtgatttaaggctgccttatgctctgtttaacttgatgcagaagcgccgtttcgaacgttatcaatatgttctttctcgcttggaacagcctgttaatttagatggcaatgatacgtttgaaaccgagcgtactaaggctccgtggccgaccagcgttgtggaattaaataaactctgggatgccaagattaaatctgattggataaatctcaaactgtctggtaaagatgataaagaaatcaaggaaatacttaccaaacgttatcgaactcatctaaaacgtcttaatcaaagtaagagtgaggacgtttttcaaattatcatgatggcttttgcgcgtgaaatagatcctcacactagctatctttcacctagcaatacagaacaattcaattcagaaatgagcctttctcttgaaggaattggcgctgtcttacaatatgatgatgaatatatcgctattcgttcactggttgggggaggccccgcagcgaaaagcaatttactgaaggatggggacaaaattattggggtcgggcaagccgggaagccaattgtagatgttgtcggatggcgtctggaagatgttgtgactctgataaaaggaccgaaaggaagtaaagttcgccttgaaatcatacccagcacgaaaggggctaaaaatcatatcgtcacgttaactcgtgagaatattcgccttgaagataatgcagttaagatgtcagtaaaaacggtaggaaaagaaaaaattggcgtccttgatataccgagtttctatgttggcctgactaacgatgtgaaaatacagctgcaaaaattgaccaaacagggcgtgtcctcaattgtaattgatttacggaccaatggtggtggagcgttaactgaagctgtatcgctgtctggtttgtttatttctactggtccgattgttcaaatccgggataataccggtagaataaaacaagactcggatactgatgaagcaatatattataaaggccctctagtcgttttagtggatggcaggagtgcttcagcatctgaaattttcgctgctgttatgcaagattacggccggggcttaattgttggtgatcctacttttggtaaaggcactgttcagaatcatcgttctctaaatcgtatttatgatcagatgttaaaacctgactggccagagattggttcagtgcaatatactgttcagaaattttaccgggtgaatggtggcagtactcagcttaaaggtgtaactcctgatatccttatgccaacagcggaagagcctgctgatataggtgaaagccaagaggacaatgcgttaccgtgggatagtattcagccggcatcttatcccttctcaaaggttatttcagcgtgggtgccgttactgactcaattgcataaccagcgtattgccaatgctcctgagtttaaatatatcaagcaagatattgcttattacaaattaataaaagctcgtaatggcgtttattctctgaattatgcgcagagagagaaagagaataaggagtatgaatcaatcaagttgaatcgtattaatgagcgatttaaacgagaggataaaaaaccactcaagtcacttgatgatttaccgaaagattacaaagggccagatccctacttagatgaatcggtacaaattgctctggatttggcacatcaaccagccgaaataactctgacgaagtga

SEQ ID NO: 986 - DNA, 123 bp, Xenorhabdus bovienii
  Coding sequence Name=Xb4151_4152.C421.gene98.dna; Position on contig =64406..64528bp; Strand=-
atggagattcattccatattattcaatttttttaagatgctaagcgatagaatcaacataactttacagtgtcacaaaaaaggccgactaccaagtcggccttttatctgtaacgaactttaa

SEQ ID NO: 987 - DNA, 885 bp, Xenorhabdus bovienii
  Coding sequence Name=Xb4151_4152.C421.gene99.dna; Position on contig =64584..65468bp; Strand=+
atgatgcgaatagccttgttccttctcactaacctcgcggtcatggtggtgtttgggataatactttcactcacaggagttcagcaaagtagtgtagctggtctcatgattatggctggtttgtttggttttggtggcgcgttcatttctctgttaatgtcgaaatggatggcattgcgtgctgttggtggtcaggtcattgaaaaaccttccaatgaaatggaattgtggttgatggaaactgttcgccgtcagtcagatcaggttagtattaccatgccacaggtagctatttacaatgctcctgatattaacgcatttgcgacaggcgcacgtcgtaacgcttcgttagttgctgtcagtactgggttgctgaataacatgagtcgtgatgaagcggaagctgttattgctcatgagatcagccatatcgctaatggtgacatggtaacgatgacgctgttgcaaggaattgtgaacacattcgttatttttatctcgcgtatcatcgcacaggcggcttcaagtttcctgtccagcaatgataatgagaatgaaagtagcagcaacggtaatccaattgtttatatggtgctttcgatggtactggagattgtattcggtattctggcaagcattattaccatgtggttctcccgttaccgtgaatttcacgccgatgcaggatcagcgaaactggttgggcgtgaaaaaatgattgctgcgttgcaacgtcttaaaaccagctatgagcctcaagaagagggtcgtatgatggcattctgtattaatggtaagtctaagagcttcagtgaattattcttatctcatcctccattagataagcgtattgaagcccttcgtagtggtgaatatataaagtaa

SEQ ID NO: 988 - DNA, 108 bp, Xenorhabdus bovienii
  Coding sequence Name=Xb4151_4152.C421.gene100.dna; Position on contig= 65489..65596bp; Strand=-
ttgcataatatcctcaaaaaactaaatttcgctcacaagagcaataaaaaagccggcattcatgatgaataccggcttttttcactgaatatttacttcagaccataa

SEQ ID NO: 989 - DNA, 1392 bp, Xenorhabdus bovienii
  Coding sequence Name=Xb4151_4152.C421.gene101.dna; Position on contig= 65690..67081bp; Strand=-
atgaatttaccactcgtcattaatgtgctggtttttgtagcactacttatagtattagcaaaagcgagctcaaataagtggagcctgtccaaaaaagttgttgttgccctaatcatgggtgttgtttttgggctggcattgaacgtcatttatggtgcacacaatatcattgtgaaagaatcaattaaatggttcaatatcgtcggcaatggctacgtgcagttactgcaaatggtcattatgccattagttttcgcttctattctgagtgcagtcgcacgtttacataaagcgtccgctttaggaaaaattagtttcctgacaattggaaccttgttgttcaccactgctatttcggctttaatcggcatcattatcgccaatgtgtttggtctgactgctgcaggattaattcaaggcacacaagaaacggcgcgcctgtctgctattgaaacaagttatatcggcaaagtttcagatctgggtgtaccacagcttatcctctcttttattcctaaaaatccatttgctgaccttactggagcaagccctacttcaattatcggtgttgtaatttttgccgtgtttctaggtatcgctgcattacaaatgcttaaagatgaccatgaacgtggtgagcgagctcttattgccattgataccctgcaagcatgggcaatgaaactcgtcaggctggttatgcgcctaacaccatacggcgttatggctctgatgactaaagtcgttgccagctccaacattcacgatattgcacaattgggcaattttgtcgttgcttcctatattgcccttgggttgatgtttgtcgtacatggaggacttttggcacttactggcatcaacccgatcaaattcttcaagaaagccggccctgctctgacgtttgcatttaccagccgttcaagtgctgccagtattccgttgaatgttgaaacacaaacacgtcgccttggtataccagaatccattgccagtttttctgcttcttttggtgcgactatcggtcaaaatggctgtgccggtatttatccagctatgttagcggtaatgattgccccaaccgtcggtattgaccctttcgatcccctgtggattgcgactctcgtcggtattgtgacgatcagctctgcaggtgtcgctggtgttggtggaggtgcaacattcgcagcactgattgttttacctgctatggggctacctgtgactttagtcgcactactgatttctgttgaacctattatcgatatgggccgcacagcattaaacgtcaatggtgcaatgacagctggtacaatcactagtcaattgatgggtacaactaacaaagaaatattagagcaagatgaaacggtaggattaagtcagtcctaa

SEQ ID NO: 990 - DNA, 162 bp, Xenorhabdus bovienii
  Coding sequence Name=Xb4151_4152.C421.gene102.dna; Position on contig= 67248..67409bp; Strand=-
atgaccccatttcctcaatggggtcaccctcaaaaacataaacaatgtttatttttttcacttttatcactatgtgtaaatccacaaattatatcaataatcagcaaatatcagacgaaaatcaaatataataatataagtatttataatcaattttactag

SEQ ID NO: 991 - DNA, 129 bp, Xenorhabdus bovienii
  Coding sequence Name=Xb4151_4152.C421.gene103.dna; Position on contig= 67371..67499bp; Strand=+
atgtttttgagggtgaccccattgaggaaatggggtcatgaactaataagactatatttaatccgctacttatatagactctgtaacttgtcaatttgcaacttatcgatttgtaatttatcaaaatag

SEQ ID NO: 992 - DNA, 582 bp, Xenorhabdus bovienii
  Coding sequence Name=Xb4151_4152.C421.gene104.dna; Position on contig= 67436..68017bp; Strand=-
atgacagcagaagggcatctccttttttcagttgccagcctcatattggctcaccagctagaaattacaccagaaatagcacagggagactggcttcatatgcttcccggagtgcttctggcctcattgttacctgatattgatcatcccagttcaacgttaggtagattatttcgttttatatcaattcctattgcccgactatgtgggcatcgtggatttactcacagcttactagccctgggagtaggaattattctcttccaggctgaaataccgtctgggtggcccattccaactgacttttttcatgcaatgattgtgggttatatcagccatctgattgctgatatgcttacacccgcaggcatcccactcttatggccactgaggatacgtttctgtatccctattcttagaggaaaggaacgcaaaaaagcggagcgatttattgctgtgctggtgctcgtcattgccattctccttccacatcaaattgatttttcgtttatccaccactattttgataaattacaaatcgataagttgcaaattgacaagttacagagtctatataagtag

SEQ ID NO: 993 - DNA, 117 bp, Xenorhabdus bovienii
  Coding sequence Name=Xb4151_4152.C421.gene105.dna; Position on contig= 68129..68245bp; Strand=-
gtgctgccattttttgatttgtattttccctacagggcagcgcaaatattcatcataatgtactttatcctagctgctctaggtaaaaatcaattaaatcttagtgttctatattaa

SEQ ID NO: 994 - DNA, 285 bp, Xenorhabdus bovienii
  Coding sequence Name=Xb4151_4152.C421.gene106.dna; Position on contig= 68236..68520bp; Strand=+
atggcagcacagagcaactatcaagtaatgttttctatggttaactcttccagtgaatttaacttaatatcagccagtgaccagcgggggtcatcaaaatggtggaaggccggaatcacaatagagcgcattcttgctgctttggttgctaccataccgttgaaaaaatcttccagtataaggcaattaatagggttaacctcaagttggatagtgatagtagcttcctttcccactgttccacaatctcccacttttctttcaggtagtcgcgaagggggttga

SEQ ID NO: 995 - DNA, 327 bp, Xenorhabdus bovienii
  Coding sequence Name=Xb4151_4152.C421.gene107.dna; Position on contig= 68497..68823bp; Strand=-
atgctcgaattgacgttgactaccgtcaggaagagtaattacaggcatttaaaatccttatctacagtggtgacccacacgaaagatcacttgcatgaaataaaatttgtttattttcaattcgttattagcaatctcttacttcactctgtaagttatgtacacaattcatcaaactacctatgtacattgctaaaactcaaaatccatattaacacacagagttactatctgactatgttgataaattatcaatcatctctccaccccacccatccgtttgccgactacattgatgagatatcaacccccttcgcgactacctga

SEQ ID NO: 996 - DNA, 1666 bp, Xenorhabdus bovienii
  Coding sequence Name=Xb4151_4152.C421.gene108.dna; Position on contig= 68776..70441bp; Strand=+
atgcctgtaattactcttcctgacggtagtcaacgtcaattcgagcatgctgtttctgtaatggatgtggctcgcgatatcggtgtgggcttggcaaaagcgtgtattgctggccgtgttaatggcgaattggtggatgcatgtgaattaattgaaaccgatgctaaccttgcaattattaccagcaaggatgaaaacggtctggaaattattcgccactcatgtgcacatttattaggtcatgcagttaagcagctatggcctgatacgaaaatggcaatcggtcctgtgattgacaatggtttctattacgatgttgatttggatcgttctttgacgcaggaagatatcgagttgcttgagaaacgcatgctggagcttgccaagacagattatgacgtcatcaagaaaaaagtcagttggcaggaagcgcgtgaagcattcgcagctcgtggcgaagaatacaagatccagattctggatgagaatatcagccgtgatgattatccgggtctgtatcaccatgaagaatatatggatatgtgccgtgggccacacgtccctaatatgcgtttctgccatcacttcaaattgcagaaaatagcgggcgcatactggcgtggcaatagcgacaacaaaatgttgcagcgtatttacggtactgcatgggcagacaaaaaacaactcaatgcctatttgcaacgcttagaagaagcttcaaaacgcgatcaccgtaaaatcggcaaacagcttgatctgtaccacatgcaggaagaagcgccgggcatggcattctggcataatgatggctggacaattttccgtgagctggaaacatttgcccgagttaagctgaaagagtaccattatcaggaagtgaaaggcccattcatgatggatcgtatcctgtgggaaaaaacaggtcactgggaaaactacaaagaacatatgttcaccacatcatcggaaaaccgtgaatactgcgtgaagccgatgaactgcccaggacatgtccagatttttaatcagggtctgaaatcttatcgtgacctgccgttgcgtatggctgaatttggtagctgtcatcgtaatgaaccgtcaggggcattgcatggattgatgcgtgtacgcggctttactcaggatgatgcacacatcttctgtactgaagaccaaattcatcaagaagttagcaattgcatcaaaatgatttatgacgtgtataatacatttggtttcgagaaggttgttgtcaaattatcgactcgtccagaaaaacgtattggcactgaaaaacagtgggatgaagcagaagctgatcttgctgaagcactgaaacaaagcggtattgaatttgaatatcagccgggtgaaggtgctttttatggccctaagatcgaatttactctatatgattgtttggatcgtgcgtggcaatgtggtactgtgcagctcgatttttcattgccagcgcgtttgaatgcgtcatatgtcggtgaaaataacgaacgtaaggttcctgtaatgatccaccgtgctgttctaggctctctggaacggttcattggtatcctgactgaagaatatgctgggttcttcccaacatggttggcacctcaacaggttgtcgtcatgaatattactgacggtcaggcaggttattaca

SEQ ID NO: 997 - DNA, 1647 bp, Xenorhabdus bovienii
  Coding sequence Name=Xb4151_4152.C422.gene1.dna; Position on contig =1435..3081bp; Strand=-
atgaaaaaaatcgtattgtcagcgatgctgctattttccacactctttcacaacttagcacaagcggatgccatttcaggcaaggtcgaagaacaacccttgaatattcaagctattgttatgtttctgttattcgttgggttcactctttgcattacttattgggcttcaaaacgaacgcaatcacgttcagattattataccgctggtggacgtattacagggtttcaaaacggaatggccatcgctggtgactatatgtcagccgcctcttttctgggaatttccgcgttagtctatacctctggttacgatggcctgatctattcaataggcttcctcgttggctggccaattattctattcctcatcgctgaacgtttgagaaatctagggcgttacacgtttgctgatgtcgcctcttatcgattgaaacagcgtcccattcgtactttgtcagcaataggctctttggttgtcgttgcactatatttgatcgctcaaatggttggggcaggaaaactcattgagctgctatttgggttgaattatcacattgcagttattttggtcggtattttgatggtgctgtatgtgctgtttggtggaatgctggcaacgacatgggttcaaattatcaaggcaatcctattactggcaggagcaacattcatggcgctgatggtcatgaaagctgtaaatttcaatttcaatactctgtttaaagaagctatagctgtgcattcccgtggtcaggcaatcatgagcccaggcggattggtgtctgatcctatatcagcactctctttaggactggcattgatgtttggcactgccggattgccacatattatcatgcgattttttaccgttagtgatgctaaagaagcccgtaaaagtgttttctatgccacagggtttatcggctatttttatatcctgacgtttatcattgggtttggtgcaatattattagtcagtcccaatcccgcgttcaaagatgcaactggggcattaattggtggaacgaatatgtccgctgttcatcttgccgatgccgttggcggtaacttcttccttggtttcatctctgccgtggcctttgccactattttagctgttgtggcagggttaactttagcaggtgcttcagcagtttctcatgatctctacgctaatgtaattaagcaaggtcaagccaatgagcgggatgaactgaaagtttctaagattaccgtcattattctcggttttgtcgccattggattgggtattctgtttgaaaaacaaaatattgccttcatggtgggtttggcattctcaattgccgcaagctgtaactttccgattattttattatcgatgtactggaacaagctgacaacgcgaggggcactcattggcgggtggttaggattaattagtgcggttgtattaatgatccttgggcctactatttgggtcaacatcctcggtcatgaaaagccaatttatccgtatgaataccctgcactgttttctatgtttgtagcattcatctgtacatggttattttccatcacagatggatcacaacaaggtcagcaggaaaggaaaatgtttcgcaatcagtttattcgttcacagactggaattggtatcgagtag

SEQ ID NO: 998 - DNA, 312 bp, Xenorhabdus bovienii
  Coding sequence Name=Xb4151_4152.C422.gene2.dna; Position on contig =3078..3389bp; Strand=-
atgaatcctgatatttatcaagagattgaaaataatccccgctttaaggaattggttcagaagcgtgggcgctttgcctggttgttatccgccatcatgttagtactttatgttggatttatttttcttatcgctttttcccctgagtggcttggtactcccctctatgaaggctccagcatgacgcgtggtattcctgtgggggttggcattatatttatttctttcatattgacagggatctatgttgtcagagcgaatggtgaatttgatcgtttgacttcgactatcctcaatgaggtaaaaaaatga

SEQ ID NO: 999 - DNA, 1956 bp, Xenorhabdus bovienii
  Coding sequence Name=Xb4151_4152.C422.gene3.dna; Position on contig =3559..5514bp; Strand=-
atgactcagataatcaagcatcttattcctgctgacattgcagaaacggccctgataagcaaacaacaatatctacaagattaccaatggtcactacaagatcctgaagcgttctggagtgagaaaggtaagatagtggattggattaaaccttatactcaggttaaaaacacctctttcgacccagggcatgtcagtatccgctggtttgaagatggcacactgaatttaagtgccaactgccttgaccgccatttgcaggaacgtggtgagcaaaccgctatcatctgggaaggagacaatcccgcagaatccaagcatgttacgtatcgcgagctatatcatgatgtctgccaattcgccaatgtattgaaaaaacttgatgtcaaaaaaggtgatgtcgttgcgatttatatgccaatggtacccgaagccgccgttgccatgctggcctgtacccgagttggtgcaatccattccgtgatttttggtggtttttctcctgatgccattgctggcagggttatcgattccaatgccaagctgattattaccgcagatgaagggatacgtgcaggccgcgttattccattgaaaaagaatgtcgatgaagcactgagtaatccagccgtaaccgacgttgttaatgtggtagtcttcaagcgtactggtaacaccaaaagctggcaggaaggtcgtgatttgtggtggcatgagttgatcgaaaatgtcagcacagattgccctgccgaagaaatgaatgccgaagatccacttttcatactttatacctctggctcaaccggcaaacctaaaggggttctacataccactggcggttatctggtctatgcttctttgactttcaaatacacgtttgattaccgccctggggagatctactggtgtacagccgatattggctgggtaaccggccacagctaccttctgtatgggcctctctcctgcggtgcaacatcattgatgtttgaaggtgtaccaaactaccccgatgtcaatcgcctctgtcagatcgttgataaacatcaggttaatattatctatactgcaccaaccgccattcgtgcattaatggctgaaggcgataaggcgattgaaggaaccaaacgtacgtcactacgtatcatgggctcggtaggtgagccaattaatcctgaagcatgggaatggtactaccggaagataggtaacagtaaatgtcctattgtcgatacttggtggcaaaccgaaacaggcgggttcatgatcacgcctttgcccggagcagtcgacctcaaaccaggttcggctactttgccattcttcggtatcagtccggcattggtgggcaactcaggtgagccattaactggcgaatgtgagggtaatcttgtcatcacggattcctggccgggacaagcgcgaactttatttggtgatcatgagcgttttgaacaaacctatttttccactttcaaaggtatgtatttcagcggagatggcgctcgacgtgatgaagacggctattactggatcactggccgtgtcgatgatgtcctgaatatttcaggtcatcggttgggaaccgcagaaattgagtctgcgctggtttcacatccaaaaattgccgaagctgctgttgttggcattccacaccatatcaaagggcaggcgatttatgcctatgtcacactgaatcatggtgaagaaccttccccggatctttataccgaagtcagaaattgggttcgcaaagaaatcggcccgattgcaacacccgatattcttcactggacggattctttgcccaaaacgcgttcagggaagatcatgcgccgtatcttgcgcaaaattgcttccggcgataccagtaacttaggtgatacctccacactagcagatccgggtgtcgttgaaaaactgctggaagaaaaacaatccatgaatatgacttaa

SEQ ID NO: 1000 - DNA, 180 bp, Xenorhabdus bovienii
  Coding sequence Name=Xb4151_4152.C422.gene4.dna; Position on contig =5719..5898bp; Strand=-
gtgaatagctcatgtcatatctccagtagtttagaatgtataaggctcacagcttgtgaacaacatagttattataatgacttaaacagcaatgaaaatgattatcaattccatattataactagggtttcctttccatttctcagtttcatttcttcattagatagaataactaaataa

SEQ ID NO: 1001 - DNA, 627 bp, Xenorhabdus bovienii
  Coding sequence Name=Xb4151_4152.C422.gene5.dna; Position on contig =5886..6512bp; Strand=+
atgagctattcactgcccgctctaccttactcttatgatgcgttggagcctcatttcgataagccgacgatggaaattcattataccaaacaccatcaaacctacgtgactaacacgaatacagcgttggaagctttccctgaattagctaaacttcatattgatgatctgatccagcagcttgataaaatccctgcggataagcgcacttttattcgcaataatgcgggcggtcactcaaaccatagtctgttctggaaaggattaaaattgggaacggtcttaggtggtgctttgaaaacggccattgagagggatttaggtagcattgagatctttaaggaaaaatttgagcaggcggctgcaacccgctttggctctggctgggcatggttggttctaaaagcagatggcaaacttgcggttgtttcaactgccaatcaggacagtccgttaatgggagaggaaattgccggtgcttcaggttacccgattctgggtctggatgtgtgggaacacgcttattacctgaaatatcaaaaccgccgtccagactatattaaggcgttttggcatgtagtggactgggatgaggcagcaaagcgttacgaagaaaaaattaagtaa

SEQ ID NO: 1002 - DNA, 1035 bp, Xenorhabdus bovienii
  Coding sequence Name=Xb4151_4152.C422.gene6.dna; Position on contig =6668..7702bp; Strand=-
atgaacgaacccactgtaatgaaaccaaactcccaaaaacctattgtattcagcggcgcacagccttccggtgaattgaccatcggtaactacatgggggcgttacgtcagtgggttaaaatgcaggatgagtatgattgcatctattgcatcgttaaccagcatgctattaccgtgcgccaagacccaaatgaattgaaaaaacgcacgcttgatacgcttgcactttacctcgcatgtggcattgaccccaagaaaagtacgatcttcgttcagtcacacgttccacagcattctcaattaagttgggtacttaactgttacacctattttggtgaactcggccgtatgacccagtttaaagataaatcagctcgtcatgcggaaaacatcaacgcagggttatttagttatccggttctgatggccgcagatattctgctttatcaagccaatcaaatccctgtgggaattgaccagaaacagcatcttgaattgagccgtgatctggcacagcgctttaatgctatttacggtgatattttcaccgtaccagaaccattcattccaacgggtggtgctaaagtgatgtctttgcaagatccagccaagaaaatgtcaaagtcggatgataactgtaataacgttattgccctgctggaagatccaaaatctgtcgcgaaaaaaatcaaacgtgcagttaccgattctgaagatccacctcgtgtacgctatgatctggaaaacaaaccgggtgtttccaacctgctggatattctttctggtgtcaccggcaaaaccattgctgaattggaagctgagtttgaaggaaaaatgtacggtcatttgaaaggcgctgtcgcagatgctgtatccgaaatgctaactgatttgcaagaacgttatcatcatttccgtaatgatgaagcattgctaaatcaaatcatggcagaaggggcagccaaggcacaagcccgtgctcaggcgactttggataaaatctacgatgcggtaggtttgctcgctcatccgtaa

SEQ ID NO: 1003 - DNA, 705 bp, Xenorhabdus bovienii
  Coding sequence Name=Xb4151_4152.C422.gene7.dna; Position on contig =7707..8411bp; Strand=-
atggtaacaagtattaagaaaaatcttcgtgccattgcatttgatctggatggaacattagtcgacagcgccagcggtctggcggaagcactggatcaggctctgattgccaaaggtttacctccggcaggcaaagaacgagttgctatctggataggtaacggcgcggatgtcatggttgaacgtgcactgaaatgggcaggcgtagaatccacccctgaattgcatcgtgaaacccgtaaactgtttgatgggttttatgaaacaaccgtgacaacaggcagccaactgtttccctatgtaaaagaaactctggcaacactggcacagcataatctgccaatggccatcgtaaccaataaacccacaccttttattgcgccattgctggaatcattggggatcagtgaatacttttcactggtgctgggtggtgatgatgttaaagagaaaaaaccccatcctgccccgctatatctaacaatgggcatgtttggcatccataaagaagaattgctttttgtcggtgattcccgtaatgatattttagcggcacaggcagctggctgcccttgtgttggcttaacctatggatataactacggagaatcgatagcattaagccacccagattatatattggaccatttcccggatttactaccggctatcggattatctacgttaaaacttcaggaagcgtaa

SEQ ID NO: 1004 - DNA, 675 bp, Xenorhabdus bovienii
  Coding sequence Name=Xb4151_4152.C422.gene8.dna; Position on contig =8411..9085bp; Strand=-
atgaagaaagattttctgattgccccatccattctatctgcagattttgcccgattaggtgaagataccgcaaaggttctggcagcaggcgctgatgttgtccactttgacgttatggataatcactatgtgccaaacctgaccattggaccaatggtctgtcaggcgctgtgtgattatggcattacggcaccgatagacgttcatctgatggtaaaacctgtagatcgcattatccctgattttgctaaagcaggtgcaacctacatcactttccaccccgaagcgagcgagcatgttgaccgtaccctgcaactcatcaaagaacatggctgtaaggcaggtctggttttcaacccagcaacccctctcagctaccttgattatgttctggataagctggacgtgattctgctgatgtccgttaacccgggtttcagtggtcagtccttcattccagaaaccctgaacaagctacgacaggtacgcaaaatcattgacgaaagcggatacgatattcgtcttgaagttgatggtggcatcaaggccaataatattagagaagccgctcaggcgggcgcagatatgtttgttgcaggttctgctattttcagccagcctgactataaaacggtcattgatgagatgcgccgtgaattatcaaaggtggcataa

SEQ ID NO: 1005 - DNA, 819 bp, Xenorhabdus bovienii
  Coding sequence Name=Xb4151_4152.C422.gene9.dna; Position on contig =9144..9962bp; Strand=-
atgaaaaaaaaacgcgctttcttaaaatgggccggtggaaaataccctttggtggatgacattagacgtcatctgccagagggagaacgcttaattgagccatttgttggcgcaggctcggtattcctgaataccgattatgattcttacatcttgtcagacataaatagtgatctgatcaacctgtatgacacggtaaaatctcgtccagaagaatttatcaatcatgcccgtccattattctctcaggagttcaacactgcggaagacttctatcgcctgagggaagagttcaacaaaagccaagaaccactgtaccgcagtctattgtttctttaccttaaccgacactgctataacggcctttgccgctataactctcgaggagaatttaacgtcccttttgggcgatataaaaaaccttattttcctgaagatgagctttactggttcgctgaaaaagcccaaaaagcctcttttgtctgccagcattaccaaatcacgttagacaacgctccacaaggatcagtaatttattgtgatcctccgtatgccccactttcggcaacggctaattttacggcctatcatacaaatagttttaacctcctcgatcaagaaaatctagcgaggatggcctatcatctttcctctcaacagggcattcctgtgctcatatccaaccatgacacgctaatgacgcgggaatggtatcatcaggctactcttcatattgttaaagcccgtcggacaataagtagaaatattcttgctcggagtaaagttgatgagcttttggcgttatactgccggaagtga

SEQ ID NO: 1006 - DNA, 966 bp, Xenorhabdus bovienii
  Coding sequence Name=Xb4151_4152.C422.gene10.dna; Position on contig =10048..11013bp; Strand=-
atggacgaattaaaatcagaaaacaaacaaaaaacagaaaacgaatttaaacccgatacatccgatcgccaccctccgcgatcgcgcagccaatccaaccagcccaagctggcagtatcccgccagcaattaatgattggggttggaattctggtgcttttactgctgattattgctatcagttctgcattgaaatcgccaactgagcatgagaaacagcaatcccagaatacggctgagaaaaacatcgatctatccggctcttcttcactctctaccaataatcagaatagctcgccggaaaatccattggcatcagcaatcaatggctcacaagaaatcagtatgccacccattagcaatacaccaagcaaagatctttctccagcacctgaggcaagtaaccacaaccagcgcatagaattgcccggtgatatttctgatgccttgaatcaacagcaaggtaacatcaataatacggtgcaaaaaaacctgacgccatcacagtccaacccgatgcaacagacggtgataccgccagttgaacagaataagactgaaaaagttgcaccgccgaaaatagaaaaaacggaaaaagtggcaaaatcagaaaagcatgccaaatcaactgataaaccagcaatattccaccatcaggccagtaaaaagagtgtgactgatactcgcggtgatttactgaaagcctccgccaacagattcacactccagttgagtagcgccagccgctcggataccttaattgccttcgcaaagaacaataacctgtcaaactatacggtttatgaagctaaacgtgaaggtaaggcatggtttatcttgatccacggcagttatggttcggtttctgacgccaaaagtgccatttcctcactcccggctgaagttcaggccaaaaaaccttgggttagaaaactacaacaggttcagcaagatctgaaaaaataa

SEQ ID NO: 1007 - DNA, 1098 bp, Xenorhabdus bovienii
  Coding sequence Name=Xb4151_4152.C422.gene11.dna; Position on contig =11201..12298bp; Strand=-
atggaacaagtaactgttacgttaggtgaaagaagctatccgattgccatagcccaagggctattttctagcgatgaggcattcaagtccctgcaagctggtcagcaggtcatgatagtgaccaacgagacgctggctcccctgtatcttgaacaggtgaaatccacattgcaggggatgggccttcgggtagacgaagttatcttacctgacggtgaacagtacaaatcactttttgtggtcaatgacattttttccgctttactggaaaataatcatggtcgtgacacaacgcttatcgctctcggtggtggtgtaatcggtgatatgacagggtttgccgccgcttgctatcaacgcggcattcgcttcatccaaatacccaccacattactttctcaggttgactcttccgtcggtggaaaaaccggcgtcaaccatcccctcggcaaaaacatgataggggccttttatcagccagcatccgttattattgatatcaattgcctgaaaacattacctgctcaagaactgcatgcaggactggctgaagttatcaaatacggcatcattctggatggtgaattttttaactggctcgaaagcaatatcgaacaattactggctctcgataatcaggtaatagcttattgcattcgtcgctgctgtgaactcaaggcatgggttgtcgctgctgatgaacaagaacgcaatgggatgcgggcactattaaatctcggccatacctttgggcatgctattgaagctgaaatgggttatggtgtctggctgcatggtcaggcggttgctgcgggtatggtgatggcagcacggacatctgaacttatgggcacgttctcaaaacaggatactcagcgcattatcagtttgctggaacgggcaaaacttccagtcaacggcccagtggaaatgtctccagaaatctatttgccacatatgatgcgcgataaaaaagtctctgcgggaaaattgcatctggtactgcctacagcgattgggaaagcagagcttcgttctgatatcgggtctgatgttatattggacgccatccacctatgcctgccatcgaccagctaa

SEQ ID NO: 1008 - DNA, 522 bp, Xenorhabdus bovienii
  Coding sequence Name=Xb4151_4152.C422.gene12.dna; Position on contig =12344..12865bp; Strand=-
atggcagagaaacgcaatatctttctggttgggcctatgggtgccggcaaaagcactattggtcgtcagttagctcagcaactcaatatggagttttacgactctgatcaagaaattgagcgacgtaccggagctgacgtgggctgggtatttgatgtggaaggcgaagaaggcttccgcgatcgtgaagaaaaaataattaacgaattgactgaaaaacaaggcatcgtactggcaacgggtgggggttctgttaaatcaaaagaaacccgtaatcgtctgtctgcccgtggtgtggttgtctatttagaaacaaccatcgaaaaacagttagctcgtactcagcgtgataaaaaacgtcctttacttcaagtggatgcaccagcacgcgaagttttagaaaatttagctgatgagcgcaaccctctctacgaggaaattgctgatctgactatccgtacagatgagcaaagcgccaaagttgttgctaaccaaatcatcgaattactggaaaaaaactga

SEQ ID NO: 1009 - DNA, 252 bp, Xenorhabdus bovienii
  Coding sequence Name=Xb4151_4152.C422.gene13.dna; Position on contig =12970..13221bp; Strand=+
atgggaaaattatctcagtacatcaacctgtattgcaactatatatatctggcacgaaccgttgtagtctggtttatgctttgttggctgactgtgagcctactttatgtttattggggtagactcttacttgtgatgttagacccgctcactcaattagataatccttgtatgctaaattactcccagcgtcaaatccataaacaggtcagaccaagaaaaatagtagaaaatctggttaaaaagacgtaa

SEQ ID NO: 1010 - DNA, 1086 bp, Xenorhabdus bovienii
  Coding sequence Name=Xb4151_4152.C422.gene14.dna; Position on contig =13269..14354bp; Strand=-
atgaacagtcatttttttattttgctggcttgcctgtttctgttactgccaatcctcgcttctgccgaagaaattaacacatggaaagaaacagagagcgaaaaagcggtgagaaatccgttccagccaccaaaaaacgaattagatgaacaactcgaatttttcccagcagaaagagatgaacaggagcaagagattgaatatcagtcgattactctgcaatacgctgacgcagggcagatcgccgaacaattacagaaaaatactccggctctactgacaaaatggggaaaagttgaacacgataccatgaccaacagcctgatactggaagataagtttgatgccattacccgcatcaaaggttggctgaaagaagtggatacgccacaacaacaagtacaaattacggctcatattgttaccagcagcagagaggctctgcatgagttgggaattcactggggcatggctgctgatccactaaatcgctcaataggcctcaaccgtttgaatttgcatcaatccgcaggtaatcaaagccaccgactggtactgaacactgcccgcatccatgcaagcctgctggaaatggagctcagtgcactggagcaggaaaaccaactggatatcattgccagcccaaggctgacagcctcacaccaacagccagccagcattaagcaaggttctgatatcccttatctcgttcaggacaaggacaaaacgacgattcaatttaaggaggcggtattaggtatggaagtgactccacacatattgagaaaagggaaaatccgtttagcgctaaaaatcagccagaatgctcctggactgcccattagtcagggaggaaatgaaaatctggcgatagataaacaggaaatcgtgacacaggttaccgtcagaaacggggaaaccctgattcttggtggcatttttcagcagaaaaaaggcgctagcctgcaaaaagtcccttacttgtctgatcttccactattgggtgcattatttaaccaaaaaggagaacagcacagccgaagggaactcgtaatttttatcacacctcaactgaccgatatttga

SEQ ID NO: 1011 - DNA, 552 bp, Xenorhabdus bovienii
  Coding sequence Name=Xb4151_4152.C422.gene15.dna; Position on contig =14357..14908bp; Strand=-
atgaaaagtaattatcttgtgtggtttcatcgtccagcatggcagttgtttctgttgcagcaattgccagttattccactcatattgggtttctatttttgggtctggcaggagaatgagtacgcaatccatgacctccagctcaatctcacagagcagaaacacaattcggcgttatccgaaaaacgtatcgccgagttacccaatttacccgatatccgacagcagattcagcaattgacggcagaactcagccaaggcaataatattttgcccaacaatatcccgcaaaaaaatgccaccgtactcaaacgccttcatcagcccttaaccagctctggcagtcagctcatggagtggaaaagccatagggaaggcaaccagattttctggcacatcatgctgtcactgagctatgaccaactcctccatttcctcaatgaaatccaacaagtacaacctgttttgctgatcaaacacctcaccatcatccctgtcgataacgatctgactgtccgcatggtgctgtcagatgtcctccatgagggataa

SEQ ID NO: 1012 - DNA, 366 bp, Xenorhabdus bovienii
  Coding sequence Name=Xb4151_4152.C422.gene16.dna; Position on contig =14898..15263bp; Strand=-
atgcagttacagcaaaatatccaagaaagcgaacacgctattcaacatcatcagcaattgacacaacaattaaggaaaaaacagacattcatggaacagaaccaaagatatttacagttatttcgtcaactccctcatttgttgccggaaaaaagctggcttactgcattcagtgacgacaccggccaattggtttttgccgccagcagtcaaaactacgatgatgtctcggacttactggataacctgaccgacaatgcctcactgaacaatgtccaactgaaaaaaatgagcaccacggaagaacatctcaagatatttactatcgatgccaattggttaatgggagcacctgatgaaaagtaa

SEQ ID NO: 1013 - DNA, 828 bp, Xenorhabdus bovienii
  Coding sequence Name=Xb4151_4152.C422.gene17.dna; Position on contig =15446..16273bp; Strand=-
atgtatttatcaaaatggtatatcggactggatgtccatgaacattacattaatgctttcgcagccattaaacgccgtgatggctggcaacttcgccattgctggcaatatcgtttatcaagcgacattatttcaggaggacggctacaacatcctgaaaaattaggccacattttaatgcaatggcggcgaaaattacctaaaaagattagcttacgattaacattacctgttcaacaaaccttacagaagcagatcgccctacctacccatactctattgcaagagccagaactcggctggtttgttcatgccaatgccgaaaaacaattccctgtcagtgatcttgcgttggattatcgagtacgaggtcagcaaatttgtatcagtgccacccggcaaaaagatctcaacctctggcttaagctgctcgcagacatcgatttatcccccgatgccattgatatttctccctgcgcattgcgctatattgccaaactcgcgggcgttcccgatgacggctggttgatccacaaacgcataacagactggctatgggttacccccgccagtagcccttttggttatgggttgatatcaatacagacacatccgcatctggcacaaatcatcagccagttacctgttttatcagacatggccagccctgagatttattacagtgacgaacagcatgctatacccgcagaacccgttcatgtctggcacatgcagaccgcatttcgccattaccagctcccattacccgaaaaaacagatgccttcattatcgctgcggggctggcactgaggccggatgatcaatga

SEQ ID NO: 1014 - DNA, 2508 bp, Xenorhabdus bovienii
  Coding sequence Name=Xb4151_4152.C422.gene18.dna; Position on contig =16412..18919bp; Strand=+
ttgatccttgtcgttgtttgcattttattgggaaccgcctcgatttttggtttgtacaaatatatcgagccgcagttaccagatgtcgcgactttaaaggatgtccgattgcagacaccaatgcaggtgtacagtgctgatggcgagttgatggcgcaatatggtgaaaaacgtcgtctgccgctaaccctttccgaaatgccgcctttgatggtaaaagcctttattgccactgaggacagccgtttttatgaacaccatggtgttgatcccattggcgttatccgtgcggtttcggtcatgatgacttctggtcacgcttcccaaggggcgagtaccattactcaacagttggcgagaaactttttcctcagcagagagaagacgctgatacgtaaggcgaaagaagcgtttctggcgattaagatcgaacaactgctgacgaaggatgaaattctggagctatacctcaacaaaatttaccttggtaatcgtgcttacggtgtaggggctgcggctaacgtctattttggtaagaatgccaatgagttgactttgagtgagatggcgatgattgccggactgccgaaagcaccttctactttaaacccgctctattcttatgatcgtgcagtcagccgtcgtaatgtggtgttggtgcgcatgctggaagaagggtacattacccagcagcagtacaatgaagccagaagtgagaaattggttgcccgttatcattcaccacagattgtcttctctgcgccttatctgactgaaatggtacggcaggaaatgattaaccgttatggtgaaaatgcctataccgatggatataaggtctataccaccattactcgtaaagtccaattggctgccgttgatgccgtccgtgcaaatgtaattgattatgatatgcgtcatggctatcgcggtgcacaggaagtgttatggactgtcagccagtcagcatggagccagagccaaattgttgataagctgaaaactctgtccaaatatggctcattgctgcctgcggtggtcacgaagtccagtgcgactcaggctgaagctatgctggtggatggcaataaagttgaactgactatggcgggcgttcgttgggcgcgtcaatttaaatctgacagtctgcaaggagcggcaccacgcagtgtcaatgaagtgattcgagccggtgaacaggtttgggtcagaaaagtcaatgatatctggtggctggcacaattacctcaagttaacgcggcgttggtatctctcaacccgatgaatggtgaggtagaagcgctggtcggtgggtttgatttcgagctaagcaagtttaaccgcgtgacccaatctctgcgtcaggtgggttctaacatcaagccattcctgtataccgctgcaatggacaaagggctgacgttggcatctatgtttaatgacgtgcctatcagccgttgggatgcgggagctggaacggattggcgtcctaaaaactcaccgccgtcttacgatggaccgattcgtctgcgtcaaggattggggcaatccaagaacgtggtcatggttcgagccatgcgtgcgatgggggtggattatgccgctgactatctgcgccggtttggcttgccgggggaaaatgtcgtgcggacggaatcgatggcgctgggttctccttctttcacaccaatgcaaatggtgcgtggctatgcagtgatggcgaatggcggttatttggttgatccttacttcatcactaaaattgaaaatgatgaaggaaaggtattgtttgaagctaaaccgaaactagcctgcccacagtgtgaaaatattccggtgatttatggtgatacagcgcattccattgagttgtccgaagattcgattgagaacgtgacccattccaatgttacgcaaaattcgactcagccacagtcagagttagagcgtgctccggttaatgtgaacaacgatgatcagcagtacgcgcctcatgtcatcagtacgccgctggcgttcctgattcatgatgccttgaataccaatgtctttggtgaaccgggttggatggcgacaggctggcgttcagcccgtgatttgaaacgccgggatatcgggggcaaaacaggaacgacaaacagctcgaaagatgcgtggttctctggttatggccctgatatggttgccacggtctggattggtttcgatgagcatagtagatctctggggcgtacacccgccctgaaaggtgaaggcggagcgaaaagtgctcaacctatttggaatgatttcatgaaagtggcgctggaaggtgtaccggtaaaagtgatggaaccaccagcaggcatcgtttctgttaccattgatcgtgcgacgggtaagctatccaatggtgggggcaatacccgtaaggaatatttcattgaaggtacacaaccaacggaatatgccgtcccagaagcaggaacgacagtcactgagaatggagagagtcaggaactgttctga

SEQ ID NO: 1015 - DNA, 1050 bp, Xenorhabdus bovienii; identical to SEQ ID NO: 483
  Coding sequence Name=Xb4151_4152.C422.gene19.dna; Position on contig =19254..20303bp; Strand=+

SEQ ID NO: 1016 - DNA, 1677 bp, Xenorhabdus bovienii
  Coding sequence Name=Xb4151_4152.C422.gene20.dna; Position on contig =20593..22269bp; Strand=+
atgagtaatttacccgtaattgttggtttgggtggtatcaatgcggccggaagaagttctggattccacagctataaacgcattgtgtcagacagtctcagcgacgagatcatgcaagatacatggctcgatttatgtcatcgaatgggcattgttaaaaatacagtatcggttacagatgcccatatcgagagtgccaaaaacggcacactgatcagaaaaataacgcacttcgatacgcaaaaagtatcttctgtaaccagtgcgggtcagttgccggaaggatttgaagttggtgatttatataacgcaaaccatcatccgcgcggtttacgtctgacagtctatggagcctcggatttactcagttcaattggcatttcatggccagatatcgccaaattggtggaacccgatcaaatttctgtttatgccagtagcgctctgggtcagatagaccgattttcattggcaggtttaattggcaacccacagaatggcacacgtattagttccaaaatgctagcgctttcccttgctgacatgccggcaaattttattaatagctatattatcaatagtatcggcaacacatcagctaatctaggtgcctgtgcaagctttctgtataacctcaaacagggcgtcaatgatatcaaacaaggtaaggcaaagatcagtttagtcggatgctctgaagcagctatcgtccctgaaattatcgaagggtttcgagttatgggcgctctcgcagaagaccatcaactatgtaaactggatggaaccgatattgttaacaaccgccgtgctacccgaccattttcaactaatgttggatttaccattgccgaatctgcgcaattcgtattactcatgagtgacgatcttgctttacagtgtggtgccaacatccttggcgctgtgcctgatgttttcgtcaatgcggatgccaataaaaaatcaatatcctcacccggaattggtaactacattaccatgatgaaagcagcctccctagctgaccatctactggatggcaaattacagtattcttacgttcaggcacatggtactggaacaccacagaaccgagtcactgaaagtcatatcattaatgaagttgccaaagtttttggactcaaatgctgggatgtcaccgccataaaatcgtatgtaggacattccatcgccgcctctgcgggcgatcaattagcctgtacattgggggtttggcagtacggatggatccctggtattaaaaccatcgatcacattgccgaggatgtacatgcaacaaatctgaatattttgatgcagaataagtttgcaggcgagcacggtgaggagatgcgtgccacaatcatcaataccaaaggattcggtggcaataacgccagtgcagttattttatctccacagcaaaccatgcagatgctgaacaaaaaacacggtagctccgctgtctacacatatcatcagcgtaatcaaattgttaaacgtataagtgaagatcaggatcgagcaatttgtcgtggtgaagaatcggttgtttacaatttcggcaacgcagtgatgcaatcatcagatataaaactttcacgtcaggaagtgaaattatcaggatataatcacaccataaagttgccgaatgcagaggaattcagtgcattcttgtga

SEQ ID NO: 1017 - DNA, 165 bp, Xenorhabdus bovienii
  Coding sequence Name=Xb4151_4152.C422.gene21.dna; Position on contig =22381..22545bp; Strand=+
gtgttacagcaaattgccgctattcgtggtgccgtcaatggactaatggcgggtgtccttgaaagccatttacgtgaagaactgacaaataccgagcaaacaccagaagcacagaaagcctcgatcgaagatgccgtttctctgatccgaacttatcttcgctga

SEQ ID NO: 1018 - DNA, 1110 bp, Xenorhabdus bovienii
  Coding sequence Name=Xb4151_4152.C422.gene22.dna; Position on contig =22613..23722bp; Strand=+
atgaaatcacgagccgctgttgcattcgggccgggccagccccttgaaattgttgaaattgatgttgcaccgcctcaggccggagaggttctggttaaaatcagccataccggtgtgtgtcatacagatgccttcaccctgtcaggggatgatccggaaggcgtatttcccgtcatactcgggcatgaaggcgcaggcgtagtcgttgaggtgggcgcaggcgttaccagcgtcaaacccggtgatcatgttatccctctttataccgcagaatgtggagagtgcctgttctgcaaatccgggaaaaccaacctgtgtgtcgccgtgcgggcaactcagggaaaaggtgtcatgccggatggcacaactcgtttttcctataatggacagcctatttatcattatatgggatgctccacattcagcgaatacaccgttgtcgccgaagtctcactggcaaaaatcaatccggaagccaaccatgaagaaatatgcctgctgggttgtggtgtcactaccggcattggcgctgtgcacaatactgcgaaagtgcaatctggtgactctgttgctgtctttgggctcggcggtattggccttgccgtgatccaaggtgctcgtcaggcaaaagcaggcagaatatttgctattgataccaatccggcaaaatttgaactggccaaacagttcggtgcaaccgactgcctgaacccgaatgattacgataaacctattcagcaggtcattatcgaaatgacagaatggggggtggatcataccttcgagtgtattggtaatgtcaatgtcatgcgtgccgcactcgaaagtgcgcaccggggctgggggcaatctgtcattattggtgtagcgggtgccggacaggaaatctccacccggccattccaactggtcaccggccgttcatggcgcggaactgcttttggcggagtcaaaggccgcagtcagttgcctaaaatggtggaagaggcaatgaaaggtgaaattgagttaaaaccttttgtgacccacaccttaccacttgagcgcatcaatgaagcattcaacctgatgcatgagggaaaatccattcgtaccgtcattcattactaa

SEQ ID NO: 1019 - DNA, 867 bp, Xenorhabdus bovienii
  Coding sequence Name=Xb4151_4152.C422.gene23.dna; Position on contig =23771..24637bp; Strand=+
atgttttacagagaggaaaaaatggagaggattgaacgccgcgcttgttttgggggatggcaggatgtttatcagcacgattcgaccgagcttggctgtaccatgagttttgctgtctatcttcctcctcaggctgaacatcagaaattaccggtgctgtactggctctcggggctaacatgcaatgaacagaatttcatcactaaagcgggcgctcaacgctatgctgccgaacagggtattatccttgtcgctccagataccagcccgcgtggtgagaacgttgcggatgatgatgcttatgatttgggtcagggagccgctttctatctcaatgcaacacaagaaccttgggcaccgcactatcgcatgtacgattatgtggtgtcagagttaccggcattgatcgaagcacattttccagtaacagaggatcgcgctattagcggccactctatgggaggtcatggcgcactgacaatcgcgctacgcaatccggatcgttatcacagtgtatcggcattctcgcccattgttgccccctctcaagttccctggggagagaaagcttttcgtgcttatctgggtgatgatcgtgacacatggaaagcctatgataccatcaggttgatcgccaatagtgctaaacccttacatttgttgattgatatcggtaatgatgatccgtttcttgcagaacagttacgccctgaattgctgaaagaggcatgcgaaaaggccggacagccttatacactgaatcttcgcacgggttatgatcatagctactactttgtcgccagttttatcggtgagcatatcgcatatcatgctgaggtattgaagggctgctgtgctgataattga

SEQ ID NO: 1020 - DNA, 981 bp, Xenorhabdus bovienii
  Coding sequence Name=Xb4151_4152.C422.gene24.dna; Position on contig =24702..25682bp; Strand=-
atgacaagagtagcgattgcatcgttaggaatttggcatcctccaacttcggttaataataattggtttatagaacactatgccgcccaaggcattgatatgagtggtttgctgaatgcgcttggccataaaaatcgttacctgatccgtgattcatctgatacaacactcacgatgtcagttgcagcatctaataatgctattcagcggctgggatgtcaggctaaggatctagacttcatcgtgtttgcttctcaaacgccagaatatctcattccttcaacggcgctcaaaatacatcatgctattggaggcggagaaagggctttggcatttgacatgaatgccaattgtgcggggttattagttgcggtagaaatggtttccagggcgatgatggcaagtccgtcatgccagcttgcactggttgtaggcagcgactatcttggggctcacagcagtaatgcaccggtctaccactcatgttttgcagagtcggctgtagcggtaatccttcataaaactgaacagggcaatggttttatagactcagaatttcgtatacaaacctcagtaatcgataattcacttttccctgcatgtggattatcaaatattcaccggcatgatgtttctgcacaagtcaaattcaccccctttgatgatgatatctgtattaccgccgcattcgaatctatccaattgttactttcacgacataatttagttcctgctgatattaagggatttatgttttcacaattttctgtaagtaacattcgacgactctgtgaagaacttggtgtggatcaggataaggcattatttattggtgatgagtatggttacactgcaaccaatagcccatttgttgcactttatgaaacgctggaaagaaaaaaaattgtccggggtgatttcctgattttctggacgattggtgctggctggcaaagtatcgctgtattaatgcaatattaa

SEQ ID NO: 1021 - DNA, 1032 bp, Xenorhabdus bovienii
  Coding sequence Name=Xb4151_4152.C422.gene25.dna; Position on contig =25997..27028bp; Strand=-
atggaaaataacatctcaattatttcggcggcaggtatcctgccaccgggaaacattattattcacccagaagataacatacgtaatgaattcagcgcacccggtgaagtgcagttatctcgatcacgcactttatggcgtttagagcataaaaaagatttaattgaattaatgaaagtcagtttgttagcagcagtaaaacaggtacagatggatatttcagatattgattatctgattcttagccaagtatggtctgataacattttgggcgatgaggccggacgactggccagagaactaaagctatcctgtccggtggtgtcaattaatgtcggaacaagtggtggtgcaactggactggaaatcgccactgctatgtttgctaactctgaatttcataacatcgctgttattgcggggtgtaattattcgcattggttctcaatgagcgatcccgcgaggactttgttaagtgatggtgctgcatgcttagtacttagccgaaaacaaggtatgacagtgacgggttgtcatactttgagtactgcacattacgatgtattgaaatttaatgaaggacctgaacgttatgtctactataaaccgaaggggggtgaatatatatttaataatatgaaggagacgatttaccagtgctgtaataaagtgtgtcaatcaaacggaatgagtctaaatgaggtcagcgctttttacgtttatgacccgagcgattgggttgccagtgcagctgcagaagcgttgggcgtagggaaagataaaattatctctatttttcacaaatatggaagtttggggccagcacagagctttttcggttttatggaaatgcaggataataaaaatttgactgactctgattgggtcattgttatgggattgggcccttcgaccactgcgactgctgttctatttcgatggcagaatattccttgcaatgtatattattatgatcataagacacagctaagtaatccaatgttacctagtggtgtgactcaaaatatttaa

SEQ ID NO: 1022 - DNA, 1698 bp, Xenorhabdus bovienii
  Coding sequence Name=Xb4151_4152.C422.gene26.dna; Position on contig =27018..28715bp; Strand=-
atgtcagttaatattgcgaaagctttagttaaattgcttgaggattgtgaggttaaagcggcatttggggtttccggggggtttattgcacctatatggcaggaattaacggaatcagaaaaaataaaactatttcactgtagacatgagtcgggaggagccttttctgcatctgaattcagtttatgtcatcaggttccagccgtcgcttttgctacagcgggtccgggaataagtaatgcattaactgggttaagagcagcaaagttagatggtgcaaaggtcatttttatctcatcaatcacatctgttgcctcttcaggaaagtggagcctacaggaaactacagtacaagatatagatggactgtgtatccctgatggacacggttattttgatgaaatcatcatcataaaccaaaaggatgattacgctcacgtcgagagcaaattaaggaaaggattaaataagaaagacggttacgtggttggtatatttttgacaacaaaagtgcagcaggaaatcatcgattatgaaaatgatgaggcgctttccttatctcatgatgatttagacgaaaatgcgaaacgtcattcacgggaaatagccgatttgctcgtcaatgaaaatgctgttttttgggcaggatttggtgctcggcatgcttctgcattgttgacacagattgctataaaaacaaattcacgggtcatatctactccgcgggggaaagggatctttgatgaaaaacatagtctttatgccggaaccagtggtttaggatcggattcagaaagtattaataaaacattacattgtccgttattgtcagctgttatcattatgggaagcagattgggtgagctgagttcatcctatgcccaaaataaccttaagaaggttaaagtttattatataggtctaaatgcacaggaaattaaagggaatctgccctcgcatactgttctcattgacagcgatattgaaacatttctcacttctattgatacctgcttggctgagaaagtaataccttccagtcacattaaggccatttcagcaccacatgacagtcataaatgctattcagatgcagcaaaagatgtgatccacccgcttgatgtgatgagtgtggttcaggaaatagctatcgatatgttcgattgttatgttgcttcagaagcgggaaattcctttgtctggactaatcgctacctgaagttttcgaatccattgagatatcgtgtaagtacagcttatggcgccatggggcactacgcttgtggattggtaggaatggctgcatcaaaagagcgctgtgcagtaggtatcataggtgatggcgcaatgctgatgtcgaatgaagtaagtacggcagtcagattcggattacctgctatctggcttgtgatgaatgattccggttacaatatgtgcagacaggggcaggagctattaggttatccgccacttgactgcagtatacctcaagttgactttgctgtatttggacagtctattggagcgacaggttataacgtaaggaataaaaaagaattacgtgaagcccttattcatgcaattgaagaaaagaaacctgccgtaattaatgcatttattgataaatatgagatccctcctctcggtgatagagttgaaactttcaggaaattaaaggaagagctggatggaaaataa

SEQ ID NO: 1023 - DNA, 528 bp, Xenorhabdus bovienii
  Coding sequence Name=Xb4151_4152.C422.gene27.dna; Position on contig =29469..29996bp; Strand=-
atggccagcagaggcgtaaacaaagttattttagtgggtaatttggggcaggacccggaagttcgctatatgccgaatggcggtgcagtcgccaacattactctagcaacgtctgaaagctggcgtgacaagcaaaccggtgagatgagagaaaaaaccgagtggcaccgagtggtgatcttcggcaaactggcagaagtcgcaggtgaatatctgcgcaaaggctctcaggtttatatcgaaggctctttgcagactcgcaaatggcaggatcagggcggtcaagaacgttacactactgaagttgtggtaaatattggtggatcaatgcagatgctgggtggtcgcggcggcgcgtcgcaggatgcaccagcacaaggcggtaattgggggcagcctcagcagccacaagcttctcagcaattcagtggtggtggtcagcagccatctccatctcgtccggcacagtctccagctccacagagcaacgagccgccaatggactttgatgatgatattcctttttga

SEQ ID NO: 1024 - DNA, 2832 bp, Xenorhabdus bovienii
  Coding sequence Name=Xb4151_4152.C422.gene28.dna; Position on contig =30247..33078bp; Strand=+
atggataacatcgaagttcggggcgcccgcacccataatctcaagaatatcaatctgataattccccgtaacaaactgatagtcattacaggattatcaggctccggtaagtcgtccctagctttcgatacattatatgcggaaggtcaacgtcgttatgtggagtcactctctgcctatgcacgccagtttttgtctctcatggaaaaaccggatgttgatcatatcgaaggcctctctcccgccatttccattgaacagaaatcgacttcccataacccgcgttcaactgtcgggacgattaccgaaattcacgattatctccgcctgctgtttgcacgcgtaggggaaccccgttgccccgatcatgatattccgctggctgcccaaactatcagccaaatggtggataatgtgctggtattaccggaaggccagcgtctgatgctgctggctcctgtcgtcaaagaacgcaaaggggagcacaccaagctgctggataacctgtccgcacaaggctacatccgcgcccgtattgatggagaagtgtgtgacctgtctgacccaccaaaacttgaattacaaaaaaaacacactattgaagtggtcgtcgatcgcttcaaagtccgcgctgatctggctcaacgactggcagaatcattcgaaaccgcgttagaactttccggcggaacggctgttattgccaatatggatgacgagcaggctgaggaattaatcttctccgctaattttgcctgttccgtctgtggttacagtatgagtgaactggaaccacgcctgttttcctttaacaatcccgcaggtgcctgccctacttgtgacggtttgggcgtccagcaatttttcgatcctgagcgagttatccagaatggcgatatttctctcgcgggtggtgcgatccgaggttgggatcgccgtaatttctattatttccagatgcttaagtcattgtcagaccattataaatttgatatcgaaattccattcaatgacttagacccagccatcagaaaaacagttttatacggttcagacaaagaatccatcgagttcaaatacaccaatgatcggggcgataccacagttcgccatcatccgtttgaaggtgtgttgcacaatatggagcgccgctataaagagaccgaatccagcgcagtgcgggaagaactggcaaaatatatcagtaaccgttcctgcatctcctgtgatggaacccggctgcgcaaagaagcgcgttatgtctttatcgaaagcaccacgctgccgcaaatctccgagttcagtattggtcatgcgatggcgtttttccaaaatatcaaactgagtgggcagcgcgcccaaattgctgaaaaaatcctgaaagagatccgggaccgcctgaaatttctggtgaatgttggcttgaattacctgaccctttcccggtcagcggaaaccctttccggcggtgaagcacagcgtatccggctggccagccagattggcgcgggtctggttggcgtcatgtatgtactggatgagccatctattggcctgcatcaacgtgataatgaacgtttactggaaaccttgctgcatctgcgcaatttggggaataccgtcatcgtagttgaacacgatgaagatgccattcgggcggcggatcatgtcattgatatcgggccgggtgccggtgtgcatggcggcaaaattgttgccgaagggactattgaggatatcatgaccaacaaggagtctctcactgggaaattcctgagcggtaaatgtaaaattgcaatccctgaacagcgtgttcctgccaatcccgataaagtactggaattgattggtgccaagggcaataacctgaaaaaagtgacattaaaactgcctgtcggcttgttcacttgtgttacgggtgtttcaggttccggaaaatcgactctgatcaacgatacactattcccaattgcgcaacgtcagttaaatggagcgaccaatattaatccagcgccttaccttgatgttcaagggctggaacattttgataaggtcatcgatatcgaccaaagtccgatcggtagaacgccccgctccaaccctgccacttatactggcgtgtttacgccagtgagggagttattttctggcgtgcctgaatcccgcgcccgtggctatacaccggggcgtttcagtttcaacgtcaagggcgggcgctgtgaagcgtgtcagggtgatggcgtaattaaggttgaaatgcacttcctgcccgatgtttatgtgccttgcgatcactgtaagagtaagcgctataaccgcgaaaccttggaaatcaaatataagggcaaaaatatcaatgaagtgctgaatatgaccattgaagaagcccgtaagttttttgatgcggttcctgctctcgccagaaaactgcaaaccttgatggatgtcggtctttcctatattcgtctggggcaatcggcaaccacgctctcaggtggagaagcacaacgggtcaagctgtcacgtgaattatccaaacgtggtacaggccagacgctgtatattcttgatgaaccaacaactggcctgcatttcgccgatattcagcaattgctgtctgtcctgcatcaattacgtgatcagggaaatactatcgtggtgattgagcataatctggatgttatcaaaaccgctgactggattgtcgatcttggccctgaaggtggcaacggtggcggtgaaatattagtgtcaggaacaccagaagaagtggctcaatgtgaagaatcccatacggcacggtttttgaaaccgatacttgagcgtcaataa

SEQ ID NO: 1025 - DNA, 159 bp, Xenorhabdus bovienii
  Coding sequence Name=Xb4151_4152.C422.gene29.dna; Position on contig =33322..33480bp; Strand=+
atgtatatgtttttacctttcttaattgcgttagttatcattccaacagttattattggcaagaaaaagctgacctacactctttggtttgcattattaatcatcacggtattttggtttaaatatcatgcgactgatgcattgaacctttctttctaa

SEQ ID NO: 1026 - DNA, 555 bp, Xenorhabdus bovienii
  Coding sequence Name=Xb4151_4152.C422.gene30.dna; Position on contig =33505..34059bp; Strand=+
atgtcagcatcccgcagtcttaatcctgcaatggtcttaaatatccttggtctattcggcatcagtgtcgttttgataatcgcgttctattatcaattggcacgttttgaacttccctgcccattatgtctgttgcaacgtgcaggtatcatcatgattggcttaggttttctgttcaatatttatttcggtattaaaaatgctcactacagtctatctctgctaggctgcctcgtgaccggttttatcgctatgcgtcaagtctctctacatatcctgccgggagatacaggatatggctccaccttcttaggcttacatttttatacttgggccgcagtcttatctattcttaccattattgccatcgctgtcattatgcctctgaaagcaggcaactccgattcatcaagatacacaccgcccacattaggcaaaatagccatggggctgtttgcatttttgatcgcagctaatctggtttctactgtgctggagtgtggtagcgggcaatgtgatgataacccaacattttatcagctattgaaaaagtaa

SEQ ID NO: 1027 - DNA, 276 bp, Xenorhabdus bovienii; identical to SEQ ID NO: 154
  Coding sequence Name=Xb4151_4152.C422.gene31.dna; Position on contig =34231..34506bp; Strand=+

SEQ ID NO: 1028 - DNA, 291 bp, Xenorhabdus bovienii; identical to SEQ ID NO: 155
  Coding sequence Name=Xb4151_4152.C422.gene32.dna; Position on contig =34635..34925bp; Strand=+

SEQ ID NO: 1029 - DNA, 1170 bp, Xenorhabdus bovienii
  Coding sequence Name=Xb4151_4152.C422.gene33.dna; Position on contig =34942..36111bp; Strand=-
atggctgagacacagcatacccaaactcgccctgaatttacagttcaaaaaaaatccggcagtcaaaaaccgctcgacctgatccagaccgtgaaaacatcggccatgtattcatgggcaaatctgctgtctgcctgtggtattgatgttccggcaaagggtaaacatggcgcttgtcctatttgcggtggtactgaccgttttcactttcttgatgatcaccatcatggtaactggcattgccgccagtgtgatgccccgaactatggcgatggactggatttagtggcaagaacccaaaagatttcgattactgaagcagcgaaaatcattgctggctcgttggcattgcctttgccagaacccaaaccagccaaagaaaacctctatccaacacaaccgattgccgacagagtcgcggcactgatggcgcaaactgttgtgggacaatctccctatctgactgcaaaggggctgcattgccctaatcagcggttattgcctgataattcaactgtgttgcgactcgcaacactggacaatatagtcacaggcgcgcagatcatcaaaccgaatggcgagaaaaaactcctcaccggcagccagaaaaaaggtgcgtttattcctttatcaacgctggaagagaaccctgataccgtcatcattaccgaaggttacgccacggcactcacggttaaccagctatacgaaggtgttgttctggccgcgctggatgagggaaatttatttcctactgcaaaaaccattcgggaacgttggccggacgcaaaaatcattattgcagcagataatgactggcacacaccgggcgagctggataaagacggcaaacccaaaaagaatgttggcaagatctcggcagaaaaagccgcctacgcagtgaatggctgggtcacattgccaccggataatatcaaagctgactgggacgattgtcgacaacaacacggcattgaagcagcaaaacaggcattcagtaacgggttatatcaagcaggggaaccaatgaaccatcacacaatagaaagccgccgttatgacaatgtcgaaagcatttatccaaagcgcaaaacaaagttaccgctgtcagtgggttcggcaggatttgatgcgcagttagactacgtggttaaaggggtcatgtattaa

SEQ ID NO: 1030 - DNA, 207 bp, Xenorhabdus bovienii
  Coding sequence Name=Xb4151_4152.C422.gene34.dna; Position on contig =36221..36427bp; Strand=-
atggcagtgacagcattgaaggtaaatcttatccgtttgccggaagttcagcgccgaacgggttacagcaaggcgtggatctacaaattaattagcgatggagaattcccgaagcaggtcaaaatcggcccccgctccatcgcatttattgaatcagaaatagataactggattgcccaacgcatcgcggaatcacgggcggcataa

SEQ ID NO: 1031 - DNA, 1272 bp, Xenorhabdus bovienii
  Coding sequence Name=Xb4151_4152.C422.gene35.dna; Position on contig =36567..37838bp; Strand=-
atgaaacttaatgcacgacaaatcgaaactgcaaaacccaaagaaaaaacctacaaactcgccgatggcggcggtctctatttagaagtctcgtcacgcggctcgaaatactggcgcatgaagtattaccgcccgaccgataaaaaagaagaccgtctggcgttcggtgtttatccgactgtatccttagccgatgcccgcgctaaacgcgatgaagccaaaaaactgatggcacagggcatcgatcccaaagccgaaaagaaaggcacaccaacgcctgccaaagtcaactcgtttgaacaagtcgcccgtgcatggcacgccagtaacaaacgctggagcgacagccaccgtcaaaaaatcctgcgcagccttgagcaatatattttcccccatatcggcgccagagatattaccacattacgcaccagccagcttttagcgcccgtcaaggccattgatgagcaggacaaacacgatatcgcccagcggctgcgccagcgtatcaccgccatcatgcgctacgccgtccagaatgatattctggagtccaacccggctaacgatatgaccggcgcactcaccaccgcaaaatcccgtcatcaccccgccttgccccatgaatgtttacctgatttcctgaaccgattgtctgcttaccgaggacgcttactgaccaaaatcgcggtagaactggcgctgctgacgtttgtccgctccagtgagctgagatttgcccgctggcaggaaatcgaccttgaaaattcagtatggaaaatccctgccacaaggcaaccgattaaaggcgttcgcttttctgagcgcggcatgaaaatgaaaacggatcacattgtaccgttgagccgtcaggcggttggtcttatcaacgcgttacacgaactgagcggcaactgcgacgtgatgttccccagcgatcataattccgcgaaagtcatgagtgaaaacacggttaacaaggcattacgcgcgatggggtacgatactcaaaccgaagtctgcgggcatggtttccgcacaatggcacgtggtgcaatgggggaatccggcctgtggagcgatgacgctatcgagcgccagttaagccatatcgaacgaaacaacgtccgggcggcctatattcacacctccaagcatctggacgaacggcggctgatggtgcagtggtgggcggattatctggatgccaaccgggaaaaaccaatcacaccctatgacttcgccaaaccgctgcgcgacagagcaaaccgatag

SEQ ID NO: 1032 - DNA, 888 bp, Xenorhabdus bovienii
  Coding sequence Name=Xb4151_4152.C422.gene36.dna; Position on contig =38120..39007bp; Strand=+
atgataattcttcccataatttcccccaaagggggcgaaggtaaatcgactcacgcggctaatctggccggtttttttgccgatgccggtttatgcgttctcctgattgatgcggattactcgcaacccacgtccagcagtatttttcccctgagctatgaagcgcccgccggattgtatgagttgctgatgcagacggtggatctgaaccagtctgagcagatcatttcccgttcggttatcaaaaacctcgatattctgatctccaacgatccggatgaactcctgcccacggcaatgctgcacgcgcccgacgggcgtttgcgtctgcgcaatgtcctgcaacatcctctcttcagccagtacgatattattttcattgattccaaaggggcgaccggcgtgatgagcgagctggttgtactggcggccacgcagggcgtgctgggggttatcaagcctattttacccgacgtccgcgagttcctgcgcggcaccctgcggatgctgacccggctccggccttttgaacactacggtatccggctgccggctatccagatactggtcaacgggattgaaggaacgaatctcgaccgggatacgctgagtgaactggctgacattatcaataatcaacggtatgacgcttccgcactgggcggcaggcaggtttaccagctgctggaaacccggatagacctgctggatatctacaaactggggcatgtccgtgcccagcccgttcatcgccttgagtataaaaccacccgaaaaagcccggctgccgcgcaaaccatgcaccgcctcgcctgtgagttagtgcccttatgggcggaaaaattcgacgcggtattgactgtgcaaccgacaggagaggcgcaatga

SEQ ID NO: 1033 - DNA, 378 bp, Xenorhabdus bovienii
  Coding sequence Name=Xb4151_4152.C422.gene37.dna; Position on contig =39004..39381bp; Strand=+
atgaatgttatctggcgggcggtctgctttcgttatgagcgcgttgaattactgttcagtgatgatgagaggtttgtgtttgtggatgcgccggatcgtgaaaccgcgcagacgaaacttcagatcctgttgccagctgttcccgatgtttctccggaaggggtagagcattattatccccgtatgcgcaggcaggccatgcgccccgatgcgtctctggatttggcgttgctggaatgtggctgggaaaatgaccagccgcagtatctgacccataacgaggtgctgttctgggtttcttcccctcatctgcaacagcgtttaatcgctgccctgaatgcgatcagcagggaggcagccgatggacatagcgcatga

SEQ ID NO: 1034 - DNA, 1377 bp, Xenorhabdus bovienii
  Coding sequence Name=Xb4151_4152.C422.gene38.dna; Position on contig =39365..40741bp; Strand=+
atggacatagcgcatgaacatttacagatcatcagtgaagaggcgcccagctatgcgtatgccgaagtgggggtgttgggggggctggtactggagaatgagcgctgggatagcgttgtccagctattggttgccgacgatttttattttccggcacaccggataatatttcaggccatcgctgaactgagcgaaaaaaactgtccgttcgacctgattaccctgaccgataggctgacccagcgtgggcaaattgatcgggcatgcggttttgcttatgtagcggaagtgtgtaaaaacacgcccagtgccgccaatattgaggagtatgcccgtattgtggcggaaaaaagccggttacgtcagttactggcactgggaaaatccctcagcgctgacgtttttcagccgaatattcagtcagataccctgatagagcaggcagaaagtcagttgtttaatctggctgaaaaaggttcgacccgccagcatcaggaaatgaccctgttgcagggcgcagacagcctgattgcccatctggagcgaatacaaggctcacagggaataaccggcacaccgaccggatttcaggatcttgatgaaaaaaccggcggcttgcaggccggtgatctcattttgctggctgcccgcccttcgatggggaaaaccgcgttgggactggcctgttgcttgggtgtcctgcggcaccgggatgatgccgtggtacagattttcagtctggaaatgccggctgcacaactgatgctgcgcctcactgccatggaaggcggggtttctctgagcaccctgcgcagcgggatgctggatgatgagcagtggggacgcataagccagagtctggatcagtttgcccgctgggatcagcgtctggttattgatgattgcagtcatcagacgcccgcactattacgcgcccgtgcccgccgctatacccgcaaatacggtcaacccgccctgattatggttgactacctccagctgatgtgcgcgcccgggcaggaaaaccggacgcaggaaattgccgatatctcccgtaacctgaaagcgttaggcaaagaactgggctgcccggtactggcgctgtcccagcttaaccggcaggtcgaaaaccgttccgataaacgtcctaacaatggtgacctgcgtgattccggctcactggagcaggacgccgacctgatactgcatctctatcgcgatgaagtctatcacccggacacacccgatacaggtactgctgaaatcattattggtaagcagcgtcaggggccaacgggcgtggttcgtgtgggatttgacggccaatatacgcggttttcggacttatccgcagacagtgatggttacggggagtaa

SEQ ID NO: 1035 - DNA, 1578 bp, Xenorhabdus bovienii
  Coding sequence Name=Xb4151_4152.C422.gene39.dna; Position on contig =40745..42322bp; Strand=+
atggcacggcaacctctcaatatgggcaatgccctgttacaacaagggcgccaggccgcggcgacactcagtgaacaaccccctgtgtcggaaatgccgatggtactgacactggatcaactccgccccaatccggataacccccgcaccagtcggaacccgcgttatgaggatatcaaggcctccatcaaagtacgcgggctggatacggtgccgaaagtcacccgcgatccggaaggtgaagatgtctatatcttcagtgacggcgggaatacccgttatcaggttttgtccgaactgtggcaggaaaccggcgatgagcgtttttatcgtgttcactgcctgtttaaaccgtggccgggcagattgcagtgtgtcatcgggcatctggcggaaaatgaactgcgcggtgaactcagttttattgaaaaagccctgggggtctgcaaggccagaaccctttttgaagtacagaaccagcagaaaatcacccaaagtgagttgtctgcactactgggggaagccggttttcctgtcagccgcagttatatcagccggatggaagataccgtgcaatatctctatccgtggatgccggatctgctgaactcggggctgaaggtaccccaaattcgtttgttactggcattacggcaggatgccgaggccgtctggctgcaacatgttgtcagtgcaatatcggagcctgcctgttcctttgatgcgatttttggtgcctgttgccgcaaatttgactccccggaatcctggtcaccggagatgttccgggatgaacttatcggcgatttattgcaggtattgccgcacccgcagctgaattatgaccgctgggtactggaactcgatccgaaggaaagtaaccgccggcaactctttggtgaacaggccaccccggttgaccttgtgccggaaaagccggatacgcctaaagcggatcgggttcgggcgccagacagggaaccgaaccggcgcataatgtctcaacccgtcacggatgcggagcaggcatcggagacaacatgcgctccggtcgataagacacccgtgcctgctccgtcttcccgaaacaatccggtgctcccgccttatcagccggatagtccgtctgaaccggcgctgtctgagcctgaagccgacgatctccactttgcccggaccgggctggagccggtcagctcagtctggcacatttccccgatgcaggacgatatcgagcatttgcaaaatatggcgtttcgcctggcgtttgaactggccgaagtgatgggctgtgaccgtgatttgctgccggtatcggatgaacggtcggcgggattttgcctgattgacgggccggatgttcatcctttttcgtgtttattgcactccctgaccggggaaatctcgactgaccgtcatgaactgacgctgactgccgttctgctcggcaccgccggacggaaggcggtaccattactggatgacagccagaccgtgaagtttttgcggctgctgcggattatccgccgcctgcgtgaacttcagcgtgaaatggtgccggagatgttggcgatgtag

SEQ ID NO: 1036 - DNA, 582 bp, Xenorhabdus bovienii
  Coding sequence Name=Xb4151_4152.C422.gene40.dna; Position on contig =42403..42984bp; Strand=+
atgaatcatttatcgcaagcgaccaacagcctgttgttgcagttggtgatggatttgaagaacggctatatccgccgttgcgaagcactggggctggcaccctcggagatgctgatgttacagagcctgacgattgaggatttgcattatctgggcaacagcccggtatcggtgctgagtgtgcaaattcatcacgccaatctggcccgcatcttacatcaggcgcgtatcgaacagcagcggatacaacgcattgaccgggctctggcactcagcggatcgattgatctgatgcactatttttttggcctgtccagtctggaggtggcggcgcgccggcgtattgccggtattgccgtgaagtcggggcgggtttcggtgctgacggaagcggaaaaccgtgacctgtggcagcgctggcaggcggcaaagatgagggatgcggacagtgccgacgggctggatatcatgatggacgtggcggagcatcatgatatttcgctgacgtccgtctggaatgccgtcaaagaatggcagcaacagggtgcatccggatcggtctctgtgaaaaaacagggataa

SEQ ID NO: 1037 - DNA, 258 bp, Xenorhabdus bovienii
  Coding sequence Name=Xb4151_4152.C422.gene41.dna; Position on contig =43005..43262bp; Strand=+
atgtcaggaaaattaaccgaaatcatgcccggcctgcatgtgccggtaacggcaccgctgtcctttcgccgtaaggcgcaatatcaggtgaaatgttatcggcggggtcagcgtaattacgtccggctgaaggaaaaaggcaccgggtatctgaaaatcaacgtagggctgttctggcggctgttaagccgtgacagcgggcagtcgtgggagctgatgcaccacgaacgctacaacaatgaaattcgtaaatcgtaa

SEQ ID NO: 1038 - DNA, 1224 bp, Xenorhabdus bovienii
  Coding sequence Name=Xb4151_4152.C422.gene42.dna; Position on contig =43358..44581bp; Strand=+
atgataaacctgtcagcagacagcttaattgcccacactatggccaaaatgaaaagccgtctggaacaacgccccgacgatgacgtttcacagctgcgcagtggtctgctgtttatgggtaacattcaggatgcctatccccgtcgcctgttactggatgatcgcctgtcaccactggataaaacgggctggatgatgatccgtttgtatgcgcaacaaaatgaaggggcggttttccccagctacgatgaattgcagctgctgctggcctcgccctataaaggcaaagcctcccgtgaaaccgtcagccgggtattgctgatgctgcgaataaccggctggctgagtttatgcaagcgtatccgcgacgagcatgggcgggtgcggggcaatatctatgcgcaacacgatgaaccgctgacctgccgtgatgccgagattctcgatcctcactggctggatactgtggcagaagcctgtcgcagcaaaaaccgcactatcagccagacggcacgggaggtactgactgacattcaagaagatccactgatgcgtcatcgtcacagtcatatccgtttgctggaagcgcggctgaatgcggtgcagacgccacagcaaagggtcatgaggcaggcgcttcaacagggaaaacagcaaaccgaactcagggaaatgaaaccgggttcggaaaccgaatccggtcagttaaaagggcagaataagccgaattcggaaaccgaactcagcatgaaatcaatgacttgtcgtcaaaccactaaaccgaactgttatgtacgttctttcacacagagtgtgaataaaaaaacatacgtagatacaccgtccgctatttttctgccggaaaagttatgcaggcaactggagccggaagatggggggatgctgaacagccagttgcaggcactgcctgctgaacaggcgcaggctgtgttgacttgtctggataaggcgttacaggcaggtaaaatcggtaatccggtcggctggctgctggcgatgatgaaacgggcacgggagggaaaactgtatgtgcaggccgaaccggctgtcacgacgacggcggctgcgaagaaacccgttgaattcacacgggaaacggcgcgttctgttcccccctcttcacaagcccatgtcagcagtgtagtgaaagacattcgtcagcggctggcgcaggcaaaatatcaccgtgatgacatggggtaa

SEQ ID NO: 1039 - DNA, 543 bp, Xenorhabdus bovienii
  Coding sequence Name=Xb4151_4152.C422.gene43.dna; Position on contig =45037..45579bp; Strand=+
atgtctgaacctgatgaaaaaaccgcaccgtcgcccccccgtcgtgccggtgcactgaaatccacgttaaccattgaactccatacccactacgccatccgcctctgggcagggcgtaaaaaagaagacgtcaccggccgccgtcaatacccggacattatcggcatgccgcaggtaattaaacgggcgggcaccatcagtgaggatgcggctgccgataacccgtatgccgacagctggctgatgaaactggaacaggccctggtggcggcctcggccagccttcagcagcgtattgccaccttgcaggaaacactgaacgccctgccggcacaggtgacgttatccgcggtttcctctgttgaaccgctgaatatcggggtctacagtcactccccgctgggttaccgctgtgtctggctgttggtcggtttcgaccagctggcgatgaaaacctttcaggcgtttcattacggttttatttctcgttcagagcgggatgcgttgctgcataacggcagtcgggtgatccgccagatttag

SEQ ID NO: 1040 - DNA, 2779 bp, Xenorhabdus bovienii
  Coding sequence Name=Xb4151_4152.C423.gene1.dna; Position on contig =1..2779bp; Strand=-
atgacattgcatattatcgagggcgccaaaggcggcgggggcggcggacatacaccttatgaaatgcccgataacattcaatcgacggccacggctaaaattctggtggccttgggtgagggtgagttcgtcaatgatctgacggcaaaagatatctatctggacggcacacccttgcagaacgacaacggaaccatgaattttgcaggcgtgaaatgggaatttcgccccggtacccagcatcagaactatatcaaaggcatgagcgcggctgaaaatgaaatccgtctgggtacagaaataaaaaccgctgtgccctggacaaaatacatttccaacaccaagttatcggccgtccgtgtccgtctcggctggcctacgttgagaatgcaaaaagaaaatggtgacacggtgggctttcgcgttgattatgccattgaattatccaccgatggcggcagctatcaggctgtgtttgatacccatattgacgccaaaacaaccaccctgtatgaacgctcataccgcattaatctgcctgataccaaaacgggctggacggttcgtgttgtcagaaaaacaccagacagcaccagcgagcggatcaacgataaaatgaatatcatggcgtttaccgaaattatcgacgccaaattacgctacccgaataccgcgctgctgtacgttgaatttgacgcccggttattcaatggcaataccccgctgatttcctgtaagcccaaggggcgcattattcgcgtacccgccaattacgacccggttaaccgcacgtacagtggcatctggaacttaaccttcaaatgggcgcacagtaataacccggcgtgggtactgtacgatatactgctaaacgatttatgcggccttggcgacaaaatcgaccgcacgcaaattgatgaaatcgaactgtatcgcgtggcgcagtattgcgatcaactggtccctgatggcaaaggcggtggtggcatggaaccgcgctttacctgcgatgtttacatacaatcacgcgaagaggcacataaagtgctgaccgatattggcgccatattccggggttcagttcactggggggctaatcagttcgtggcagcggcggatatgccggatgacattaaatatatcttcactcaggccagcgttatcaatggcgactttgtttacagcggcggcggcgaacgtaaccgtagcacggttgccatggtgagctggtcaaatccaaacaatcattacaatgatgaagttgaagttgtttcagacgataatttaatccgacgttatggtatcaaccagattgatatttccgctatcggctgcacccgtcagagtgaggcgcaacgccggggaaaatgggcaatcctgaccaactcacgcgatggcatgatttcatttcgtgtagggctggatggtcaaatcccgatgcccggtcatattattggcgtggcacataaaaaccgagccgggcgcactatcggtggtcgcattcagtcggtgaacgatcgcaatatcacactggacagaaaacctgatgtgaaggcgggtgatcgtctattggttaatttaccgacaggaaaatcagaaggccggacggttcaggccgtcaatggtcacattgttaccgtgacgacgacttatagtgaatcacctgtatccggtgctggctgggcggtggatgcccatgatttatttattcagcaatatcgcgttgtcggcatcaaagataacaatgatggtacattcgaaatcaacggcctgtatcacgatcccgataaatacgaccgtatcgacacgggcgccagaatcgacgaacggcctatttccattattccggcaagcgtccagcagccgccgaattcaatcaggattgagagtttttcgtttgttcagcaaggcatttccaccactaccgtgcggattgcatgggagaaagcggaaggggcggcggcctatgtgggagagtggcgccgggatagcgggaactggatttctattccccgtaccgcgtcattgggttttgaaatacctaatgcgtactccggcagatatcaggcccgtatcaaagccatcaactcctttgatattcccagcttatttatctcctctgaagaggtcaatatcgttggaaaacaaggcaaccctccggcaccgctgggattcagaacaaccccaattatcttcggtatccagattgactggggttttgcgccccagaccgacgacacactgaaaactgaaatccagtacagcaggacgaatgacggtgagggtttactgttgctggccgatattccctatccccagcgaatgcacacgatgcaggggctggcggcaggcgttgcattttatttccgtgcgcgtctggtggataaatccggcaatcaatccccgtggacggcgttcattcgtggggagtcgtcttcggatacgaactggatcattgatgcagccggtaaggaatttctttccaacaaagcaggacaacggttgcagtctcaaatggactttaactccgaagccatcatggagaacgccgcattgacaggggcagttgttcagcgacagttgcaagtaaacggcaatatgcgagccgaaatactggaagtcaaaaccacgcaggtgaccgaccgggaagcctttgcggagaagatggaaaaggtgcaggccgatgtcggggagaatgcggcggctgtaaagacaaaggcgacagtggtctttgatattgacggtaacggctatgccctcaaagagattgaagccgggg

SEQ ID NO: 1041 - DNA, 207 bp, Xenorhabdus bovienii
  Coding sequence Name=Xb4151_4152.C423.gene2.dna; Position on contig =2843..3049bp; Strand=+
atgttggcttgcttaaatctatccggcgtcactatgggcagggatgcccgcgcctcgatgagttccgcacctgataagcctaaaaaaccgcacggcttcagagagccattttttatgtcaggattccatcaggtcgataagccgttcatgtcatcaataatcagtcttcgcaaaaccagattgggaactgctttaattaacgattaa

SEQ ID NO: 1042 - DNA, 1041 bp, Xenorhabdus bovienii
  Coding sequence Name=Xb4151_4152.C423.gene3.dna; Position on contig =3075..4115bp; Strand=-
atgctggcagggtgtttctttcaggagaagaccatcatgcaaaacgttacgcttattggtattgatctcggcaaacattctttccacgttcactgtcaggacaaatcaggaaaggccctgctgcgtaaaaaatttacccgcgccagactgatggagtttttagcgggatcgccatcagcgactgttgtaatggaagcctgcgccggtgctcactttatggctcgccggatcgctgcttttggtcacgaagcgaagctgatttctccacaatttgttcgtccttttgtaaagagcaacaagaacgattttgtggatgctgaagccatatgcgaagctgcatctcgtccctccatgcgatttgtgcaaccacgaacagaggcgcaacaagctatgcgcgccctgcatcgggtcagagaatcactggtcagagacagggttaaaaccactaatcagatgcacgcttttttactggaatttggcatcagtatgccgatcggaaccgccgtgataaaaagactttcaaccgtcttggcagagaacgaacttcctccctatctggcacagttgctgatgcgcttacatgcccattatctttatcttgtcgaacagctcaccgagcttgagacggcactggagcaggagctgagacgtgatgaaacaggacagcgtcttcagacaataccgggcgtgggtccgataactgccagcgtcttatcatcgcagctgggcgatggtaagcagtatggctgtagccgggattttgctgcttcaaccggtctggtaccacgccagtacagcacgggtggcaaaaatacgcttttagggataagtaaacgcggagacaaaaatctgcgacggttacttgtccagtgcgccagagtctttatccagagaatcgattatcagtcaggaaggctggctgaatgggtaaaggctcagcttgagcgaaaacactcaaatgttgtggcctgtgcgctggccaacaaattagcccggatagcctgggcaatcacaacacggcaaactgtgttcgaaaggtaa

SEQ ID NO: 1043 - DNA, 159 bp, Xenorhabdus bovienii
  Coding sequence Name=Xb4151_4152.C423.gene4.dna; Position on contig =4038..4196bp; Strand=+
atgtttgccgagatcaataccaataagcgtaacgttttgcatgatggtcttctcctgaaagaaacaccctgccagcataccgctcacagggtggtggggaccatctcattaaccgccttgctaaaaatagtcttttttgtgatcgggcgcataaaataa

SEQ ID NO: 1044 - DNA, 273 bp, Xenorhabdus bovienii
  Coding sequence Name=Xb4151_4152.C423.gene5.dna; Position on contig =4289..4561bp; Strand=+
gtggttcgatacactaatcacatacgctatctaagaatattatttttcaaccgcaatcattttaattttttacgctgttattgtcggataccattttttatttcacttgatttaacttggcctttactccttctttatttattattgccttcattttatttatcacggatcagccgatatattcggacaacagagtcccttcaaattatcggaaaacaacctattgcgtccttaattaaccaatttgtcggagacaatgtgagtgagatttaa

SEQ ID NO: 1045 - DNA, 129 bp, Xenorhabdus bovienii
  Coding sequence Name=Xb4151_4152.C423.gene6.dna; Position on contig =4520..4648bp; Strand=-
atggtgtgtctccctaagatgatggaatgttatgaaataggcatcccgcctgataacaacacaggccataacattcgggtacaagatttaaatctcactcacattgtctccgacaaattggttaattaa

SEQ ID NO: 1046 - DNA, 2187 bp, Xenorhabdus bovienii
  Coding sequence Name=Xb4151_4152.C423.gene7.dna; Position on contig =4647..6833bp; Strand=+
atgtcaataaagaagaacctcgataaattgaagaaagggcaagcccttgttcagcaggggcaagaggctgttcagaaagcgaaacaagttgcaggcaaattgggcagcggcatgtcaggaacagcaggtttaatcccgggtggtggttttgccggcggaataggcggccgttcaggcagcggcatgacaagcaccgcgggcttaatcccgggtggcggttttaccggtgggcaggggctggcagaacgctcagccgggggacagaatgccgccaccaaagcactggaaaaagtcggccagatgctgatgggcgggcgtgacccgagtggcctgcaatttaccctgaccgcaggcagcttaccgccacagacgtttgtggtgaccgatttcaccctgaacgaaagtttttcccagccgttcagcctgagtgtgggactggcgagtgccgacccggttattgactttccggccgtactggatcgcaccgccacgctgaccattctgcaaaacggtatcgaacaacgcagcatcacggggatcgtttcccgctttgagcagggtaacaccgggttgcaccagaccacctaccagatgactatccggccggatctgtggcgcacgaccctgagacagaactcacgtattttccagcagcaggatatcgccaccatcatcaccgccctcctgaaagaacacagcatccgcgatgtgatcttcagcctgcgccatcctcatcccgcgcgcgaattctgcgtgcagtatcaggaaagtgactttgccttcctgcaacggttaaccgcggaagagggtattttctacttcttcgaatgcagtaacgggcgcaacacgctggtctttgccgatgactgtggttctgtgccgccgggcatagtcatcccttatcagcccggtgaagtcaacaccgtgggtgaacctgccatcagcagcctgacatgcagcgcacaagtacggccggctcaggtacagcttaaggattacactttcaagaacccggcatggccggcggaatttcaccagcagatgcgggatgaaaatctgcaacaactgtactacgagcactacgactaccccggccgcttcaaagacgaggcgcatggcaaggattttacccgctaccggctggaggcgctgcgcagcgacgcagtgaccggacagggcagcggcaatgcgatagcgctacagccgggtaaactgtttatcctgaataatcatccacggatagacctgaaccagtcatggcagaccatctccaccagccacagcggcagccagccgggtgcactggagacagcaaccgacggcgcaggcaccacgctgcacagccacttctatttcatccgccagaatcagaactggcgcccggcaccgctgtccaaaccggtggttgatggcccacaaatcgctaaggtggtcggcccggccggcgaagaaatcttctgtgaccaatatggacgggtacgtctgcaattcccgtgggatcgctatggcaaatccaacgaccagagttcctgctggatacgggtgagccagccgtgggcgggccaaggctggggcatcctggccatcccacgtatcggacaggaagtggtggtggatttcctgcacggcgaccccgaccagccgatagtgaccgggcggacttaccatgccagcaacatcccgccgggggccttgccgggcagcaaaacccagatggcgttccgctccaaaactcacaagggacagggctacaacgaactgctgtttgaggatgccaagggcagcgaactgctgtcactgcacgcgcagaaagacatgtacaccaaggtgctcaataaccgggatacccatgtgctcgccaaccacagcgaaaccgtggagaaaaaccagaccatcacggtcaatgagaacaaagaagaaacggttacgctcaacagcacggaaaccgtgaaagaagtgcgcaaactgatcactggcaaggactacattatcgaggtcggtacccacaagatagaaaccatcaacaataccctttccatcacaactggcgatgtgatcgagctacgctgcggagcaagtgtgttacgtatggacagtgccggacgtatcacccttcagggcagtgagtttaagtttgaggccagcggcccggtgcaaatcacgggtaaagacatcgacctgaactaa

SEQ ID NO: 1047 - DNA, 1218 bp, Xenorhabdus bovienii
  Coding sequence Name=Xb4151_4152.C423.gene8.dna; Position on contig =6849..8066bp; Strand=+
atggaatttcgtaacctgaccccctttgcggtgatgaactattcaatgctggatgttgaggatgtggagcaccacgtggcggtcataaaaatcggctaccagctattgcctgtcggacaaggggaatacagtgctgaattactgcccgcgccgcgcctgtgtttacaggatgaataccgtgaacagatgaatgcctcacaggtgttgcaggagagtgatcttgccccgtttaaaccacgctgtgacgtgattgtcaacggcacggcgtatgcgccggataaccgaccctgtactgagtttcctgtacggctgcgggtaaagagcaaacagggccagaccctgctcgacaaaaccctgaccataaccggtgaacgggaatttattcgtgatgctggcggtcagtggcaactgaccgacccgaaaccgttttcaacactgccgctggattatcgctatgcctttggcggtgaatgcaaaatccaagcagatgataaagcgagcgaacacctgaaagaacgtgaccggctgacaccggaacagcgccggcaacatccagacggggaaaacgctcctgttgctcatgccgtgtgtgaaagcaacccgctgggtatgggatttatcacgccgtggtatgcacaggccaaaccacttacccgttcccctgccctccgtattacccgaccggatgccccgttcaccgcgcagcattttaccactcaactggatggaacgttggcgcctgatacacccgcctgccagccacaaggcatgggctttatcggccgtccgtggctgccccgccgccagctggccggcacttacgatgccgactggctgacacatcgacatccttacctgccaaaagattttgactttggctactggaacggcgcccccactgaccagcaaattgactggccggacacggatattgccatcacgttaagcggcctgacgcctgatggtgaactgcacgtcaatctgccgggacaccgtccgtttattctgctgcgaatgcacaacggcatattactgcccgtgccgatgcgtatggatacgttaattatcaacagcgaggcaaggacgctgcacatgacctgccgactgagtttcaaagcctcactgcccgtgcgagtggctgaaacccggtttgaaatcaacccggatgcccccttgctcaatctggcaccactggaagaggagaaaacggatggctga

SEQ ID NO: 1048 - DNA, 402 bp, Xenorhabdus bovienii
  Coding sequence Name=Xb4151_4152.C423.gene9.dna; Position on contig =8014..8415bp; Strand=+
atgcccccttgctcaatctggcaccactggaagaggagaaaacggatggctgataattacatcgcccgcactgcaggcgaatggctgatcatcggcatgttgcccgacgtgtgcaaaaccccgatgggcgcgtcaacaccgccgatcccgtatccggtcattgcgaaactggcaggcagtgacacccccgtgaaatcggtacgcgccaatggccaacccgtagtggtatttgcccagagctttgtgccgacaactctcggcgaccagccgggcgtggccaacgggattaagagtggcacggtgggggcgaaatgccatcccaaagcgcataccaacaccgtccgggccggcaataaactggtactgcgccacggggatgaattctggatgaatggcgcataa

SEQ ID NO: 1049 - DNA, 4557 bp, Xenorhabdus bovienii
  Coding sequence Name=Xb4151_4152.C423.gene10.dna; Position on contig =8427..12983bp; Strand=+
atgtcagaagataaagctaaccgagaggacgtctcgtcagaaacgggcgaacacattccgccacaacccaatacagccttaccatcaaaaccacgcagtgacagcccgactggtgagggcaacacgctgggtaaaatcatcggtcaggcaccacagggggcgagttcgccccatgaggcgaatccggtggtgataccggaaagcaaacccgaaatgagtgcatgggaaacgctgaaaacgatgggaaaagcgttaggaaacgctgccgtagacaaagccaaagaaacaaaacaagacctgtcaaccgtaagcggatgggatccgattgaacagcagaaaggcattgccaaaaccgtcagtaataccgccgtggggctgggcgaaatggccattaagggcggaatgctgaactcagctcgtgaagcggacgaatcggcccgttcattagctttctgggggaaagtatttggcaaccctgacaccgaaaaacaggctaaagtgataggcgaagtcgccgatgccggccgcacgaatgccaaacagtttaatcttgacgagtacaagatgacactggacacgcccggacaacgtattggcggcacagccgctgatattttcatgcttatcggcccgacaaaaggtgcgggtactgcaggctcagtgactaaagcacccgaaatcgcgaaagtggcagaagctggtgcactggcgacaaaatcccgtgaggcagcacaggtcgtagaagccagtacacaggcggctaaaaacgccaaccctgccgctggggctataatcaaagaaaaacccgcgacatccccgaaaacggaagtcaaacccacaacagaaaagcctgtcgataacgccacctcatccggcaaaaaaaagggcaatgacaacgaactgtccagtacaaagggcgatccggtcgatatggccaccggcgatttcctgcaagtctggccggttctcgccattccgggggtgttgccaataaacctcagccgaacctaccgctccacggcggatttacacggcctgtttggtgccaaatgggcggatgactggtcactgaaactggctatcagtcagggggaagtgcactatacccataccgatggcgttatctacgattatgccacaccggataaccgggtcttgtcccgtaaccgtaatcttccccattgcctgttgacgggcgaactgaccggcgaactgtgcctgaccgaccgccgcacccagttgacgtaccatttcagcccgatgtcaggcaacacacgaaaattgtctgctatcactgaccggcgtcagaaccggattgattttatctacgataagcagtcgcaactgacggccgtcactcgcaatgacggcctgcggttaagcctgcattatctggacggccggcttaacacgatcacgatgcaggaaaaccgcgaaggtcagcctgctgagcaatgtctgttgacctgtcaatatgactcacagggctatctgaacgagtgtgatgctttccagcacaaccacctgtggcatgaatatgatgtgcaggggcggatgatccgctggcatgataccgaccagactgacctgacgataacctatgacgagcgcggtcgggtactcagcaccacctctcccagcggctactggcatgaccgtttccgctatgatgacaacgcccgcattaccacctatctggatggcgaagggggtgaaacccactaccactacgacccgaacggattggtgatacgggaagtggatccactggggcgtattacccgccgtcagtggcgtcacagcctgctgatgtgggaaagcgacccgatggggcagatgactgcctttgattacaaccctgacggtgcattgaccgaagtgaaattgccaaccggcgatacctttgcttacggttataacgagcatggacagcttatcgaaagtgtactgccgaccggcgaacgttggcaacttcactatgatgagcagggcaacctgactgcgctgacccacccactgggtcatcaggaagaataccagtacggcacgcagggcgaattgcgccagcgtctgttaccggatggccgccagtggcactatgcctatgacgagaaacaacggctggccgccgtgatgacaccggatggcgaaactaccggcctgcaactggatgcactggggcgtttgcgccagttcaccgatgcgctcaaacagcagacgcactaccgctatagcgatgatcatgccagccttaacggcagcctgactgaagttgagttgccggatggggttacccagcaactgagatatgacagtgaacggcgcgtggtagccgccactgacggggaaggccgcacaacccgttatcaatacggcgcttttgatctgctcaatcaggttacccgaccggatggcactatcttgcgctttggctatgaccgtctgacccgtctgaattcagtcaccgcctccacgggagaaacttaccgctatgagcgggatgccgcgggtcagattatccgggaaaccgattttaccgggcgtaccctcgaatatcagtacgataaactgggacgccgtacactgactcaataccccgatggccagcaacttcgctggcactattccgccgcaggtttgctggtcaaacaggaaagctggcagccggaagaaaaccaacaggtgctaaaagacaccaccacttacgagtacaaccaacggtatcaattggtgaaagccaccaatgcggatgctactgtcgagtatgagtatgacaaaactaccgggttgccaacctgcgaacgtatcaacgggcgggaaatcacgcgcaaatgggataacctgaccgggcgtccggtcagtgaaagtgtggagggcaataccctgcacttcggttataacctgtcggggagtctgaatcactttcagcttaacgagcattcaccgctggccttccggcatgatgcgctgggtcgggaaacggtacgggaaagcgccaacggctttattcttgccagccgctataccgcaaccggattgctggcccatcagtcggcagggcaggccaccccatttttcagggaaacgctggcacaaaatgatccgcattttccgccgcaagcctctgccgttaaccgaagctggcaatatgaccgtgcccacaatgtgcgggtgattgacgacagccgctgggggcaaacccgttatcgttacaataccaacgaccagatcctgcataccctgttcgagggtgtgcgtccgcatgaagaacaatttagctatgatgccaacggcaatctaaaccaacatctgccgcccgatgcacaaggtgcgctggaacaaattacacaacgccagaaagccgggcgggtggtgcagcagggagatatccgctatcgctatgatgataatggccgtctggtggaaaaaaccgaacagcgggacgggttccgtccgcaaatctggcgctaccgttgggatacgcaaaaccagctcactcacgtcgaaacgccagatggctcacgctggcattatcgctacgatgcttttggccgacgagtccgtaaactgaaagttcacgatggtaaactcaccgcaactaatttacagttgtggctggcaggtaaagcggatttagcgccaagatccgatgctattataggacaggaatatctgtggagcggcgatcagcttatcgaagaagtgccgatttacgccgatggcacaccagtggaagatcagcgtgtccgttggttatatgaacccggttcattaacgccgtcagcccgctttgaaaaaggcaagctacactatattgtgagtgaccatcagggtacaccacgcgaaatgttgtccgaagaaggggtactggtctgggcacagcggctgacaacatgggggaaagcggagaaatcgcaggttatcgcctccaataatccggattatcatgttaactgtaatctgcggttctgcgggcaatatgaggatgaagagagcggattatattataatcgttttcgttattactcgccggacacggcgcagtatatttcggcagaccccattggcttattgggtggagtgaatccgtatggctatgtacataatccgtcaaaatggatagatccttacggtctggcaggcgggattggtaacaaaggcgattacatcataacttatcgtggagatacacggagcttcactgaaatttttgataagggatttgaaacgcttgggccaagtaaggatttgtataaacacgcattagataatagagcacctccgagcgatttcgtaagtactaccattgacccgacaaaaaccattagttttgcaacaaaatatggacaaaaaagtggctatatgtacaccatgaaaaccaatcacggtatagatgtaaacaaagcattaggcgcaagatcaccatttgctgctgaagcagagattgcaatgcctggaggggttagagctgaagatatattaggtgcaagagcagtcaatgccgatggagaaatgtgggactatactattctaaatccaaaaaggtatggaaaatga

SEQ ID NO: 1050 - DNA, 405 bp, Xenorhabdus bovienii
  Coding sequence Name=Xb4151_4152.C423.gene11.dna; Position on contig =12980..13384bp; Strand=+
atgacagatgttgataaaagaaaaatcaaaataatactcaatggagaaatggaagaagctgaattacatatgattacttctccgaataggcattgctgtttaaaaatatttcataataataatcaattggcagaatcaaatgatactgattatttttcatgttttgcagatttaagaaaccaattaaaaaatatcatttttctttgcaaaggagcaaaaataaatgtgtatccgtctgccatgtcgagggatatgtcagatggtatagtcgcttatgaaactacattaggtcagccaggattacctgaaaatcaggttcatatatttgattttgaagataaatatgttgatattactccagaagagcaaagaaaatttcattctcaatggtttgaatcattgtaa

SEQ ID NO: 1051 - DNA, 321 bp, Xenorhabdus bovienii
  Coding sequence Name=Xb4151_4152.C423.gene12.dna; Position on contig =13473..13793bp; Strand=-
atggctaaggcgcattctaagcaaaaccgtgcagtaaataaagctacaaaaatagaacgttattacaccgtgggatacgtgccgcaaaatgacaaggccaacgccccgcccgcgatccatcttaaagggcaatggcttaaggccgcgggctttgagattggcggctcggtcacggtgaagattatggagggctgtttagtgctgatccctgacagtgacgagacccaccgcctcaaacagcaataccagcgtcagcgcgagcaaatcagtgaaattaagctgaggatgcgggagctgattggggattataaaagcggctaa

SEQ ID NO: 1052 - DNA, 405 bp, Xenorhabdus bovienii
  Coding sequence Name=Xb4151_4152.C423.gene13.dna; Position on contig =13884..14288bp; Strand=-
atgtgtgccgtattggtatttttctttgtgccccaatggatggcagcagcaacagagaagaaatttgcacaacgcttgcgggaactgcgcagacaaaaaggcctctcccagtcagagctgggcaagctggctgaactccattacacccacattggccgttttgagcgtggcacttcacgaccgggcagcgacaccttaaaacgtctggcggacgtgctggatgtgaccagtgattatctgctggaaggggcagagaccgacgcggcgaaagcccggtttgaggacagggaactgctgcggcagtttcaggcggtggaacagttaccggaggaagacaaggaagtgattaagaagttgttggatgcctttttaaccaagaaacagttacaggcactggcaagatag

SEQ ID NO: 1053 - DNA, 2058 bp, Xenorhabdus bovienii
  Coding sequence Name=Xb4151_4152.C423.gene14.dna; Position on contig =14193..16250bp; Strand=+
ttgtctgcgcagttcccgcaagcgttgtgcaaatttcttctctgttgctgctgccatccattggggcacaaagaaaaataccaatacggcacacatggtaacttacgcctgtgccaactcaccgatgccctgaagcaacagactcactatcgttacagcaacgaccatgccagccttaacggcggcagcctgaccgatgttgaactgccggatggcaccacacaacaactggcctatgacagtgagcgccgtgtggtggcagtcactgacggtgaaggccgtaccacccgctacacttacggcgcgtttgacctgctcaatcaggttatcgactttccggccgtactggatcgcaccgccacgctgaccattctgcaaaacggtatcgaacaacgcagcatcacggggatcgtttcccgctttgagcagggtaataccgggttgcaccagaccacctaccagatgactatccggccggatctgtggcgcacgaccctgagacagaactcacgtattttccagcagcaggatatcgccaccatcatcaccgccctcctgaaagaacacagcatccgcgatgtgatcttcagcctgcgccatcctcatcccgcgcgcgaattctgcgtgcagtatcaggaaagtgactttgccttcctgcaacggttaaccgcggaagagggtattttctacttcttcgaatgcagtaacgggcgcaacacgctggtctttgccgatgactgtggttctgtgccgccgggcatagtcatcccttatcagcccggtgaagtcaacaccgtgggtgaacctgccatcagcagcctgacatgcagcgcacaagtacggccggctcaggtacagcttaaggattacactttcaagaacccggcatggccggcggaatttcaccagcagatgcgggatgaaaatctgcaacaactgtactacgagcactacgactaccccggccgcttcaaagacgaggcgcatggcaaggattttacccgctaccggctggaggcgctgcgcagcgacgcggtgaccggacagggcagcggcaatgcgatagcgctacagccgggtaaactgtttatcctgaataatcatccacggatagacctgaaccagtcatggcagaccatctccaccagccacagcggcagccagccgggtgcactggagacagcaaccgacggcgcaggcaccacgctgcacagccacttctatttcatccgccagaatcagaactggcgcccggcaccgctgtccaaaccggtggttgatggcccacaaatcgctaaggtggtcggcccggccggcgaagaaatcttctgtgaccaatatggacgggtacgtctgcaattcccgtgggatcgctatggcaaatccaacgaccagagttcctgctggatacgggtaactcaaccgtgggcagggcaaggctggggcatgctggccatcccacgtatcggacaggaagtggtggtggacttcctgcacggcgaccccgaccagccgatagtgaccgggcggacttaccatgccagcaacatcccgccgggggccttgccgggcagcaaaacccagatggcgttccgctccaaaactcacaagggacagggctacaacgaactgctgtttgaggatgccaagggcagcgaactgctgtcactgcatgcgcagaaagacatgtacaccaaggtgctcaataaccgggatacccatgtgctcgccaaccacagcgaaaccgtggagaaaaaccagaccatcacggtcaatgagaacaaagaagaaacggttacgctcaacagcacggaaacagtgaaggaagtgcgcaaactgatcactggcaaggactacattatcgaggtcggtacccacaagatagaaaccatcaacaataccctttccatcacaactggcgatgtgatcgagctacgctgcggagcaagtgtgttacgtatggacagtgccggacgtatcacccttcagggcagtgagtttaagtttgaggccagcggcccggtgcaaatcaccggcaaagacattgacctgaactag

SEQ ID NO: 1054 - DNA, 1218 bp, Xenorhabdus bovienii
  Coding sequence Name=Xb4151_4152.C423.gene15.dna; Position on contig =16266..17483bp; Strand=+
atggaatttcgtaacctgaccccctttgcggtgatgaactattcaatgctggatgttgaggatgtggagcaccacgtggcggtcataaaaatcggctaccagctattgcctgtcggacaaggggaatacagtgctgaattactgcccgcgccgcgcctgtgtttacaggatgaataccgtgaacagatgaatgcctcacaggtgttgcaggagagtgatcttgccccgtttaaaccacgctgtgacgtgattgtcaacggcacggcgtatgcgccggataaccgaccctgtactgagtttcctgtacggctgcgggtaaagagcaaacagggccagaccctgctcgacaaaaccctgaccgtaaccggtgaacgggaatttattcgtgatgctggcggtcagtggcaactgaccgacccgaaaccgttttcaacactgccgctggattatcgctatgcctttggcggtgaatgcaaaatccaagcagatgataaagcgagcgaacacctgaaagaacgtgaccggctgacaccggaacagcgccggcaacatccagacggggaaaacgctcctgttgctcatgccgtgtgtgaaagcaacccgctggggatgggatttatcacgccgtggtatgcgcaggccaaacaactgacccgttaccctgccctccgtattacccgaccggatgccccgttcaccgcgcagcattttaccactcaactggatggagcgttggcgcctgatacacccgcctgccagccacaaggcatgggctttatcggccgtccgtggctaccccgccgccagcttgccggcacttatgatgccgactggctggcacatcgacatccttacctgccaaaagattttgactttggctactggaacggcgcaccaacagaccagcaaattgactggccggacacggatattgccatcacgttaagcggcctgacgcctgatggtgaactgcacgtcaatctgccgggacaccgtccgtttattctgctgcgaatgcacaacggcatattactgcccgtgccgatgcgtatggatacgttaattatcaacagcgaggcaaggacgctgcacatgacctgccgactgagtttcaaagcctcactgcccgtgcgagtggctgaaacccggtttgaaatcaacccggatgcccccttgctcaatctggcaccactggaagaggaaaaaacggatggctga

SEQ ID NO: 1055 - DNA, 402 bp, Xenorhabdus bovienii
  Coding sequence Name=Xb4151_4152.C423.gene16.dna; Position on contig =17431..17832bp; Strand=+
atgcccccttgctcaatctggcaccactggaagaggaaaaaacggatggctgataattacatcgcccgcaccgcaggtgaatggctgatcatcggcatgttgcccgacgtgtgcaaaaccccgatgggcgcgtcaacaccgccgatcccgtatccggtcattgcgaaactggcaggcagtgacgcccccgtgaaatcggtacgcgccaatggccaacccgtagtggtatttgcccagagctttgtgccgacaactctcggcgaccagccgggcgtggccaacgggattaagagtggcacggtgggggcgaaatgccatcccaaagcgcatacaaaaaccgtccgggccggcaataaactggtactgcgccacggagatgaattctggatgaatggcgcataa

SEQ ID NO: 1056 - DNA, 4599 bp, Xenorhabdus bovienii
  Coding sequence Name=Xb4151_4152.C423.gene17.dna; Position on contig =17844..22442bp; Strand=+
atgtcagaagataaagctaaccgagaggacgtctcgtcagaaacgggcgaatacgttccgccacaacccaatgcggccttaccatcaaaaccacgcagtgacagcccgactggtgagggcaacacgctgggtaaaatcatcggtcaggcaccacagggggcgagtccgccccatgaggcgaatccggtggtgataccggaaagcaaacccgaaatgagtgcatgggaaacgctgaaaacgatgggaaaagcgttaggaaacgctgccgtagacaaagccaaagaaacaaaacaagacctgtcaaccgtaagcggatgggatccgattgaacagcagaaaggcattgccaaaaccgtcagtaataccgccgtggggctgggcgaaatggccattaagggcggaatgctgaactcagctcgtgaagcggacgaatcggcccgttcgttagctttctgggggaaagtatttggcaaccctgacaccgaaaaacaggctaaagtgataggcgaagtcgccgatgccggccgcacgaatgccaaacagtttaatcttgacgagtacaagatgacactggacacacccggacaacgtactggcggcacaaccgctgatattgtcatgcttatcggcccgacaaaaggtgcgggtactgcaggctcagtgactaaagcaaccgaaatcgcgaaagtggcagaagctggtgcactggcgacaaaatcccgtgaggcagcacaggtcgtagaagccagtacacaggcggctaaaaacgccaaccctgccgctggggctataatcaaagaaaaacccgcgacatccccgaaaacggaagtcaaacccacaacagaaaagcctgtcgataacgccacctcatccggcaaaaaaaagggcaatgacaacgaactgtccagtacagagggcgatccggtcgatatggccaccggcgatttcctgcaagtctggccggttctcgccattccggggttgttgccaataaacctcagccgaacctaccgctccacggcggatttacacggcctgtttggtgccaaatgggcggatgactggtcactgaaactggttatcagtcagggggaagtgcactatacccataccgatggcgttatctacgactatgccacaccggataaccgggtcttgtcccgtaaccgtaatcttccccattgcctgctgacgggagaactgaccggcgaactgtgcctgaccgaccgccgcgcccagttgacgtaccatttcagcccgatttcaggcaacacacgaaaattgtctgctatcactgaccggcgtcagaaccggattgattttatctacgataagcagtcgcaactgacggccgtcacccgcaatgacggcctgcggttaagcctgcattatctggacggccggcttaacacgatcacgatgcaggaaaaccgcgaaggccagcctgctgagcaatgtctgttgacctgtcaatatgactcacagggctatctgaacgagtgtgatgctttccagcacaaccacctgtggcatgaatatgatgtgcaggggcggatgatccgctggcatgataccgaccagactgacctgacgataacctatgacgagcgcggtcgggtactcagcaccacctctcccagcggctactggcatgaccgtttccgctatgatgacaacgcccgcattaccacctatctggatggcgaagggggtgaaacccactaccactacgacccgaacggattggtgatacgggaagttgatccactggggcgtattacccgccgtcagtggcgtcacagcctgctgatgtgggaaagcgacccgctggggcagatgactgcctttgattacaaccctgacggtgcattgaccgaagtgaaattgccaaccggcgatacctttgcttacggttataacgagcatggacagcttatcgaaagtgtactgccgaccggcgaacgttggcaacttcactatgatgagcagggcaacctgactgcgctgacccacccactgggtcatcaggaagcataccagtatggcacgcagggcgaattgcgccagcgtctgttaccggatggccgccagtggcactatgcctatgacgagaaacaacggctggccgccgtgatgacaccggatggcgaaactaccggcctgcaactggatgcactggggcgtttgcgccagttcaccgatgcgctcaaacagcagacgcactaccgctatagcgatgatcatgccagccttaacggcagcctgactgaagttgaattgccggatggtgttacccagcaactgagatatgacagtgaacggcgcgtggtagccgccactgacggggaaggccgcacaacccgttatcaatacggcgcttttgatctgctcaatcaggttacccgaccggatggcactatcctgcactttggctatgaccgtctgacccgtctgaattcggtcaccacctccacgggggaaacttatcgttatgagcgggatgccgcgggtcagatcatccgggaaaccgattttaccggacgtaccctcgaatatcagtacgataaactgggacgccgtacactgactcaataccccgatggccagcaacttcgctggcactattccgccgcaggtttgctggtcaaacaggaaagctggcagccggaagaaaaccaacgggtgcttaaaaacaccaccacttacgagtacaacaaacggtatcaattagtgaaagccactaatgccgatgccatcgtcgagtatgagtatgagtatgacaaaaccaccgggttgccaacctgcgaacgtatcaacgggcgggaaatcacgagaaaatgggatgagctgaccgggcgtcccgtcagtgaaagtgtggagggcaataccctacattttggttacaaccagatgggtgcactgaaccactttcagctcaaccaacatgcaccactgaccttccagcatgatgttctggggcgggaaacggtgcgggaaagtgcccacggatttattcttgccagccgctataccgcgaccggattgctatcgcatcagtcagcagggcaggctacccaattcttcagggaaacgctggcacaaagtgacccgcattttccgccacaagcctctgcggtcaaccggagctggcaatatgaccgcgcccataatgtgcgggtgattgacgacagccgctgggggcaaacccgttaccgttacaataccaacgaccaaatactgcataccctgttcgagggtgcgcgaccgcatgaagagcagtttaactatgatgccaacggcaacctgagccagcatctgccggttgatgcctatggcgcgatggagcaaattacccagcaccagaaagccggacgagtggtacagcaggggaatatccattatcgttatgatgataatggacgtctggtggaaaagaccgaacaccgtgatggcttccgcccgcaaatctggcgctaccgttgggatacacaaaaccagctcacccattgtgaaactccggatggctcacgctggcattatcgctacgatgcttttgggcgacgaacccgtaaactgaaggttcacgatggtgaactgaccgccgctaatttgcagttgtggctggcaggtaaaccggatttagcgccaagatccgatgctattatggggcaggaatatctgtggagcggcgatcagcttatcgaagaagtgccgatttacgccgatggcacaccagtggaagatcaacgtatccgttggttatatgaacccggttcattaacgccgtcagcccgctttgaaaaaggcaagctacactatattatcagtgaccatcagggtacgccgcgcgaaatgttgtccgaagaaggggtactggtctgggcacagcggctgacaacatggggaaaagcggataaatcgcaggtcatcgcctccaataatccggattatcatgttaactgtaacctgcggttctgcgggcaatatgaggatgaagagagcgggttgtattataattttcatcgttattactcgccggagaccgcgcagtacatttcgcctgacccgatcgggttattgggcggggtaaatccgtatgggtatgtgcataatccctcaaaacttgtcgacccgtatgggctgagtgggacttcacaggttgcaagtaaacctgatttttatgtcggaccagatggacctagtgcaactatgccttcgactgcatatagatatatgaacagcgaagggccatatgctgctatgacaatagaaaaaaaatctgcgccgttaagttactttggatacacaaaatataaatcaggtcatgaagccagagatgcctatcaaatattttatgaaaaaggtaatcctgactcttggagtgatgctcggttgctaggcaaatttgatacattgcagctttataaaaatggtgttcctcaagtaaaggttcctcttgctaacggtgataaaggtccaggattggaactatttactagtgcatatcctcaatacggtaagggaggagctgtacagttgcttcctatagaaaaaaatcttcctgttactttcgataaagtaactatcattccggagtaa

SEQ ID NO: 1057 - DNA, 210 bp, Xenorhabdus bovienii
  Coding sequence Name=Xb4151_4152.C423.gene18.dna; Position on contig =22447..22656bp; Strand=+
atgacagaaacagaactgcgaaaaaaccttacatatctagtagataagtacatgccagataatgaaaaaaaagaagagctatacacttatatccaacgagaaaatgttccagtaaaaggaatattggcagatttcaacgaatataagacaaggacagtcgaacaagttgacggtaatctaatcagagagatatatttttactattgttaa

SEQ ID NO: 1058 - DNA, 690 bp, Xenorhabdus bovienii
  Coding sequence Name=Xb4151_4152.C423.gene19.dna; Position on contig =22735..23424bp; Strand=+
atgcaggtctggacacagtggctaacaacatgggggaaagcggataaatcgcaggttatcgcgtctaacaatccggatttccatgttaactgtaatctgcggttctgcgggcaatatgaggacgaagagagcggattatattataatcgttttcgttattactccccggacacggcgcagtatatattgcccgatcccctgaatttagcgggtggtgtgaatccatatggatatgtccacaatccttcgaaattcgtcgatccttacggattatcttcaacatctgaagtcaaagcagcatctattcagtcaccatcagaatttgctagaagttggcaagggcagggagagtaccccggtgttgatcgctttaaagatattacggtaaaaaaagatacaatattaatggctggagctccgggacaaggtaatttttatactacagttagtgctatagaaagaagtggattttctcaagaaggtgtatttaaaggcttacaagtaatgcctcatccacaatttggatatagacccggtatgacggcttatcgagttctagaagatacaccagctgcatttggcatagttagggctaatcctcaacatggagccggaggattacctcaaattgttattaaaaattatgagggaattctagaacctttatactcggtgaaattgataaaatga

SEQ ID NO: 1059 - DNA, 423 bp, Xenorhabdus bovienii
  Coding sequence Name=Xb4151_4152.C423.gene20.dna; Position on contig =23421..23843bp; Strand=+
atgatatattttaatggtgatataagtctaaatggaataataataaatccattaattacattggatgactttctaaccctaacattagatcttaatcctaaaaaaatgtatgactttgaaggtagagtcagctactcaatagatgacattctctttttagataaaaattatattatcaacgttgttttccaagatgggattattgattttattaaattacttccatttaataaggaaaaagagaataaaatcaatgtatttaccaacgaaaaccagatgaggaacaaattgattaatgatgatttattaaaatcattatttggttcatcagagaaactatttttcctatggggaaatattgagtctgtggatgataataaatcgggtatgtcatacatcatcatttcatataaacaacaataa

SEQ ID NO: 1060 - DNA, 315 bp, Xenorhabdus bovienii
  Coding sequence Name=Xb4151_4152.C423.gene21.dna; Position on contig =23991..24305bp; Strand=+
atggactctattgaacaatcaaaaaagttaagagtccttttcctttcactatgggaaattatgcgtgttaatggtggaggaaattggataaagggcattgagaacgttattacactgctgacgcccccaacatatgggggtacaaacgatgcacaatctgctattgaagatgctcgccgtgcatatggatctatgttcggaggttatggtggtttttctgaatactttatttggcgggatgattttaatgaacgacttaaagccaataaagcattagataaaataaaaaacgatatcaatgatacgtttaattaa

SEQ ID NO: 1061 - DNA, 195 bp, Xenorhabdus bovienii
  Coding sequence Name=Xb4151_4152.C423.gene22.dna; Position on contig =24459..24653bp; Strand=+
ttgaggctgttcgtctcgtcgctgccggggatgagtactaaacagccctccatgattttgactgtgaccgagtcgccaatggttaaagaacagtttaccaagtcaggaaccagattagacggtagggccgatcagatagtcttaccattaggttatccaataagttgggtaaaagatgtaaggtttttgaagtaa

SEQ ID NO: 1062 - DNA, 126 bp, Xenorhabdus bovienii
  Coding sequence Name=Xb4151_4152.C423.gene23.dna; Position on contig =24668..24793bp; Strand=+
atgaataaagaacagttacttataaagatagtgaaagcaatagatttattggaggaagaaaaaagaaataataaaaatcagttgcaatcaataataaatttgttcataaaaacaaaagaaaaataa

SEQ ID NO: 1063 - DNA, 384 bp, Xenorhabdus bovienii
  Coding sequence Name=Xb4151_4152.C423.gene24.dna; Position on contig =25047..25430bp; Strand=+
atgataacggtatatcaatatatttatgacaagatgatcaaaaaaagagaagagatgcgcagctatttactgggtccgttgagtgatgatttacccgaagaatataaaccgatacgtgaactttattatacgggttcagccaaaggaaaatcctatgtggagaaaatgatcatcaaaacagccgatgatctccttcttttacaacttgaaaagatggataaactacggtttttggaaaatggtcaggacatgttttcaatggagttaaaactcaatgaatacaatagcattgttcatgtaccccaaaacctcagtttctgctcaataatgaaagagttgattgaggaagaaaacaataaccatatttcgcgatttgtttattga

SEQ ID NO: 1064 - DNA, 285 bp, Xenorhabdus bovienii
  Coding sequence Name=Xb4151_4152.C423.gene25.dna; Position on contig =25516..25800bp; Strand=-
atgaaaacagaaccaaaaaaatttgatgttgtggagtttttagaaacggaagaagatattcaggcctacttaaatgcggctatcgaagagaatgatacaaaatatttatttaaagcattaggcaacatagccagaagaaaaaatatcagtcaactctcgaaagaatcaggaataagccgtgaagggatatacaaggcgttatccggtgaaggcaacccctcgtttaatacggtatacaaaatatcaaaagtactgggtttgaaactgcatttcacaggagcttaa

SEQ ID NO: 1065 - DNA, 321 bp, Xenorhabdus bovienii
  Coding sequence Name=Xb4151_4152.C423.gene26.dna; Position on contig =25802..26122bp; Strand=-
atgatcttagctttagaggtgagcatgataaccattgaaaggacgcaagattttgaaaaatggttaaaatccttaaaagacaggatagcaaaagccaaaatcttaatcagaattgaaagaatggaagaggggaattttggcgatgttgaacctgtgggagccggggttttggaacttagaatacattacgggcaaggctatcgtgtctactttgctaacaaaaataatgaaatcatattattactctgtggtggagataaaagcagccagcaggcagatataaagaaagcaaagcaacttgcgaaagaatggggattttaa

SEQ ID NO: 1066 - DNA, 339 bp, Xenorhabdus bovienii
  Coding sequence Name=Xb4151_4152.C423.gene27.dna; Position on contig =26200..26538bp; Strand=-
atgaaacttcatttttctactgataatgctgaactgccggaatgtgtcttaagcggtgacgatatgcaacagatgggctttatgccgaatactttgtttcatatccagcaatataataacgggctgatgttgacgttggcagagcctgatgtgattcccctgtctcacacggcggaaaatgatccgtatcaaggcatcgattgggtgcgtgataatggcgagctgtatctggctggcgactggttaacggaaaccggtttgttggataatcccgttcaagttgcttttggctacggcaaaattatgttgatgacagaatctgatctgatacccgtctga

SEQ ID NO: 1067 - DNA, 120 bp, Xenorhabdus bovienii
  Coding sequence Name=Xb4151_4152.C423.gene28.dna; Position on contig =26535..26654bp; Strand=-
atgaaaaatcatattgaacacgcctgtgtgagcggcgctttgcgcttaaagggcaaaatttttcttttgcgaagccactcgcattttattttaccgattaaacaaggaaggaaccgatga

SEQ ID NO: 1068 - DNA, 330 bp, Xenorhabdus bovienii
  Coding sequence Name=Xb4151_4152.C423.gene29.dna; Position on contig =26678..27007bp; Strand=-
atggctgacgcgcattctactgcaggcatctgcatttacaaaatttcccaacccgaacgttatcagaaagtggtttatcgtcctaagggagttaaccgcacgatccctgccattaacttaagcggaaaatggctgctggaagcgggattttccattaatgatccattaaaaatcagagtgatgccgggctgtctgatcatcaccagccaaaatttctatgaactgtggcactgtttaaaaagcctgaatgaaggtgaatgggatgatatcgctgtggcacactggctgcggcaatttcccggaaaattaactaagaagctgccgaaataa

SEQ ID NO: 1069 - DNA, 216 bp, Xenorhabdus bovienii
  Coding sequence Name=Xb4151_4152.C423.gene30.dna; Position on contig =26973..27188bp; Strand=+
atgcagatgcctgcagtagaatgcgcgtcagccataataactactccgatagttgttgcggttagcggttttatcgtgttgctgcacggtaaagccgcgtcgaattttcaccgccactctatctcccgtccaaataacataccactgacaaaaattgcctttgcaaagcggctcgcaagaagtcgagcaaaatttgcactattattcgtattgtag

SEQ ID NO: 1070 - DNA, 255 bp, Xenorhabdus bovienii
  Coding sequence Name=Xb4151_4152.C423.gene31.dna; Position on contig =27229..27483bp; Strand=+
atgaccatcacaaccctatccagtcgggagctcaaccaggatgttacccgcgcgaagaaagcgaccaaaaacggccccgtctttatcaccgatcgcggcaagcctgcttatgtgttattgagcatcgaggaataccggctgctgaccaaacagcatcgcaacatcgctgattcactggcaatgccgggagttgcggatattgagtttgagccacagcgcgtgactatcgaaacccgccctgcggatttctcataa

SEQ ID NO: 1071 - DNA, 426 bp, Xenorhabdus bovienii
  Coding sequence Name=Xb4151_4152.C423.gene32.dna; Position on contig =27483..27908bp; Strand=+
atgtatgtactcgataccaacgtagtgtccgagctacgaaaaattcgggccgggaaggccgatccaaacgtggcaaaatgggctgaaagtgtcgatgcagccgatctctttgtttccgccattaccataatggaattagagcttggcattctgttgattgaacgtaaggatgctacgcaaggaaccctgttgcgggcgtggctggaacaacatgtcctgccggaattcactgaacgcacgttacctgttgataccgccgtggcacaacgctgcgcacggttgcatgttcctgaccgcgccagcgagcgtgatgcactgattgcagcgacagcgcttgtgcatggaatggcggtagttacgcgtaacgtagccgattttcagccgacaggtgttacaatcctcaatccgtgggagccgaactcttaa

SEQ ID NO: 1072 - DNA, 171 bp, Xenorhabdus bovienii
  Coding sequence Name=Xb4151_4152.C423.gene33.dna; Position on contig =27883..28053bp; Strand=-
ttgttagtcatccttttagttagctactctgcaacttggacattgatggccacagggaacttccgctccttactcttaaccgacagtcagatgtatctgtgctctgccataggacaccatcaggttaagtcgcagctaatacacattaagagttcggctcccacggattga

SEQ ID NO: 1073 - DNA, 1371 bp, Xenorhabdus bovienii
  Coding sequence Name=Xb4151_4152.C423.gene34.dna; Position on contig =28126..29496bp; Strand=-
atgactgctggtcgaatctttaaaaaatccttttcggaaagaaacctcctcaaagtatataaggaaaaaataaaagaatccggtgctattggcatcgaccgagttcgcccttctaaactcgactcaacgataaaaaatgaaattaaatttatttctgaaaaagttaactctggtagttacaaattcacagcctataaagaaaagctaatatctaagggagctaactctaaccccagacagatctcaatacccacagccagagataggattactctcagggctctttgcgaatgtcttacagaaatttatcctgactctaggttgagactgccacataaagtaattgattcactgaaggttgcattgaatagcggcctatatacagaatatgctaagatagatctcagaaccttctacccttcaattaaacatacactgatagctgatgcaataaaaaataaggttagaaagagcgagattagaaaattaataatgtcgtcattggtcgttcctacagtaagtgaatttaaaggtagcaaaggcgcctcagcgaaccccagaggagtacctcaggggctagcaatttcaaacattttggctgagatttctttatccattttcgataaggaaatcaatgaaattccagatatctggttcatgcgctatgttgatgacattcttattctgaccccaaatagccaagccgaaacgatggcatctcatgttattaagaagctccaactattgaatttaaatcctcatccactaaatgaggagaactcaaaatccaaagttggtaatctggatgaatcctttgactttcttggttatcacataagccaaggagaattattaatcaagcatgagagtattctcagattcgaatcctcactagcaaaaattttcactgcatacaagcatgcggtactgcaggctaagaataagtgcgataaagagcgagccatagcgtactgtcagtggaaactcaaccttagaatcacagggtgtgtatttgaggggaaacgcctgggatgggtatcatacttctcgcaaatatccacaacggcccaacttcgctccgttaatcataccgtaagtcatcttatccgccgattcagtctttcatctgaaataaaacaaaaatctttgataaaaacattctatgaacttcgtcgtggaactgcggacacatttaaatacatacctaactttgacaacctagatatatctcagaagcgagaacttgtttcaatgtggataggtaaagataaggcaaaaatgttaagcaatagtgaaatagagcgaaagtttaaatttaaaatagccaattccgcaaaagaacttgaagaagatatttcaggaatatcataa

SEQ ID NO: 1074 - DNA, 546 bp, Xenorhabdus bovienii
  Coding sequence Name=Xb4151_4152.C423.gene35.dna; Position on contig =29474..30019bp; Strand=-
atgcgggacaatatctggtttacatataaagcacgtattaatgcacatcatcgcctggagtggcttgaaaaacactctcagttcatcctcgtttggtatgctatattaagtgcagtgctttcaatcgtgacattacgctttccaaaagtcctagggaataacaccgatattcttgcgacaatactttcggtggctttactaggtatttcacttgtagtttcaaacttggatttccgcggcagagcaatatccatgaggaggaattatcttgcactacagcggctctattctgatactacaattgggcaaccattaacgcttgaacaaagaaaaaaatatcatgaattgctcgatgaagttgagaatcatcttgatatagatgatcaaatcgcacgtgtagcccaggtaggacttacaacaaggatccctaccaagaaagaaaaacgaacagttctaggctggaaaataaagcgattcatatttacttattccttttacctactcccgcttgtttggatagcctatgactgctggtcgaatctttaa

SEQ ID NO: 1075 - DNA, 294 bp, Xenorhabdus bovienii
  Coding sequence Name=Xb4151_4152.C423.gene36.dna; Position on contig =29911..30204bp; Strand=-
atgaaattgtcatactttaaaaggatggggcaggttcttcctcttgcttttgtaagggcggctctgataatgaatagcgattttttgctgttgggcttaggctcactgatcctgcttagcagggtgttcaacggttccaatctttcctgccccttccatatcccaaaaaataaaagggagttttcatgcgggacaatatctggtttacatataaagcacgtattaatgcacatcatcgcctggagtggcttgaaaaacactctcagttcatcctcgtttggtatgctatattaa

SEQ ID NO: 1076 - DNA, 2640 bp, Xenorhabdus bovienii
  Coding sequence Name=Xb4151_4152.C423.gene37.dna; Position on contig =30374..33013bp; Strand=-
atggaaaagcagccaattcaaggtaataaaggcggccgtcagcagccgcgcaccccagtggaagcaccggactccctgcaatccacttcctataccaagattatcctcgcgcttggtgagggagaatttgcgggcgatctggatggtcagcgtatttttctggataacacgccgcttattggctctgacggcagacccaattttgaagggatcaaatgggaattccgccccggcacgccctatcaggcgtatatccccggtatgccagcggttgaaaatgcccgaaccgttagtgcggaactggttagctcatgggtgacgacggtgaccaatactcaactgtcagcagttcgcctgcggttatcgtggcctcagttgcagaggcaaaaagaaaacggggatacagtgggctatcgcattgaatatgccattgacctcgccaccgatggcggcgcttttaaggaaatcctgaaaaccgccgtggatggcaaaagcaccactaaatacgaacgctctcatcgggtggatttacctcaagctcattcgggctggcaattgcgtcttcggcggttaacgccaaaacagaacagtaatcgaatcgctgatgccatggtggtggaggccatcactgaggtgatcgatgccaaattaagctacccggaaacggctctgttatttgttcagtttgatgccaaacagttccgcaatatcccacaaatcacctgcgaacccaagatgcgcatcatccgagtgccaagcaattattatctggaaccccgtcgccgttattatcatggcagctgggatggcaccttcaaatggtcatggagcgacaatcctgcatgggtgctgtatgacctgatgatcaatgaccgcttcagcatcggcacccgggtgaaaacggaaaacctgaatctggcaaaatgggatctgtaccgcatcgctcaatattgcgaccagatggtgtcggatggtgaaggcggtgaagagccgcgtttcacctgcaatgtctatattcagtcacaagaagatgcctgggccgtgttacgtgacattgcggggatcttccgggggatgactttctggtccaataataacatgaacgtgctggcggacatgccgcgcgatatggattacctctttacctgtgccaatgtgcgtgacggcaaattcacctattccagtgccagcgagaaaacccattactccacggccatggtgagttggtccgatccgcagaacggctatcaggatgctatcgaacctgtgtttgaacatcgcttaatacgccgctatggtattcggcaggccgatattaccgccatcggttgtatcagccaaagtgaagcgatccggcgtggcaaatgggtgttgcacaccaacgaacatgaccggacagccaatttcaccgtcggactggagggctacattcctttgccaggttaccttatcggtgtgtcggataatctgttgtcaggggtgggaaggagcggtcgtattcaggccgtgccgaggcgatacattatcaccttggatcgggtgccgtcggcaaaagtgggggattggctggttatcaacctgccgtcaggtaaggcagaaagggatctcatttcagcgatcaacggacaggaggtttctgtgtgggatcgtggctatgcctattcagaacaacctgaagtaggttcaatctgggtcattgaatctcgctatgaaccggagcaacctttccgggttattggtatcaaagcgggggaggatggcgtgtcatttgacatcacagcggttgagcacaatcccgacaagtacgcacttatcgacaaggatatccgcattgacgaacgcaccgtgaccattattccacccagtgttcagccggcaccgaaggatgttctcattgacagttattattcactgaatcagggcatcatctccaacacgttgcagatcacatgggatgctgccgacagtgccgtggcctatgaagtcgaatggcgcaaagacaacggtaattggataacggctccccagactactgtacggggccttgaggtaccgaatgttgatgacgggcgctatcaggcgcgggtcagggcgactaatgccgcggcaatatccagtatctggatgaacacacaggataccctgctaggtagccgcaaagagattccgtcggcaccgcagtccctccaaaccacgtcgctactttttggtatccggctggattgggactttgccaacccaacggatgttctgctgaaaacggaaatttgctacaacaaaaacggagaagatgatgacacgctgcagttcgccgatatttcctatccgcaacgaacccatactttgcaggggctggcggctggggagaagctctattttcgggctcggctggtggacaaatcgggtaacgcttctgagtggacatcatgggtcagcggtgtcgcgtccaatgataccggctggatagtagaggccagtcgggatcattttctggacacagaaatcgggcggcgcttacagaatcaactcaatgagcaagccagagtcgatgcgcatcatagccagtccattgcggaaaacgcgcaggccattgagaggcttaatgacattctggaggatattcagcggcgtatgcggtaa

SEQ ID NO: 1077 - DNA, 576 bp, Xenorhabdus bovienii
  Coding sequence Name=Xb4151_4152.C423.gene38.dna; Position on contig =33031..33606bp; Strand=-
atgaacacattacgaaccgtgcggctttacggtgtactggggactcagttcgggcgagtacataaactggctgtctctaccccgcaggaagcaatccgggcattatccgtgctgattaaaggatttgaacacttcctgctgactgccaaagaacaggggctgacctttgctgtgtttaatggaaaacacaatatcagccgagaagagttggtatttgtcgggcaggacgatattcgtattgccccgatgattattggtagcaaaaatgccggtgtttttcagaccattctgggcgcggtgatggtggttgctggcgcatttttgtgggcgaccccgtttggtgcgccaatggtcatgtccggggttggaatgatgttgggtggcgtggtgcagatgctctcacctatgccgggcgggctggcacgacgtgaagatcccgacaacaaaccctcctatgctttcggtggtccggtgaacaccgtggcacagggaaatcctgtgcccattggctacggcagacgccgtattggtggtgccatcatttcagcgggtatctactctgaagaccaacaataa

SEQ ID NO: 1078 - DNA, 747 bp, Xenorhabdus bovienii
  Coding sequence Name=Xb4151_4152.C423.gene39.dna; Position on contig =33603..34349bp; Strand=-
atgacaatcctgcgaaaatccacgacccgcgccatcatggcgcatgctcagtccacctatccggatgaatgttgcgggctgatcattcaacagcatcgtcggcagcattatcttccctgtcgcaacaccgcactgtcacccacggaacagttcagtattcaccctgaggattatgccgctgccgaagacaaaggttcaattattgccattgttcacagccaccctgacgcgaccacacagccgagccagttggatatcgcccagtgtgacctgtcacaaattccttgggtgattgtttcgtggccagaaggggatatccgtaccctgatgccaattgaaggcattaaaccactcattggccgcccgttcgtgcacggtatctgggattgttatgccatcgtgcgtgattggttcagactggaacgaactattgaactccctgattttgaacgtaccgatagctggtgggttcggggcgaaaatctgtatatgaaacagtatgccgctgccggatttgtcgcgtgtcgcggtgaattacagacaggggatgtgatcattatgcaggtgcaggccaatgaacccaatcatgcagctatttatctgggggacagcctgatgctgcaccatctgtatggacagctcagcaagcgagaaccttatcatggctactggcaggaacgtaccatcatcactttgcgttactcatccgcttcagcggattttttgtttagggaagtcacttcatga

SEQ ID NO: 1079 - DNA, 738 bp, Xenorhabdus bovienii
  Coding sequence Name=Xb4151_4152.C423.gene40.dna; Position on contig =34352..35089bp; Strand=-
atgacaatcaatgccactctccagcaacttgagccggggagcaaagtcttattgtttgcagttgacggttcagcgtttggtgggccagagctgtattttcacaatcaccctatcgtttacaccggggccgaactggaaagtgcagataacttacccgctaaatccctctggtggcagggcgtcgaatataaaccgtggcccgtcagcattgaaggactggaagttactggcgatgggcgggcggtgacaccgaccctcaatgtggccaatctggacggctcgctcagtgcgttatgtctggcttaccaaaacatggtgcaagcgcgtgtcacgatccgcatgacctttgcgcattatctggatgcccgtaattttcccggcggcaacccgcaagccgatccgacacaggagaaaatcgaggttttctacatcgacagcaaaacgcaagaagataacgaaaacattcagttttccctctcctccccagccgatttacaaggcattaaaatcccgactcggcaaattcatagcttgtgtacatggtgtatgcgtggacagtaccgccagtcgccgtgtggctacaccggcacccaatattttactgaaagaggtaagccgaccgatgagccggcggcggatgcctgcgggggactgatgagcgattgtaaaaaacgttttggtgacacggaacagctgccttttggcggcttccccggttcagcgttgctgaggcgataa

SEQ ID NO: 1080 - DNA, 336 bp, Xenorhabdus bovienii
  Coding sequence Name=Xb4151_4152.C423.gene41.dna; Position on contig =35101..35436bp; Strand=-
atgatgataaaaacctttgatttccctgcaagggtaggtacaagtggggagtttgagcctattgtgcgtaccgtccagtttggtgatggttataaacaaacgtcaggcgatgggatcaacacgcagcgagaaagctggcccttgtcttttgtcggggcacagtcagacatacagcctatcatggattttttgcgtgaacatcagggctggcgctcattcaaatggcgtaatccgttatctgaacttgggttatatcaggcgggaaaattcactattcaggccaatggtacttatttcaccctttccgtgacatttacccgcatttatcacccttaa

SEQ ID NO: 1081 - DNA, 3336 bp, Xenorhabdus bovienii
  Coding sequence Name=Xb4151_4152.C423.gene42.dna; Position on contig =35433..38768bp; Strand=-
atggctaatttatcgacattaacggtcggcttgctggtcaatgccaccgcatttaagtcccagatgatggatgcctatcgttatgccggacgggagtctgaacgttttaacgataaatcggtggcagatgccaacaaggtgaaaaagagctatagctctctggcatcacacattaaatctgtgtccgggcaactggcgttactggcaggaatggggttttcactgagcagtatgatttcccatacccgccaatatggtcaggcattgtccgacctgtctgccattacgggtgccacgggtgcgcagttaaagaaactggatgaaaccgcccagcagttaggccgaaccaccgaattcggggcaaccggtattgccaatgccctgaaattaatggcctccgcgaaaccggaattgctgaaaaacacggcagcgctgacgcaggcgacggaaaaagcggtgattctggcgcaggcgtccggtatcgaattacctgaagccaccaaagcactggcgttatcgttaaatcagtttggggccagcgctgcgcaggcagatcgttatatcaacgtactggccgccggcgcaaaatacggttcgtcggaaattaacgaaacggcgcaggcgattaaaaatggcggaacggtcgcggcacaggccgcgataagctttgaagcactgaatgctgtgatccagatattggcggcaggcgggataaaaggcgcagaagccgggaccgcgatccgcaatattattctggctctggagaaatccaacgacaagaaactcaagccttcggtggtggggctgggatcagcactggatcaccttaaaagcaaaaacctgtccacagcggaagccgcgaagctgttcgggcgggcgaatatcagtgccgcgtctcagttggtggtgggtcgtggcaagctggatgcgttaacgcagtcactgaccgatacccgggtcgcctatgatcaggcatctgaacgggcgaataacctgagcgctgatctggatgtgttagccagtgcctttgagggaatggcgattaaaatcggccagaacgccgatggtccgttgcgtagcggggtacaaaatgccaccagcgcgatcaatgcgttgtccgaaaactttaatctggttgccagtgtggcattgcatacgttaattcctgtgatggcgactaagctgactgcgggattacgtgaaaatattacggcatggcgcgccaccgaaaaagccgctcgtgatgttgctaaacagcaggcagaaaccgcaaaacggacaattgaacaggccaatgccacgctgcgttcaacggaagcacagggcaggcacattaaatatctggaaagcacaaatcgcttgcacggtctttccgtcaattacgcaaaagaaaaaagaatcctgatccggcaggaaacggaagctctcaaattgcaaacacaggcaaccgggcaacttgaagcggctaaccgccggctttcttattcctatcgggcattatctgccgccgggggagttgcccgtggcgcacttgccatgattggtgggccatttggtgcagcgatgttggtgggttcagccttgtatggattatatcaccatagcgttcaagccagagaggggttgcggcacttaaaggatgaaaccgttgaaacggtggctggactgcaacgtctttccagaattaaggtggaagtcgagcttgataaaactgacgatgatatcaaccacctgaaagaagaactcaagcagattgatagccaactggaacggtattctcaaacccgaatcaagcgattacaaaatcgtcgaaaagggttcttgagttttctttatgaagatccgaaagaagttgaaaagcaaggtcgggtattactcagtcgaagagaagatatcctcaaagggatagaaaataaaacagcaagaaagaaaaacctacaggcaacatcggtagcgggtatctttgaccaaccaccgccggagccgccaaaacccgaggggaacggcacgggtaatccgtggacaggccaagatctcatcaaagaagagaaacaaggcaaacaatcacttaacctttatcagcagttacgtaaggaaattgagcagacccatgccaccagcttggatcgcattcggttcagcgagaaagaaatgctgggtaaaatccatgaagttggcaaatcgggtatggcttcggaaagtgagcttcaacgcttaaaaaccctcaatgccgaaaatcaccaaaagcagcggctggaactggcagaaaagtattctccggcagccgcgttgattcggcaggaaaaagaagccagcgcagagcttaaagccctgtaccgcgaacgattgttgaccgaacaggaatacctgtttgccagtaaaacactgtatcaaacttcggtaaaagacaaattagcagaacaggcgaagcaaatttccgccccgcatctggatatgacgggtgaggttgatcccgttgtgcaactgcaaaatcagctcatagaacaaaccgcgctttacgacacctactaccggaacggacttctcagcaaagaacgtcatgagcagttaataacagcagcggctaatcgctccaaagacgcgcaatttgccgccgcaaaggatttatatgcatcacaaggcgattttcagaaaatgcagatggatctgctggatatggtcgagcaacgcacgggtaactcgttaacaggcatgttgacaggcacaaaatcattttcggaatccatgcgggaactgtcggcatcactggcacaatccatcattcaggatctgatccgtattgcgatgcaggcactgataaccaaagctatctctggtttctttgggggcgcaatgggaggtatgggagccagcgcattgtcttcagcgggaggcggcctgtcttcagtcggttctggaacaaccattaccccagatgtctggaagagtcccatcatgaatgcgaaaggtggcgtttatcaatctgcggatttaagtcagtacagcgggcagattgtcagtagcccgaccttgtttaagtttgccaaagggggcggagtgatgggggaagcgggacccgaagccatcttgccactcaaacgcggtactgacggtaagctgggtgtgcaggccaccggcagtacggacaaccaaaccttcaacaccgtccatattgtgatccattccgatggcacccatgacacaaaaacatctcgtggtgcggaatcagcggggcaggatatcgcgaaatttgtcgatcaacgattcaaatttttactgcataaaagtctaagtcaaggtggtgaactcagtgcggcgattaaaggaggccgatga

SEQ ID NO: 1082 - DNA, 93 bp, Xenorhabdus bovienii
  Coding sequence Name=Xb4151_4152.C423.gene43.dna; Position on contig =38987..39079bp; Strand=-
atggcgatccacgataacgccaccctgattgaagccattcagaccgtgaagcgtcacgccatcggtacactggaggaggccgaaaaaaactga

SEQ ID NO: 1083 - DNA, 354 bp, Xenorhabdus bovienii
  Coding sequence Name=Xb4151_4152.C423.gene44.dna; Position on contig =39042..39395bp; Strand=+
atggcttcaatcagggtggcgttatcgtggatcgccattaactcatcggtggtgggcaagtcagccttatcaatgggttttcccttatcatccaccagacaatccagcaccatctggatattcaggcgggaggcctcgcgcccgtttccggcatcacttaacgtttccgctttttcttccagttccagtaattccagtgccgtcatccggcgcaggttgatttgggtgccaaatagcgccaccgctttaatctgtggacgcggggtaagtaaggcggctttcagtgttttcattgggtcactcctgttttggtgtcagcgataccccagacgaggttgttttgtttgcccttga

SEQ ID NO: 1084 - DNA, 462 bp, Xenorhabdus bovienii
  Coding sequence Name=Xb4151_4152.C423.gene45.dna; Position on contig =39331..39792bp; Strand=-
atggcaacttcacccgaatacgccgtactgccagcgggtacactcgtgaaatttggcaaacccggcgacagcgtggaacagatgaaaccgctgattaactgcaaggcattgggtgccactgggctaacgggcagttttgtcgactgcaccaccctgatggataccaataaacagtttatttccgatatgccggaggggccggaaaaatccctcggctttattgatgatccggagaactccgattttgtttctttcctgaacgcggctgaaaagcgcgacacggtgcaattttacatcgccctgccgaataagcgcaccgcgacaatggtgctggcactgtccggctgggaaatgaacgacattaacgccccggcgagtgaagtgattcaaatcaccgtcaagggcaaacaaaacaacctcgtctggggtatcgctgacaccaaaacaggagtgacccaatga

SEQ ID NO: 1085 - DNA, 558 bp, Xenorhabdus bovienii
  Coding sequence Name=Xb4151_4152.C423.gene46.dna; Position on contig =39804..40361bp; Strand=-
atgggagtcggtgcaacacgggtttatcggtcattatccggtacaggtcgtgacgcgcggtgcactgtaccaaaatgcagaagaactgacggaaaatcgcaagcgttaccgtatcacacgggactttatcatcacttacacggagcatctgacatgatcaccgcaaaaacaacgggatggacggaattggggcacaaattgcaggcgctggacagtgatctccagactcaaatcctgcgcaaaaccggaaaagttgccatggaaatcgtcaaagaagatatggaagcccatgccggctatgaccgaaaaagtgagggtccccatatgcgggatgccatccagatccgttcgacaaaatcgaaaaaatacaaaggcggagtaattatcaaggttggcccgacaaaatcccatcgcataaaagcattggcgcaggagatgggcacgattaagcaggtgccaaaaccctttatccgtccggcgctggattacaacaaaaccactgttattaaagtgctcgcgcaggaaatccgcgatgctttatcagggtacagtcaatag

SEQ ID NO: 1086 - DNA, 396 bp, Xenorhabdus bovienii
  Coding sequence Name=Xb4151_4152.C423.gene47.dna; Position on contig =40205..40600bp; Strand=-
atgtgcgtcatgatagaacctgaacttcaatccgatttaacgcgattaaccgaactgcctgtctatccgctgatactgccgtccagcgtgttagagggcgtgacctaccagcgtatcagtgacgcgaaattcaattctggactggcggcgacacaactcattgaggctcgctttcaaatcagtcttatcctgcatgactataaaaaagcacttaagctggaaggtaaaatttgctcagcatgggagtcggtgcaacacgggtttatcggtcattatccggtacaggtcgtgacgcgcggtgcactgtaccaaaatgcagaagaactgacggaaaatcgcaagcgttaccgtatcacacgggactttatcatcacttacacggagcatctgacatga

SEQ ID NO: 1087 - DNA, 414 bp, Xenorhabdus bovienii
  Coding sequence Name=Xb4151_4152.C423.gene48.dna; Position on contig =40578..40991bp; Strand=-
atgaaaatcgggaggcacagaccttacccactggatttaaagcgttgctggaaccctaccgttttattccgctataggagaatgccgatgaaagccggctcacttcgctatcgcattaaactgtttcgccctgtcaaaaaccgtgatgatctgggtgctgaaatcattgggcgggaatatgtcactgaaacttgggcacgggcggaagccatgtccaaccacaaaatccgcacggcggatcagcaacacgtgatcgaagtgcaacaatttacggtcaggccaagaaaggacgttgaacctaactggttggttgaacatcagggacggctatttaccgttcgcgccgtagaccgcaaccgcaccgaccgagccattattaccacggaggcggatgtgcgtcatgatagaacctga

SEQ ID NO: 1088 - DNA, 156 bp, Xenorhabdus bovienii
  Coding sequence Name=Xb4151_4152.C423.gene49.dna; Position on contig =40915..41070bp; Strand=-
gtgccggagggtgatccggatggcctgttagcaaccgacgatgtcacattggcgattatgctagcggtgggttactggtatgaaaatcgggaggcacagaccttacccactggatttaaagcgttgctggaaccctaccgttttattccgctatag

SEQ ID NO: 1089 - DNA, 198 bp, Xenorhabdus bovienii
  Coding sequence Name=Xb4151_4152.C423.gene50.dna; Position on contig =41135..41332bp; Strand=+
ttgtctaataaatcatcttcggtatggttatcactgtcgatacggcactgctgccggagcagctcaagtgtgggaaaaggcatgtcatctcctgataatacggtgactacgccttatcttctgctactttcagcagtttcacggcgttgctgtccaccagcagggaaccaacccgcctggtggtgtagaagtgaataa

SEQ ID NO: 1090 - DNA, 1212 bp, Xenorhabdus bovienii
  Coding sequence Name=Xb4151_4152.C423.gene51.dna; Position on contig =41241..42452bp; Strand=-
atggctattgaagtcaaagatgtacagcaggttgcgcaggaaattcagcagcgtttcgacgaatttcggcagaaaaacgaccagcgcattgaggcgattgaggcggaaaaaggcaaactggccgggcaggtggaaaccctgaacggcaggctgtctgagctggatgccctgaaaaccgcactggaagaggagctggccgggctgaaacgtccggcggggggcagcaataacaaagccgtgaatgagcataaaacggcgtttgcccagtttatccgcaagggacgggaagacggactggccgagctggaacaaaaagccatgcagaccacggctgatccggaagggggctatgccgtaccggaagaactggatcgcagcatcatcagtgctctgaaagacgaggtggtgatgcgtgctgaatgtcatgtggtgtccgtcggtaatcccaactttaagcggttgatcaatcagggtggcaccaacagtggctgggtcggcgaaaccgatgaacgcccggaaacgaaaacaccgaagctgacgcccatcgaaccaacatggggtgagatttacggtaatcccgccgccacccagaccatgctggatgatgcctttttcgatgtggaagcctttatctcgtctgaactgacacaggaatttgctgaacaggaggaaaatgcttttacccacggtgacggtaaaaataaaccgaaaggcttgctggcctatggcagtgatgcgcaggaagataaggatcgcaaatgggggacgttgcagcaccgattgctgaaaaagccgaccacagtcacggccgacgacatcatgcagttgatctacaccctgcgcaagccgtaccgcacaggagcgaagtttatgatgaacaacaacatgttgtttcaggtgcgtaccctgaaagacagccagggcaattatctgtggcaacccggtctgcaactggggcaaccctctgcgctgctgggctacggtattgcggaaaacgaacaatttgcggatttgggggcgggtgcggtgccggtggcgttcggtaactttaaacgctgctacaccattttagatcgcatgggtgtgcgtatgctgcgtgatccttacacccacaagccctttattcacttctacaccaccaggcgggttggttccctgctggtggacagcaacgccgtgaaactgctgaaagtagcagaagataaggcgtag

SEQ ID NO: 1091 - DNA, 657 bp, Xenorhabdus bovienii
  Coding sequence Name=Xb4151_4152.C423.gene52.dna; Position on contig =42465..43121bp; Strand=-
atgccgatgatgaccaaacaacggcttgatatgcccctgaaaattaaatctgtcagtgattccggcgagtttgaagggtatggctcagtattcggactgaaagacagtaccgacgatatcgttttacccggtgcgtttgccaatacgctgaaacaatggggcgaaaaaggcagcttaccggccttgctctggcagcaccggatggatgaacccatcggtatctataccgaaatgaaagaagacgaaaccgggctgtatctcaaaggacggctgctgattgaggatgacccactggcaagacgggcacatgcccatatgaaagcgggttcactctccggcctgtctatcggttatgtgctgaaagacggggagtatgaccggaccaaagcggcttttttactgaaagatctcgatttatgggaagtgagtctggtgacctttcctgccaacgatgatgcccgggtcagcaacgtcaaatcagccttggcgcgtggtgatattcccacctctgattgcatcgagcgggtgctgcgcgatatcggtctttcccgtacacaggccaagtcttttatgtcagcgggttacagtgcgctctccttgcaggacgcagaagccgccaacgcattaaccgcactgaaatcattacattttaactaa

SEQ ID NO: 1092 - DNA, 1233 bp, Xenorhabdus bovienii
  Coding sequence Name=Xb4151_4152.C423.gene53.dna; Position on contig =43093..44325bp; Strand=-
atgttttttcccggactgtttcgtaaatctgccgacccgctgacttcccgtgagttaagtgagctgattggcttgtcttatgacacctacagcgggaggcgagtcagcccacagttagccatgcagttaactgcggtgttcagttgtgtgcgggtgctggcggaatccgtcggtatgctgccctgtttgctgtatgaacaattagaacgtggcaatcggcgcgccgttaacgagcggctgcataagctgctgtcggtcaaccccaatcactacatgaccccacaggaattctgggagttgctgattgcctgcctgtgcctgcggggcaatttctacgcttacaaagtcaaagcattgggggaagtggtggagctgctgcccctcgatccgggcagtgtgacggcgaaactcaatcacgactggcaacctgagtatcaaatcaccttcccgaatggagaaagcaggacgctgatgcaggatgaactctggcatgtgcgaatttttacactggatggcctgaccgggttaagtcccatcacctatgcccggcaagccatcgggctgggattggcgaccgaagagcacggttcacggttatttggcaacggtgctgtcaccagtggcgtattgcaaacagatcaggcactgaaagacgaggcgtatcagcggttgaaaatggattttgaagcccgccatcaggggctggttaatgcccataagccgatgatcctggaaatggggctgaaatggcatcaaatcagcctgtccgctgaagatgcgcagtttctggaaacccgtaagtttcagcttgaggaaatctgccgcatcttccgggtgccgttgcatatggtacagaacaccgaccgtgccacctttaacaatatcgaaaatctggggatcggctttatcaactactcgctggtgccttatctcacccggattgaacagcggattaatgctggtctggtcaattccaataaacaggggcggttctacgccaaatttaataccggcgcgttgctgcgcggggatatgaaatcccgctttgaagcctacgccaccggcattaactgggggatttacgcgccgaacgaatgccgggagctggaagaactcaacccccgcgagggcggtgatatttatctcacaccgatgaacatgaccacgaaacctgaacaagtcccgaaaaaagaggaagaacgccatgccgatgatgaccaaacaacggcttga

SEQ ID NO: 1093 - DNA, 177 bp, Xenorhabdus bovienii
  Coding sequence Name=Xb4151_4152.C423.gene54.dna; Position on contig =44325..44501bp; Strand=-
atgaaaggattaatgattgctgccctgctaatcgggctggcgggcggcgttttgctgtcttacggcgcatggctgttgttaccggcggccggatttatggtgtctggcgtgttgtgcctcggctggtcgtatctggtttcacgtatgttgagccaaacactggataaggaagcctga

SEQ ID NO: 1094 - DNA, 1731 bp, Xenorhabdus bovienii
  Coding sequence Name=Xb4151_4152.C423.gene55.dna; Position on contig =44511..46241bp; Strand=-
atgagccgcaaatcttatctgaatgtcaatacggcgaaccaatatgcccgtgatgtcgtgcgtggcaaaattgacgttggtcgctacgtcagagaggcctgtcagcggcatctggataatctgcatcaggaaaagagccggcagttcaactatcggtttgataaggatctggcagaacgcgccgcgaaatttatccagctattgccgcataccaaaggcgaatgggcatttaagcggatgccgatcacgctggaaccgtggcaactgtttattgtctgctcggtctttggctgggtgcataaaggcagccggttacgccgctttcgggaggtgtataccgaaattccccgtaaaaatggcaaatcggcgatttcagccggtgtggcactctattgttttacctgtgataacgaattcggtgcggaggtttattccggcgcgaccacggagaaacaggcgtgggaggtattccggcctgcgcgactgatgtgcaagcgtaccccgctgctacttgaggcgttcggcattgaagtgaatgccgccaatatgaaccgcccggcagacggggcgcggtttgagccgttaattggcaatcccggtgacggtcagtcccccagttgtgccattgtcgacgaatatcatgaacatgataccgatgacctgtataccaccatgctcacgggaatgggagcacgacgtcagccgctgatgtgggcgatcaccacggcaggttacaacattgaagggccttgctatgacaagcggcgcgaagtgattgaaatgctgtccggtaatgtgcccaatgaagagctgttcggcgtgatctataccgtggacgagggggatgactggacctcaccggacgtattgcgcaaagccaatcccaatatgggcgtctcggtctatgctgattttttgctgagccagcaacaacgcgccctgaataacccgcgtttagccagcgtattcaagaccaaacacctgaatatctgggtgtctgcacgggaggcttatttcaatatggtgaactggaaacagtgcgaagacacttcactgacgctggaacaattcgcaggtcagccttgttttctggcttttgacctcgcccgtaaactggatatgaatagcatggcgcggcttttttcacgtgaaactgacggcaagcgtcatttttacagtatcgccccacgtttctgggtgccgtatgacacggtttacagcgtggagcagagtgagaaccgccgcagtgccgaacgttttcagaaatgggtggaaatggatctgctgaccgtgacggaaggtgctgaagtggattaccgctatatccttgaagaagccaaactcgcctgtcacctgaacccggtcaatgaagccccgatcgatccctttggggcaaccggcttatcgcatgcattggcggacgaagggattaatcccattatcattacccagaatttcacgcatatgagcgatccgatgaaagagctggaggccgccatccagtccggtcgtttccatcatgacggtcatccgataatgtcctggtgtctcggcaatgttgtcggaaaaacgctggctggcaatgatgacattgtgcgccccatcaaagagcataaagacagcaaaattgatggcgcggtagcgctgataatggcgatggggcgggctattttgcatgaagcccccagtctctcagatcatttgatctcccacggtgtacgctcactctga

SEQ ID NO: 1095 - DNA, 495 bp, Xenorhabdus bovienii
  Coding sequence Name=Xb4151_4152.C423.gene56.dna; Position on contig =46238..46732bp; Strand=-
atggcgggaacgatgggtaagtcaggccgtcgtcccaagccaacggcacgcaaagaactggcgggcaatccgggcaagcgcaagctgaaccgggatgaaccgagctttacgccactgaccggagtatcacccccggattggtttgctgaaaacgagatgctgctggctgtggtgatgtgggaactgaccagcaaagagctgtgcgcccaagggttactctgtgtcacggatcttgcggtgctcgaacgctggtgtgtggcttaccagttctggcgcaatgctgtgataaatatcgcccggcagggtaatacggtaaccggtgcgaccgggggacccattaaaaacccggaactgactgccaaaaaagaacaacaatctgaaatggatactaccggcgcgatgctggggttagatccaagcagccgccagcgcctgataggtgcggcgggtcaggccaaaacggacaatccatttatgaggatgatctcatcatga

SEQ ID NO: 1096 - DNA, 156 bp, Xenorhabdus bovienii
  Coding sequence Name=Xb4151_4152.C423.gene57.dna; Position on contig =46656..46811bp; Strand=+
ttgcccggattgcccgccagttctttgcgtgccgttggcttgggacgacggcctgacttacccatcgttcccgccatacgcagcccctcccggcttaaaaatggtgaaagatcagtaaaaagcacccgatttaaatttcatttttcgcgggcataa

SEQ ID NO: 1097 - DNA, 135 bp, Xenorhabdus bovienii
  Coding sequence Name=Xb4151_4152.C423.gene58.dna; Position on contig =46786..46920bp; Strand=-
gtgaatattaatttcaaaagtaatcatttcgaatttcatagtcacaagaggagggcgggtaaaatccctacccctctcgcccccaaggaccgcccccttggggctttttttatgcccgcgaaaaatgaaatttaa

SEQ ID NO: 1098 - DNA, 351 bp, Xenorhabdus bovienii
  Coding sequence Name=Xb4151_4152.C423.gene59.dna; Position on contig =46928..47278bp; Strand=-
atgccaccccgtattccaagagcctgtcgcaaatcaggctgccctaagaccaccactgaccgtagcggctactgtattgaccaccagcacaccggctggcaacgctaccagcagggcaagagccgacatcaacgcggctatggcagccaatgggataagttaaaggttcgtgttaaacaacagaataaccacctgtgtcagtactgtttacggcagggacgagtggtcacaggcaccaccgttgaccatatccaacccaaagcgcatggcggcactgatgcgttaagcaatctacagctattgtgtgaagcctgccatcgacagaagacagccacggagcgattacgctga

SEQ ID NO: 1099 - DNA, 312 bp, Xenorhabdus bovienii
  Coding sequence Name=Xb4151_4152.C423.gene60.dna; Position on contig =47408..47719bp; Strand=-
atggagcatataaaaagtaaagattttaaatctgagcgagcatgggattctcggttgatctcgaatcttgatggcgttaccgtaaaacttcattggactaaccaaccttatatatggcatatcaacgagggtgaagaagtgtttgcggtcatggatggaaatgttgatatgcactataaagaaaaaggacaggaaaaaatcgccaaattaaaaacaggagatatattttacgcttctattggcactgagcatgtagcttatccaataggtgaagcaagaatattggtaatagagaaagaaggcagtatttag

SEQ ID NO: 1100 - DNA, 474 bp, Xenorhabdus bovienii
  Coding sequence Name=Xb4151_4152.C423.gene61.dna; Position on contig =47830..48303bp; Strand=-
atgaagctcaatttcaccaagggtacggttattgcgttgatgattgcttcagccgcaaccttcttataccgctctgaatataagaaacagctcggtattaataacgagcagataacagaaatccagcaactgactgacaccattgattatcagaatacgcatattgaaatgctgcatggattggatagcaaacacactcaggaactcgccaatgccaagattgaaatcgatactcttcgggctgatgttgccgctggtcgtcgcaagttgcgcatccaagcagcctgtcccgtgcctgaaaccactccctccagcagcgtggtcgatgcaaccaccgtcgaactcactggagaaactggatcagctgttctcgatatccgggaaggcatcatcaacgaccgagcaaaattaaggtatttacaggaatatgtgagtactggatacagaggaaatcacggaaaaccaacaccataa

SEQ ID NO: 1101 - DNA, 435 bp, Xenorhabdus bovienii
  Coding sequence Name=Xb4151_4152.C423.gene62.dna; Position on contig =48300..48734bp; Strand=-
atggaaatcagcaataaaggccttgagtgtatcaaacagtatgaaggcctgaaactgaaagtctaccccgatcccgcaactggcggcattccgtggacaattggttacggtcataccaaaggggttaaaaaaggtgatgtgattacagagcagcaggctgaagcattcttgcaggatgatctccagcctgtttacaccacattaaggcaatgggttaacgttcctttgaatcaaggccagttcgatgctttgtgctcgtttatcttcaattgcggtagcggtaacttttctggctctactttattaaagaaactcaatcaaggtgattataaaggcgcagcggcagaattttcccgctggaataaagcagcaggtaaggcaatgcgtgggctggataatcgcagggcatctgaacgccagatgtttttatcatga

SEQ ID NO: 1102 - DNA, 495 bp, Xenorhabdus bovienii
  Coding sequence Name=Xb4151_4152.C423.gene63.dna; Position on contig =48718..49212bp; Strand=-
ttgtgcgccaccgtatactgtatagcgtcagtatacgttaagtgtgtgcagtgtcaaccgactttgccaccgcaatcactctcatcacatccgtatacacgcacaggggctaacattactcaccctacagacacccattgctttaacaggggaaatatgaaaatgaaagaaaatcctgatatatgggtacaccttggtaactggtttgtttcaataaaagagcaaggcgttaggtcagtactcgccgggacaatggcctttcttcgcggccgttataacggtggaggttggttaaaggtgtcaattgatgccttcatgtgtgccatgttcgcgtggtttattcgtgatgtcttaaatctgtttggtctgaatcctgatttagcctatatcggcagtgtgatgattggctatctagggacggattttatcggtcaattactgcgtaaggccgcagagaaaaaaacgggagcatcttctgatggaaatcagcaataa

SEQ ID NO: 1103 - DNA, 282 bp, Xenorhabdus bovienii
  Coding sequence Name=Xb4151_4152.C423.gene64.dna; Position on contig =49212..49493bp; Strand=+
atgattaagagttttaaacataaagggttagaaaaattctttaaaacaggctctacagcaggcattcaggcgaaccatgctgtaaaactgaatattcaattaaccgcgttaaacaccgccaaaaaacccgatgacatgaacgcgcccggctggaaattacccccgttaaaaggtgctgatttaaaaggccactgggctgtttctgtcaacgggaactggcggctgacatttcgctttgaaggcgaagatgccattttggttaattatcaagattatcactga

SEQ ID NO: 1104 - DNA, 282 bp, Xenorhabdus bovienii
  Coding sequence Name=Xb4151_4152.C423.gene65.dna; Position on contig =49505..49786bp; Strand=+
atgagcagaatgcataatcccgcccatcccggcattgtcttacgcgaatatttaggcgacatttctgttacagaagcggcaaaagcgctgggcgtaacccgtgtggctttatcccgtattttaaatggcagcgcaggcatatccgcagatatggcacttcgtttagaagcggcattgggaaccagtgccgaaatgtggacaagtatgcagtcccagtatgagttatggcaggcttctcaacaacaacgccccgaaatcaggccgatatttgcacatctataa

SEQ ID NO: 1105 - DNA, 132 bp, Xenorhabdus bovienii
  Coding sequence Name=Xb4151_4152.C423.gene66.dna; Position on contig =49729..49860bp; Strand=+
atggcaggcttctcaacaacaacgccccgaaatcaggccgatatttgcacatctataatgatgaagtggttcggtattgccgaactacttcaactatccagtcataccgatgagttgagtcgtaaacgctaa

SEQ ID NO: 1106 - DNA, 1038 bp, Xenorhabdus bovienii
  Coding sequence Name=Xb4151_4152.C423.gene67.dna; Position on contig =49857..50894bp; Strand=-
atggatctacgccctgtcaccttagtcaacgatgactctctgaaatttatcaaaactctgccggataactgcatcgatttaatcgccactgacccgccgtactttcgggtaaaagcgtgtagctgggataaccagtgggaggacgtcacggcctaccttgcctggctggatgaactgcttgctgaattttggcgagtactgaaaccgaacggcagcctgtacatgttttgtggttcgcgtctggctgctgataccgagctgctggtgcgggaacggtttaacgtgctgaaccagattatctgggcgaaaccgtccggcccgtggcgcaggcagaataaagaaagcctgcgcatgtatttcccggccactgaacgcatcatttttgccgaacattaccagggaccctatcacccgaaaggggatggctattacaagcaatgccaggatctaaaacagtcggtatttaaaccactggttgattattttcgtggttctcgaaaagcgctaggtgtcacggcaaaagccattcatgccgccactgggaagcagatggccagtcactggttcagcgatagccagtggcagttacccagtgaaactgactatcaaaagttgcagggtttgtttgaccgcatcgccaaagaaaagcatcagcgtggcgaactgaacatcccttatgctgagctggtgggttctcatttcaccctgtcgcgtcagtatgatgaattacggcaggaatatggtttaatgcgccgcccattctcggtgacagccgccgtgccgtataccgatgtctggcagtttgcccctgttcagtattacccgggcaagcatccgtgtgaaaaacccgctgatttaatgacgcatattatccagtccagtagccgggaaggggatctggtggcggatttctttatgggttctggggcgacattgaaaaccgcgttgaaactcaatcgccgtgtattaggagttgagttggaagaagaacggtttaagcagactattcaggagatcaacgggcagttgtcaacttag

SEQ ID NO: 1107 - DNA, 168 bp, Xenorhabdus bovienii
  Coding sequence Name=Xb4151_4152.C423.gene68.dna; Position on contig =50821..50988bp; Strand=+
atgcagttatccggcagagttttgataaatttcagagagtcatcgttgactaaggtgacagggcgtagatccatccgcttttttcctctcgacactggcgactttcaggaaaaccacaacacgaaaagccggcattcaccggctgcgctttcacgtcctgggaaatag

SEQ ID NO: 1108 - DNA, 243 bp, Xenorhabdus bovienii
  Coding sequence Name=Xb4151_4152.C423.gene69.dna; Position on contig =50994..51236bp; Strand=-
atgtgtctatgcacaaaaactgaccatgaggttaaatttatcatgctaaaacatgaagatatgacaatgacagccgcctgtgttttagacgccgtgcctttgcatacgtggttttctgtttctgaagtgtctaaattaatggggctgcctgaaccccgttgccaattactgttaacacaatttcgtctggcgggtttaatggaaagccgggaggatgacacgtttttcaaacgttctccctga

SEQ ID NO: 1109 - DNA, 96 bp, Xenorhabdus bovienii
  Coding sequence Name=Xb4151_4152.C423.gene70.dna; Position on contig =51193..51288bp; Strand=+
atgataaatttaacctcatggtcagtttttgtgcatagacacataggtaactctgacccgtcacaacagcaagtcttatgtttatttcaggcgtaa

SEQ ID NO: 1110 - DNA, 138 bp, Xenorhabdus bovienii
  Coding sequence Name=Xb4151_4152.C423.gene71.dna; Position on contig =51425..51562bp; Strand=+
gtgctaacgggatatctttatccatgtccagtgggatatccagcatcattaacatcccttcaatcacgccttaggccttttgtaaccgttttccgatatgcgtatcagaacagtggtgatcatgggccaattgcataa

SEQ ID NO: 1111 - DNA, 309 bp, Xenorhabdus bovienii
  Coding sequence Name=Xb4151_4152.C423.gene72.dna; Position on contig =51495..51803bp; Strand=-
atgcgtgatattcaattagtcatggaacgctggggcgcatgggtggctgataatcgcgacggggtttactggtcctccattgcggcaggtttcaaaggattaatcccgaacagagtgaagtcccgggtacaatgttgtgatgatgacgctatggttatttccagttgcatggcaaaactgaatcagcagtctagtgatgcccatgacctgttgtttgattattacgtctttggtaaaacgtttatgcaattggcccatgatcaccactgttctgatacgcatatcggaaaacggttacaaaaggcctaa

SEQ ID NO: 1112 - DNA, 1362 bp, Xenorhabdus bovienii
  Coding sequence Name=Xb4151_4152.C423.gene73.dna; Position on contig =51822..53183bp; Strand=-
atgaacgtatatgatttggaaatggccgtcatcagtggtttgttatcgggcggggcgacaccggacgcttacgacgtattggcaattttaccggatgaggcgttcagctccgttcatctgcgccgggtgtacggggaaatcaaaaagcaggccctgagcagtaccattatcgatccctttttcattgcggatgcgatgggtgaagaacgcggcattctggctaacctgctggaactggccaagaccccggtctggcaggccaatttaaaaggttatgctgaaaaagtcatgcgttactggcgtgtacgtcaggttactgatctgattaaccgttaccagaaagagattcaggtctgcggcaatcatacgcaagctgaagcactgatcgaggcttttgcatcccagtttaatggattatcccggagtgatagtagcttacaacccgtggtcatcggtacattgctggatagatacgttgaaacactggaagcgcgcaatcagggcaagacaggcatgatcctgacaggtattgagccgctggacgaactgacaggcggatttaacccgactgatctgattttactgggcggacgtccgggcatgggaaaaacggaactggctttgtgcatgattgacggcatgacccgcgacggtggcggggctttgttgttttccatggaaatggcagcgcaacaaattgccgagcgaatggtagcgaattcggctgcgatgccggtgtctaaactcagaaactgtgaactgtatgacgaagactgggggcgcattggcaatgcactcggttcactcattgagcgggatattcatgttctggatgccagtgatctgagtatcgaacaaatttgcgccatcagtgaaacccataagcgtcgccacccgaacttaaagggcattttcgtagactaccttgggttgattagaaaaccccgggctgaccgtcacgacttagccgtggcagaaatatcgaaagcactgaaaggattggcgaaacggctgcataccccggtcacggccttgagccagctctcaagggaagtggataagcgccctttgtatcagcgtcgcccgatagcggctgacttacgtgattccggctcgctggagcaggatgcggatcgcattctctttacttaccgggatggggtgtataacccactcagccccgccagccagtacgcggaaattattctggagaaaaaccgccacgggcaaaccggaacggtttatcaggcattcaggcacggccattatctgccgaccgatcagatatcggctgctgaagtttgccggatgcaacgacaaaccaaacaaaaagaacgccgctatgctgacagggcactttaa

SEQ ID NO: 1113 - DNA, 585 bp, Xenorhabdus bovienii
  Coding sequence Name=Xb4151_4152.C423.gene74.dna; Position on contig =53180..53764bp; Strand=-
atggaaacaatcgatctgggcatattgaaaattgttccccgctttgcgcaggccagctttgccacttaccaaccgcagagcctgagggcagaaaccaacctgaaaacctgtcagggttatgtccagacgtgggaggaacgcaagcgggcaggggaaggcatgatcctgtgcgggcgtcagggcacgggcaaaacccacctcgccgtcgccctctgccgtgaaatcgccacaggcggtgatgaagcggtttttattaccaccgcgtcacgcatcatccgggcgtttcgtcgctcatggaatagcgaaggtgaaatgagtgaatttgacacactgaaattttacagcgagctggatttgctggtgattgacgaaattggtgtgcaatacggcacggagtctgaacgcaatattttgtttgaggtgctgaataatcgctatgaagacctgttgcccaccatgctgatcagtaatttgcctgtgactgagctggcgcagtttttgggtgatcggacgctggacagagtacttcagggtggcacggtattggcctttgactgggaaagctacagaagggaaatcgcatga

SEQ ID NO: 1114 - DNA, 759 bp, Xenorhabdus bovienii
  Coding sequence Name=Xb4151_4152.C423.gene75.dna; Position on contig =53780..54538bp; Strand=-
atgagtatgagtctaatggcgaaggcaatgagtatccgagtgggtaatcccctgagaaaactggtgctgattaagctggccgacaatgcaaatgataaaggggagtgctggccctcatatcagcatattgcagatcactgtgaatgcagcaaaagcgcagtgcgaagccacattgatgccctgattaagatgggcttgcttatcaaggaaaaccggctcggcaatcacaacgggaaagggaatgcctcgaatgtctattacctgaatttatccgctgaccctgtgtcaccaaaaagcataccccctgtgccacctgctggcagctctgtgtcatctgctggcacccccatgccgccagatgacatcccccctatgccatcagatggcaccagaaccagtcactcttttgaacctgtcaaggaacccgtcaaagaacctataaaacccaaaggggccgggcaattcgatcccctgacggccaaaccggaaaacgtcagtgccgaaacgtgggcggattgggtgacgttcaggcaggaaatcaggaaacccctgacggaaaccagttgccgccagcaggctaagcaattggcaggatgtaccaatcctgatgaggtgatttgcacctccattgccaacagctggcaagggttatttcctgacaaaccgagatccgggcgtccaccacaaaccaacacccatactggatttaagcacaagcgttatgaatcacacggcgcgaattggacaaaaaatctttaa

SEQ ID NO: 1115 - DNA, 255 bp, Xenorhabdus bovienii
  Coding sequence Name=Xb4151_4152.C423.gene76.dna; Position on contig =54616..54870bp; Strand=-
atgaaaaacagtgtgataaaaaaagtgatagatatcgcaggcagccaggccaagctggctcaggttctgggatgtgcacaatcgctcatcagcgcatggttatacggaaaaaaacgggtttcggtgtcgttggtacccgatatcgtggttttgtcgaacggggcagtccaagcccatgaactgcgtcctgatctgcctaccgttttcccaccacctgaagccaaagcccatgagtcaattccggtcggtggctga

SEQ ID NO: 1116 - DNA, 180 bp, Xenorhabdus bovienii
  Coding sequence Name=Xb4151_4152.C423.gene77.dna; Position on contig =54792..54971bp; Strand=+
gtgcacatcccagaacctgagccagcttggcctggctgcctgcgatatctatcactttttttatcacactgtttttcattagttcctttctccaacaccacggcaataacaatatcactaacagtcaatataaatcactattggagtgtttgtaaagatatcactctagagatagaataa

SEQ ID NO: 1117 - DNA, 666 bp, Xenorhabdus bovienii
  Coding sequence Name=Xb4151_4152.C423.gene78.dna; Position on contig =54998..55663bp; Strand=+
ttgggtttatcccctgtattccacgtcaatgcgggaaccactcatgaggcacttatgactcttgctgatagattaaaagaagccatggcagataaggggctgacccaatctgctctggcaaaaaaagccggcatggcacaatccatgatatggaaattactttccgggaacgccgtcaaaacaggccggctcgttgatttggccaaggcgcttgacgtgcgcccggaatggctcagtgatggcagtggtcataaatcgcagtctggtgatactgattttgctgtcagacataacaaccgttatgtcccggtaaaaatttatgaagcagaacaagaaaccccggagttcttcatggtgccggccttttttgaacagcaggcccctgttgaatcctgccgggcttatcgcatcacccaaaataccggctgcactgaagcgccggaagggacggtgattgtggtggatacacaggaaaatatcgccaatgatgatttagtctatgcacgcatcggagagcactattcagtttatcgttataaacaagggggggctgtcagctatttgtctgttgacgatacgcgtatccccttgatacctctctcttctgacatggaaatcgtcggtgtgattgtttatttattccggaacatgaagcgaaaacgataa

SEQ ID NO: 1118 - DNA, 93 bp, Xenorhabdus bovienii
  Coding sequence Name=Xb4151_4152.C423.gene79.dna; Position on contig =55873..55965bp; Strand=-
atgatggcagaaataaaggtacgcataaatcctctcgctgactattgtagtgattattcctatcactttgatgcggctaacattatcacttaa

SEQ ID NO: 1119 - DNA, 381 bp, Xenorhabdus bovienii
  Coding sequence Name=Xb4151_4152.C423.gene80.dna; Position on contig =55940..56320bp; Strand=+
atgcgtacctttatttctgccatcatcaataaaccagcaacaaaacaaaaaaaggctatcaacattaatggcattgttgccaatatcgcacaaaaaaacagcctgcatacaggaacaacacctatcacctttttggcagaccaatatcatcagggcaaaaaccagaatcacggcatgggcataaaaaataaagatgaatttaaacatcatatattaacgacgtatcgggtcagcccaaaacatacagaacctgttccttgctataatttagaaccgattgtcgattacggttatgcgctctataagcggagaggacgatatatgcatttaattgatatcattcctctgattaaagcagacaaaaaacactgtcagttataa

SEQ ID NO: 1120 - DNA, 231 bp, Xenorhabdus bovienii
  Coding sequence Name=Xb4151_4152.C423.gene81.dna; Position on contig =56407..56637bp; Strand=+
atgtttcactctaaattcagaacggttacacacaggaagagaacacgaaagaagtctgttatatggaaactgcaaataaaatggctcaaatggagccagaaaaaatatcatcttacatctttatattgggaacaaacaaaatacggagcaatgcctatcagtaatcaaaacaacaagagatacgccctgctggtactgccgatagcccgatcacaagcaagggagttttga

SEQ ID NO: 1121 - DNA, 180 bp, Xenorhabdus bovienii
  Coding sequence Name=Xb4151_4152.C423.gene82.dna; Position on contig =56667..56846bp; Strand=+
atggcgataagatacattaagcgtgaagagatgcaacgactcacaggaaaaagcaaaacaaccctttggagaatgtacgcaaaaagaaatgagtttcctaaaccagataagactgcgggtggaacatttttaggatggactgaagaggtctatgaggcttgggtgagagagaagaagtag

SEQ ID NO: 1122 - DNA, 96 bp, Xenorhabdus bovienii
  Coding sequence Name=Xb4151_4152.C423.gene83.dna; Position on contig =56854..56949bp; Strand=+
ttgacccattacctgacccgttattttgacgggtttttcatttttcactgtaactttttgattttatggtacgccctacaggattcgaacctgtga

SEQ ID NO: 1123 - DNA, 150 bp, Xenorhabdus bovienii
  Coding sequence Name=Xb4151_4152.C423.gene84.dna; Position on contig =57067..57216bp; Strand=+
atgcctgtcccagatctgtcccaaccaattcacccagacaaccccacccaccagtttaccgcccacaatttccccaatccacccaactacccgctaatctcccctattggctatttattgacggctgacgtgacgccgtactcctgctga

SEQ ID NO: 1124 - DNA, 711 bp, Xenorhabdus bovienii
  Coding sequence Name=Xb4151_4152.C423.gene85.dna; Position on contig =57177..57887bp; Strand=-
tatcaattcgagctcggtacccgattttttaacagcaatgccaattcatctgtttcatggacagattcgtatacacagatagcagtatctttattcagtgatgatgaattcaatatcattattggtggcgatttaggctccgtccccctgtattataggcgaagacgctatggcaaatgggatgataaaattgagtttattacgaccaaaaacacgacctttgacggtagcggttatctcaagaaagcctcccccatcatccaaatctaccccgatggcacctttaccactaacgacgaatccgaaggggcgacagtcaccagactcggcctcggtcactacaaactatccggcatccttggctataactcagacggtgcatggggtgttcatggcggtatcagcgttccccgtgacgtcaatggcaatgagttagtgtatgttgatgataaagtgctgccggatggggctattgaaatcaaagtcacacacagacagaacgcgcatatgcctgcccgattacagaacaggcgcatgaagtcagtggatgagccggcttattacacggatgatgaaccctgtgatttaccagccggcacccgattagacgtccgcgtccagatgccggaggattctatctggaaccagaaacaggtattggcatctgatcctcagcaggagtacggcgtcacgtcagccgtcaataaatag

SEQ ID NO: 1125 - DNA, 484 bp, Xenorhabdus bovienii
  Coding sequence Name=Xb4151_4152.C424.gene1.dna; Position on contig =1..484bp; Strand=-
atggattggggtgcatttttaacaacgggtaacggtgttccgtggtggacacccaaaacgacccccctttcttttgtgagaaaagaatcggtctggactgacagatacgtgaagcggatagaaacgggtatcagcacgaaacaaccctgcatggcgtttatgtgtgctcacaccagcaatgtctggtatgcaccttatggggtcatgttcgggggcggttcggaatggggtattgagataacccggggcgagagtggcactgagacttcgatcttgtgtgagatttatctgttcactctggtttatccccagcctgtcccggattggggaattgctgtctgggacgaagcaggaaaatgtgtcattaccagcgatacaaggcctttgagtatcgaaggggaactcagttcccacagcagcaaagaaactgtggtgcaagggaaaaaaggcatattaatgcagaaaacgggttggatactgtcca

SEQ ID NO: 1126 - DNA, 336 bp, Xenorhabdus bovienii
  Coding sequence Name=Xb4151_4152.C424.gene2.dna; Position on contig =469..804bp; Strand=+
atgcaccccaatccatatatcacctcacgcagtgtagtaagcaatcagccatccctcaacggcgtcgtcgttgccatccgaaatgatgatttgattatcctttaccaaaaattgacgttttttatctacccggtcagtacaaagaaagacataagaaagccgcaatccttcattcatcggctcccgggggacagtgagcgcacctgtcgtctgcccgctctccagcttcataaagccagcataaagaaaggggcgaatgccggtattacgctgccgcccctgttcatcccagaccccaaacccgtaatcactcatcgtcgaaattgtcctatatag

SEQ ID NO: 1127 - DNA, 3138 bp, Xenorhabdus bovienii
  Coding sequence Name=Xb4151_4152.C424.gene3.dna; Position on contig =780..3917bp; Strand=-
atgggtaaaggtggcgggggtggcagcacaccaacattagtcgatgacaatctaaagaataaacaatttttacgggttgttgatttgattggtgaggggcaaatagaagggcctgtgggtggactacatgggttcagggttaatggaactcctgtcgttgataaaaatggcaatcccaatattaacggtgtcactgtacagtggcgggcgggtactcaatcccaagagccattaagcgattatccatttgttgaaagcgagattcctgttagtgttgaggtgaaaaaagatactcctattctcaggatggtttcaaataaagatgtggatcgcgtcaggttcactctgggcgttagtcaactggttcagacagacagtaaaggtaatcagagcaatagttcggtgcaactggctattgacgtgaatgatggttctggctggcagcatgttaagaccgttcagataggccccggtaaaattagcggacaatatcttgaatcacacaccattaatgcaccccagaaaaaaccgttccaaatccgcgtctcccgcttaaccgatgacagcaaaacggaccagctccgcaacggtactgtatgggccagctataccgaaattaccgacactctgatgagttaccctaatagtgccgtggtcggtatgcgtattgatcggtcattgtttgcagatacacccaaacgaacctaccacatcaaaggaatgattgttcaggttcccgataattatgatcctgagagccgccattattccggcgtttggacggggcgatttaaacccgcatacacaaataaccctgcgtggatattctacgatttggtgactaatacacgctatggcattggcaaattgatggggtcatttggctgtgacaaattcgcgctgtatgccattgctcaatattgtgatcagcccgtccctgatggatttggaggaactgaaccgcgttttacctgcaatgcgtatatagctactcaacgcaaggcgcgggacgtactggatgatctggcttcggtctttcggggcatgcaggtctggaacgggctgcaactgacctgctttcaggacaggccatccgatccggtctggacatttaccaatgccaacgtggccgaaggaaaatttaactacagtgcagcagcaaagaaagcccggcatacggctatcgaggtgacttggactaacccagataacggctggaaagatgagcgggaaatgattcaggatgatgagttggcagctcgtcttggtatcaatattaagaaagtgacagcattcggctgtactagccggggacaggctcaccgtgtcggtaaatggatcattgaaactgagaaactcgaaacggattcggtcacgttcagtacaggccgggagggaattaactgtattcctggtgacattgttgaaattgccgataacagcttcgcagcggcacgtattggtggacgtgttctctccttctcaggcaaagaggttcgacttgatgcgccagccgaattttcgaaaggcgagtcaggctatttctcctacatgggcagcgaagggaagttcgtccgggtggatatcgaatccgtcagcggggatatgattacactgaaagaagaacctgtcggattgcggcaatggggtgtattttccatatctaaaaagtcgctggtgactcgcctattcagggtgatgagcattgccgaagacaataagacgggtaactacaattatacctgcattcaacacgagccacagaaagaagcgattgttgataacggcgttgattttcaggggagtccagccacacaaaatgttattcgtattcccaatattgagcgattaagtgtcgcttatattcaagacagttctcaggtgcaggctcgcgctatgtgggcgaccacaacaataaaccgaaatatcacctttgatgtggccgtatatcgtgacaataaagtggtatctcgcggcaatactaaggaactggaatattattttaatggtctggatgctggtatctatatggttggcgtccgtgctcgtgatgataacggaatgctgggggatgagtctaaggttcagatggtaattggcactcccgccgccccttctactgtcaatattgagtccggattttttgagttgaaagccattcctcatatcagcgccccaaagactttggatactcaatttgaattctggttttccgagaaccgcatttctaatatcaatgaaattgaagcaaaagccgattttctgggcattgcaaaattttggataaagggccaattgaaagcgggtacaccatattggttttatgttcgcagtatcaatgaatttggcaagtctcattttgtcgaagcggaaggccagccaaatgacaatgctaaggatattttagaggttgttggcgaacagtttctttccaacaaagcaggccagcatctacagtcccaaatggactttaactccgaagccatcatggagaacgccgcattgacaggggcagttgttcagcgacagttgcaagtaaacggcaatatgcgagccgaaatactggaagtcaaaaccacgcaggtgaccgaccgggaagcctttgcggagaagatggaaaaggtgcaggccgatgtcggggagaatgcggcggctgtaaagacaaaggcgacagtggtctttgatattgacggtaacggctatgccctcaaagagattgaagccggggtgaagtacaaaggccagctctataaagccgggatggtgataggggctgaggtgaagaatggcgaagtgcataccaatatcggctttaacgctaacaacttcgtctggttcaatccggccagcggcaagatggaaccctttatggcggctaagaacgggcagctttttattcggcaggcgtttattgatcaggccttaatgcgggaggctatcctgtctgatgccatcagatctaaaaattacgtgcagtatcaggcgggctttttgattaatgcggcgaccggcgcttttgaatttaacgacatgcgggttcgggcgggattgcgttgggcaaacggggcgatagcctgctatgaccccagcggacgggttcgggcggccatgggctatataggacaatttcgacgatga

SEQ ID NO: 1128 - DNA, 594 bp, Xenorhabdus bovienii
  Coding sequence Name=Xb4151_4152.C424.gene4.dna; Position on contig =3917..4510bp; Strand=-
atggtcaagctacagcttggaggccatcttagaagatttggccgtcgctacgaattagaggttcgtgatgcagcggaagccgtcaggtgcttgtgctaccagttgaaaggctttcagcaagcgatttctgatggccttattcgtgttcgcattgctgggcgtgacatgacagaaaaaagtattcctgctggtatgaatcacccccttaatgatggcgatacgatcactatcgttccggttgttggcggtgctggtggtaatggcgttggcatggctattctaggcgtggtagctgttgcggcggcattctatacgggtgggggatcattagctgcatgggcaagtgcgtctggtgcagcagctacagctgctacaggcttagcaattgcgggtgttgccctgatcagtgcagggctggcctccatgttaaccaaaatgcctaaaggccccgaaatgggttcaagcaaaacggatggaaaccagtatttcaactcactggagaaccgaattggacagggttatccgattcctattgcatacggtgagatggttgtgggttctaatgttatttctcaaggcttggagacagaataa

SEQ ID NO: 1129 - DNA, 720 bp, Xenorhabdus bovienii
  Coding sequence Name=Xb4151_4152.C424.gene5.dna; Position on contig =4453..5172bp; Strand=-
atgattgaacgagacattatcgcccacgcgaacgcgaaagcggaaggggtgagggaatcgtgcggcttgatttcaggtggccgctatttcccatgccgcaatatttcgccagatcctgagaactacttcgagattaatcccgatgactggataaccgcagagtgctttgcggatattgacgccattgtgcacagtcatccaaatggaaaaacccgattgagcgcaggggacagagaacaacaaatcaaaaccgggttgccgtggtggttggcctgcggtgatagggtacataaattccgccctgttcctcgtttattgggtcgagagttcatacatggcacacaggattgctattcgctaattcgtgacgcctaccatctcgcgggcatcgagttagcggacattccacgtgacgatgaatggtggaacaaaggccaaaacctgtatctcgataatagtctcagtcagggatttgaacaggtcgatgacattcagtccggcgacatcattttgatttgtctgggtagccagacgccctgtcacggggctatttatctcggcaatcagcaaattctacaccatcggccagatcgcatcagcaaacgcgatatctatgacggttattggctcaagtacacacattcaatatggagacataaacaatggtcaagctacagcttggaggccatcttagaagatttggccgtcgctacgaattag

SEQ ID NO: 1130 - DNA, 684 bp, Xenorhabdus bovienii
  Coding sequence Name=Xb4151_4152.C424.gene6.dna; Position on contig =5177..5860bp; Strand=-
atgcggattgcggttactgaactgagccagaatgccacgcttaatctctatgaaattgatttaaccgctttcgggggtgatatttaccgctttcatgacggtatgaatggaaagttggagccggtcatctggcaaggtgtgcgctatgaggcttaccctgttgaagcgtcgggctttgagatgaacggtaagggtcccagcgccagacctaaaatgatatttgccaacgtcgatgggttcattactgcgataaaccaagatttcaatgatgctttgggagcggttgtgacacgccaccaagtgccggaaatttatcttgatgcggtcaattttcccaatggcaacccacaggcagacccaaccagagaagccgtgagtaagtacctgatagagcagaagcaggattcaaacgctgattttgttacctatgtgctggcgttacccagtgaaaccgatggtgccttgattccggcaagagtgattcaggcggatatctgttgttggcaataccgttctgctgattgtggctatgatggcccaccagtggcagacgagaaggatcagccaaccactgacccgctgaaagatcgatgttcaaagaaatacagtggctgcatttgccgctttccccgccccctatccctgccttttggcggttttttgggtgccaataaattaggttaa

SEQ ID NO: 1131 - DNA, 336 bp, Xenorhabdus bovienii
  Coding sequence Name=Xb4151_4152.C424.gene7.dna; Position on contig =5878..6213bp; Strand=-
atgacaaaaacagaattcaaatggcggcctcaagataactatgaggtcacacatgagccgcgtgtcagggtcgtgaaattcggtgatggttatgagcagagagtcaaagacggcattaacaaccagttgaagcgctatcaactcagttttattgagaaagtggatacagggcgagccattgacgggtttctgcgagccagaggtgcggtggagtcttttacatggctcactagtgacgataaccaattgcgtactttcgtttgtcgttcttggacggtaaacaggcaacaggtgatctggtctatcagttgcacctttgaggaggtagtagcgtga

SEQ ID NO: 1132 - DNA, 339 bp, Xenorhabdus bovienii
  Coding sequence Name=Xb4151_4152.C424.gene8.dna; Position on contig =6268..6606bp; Strand=-
atggtggcaagcagagtacggaaggtaagaatggctaagcatttagagaatgtaatccctatatttaaagatactcccttgccagaaaatgaaaccagtcactctggagggaatggtggaggtggagagatggaaacaagagttaaaaagttagaagaatatgtacattccatcaaagtagatctcgctgtcatcaaatcaaactatgcaacaaaagaagatattgcatcggtgagagttgaagtacaaaaagctattgcaaaccaaactaaatggatagctgcgaccctcatagccacagcgagtattgcaattgccgtatctaaattgattttttaa

SEQ ID NO: 1133 - DNA, 150 bp, Xenorhabdus bovienii
  Coding sequence Name=Xb4151_4152.C424.gene9.dna; Position on contig =6626..6775bp; Strand=+
atgataggcattgaaatacatttcatgactacaattttgacaaatgcccctatatttatatttggctatattatatttacttttaatggatacctcgttaacttctatcggaatgagatagaactcttcatctgtcccgtcagccattga

SEQ ID NO: 1134 - DNA, 222 bp, Xenorhabdus bovienii
  Coding sequence Name=Xb4151_4152.C424.gene10.dna; Position on contig =7134..7355bp; Strand=+
ttgaccattattactgacattgaaattattgacctgattaataactataccaccactaccacctttccccatatccctattactaatcacctgccccctgtcacccggtatcatgtattgatgaccgttattcgctttgaatatttcaggcttattgtcttcaccaatgcgataagcaccgttcggactgactggcccaccatttttacgagcgcccattaa

SEQ ID NO: 1135 - DNA, 582 bp, Xenorhabdus bovienii
  Coding sequence Name=Xb4151_4152.C424.gene11.dna; Position on contig =7698..8279bp; Strand=+
ttgatacatctcattctggcctttccattgttcccattgggcgttagcaaggtcttcttgatacttcttttcgatagcggctctggctgcctcggcctgttctttcaactcggtatgcctctgctcgaaatctgtgatagctgctatttttctatcatgttcattaatgaggttttgtactgggtcgaattccccaagggttttcatggcaggcgatacggcttcattgactttgcgttgtcgttcctcttcttcggccttgtccttaattgctttcatctgctcttggaacgttttttcgtcgatgaggtgcttatcgtacatcctcgtgaggtcatcttcttctttcttccgaagctttgcggaatgggctgcaacatcgagttcagaggctttaattttgtcatcttttgcttggttagccagccaaattcttgcagcaagatcttccgctgcttttatctggagttcactagaaccctccggcatcgcctttcgagcatcatatttagccatctcaaggctgttttcttcgtagccagtgttgaggcgttcaagttcttcgcgttgatctttaagtga

SEQ ID NO: 1136 - DNA, 291 bp, Xenorhabdus bovienii
  Coding sequence Name=Xb4151_4152.C424.gene12.dna; Position on contig =8156..8446bp; Strand=-
atgcgggtgcaaactcaggagatactgaaaagtacgttaatctggttgttaaaaaacaagaagttgatgaagcagccgagaaacgaaaaaaggccgctcaggaggctgaatcagcagctaagaaagctcaagatgaggctgaaagtcgttctaaacagattgcaaactcacttaaagatcaacgcgaagaacttgaacgcctcaacactggctacgaagaaaacagccttgagatggctaaatatgatgctcgaaaggcgatgccggagggttctagtgaactccagataa

SEQ ID NO: 1137 - DNA, 228 bp, Xenorhabdus bovienii
  Coding sequence Name=Xb4151_4152.C424.gene13.dna; Position on contig =8479..8706bp; Strand=+
ttgcctttttcatcaggtatcgatgctatttccaagtccctttcggcattcttaatcatgccttccattttcttattaacttcttttgtatcttcgcctacggatttaattgcgataccaaggctactaagtttaacttttattaaatccactacctccccgtatgttttccctgcattctcccattccttaacgttattagggatttcctttttaccttgctcataa

SEQ ID NO: 1138 - DNA, 183 bp, Xenorhabdus bovienii
  Coding sequence Name=Xb4151_4152.C424.gene14.dna; Position on contig =8832..9014bp; Strand=+
ttgcgcttgtttctcatcatcagtaacagcttgctcggcaaaatcgctatcaagcccgttactcgtgtaataggctatttttatcgctctttttttagggtctttgaatttatcgagttccttctgcaattcatcaattttttgctctgcgtttttggcgtctattcccatctgcttgattga

SEQ ID NO: 1139 - DNA, 213 bp, Xenorhabdus bovienii
  Coding sequence Name=Xb4151_4152.C424.gene15.dna; Position on contig =8935..9147bp; Strand=+
ttgaatttatcgagttccttctgcaattcatcaattttttgctctgcgtttttggcgtctattcccatctgcttgattgatttattcatcttatcaatttcagcagcaacctcttccacactcaaatccttgagtttttctttaacatcgcctaaatttttcgcatattccctcgcaccgtctgatgcctgtttggttttttcatacatatag

SEQ ID NO: 1140 - DNA, 246 bp, Xenorhabdus bovienii
  Coding sequence Name=Xb4151_4152.C424.gene16.dna; Position on contig =9166..9411bp; Strand=+
atggtgataaggccgaaccatccccccacaaaagcgaatgcagatcccagcaatctcaagcccacagatgcctctttagcggcaacaccaacagcagcagtagctaccgctgctactttgccagtagttgccacttctaggttgactattgctaacctagacttagcaatgacgagattatcagtcgctatcctctcagcattagtaccagccgctgctttaagttccgcttctgcaaccatatag

SEQ ID NO: 1141 - DNA, 369 bp, Xenorhabdus bovienii
  Coding sequence Name=Xb4151_4152.C424.gene17.dna; Position on contig =9487..9855bp; Strand=+
ttggcgtgtgatgccctagcatcagccagagaagcttgcgtggatgtgtgcatagctctcactttacctgccagtgcgccattaaatttagcgacagccgctagtgctaccatgccgatagcggtagcaaatacatccagatttccgctcaaattcaccaatgatttattgaatatgttcgctgctgtacttaccttactagactcaccaacgaacttggtgacgttattgttagcgaccacgaacgcctgttctatcgtggaggtagttttagcaaattctttggcgattttatctgcacttgctttcattgcagcgacaactattttggaggttaatttaccttgcgctgccattgcctttaattga

SEQ ID NO: 1142 - DNA, 120 bp, Xenorhabdus bovienii
  Coding sequence Name=Xb4151_4152.C424.gene18.dna; Position on contig =9797..9916bp; Strand=+
ttgcagcgacaactattttggaggttaatttaccttgcgctgccattgcctttaattgaccgatatctttaccaagatagtcagcaatggcttgcattatccttatgccgttctcgctaa

SEQ ID NO: 1143 - DNA, 543 bp, Xenorhabdus bovienii
  Coding sequence Name=Xb4151_4152.C424.gene19.dna; Position on contig =10557..11099bp; Strand=-
atgtcagatatttcaatacagggcgaaccaagagattattataaaattctcataaaaagtgacgatagcgaatgttatcaggccaacaggcgcacaataagagaaataatgaaagttataaatggagctacggaaaagtatcaagagaatggtgattctgatacggttattcaaatgcatcaagattattatgatgcttttgatgttttcattcttaatgagcctgacgatgcaaagatagctatgcgtagcgtgctggcagaagaaatgaaagccaaagaatgtgagcttaatattggcggtggttctataccaaaagtaataggttttctattaacatttattggcctatttgtttgcttttatgcttgcacaatgaatatttcagttgggtattatgacaaggttattaatgctggattagttgcagatcggcagctttatatgacggctggagtgggaatcaccattattggctcgttggcaattttattttcgttgcttttgggtaaaatgggaaaacgatttatagcaagacaataa

SEQ ID NO: 1144 - DNA, 576 bp, Xenorhabdus bovienii
  Coding sequence Name=Xb4151_4152.C424.gene20.dna; Position on contig =11241..11816bp; Strand=-
atgaataaaattacagttgatgctagattagaatcaagaaaccgattcaaggtggttaagcctcatgaaaactcagatgattatgaatcacagcaatctaaaattggtggcagtggtggaggtggcggtatggaatcacgagtagcaagacttgaatcagacgttgaacatatcaaaactaccatgaacgatatgaagtctgacctgaaaacagttaccggtgatgtcggcacaatgaagactgacgttgctgttattaagcaaaaattagacgcaatcgacagcgctctatctaagaaaccaagcgaagatcagcttgatgctagattaacaaagacagagaacagatttgactctaagctcacagaagtagagaacagatttaactctaaattcaaagagatggacaataaacttgataatgcaatatctcgaattgagtcatctcttgagaaaaatgcattatcttttgatggtaagttgaaagatgcacgtttaagtttaatcctctggattttaggtctgcctggcctattgtttgtcatctatcgactatacatatcatttttaggctaa

SEQ ID NO: 1145 - DNA, 417 bp, Xenorhabdus bovienii
  Coding sequence Name=Xb4151_4152.C424.gene21.dna; Position on contig =11809..12225bp; Strand=-
atgaagggaaagacaatgaataatgaaagaatagcgtttattcacccgtataatcctgatagcgatgaacagccattgcttgtttttgagtgcgaagaattaccatttattgttgattttcatttcaaggttttcatgattaatttaaaacatgatgagccgtattacatacaaagccagttgtttagggttacagattcgaaccaaacagaagtgtgtgataaaaaaggcttttggatgaaaacagaagatacgcaggggaagccagatgatatcgctgcatctatcaggctcagttttctcaagtccatgttttcatatgagggcacgtatttcgttaggactggcattctagtcaataacgaggaaattgatggcaatgaggcctactttaaagtgagtcttgtaaatgaataa

SEQ ID NO: 1146 - DNA, 261 bp, Xenorhabdus bovienii
  Coding sequence Name=Xb4151_4152.C424.gene22.dna; Position on contig =12210..12470bp; Strand=+
ttgtctttcccttcatacatccgcttgattgttttcataaacaactctttgaacttctcagactctaactgcacaagttcgtctatgttctttggttttgattcttcgtctacagcagtttgtaagatcatgaccatttcagaattaagggagcgcccgttcttcctcgctctatcggtcagcttttcctttaattcgtcaggcatccttatgctgtacggactgatatctctaactttcttcattgaacttagccattaa

SEQ ID NO: 1147 - DNA, 270 bp, Xenorhabdus bovienii
  Coding sequence Name=Xb4151_4152.C424.gene23.dna; Position on contig =12471..12740bp; Strand=-
atgaaaaagtacaacaaagaagtatttgaacagatctcaaaactacaatgggtattggatatagcccaagagtatgaaggaatttgtttatttactgaagacacattaaccattgattattatgatgaattttgtcaatgttcagtgcatcttggatttgatgatcagtttgcaataagggattcatttggtaactggcggcaaacaagtgcagaagagtgtattgagcttagagaaggaaaactaaagggatcaatgaagttaatgtga

SEQ ID NO: 1148 - DNA, 249 bp, Xenorhabdus bovienii
  Coding sequence Name=Xb4151_4152.C424.gene24.dna; Position on contig =12628..12876bp; Strand=+
atggttaatgtgtcttcagtaaataaacaaattccttcatactcttgggctatatccaatacccattgtagttttgagatctgttcaaatacttctttgttgtactttttcataattgcgctcttacttttatttgactatttgcagtgttactcagtaaagatgcaagttaaagcaaaacaaatatattatatgatgttgcatgcacttaacgctatattagttgacagagtacaagtttacttataa

SEQ ID NO: 1149 - DNA, 213 bp, Xenorhabdus bovienii
  Coding sequence Name=Xb4151_4152.C424.gene25.dna; Position on contig =12903..13115bp; Strand=-
ttgctttatttcgatattgagttaccactaacaaagagtggtgtcaggaggttcgaaacggtgcaaaagagaccgcggacttattcccctttcgggtgttgtattcgtcgccctcccgactttgaatcggagatatggttgatcaatcaaccattaaaatttaggcataaaaaatccaacactgacggggttggctctgaccgcttttgctga

SEQ ID NO: 1150 - DNA, 771 bp, Xenorhabdus bovienii
  Coding sequence Name=Xb4151_4152.C424.gene26.dna; Position on contig =13129..13899bp; Strand=+
atgattactaatcaattaaccatctctagcacatcaattcatcaagataaagatggacgctactcactgaatgatctacatcaagcatctggcggtgagcaaaaaaataaaccagtgcattggttatctactcagcaagctaaagatttgattgaagaaatttcaaaggtagaaaatcctacctttaaatctgtattcataaaaaaggggcgctatggcggaacttacgtttgcaaagaattagtttattcctatgcaatgtggatcagcgccgcattcgccctaaaagttatcagagcatatgatgacttggttaatggtcgtattagtacagtagaaagtaagaccacagttcagcaacggaacccattaaagaacgccgttaaccttctggtcagcaagaaaggtatcatgtacccagaggcttactcactggttcaccagcggttcaatgtagagcatatagacgaattgacagccgatcagttaccacaggctatcgaatatgttcacaagatggcaatggaaggtgagtatcttggcaaagaagaattacctgttctgcgtggttattctggattcagcggaaagttactaatggaactggaaaacggcgaagttgtttactcctcagcactaacaccaaatcaccatgtagcgaccataaatgattttatggaaattgcacaacgtgctggatacctgctgatacgtaaagaagatatgcaacccatgatgaaggcattggaaagctataaattcaacgcctaa

SEQ ID NO: 1151 - DNA, 201 bp, Xenorhabdus bovienii
  Coding sequence Name=Xb4151_4152.C424.gene27.dna; Position on contig =13929..14129bp; Strand=-
atgatggataatactgatttaaaaaataatcaaggtgatcaaaaacccaaacgacaccctcaatctctagggtctgaaatgttacgcaaaatttctcgtaggtttccccatatatctcaagaggtgtccactcccagacaagtacagactgagcgtattcgatggcctactgagggttttccaccccctgtgaggttataa

SEQ ID NO: 1152 - DNA, 642 bp, Xenorhabdus bovienii
  Coding sequence Name=Xb4151_4152.C424.gene28.dna; Position on contig =14279..14920bp; Strand=-
atgccacaaagattggtaagtcctgaaaagattaatgaagttttcgctcatttgaacgaaagctcagataatcacaccctctacgcctctttaatgggtggagcagatatcacaggacaaataaaaggattacccctttctcctggctatcgcatggttcgtattgataatcgattgactaataagattagtcagtctcattttgagctggctctgataaacgacatatcaaaagaggtcgcttattataaccgagtggttatacagcctgacgttgagttaaattgccgtcctgtaacccaaattctcgtttggcgcattagaactcctcagcatcgggcagctctacgtgatttagctggtaaggtgttctttgattatctgctggagcgctataacgtaatagtatctgacatgaatcaaactaatgatggcatggctttttggcaggatcgcatgtatgacgccctgatgtataatctgcatgtttacgcctatgacatgataacctgcgaactgcgcaagattctgactcaagatgatgttagccgacaagagatgtggctatggggtgatcccgagcatcatcaaaacagactggctatcatttctaaaagtgaattaccaatgccaaaagaataa

SEQ ID NO: 1153 - DNA, 201 bp, Xenorhabdus bovienii
  Coding sequence Name=Xb4151_4152.C424.gene29.dna; Position on contig =14990..15190bp; Strand=+
gtgatattagtctacttgaacctaaggttcaatagcattggctatattgctattgtttcgttgatgattaaaatgtgtcagtttttagccatccgtaacccgaagttaagcatgaatccatgccatttcatcgctgcatactcaccagtctgcgtttgccgctcatcagctcattggtgcgcttatcatcagcatcgataa

SEQ ID NO: 1154 - DNA, 687 bp, Xenorhabdus bovienii
  Coding sequence Name=Xb4151_4152.C424.gene30.dna; Position on contig =15117..15803bp; Strand=-
atgacacctatttttgaaatcggcgagatagttatctccactgataaacgcgattttttactttacccctcattctcttcaatgacgagaattggaacgcctcaacaaattgtgggggcgtacacgttgctcaatggcgcggagacgcaggaactcattaaccgagcagtgatagcctatggcactcttccagactggctgattaagctgatgcgtaagcccattggacggaagattttatctactgccataatggttatacaggcttgttgtgatgaagatgcagacgagctcatcggggagtggcgaccggggcgaaggggtctggtatatcgaccgggacgaatgcccgtgaatgacatcattgtggttgctactgaactgataacacatggagttattggtaaggttgaaatcaggaggctccaacgacatgaaggtacggaagcgtattccgaccagtttaaagctatcgagtatatcagtgctgcccgcacgcacttcaatatgacacgagaggaagctgaacggttaaccatgaccgagtttcagatgatgctgaaagccaagttccctgatgagaaaggctttacgcgtgaagagtatgacgctgttatcgatgctgatgataagcgcaccaatgagctgatgagcggcaaacgcagactggtgagtatgcagcgatga

SEQ ID NO: 1155 - DNA, 753 bp, Xenorhabdus bovienii
  Coding sequence Name=Xb4151_4152.C424.gene31.dna; Position on contig =15853..16605bp; Strand=-
atggcaaattgcccggtagaaaccaataaacttattggccgtaatgccattatccgtattgcacatggttgtcctgatgcagtacccgatcaatcagcgttttttcggattggtgcattgaccaccaaatcatttgatctgtcacctaacacactgacctcagaggcggatgattcaaaggggctggtggaaagtgtcgtcaccagcatgaacttaaccatctcatttgatggtgagtatcgtaagcgggacaagaaagatgatttcggtccattgcgattgttgcaggaaataccgagagaggttcaggctggccgtcagccctcgtattgggtacagatggattttacaggcgagaatgccttcgttctgcaaggctacatggtcttcacgtcgtggtcatctaagttcggtgctaacgaagtggctacgtattccggtgagttaaaaatatccgatgccgatacggttgaatggttgatcgaagaagtcgcggtacagtcaatcaccgctaatccttcgtcattgactgtagccgtaggaaaaaccggttcttttgtggttaatttcaatcctgctgatgcgaccaataaaaactataccgtgacatctgataaaaccagcgttgctacagtgagcaagataggtagcgtggtgacagtgaaaggggttgcagaaggctcggcaaatgtcaccgtcacttccgaggatggcagtaaagccgccaaatgtgcggtaacggtaactgcttaa

SEQ ID NO: 1156 - DNA, 180 bp, Xenorhabdus bovienii
  Coding sequence Name=Xb4151_4152.C424.gene32.dna; Position on contig =16577..16756bp; Strand=-
ttgcctgaatgctgttttcaatctgggcggtatgccaacccccatcccgacacaagagaaccgatacatcatccggttactattccgttgtacatcataatcaggtcgcgtaacgcggccttttttatttctattaatagaggttattcacatggcaaattgcccggtagaaaccaataa

SEQ ID NO: 1157 - DNA, 387 bp, Xenorhabdus bovienii
  Coding sequence Name=Xb4151_4152.C424.gene33.dna; Position on contig =16768..17154bp; Strand=+
atgagcagccacatagtcgagtatttcctgcgctcgctggataacgggctgtgggtcgttctgtccactgaccagtatcacctgcacattgtcatccgcactgagatcatccagtcgtcctgttccacccgatggctgaaagaccatgtactgcgctttcccgccatcgcctttctgttcaatccaagtgaccatctgtaccgtgaaaccatcaatcagccttgccgttgccagataatgccggaattgttcaaatatactcatagcgatttcaattcctccatgacagccttatcgatctgcgcccgcacttcattaaatccgcgcttcaagaactcttttttcgcggttgccctgcggaagttttgcttaaccttggggtcatga

SEQ ID NO: 1158 - DNA, 372 bp, Xenorhabdus bovienii
  Coding sequence Name=Xb4151_4152.C424.gene34.dna; Position on contig =17028..17399bp; Strand=-
atgggcgtgaaagtcaccggcattcgtgaggcgcaaaccagacttaatgcactcatcggcgatattagagggcgtaaggtggttcgtgccatgcataaggcgctgtatatcgggagcgctcaggctgctctttatacgccgattgatactgccaccctcattaactctcagttccgtgatgttcgctttcagggaacacggttaacggggcgggtgggatattctgcaaactacgccgtttatgttcatgaccccaaggttaagcaaaacttccgcagggcaaccgcgaaaaaagagttcttgaagcgcggatttaatgaagtgcgggcgcagatcgataaggctgtcatggaggaattgaaatcgctatga

SEQ ID NO: 1159 - DNA, 348 bp, Xenorhabdus bovienii
  Coding sequence Name=Xb4151_4152.C424.gene35.dna; Position on contig =17401..17748bp; Strand=-
atgagcagtgttgctaactgggcttataccgccccttgtaccttctggaagcggctagaaaatgatgagtatggtaaacctcttggttatgctgagccacaaatcatcttgtgtgattatcaaggtggattgtccagcaaaatatctggggttggtgctgaacttgttgccaaaaacacattctggactgagtttgctgatgcctctataggggattatatcctgattggcgagtcatctaatctgaatcctatcgcggcaggggctgacgaactcaagcacatcgtgcgctatgccgacacatttgaacgcatggcggatgattacgcattagtgacgggggtgtga

SEQ ID NO: 1160 - DNA, 414 bp, Xenorhabdus bovienii
  Coding sequence Name=Xb4151_4152.C424.gene36.dna; Position on contig =17751..18164bp; Strand=-
atgatgcagagaaagctcttgcggaagcggccagaaaggcgaaaaaagatggtgataacactgagtgacattaagccgatgatcgccgagttgggtttcacattgcctgattctgtactggaattgctcttggagcaggtgaatgtaacctcggagtgtatgacggctcagggttatgaggacaacctgcaaaaactcctgcttatctatgccgctgtccgtctggcttccctgtccggtgcgagaaaaattgcctcacagggttcgccctccggtggttcgcgttcattcaattacgattcagccggcacggattatttgctgaaacaaatcaggatctgggataaacaaggctgcctgtccggtttgccgctggaaagtaaatcagtcggcttctttgatgtagtggggtga

SEQ ID NO: 1161 - DNA, 390 bp, Xenorhabdus bovienii
  Coding sequence Name=Xb4151_4152.C424.gene37.dna; Position on contig =18097..18486bp; Strand=-
atggcactcgtaaaaattttggtaacaaatctttttgccggtgccaaccttcagaagttggaggttggccacacctatgagattaatgacagtattgctgttaagtggattgacgctggcaaagcagaagcttctaaagataaaaagggggagaaattagtatttgaagtagcgacacctgcaaccatgaatttttctgaagattcagaactacaagctgaactggatgacgctaacgctaagatgctagccatgattgaggccgctaaggcaaaagaaacggaactcacagaagtattggcggctgaaaaaaaacgagctgatgatgcagagaaagctcttgcggaagcggccagaaaggcgaaaaaagatggtgataacactgagtga

SEQ ID NO: 1162 - DNA, 1077 bp, Xenorhabdus bovienii
  Coding sequence Name=Xb4151_4152.C424.gene38.dna; Position on contig =18496..19572bp; Strand=-
atgttttatttttcaactaaacgggcaaccgaaaccggcaaccttgaggctaatcaagctcagtttggcgagctgacgttagcccgtaattcatctgctcaggcggtagcggcttttatttctcgcgctcgcttccgtggtgaggatgctccgcgccttgatgcggttaatgctatcgatgatatcaagcgcctgtatcgtgcgtatgaccagactgtgctggcagagtttgagcctaacactgaattcactctgttaaatgatctggtgggattatctcgctcagtgcgtttagaagaatcagtgtatgaatatgctcgtactggcggcactggttgggcacatacgtcaatgtctggtcagattggtgcagctctggatgcacgttcttacagctttgacggtacgatggtgccaattcacgatacgggctttaagttcaattggcgcgatccggtatttaacaaaggctctgcgctggcttcattgtctgatgcacaggccgactctgtaaaagttgttcgtcgtaagtatctcgactttatctggaatggtttccgcgacagtgaaggtaatttcattaagtttgatgataaaacgtggaaaggcttacgcgctgatgagcgtatcgcacaagtcacgctaaacgtcgatcacaccacgagcacagatggtcaagcaatgcgtagtgaagttatgaaagtgcgtgacgtgctgaaattacaaaactaccagtacggggcacagacttggtatgtatcaggtgacgtcctgtctaactgggaaaaactgtactacgacgttaaccagacccgcactgttcttgaggaaattaagaaaatcacgggcattgctggcatcaaagaagactttgagctgaaaggcaatgaaatgatgatcattccactgggcgcaggtgttatcgcaccgattgttggacaggctttcggcacggttgcggatccacgccagttctataactccgactatgtatggcgcacatggggggctgctggtctgatggttaagcaggatattaacggacacttctcagtcatccacgccaaaggcaagtaa

SEQ ID NO: 1163 - DNA, 435 bp, Xenorhabdus bovienii
  Coding sequence Name=Xb4151_4152.C424.gene39.dna; Position on contig =19583..20017bp; Strand=-
atggaaatggctaaagacggaaaacatgtaattcatgcgggtggtgtatttaccaatccgatgctgaatcgcgaaggtgcggcggcggtagatacgaagcccggcaccattgggtattttgaggcaggcaaattcaaagcctccgtggacggcaaagaatcagccattttgtatgttgccaatatcgactatctccgctgccagacagtggatgacgctatcacggcgggttcagtggtcatctgtattcaccctatggcgggggtattcctaaacgttcgtgcaactgagggaacgtataaaaagggtcagcctgtgacggctgctaacggtcagattgcggcggctggtgatggtgttgctgcatttgcctatgtcgaagaagacagtatcacagcaaaagcgggtgatctggttcgcgtggtgtttaagtaa

SEQ ID NO: 1164 - DNA, 1389 bp, Xenorhabdus bovienii
  Coding sequence Name=Xb4151_4152.C424.gene40.dna; Position on contig =20017..21405bp; Strand=-
atgaagctatccagcgttcatgttaaatccctagccctaaactcctccaatatctcaactgaaactatcgatggtgatgcacatattgtcattcgtggcgttgtacccgttgttgatgatgttgtgatgaacggcggtctttatccggctggtgagattaacaagagctacaaatcaatagaaggcaagcagatgcctttgggacatcccagcattgacggccagtatgtctctgcggatgttccccgtgcggtcaatcagtttcatgttggtgcatgggctgagaatgtacgaaaagacggtgatcgggttgtcatggacatgaagattaaccgtcggtatgcggagtctacggaaaaggggcaggttttactacagcgtctggatgacatgatcgctaacaaaggcgctgagcctatacacatttccactgggctattgctacagcgtgagcagaacggcgggaagtcacgagggaaaaagtacacatggattgcacgaaatatgcagttcgaccatgtggccattctcccacccgaagaaccgggagccgcaacaccaaaagagggggtggggatttttgtcaactctgatggtgaaaagctgaatgtcgagcaggttaatctgtctgatgcatcaaattgcacaaaagagggagtggttgataaaacgaaattctttttcaccaatgcctctaacttctcattcgatgacatttactcagcgctcagagcaaagttaaaagttgcatacccaaatgatgactggccttaccctgaaaccgtctggcctgacaaatttatctactaccgatccggtaaaacctatcagcaaaaatatctcatgaacgatgacggtacagccgaactcgtcggagagtctgtcgaagttgtgcgtaagccaactgaatacgaaattaaaaccaacggagctaataacccgatgaaagacatgattgttaacgccctgaaagcgaaaggtaagtcgactgacggcaagaccgaagctgaattgcttgatgcatacaaccagatgaatgctgacgaagcaaaagacaaagaaacgctggaagaaaaagccgcgcgcgcgaaaaaagagaaagaggccgtaacaaatactgatgcgattaccgcagcaataaatgcagccatgaaaccagtgactgacaaaatcaccacgctggaatctcagttgaccgcgaacgcagacaaggagaaatccgacaaacgtgctgcggtaaaagcgaagtttggtctggacgatatcgcggttaatgcgctggatggtgcagcactggatggcttttatgcccagtgccagacatcagcagggctgaattcatcattcacaaacaacaattctgaatcattcacatctatgccggagtaa

SEQ ID NO: 1165 - DNA, 993 bp, Xenorhabdus bovienii
  Coding sequence Name=Xb4151_4152.C424.gene41.dna; Position on contig =21426..22418bp; Strand=-
atgacccagaccaaaattggaaccccgataataccaaggaataagcgtgaccccacgcaatcataccgccccgttaacaagatgtttcgtgatatcgaacagcggtattacggcatcaaggtggcgctgaaacaactatttaatgaaagattggttggccgagagcgtagtgttaattcactctatggatacatactcacccaaaatgcggtaaagcctgacacgctttaccgagtcaatgccggaacgtatatctatgacatgacagcccagcaactggctgatctgctggagatagtgcaaataattctggatgattttttgcttgctggtgggaaagatcagctatgggcttttagttatgtagcggatgagtatcagcgaggaacattaaacgcctataccaatctatccgcacagtcagaaatctacgcacagaaaaccacactctcagccttgttatcaacgccagcctatcaaaatcaggtggcggcagcttttatatcaacctacagcgattggaagggcgtttctgatgcggcacgggctgatctttctcatgtgatagctgaggctattgctcgcggcgtcaatccgagagagattgccgctatcatcagtaaacgcttgaatgtgtcaataggaaccgccaagaacatcgcccagactgagcaagtaggtgcattgcgagaggctaattggaatgaatctgaatgggctaaagaacggctgggattaaataccaaattgctttggttatccgctctgaaacctacaacacggcaatggcatgcagtcaggcatgggaaactctacacaaaacaggaagctgaggaattctattccaagaacggtaatcgctatcgctgctactgcgcacaacagcctgttgttctggacgatagcggaaaactgtataacaccgggctgactaaacgtctgacagaagaacgtcaggcgtggcaaaaaccagaaccggaacaaatcgagtaa

SEQ ID NO: 1166 - DNA, 1368 bp, Xenorhabdus bovienii
  Coding sequence Name=Xb4151_4152.C424.gene42.dna; Position on contig =22375..23742bp; Strand=-
atgctctatgcgtcgggtgggattagcggcaatacaaaacgaaccaatatttattctgagttcggttatcccgagcagctcagattcaaagagtactataacgtctatgagcgtaatgctgtagctcatgccgccgtgcatcgtttgctggacgggtgttggcaggacaatccgaccattattgatggcgaggaaaagaaagagtcagacgtaaccagcgcatgggaaacgaaagttacaaagctgctaaagccgttctgggcgaaaatcaaagatgctgatcgccgcaatatgattggtaactactcagcgctgcttattcaggttagggatagcaaaaactggagtgagcctgttgatgttactgtggtatcacgactaaaagttgatgcagtagttaacctaatccccgtctgggagcctcaattgactgttgccgagtgggatcaggatattcattcagatacctatgggcagccaaagatgttcaattttgatgaacgtcccgtgggtcaggttgagatgcaaggcccagcgaaacaacttctcattcatccatcacgggtgattactttgtgcgaaggtgccgaaagtggggatattttctccggcacgccgttgctcagggcggggtataacaaattgctggatatcgaaaaggtatctggtggtagttccgagggttttttgaaaaacgcttctcgtcagatcggggtggagtttgaaaaagaaactgatatgaatagtatcaccacggcggcaattcaagctggctacaaagacctcggcgcggcactggaagataaaatcagcaagctcaacagagggactgactcagcggcagtgatgcaagcggggcggttgaatgtcctgtctgttgctccgggagacccaacacccacatgggaagtgacagcccgtgagttttgcgcctccgtgcaagtgccgtttactgtgctgttcggcactcagaccggaaagttagccggtgataaagatgatgccacttggaaggttcggttgaatggtcgccgatggggttttctaacccaatatgtgacgcaattgataacgcggttgtgggaaatcggcattatcgaaccaccttcttccggtgaggtcactattgcatggtctgacatgctcgccgccagtgagcaggagaagatcgacaatatgattaagatggctgaggctgcacttaagacacaacaggcttttgggacacccgcgtttactcctaatgaagtccgtactgtaggcgagatggagccgttggaagaagagccagagccacagggcgcaaccggagatccgttaactgatgacccagaccaaaattggaaccccgataataccaaggaataa

SEQ ID NO: 1167 - DNA, 1470 bp, Xenorhabdus bovienii
  Coding sequence Name=Xb4151_4152.C424.gene43.dna; Position on contig =23809..25278bp; Strand=-
atgaagccagaacatttagcgttactgcgcgataaactctggcggctgaatcatctctactggattacggacaaagaaggtcgccccgtcagatttaagatgacaccagagcagctggagtatttcgagggcatccatacccgtaatattatcctgaaagcccgtcagctcggtttcacaactgaggtatgcattatccagcttgacgctgccctattcgaatctgccaaatgcgccctgattgcccacaccctgaatgacgcaaagcgactattccgtgagaaggttaagtacgcctatgaccaattgccggatgagattaaagccgccaatcctgccagtaatgacgcagcgggtgaattagtctttcgcaagggcggctcgctgtacgtatcaacctctttccgtggtggcacattgcgttatctgcatgtctctgaattcgggaagatatgcgccaagttcccccacaaagccagagaaattgtcaccggtgcttttgaagcggtatcgacagattgtttcacgacgattgagagtacggcggaagggagagcgggatacttctttgactactgccagacggcagagaaagcacaactacagggtaagcagctatctaacctcgattggaagtttttctttttctcgtggtggaagaatccgcaatacgcaatagacccagtagaggcatggcctcagcgcctggttgactacttcgctgaattatcaggcaaacacggcattcagttaaatgaacgtcaaaaggcatggtatctcgccaaagagaagacactcggcgatgacatgaagcgggaatatccatccatcccgtccgaggcattccagcaatcagtagaaggtgcgtactacgccaagcagttccgctggctatatgagaacaaacgcatcggaaaattaccggataattcacacctaccagtacataccttctgggatatcggggtgggtgattcgacggcgatctggttcgtacgtgaagtgggggaagagttccacgtcatcgactattacgaaaactccggtgagggtttacggcattacatgaaggtattgaaggataaaggctatatctatggtgatcattgggggccacatgatatcgataaccgtgagtttggcgctgatgccaagtctcgacgagaactggcgcgcgaagggtacgaaatcgacggtcagaaatactcaatgatcttcaaggttgtgccaaaggttggcgtggatactggcatagaatcggtgcgtgaaatcctgtccagttgtgtatttgatgaagagtgtagtgaggggatatctcatctggaaagctaccgcaaggaatgggatgacaagcgcggttgctggaaagataagccacttcatgacttcacatcacatggtgcggacgggttcaggtattttgctgttgccaagaacaaccgtaaggctgtgggcgcatttttcttttaa

SEQ ID NO: 1168 - DNA, 222 bp, Xenorhabdus bovienii
  Coding sequence Name=Xb4151_4152.C424.gene44.dna; Position on contig =25372..25593bp; Strand=+
atgtgcttgcctaacagctctaggttcttcactttatccggccacttgattttcttgagtaacgctgtggtatcttgtgaacccatctcaaccacttccataccggatagagtggtacgccagactttaggccagtcttttaccggtttcagttcaccgccatcagtaagaatgtcgagtacgtccatctggtcaatttcgaccaaccgctttaatacgtag

SEQ ID NO: 1169 - DNA, 243 bp, Xenorhabdus bovienii
  Coding sequence Name=Xb4151_4152.C424.gene45.dna; Position on contig =25684..25926bp; Strand=+
gtgcggttagcagtcctttcgctgtaccccgcacgaatggccgcttgtgtggcgttcaaatcaacgaggtactcgcgacaaaacatttcttgtttgtcggtgagtgccatttctttttcctctataaagcaaaaaaccctccgaagagggctgaattatcgtgcattaaatatcaatttggagctgaactatacttttcaatcattgggtcttcttgaatatgatattcacctatatctataa

SEQ ID NO: 1170 - DNA, 231 bp, Xenorhabdus bovienii
  Coding sequence Name=Xb4151_4152.C424.gene46.dna; Position on contig =25856..26086bp; Strand=-
atgggtgggtcatcaacttatgtcagatttaaaaatggtgattacagctatgtcgtctatgcagggggaagtaaatattgggatttttcagggcttgttgtttataaaggcgataaaattatcaataaaaagtcctgcaaagattccgaatcgttaggccttatagatataggtgaatatcatattcaagaagacccaatgattgaaaagtatagttcagctccaaattga

SEQ ID NO: 1171 - DNA, 1050 bp, Xenorhabdus bovienii
  Coding sequence Name=Xb4151_4152.C424.gene47.dna; Position on contig =26178..27227bp; Strand=-
atgattgcgcccatgaaaattaatctaacagatgcccaaaaagacgccctcgaattgatgcatgatacgactcgcgatggacgagtacgtgaccgcatcaaggccgtgcttttggcctcagaaggctggactgcccagatgattgctcaggctttgcggatccatgaaagtacggtgagccgccatctgaaagattacttctctgaggaaaaactcgcccctgaaaatgggggctctgaaagccgtttgtctgccgaacaaacaacagaattagttgagtatctgatggcaaatttgatgcacactaccgcacaaattgtggcctatgttcgggcacgatggcaggtgactttcactgtcgcaggaatgacgaaatggcttccccgtcaaggtttcagccacaagaacccaatgggtgccccgcataaatttgatgcggatacaccgccacagtttattgaaacctacaacgcgctgaaagaagaatgtggccagaatgcgcctattttatttattgatgcggttcacccgaccctgtccacaaaattaagttatggctggatgaagagcgggcggaagcacgtcaaagtggttgaaaccacaggcagtcgtactcgactcaacatcatgggtgcccttaatttacaacggattgaagagactattgttcgtgaatatccgacgattaacgcgaaaaatgtcgtcctttttttcggctcaatccgggaaacctatccactttcgcaaaaaatccacattattctggatggtgcgggttatcaccgttccggagtcgtccaattttttgccgaggttttgaatattgagttgcactacctgccgccttacagccctaatctcaacccgattgagcgattatggaagtatgtgaatgagcaggtacgaaacaatgtctattttccggataccaaaacattccgtgaaacgctgcgccacttttttcatgtcacattgccagaaaaagcgaaagaactcaccactcggttgactgataacttccagattttaaaacccgcatcttcaagttaa

SEQ ID NO: 1172 - DNA, 231 bp, Xenorhabdus bovienii
  Coding sequence Name=Xb4151_4152.C424.gene48.dna; Position on contig =27240..27470bp; Strand=+
atgaaaaatcaagcatcttcaatgacgacgggtataggccaaacgtcacctttcaagatgatgaatatgtactcattttttgaaggaaatcctacattaccagaaaaaaacccacaagatatattggacacacacttttatattgtagtcgttggagattttgaaagtgcttatgacatagatataaaccataaaaaatggtggagcaaagtactgcaatatttccattaa

SEQ ID NO: 1173 - DNA, 774 bp, Xenorhabdus bovienii
  Coding sequence Name=Xb4151_4152.C424.gene49.dna; Position on contig =27569..28342bp; Strand=-
atggttattggtgctcagatggtgaatggtcaagtgagaacggatattggttttaatgccaataattttaccttcgtcaatcccgcaaataacaaattcgaaccctttgtggcagctaaaaatggtcagttgtttattcgggatggatttatagaagatggcagtattaccaatgccaaaattggcaattacatccaatccagaaattatatcacgggtcgggcagggtggaaaattgacaaaggcggctcggcagaattcaaccatgttattgttcgcggggagatacatgcaaccagtggcacgttcaccggaacaataaagggcgctgatggctatttttccggcgcagtatatgcgaccaaaattgtgggtgacgttgtgtctgttacgttggggaatgtatcattaggcaaccgtgacagcattttttttcataaaagactaacggaatctatgccgtttgatcgggtttttatttatggatcgataatgactcagcgttacgtcggatctttgggtggttcgggggaggcatccgtttcggtatacgttaataatgcgcatgtggctgggcaaaactttttcatggagtcttctgatagcgtcccgcagtgtatttccggcacgttgtttacaccccctataaccatccccgccaatacaacgccgaccattaaagtcgttctcacaacccacggcacgggcattacataccctactaccggtattggtatgctgtttaaggccagtagtcagtggtctaacatgtaa

SEQ ID NO: 1174 - DNA, 771 bp, Xenorhabdus bovienii
  Coding sequence Name=Xb4151_4152.C424.gene50.dna; Position on contig =28052..28822bp; Strand=+
atgtatctccccgcgaacaataacatggttgaattctgccgagccgcctttgtcaattttccaccctgcccgacccgtgatataatttctggattggatgtaattgccaattttggcattggtaatactgccatcttctataaatccatcccgaataaacaactgaccatttttagctgccacaaagggttcgaatttgttatttgcgggattgacgaaggtaaaattattggcattaaaaccaatatccgttctcacttgaccattcaccatctgagcaccaataaccatccccgctccgtgataatttccgctggcatctttgatacccactttaatgtcccatgttgccaatgcggtgacttctttcaggtcaaaaaccgtctgtatggtatactataccgctgcccagctcttatcggccgttgccttgaccgtatcaatcttttcagccaacgattttgtctcagtcacagtgaagttccgaaccttgacaatttccgatttcatttccccgttctggcgcataaagtattgactgttgccattcgcggcggcggaattaatcaacattccttcaatgttggtatcaatctgctcctgcaactgctggcctgctgtgttggaaaggaactcattaccagccgcatcaatgatccagttcgcatccgaagacgactccccacgagtgaacgccgtccacggggattgattaggacatccagcagttcgaggggttttatatctgctattggcctattaccaatataa

SEQ ID NO: 1175 - DNA, 423 bp, Xenorhabdus bovienii
  Coding sequence Name=Xb4151_4152.C424.gene51.dna; Position on contig =28800..29222bp; Strand=-
atgatgaagctaacagacgtggcaatcaagagagccaagccagaagcaaaatcttatacgctatctgatggaaatgggctttggttattgatagaaccgaacggatctagaggctggcgattccgttatcgctttgaaggtaagcagaagatgttatctttaggcacttatcctgaagtacctttagcagaggcaaggaaaaggacagcagggtgccgttctatgattgctgatggcattaatccttctgaaaatagaaagcagaagaagagggagagtgtcatcatgtctgaaaatacttttgaaaaaattactcgtgaatggtacgaaaaacgtaaggataggtggtcagcagggtatcgcgctgacatgatgagtgctttgaaaatgacgtctttccttatattggtaataggccaatag

SEQ ID NO: 1176 - DNA, 1050 bp, Xenorhabdus bovienii
  Coding sequence Name=Xb4151_4152.C424.gene52.dna; Position on contig =29495..30544bp; Strand=+
atgattgcgcccatgaaaattaatctaacagatgcccaaaaagacgccctcgaattgatgcatgatacgactcgcgatggacgagtacgtgaccgcatcaaggccgtgcttttggcctcagaaggctggactgcccagatgattgctcaggctttgcggatccatgaaagtacggtgagccgccatctgaaagattacttctctgaggaaaaactcgcccctgaaaatgggggctctgaaagccgtttgtctgccgaacaaacaacagaattagttgagtatctgatggcaaatttgatgcacactaccgcacaaattgtggcctatgttcgggcacgatggcaggtgactttcactgtcgcaggaatgacgaaatggcttcaccgtcaaggtttcagctacaagaagccaatgggtgctccgcataaatttgatgcggataaacagcaacagtttattgaaacctacaacgcgctgaaagaagaatgtggccagaatgcgcctattttatttattgatgcggttcacccgaccctgtccacaaaattaagttatggctggatgaagagcgggcggaagcacgtcaaagtggttgaaaccacaggtagtcgtactcgactcaacatcatgggtgcccttaatttacaacggattgaagagactattgttcgtgaatatccgacgattaacgcgaaaaatgtcgtcctttttttcggctcaatccgggaaacctatccactttcgcaaaaaatccacattattctggatggtgcgggttatcaccgttccggagtcgtccaattttttgccgaggttttgaatattgagttgcactacctgccgccttacagccctaatctcaacccgattgagcgattatggaagtatgtgaatgagcaggtacgaaacaatgtctattttccggataccaaaacattccgtgaaacgctgcgccacttttttcatgtcacattgccagaaaaagcgaaagaactcaccactcggttgactgataacttccagattttaaaacccgcatcttcaagttaa

SEQ ID NO: 1177 - DNA, 462 bp, Xenorhabdus bovienii
  Coding sequence Name=Xb4151_4152.C424.gene53.dna; Position on contig =30541..31002bp; Strand=-
ttgttgttgcctctgggatatgagctggctctgggtggatttattgtttgtggactgttgttttgtctggtttcgttgattgtcaaaattgcaggacggggttggatcaatgtgatttttccgccagcggcaatgggagcaattgttgctgtcattggtctggagctggcaggggttgcagcagatatggctggtttgcgcgtagccattggagctgaagtcaatacggctaacctgactatatcgatggtaacattagccgtgacaattttgggttcggtgatgttccgtggctttatggcgattattccaatcttgattggtgttttagcaggctatgcgctggcgttttttatgggagcagtggattttactcctgtacttgaggcaccgtggtttgcattaccgacattctatacaccgcgttttgaatggtttgccattatgactatacgcaattaa

SEQ ID NO: 1178 - DNA, 696 bp, Xenorhabdus bovienii
  Coding sequence Name=Xb4151_4152.C424.gene54.dna; Position on contig =31137..31832bp; Strand=-
atgtccctgatccgaaacgcgtttaaacgcctccattatcctgtcgatatcatggcccaatgtgtccgttggtacctcgcttatgccttgagtctgcgcaatctcgaagagatgatggcagagcgcggcattgaggtcgaccatgccacaatacatcgttgggtgttacgtctggtgcccctgctcggcaaggctttccgacctcgcaaaaagcccgttggctcccggtggcgaatggatgaaacgtatatcaaagtgaaaggtcagtggaaatacctttaccgggcggtcgataccgacggtcagacggttgacttcctgctgaccgctcgccgcgatgcaatggctgcccagcgttttttccgtaaagcgatacgcctgcacggcagacccgccgttgtgactatcgataaaagtggggccaatactgccgcgctcactctcctcaatgcggaaggatcgcctcagcaggggattgaaatccggcaaaataaatacctgaataatctggttgagcaagatcaccgcaatatcaaacgtcggatacgacagatgctggggttcaaatcgtttcgccgggcacagacgctcctggccggcatcgaactgattcacatgatacgcaaagggcaatatcaacatccacaaagtgatggattatcacccgcggaacaattctatttgctggcggcctaa

SEQ ID NO: 1179 - DNA, 171 bp, Xenorhabdus bovienii
  Coding sequence Name=Xb4151_4152.C424.gene55.dna; Position on contig =31797..31967bp; Strand=+
atggaggcgtttaaacgcgtttcggatcagggacatcactctggactcgctcaaaaacaggggagcttacctgatgaccgcttaatgcgacagaaccttatttatatcctctatgttactttgctagaaaccaaaaaaagccggcttttcagccggctaaatgttatttag

SEQ ID NO: 1180 - DNA, 627 bp, Xenorhabdus bovienii
  Coding sequence Name=Xb4151_4152.C424.gene56.dna; Position on contig =31960..32586bp; Strand=-
atgaagatcgttgaagttcaacacccactagttaaacataaactcggcctgatgcgagctcatgatataagcactaagcgctttcgtgaactggcctcagaagtgggtagccttctgacatatgaagcaactgctgatttagaagtagaaaaagtgaccattgaaggatggtgtggtccggtagaaatagaccagattaaagggaagaaaattactgtggttcctatcctgcgtgccggtttgggcatgatggatggtgtattggaaaatattccaagtgctcggatcagtgttgtcggtgtttatcgtgacgaagaaacgttcgaacctgtgccttattttcagaaactggtttctgatattagtgagcgcatggctttggttgttgatccgatgctggcgaccggcggttctatgattgccacgattgatctgctgaaaaaggcaggatgtcctgtgattaaggtattggttttggttgccgcaccagaaggggttgccgcactggcgaaggttcatcctgatgtcgaactgtttactgcctcgattgacgaatgtctgaatgagcatggatatattgttcctggtctgggagatgcgggcgataaaatatttggtactaaataa

SEQ ID NO: 1181 - DNA, 144 bp, Xenorhabdus bovienii
  Coding sequence Name=Xb4151_4152.C424.gene57.dna; Position on contig =32878..33021bp; Strand=-
atgctggggttcaaatcgtttcgccgggcacagacgctcctggccggcatcgaactgattcacatgatacgcaaagggcaatatcaacatccacaaagtgatggattatcacccgcggaacaattctatttgctggcggcctaa

SEQ ID NO: 1182 - DNA, 696 bp, Xenorhabdus bovienii; identical to SEQ ID NO: 1178
  Coding sequence Name=Xb4151_4152.C424.gene58.dna; Position on contig =33087..33782bp; Strand=+

SEQ ID NO: 1183 - DNA, 126 bp, Xenorhabdus bovienii
  Coding sequence Name=Xb4151_4152.C424.gene59.dna; Position on contig =33805..33930bp; Strand=-
atgctgatttttagaaactcactttcgctccaatacccacttcacgtggctccagcatatttcctgcaatcccagccgtgcgatcatgagatttatggcagtgtcgcgttaacggcggcaagttag

SEQ ID NO: 1184 - DNA, 339 bp, Xenorhabdus bovienii
  Coding sequence Name=Xb4151_4152.C424.gene60.dna; Position on contig =34086..34424bp; Strand=-
atgagccagatgactgcattgagaaaagtaaaaaatttaaaacaagaatttgatttaatcaaagaagtatggtcaccgaaggtaataactcaaacaaacgaatataagataattatattactcgcagacggtgattttatatggcacacccataaagatgaagacaaggtattcatggttattgaaggtgaacttcgcatcgattttaaagatgatcatgtaataataaagcaaggtgagttttttgtggtgccgaaaggagaagaaagtaagccttcgtccaaagaattaaccaagctgctattaatagaacctatcgtgacaaattcaggccaataa

SEQ ID NO: 1185 - DNA, 744 bp, Xenorhabdus bovienii
  Coding sequence Name=Xb4151_4152.C424.gene61.dna; Position on contig =34530..35273bp; Strand=-
atgaacagctttaagggaaaaaccgtctgggtgacaggagccgggagcggtatcggttaccgcacagcactccgctttcacgaggcaggcgctaaggtgtttggattcgatctgaaattccctgattcaatgccgtttgagacgctgattctggatgtcagtgacgattgtgcggtacaaaaaatctgcccgccactgctaaaggaaaacgggctggatatactggtaaacggtgccggaattttgcgccttggttcagcagaaacattaagtcgtgaagactgggaaagctcaatcaacgttaatgcgggtgcagcattcaatctgtttaagatattaattccacatttccagcgtcagcgcagcggtaatatcgtttcgatcgcctccaacgccgcccatgtaccacgcgttaatatggccgtttactgcgcttctaaagcagcaatgcggagcctgtgcctgagtgtagggcttgaactggctccttttgggatacgatgtaacattgtttcgccgggttccacgttaaccccaatgctggaaggaatgttcgatgatgatatcgcgcaccagcgtttgattcatggcgttaccgaacaatttaagctgggcattccactcgggaaaatcgcccatcccgacgaaatagccagcgtcattctgtttttagcctccgaacaagcaagtcacatgacgttgcaggatattgttattgatggcggtgccactctcggtgcctga

SEQ ID NO: 1186 - DNA, 885 bp, Xenorhabdus bovienii
  Coding sequence Name=Xb4151_4152.C424.gene62.dna; Position on contig =35270..36154bp; Strand=-
atgagcattcctaaacttcaggactataccctgcccgatgaggccaccttacctgcaaataaagtggaatggacgttagagccgcagcgtgctgctctgctgattcacgatatgcaggaatatttcctcaacttctggggaaaagaaagcaaaatggttcagcaagttatcgacaacattgttattctgcgcgcccgttgccatgcacttggtatcccagtgttttatacagctcagccgacccaacagagtgacgtcgaacgagcgttactaaatgatatgtggggaccggggctgaacaactacccagaacagcaaaaaatcgtggcagcactgtcccccgagcaacaggataatgtgctggtgaagtggcgctacagcgcatttcagcgctctgatttggagactcagctgaaagaacacaagcgtgatcagctgatgatctgcggcgtgtatgcccatatcggctgcctaaccactgccactgacgcctttatgcgcgatatacaggcttttatgataagcaatgcgctggcagacttcagccgagaagagcatatgatggcactacgctatactgcaggctgttccggtcaagtgttgagtaccgatatggtgctgtcggcgctcgattcttccacagcagaaagtcaatgggatcgagaacggttgcttaccctgttacagtctacactggacgaagatgtacacgacattggtgatgatgaaaacttgcttgattatggcttagactcgctacgcatgatgtctttcgtctcaaaacgccggcaggaagggtacgatcttgattttacctcgttgatgaaacaacccacattgcgcaattggctcacattactgaacggcgatttggaggcgaaatga

SEQ ID NO: 1187 - DNA, 348 bp, Xenorhabdus bovienii
  Coding sequence Name=Xb4151_4152.C424.gene63.dna; Position on contig =36289..36636bp; Strand=+
ttgttcgcgcaaccagcgacggaatacggctggctttacagcttcgtgttcgcgtgttaccacatatgcgcaagttttctcacccatcagacagtcaggaatagcgaccaatgcggcgtataccaccgctgggtggcgcagcagaagatgttcaacctcttcagccgcaattttttcgccgccacgatttatttgatctttttcacgtccgacgactttgaggtatccgccgggaagctgaatgacgacgtcaccagagcaataaaacccatcgctgtcgaacacggtttggttatgttctgggctgcggtaatagccccgaaaagtgtatggacctctggtcattaa

SEQ ID NO: 1188 - DNA, 162 bp, Xenorhabdus bovienii
  Coding sequence Name=Xb4151_4152.C424.gene64.dna; Position on contig =36735..36896bp; Strand=+
gtgtgtcgtcatcatctagtcgggtgtagttcaccagaccttccgccataccaaatacctgttggagctggcaccctagctcttttgggatgcgtctggccagtgcttctcccagaggagcaccgccgaccagcatcacctccagactggagagttcgttga

SEQ ID NO: 1189 - DNA, 168 bp, Xenorhabdus bovienii
  Coding sequence Name=Xb4151_4152.C424.gene65.dna; Position on contig =36898..37065bp; Strand=+
gtgaccgatgagattggcatactccagccagatgctgacagcaggtggcaccagggcaacaagattgatctgatgatgtgcgatagcaggaaaacatccatctggactaggatcgggaacgaggacaacctgaccacccgcatagaatacgcccagagctcccggtga

SEQ ID NO: 1190 - DNA, 228 bp, Xenorhabdus bovienii
  Coding sequence Name=Xb4151_4152.C424.gene66.dna; Position on contig =37081..37308bp; Strand=+
atgtgcagccggcagtgcacagagatatcgggtcttactgcttacgttgcagatcggattactggcgcggatgctgtaatagtagtcgttgtgggtacgtggaatcagcttgggtgtgccagtgctgccgccggaaagctggaaaaatgcgacctcatctgccggcgttggtgttggcgtgaagtctcccggttcttccgatatcaggcgtgcaagcgaatggtctga

SEQ ID NO: 1191 - DNA, 285 bp, Xenorhabdus bovienii
  Coding sequence Name=Xb4151_4152.C424.gene67.dna; Position on contig =37491..37775bp; Strand=+
gtgcgacacctaggcgcagtaaggcaaaaaagacgatataaaactcagcctcgttgccaagctgaaccagtgcagtttgtccctgacgcacgccgcgtcggtgcagagaggcggctaatcggtttactgcctcattcagctcccgatagctccagctctgctcaccgcaaaatagtgctgtggtatcgttctcgcggtgaatatcaagaatctcgctcaatggacgatcaatccagtaccctttcaggcgatagagtgcagccagatcctgaggccaacggttga

SEQ ID NO: 1192 - DNA, 1089 bp, Xenorhabdus bovienii
  Coding sequence Name=Xb4151_4152.C424.gene68.dna; Position on contig =37782..38870bp; Strand=-
atgagagtgataaccgcgaagctgaaaaacgtaatagtattaatgcaaggaatcgtagcaaagaggagtgcaccaggcaccaaaacggcaattccgcttttcaaaatacggcagacaattttcgtcgttacgcgtaaccagatggcgcttgcaagcgcaacctccgtatccgacgcattgattgacactagtagtaccttcaccaactatttaggcttatctaaccgcaacgctgaagtcgtagtccacctctttcactacattccagatcacgatgcgttttgcgccatggtggagagcgcgctgagtcctctacgcattggagagctcgataaagttgtgctgtcgcgtctgctacagattgaaagcatccccccgcttagcgcactgaatctgtggctgcagctcaacagacagaatccagagagctacaactttcacttaccgctggcagatggcacgctgattggtgctagccctgaattgctgctacgcaaagagggtaatgtcttgcgctcctgtccccttgcaggctcagtgcggcgaggcgacaataccgccagtgaccgaaatgccaaagaaaagctgttggtctccggaaaagatcgccatgaacatcgggtggtcacggaggctatccgtcgccaactgacggatctttgccagtctctgacgatccctgaaccttcgctgttcagcacgcccacgctctggcatctcgctactgagattcagggtatattggccaatgatcgcgatagtgctctatcgcttgcctgcctacttcatcccacgcccgcattatgcggcgctccttatacctcatcccgcaatttgatcggcgcgctggaacccttcgatcgcggctggtttggcggtatcgtcggctggtgcgacgcccgcggaaacggggaatgggtagtggcgatccgctgcggtaaagtgcggccccatcagattgagctattcgccggcgccggcatcgttccggactctgttccggaaaacgaatggatggaaacccataccaaatttaacaccatgctgaacgcacttggttttgcgatgcaacaggagcagacattatga

SEQ ID NO: 1193 - DNA, 135 bp, Xenorhabdus bovienii
  Coding sequence Name=Xb4151_4152.C424.gene69.dna; Position on contig =38867..39001bp; Strand=-
atgtttaagataagaaaaaaacttgtggtgaaaatcatctccagatgcaccggatttgggtttcaggtggtactgttttcaatacccacgttatctgatgaggcgtatgcggctagcacgggattggcatcatga

SEQ ID NO: 1194 - DNA, 138 bp, Xenorhabdus bovienii
  Coding sequence Name=Xb4151_4152.C424.gene70.dna; Position on contig =39020..39157bp; Strand=+
ttgccttataaaaataatttaataaccatcaatgaatttgtactgcttacaggcggcgctggaaacaaaatgttcgtcataaagaggtatgagctcttgaggaagaaaacactattacaatattttagatgtaaatga

SEQ ID NO: 1195 - DNA, 222 bp, Xenorhabdus bovienii
  Coding sequence Name=Xb4151_4152.C424.gene71.dna; Position on contig =39382..39603bp; Strand=-
atggcggatttcctatcgataaatagtgtttacggctgtagtactaagcgcatggtgaaaaaacagcaaatgcaatggagtcaacaaggtgcacattatctactccagacgcgaacagcggtactcaataatgatttaaaaacgcgatttgagcactggtatccggggatcaaattaagcaaagaaacagatcactatttggcagagattattgctgcatga

SEQ ID NO: 1196 - DNA, 336 bp, Xenorhabdus bovienii
  Coding sequence Name=Xb4151_4152.C424.gene72.dna; Position on contig =39661..39996bp; Strand=+
ttgtactacagccgtaatccatattgtgccatgatagggctcttcttccttaaatcaaaggcggtgttacatgtcatcctctgccaaaatctgggaacaggcgctacaggcatgacatgcccgtctgactcccttatttcactctatcggcccacgacaacgcagcctcgcctatcttcgggggattgctcagtgatgttgaacgtaagaatagctggcaactggctgaatggatgggggaaagtactcccgatggcattcaattgggcgatgaacagggggttctcatccaaggcaatcgcatctaaatttgatgcgctttgcccagtactgtaa

SEQ ID NO: 1197 - DNA, 1122 bp, Xenorhabdus bovienii
  Coding sequence Name=Xb4151_4152.C424.gene73.dna; Position on contig =39965..41086bp; Strand=-
atgtcctctgtcagccctttgttacagcattttgcctcacttgaagatccccgagttcaacgaactcagttgcatagtttggaaaatatcctgactatcgccatctgcgctgtgatttgtggcgctgaaggttgggtcgaaattgaagagtttggcgaatctaaacaggatttctttacccaactgcttgatctcactaatggcatcccctctcacgatacctttggtcgtgtctttgctgcacttgatgcgcaggcttttgccgactgtttcacctcctggatatctacgctggcacaaggagttgatcagggtatcatcgctattgatggcaaaaccatgcgccggtcactcgataaagccaacggcaaggcggcaatccatctggtcagcgcctttgcctgtaccaatcgcttagttctgggacaagtgaaagtggagagtaaatccaatgaaatcaccgctattcctgagttacttcgacgattggttttgtctggaagtctggtgactatcgatgccatgggatgccagaaagcgattgctcatcaattacatgaagcgggcgcggattacgtactgagcctgaaagaaaatcatcccggcccgtataatgatgtcagccattatttcgattatgtctcatcccaaccggagcgcctgagcgaatatgaagacgtggatgccggacatggccgcattgagcgacgcacagtacaaatgacccatgttgattggttgccggaaaaggcgtgctggtgtggtttacacagcataatacgggtgatccgcgaacgctatgtaggaaatgaagtgagccgggagagctgttattttatcagcactttacgtccgacagaggctcaacgggcagcgacagcgatccgcagtcactggcaaatagaaacgcaactccattggtgtctggatattgcttttaatgaagatcagcagcggatgcgggaaggcaatgcagccgccaatatggcattactcaataaaatcgcgttgaatttactgcgcttagctcccaccaaagcgggaattaaagcacgccgtaaacgggctggttgggatggtgaatatctacttacagtactgggcaaagcgcatcaaatttag

SEQ ID NO: 1198 - DNA, 276 bp, Xenorhabdus bovienii
  Coding sequence Name=Xb4151_4152.C424.gene74.dna; Position on contig =41234..41509bp; Strand=+
atggcattagttgaagtgaagtgtcggttttgtggccaaaccacgcctgttaaaaaacacggtaaaggagaaggtgggcatcaacgatattattgccagtcctgtcgtagaaccttccagctcgaatacacttaccgggcttgccattcgggtatgaaagagcaaatcgtcgagcttgccatgaataacgccggtattcgtgatacggcacgggcacttcatgtcagcattaacgctgttgtacgcactttaaaaaactcgcgccgcgatgtgtaa

SEQ ID NO: 1199 - DNA, 366 bp, Xenorhabdus bovienii
  Coding sequence Name=Xb4151_4152.C424.gene75.dna; Position on contig =41563..41928bp; Strand=+
atggggtcattcatcagtaacaaaaaacggcaacgctggctgtggtacgcgtgggagcctcgcttgaaacgtattgtcgctcacgcttttggcgctcgtagcaaacagacactcaggacgttgctggaaaagttatccgcttttgatgtggcattctggtgcaccgataatttcggggcatatgacatattggctgatgagaaacatatcaccggtaaactttatactcaacgtattgaacgagaaaatctgaacctgcgtaacaggctaaagcgactcaatcgcaagatgctgggttattctaagtcagttgaaatgaatgacaagatcattggcacattcatcgaacgtgagttctattattga

SEQ ID NO: 1200 - DNA, 255 bp, Xenorhabdus bovienii
  Coding sequence Name=Xb4151_4152.C424.gene76.dna; Position on contig =41869..42123bp; Strand=-
atgtccccactgaatttggcaaatggaacaccatttttaagcgctttaatgatgggtctaagaaagctatttttaatttattattcaaattattatctgagaatacagatacagaatggttgttcattgatggcagtattgttcgggctcatcaacatagttcaggggtcgtgtattcaacctgttgattggccatcaataatagaactcacgttcgatgaatgtgccaatgatcttgtcattcatttcaactga

SEQ ID NO: 1201 - DNA, 108 bp, Xenorhabdus bovienii
  Coding sequence Name=Xb4151_4152.C424.gene77.dna; Position on contig =42267..42374bp; Strand=+
atgatggtctggggtaatggttttttcgcgaagacaatgataccagagcatcatgctgttcaaattcccctcataaaacgtcaacagcccctaatctggtcaatatga

SEQ ID NO: 1202 - DNA, 108 bp, Xenorhabdus bovienii
  Coding sequence Name=Xb4151_4152.C424.gene78.dna; Position on contig =42411..42518bp; Strand=+
atgactaacatattaaattttaagttattattctgctgtgtattggtcggtgtaaaaaccatcagtcaaagttttttgcagggaacaaaaattcatgagctatgttga

SEQ ID NO: 1203 - DNA, 453 bp, Xenorhabdus bovienii
  Coding sequence Name=Xb4151_4152.C424.gene79.dna; Position on contig =42505..42957bp; Strand=+
atgagctatgttgatcctactttacttattttgttagtgctggcaggccttggcattatcagccataacatgacagtaacgcttgctatgctgtttttgctgatagtccgtattacaccactgaatcactttttcccttgggtggaaaagtatggcttgacgataggtatcctgattctcaccatcggagtcatggcacctatcgcaagtgggaaaatttctgcgcaggacatattcagttcattcctgaattggaagtcgctgctcgctatcgctgtcggcattatcgtatcgtggctgggaagccgtggtgttgccttgatgtcgagtcagccatctacagtggcggggttattggttggtactgtattgggcgtagcgttgttcaagggcgttcccgtcggcccgctgattgcagcgggtattttatctatcatgattggtaaaccatga

SEQ ID NO: 1204 - DNA, 2142 bp, Xenorhabdus bovienii
  Coding sequence Name=Xb4151_4152.C424.gene80.dna; Position on contig =42954..45095bp; Strand=+
atgaccatgttagattcgatctggaaaaagttgcaggagcaaatgcagcagcaagggcagcgccgcttggtggttttaagtggtgatgtcctgtggagcgagcagattgtcaatcagctgaaaaaacagtttcagggggattgggtaacagtcgcatctggagacgagggtgtgattgagccagtaaaagcgtgtagtttgcttgggcgcgaatttatgcatggggtttttgatgtcacccgtggttttaatgccgaagcgctggcgattctggctggtacgctaaaaacaggaagctggctggtgatgcgtgtacccacttggtcacaatggccagcacagccagatgaagacagttcgcgttggaacgagtcggctggcgtgatctctacaccttattttatccaacatattcaacagcaaatcctagggtttcccgatatcctgctatggcaacagggaaaaccctttcagccaatgcaattaccacaaaccgcatcgtggcagatgcctgatggtaatcctactgccagccagcaggctattcttgagcaattactacgggcttcacagggagtttgggtggtcactgcgccccgaggacgcggaaaatctgccttggccggaatgctcatacagcaatggcaggggaagtgttggctatgtgcacctgcaaaaatcacaacagaagttattcggtattattccgggacttccgatcctgagcagggttctcccgttgataaaaccccattctgggcggtagacaatttattgaaatattgtcgattgaaaaataatcgggaaggacatgatattgatgcagactggcttctgattgacgaagccgcggcgatcccaaccccgcagttagccgaattaatccgatattttccacgagtgttattaacgacaacggtacagggctatgaaggaaccgggcgtggatttttgctgaagttgtgtgccacattgcctgattgccatgttagagaactggaaacaccgatgcgctgggctgaaaatgatccactggaaacatggttagatagcacactgttatttgatgaaaaatcgttgtctggtaagccattggtttattccgaacctgagaaaaatttgcacttttatcccatcactcaggcaatgtggttgcgacaacctgaattactgcgtcagttttatggactgttgacgagtgctcactaccgcacatctcctcttgatttgcgccgtttgctggatggtaacggaatgacttttctggccgctacatctcgttccgctgtgaataatcaacaattgatcggcgcgttatggatggtaagtgaaggtgggttgccacagacattggcgcatgaagtgtgggcaggtcgccgtcgtccaaggggaaatctggtggctcagtctctggccgcccatagtggctttccacaggctgcgatgatgcgttcacagcgtgtcagtcgtattgctgtccgggcacaatatcgccgtcgtggcattgctcaacgcttggttgctcaacagtgtcaagaagctcgcacgcaaaagcaggattttctttctgtcagctttggttataccgctgaactttggtcactctggcaaacatgcggctttcgattggtgcggataggaacccatctcgaagcaagcagtggttgctataccgcaatggctattttgccactgagtgagaagggaaaatggctggctgagtccgcacaacagcaactatgtcgtgatgcatactggctggaattactgatcggtttttccttacccattgatcatcatgatgataaccagctcagtgataatgactggcaggaactggcgggttttgcattcgctcatcgtcccctgtctgcgtcttattttgcgttacagcggctattgttggcacttgatctggctttgccagcattaagaaaatatcttcaacaacagatagatattgaacagtgcgcgcgcgatttattcctgagcggacgtaaggcgttgttgaaacgttgtcgggaagaaaccgcaggagcattggcaagcattgatgagatacttgccaatcagtggaaaaattggactatttcttgcggtgtttctgggaacaatcgtcctcatcatcccatttatcattaa

SEQ ID NO: 1205 - DNA, 195 bp, Xenorhabdus bovienii
  Coding sequence Name=Xb4151_4152.C424.gene81.dna; Position on contig =45040..45234bp; Strand=-
atgcactggttgatggattattggtgggttattctgttactactcatcggtattattgttaatgcgataaaagagctgagccgcgtcgatcagaagcgctttttagataacaaacgagaattaccccctcaccgagattttaatgataaatgggatgatgaggacgattgttcccagaaacaccgcaagaaatag

SEQ ID NO: 1206 - DNA, 675 bp, Xenorhabdus bovienii
  Coding sequence Name=Xb4151_4152.C424.gene82.dna; Position on contig =45283..45957bp; Strand=-
atgatgacgcctgaaatgttgacaggtctgtcaacagatcacttggtgacattcgcgggtaatcaccgtttacagttcaatgccaccaaagcgtttcttgccatgcaaagagatgcagccaaggcaggctttaaattacagcccgccagttcatttcgtgatttcgcacgccagcaagctatctggaatgaaaaatttcggggacaacgtccggtattggatgacaatagccagccccttgatattacaaaaatgaccgaaggagagatttgcgaagctattctccgctggtctgctctgccgggagccagccgtcatcactggggtactgaactggatatttatgacccattccttctgccacaaggtcagaaattgttactggaaccatgggaatatgaaaacggtggctattttgaaccactatcagactggctgactgaaaatatgtctatttacgatttttatcgcccattcaaccgacatagcagtggtgtagcatatgaaccgtggcatatcagtttttggccgttgtcccatgaagcagaaaatttgttcaatgagcaagtgctgctaaaggcctggcaggatcacaacattgctggtattgattggttatcagccaacctctcctctctttttgcaaagtatgtcaaaattgccgagcaggattaa

SEQ ID NO: 1207 - DNA, 1128 bp, Xenorhabdus bovienii
  Coding sequence Name=Xb4151_4152.C424.gene83.dna; Position on contig =45954..47081bp; Strand=-
atgatttgcccagtaattgaacttgcccagcagctaatcaaacatccttctgtcagccctgatgaccaaggatgtcaggatatactcattcaacgtctgcaagatactggttttacaatagaacgaatgcctttcggggataccctgaatttctgggcttatcacggaacaggcacaacgtttgctttcgcaggacacactgacgtcgttcctgccggcgatacttctgagtggcaaacccctccttttgatcccgttattcgtgatggcatgctgtatggccgtggggcagcggatatgaaaggttctctggcggccatgattgttgctgctgaacgttttgtcaaagataatcctgaccatccgggccgcctcgctttcctgattacttcagatgaagaagccagcgcgacaaatggcaccgtcaaggtggtcgaaactttaatgtcacgccatgaacgcctggattactgtctggtaggagaaccttccagccagcaacgtctgggtgacataattaaaaatgggcgtcgtggttccctgacagccagtctgactatccacggtattcaagggcatgttgcctatccacagctggcagataaccctattcaccattcactgccttttctacaagaactagtcaatacccaatgggacaatggcaatgaatttttccccgccaccagtatgcaaatcgccaatattcaagcgggaaccggcagcaataacgtcataccgggtaaattgtgggttcaatttaatttccgtttcagtactgaattgacagataccgaaatccgccagcgggttgaagatatgctgaaaaaacataatctgaaatatgacattgactggtggctatccggccagccttttttgacctgcaaaggtgaactggtcgatgccgtggttgaatccattgaacagtgttgcggatataaaccagagatatcaatgagtggcggcacatcggatgggcgttttattgctaaaatgggagcgcaggttgtggaattagggcctattaacgccactatccataaagttaatgaaggtatcagcgtgtcagatttacagaaattgagcctgatttaccaacgtatcatggagcaattaatcaaatga

SEQ ID NO: 1208 - DNA, 381 bp, Xenorhabdus bovienii
  Coding sequence Name=Xb4151_4152.C424.gene84.dna; Position on contig =47096..47476bp; Strand=-
atgtcagataccacttatcacacagcattcactctctacggtatcaaaaactgcgataccatgaaaaaagcgcgtcgctggctagaagaccaagagatcccctatcagtttcatgactatcgcgttgatggtctatcctcagaattgctacagttatttattgaacaagtcggttgggaacccctgttgaatactcgcggtacaacttggcgcaaattgtctgatgatcaaaagtcagctattaatagtacagacgctgccaaaaaattgatgctggaacaacctgcaatcataaaacgcccactattggtgtcagaaacagggaattatttactcggctttaaagccgaacaatatcaacagtttttctttcatgactag

SEQ ID NO: 1209 - DNA, 111 bp, Xenorhabdus bovienii
  Coding sequence Name=Xb4151_4152.C424.gene85.dna; Position on contig =47475..47585bp; Strand=+
atgatgagatccttagtctggttttacacatccgacataatgcgggaaatttggcattttatccagataacacgacatctttcatgtacgccatctacgtcatttctttag

SEQ ID NO: 1210 - DNA, 99 bp, Xenorhabdus bovienii
  Coding sequence Name=Xb4151_4152.C424.gene86.dna; Position on contig =47558..47656bp; Strand=+
atgtacgccatctacgtcatttctttagaatggataacaatctgttctgcttatgatcaaattattctgtctgttacattagttaatcatgcaaaataa

SEQ ID NO: 1211 - DNA, 636 bp, Xenorhabdus bovienii
  Coding sequence Name=Xb4151_4152.C424.gene87.dna; Position on contig =47802..48437bp; Strand=-
atgcataatcactcagtcatgatagtcgatgatcatcctatcattcgtcacggtttaaaaaggttgattgaactggaacgtgaactcattgtgactgctgaaacagacaatggtgaagatgctataaatatcgcctgccagataaaacctgacattattctgatagatttaaaaatccatggcctttccggaattgatacgattaaatctctccgccgaaaaggtcttgattcctatgttttggtactctcagattcagataatcgcggtgatatttatgatgccattgatgccggggcaaatggttatttattaaaagatattgaactgactcctctgataagtaagataaaaaaagccgcaaatggcgatgcggtgtacagtgaaaaagtctatcaatatttatccacccgtcatctttatattgatcctttatcaaaattaaccaaacgtgaattggatgtcctaaaagaaatctcagaaggaatgacaaataaagaaatcgctgactttctttttatttcagaagaaactgtgaaagttcatacccgtaacttattgaaaaagcttaaatcccgctcccgactagaagctaccatcatctatctaagacatagaaaaccagagttagtctga

SEQ ID NO: 1212 - DNA, 165 bp, Xenorhabdus bovienii
  Coding sequence Name=Xb4151_4152.C424.gene88.dna; Position on contig =48430..48594bp; Strand=-
ttgcgatatttttatatcaggatatattttcagaatctcattatctatgattcaacatactctataaaaattacacagcaatttaacataaagcagagtcctgtcttttatgttttattaaatataaaaatctgcatttctatatgggagaaagaacatgcataa

SEQ ID NO: 1213 - DNA, 141 bp, Xenorhabdus bovienii
  Coding sequence Name=Xb4151_4152.C424.gene89.dna; Position on contig =48545..48685bp; Strand=-
atgcgtactttatttagaaaattactagcaattaaggaaacgcattttcttatggcagtgaattttatttcgcctgaatggataaacctgtttgcgatatttttatatcaggatatattttcagaatctcattatctatga

SEQ ID NO: 1214 - DNA, 2283 bp, Xenorhabdus bovienii
  Coding sequence Name=Xb4151_4152.C424.gene90.dna; Position on contig =48980..51262bp; Strand=+
atgatggacgagaaattaaaacaaagtgctcttgattttcatgaattcccacaaccaggaaaaatcaccgttaccccgaccaaaccattagcaacacagcgtgatttggcattggcatattcgccaggcgttgctgcgccttgccttgagatagcaaaagatcccctggcggcttataaatatactgcacgcggcaatcttgtagcggttatctctaacggtactgctgttttgggcttggggaatatcggtgcattagccggcaaacccgtaatggaaggtaaaggcgttctatttaagaaattctctggtattgatgtttttgatattgaagttgatgagtccaatcctgataaattgattgatatcattgctgcattggagccgacttttggtggtattaatcttgaagatatcaaggcaccagaatgtttctatattgagcagaaactccgtgagcggatgaaaattcctgtattccatgatgatcagcacggcacggcgattatctgtacggctgcggtattaaatgggttgcgaattgtcaataaagatatcggcaaagtacgcatggtggtatctggtgcgggtgcagcatccatcgcctgtatgaacctgctggtggctctgggtctgaaacgtgaaaatattaccgtctgtgactcgaagggtgttatctatcgtggtcgcgaagagaatatggaaaagaccaaagccgattatgctatcgaagataatggctgtcgtacgttgatggatgtgatcccagatgccgatattttccttggttgttctgggccgggtgtcctgacaccagagatggtgaagacgatggcgaaagatccgctcatcatggcgttagcgaatccagaaccagaaatcctgccaccactggcaaaagcggtgcgccctgatgccattatctgtacaggtcgttctgattttcctaaccaagttaataacgtactctgctttccattcatcttccgtggcgcactcgatgtcggagcgacaacgattaatgaagagatgaaactcgcctgtgttcacgcgattgcggatttggcattggccgaacaaagccaggaagtggcttcagcctatggcgatcaagatttgttctttggctctgaatatattattccgaagccatttgatccacgcctgattgtcaaaatcgcgcctgccgtggcgaaagctgcgatggattctggtgtcgcaacgcggcctatcgctgatttcggggcatatattgagaaactcaacgagtttgtctataaaaccaacctgtttatgaagccaattttctctcaggcgaaaaaagagaaaaagcgtattgtattggcggaaggggaagatatccgtgtactgcatgccacgcaggaattggtttcccttggattggcattcccagtattgattggtcgcccaagcgtcattgaaatgcgtattaagaagcaaggaatgcacattgaaattggtaaagattttgaagtagtgaataacgaaaatgatccacgttttaaagagtattggcaggaatattaccaactgatgaaacgccgtggtatttctcaggagcaggctcgtcgtacagttattggtaatccgacactgatcggtgcaatcatggtacatcgtggtgaagcagacggcttgatttgtggcaccgtcggcagctacagcgaacattatcaagtagtgaaagatttctttggcttccgtcagggggtacataccgcaggtgcgatgaatgctttgatgttgccgatggggaatacttttattgcagatacttatgtcaatgaagatcctactccagaggaactggctgaaattacattgatggctgccgaaactgtgcgacgttttggtattgaacctaaagttgctttgttatcacgttcaagttttggttcttctgattgtgtttcagcacaaaaaatgcgtaaggtgctggaactggtacaggaagcggctccgtcacttgaaatcgacggtgaaatgcacggggatgcggcactggtggaaaatattcgccgtgacatcatgccggacagtccattaaaaggttcagctaatttgttgatcatgccaaatatggaagctgcgcgtatcagctataacctgctgcgtgtcaccagctccgatggggtaacggttggcccggtattgatgggcgtgtcaaagccggtgcatatcttgacgccgattgcttctgtccgtcgtatcgtgaatatggttgcgttggctgccgttgaagcacaaaccgatccactgtaa

SEQ ID NO: 1215 - DNA, 903 bp, Xenorhabdus bovienii
  Coding sequence Name=Xb4151_4152.C424.gene91.dna; Position on contig =51417..52319bp; Strand=+
atgaaagcacctacctgtataaaatcgacttttttagcgtgtgccttcctgtttggcggctgtgtaacaccacagcacgatcctcaaaatggatctcaaagagcgcttcaaaccctttccagtgaattagtgcaatccggcatgttgcttgatatgaagacgggcaaagcgatcacctccgcagaactgcttgagcaactggctgtttatcctcgagtcattgtgggtgaaaagcatgataatccctatcaccatcagatcgagttatggctggttcagcagcttgggcaaaaacgcccccacggttccgtattgctggaaatgattaacccaaaccagcaggaaaaagtgaataaagtcaaaagctggttgcagagcaatccgattgtcagagaggaaagaattaaacaattattggcgtggcagcagggctggccgtgggaattgtatggggaactggtcacggagttgatgaaagcaccttatccgttgctggcggcgaatttggatcgttcggagattgatcaggcatataaaaatcattcccctacggataaagcggcatgggtttctgatgatgttaaaaaattaatcgaagaaacgattaaaaattctcacggtgcggacgtagaggcaaaacacctttctgccatgacgatgattcaacaaatgcgtgatcggcggatggctgagcaattggttaacgcgccatcacccgctttgctatttgcgggcggataccacgcagtaaaagcgatgggagtccctcaacatgtgaaaaaaatagtgccaaatgagcaggttgctgtattcgttatcgcagagcaaggggtttctctgaacaaagaatatgctgattttgtctggtttacccccaaagtgactaaagctataacccaatag

SEQ ID NO: 1216 - DNA, 804 bp, Xenorhabdus bovienii
  Coding sequence Name=Xb4151_4152.C424.gene92.dna; Position on contig =52432..53235bp; Strand=+
atgttgacgtataccacgtatcaaaccactcacgttggtcacgtgacaaaatcctttctcgctgcgatcactctccatgctttgctggtgggttggttcatttatacacccgagaacattgatattgaggagtttctgcctccgccagcggttatggtggagttgtcattgcagacagaagcgatacacaagatacagaatcaacctattggaattgaacagcaattgtctgttgctagccagcaacaggaaagtcaggttgatgaagtcaacatgccaaaattagacgtaaatgagaatgcccatgttttggtacataaaccaaagaaaaagcagaaagagcaagagatccctaaaaaaacacagcctgttaagcgtgtgaaggcaaaagaacgggaaagtgaaaaatcccgcagtagtgttgcaccaacaaccagtagtgcgacggcagataacatagcctctcgtacagctgcatcttatgaaagtaattccgatgccattgctgatgccaaagctatttggcaggctgaggtcagtgggcatttaaatcgctataagaaatatccgccggatgcccagagaagaaatcgaacagggcgaccgatggtaaaattcacagttaatcagttgggtactgtgattgatagtgaattaatacaacgttcggggacgaactcactcgaccgggaagcaaggctcgtgttggagagggcacaacccttacctttaccacctgacgttattttaaccaatggcagggtgacagttgaactaccgattgatttttatttatctcagtaa

SEQ ID NO: 1217 - DNA, 2181 bp, Xenorhabdus bovienii
  Coding sequence Name=Xb4151_4152.C424.gene93.dna; Position on contig =53245..55425bp; Strand=+
atgaatggcatgttacagcataaaacggtattttcacctcaaacaaaaagggtagtgcgcagctttctactaggtggtagtttgctgtgtaacagttttgccactattgcaatggagaaaaatatggtgccacctatggccacaaaacagccacataagatgacgttccacggtgatacccgcgttgacaattattactggctgcgcgatgacactcgtcaggataaagacgttattgattatttgacggctgagaatacgtataccgagcagatgctgaaatcaggccaggaattacgggaaacactgtataacgaaatggctggcagaatgagtaaagaagaccagtcagctccttatacctataatgggtatgtttatcgtaccgtttatgaggcagggaaagattttccgatctatcagcgtaaacctgtcgataattcaaccgactggcaggtgatggttgatggcaatgagcgggcaaaaggccataagttttatcgagtcagtggatttgcggttacgcgggacaacaagcgtatagctgtggcagaagatactcaaggtcgccgcaattatcaggtttcatttaaaaatttagatgatggtgaatggcagaacaatgtcattgaaaacacatctggcaatattgtgtgggcaaatgatggtagtacgctgttttatgtgcgtagagatccacagactctgttgccttatcaattattccgtcatcaatatggcactgatatccaacaggataaaaaaatctatcaggaagatgatgaccgcttttatctgggaatatcagaaagcacctcgcttgactatattctgatctctattaccagcagtacgacctcggaatatcggctgattgatgccaataatcctcaatcagaaactcagattttttccgctcgtcaggctgggcgtgaatatgatctcgatcatttccgtggacaattttatatccgttccaaccatgagcatccattgtttggcttatatcgagcagacgctattaataagccgtggaagacggtgattgcacctcaggaagagactgatctggaaaattttgccctgttcaatcactggctggtagtgcaagagcgtaccaaaggattgtcaacaattcgccagattgattggaaaacccagcaggaaaaacgcgttaagtttgacgaacctgcatatatggcatcgttagactataacccggaacccgatactgatttactgcactatagttattcctccatgactacacccagttcggtattccagtggaatatgcaaacaggtgaacgtgagttactgaaacagcaggaagtgaaagggttcgataaagagaactatgaaagccagcgtatttgggtaaaagcccgcgatggtgtagaagtaccggtttctctggtataccgtaagtcattatttaagaaaggtgaaaatccaatcttgatttacggttatggttcttatggtatcagtatggacccttatttcagctctccgctgctgagtttgctggagcgtggcttcgtgtatgccttggtacatgtgcgtggtggtggtgaattgggtaagaactggtatctgcaaggtaaagtcgaaaacaaaatgaacagtttccatgactttattgatgcgacccaaacattgcttgctgacgggtatggtgacagccagcgcgtatatgccgaaggtggcagcgcaggcggtttattgatgggaacggtgatcaatcaggctccggaactctatcgcggagtgattgcaaaagtcccttttgtggatgctgtgaccacaatgcttgatccatccattccattgacgacgggtgaatatgaagagtggggcaatccaaataacaaagaagattacttccgcattaagtcctatagcccttatgataatgtcaaacatcagcattatcctcatttattggttacgacgggtttgcatgattctcaggtgcaatattgggagcctgcaaaatgggtggctaaattaagggaaataaagcagggggatagtctcttattactggaaacgaatatggataccgggcatggtggaaaaccagggcgttttaatcgcttgaatgatattgcctttgattatagttttcttttaatgttggatgataccaaagtttattttccacaactaaaagactaa

SEQ ID NO: 1218 - DNA, 2265 bp, Xenorhabdus bovienii
  Coding sequence Name=Xb4151_4152.C424.gene94.dna; Position on contig =55544..57808bp; Strand=+
atgttaatgaaaattgtggcaaaaatagcgggagccagtgcaatacttattgggcttcaggggatagctcatgctgaaaatgcgagtgacaataaaaaagaaaaagttatgcgctttagcagcctgaaagtttcaggtgctcaagataataattccccacaggttgaagcaatggaaaaacccggcgcttatagttctgtcggggaagataataagctggaatcgatggacagcgtcctgcgcagcctgccggggacttatactcagatggatgcaagtcagggaactataagtgttaatatccgtgggttaagtggttttggccgcgtcaatatgatggtagatggtgtcagtcagagtttttatggtacttcgccgagtgaatatgggcatggggcgcagccttataaccaatttggtgtgttgcttgatcctaattttattatacgaacagatattgatcgtgggcaatccagtgattctgactcagtcaatgcgttggtgggaagtgctaacttccgtaccattggtgtcgatgatgtcatctttgaagggagtaaactaggagtgcgtactaaatgggcatacggtaacaatggtattggcaaaagtggaatgatggcggttgcaggaaaaatacaaacatttagtccagaaggttcccttggtgcaatgtttgctgttagtgggcacagtattgatgcacattataaaaatgctatgggtgttagtagtaatgaatttggtacaagagattcatttaaacaaaagccaaaatctcaactgatgaaaataaatatcaaacccaatgattttcatgatctggagttaagcgggcgtttttatcacaataaatttaataaacgtaatattgatagttatgactattatttgaaatatcattacacaccatttagtgaattaattgacacaagaattttgctcagtacaggaaatagtattcaagacgttcaaggtggcgctttggctggactaagcagaagtgaatcacgtaataaatctgatgccattgatatcaaaaacaccagtcgatttaattacggtgataccgattttgcgtttacgcttggtagcaaattgatacgtaatgaatatcgcaagagaacgggtattgatttcggtgatgggaaagagtatgtatctacagaagataataacgtattttccccaagcgggaaacagaatactaccagtatttatagcaagttaaaagttgaacacgatatttataccgcagatctgggactaaattatctagattccagcttaaaaggaataaaaccagcttgtgatgagatattagattgttttccacagggaagatcattattgaatataaaatcgcgtggatttaatccgggaattttattatccgcagaaatcatccctgcattccagccatttataagttacgcccattcaatgcgaacaccaaatgcacaggaggttttttattccaatgaagcgggggcttctgtaaatcccttcctgaaaggggagaaagcggatacttatcaaattggttttaatagctatcgcccaaatttaattgtggaaagagatacgttccgcctgaaagcagtatatttccataccaagattaaaaattacattaggagtgaatcttatacactatgtgcaacaggaaaaatctgcaaagatgatggttcattggaattcaaagattaccatgaaagatcgtttaatataatggtttataccaataacttaacaccaactaatatgagtggttacgagctttcggcaaactatgatgctggtatattctacagttcattggcgtatagccagcaaaaaacacaacagccgacttccagagcaacatccgaatttggggcgagtccagcatctcaattgccagaacgttatatcacattggatacgggcgttcgtttattagacgaaaaaattcgtgttggggctatagtgaaatatacgggaaaatcttatcaccaagatcctttaatggaggtggataaaaacaatggtggtcatataaagatggtgaaagatgataagataccaaccattgtcgatttatacacggattatcaggtcaataaaaatatttctgttaaattatccgtacagaacttgaccaatagaaactatgctgatgcattgaaccgtatgaattcctcagcatttatgggagatgatgatgcagtgacccaaactgctcgtggcagaacctacgtaatgggtgcggaagttcgcttctaa

SEQ ID NO: 1219 - DNA, 1368 bp, Xenorhabdus bovienii
  Coding sequence Name=Xb4151_4152.C424.gene95.dna; Position on contig =57858..59225bp; Strand=-
atgtcactaccaaccaacaccggaattttttctgttagtcgcctgaatcagactgtccgtcagctattggagctggaaatgggtagaatttggctaagtgctgaaatttctaatttttcccagccttcatcagggcattggtacttcacgttaaaagatgaacgagcacaaattcgtgctgccatgtttcgtagcagcaatctgcgggcaacatttcgtccacaaaatggtcagcaggtgttggtgcgtgcacagattacgctatatgagccacggggtgactatcaactgattgtggaaagtatccaacctgctggagatggactgctacagcaacaatttgagatactgaaacagaaactcacctcagaagggttatttgattcgatccataaaaagccactgccctcaccagcaaaacgcctcggtgtcattacctccgccagtggcgcggcgctgcatgatattctccatatcctgaaacgccgagatccatcactgccaattatcatttatcccactgcggttcagggagctgaagcgccgttacagattattcgggcgattgaactggcaaatgatcggcaggagtgtgatgttttaattgtcggccgtggcggaggttcgctggaagatttgtggtgtttcaatgatgagcaggtagcgcgggcaatcttccagagccgtattcctatcgttagcgcaattgggcatgagaccgatgtcacaattgcagattttatagccgatctacgcgcacctacgccttctgcggccgctgagctagtcagtcgcaatcaaattgagctgttgaggcaggttcaatctctgcaacaacgactcgaaatggcgatggattacttttttgcccaaaaactgcgtatttttaatacgttgcagcatcagctccagcaacagcgccctgatttgcggctggctcgtcagcagaataaattagtggaattacgtcaaaaactggtcgatagcctcctgcgctgtttgaagcaacattttctttcacatgagaagctaaatctacgactcttacagacaaatcctgagcagcaaattcggcattatagccaacagatccaacaatatgattttcggttgaagcaagcgattgaacgccaattaggacattatcgggagaaatttgcggtttcctgctcccagctcaatgcagtcagcccactggcgacgctgcaacgcggttatagtatcagtgaaactgcggatggcactttactgaaggaaactaagcaagtgaaagttggggataccctaaacactcgattacaggatggctgggttaaaagtcaggtgattcaagtaaaaagaccgaccaagagagaaaaattacaatag

SEQ ID NO: 1220 - DNA, 1467 bp, Xenorhabdus bovienii
  Coding sequence Name=Xb4151_4152.C424.gene96.dna; Position on contig =59396..60862bp; Strand=+
atgttgcgaattaaaaaagaagcattaacttttgatgacgttttgttggttcctgcccattctacagtcctgcctaatacagcagatctgtccactcaattaacttccactattcgtctgaacgttcctatgctctcagcggccatggatacagtgacggaatctgctctggcaattgcactggcccaggaagggggtatcggctttattcacaagaatatgcccattgagcgtcaggcagaagaagtccgccgcgtgaaaaaacacgaaagtggtgtggtgactaaccctgttactgtaacgccacaaactacactgcgtgaagtacatgaactgactaaacgtaatggtttcgcaggttatcctgtcgtgacagaagagaacgaactggtaggtatcattactggccgtgatgtacgtttcgttactgatctggatcagccagtgactgcggtaatgacgccgaaagagcgtctagtcattgtaaaagaaggtgaagcgcgcgaagttgtgttgcagaaaatgcacgaaaagcgtgttgagaaagcactggtcgttgatgatagtttccacttgcttggcatgatcactgtgaaagatttccagaaagcagaacgtaagccaaacgcctgtaaagatgaagagggtcgtctgcgggttggtgctgcggtcggtgcaggtgctggcaatgaagaacgtgttgatgcgctggtagctgcgggcgtggatatcctgcttatcgactcatcccacggtcattctgaaggtgttttgcagcgtattcgcgaaactcgtgctaaatatcctgatttgcaaatcattggtggtaacgtagcgactggcgaaggtgctaaggcactgtttgaagccggcgttaacgcagtgaaagtcggtattggccctggttctatatgtactacccgtatcgttactggtgtcggtgtccctcaaatcacggcgattgctgatgcagtggaagccctggaaggtactggtattcctgtgattgctgacggtggaatccgcttctctggtgatatcgctaaagcgattgcggcgggcgcatcatgcgtcatggtggggtcaatgctggccggtacagaagaatcccctggggaaattgaactctatcagggccgttctttcaaatcctaccgtggtatgggatcactgggcgcgatgtccaaaggctcctctgaccgttacttccagaccgataacgcggcagacaaactggtgccagaaggcatcgaaggccgtgtggcttacaaaggcctgttgaaaagcatcgttcaccagcaaatgggtggcttacgttcctgcatggggttaacaggctgtgccactattgacgaactgagaactaaagcagaattcgttcgtatcagtggtgcaggcattcaggaaagtcatgtacatgacgtgaccatcaccaaagaatcaccaaactatcgtttaggtttgtaa

SEQ ID NO: 1221 - DNA, 1578 bp, Xenorhabdus bovienii
  Coding sequence Name=Xb4151_4152.C424.gene97.dna; Position on contig =60939..62516bp; Strand=+
atgacaactaatatccaccagcatcgcatcctgatccttgattttggttcgcaatatacccagctaattgcccgccgtattcgtgaaattggtgtttattgtgaactttggacatggaatgtcacggaagagcaaatccgtgaatttaacccgagtggtatcatcctttcgggtgggccggaaagtacaacagagaataatagcccgtgtgcaccggaatatgtctttcatgcaggtgtgccggtactgggaatttgctatggtatgcaaactatgtccatgcaactgggcggcaaagtgggcaattctactgagcgcgaatttggttatgctcaagttgaaatcaaagatgactgtgaattattccgtggcattcaggatgttcagagtgaatccggtaaacctttgttggatgtttggatgagccatggtgataaagtcactgctattccagaaggtttcatcaccgttgccagcacggatacctgcccgtttgccattatggccaatgatgaaaaacgtttttatggcgtacaattccacccagaggtgactcatactcatcagggtttgaatattttacaacgctttgtactggatatctgtcaatgtgaagtattgtggacgccagcttccattatcgacgatattgtagaacgcctgcgtacgcagattggtgatgatcacgttattctggcactgtctggtggtgtggattcttccgtaaccgcattgctgctgaaccgcgcgattggtaaacgtctgacctgtgtttttgtagacaacggtctgttgcgtctgaatgaagccgatcaggttatggcaatgtttgagggtaaattcgacctgaacctcgttcatgttaaggcagaagagcgcttcctgtctgcgttggcgggtattgatgagccagaagccaagcgtaaaaccatcggccatgtctttattgatgtatttgatgaagaagcatcaaaacaaactcaggttaaatggctggcacagggtacaatttatccagatgttatcgaatctgctgcttctgcgacaggcaatgcccacgttatcaaatctcaccacaatgtgggtggtctgccggacgatatgaaactgggattagttgaaccgctgaaagagctgtttaaagacgaagttcgccgtattggtttggaactgggtctgccatatgacatgctgtaccgccatccattcccaggcccaggtcttggtgtgcgtgtattaggtgaagtgaagaaagagtattgtgatctgctgcgccgtgcagatgctatctttattgaagaactgcataaagcggatctgtacaataaagtcagtcaggcgttcactgtattcctgccagtgcgctctgtcggcgtaatgggtgatggccgtaaatacgattgggtcgtttccctgcgtgcagtagaaaccattgactttatgactgctcactgggcacacctgccatatgatttcttaggtcgtgtgtcgaacaggatcattaatgagatcaatggtatatcgcgggtagtctatgatatcagcggtaagccacctgcgacgatcgagtgggaatga

SEQ ID NO: 1222 - DNA, 162 bp, Xenorhabdus bovienii
  Coding sequence Name=Xb4151_4152.C424.gene98.dna; Position on contig =62473..62634bp; Strand=+
atgatatcagcggtaagccacctgcgacgatcgagtgggaatgatctagagtcttcccaagcctccccaaatcatcataattttctaattaagaccctgatttcagggtctttttatccctgtatctcaccaaatcacaccacctcagtattcaatttttga

SEQ ID NO: 1223 - DNA, 165 bp, Xenorhabdus bovienii
  Coding sequence Name=Xb4151_4152.C424.gene99.dna; Position on contig =62818..62982bp; Strand=-
ttgcattccgtttcagttcacgtgaaaccgtgctggaatgaacaccaagcgattcagcgtttgatgttgtggaaagcccctgttatacagggcttgaagctgatatctttgctcgggagtcaactgtcggtactgtctggtttgtttatgcatatcaggccatga

SEQ ID NO: 1224 - DNA, 141 bp, Xenorhabdus bovienii
  Coding sequence Name=Xb4151_4152.C424.gene100.dna; Position on contig= 62942..63082bp; Strand=-
atgttttcatgccgggggtggtattttctaaacttaaaagcggtcttttttcgattatttttcaatatttcagcagacttagcacaatattgtttattgtttgcattccgtttcagttcacgtgaaaccgtgctggaatga

SEQ ID NO: 1225 - DNA, 162 bp, Xenorhabdus bovienii
  Coding sequence Name=Xb4151_4152.C424.gene101.dna; Position on contig= 63018..63179bp; Strand=+
ttgaaaaataatcgaaaaaagaccgcttttaagtttagaaaataccacccccggcatgaaaacatcttgtctgagggattatcaatgggttggtcgccagagaatattgactacgaatgcgtctggagtgtccggagatatagcagaatcaacataacctga

SEQ ID NO: 1226 - DNA, 405 bp, Xenorhabdus bovienii
  Coding sequence Name=Xb4151_4152.C424.gene102.dna; Position on contig= 63181..63585bp; Strand=-
atgccacgtaaacaggggtattcggaaaaagggttacgctgttttggtacgcatgactggcacgcaaaaggccgtctcaacgtcattggcgccattctcgaaaataccttcgtcaccttaagcttatttaccgggaatattaatgccgatgtttcttatgcgtggatgacgcaagatttgctgccaaagcttccacacggagcagtgatagtgatggataatgcgcctttccataaacggaatgacacgacacaagcgatagcagacagcagatgtcaactggaatggcttcccgcttatagtccggatttaaaccctatagaacacaaatggggcggagcaaaagcgataaggaggcaaaaaagatgttcagttgatgagttgtttacggagcatattgaatag

SEQ ID NO: 1227 - DNA, 324 bp, Xenorhabdus bovienii
  Coding sequence Name=Xb4151_4152.C424.gene103.dna; Position on contig= 63465..63788bp; Strand=-
atgggaaagagcaaaacgtttaggtgtctcataatcggctattcattacgccttgaaacggctgaatatcaccccgaaaaaaaacgctccaacaccctcgcgctgatcctcaagctcgtcaggcatttatcgagcacatcagcgatgatgaacagactggcagaccccttgtttatttggatgaaagtggttttgctcaatcgatgccacgtaaacaggggtattcggaaaaagggttacgctgttttggtacgcatgactggcacgcaaaaggccgtctcaacgtcattggcgccattctcgaaaataccttcgtcaccttaa

SEQ ID NO: 1228 - DNA, 252 bp, Xenorhabdus bovienii
  Coding sequence Name=Xb4151_4152.C424.gene104.dna; Position on contig= 63755..64006bp; Strand=-
atgggctacagcttagattttcgaaagcgagtactggcatacaaagacaagcattcgttgactttcgaacaaacgagtgcccattttgagatctccatgcgtaccttgttccggtggtgcaataaaatagaaccttgcatgacccgcgataaacccgccacgaaaatccctgataaggtactcattgcagatgtccaaaatttttctgatgactctcaatgggaaagagcaaaacgtttaggtgtctcataa

SEQ ID NO: 1229 - DNA, 1191 bp, Xenorhabdus bovienii
  Coding sequence Name=Xb4151_4152.C424.gene105.dna; Position on contig= 64161..65351bp; Strand=+
atgtcctctgtcagccctttgttacagcattttgcctcacttgaagatccccgagttcaacgaactcagttgcatagtttggaaaatatcctgactatcgccatctgcgctgtgatttgtggcgctgaaggttgggtcgaaattgaagagtttggcgaatctaaacaggatttctttacccaactgcttgatctcactaatggcatcccctctcacgatacctttggtcgtgtctttgctgcacttgatacgcaggcttttgccgactgtttcacctcctggatatctacgctggcacaaggagttgatcaggatatcatcgctattgatggcaaaaccatgcgccggtcactcgataaagccaacggcaaggcggcaatccatctggtcagcgcctttgcctgtaccaatcgcttagttctgggacaagtgaaagtggagagtaaatccaatgaaatcaccgctattcctgagttacttcgacgattggttttgtctggaagtctggtgactatcgatgccatgggatgccagaaagcgattgctcatcaattacatgaagcgggcgcggattacgtactgagcctgaaagaaaatcatcccggcctgtataatgatgtcagccattatttcgattatgtctcatcccaaccggagcacctgagcgaatatgaagacgtggatgccggacatggccgcattgagcgacgcacagtacaaatgacccatgttgattggttgccggaaaaggcgtgctggtgtggtttacacagcataatacgggtgatccgcgaacgctatgtaggaaatgaagtgagccgggagagctgttattttatcagcactttacgtccgacagaggctcaacgggcagcgacagcgatccgcagttactggcaaatagaaacgcaactccattggtgtctggacattgcatttaatgaagatcaacagcggatgcaggagggcaatgcggcggctaatatggcattactcaataaaatcgcgttgaatttacttcggttgtcccctaccaaagcaggaattaaagcccgccgtaaacgggcggattgggaggacaaatatctgcttacggtattgggtaaagcccagcaaatttatatgcgattgccctgggtcgcacccgtttcaggatgcaaccgcgttgcgcacccgttatgcaaaaaataa

SEQ ID NO: 1230 - DNA, 180 bp, Xenorhabdus bovienii
  Coding sequence Name=Xb4151_4152.C424.gene106.dna; Position on contig= 65279..65458bp; Strand=-
gtgatcttctttcttagggaatatcactggttcaggccaaagtccggttgccgtgattcatggcttgagccacaatcacagccatcagactgtcagcatcagcatccttattttttgcataacgggtgcgcaacgcggttgcatcctgaaacgggtgcgacccagggcaatcgcatataa

SEQ ID NO: 1231 - DNA, 1050 bp, Xenorhabdus bovienii
  Coding sequence Name=Xb4151_4152.C424.gene107.dna; Position on contig= 65699..66748bp; Strand=-
atgattgcgcccatgaaaattaatctaacaggtgcccaaaaagacgccctcgaattgatgcatgatacgactcgcgatggacgagtacgtgaccgcatcaaggccgtgcttttggcctcagaaggctggactgcccagatgattgctcaggctttgcggatccatgaaagtacggtgagccgccatctgaaagattacttctctgaggaaaaactcgcccctgaaaatgggggctctgaaagccgtttgtctgccgaacaaacaacagaattagttgagtatctgatggcaaatttgatgcacactaccgcacaaattgtggcctatgttcgggcacgatggcaggtgactttcactgtcgcaggaatgacgaaatggcttcaccgtcaaggtttcagctacaagaagccaatgggtgctccgcataaatttgatgcggataaacagcaacagtttattgaaacctacaacgcgctgaaagaagaatgtggccagaatgcgcctattttatttattgatgcggttcacccgaccctgtccacaaaattaagttatggctggatgaagagcgggcggaagcacgtcaaagtggttgaaaccacaggcagtcgtactcgactcaacatcatgggtgcccttaatttacaacggattgaagagactattgttcgtgaatatccgacgattaacgcgaaaaatgtcgtcctttttttcggctcaatccgggaaacctatccactttcgcaaaaaatccacattattctggatggtgcgggttatcaccgttccggagtcgtccaattttttgccgaggttttgaatattgagttgcactacctgccgccttacagccctaatctcaacccgattgagcgattatggaagtatgtgaatgagcaggtacgaaacaatgtctattttccggataccaaaacattccgtgaaacgctgcgccacttttttcatgtcacattgccagaaaaagcgaaagaactcaccactcggttgactgataacttccagattttaaaacccgcatcttcaagttaa

SEQ ID NO: 1232 - DNA, 903 bp, Xenorhabdus bovienii
  Coding sequence Name=Xb4151_4152.C424.gene108.dna; Position on contig= 66971..67873bp; Strand=+
atgaatatcaacatattaattacatcgatagcagtcgaaaaatattcgacaaaaaataaatcacctcgagaaaccaatatgcaaacagtaagcctaaatgaaaaaattcaaattttccgtcaactccatgaggaaggtcgcctaatattagccaattcttgggacgtcatgagtagtcgtttagctgaacaaagtggtgccaaagcgatagccacaacaagttctgggatatcttggagcttggggtaccctgataatcaattagccgatcggaaactggtgataaaagcgctaggtttaattacagactgcaccaaccttccagtttctgctgacattgaagatggtctgctgagtattgatgaaaatatggatcatcttgtacaagacttatattctgtcgaatgtgtcggtattaatatcgaagatgctcaaaatggtaagtcaatgtctatagaggatggtgccgaacgcatagctgctgtacgtacttccgcgaataaattgaattacaatttatttatcaatgctcgtattgattcatggcttcgtggtgaaaataccgaaccagctcacttgatttcccgtgctaatgcttaccttgccgctggcgcagattgtatctttatccccggtctaaccgatttagctatctgccaaacgatcagtactcatattaacggaccgttaaatgtaatggcacactctggggcccccagcgcagaagaattttttgcggctggagtgaaaaggatttctggcggttctttctttgctgaacaagcatacggaatcactttggcaagtatggagaattttgtacgaaatggtatgttacagccaaatgataaggcaaaactgaattatatggagctaaatgctctattggatcagaaagtataa

SEQ ID NO: 1233 - DNA, 114 bp, Xenorhabdus bovienii
  Coding sequence Name=Xb4151_4152.C424.gene109.dna; Position on contig= 68003..68116bp; Strand=-
atgacttctttgaaaacagattatgtttctaagctgtgtgaattttcaagagaaaatttattttgtttttatctaattgaaattattttaatactgtattgttttcttaattag

SEQ ID NO: 1234 - DNA, 378 bp, Xenorhabdus bovienii
  Coding sequence Name=Xb4151_4152.C424.gene110.dna; Position on contig= 68187..68564bp; Strand=+
atggcgtctggtatgagtcaaacgttaacttctcaatctaatttacaagataatccctgtataagctgtggtgcttgctgtgcatattttcgtgtttcattttactgggcagaagccgaagatggcggaggtactgttcctatctttatgaccgaaaaattaaacgctttcatgagttgtatgaaaggtacaaatgaacctaatccccgctgtataaatttacgtggtgaaattggtcaatcagtctcttgtaccatttatgataaaagaccttctccttgtagggaatttactcaagcttgggaaaccgacgattacaatgaagcctgtgatcgtgccagagccgcttatggacttccgccactgccaaaattgtag

SEQ ID NO: 1235 - DNA, 141 bp, Xenorhabdus bovienii
  Coding sequence Name=Xb4151_4152.C424.gene111.dna; Position on contig= 68682..68822bp; Strand=-
ttgacttttaatcaattggtcgcaggttcgaatcctgcacgacccaccatgaagtgggcgattagctcagttggtagagcatctcccttacaaggagggggtcatcagttcgaatctggtatcgcccaccacttcatctaa

SEQ ID NO: 1236 - DNA, 117 bp, Xenorhabdus bovienii
  Coding sequence Name=Xb4151_4152.C424.gene112.dna; Position on contig= 68917..69033bp; Strand=-
ttgacttttaatcaattggtcgcaggttcgaatcctgcacgacccaccattttaaatatcaaatcaaaattatctaattgggtcgttagctcagtcggtagagcagttgacttttaa

SEQ ID NO: 1237 - DNA, 135 bp, Xenorhabdus bovienii
  Coding sequence Name=Xb4151_4152.C424.gene113.dna; Position on contig= 69051..69185bp; Strand=-
ttgaagtgggcgattagctcagttggtagagcatctcccttacaaggagggggtcatcagttcgaatctggtatcgcccaccacttcatcagattgtttcgcagtatcacattgatatttaaaatgggtcgttag

SEQ ID NO: 1238 - DNA, 162 bp, Xenorhabdus bovienii
  Coding sequence Name=Xb4151_4152.C424.gene114.dna; Position on contig= 69189..69350bp; Strand=-
aatctggtatcgcccaccatctctctcgtagtgataaaaaatgattttatgattgggcgattagctcagttggtagagcatctcccttacaaggagggggtcatcagttcgaatctggtatcgcccaccaatcataaatcagtggtattgatgtcgttatag

SEQ ID NO: 1239 - DNA, 684 bp, Xenorhabdus bovienii
  Coding sequence Name=Xb4151_4152.C425.gene1.dna; Position on contig =1..684bp; Strand=+
tcagccaaaaccgataaaatagatgctcaggtgctggcacagttagccctggttttatctcaacgaacagaccgggataaaatagtcaggatattgccctctgctcagcaacgagtcttgcaagccatgatcgcacgtcgtcgccaattggtcgtactttccatctcagaacgccaaaggttggggaattgccatccagacattcgagaaagcatcactttaatgatcagctttatacaggaacagcttaaggtcattgaatctgccttgtctaaacacattaaaacctatcatcgttccaaactcgatttattatctacagtaaaaggcgttgggcctgccacaatagccactttgatcgctgatgtaccggagttgggtaagttaacacgccgggaaattagtgccttgattggtgttgcaccgtttaatcgagattctggatttttccgggggaaacgaacaatctttggaggaagagcaatggtgcgtcgaatgctatatatggccacgttaacggcaattagatttaaccccgttctctgcgctttctacaagagattgaccgaagcaggcaagccaaacaaagtcgccatcgttgcgtgtatgcgtaaattactggtcattctcaatgcaatgataaaaacaaatagaccgtgggacgaatcattccacacggtgtaa

SEQ ID NO: 1240 - DNA, 144 bp, Xenorhabdus bovienii
  Coding sequence Name=Xb4151_4152.C425.gene2.dna; Position on contig =697..840bp; Strand=+
ttgctcattaaccgccttgctaaaaatagtcttttttgtgatcgggcgcataaaataaacacaatcatgattttgtcaaagttgttacctatttttttatttttatctcatgatgttacgaaaaaaaacaccttttatggataa

SEQ ID NO: 1241 - DNA, 243 bp, Xenorhabdus bovienii
  Coding sequence Name=Xb4151_4152.C425.gene3.dna; Position on contig =848..1090bp; Strand=+
gtggttcgatacactaatcacatacgctatctaagaatattatttttcaaccgaaatcattttaactttttacgctgctattgtcggataccattttttatttcacttgatttaacttggcctttactccttctttacttacttattattgccttcattttatttatcacggatcagtcgatatattcggacaacagagtcccttcaaattatcggaaaacaacctattgcgtccttaattag

SEQ ID NO: 1242 - DNA, 336 bp, Xenorhabdus bovienii
  Coding sequence Name=Xb4151_4152.C425.gene4.dna; Position on contig =996..1331bp; Strand=+
ttgccttcattttatttatcacggatcagtcgatatattcggacaacagagtcccttcaaattatcggaaaacaacctattgcgtccttaattaggtcatgtattaaatggttagttgctgtgatatgcttccggctttttaaggatgaagtatggccaaagttgatgtctattgccgttattgccacaaatcagaacaggtcaaaggacatgggaaaggaaatggcggacatcctcgttatcgctgttatagctgctgtaaggtctttcagttggcgtatacctatcaggcctgcaaacccggcgttaaagaacagattgtcgatatcgcgatga

SEQ ID NO: 1243 - DNA, 279 bp, Xenorhabdus bovienii
  Coding sequence Name=Xb4151_4152.C425.gene5.dna; Position on contig =1282..1560bp; Strand=-
atgagccactattcgcttcaggcggggttcccaagcataccaaagccagcgttggtttttcttattgccgacaaacgaccattgctcgtcgatttcacagacaatctggatgccacattccgcaaggggaagtgtcgttacgtttcggagtctgaggtttttaatgttttcatgacggtggcggtggcgactttcaggatccgagcggtgtcacgaattcccccgttattcatcgcgatatcgacaatctgttctttaacgccgggtttgcaggcctga

SEQ ID NO: 1244 - DNA, 291 bp, Xenorhabdus bovienii; identical to SEQ ID NO: 352
  Coding sequence Name=Xb4151_4152.C425.gene6.dna; Position on contig =1552..1842bp; Strand=+

SEQ ID NO: 1245 - DNA, 543 bp, Xenorhabdus bovienii
  Coding sequence Name=Xb4151_4152.C425.gene7.dna; Position on contig =1855..2397bp; Strand=-
atgagtagtagaagtgatgtaataaaaggaaggttagtttataccgaaaaattaggatgggtagatactgggcattcaaaaggtaatgatgccagaatgttaatggccgctataaattcaggtgatgatactaaagaaccatactttaccattaagtacacacaatacatggggcttggattaaaatatggcacatctaaaataacaagatggaaagtaagaagaggactatctttacacgataaaaaaagagttgcccttactattatgatgcatacaactcatctatttgaagcacatcaagattcttttccttttaattggtatacagatagtgggtacagtggtgaagatttggtttcaaatctacttggtttttatcaggctataaatggagttgattatttacctcagcttcaacctataagtaaagatgatgcactaaaaagatgggattattatggcgctataggaaagtataaaaataaaatgtttaagcctttattgttccctgacccccaaaaatggtcatgtattaaatga

SEQ ID NO: 1246 - DNA, 126 bp, Xenorhabdus bovienii
  Coding sequence Name=Xb4151_4152.C425.gene8.dna; Position on contig =2472..2597bp; Strand=-
gtgagattgggatttactaatctactatgtaattatagtatcatatactatagaagcctacattttaacgtaaaacaacaaaattgtaactttgtgttaatccagcaagagtcttctattaagtag

SEQ ID NO: 1247 - DNA, 291 bp, Xenorhabdus bovienii; identical to SEQ ID NO: 155
  Coding sequence Name=Xb4151_4152.C425.gene9.dna; Position on contig =2781..3071bp; Strand=-

SEQ ID NO: 1248 - DNA, 279 bp, Xenorhabdus bovienii; identical to SEQ ID NO: 890
  Coding sequence Name=Xb4151_4152.C425.gene10.dna; Position on contig =3063..3341bp; Strand=+

SEQ ID NO: 1249 - DNA, 216 bp, Xenorhabdus bovienii
  Coding sequence Name=Xb4151_4152.C425.gene11.dna; Position on contig =3292..3507bp; Strand=-
gtgatatgcttccggctttttaaggatgaagtatggccaaagttgatgtctattgccgttattgccacaaatcagaacaggtcaaaggacatgggaaaggaaatggcggacatcctcgttatcgctgttatagctgctgtaaggtctttcagttggcgtatacctatcaggcctgcaaacccggcgttaaagaacagattgtcgatatcgcgatga

SEQ ID NO: 1250 - DNA, 228 bp, Xenorhabdus bovienii
  Coding sequence Name=Xb4151_4152.C425.gene12.dna; Position on contig =3562..3789bp; Strand=+
ttgcatgatttaagaagaactttttcaactaaactcaatgaattaggtgtggcgccacatgtggttgaacagcttctgggtcatgctttgccgggcattatggctatatacaataagagtcaatacctaccagagaagctagatgctttaaacaaatggtgtgagcgtctggatgtattggcgggtaattatgaaaatgtggttatattaaaggcggggcagcaatga

SEQ ID NO: 1251 - DNA, 837 bp, Xenorhabdus bovienii
  Coding sequence Name=Xb4151_4152.C425.gene13.dna; Position on contig =3786..4622bp; Strand=+
atgacagaatacccagagtatgtagattattgtttgattgagtggtatgaatcagaagtgattttggattttacaattcctatccctgatgcaaaaaaagaagaacttgataaagtggggtgttttattgattctaatgaatggactccaactctatcggagaaagatgtcgcttataaattaatatttgatgaaaaaatgattttcatttggtcagcattatctaatagagcgaatgagtgccgcaatccttatatgttctatcaatctcttacggatgaaattatttccgcaatcaaagggcctagcgattgggatctattaacgcaaaaacaaaaagaagaaaaaacagaaaaaataaaaaaattgtcatttgagctaaataaagaaatatccaataccccattagatgtttcaataatgaactatgcaagccatgaatcttattttcaacgtttcaaaagaatgcacaatagtgaaaaatcaaataatatgcttgatcaccatttagagaagtattgtttttataaaaattcacattttcttcctaaatatgggcatgaaggtgctatagggtgggcatggaatagcgttggtgttacatcaccatcaataagttcttttttgcaagatttaaatgagcaggctaattcatttaaatgtgaatccatcttaaaaagaaaaaatcaaataaaaagaactttttttgttagaaaaatatcagcatttttttccgataattttggtaccccacttcataatattacagcgacaattagtagtgtttttcttgatgaagatataacgatagaggaagtcagatccatgatcagataa

SEQ ID NO: 1252 - DNA, 168 bp, Xenorhabdus bovienii
  Coding sequence Name=Xb4151_4152.C425.gene14.dna; Position on contig =4541..4708bp; Strand=-
ttggtgttatacccattcatttattcttttttaagccattggcgtaaatctggcattttaatgttgttttacgccaatgtgttatgttatctgatcatggatctgacttcctctatcgttatatcttcatcaagaaaaacactactaattgtcgctgtaatattatga

SEQ ID NO: 1253 - DNA, 282 bp, Xenorhabdus bovienii
  Coding sequence Name=Xb4151_4152.C425.gene15.dna; Position on contig =4810..5091bp; Strand=+
atgaccattcgatataacactcctacaccagaagaacgccgctctatcctttccgagtatggcgaaccttacgatcgtcttatccgtgaaaaggaacgccatcacatcacttctatttccagaacatcagcgtggaaactggagaacgaaggccgcttccctgcccgcaaaccactaggccgcaattcctgtgcttggttactcagtgacttactgcattgggtacgcaacccgccaacagtagagaacgtcaataacccctacagccgaaaatcaaattaa

SEQ ID NO: 1254 - DNA, 807 bp, Xenorhabdus bovienii
  Coding sequence Name=Xb4151_4152.C425.gene16.dna; Position on contig =5109..5915bp; Strand=+
atgaaatctaaaaatgcggccttaactggtcagggacttgctcacgctgaaaacaatcaagagcctattttagttcagcgcaaagagaacctaaaaaagaattatgccgaaatgatcccgttaacagcgggaactattaatggaaaggcagcaatggttactgatgccagaaacctgcataagtttcttggcaataaggaactgtttgctagctggataaaacagcgcattgatcaatacggttttattgaaaatgaggattacgagacttatttggaaaattccaaaaaaggtcgtccgagaactgaataccgtgttagctctgatatggcgaaagagctttctatggtggaacgcaccgaagaaggtaaagaggctcgccagtactttatcgactgtgaaaaacgtctgcgccgtgttgcaccagaagaacaccaagctgcgctgatgaactggcgtaaaaatcgtgtcgctgcctgtgaagatcataaaagcatgactgatgcgatgaaaggatatatggaacgcaccggagacactcaaaagggctttgcttacagcaatgaatctcgatttattaataaattggtgctgggtatagatcctgtcaaatgggctaaaaataagggcattaaatccaaagaagtcagagacaacatgaccgcagagcaattacagctactgacgtatttggaatcacgcaattgtgcatttcttgatttggacgcaccgactgagaagcgaaaagcccaattaatggaactggctcaacgttggttagcgcagcgtatggaagcgaagcaatga

SEQ ID NO: 1255 - DNA, 1095 bp, Xenorhabdus bovienii
  Coding sequence Name=Xb4151_4152.C425.gene17.dna; Position on contig =5912..7006bp; Strand=+
atgaattctgtaactttaagttatccaattatttctggtgactccttgagtttgaggagtcctactgtcgaagtcctcactttggccgatgggtatgcgaatattttcggacacccatcagtgaaatattgcgccaattgggatttaaaagcccatctaagtgggaatgcccattttagtgataactcattgatatctattcaaacgccagatttggcgtttgcttataatatgcgcatatcatttagcgacgcggttaatttgcgatcctcattaagtggagtgcaaacagaaaaggatagcacggcgaatgctaccctttggcgtaaagcacattttctttacaagataaatcaatcatttatccgtaatccaattctggtttacgacgaattacaacagcttaagaggctcacctctttaagaggtttggttaggctccccgataacatcgggttggttagttattgctcaatcaacttaccatctttaagagggggagttaaccaagtgaataatgttcactcggttagttattgctcaggtgatgctttggttttgcgttggcggcgtttgatctcaccctgtaatgcggtgacgataaactgtgccgtactttccccaggttcctttaatgattctacattatcggctatttcgtgtggcactcgtgcgctcatcttttgtgatttgttattaacattatcacgtgtcattactgctctccacatttgtttatgggtgccagtatacacaaaaataattataaaaaaagtattgatgtgggtgccagtttgtatttatactgggtgccagttgaatgttgcagcattcaataagaacaaggctccgtcggattgcagtccaagcggagcctctgaccactacgttacggagattaacgctatggctatacaacagcataaccaaactcgccttaaatttacattcctaattgcatcgggcactcaacgtctggtggatattcaccctgtacgtctcattactgtgttggcggacagtgaaggtgaagcccgtttactggtcggtatttcctctctggtatttgtttcccgtcaaggggtggccgcatga

SEQ ID NO: 1256 - DNA, 249 bp, Xenorhabdus bovienii
  Coding sequence Name=Xb4151_4152.C425.gene18.dna; Position on contig =7003..7251bp; Strand=+
atgagcaagcctatcactattcatcaagccgctgaaaaggcccagcaactcgaatttattaatcagcttattgagtcataccctcaccaaatacagggcagtgaaatatctgttatttcttctctgatggcaaagctatccggcgatattgctgtatttctgattgaagtaatcgcaggtgaggaagctattgataacacttccaactatagagatatgtctaccgttcagggggggagccatgcgtga

SEQ ID NO: 1257 - DNA, 222 bp, Xenorhabdus bovienii
  Coding sequence Name=Xb4151_4152.C425.gene19.dna; Position on contig =7193..7414bp; Strand=+
ttgataacacttccaactatagagatatgtctaccgttcagggggggagccatgcgtgaccccgcaccccatgactactacacccatcagaacggggaaaccgttcaggtgctgtcggtcgcctttaaccgcgtgacgtttgtccgtgatggctataacaccccgtgcatcatgccagtaagccgtttcactaaagaatacacctacgcagggagagcctga

SEQ ID NO: 1258 - DNA, 306 bp, Xenorhabdus bovienii
  Coding sequence Name=Xb4151_4152.C425.gene20.dna; Position on contig =7417..7722bp; Strand=+
atgtctgatatctataaccacttagtacgcaacaactttagcaccatgagcactgaggaaattaaagatctgcgtaagcattcagatggagcacatagcgcagtgatggcggcaatgtcagcgatgggggaactggctttctggtctgccgataatgagaactatgcagattgtcaggcaagggacgatttacgccgtatcggtgaagccctgatgtacctgccccgaattgccgaagccctgaatgacacagcacagcacgcggattttgaaattcatcaccgcgagaggttccccaaatggtaa

SEQ ID NO: 1259 - DNA, 2697 bp, Xenorhabdus bovienii
  Coding sequence Name=Xb4151_4152.C425.gene21.dna; Position on contig =7716..10412bp; Strand=+
atggtaagtcatattgatatccgttcagtgaaaatggcggctaaggatcactggcagggtttgctggctgcctgtggggtggatgttccggcaaaggggaagcatggagcttgcccgatatgcggtggcactgaccgttttcacttcatggacgatcatgggaacggtgactggcattgtcgccagtgtgatgagccgaatcacggtgatgggctggatttgctggtcagggcgaaggggatcacgattattgaggcggctaaagaggtttctcaggcgttatcgctgccactgcctgagcctgccagaaaggaagctcccaaatcaggagctcccctgatagccgaaagaattaaaaagctggtggctcaaaccacgatcgggcaatccgactatctgactaacaaggggctgcaatgcccccatcagaagctattgaaagacggctctttgttactggtcatgcaagcgttagacggaaccgtaacaggcgcacagacgatcaagccaaacggtgaaaagcgccttgtctcaggctcacagaaaaaggggagttttatccccttatccggggtaaccgaaacaccggacacgatcatcattactgagggttatgcaaccgcgttaaccgtcagccagttgcatgatggcgtggtgctggctgcgattgatgaagggaatctattcgctgttgccggacacgtcagggaacggtggcctgatgcgaaaatcattctggcggctgacaacgatatgaagtccggtcataagaatgtggggaaaatttcagcagaaaaagcggccaaatctgtcaggggctgggtcacatggccgcccacggaagataaagcggactgggacgattaccgccagtgtcacggcatcgaagcggcaaagcaggcattcagccaaggattgcatcaggcaggggagaaagcgtcagtgttaaagtcagtggtgattaatttagatgaccatcgtgagaaagaacgtgatcccctgataccgtttattgatgtgcgccacaccggggttttttacgtgaccccgaaattagacaaagaaaccggggaaatcatcaaaccggaacaatggctgtgttcaccgattgatgtcatcggcacgggcattgatgaaaatgacgagcaatacctgatagtccgttggaaagcgaagggcagtaaagacccggtcattaaaggggtagcgtcggccgacattggagaacgcgaaggctggcgaatgctcaaagcgggcggtgtgcaagtcacaacaaaaagtaatctcagggcgatcctggctgactggctgatacgaagccacacaaaagaaatctggagtatgacggcaaaatcaggctggcataaaggggcgtatatcatgccggacggttcggtgattggcgtacctcagcagcctgttttgtttaacgggggcagtgccgcggcgaatgcctataccgtttcagggacaactgacagctggcgtgaagaggtggcacggctggcgaataataacccctttatgatgctgggcattgcgacggcgttagcggccccgatgataggaattgtgggggcggacgggtttggtgtccatctgtatgcgcaatctactgccgggaaaaccacgacggctgacattgcaaccagcctatacggtaaaccggatgagcaacggctgacgtggtatggcactgcgctgggtattgctaacgaagcattggcacacaatgacggcctgttgtcactcgatgaggtcggacagggtgcgaaccctaagcatgtccacacctcagcctataccctgtttaatggcaaggggaaaatacagggggcgaaagaaggcggtaaccgtcctttggcaagctggcgaaccgtggcgatcagtaccggtgagaaagatatccccacgttcttgatggaggccgggattaaaattaatgccgggcaattagtccgattgctgaatattccgatggaaagggccaagaccttgcacggttcagaaaatggcaaggcgcatgcggatgcgttaaagcggggctgtcgtgaacatcatggtgcggcagggcgggaatggatcggttatctatcgtcacaccatgaggaggccagacaggcgtatatcgcggcgcaatcacggtggggcaagctgataccggaaagttatggtgagcaggtacaacgggtcagtgatcgctttgcggtgctggaggcggctttaatgctggggcgggtcattacgggctggaaggcgcaggattgccgcgatgtgctgcaatatatctttaatgtctgggtggcggagtttgggaccggcaacaaagaaggtgaacagattgtcgagcaggccgtttcctttcttaacgcccatggcatgagccgctatgcccctctgccctatgatgaacgggacttaccgattcgggatttggctgggtatcgggaaaagaaaggccttcatgataatgatccgatgattttctataccttacccgcgacttttaagcaggagatcgcccggggttttaacgtggatatgttcgcagacacgttagtgaaaagcgacatactcaaaaagccggccagtggcaggagctatcagggcaagacaccccgtcttaagcatctggggggtattcagcaacgggcttacatcatggtgctggtgcctgaatcagacgaagaagactga

SEQ ID NO: 1260 - DNA, 198 bp, Xenorhabdus bovienii
  Coding sequence Name=Xb4151_4152.C425.gene22.dna; Position on contig =10395..10592bp; Strand=-
atgcctccaatggcctgccaaaaagacaatttttacccgttcgatgttgtctcaaaacccctgtttgttgtctcatgttgtctcaatttaaaaactaaaataattacaattcatacagttaataaaaatgagacaaccgagacaactgagacaacagattttagccctcacatgaggagatcagtcttcttcgtctga

SEQ ID NO: 1261 - DNA, 150 bp, Xenorhabdus bovienii
  Coding sequence Name=Xb4151_4152.C425.gene23.dna; Position on contig =10612..10761bp; Strand=-
atgctgattcgagtttcattattacgctgtctcccccaccagattcaggataatcctgtcggtcagctcacgatcatggaaccgctcctcggattgagtacaagatcccggcagaatacccgcgaaaacattgattttctgacggtataa

SEQ ID NO: 1262 - DNA, 780 bp, Xenorhabdus bovienii
  Coding sequence Name=Xb4151_4152.C425.gene24.dna; Position on contig =10743..11522bp; Strand=+
atgaaactcgaatcagcattaaaacactttcacccgaaaacaccgacgttcagtgatgcgtcaaccagtaccgcaccggacagaatgaaaggaatggataccgcagcagctttggggatggcgggatcacaagccaagttcggcatggcggcatttttcgccaagaacgaggtcagtgaagaagacaggttcagcacggtagaagaactgacccgatacgcaaggcgaactgttcctaagctgatatccaaagcagcagggaataaactggggccctgtctggttatcttatcgaagatggcgtttgaagattatgcccgttcagcggcgtctacttgtcagtgttcggaatgtcgcgggaaagggcttatctacggcataaaagaagttgaaaaacatcccggcattattcgtgcggacggtgaagtgattatggcgccgtggattgaaaaagagcaggtgggtgaactttgccagaagtgtaatggtaaaggcacgctgtcaagtcgttgtcgctgcaaggggcggggtgtagtcgttgatgaggaaaagaccgccttgcagggcgtaccggttgataaaatctgcccccgatgctcaggccggggttacagccgggtgccatcatcagtagcttacacggctatcaaggcgcttgttcctgcattgactcaatcatcatggtctcgtaactggaagcccttttatgaaaagctggtaggtaagtgttacgccgaagaaagcagtgcggaagctatgtttagcaaggtaacaaaataa

SEQ ID NO: 1263 - DNA, 105 bp, Xenorhabdus bovienii
  Coding sequence Name=Xb4151_4152.C425.gene25.dna; Position on contig =11674..11778bp; Strand=+
atgagttatcttaccgttgtggagaatgccaaggctgattggcagtgtatggactatcggatgtaccgcacaccatctagaggcggcctctgcggattaggctaa

SEQ ID NO: 1264 - DNA, 264 bp, Xenorhabdus bovienii
  Coding sequence Name=Xb4151_4152.C425.gene26.dna; Position on contig =12132..12395bp; Strand=+
atgtacgcattaaagctaatcacagaaagaaacggtcgttcagtagaagagtcatggatcttgggagacatgtaccgtctggagtttttcccgaaagatgtcgctgataatgttattgcccgtgtcgagcatagccagaacggcaatctgattaatcacgacatcaaaaaaacagaccaagcctacattaccactctgacgggtgacactgttcgcacggtctgtcgaggccgaagtggacttgtagctggttccatacagtaa

SEQ ID NO: 1265 - DNA, 114 bp, Xenorhabdus bovienii
  Coding sequence Name=Xb4151_4152.C425.gene27.dna; Position on contig =12416..12529bp; Strand=+
ttgggcgctcgatattgcttattatctaatttgccgccgcaatcactcccagtacctccgtacctccgtatctcctattgcggtcggcatcctattaactcactcgtgaggtga

SEQ ID NO: 1266 - DNA, 156 bp, Xenorhabdus bovienii
  Coding sequence Name=Xb4151_4152.C425.gene28.dna; Position on contig =12533..12688bp; Strand=+
atggaaaatcgtattgaagaactggaaagaaaggttgttgggttggaaaaacagctcgttgaaaaaaataaatctgcgagctgtataattgaaaatgatatggctattctgcgtaaatgtgatggaaggattatttttcgcttagggaaaatttag

SEQ ID NO: 1267 - DNA, 237 bp, Xenorhabdus bovienii
  Coding sequence Name=Xb4151_4152.C425.gene29.dna; Position on contig =12663..12899bp; Strand=-
atgagctacgaatttgaaaaaatcaaagttgacgaaattaatctagaagatatgacttatgcagttccagtactgttcactattttggccgggatggtcacaaacaaagagcctgaaaaattggatcagctctataaattgttcgataaggttttagaaaacaatgaagatggaacaagtcgagagtcaatagccttagttggacaaataactaaattttccctaagcgaaaaataa

SEQ ID NO: 1268 - DNA, 333 bp, Xenorhabdus bovienii
  Coding sequence Name=Xb4151_4152.C425.gene30.dna; Position on contig =13049..13381bp; Strand=+
atggggtggaatatgaagatgaaagaaaatcctgatgtatgggctgagctgctcaatggcctgcaaaattcgtggccgcagatatccggctctgttttggcaatagctatctgttatggccgcctgatttatgacggtgtagaacgcaagaaccgttgggtcgaagcgctgctctgtggtgccttgtcatggagcgtgtccagtggcttagagatgtttggcgttcccagtagtttcgcgccggcaatcggtggtgtcattggttttattggcgttgaaaaaatacgtgagtttgctatccgtgccatcaataaacggttgggagataaataa

SEQ ID NO: 1269 - DNA, 402 bp, Xenorhabdus bovienii
  Coding sequence Name=Xb4151_4152.C425.gene31.dna; Position on contig =13381..13782bp; Strand=+
atgagcagaggcattcgcaataacaatcccggcaacattgaccacaactcagcgaataagtggcagggtcaattgccccacgacccgaagattgaatctcggttctgtcggtttgagtcaccagagtatggtattcgggcactgatgaagctgttgtgcaattaccacaaaaaaggctatcagaccgtcgcgaagatgatagaccgctgggcacccactaacgaaaacaacacttcggcttatatcaatggtgtggccaaggcgctaggtgttgatcctcatcaggtcattagcgttgataaggtcacattgattgcattggctaagtccattatccggcacgagaacggcaagcaaccgtattcagaggcaacgtttgagaaagcctttaatttactctga

SEQ ID NO: 1270 - DNA, 126 bp, Xenorhabdus bovienii
  Coding sequence Name=Xb4151_4152.C425.gene32.dna; Position on contig =13774..13899bp; Strand=-
atgaaaggtcgccacctggcgatatctctcaggctctatttctataagctcatgattggatttagcgcacgtcagtacgcagataaaaagaagccccgcgattgcgaggctcaggattcagagtaa

SEQ ID NO: 1271 - DNA, 576 bp, Xenorhabdus bovienii
  Coding sequence Name=Xb4151_4152.C425.gene33.dna; Position on contig =13951..14526bp; Strand=+
atgcataccattacagtccctttttataacgatgaactctatgttgtggaatacaacaatgaaccgtatgtaccaatgagaccgattgttgaaggcatggggatggattgggcgtcacaatatactaagttaaaacaaagatttaatacctccgttgtgaacatcacaatgcagctccctgatgataaacaacgcagagatgtagtttgcttagctctacgtaaattggcggggtggttacaaaccatctaccccaataaagttaaacctgaaattagggacaaggtgatccgctatcaggatgagtgcgatgatgtgctttatgattactggacaaaagggatagcaatcaacccccgcaagcgtagtgtgatggaagagctgaatgaggcctgtgctgaatttaaacgagacaagcagatagccagtgtgtttggtactggccttaacgcatggaagcacgtcagtgtcgaacataaaagcaaaataagaggattgaccgaagagattgctggtttagctctggattttgttctggccgaaataggcaagggcaaaacaacacgaacgaaataa

SEQ ID NO: 1272 - DNA, 480 bp, Xenorhabdus bovienii
  Coding sequence Name=Xb4151_4152.C425.gene34.dna; Position on contig =14537..15016bp; Strand=+
atgaaattcaacagccagtatttcacggtgggtgctctggtggtcgtctccggcctgctctggttcttttacagtgagtatcagcaaaaggctcaagattatagcgagctggacacgaagcatcaaactcaactcatcgctataaacgaacagcaaaaacgtatccagcgccttgctgaactggactccaaacacaggcaggaactcgacaatgccaaatctgaaattgatactcttcgggctgatgttgccgctggtcgtcgcaagttgcgcatcaaagccatctgtcccgtgtctgaaaccgttgcctccggcagcgtgggcgatgcaaccaccgtcgaactctctggagaaactggatcaactgttctcgatatccgagaaagcatcatcagcgaccgagcaaaactaaggtatttgcaggaatacgttaatactgaatgcagggggaatgatggcaatattcaaacatctcactaa

SEQ ID NO: 1273 - DNA, 228 bp, Xenorhabdus bovienii
  Coding sequence Name=Xb4151_4152.C425.gene35.dna; Position on contig =14988..15215bp; Strand=+
atgatggcaatattcaaacatctcactaaagatgagattaagcgtgactatgaccactatggcctattcatgggattgattccagtgtatgtcggtgacgttcatggtgagtgtagattggcggtacgaaactggttgcccgattggttgtttgatgttgccgatttcatttgcagtttatgtcccggtgattattacgtaatcaagttaacaggaataatcaagtga

SEQ ID NO: 1274 - DNA, 219 bp, Xenorhabdus bovienii
  Coding sequence Name=Xb4151_4152.C425.gene36.dna; Position on contig =15255..15473bp; Strand=+
atgttaataccgagtgtaagggggcaaataacgatgaatggattatccaaaggtgagtacaaaaccaatcggaaaatgcataaccagatattcaaatatcggcaactcaagttttatcaatattcaaaggtagctgctggagacatcactaccttgaatatttacgtgtgcaaatggttcatcgtattaattgccattccaaatagacacgtcatgtag

SEQ ID NO: 1275 - DNA, 216 bp, Xenorhabdus bovienii
  Coding sequence Name=Xb4151_4152.C425.gene37.dna; Position on contig =15416..15631bp; Strand=-
atgaaaaaatatcttcttctttgcctagtagcaggcacgactcttttagcttcgatgcagacttatgcttctatttgctcgatgcatcccagtaacacccaagactggaggaactgtataagttggtgtatggcagtaaatcctgacgttccaggctcctacatgacgtgtctatttggaatggcaattaatacgatgaaccatttgcacacgtaa

SEQ ID NO: 1276 - DNA, 102 bp, Xenorhabdus bovienii
  Coding sequence Name=Xb4151_4152.C425.gene38.dna; Position on contig =15714..15815bp; Strand=-
atgccacccgcgttaactgatggcgtgggggattcctttaaccactcaagggaatgggtaaaggaatattttgttgagtttcaagcgttaactaattgttaa

SEQ ID NO: 1277 - DNA, 108 bp, Xenorhabdus bovienii
  Coding sequence Name=Xb4151_4152.C425.gene39.dna; Position on contig =15809..15916bp; Strand=+
gtggcatttttgtatcagcatttcaccgcgtcgggttatcgccgtctgcctgtattagccatgacatgttccctttgcatcgagcgtacaggtcagaatcaaaaataa

SEQ ID NO: 1278 - DNA, 189 bp, Xenorhabdus bovienii
  Coding sequence Name=Xb4151_4152.C425.gene40.dna; Position on contig =15920..16108bp; Strand=+
atgccccagacagtcattatcagcaacatccgctgtaggcagaagaagcggtgtgacagccggagagacggcctgtattgccatcatgattcattgagtcgtgatcgctatgtagaaaagcaaagtccgataatcggatattggattaaccacacatatagaggtcactatgacagaactgaactatga

SEQ ID NO: 1279 - DNA, 366 bp, Xenorhabdus bovienii
  Coding sequence Name=Xb4151_4152.C425.gene41.dna; Position on contig =16089..16454bp; Strand=+
atgacagaactgaactatgaagcgattgggcgttgtaaggtgttaagagaaaagatagaggctttacacacgcgaaggcaccaatgtgtttataaactgagagatgaaacttcaaggctgacatttagtgatggctaccggatacctgaaattgccgagtttgacagggatctcatgcaaagtcagatgaaggatattgcccttgtggacagtgacctgatgcacgcagtacacgaatttaatatctggtgtcaggaggcaggagaaccatcaataaaactaaatccttcaactaagaaagatttggagaaattaaaaccattgccatttgatgggtttcccggctctgcgttattaagacgatga

SEQ ID NO: 1280 - DNA, 105 bp, Xenorhabdus bovienii
  Coding sequence Name=Xb4151_4152.C425.gene42.dna; Position on contig =16465..16569bp; Strand=-
atgttgccgtgcctgtactttgtgtcatgttctgttctccaaaaagaaaatgccaccctgttaactgatggccttattgataacctactctgcacctttatgtag

SEQ ID NO: 1281 - DNA, 360 bp, Xenorhabdus bovienii
  Coding sequence Name=Xb4151_4152.C425.gene43.dna; Position on contig =16542..16901bp; Strand=+
atgacacaaagtacaggcacggcaacatatgacatcactgttggtatcaaatatgacactgacacactgaaccagcttgagacacaactaaagcgtatcgctgaacaagtggatcgcattaatggtcgtcgctatgacgcaggtatgacactgtcagtagatacaggtgctaaggctggaattgctgccgatagcttcaaggtcttcgatgtaaccggaaaggtttacatgaaagaggcggtcataccccaagcggtaataaaggataatgataaccatctccgccagataatccgtgaagagatacgccagttcgtcacccgtgagagtgaacgaggcggattgttctccaagtggtga

SEQ ID NO: 1282 - DNA, 420 bp, Xenorhabdus bovienii
  Coding sequence Name=Xb4151_4152.C425.gene44.dna; Position on contig =16837..17256bp; Strand=+
gtgaagagatacgccagttcgtcacccgtgagagtgaacgaggcggattgttctccaagtggtgatgtgatgccgccaagaataccgagagcctgccgcaagcagggttgccccaagaccaccactgaccgaagtggctactgcaacgatcaccttcacaccggctgggagaaccatcagcaaggcaagagccgacatgaacgcggctatggcagcaagtgggacaagctcagagctaccatcaaggcgagagataaacacttatgccagcaatgcttacgccatggccgggcagtgacaggcgtgactgttgaccacgtcaagcccaaggcacacggtggcacggatgcgttaacaaatctggttctattatgctggtcttgccatagggcgaagaccgcaacggagcgtaacaaatga

SEQ ID NO: 1283 - DNA, 582 bp, Xenorhabdus bovienii
  Coding sequence Name=Xb4151_4152.C425.gene45.dna; Position on contig =17253..17834bp; Strand=+
atgatattacctgacttaccagaacctcagaacaaagaacaggcgtcaatctttgctaagaactatgcaaccgctattaaaaaatcacatcaaatgaagcaacttaaaatgcgtcgatttgagtgtgaggaaaaggacgcgccaaagtggtttgttcgaatggttgatatagagattaacttcattctttatcgcatagattatctagagagatgggatagaaagcctgactcgcacacctatgcaacagaaaccctgcgtcatattcgtgtcgcactcgatatgatgtgcagctttttaaagcccgaaaggatgtattttaatagcattagtcgagctgagaagtggttagagctaaaagaccatccagttaaagcggacaccccaaagcaggtgaaactgtcacgcctgtataagggtggtcacttcaagggttatgccctgagcgtggatggcatgttgctgtcgaaccagcagcaggtcgtgattgaaactcactctgagggtgttcaccccacactgaacgtaaccttcacggtaactgatgagatggcgggtgagggggtcgacatttatatttga

SEQ ID NO: 1284 - DNA, 132 bp, Xenorhabdus bovienii
  Coding sequence Name=Xb4151_4152.C425.gene46.dna; Position on contig =18000..18131bp; Strand=-
gtgccgtcggcttggggcgacgacctgatctgcccgccgttccagccatactcagaacctcccgtattcaaaaaacagggcaagagggataaaaaagactcccgatttaaatttcatttttcgcggggataa

SEQ ID NO: 1285 - DNA, 495 bp, Xenorhabdus bovienii
  Coding sequence Name=Xb4151_4152.C425.gene47.dna; Position on contig =18083..18577bp; Strand=+
atggctggaacggcgggcagatcaggtcgtcgccccaagccgacggcacgaaaagaactggcaggcaatccgggcaagcgaaaactaaaccgggatgagccggcctttacgcccctgtccggggtttccccgccggactggtttatggaaaacgaaatgcctctggcggcggtgatgtgggaactgaccagcaaagagctgtgcacccaagggttactctgtgtcacggatctcgctgtactggaacgctggtgtgtggcgtatcagttctggcgcaaggcggttatcaatattgcccaacagggtaacacggtaaccggtgcgaccgggggacccattaaaaacccggaactgactgccaaaaaagaacagcaatccgaaatggacacgaccggctccctgctggggttagatcccagcagccgtcagcgtctgatgggcgctgcgggcaaggccaaaactgacaaccctttcatgaggatgatctcatcatga

SEQ ID NO: 1286 - DNA, 1731 bp, Xenorhabdus bovienii
  Coding sequence Name=Xb4151_4152.C425.gene48.dna; Position on contig =18574..20304bp; Strand=+
atgagccgtaaatcttaccccaatgttaatgcggccagccagtacgcccgtgatgtcgtgcgcggtaagattgacgcaggccgccatgtcaaagatgcctgccggcggcatctggataacctgagtcaggaaaagacgacagggtttaagtaccggttcgataaagatcgggctgaacaggccgccaaatttattcaattgctgccccacaccaaaggggaatgggcatttaaacgcatgcccatcacgctggagccgtggcaactgtttattatctgctcggtctttggctgggtgcataagggcagccggttacgccgctttcgggaagtctacaccgaaattccccgtaaaaatggcaagtccgcgatttcggcgggcgtggcactttattgctttacctgtgatgacgaattcggggcggaagtgtattccggcgcaaccacggagaaacaggcgtgggaagtgttccggcctgcgcgattgatgtgcaagcgcaccccgatgctggttgaggcgttcggcattgaagtgaatgcctccaacctgaaccgcccggcagacggtgcccggtttgaaccgctgatcggcaatcccggtgacgggcagtcgcccagctgcgcgattgtcgatgaataccacgagcatgacaccgatgatctttacaccaccatgctgacggggatgggggcacgccgccagcccctgatgtgggccattaccacggcgggttacaacattgaagggccttgttatgacaagcgccgtgaagtgatagagatactgtccggcaatgtgcccaatgaggagctgttcggggtgatttacaccgtggacgacggggacgactggacttcgccggacgtactgcggaaagccaatccgaatatgggcgtgtcaatctatgcggactttctgctcagtcagcagcagcgcgccctgaataacccccggttagccagcgtcttcaaaaccaagcacctgaatatctgggtgtctgcccgggaagcttatttcaatatgctgagctggaagcagtgtgaagacacgacgctcaccttagagcaatttgagggtcaaccctgttttctggcgtttgaccttgcccgtaagctggacatgaacagcatggcccggctttttgtccgcgagattgacggtaagcggcattactacagtattgccccgcgtttttgggtgccgtatgacagcgtgtacagcgtagagcagaccgagaaccgccgtaccgctgaacgttttaagaagtgggtggaaatggatctgctgaccgtgactgagggggcagaagtggattaccgttacatccttgaagaagccaaactcgcctgtcacctgaacccggttaatgaggccccgattgatccctttggggcaacgggtttatctcactcactggcggacgagggcattaaccccatcatcattacccagaacttcacccacatgagtgacccgatgaaagagctggaagccgctatccagtccgggcgctttcatcacgacggtcatcccatcctgtcatggtgtatcagtaatgtcgtggggaaaaccatgggcgggaatgatgacattgtgcgccccatcaaggagcaaaaagacagcaaaattgacggggcggtcgccctgattatggcgatgggccgcgccatcctgcatgaagaacccgactttctttccaacctcgatccggatgaccttttaatgttatga

SEQ ID NO: 1287 - DNA, 267 bp, Xenorhabdus bovienii
  Coding sequence Name=Xb4151_4152.C425.gene49.dna; Position on contig =20310..20576bp; Strand=-
atggacgtttcggggctgacatacacatcggcgctgaacaggccgtcatgctcggcggcctcggccgtgagcggggtcttcgggttttccagcgattcactgcggaacagggcatcaagcaacatgtttcctccggcgggcgacggtcagggcataggcaatcaacaaaacgcccccgatgatcagggtgtttgccagcccatacttaaggtaacagccggccagcactgccccgacacccgccagcgcagtgccatcaatcagtaa

SEQ ID NO: 1288 - DNA, 1230 bp, Xenorhabdus bovienii
  Coding sequence Name=Xb4151_4152.C425.gene50.dna; Position on contig =20452..21681bp; Strand=+
atgttgcttgatgccctgttccgcagtgaatcgctggaaaacccgaagaccccgctcacggccgaggccgccgagcatgacggcctgttcagcgccgatgtgtatgtcagccccgaaacgtccatgaagctggcagcggtctatgcctgtatttatgtactggcctcgtcagtggcacagatgcccctgcatgtgatgcgcaagaccgggaaatcggttgagatggcgcgggaacatccggcgttttatctgacccatgatgagccgaacgactggcaaaccagctacaaatggcgcgaactgaagcagcgccatgtcctcggctggggcaatggctatacgtgggtgaaacgcaaccgaaaaggcgatgtgattgcactggaggcctgcatgccgtgggaaaccaccctgctgaacacaggtggacgctacacctacggggtctataacgacgagggcaatttcgctatcagtcccgatgatatgatccacatccgcgcgttaggtaataatcagaaaatgggtttaagccccatcctgcaacatgcggaaactatcggtatgggcatgagcggacaaaaatataccagcgcgttttttggcggcaatgcccgtccggccggcattgtgtccgtaaaaggggaaatcagtgataagggttgggaacggctcaaactgatgtggcgaaaagccgcggcttccctgcgcagcgaagagaacaaaaccatgctgctgcccgctgaattggattacaaagcgctgaccgtttccccggtggacgcgcagctgattgacatgatgaaactcaatcgctccatgattgccggcatatttaacgttcccgctcacatgattaacgatttggaaaaagcgacgttttccaatatcagcaatcaggctatccagtttgtgcgccataccgtcatgccgtgggtggtgaactgggagcaagagttgaaccgtcgcctgtttacccggcaggaacggatagcggggttctatgttcgcttcaatctggccggattactgcgcggtacaccgcaggaacgtgcgcagttctaccattttgctattaccgatggttggatgagtcgcaacgaggctcgcgcctttgaagacatgaacccggtggacgggctggacgagatgctggtcagtgtcaatgccgccaatcctgttaacggcaatcaacccaaccaacctgaacacgaggacaaacccgatgagtga

SEQ ID NO: 1289 - DNA, 660 bp, Xenorhabdus bovienii
  Coding sequence Name=Xb4151_4152.C425.gene51.dna; Position on contig =21614..22273bp; Strand=+
atgccgccaatcctgttaacggcaatcaacccaaccaacctgaacacgaggacaaacccgatgagtgacagagaaatgcgctgttacagcggtgaggtacgtgctgaacaactggaaaaccagccgacgcgcattgttggttacggttcggtgttcaatagccgctctgagccgttgtggggattcagagaaattattaaacccggcgcgtttgacgaggtactgaatgatgatattcgggggctgtttaaccatgatcctaattttattttaggacgcagtacagcaggaacattaacggtctcggtggatgagcgtggcttgcagtacgacatcgccgcgcctgacacacagaccattcgtgatctggtgctggcccccatgcaacgtggtgatattaaccaaagttcgtttgcctttcgggtcgcccgtgatggtgaacactggtacgaggatgaggaagggatcgttatccgcgaaatccacaaattttcacggctgtatgatgtcagtccggtgacctaccccgcctatcaggaagcgggttcggcggttcgatccctgaatgcttggaaagaagcccgaagcagcggtatctgccagaaagccattaacgaaaaacgggcgcgtgagcgtcttctgactttattgaatcgatag

SEQ ID NO: 1290 - DNA, 1224 bp, Xenorhabdus bovienii
  Coding sequence Name=Xb4151_4152.C425.gene52.dna; Position on contig =22283..23506bp; Strand=+
atgaaattgcatgaattaaaacaaaaacgtaacaccatcgccgcccaaatgcgcaccctgcatgacaaaatcggggataacgcgtggacagacgagcagcgcaccgaatggaataaagcgaaaaccgaactggacagcattgacgcccaaatccagcgcgaggaggaattacgccatctagaccagcaactggtggacaatacggagccggagcagcgtcaacaaccgggcaaccccgaaaccgagcaggcagagcgccgcgccgccgcatttgaccggttcctgcgtcacgggctgggggagatgagcagcgaagagcgtcaggcgttgaaagaattgcgggcacagggcaccacgccggacgagaaaggcggctataccgtccccacacggatgctcaataaggtggtggaggcgatgaaagcctatggcggcattgccagcgtggcacaaatcctcagcacctccaccgggcagaccatcgaatgggcgacggcggacggcacggcggaagagggtgagctgctgggtgaaaacacggcggccagcgaagaagatacgctgttcggcactgagtcactgggggcgaagaaactgtcgtccaaaatcatccgggtgtccaatgaactgttgctggactccggtattgatatggaagcctatctggccgcccgtattgcccagcgcatcggacgcggtgaggccaaatatctggtgaaaggcaccgggacaggcagtccgcaacagcccaaaggtctggaaacctcggtcacgggcacggtagacgcagcaaccaagtttagctggaaagacatgaacagcctgaaacatgcccttgaccccgcctaccgcaatacggggacgttccgctgggcgttcaatgacagcacgctgaaagtcatcaccgagatggaggatgcccagaaccgcccgctgtggttgcccgaaattgccggggtagtgccttccacggtattgggggtgccttacgtgattgatcaggcgattgccgacatgggggcgggcaataagttcatctattgtggggactttaaccgctttattgtccgccgtgtcacttacatgaccctgagacggctggttgagcgttatgccgattatgaccagaccgcgtttctggccttccaccgtttcgactgcattctggaagacacggcggccatcaaagcgctggtcgggaaaggcggcagcaacgcggcctga

SEQ ID NO: 1291 - DNA, 1041 bp, Xenorhabdus bovienii
  Coding sequence Name=Xb4151_4152.C425.gene53.dna; Position on contig =23576..24616bp; Strand=+
atgctggcagggtgtttctttcaggagaagaccatcatgcaaaacgttacgcttattggtattgatctcggcaaacattctttccacgttcactgtcaggacaaatcaggaaaggccctgctgcgtaaaaaatttacccgcgccagactgatggagtttttagcgggatcgccatcagcgactgttgtaatggaagcctgcgccggtgctcactttatggctcgccggatcgctgcttttggtcacgaagcgaagctgatttctccacaatttgttcgtccttttgtaaagagcaacaagaacgattttgtggatgctgaagccatatgcgaagctgcatctcgtccctccatgcgatttgtgcaaccacgaacagaggcgcaacaagctatgcgcgccctgcatcgggtcagagaatcactggtcagagacagggttaaaaccactaatcagatgcacgcttttttactggaatttggcatcagtatgccgatcggaaccgccgtgataaaaagactttcaaccgtcttggcagagaacgaacttcctccctatctggcacagttgctgatgcgtttacatgcccattatctttatcttgtcgaacagctcaccgagcttgagacggcactggagcaggagctgagacgtgatgaaacaggacagcgtcttcagacaataccgggcgtgggtccgataactgccagcgtcttatcatcgcagctgggcgatggtaagcagtatggctgtagccgggattttgctgcttcaaccggtctggtaccacgccagtacagcacgggtggcaaaaatacgcttttagggataagtaaacgcggagacaaaaatctgcgacggttacttgtccagtgcgccagagtctttatccagagaatcgattatcagtcaggaaggctggctgaatgggtaaaggctcagcttgagcgaaaacactcaaatgttgtggcctgtgcgctggccaacaaattagcccggatagcctgggcaatcacaacacggcaaactgtgttcgaaaggtaa

SEQ ID NO: 1292 - DNA, 207 bp, Xenorhabdus bovienii; identical to SEQ ID NO: 1041
  Coding sequence Name=Xb4151_4152.C425.gene54.dna; Position on contig =24642..24848bp; Strand=-

SEQ ID NO: 1293 - DNA, 117 bp, Xenorhabdus bovienii
  Coding sequence Name=Xb4151_4152.C425.gene55.dna; Position on contig =24859..24975bp; Strand=-
atgttggcttgcttaaatctatccggcgtcactatgggcagggatgcccgcgcctcgatgagttccgcacctgataagcctaaaaatctatggtccccaccttttttgcaacactga

SEQ ID NO: 1294 - DNA, 117 bp, Xenorhabdus bovienii; identical to SEQ ID NO: 1293
  Coding sequence Name=Xb4151_4152.C425.gene56.dna; Position on contig =24986..25102bp; Strand=-

SEQ ID NO: 1295 - DNA, 345 bp, Xenorhabdus bovienii
  Coding sequence Name=Xb4151_4152.C425.gene57.dna; Position on contig =25113..25457bp; Strand=-
gtgaccgctgggcaagctcatgaaagtcaatccgccattccgttgctcgatggcattggcgtccaacgcaaaaatggtttcatgaaacggcgcggtaaagcggtactggcagataaaggctattcgggcggaaaactccgtggttatctgcgaaaattgaggataaagagcattattccttataaaatcaatgaaaaaggtagtactgatggtcgcacgcaatttgataagcaggcttatcgtgaccggaatgtggtcgaacgctgtttcggttttctgaaaggaaatcggcgtattgcaacccgctatgaaaatctatggtccccaccttttttgcaacactga

SEQ ID NO: 1296 - DNA, 456 bp, Xenorhabdus bovienii
  Coding sequence Name=Xb4151_4152.C425.gene58.dna; Position on contig =25460..25915bp; Strand=-
atgatggcacgctacgacattcctgatgaagcatggatattgatagaatcttgtttgcccctggttcattcagaacgggcaggacgtccctatgttgaacaccgccgtgtgatgaatgggatgttctgggtgctatgttcaggggcaccgtggcgcgacttaccggaacgctatgggccttggaaaacggtctataaccgatttaatcgttggtcaaaatcaggcattatcaacaagatatttaatcgtttactgtccattctggatgaaaaagggttgattgactgggctgaaatttgcctggatggcagcaatattcgcgcgagtaaagatgccgcaggcgcgaaaaaaaacatcccgatatcgctgacgatcatgcgctgggtcgctcacgcggtggttatggcaccaaaatccacctggcaaccgaccgaaagggatttcccctcaacctga

SEQ ID NO: 1297 - DNA, 138 bp, Xenorhabdus bovienii
  Coding sequence Name=Xb4151_4152.C425.gene59.dna; Position on contig =25942..26079bp; Strand=+
atgataatactaccgatttacattaagggacacggcctagtgctgttattgatcctcatattcctggccacgcttggtataacactccaaaaacggatgcacgtttgcgttttactgatcccaaatatgggtttgtga

SEQ ID NO: 1298 - DNA, 231 bp, Xenorhabdus bovienii
  Coding sequence Name=Xb4151_4152.C425.gene60.dna; Position on contig =26106..26336bp; Strand=+
atgtttgatgatggaataatcaatagcgtacgcatgtcaccacaaatcgagccattactttacgatgatgcgatcaaaattgtgttggatttacaagatcagtggcacaaagcgggttgggtacttaccaaagctcaagaacgcccagctttagccaacactccagaattgcgtgctcaactgcgtagtatgaaaggggggggctggaacaactttttggcaagtaggtga

SEQ ID NO: 1299 - DNA, 141 bp, Xenorhabdus bovienii
  Coding sequence Name=Xb4151_4152.C425.gene61.dna; Position on contig =26534..26674bp; Strand=-
atggatagtagtatgattaaactaccacgtcgtaggcctaagcgtcgtaatagattcaatttacacctccacctgaagcaattgctcgtatcgatttttcgaccgaattccgtttactatcactgtatgataactcattaa

SEQ ID NO: 1300 - DNA, 636 bp, Xenorhabdus bovienii
  Coding sequence Name=Xb4151_4152.C425.gene62.dna; Position on contig =26616..27251bp; Strand=+
ttgaatctattacgacgcttaggcctacgacgtggtagtttaatcatactactatccattgtttttggtctgacgattatctacctctatcatgccttttattcacgtgacccggagatagctctggtgattggcgaaccttacgaggcgatgcggcaacgctccagtgctaaaattagcccaccctatgataatagcatcggattcagaatcccaaaaacggatgcacgcttgcgctttaccgatccgaaatacggatttattaccccccctgcacgattttttactgtttcctataataaaggaatcatcgagaacgtgcgcatgtccccacaaatcgaaccactactctatgacgatgcaattaaaattgtgctagatttacaagatcagtggcgtaaagcgggttggactctgactctagctagggagtccccagccttggctaacacaccagaattacgtgccaaacttcgtagtttaataggctctgaagtgacttattggcaagcaggtgaacaatatcagatcatgttgattatggcacgttttaaagatgaccgacaccctgacgaagaacgatatttaatcacgctggcgattgccgagccgtgggtaaagaattattcagactga

SEQ ID NO: 1301 - DNA, 102 bp, Xenorhabdus bovienii
  Coding sequence Name=Xb4151_4152.C425.gene63.dna; Position on contig =27227..27328bp; Strand=+
gtgggtaaagaattattcagactgacgcgcttcgcttgtcttctccgattgaccgggctaatacattaccccggtcaatcggagcgctgcgcaacgttttga

SEQ ID NO: 1302 - DNA, 621 bp, Xenorhabdus bovienii
  Coding sequence Name=Xb4151_4152.C425.gene64.dna; Position on contig =27404..28024bp; Strand=+
atgaatctattacaacgcatagatatacgacgtggtagtctaatcatagtattacccattgttcttggtctgactatcatctatctctataatgctttttattcccgtttcccagagatagctttagtgatcggtgagccttacgatgagatgcgacaacgatctagtgccgctattgatcctcatattccaggccatgcttggtacaacatcccaaaaacagatgcacgtttacgttttgctgacccaaaatatggatttgtgactcctccagcccgattttttactgttatgtttgatgatggaataatcaatagcgtacgcatgtctccacaaatcgaaccgttactttatgacgatgcgatcaagattgtattggatttacaagatcaatggcgcaaaacgggttggatgcttactaaaggataccaacccttggctaatacatcagaattacgtgcccaacttcgtagcctaagaggctttgaagcgacttattggcaagtcggtgatcagtaccaaatcaaactggacatagggcgttttaaagatgacagacatcctaatgaagagcgatatttgatcacgctggcgatagccaagccatgggcaaatcaataa

SEQ ID NO: 1303 - DNA, 384 bp, Xenorhabdus bovienii
  Coding sequence Name=Xb4151_4152.C425.gene65.dna; Position on contig =28245..28628bp; Strand=+
atgaggcgatgcggcagcgctccagtgctaaaattagcccaccctatgataatagcatcgggttcagaatcccaaaaacggatgcacgcttacgctttatcgatccgaaatacggatttattaccccccctgcacgatttttggtcatgtattaaatggttagttgctgtgatatgcttccggctttttaaggatgaagtatggccaaagttgatgtctattgccgttattgccacaaatcagaacaggtcaaaggacatgggaaaggaaatggcggacatcctcgttatcgctgttatagctgctgtaaggtctttcagttggcgtatacctatcaggcctgcaaacccggcgttaaagaacagattgtcgatatcgcgatga

SEQ ID NO: 1304 - DNA, 279 bp, Xenorhabdus bovienii; identical to SEQ ID NO: 890
  Coding sequence Name=Xb4151_4152.C425.gene66.dna; Position on contig =28579..28857bp; Strand=-

SEQ ID NO: 1305 - DNA, 291 bp, Xenorhabdus bovienii; identical to SEQ ID NO: 155
  Coding sequence Name=Xb4151_4152.C425.gene67.dna; Position on contig =28849..29139bp; Strand=+

SEQ ID NO: 1306 - DNA, 351 bp, Xenorhabdus bovienii
  Coding sequence Name=Xb4151_4152.C425.gene68.dna; Position on contig =29163..29513bp; Strand=+
atgacccgattttttactgtttcctataataaaggaatcatcgagaacgtgcgcatgtccccacaaatcgaaccactactctatgacgatgcgatcaagattgtactggatttacaagatcagtggcgtaaaacggggtgggtgctgaccagggaataccaacctttagtaaatacaccagaattgcatgatagccttcgccgtatgaaaggtactggaatgaccttttggcaagcaggcgatctatatcaggctatgctgaatatggcgcgtttcaaagatgatcggcatcctagcgaagaacgatatttgattacattgcagattgccgagccgtgggtaaagccataa

SEQ ID NO: 1307 - DNA, 618 bp, Xenorhabdus bovienii
  Coding sequence Name=Xb4151_4152.C425.gene69.dna; Position on contig =29590..30207bp; Strand=+
atgagtcttttacaacgcataggtcggcgacgttctggattaatcttcgcattattaatcgttcttggtctggctagcgtttatctttaccattccttttccgataaaccagagatagcgctggtgattggtgaaccctacgaggcaatgtggcagcgatccagtgcagatattgctcccaaataccctaataacatcgggttcaacacacctaaaactgatgcgcgtttacgttttactgatccgaaatatgggtttgttacccctcccgcacgattttttgttgtgcggtatactgatggaataatcaacagtgtacgtatgtcgccacaaattgagccgttactctacaacgatgcgatcaagattgtattagatttacaagatcagtggcgcaaaacgggctggaagctcactaaaggataccattccttggttaatacaccagaattgcatgacagtcttcgtaagatgaaaggaaccggaatgaccttctggcaagcaggtgacaagtatcagatcatgctgaatatagcgcgtttcaaagatgatcggcatcctgatgaagagcgatatttgatcactttagcaatagccacaccgtgggtaaatcagtaa

SEQ ID NO: 1308 - DNA, 108 bp, Xenorhabdus bovienii
  Coding sequence Name=Xb4151_4152.C425.gene70.dna; Position on contig =30234..30341bp; Strand=-
atgtttcttcgattctccgagttaccgggtgaattcattagcccggtaactcggagaagacaagtgcagcgcgtcagtatcgttctaaatagcgagtgtgagaaataa

SEQ ID NO: 1309 - DNA, 117 bp, Xenorhabdus bovienii
  Coding sequence Name=Xb4151_4152.C425.gene71.dna; Position on contig =30310..30426bp; Strand=-
atgaaatatataataaatatgctattcaccccgttatcccgtgaaaatatgtgtagtggtatagagataaccaatcgtaacgattatgtttcttcgattctccgagttaccgggtga

SEQ ID NO: 1310 - DNA, 135 bp, Xenorhabdus bovienii
  Coding sequence Name=Xb4151_4152.C425.gene72.dna; Position on contig =30469..30603bp; Strand=+
gtgtgtcactactttaaattcaagatattaatacctaccagagagaaattttttttcgggataacctccattgttataatatttatttttgtaataacactacgttacgggatatactgggataacacgggataa

SEQ ID NO: 1311 - DNA, 2778 bp, Xenorhabdus bovienii
  Coding sequence Name=Xb4151_4152.C425.gene73.dna; Position on contig =30698..33475bp; Strand=-
atgatggctgatatacagcatacccaaactcaccctaaatttacactttcagataagaccgctcgtcaaaaagcgctcgatctgattcagaccgtgaaaaagtccgccatgtatcattgggaaaatctgctgcctgcatgtggcattgatattccggccaagggtaaacatggcgcttgcccgatctgcggtggcaccgaccgttttcattttattgatgatcaccattacggcaactggcattgccgccagtgtgacattccgaactatggcgatgggctggatttggtagcaaaaaccaaaggaatttctattactgaggcggcgaaaatcgttgcggatgtactggcattacctttgcccgaacctaaaccagccagaaaaatcattcaaacaacacagccgattgccgacagagtggcagctctgatggcgcaaactgttgccggacaatctccctatctggccgccaaagggctgcattgccctaatcagaggttgttgcccgataattcagcagtgttgcggctcgcaacactggacaaaaaagtaacaggtgcgcagatcatcaaaccggatggtgagaaaaaattactcactggcagccagaagaaaggtgcgtttatcgctctgtcagcgctggaagaacaccccgacacagccatcattaccgaaggttacgccacggcactcacggttaaccaactctgtaacggcgctgttctggcagcactggacgcaggcaatctgctctccgttgctcaatcagtcagggaacgctggccagagacaaaaattattattgcagcagataacgactggcatcatcccgacgaactggataaaaacggcaacccaaaggtaaatatcggcaagatttcagcagaaaaagttgctcttgcggttaatggttgggttacgttgccctccacggaatacaaagctgactgggatgattatcgtcagcagcatggcattgagtcagcaaaacagacattcagtaatgggttgtatcaggtggtagagaacgtagcggtgtcaaaatctgtgaccgctaattcagatgaataccgagagaaagaatacgatccgctaaaaccccatatcgatattcgcaagaacggaatttactgggttgaacctaaagagcaaggtggcgaaatcgtcgaagttgaaaaatggttgagtgattacatggagatagtcggcattggcaatgatggcagcgaaggctatctcattatcaagctacgccaggaaggttcgggaaaatatattgttgaggcatttccccgccgtgaaatcgggatgccggttggctgggcaagattgcgctcgcggggaatgaatatcaccgtaaaaaacagtttgttgcctattttagctgaacatctgcaacgcagcggtgatcgccgtgaatggattgtgacgcagaaagcgggctggcactgcggagcgtatgtgatgccggacggtgaaatcatcggccaaccctatatgcccgtggcattcagtggcggtacatccgcaattgccggttatgtggtcagaggaacagccgaagagtggaaaatgcacgttgcgtcattactgaaaggcaaccggtcaatgatgctgggcgtactggtgggattgtctgcaccacttaactcactgacaggtggtagctgctttggtgtgcattcattcgcccaatcctccgcagggaaaaccaccaccgttgaggctgccagcagcttatacggtgatcccgaagaacttaaattatcgtggcacggtactaaccacggtttaaataatgaagccgctgcccgtaatgatggtttcatgcccattgatgaaatagggcaaagttcgaatccgaaggaagtcgcaaacagtgcctacagcctgttcaacggtgtcggtaagattcagggaaaacgggaaggcgggaaccgcgcggtgatccgctggaaaattgccgccctttcaacaggcgaggaagatttagaaacgttcctgataaaaggtgggatcaccccaaaagccgggcagcttgtcaggttgctcagtgtgccctttattgatacggaatgtttcaatggctatgaggatggtgattctcatgcaagagccatcaaacgtgaatccaaacgctattgtggtgcagcgggtcgggcatgggttcaatggttgtctgtaaatcaggagcaggtaatcgaagtaaccgcccgtaaagaaaaagagtggcttgatggcctgccagaagaagcctcagcccaagtcaagcgcgttgctgttcgtttcgcgttactggatgctgccggagagctggcaatccatattaccggctggagtaaagaagcgagtcatgcggcgataaagcaaagtttcgatgattggttagctgattttggcatcggaaatcgggaaaaatatcaggttatcacccgtactcgtgactttatccaaaaatacgggctttcacgcttccaaccttatacctacggcaggccaaatggtgatattgatacatcacactccatgagaattagcgatcttgccgggtatctggtgcataaccgtcgtaatgatgggcaaacggaataccacattattcccagtgtatttgaagcagagatattgcagggattacagaagaaatccggttttgaggccttagaagaagccggaatgctggttaaagcggaaaaagatcgctttatcagcaaaaccatttcagtaaacggcactcaggggcgatttgtggtgctgattttcagggatgaagattga

SEQ ID NO: 1312 - DNA, 129 bp, Xenorhabdus bovienii
  Coding sequence Name=Xb4151_4152.C425.gene74.dna; Position on contig =33514..33642bp; Strand=+
atgtgtaccagcacactggggcgttgtttttttatattctgtttattatgttatgttcttttctgtgctatgccgctcgtgatcctgcgatccgctgcgcaatccagttatcaatctctgattcaataa

SEQ ID NO: 1313 - DNA, 207 bp, Xenorhabdus bovienii
  Coding sequence Name=Xb4151_4152.C425.gene75.dna; Position on contig =33581..33787bp; Strand=-
atgacaatgacagcaccgaaagaaaatcttattcgtttgcccgaagttcagcgcagaacgggttatagcaaggcgtggatctacaaactgattagtgatggagaattcccgaaacaaatcaaactcggctcccgttccatcgcgtttattgaatcagagattgataactggattgcgcagcggatcgcaggatcacgagcggcatag

SEQ ID NO: 1314 - DNA, 102 bp, Xenorhabdus bovienii
  Coding sequence Name=Xb4151_4152.C425.gene76.dna; Position on contig =33772..33873bp; Strand=+
gtgctgtcattgtcatattatttatctcctgttaccgagtccttgagcgctcatcgtggacgttgtttgatgacaggcggattatttaaaaagcaagattaa

SEQ ID NO: 1315 - DNA, 120 bp, Xenorhabdus bovienii
  Coding sequence Name=Xb4151_4152.C425.gene77.dna; Position on contig =33884..34003bp; Strand=-
gtggtgattttttattctgtgttggaggctccagcggtgactaattttcatacagaatacaattcgggagctgatactccctgtaaaccgataaatttcacaaatggagtaaacaattaa

SEQ ID NO: 1316 - DNA, 174 bp, Xenorhabdus bovienii
  Coding sequence Name=Xb4151_4152.C425.gene78.dna; Position on contig =34014..34187bp; Strand=+
ttgtatgaaaaacaggctattgtgccccgggcacaggtgtgtgaaaaatcaccgcatctttacgcccttttgccaaattttccgatcaagacattttcaccgcgttccagcatctccatatggtctgcataccattgcagcatttcccttcgcccctccagatattgggcgtga

SEQ ID NO: 1317 - DNA, 318 bp, Xenorhabdus bovienii
  Coding sequence Name=Xb4151_4152.C425.gene79.dna; Position on contig =34133..34450bp; Strand=+
atggtctgcataccattgcagcatttcccttcgcccctccagatattgggcgtgattgtaagttccccggatgctgttcttatccacatgggcaagctgggtttcaatccaagccgtgttatagccttgttcatgcaggatagtactcatggtatggcggaagccgtggccggttgctctgccatcataaccaatgcgtttaatcacctgattaatggcggcctcgctcatcggtttacccgcatcattacgtcctgggaaaactatttcccacgccctgtaatagagtgcagtttgataagaatggctttaacctga

SEQ ID NO: 1318 - DNA, 891 bp, Xenorhabdus bovienii
  Coding sequence Name=Xb4151_4152.C425.gene80.dna; Position on contig =34396..35286bp; Strand=-
atgaagttaacagcccggcaggtggacactgcaaagccgaaagaaaaaccctataaacttgcagatggtggcggactatacttattggttaaccctaatggcgctcgctattggcggttgaagtaccggatcgcaggcaaagaaaaattactcgcattaggggtatatcctgatatctccctctcagacgcaagaaccaagagaaacgaagcccggcggacgctatcggatggcaatgatccgatagaagaaaagaaagctgaaaaagcagccaaagcgtttgcggtcagcaatagttttgaatccatcgccattgagtggcacgaacataaacgccccaactggtcaaaagggtatgccgaagacattttggaatatctgaaaaaagatatcttcccgtatattggtaaacgtgccgttaccgagattaaacccgccgaaatgttggctgtgctccgaaaaatggagcaacgcggtgttttggataaattgaaaaaaaccagacaggcctgtcggcaaattttcacctatgccgtgattacagggagagctgagttcaatcccgttactgatcttgccagcgcacttaaagcaccgaagcaaaaacacttctcacaccttttagctgatcaaatgaatgcattcctcgtcgccttggcgggttatagcggaagcgaagtgacccaatccgcgacacgtttactgatgcttactggtgtgcgtaccatcgaattgagagaatcagaatggactgaattcgatttcgataaggatatctggcagatacctgctgagcgaatgaaaatgcgccgtcctcacatcgttccgctatccaatcaggttaaagccattcttatcaaactgcactctattacagggcgtgggaaatag

SEQ ID NO: 1319 - DNA, 210 bp, Xenorhabdus bovienii
  Coding sequence Name=Xb4151_4152.C425.gene81.dna; Position on contig =35346..35555bp; Strand=+
gtggatttcaacctacctgactggactacagaagaacggaaaaaggctaatactgcgtatttattggggttttatggactttggaagacgttgagatatgaatggatggtacgccctacaggattcgaacctgtgacctacggcttagaagggcaaaaacctttgatttcactctatttcttacaatttcacttggtttcatcattttga

SEQ ID NO: 1320 - DNA, 135 bp, Xenorhabdus bovienii
  Coding sequence Name=Xb4151_4152.C425.gene82.dna; Position on contig =35569..35703bp; Strand=-
ttgggtttcaaacctcggattttactgtcagtcaataaggtactagccattagatatatccttcataacaggtcaagtagcgggtcaagttatgatgaaatgatatgcaactacatgaaactgttcaagctataa

SEQ ID NO: 1321 - DNA, 1218 bp, Xenorhabdus bovienii
  Coding sequence Name=Xb4151_4152.C425.gene83.dna; Position on contig =35654..36871bp; Strand=+
atggctagtaccttattgactgacagtaaaatccgaggtttgaaacccaaaaactcagcttattatacatggcaagcagcagcaacacgaggaaccgggaggttaggagttaaaacatatccatcgggaagaaaggtctttgtctatcgttattttaagaatggaaaagaaaagttcataaacctgggtgatttccctgctctttctttggcagaggcattatccaaatcacgagatgccgccgccaatgtttcagcgccagaaaaagccatcataaatcacgccacaattgaacagctattcagcgactatattgccgaccagaaacgccgtggcaagagatcttatgataaaacccagtacaggctaaatcaggtattagatagccagcacattgatagaaatacgccagcaaaagatattaccccagaccacattaaaagggtattagctgaatttatctcacgcggtgctgttgctggctcaaataaggttcgtgccaatcttcatgctgtatttaactttggtctgttcgctgacaatgatcctgccaaactgaacgagaaagttatttatggccttgaccgaaatcctgtcaccgtcgttccacgccaagaaggagcagataaagccctggatagatttttatcttgggatgaaatgaaagagattctaaaattgtttcgtatttcgtcgacagtattcccaatccatcctgattatggtcggttaatattgctttgcattttcacagctggacaacgcccttgggaaataatgaccaatacaaaagataactgggataaaaataataacacgctgacagtgcctcttcatatttcaaaaaacggtgattaccacgtcattcccttgtgcgagtctgcaactgaaatattagaatgccaagccaaacaatatccagattcagagttcttgtttcccggagacactaaagaaggtcatttactcactgctgaatatgccaagcagatccgcaaattttgtgctcgctatgattttgaaaaatttacaccaagggatatcagacgaacctttaagacgcttgcaggagagatggggatcagttctgagatgagagacaggttacagaaccataaaaaacccggtgtctcaaccaaacactacgatcgctacgactatctgaaagaaaaacgggaaattatagcgcaatgggaaagtaaattactatcactatag

SEQ ID NO: 1322 - DNA, 117 bp, Xenorhabdus bovienii
  Coding sequence Name=Xb4151_4152.C425.gene84.dna; Position on contig =36866..36982bp; Strand=-
atggaaacagacaaattaatatttggcatatttagcaatataaggattaagtcaatccaaatctcaactttgttagataactgcccggattgcaaagggcagctttctgccctatag

SEQ ID NO: 1323 - DNA, 207 bp, Xenorhabdus bovienii; identical to SEQ ID NO: 1041
  Coding sequence Name=Xb4151_4152.C425.gene85.dna; Position on contig =37146..37352bp; Strand=+

SEQ ID NO: 1324 - DNA, 1041 bp, Xenorhabdus bovienii; identical to SEQ ID NO: 1042
  Coding sequence Name=Xb4151_4152.C425.gene86.dna; Position on contig =37378..38418bp; Strand=-

SEQ ID NO: 1325 - DNA, 93 bp, Xenorhabdus bovienii
  Coding sequence Name=Xb4151_4152.C425.gene87.dna; Position on contig =38480..38572bp; Strand=+
atgtcaggattccatcaggtcgataagccgttcatgtcatcaataatcagtcttcgcaaaaccagattgggaactgctttaattaacgattaa

SEQ ID NO: 1326 - DNA, 1041 bp, Xenorhabdus bovienii; identical to SEQ ID NO: 1291
  Coding sequence Name=Xb4151_4152.C425.gene88.dna; Position on contig =38598..39638bp; Strand=-

SEQ ID NO: 1327 - DNA, 111 bp, Xenorhabdus bovienii
  Coding sequence Name=Xb4151_4152.C425.gene89.dna; Position on contig =39597..39707bp; Strand=+
ttgcatgatggtcttctcctgaaagaaacaccctgccagcataccgctcacagggtggtggggaccatctcattaaacgccccagtcaaaagaaatgactggggcagctaa

SEQ ID NO: 1328 - DNA, 96 bp, Xenorhabdus bovienii
  Coding sequence Name=Xb4151_4152.C425.gene90.dna; Position on contig =39787..39882bp; Strand=-
atgacccgatttagcgaaataattgcgactgaatcgcagtatcatatgaaaattaattacaaaaaaaatctttttctagtgaaaaaaatagggtag

SEQ ID NO: 1329 - DNA, 168 bp, Xenorhabdus bovienii
  Coding sequence Name=Xb4151_4152.C425.gene91.dna; Position on contig =39955..40122bp; Strand=+
ttgttacaagccctttcgcggcattatgcggataatttcaggtcgttaaataaacagtcattccatcaaaatacctcaataaaaaattatccccataaaattctgcaccataacaaaaaagccactttttttgcggctattttgtttacttttcagatttttgactga

SEQ ID NO: 1330 - DNA, 2847 bp, Xenorhabdus bovienii
  Coding sequence Name=Xb4151_4152.C425.gene92.dna; Position on contig =40147..42993bp; Strand=-
atggcattctattctttaatcatcccacagaacgacgaagaaaattttatggcacagatagcagacaatcccctgattttggttgatggttcttcatacctttatcgtgcataccatgcgtttcctccgctgaccaatagtgcgggagaaccaacgggcgccatgtatggtgtcctgaatatgctgcgcagcttaatcatccagtataaacccagtcatgtggcggtcgtgtttgatgccaagggtaaaacgttccgtgatgagttatttgctgaatataaatctcatcgtcccccgatgccggatgatttacgtgagcagattgagccgctgcacaaaatggtcgaggcaatggggctgccgattctggttgtgccgggcgtcgaagctgatgacgtcattggtacactggcattgcaggcggaaaaagaagggcgttctgttctgatcagtacgggcgataaagatatggctcaattggttacgccttatatcacgctgattaacaccatgactaacaccattctggggccggaaggggtttctgagaaatatggtgttccacctgaattgatcatcgatttcctcgctctgatgggagactcctccgataatattcccggcgtaccgggtgtcggtgagaaaacagcgctgggattattgcagggtatcggtagtctggatgatatctatgccagacttgatgagatcgcgacactcagcttccgtggcgctaaaacgctgagtgggaaaatggcgcagcacaaagaggtggcttacctttcttatcaattggcaacgattaaaacggatgttgagctggataaaacctgtctggagcttgcggttacagcccctgacagtgatgagctgttggcgctgttcagccgttatgaattcaaacgttggttgagcgatgtacagaatggcagttggttggaaggtaatagtcaaaaatccgctgcgacagtctctgctgctaaatcagccactatcagcagcgctccggcagctgtcaatatttcgccggaaaattatcaaactatccttgaccgaaaatcccttgatgagtggattgtgaagctgaaacaggctccagccttctcttttgatactgagacagatggccttgatactttgaccgttaatctggtgggcatgtcttttgctattgcggtgggagaatcagaggttgaagcggcatatctgccactggggcatgattacctcgatgcaccagaacaactggatctgcatgaagttctggcggcattaaaacccctgctggaagatgcaaacctgcctaaaatcgggcaaaacctgaaatttgatcgtggggtgctggcacgttatgacgtcgctttgaatggcattgtttttgataccatgctggagtcgtatgtcctgaacagtgtgagtggacggcatgatatggatagcctggcagatcgtcatctgggatataaaaccacaacttttgaagaaatcgcgggcaagggcaaaaaacagcttaccttcaatcaaatcccgctggaagaagcggcaaaatatgcggctgaagatgcggatgtgactttacggctgcaccaagtcatgtatccacagatagacagtgtaccgacgttgaaaagcgtcttccagaacatcgaaatgcccttggtgccagtgctttctcgcatagagcgaaccggtgtgctgatcgatgcccaaactctggctgaacactcaacggaaattactgcgcggctgggagaactggaaaaagctgcttatgaactggccggtgaagagttcaatctggcttccccaaaacagttgcaggtcattctctttgaaaaactgaacctgcctgtattgaaaaagacgccaaatggggcgccatcgactaatgaagaagtgttggaagaactggcagataatcatgaactgccgcgggtgattctggaacatcgcggtctggcaaaactgaaatccacttataccgacaagctgccgcagatggttaacccgctcactaaacgagttcatacctcttatcatcaggcagtgacagcgaccgggcgtctttcttcccgtgatcctaacctgcaaaacattcctgtccgtaatgacgaggggagacgtatccgtcaggcatttattgcaccggaaggttattgcatcatggcggcggactattcgcagatagaattgcggattatggcgcatctgtcacaggataagggcttgctggaggcttttgcgcagggtaaggatattcacagtgcgacggcggctgaagtctttggcgtgccattggaagaagtgaccagcgaacagcgccgcagtgcgaaagcgatcaattttggtctgatttatggcatgagtgcgtttggcctatcccgtcagttaagtattccacgcggagaagctcaacgctatatggatctctattttgaacgctatccgggggtgctggcctatatggaacgtacacgccagcaggcggctgagcatggttttgttgaaacgttggaagggcgtcgactttacctgccagatatcaaatcgcgcaatgccatgcgtcgcaaggcttctgaacgcgaggcgattaacgctccaatgcagggaacggcggcagatatcatcaaattggcaatgatcgcggtggataattggatcgtcagtgagcagccaaatgtacgtatgattatgcaggtgcacgatgaactggtatttgaggttcatgaatcagaactggcgacagcggagcagaaaatcagtgagttgatggaaaaaagtatgcagcttgatgtgccgttaaaagtggatgtgggaattgggatcaactgggatcaagctcactga

SEQ ID NO: 1331 - DNA, 255 bp, Xenorhabdus bovienii
  Coding sequence Name=Xb4151_4152.C425.gene93.dna; Position on contig =42908..43162bp; Strand=-
ttgatttttacctcctgttgctcattttttagggggataaacataaatctgttttatgtgccaattttttgtgcacaaagttatccacaattcattcatcagaatatttgtcagaaaaagcctgtcagcacgagaaaattatcgcaaaattcgtctataacgacacaatatggcattctattctttaatcatcccacagaacgacgaagaaaattttatggcacagatagcagacaatcccctgattttggttga

SEQ ID NO: 1332 - DNA, 111 bp, Xenorhabdus bovienii
  Coding sequence Name=Xb4151_4152.C425.gene94.dna; Position on contig =43190..43300bp; Strand=-
atgtgtattgtgccagtcacaataaagctggcacaatacttgctgaaaagcccctttcataacataaactttggttatatccacaagtcagtgatttttaagtcattgtaa

SEQ ID NO: 1333 - DNA, 624 bp, Xenorhabdus bovienii
  Coding sequence Name=Xb4151_4152.C425.gene95.dna; Position on contig =43355..43978bp; Strand=-
atgaagacattttggttagcactggtgggaatatttatggcatttaatgccagtgcctctggtttttctgaagataaacaatacgttgaattaaaaaatccagtggctaatcagccacaggttttagaatttttctccttttattgtccccactgttaccagtttgaaaatatttaccatgttcctagtaccgttgagaagaatttgccagcaggtgtcactcatgagcgttaccacgtcgattttatcgggcctttggggaaagatttgacagatgcgtgggcggttgccattgtcatgaaaattgaggataaaatctccccgattttgtttgagggtatccagaaaaaccatactatcaatagtaaggccgatatccgtagtgcttttatcaaggcgggtgtgtcaggtgaagagtatgatgcggcgttaaacagctttatcgtgaagtctgtggcagccaaagagcgtcaggccgtcagcagtctgcaacttcaaggcgttcctgctatttatgtgaatggcaagtaccaggttaaaaatgatggtattgagtcgacgacaatggctgggtatgccaagggtttttctgatgtagtgaattatctggtgacaaaaaaatga

SEQ ID NO: 1334 - DNA, 975 bp, Xenorhabdus bovienii
  Coding sequence Name=Xb4151_4152.C425.gene96.dna; Position on contig =43996..44970bp; Strand=-
atggcttttaacttccagaatattacaccagacttaatcatggatgcgttggtgcagtcgggtctgtatattgattctggcttaactgaactgaatagctatgaaaaccgcgtctatcagtttatggatgaaaatcgtaaacgttatgtcgtgaaattttaccgtccacagcgctggagtcagcagcagatccaagaagagcatgattttgcactggcattacagcaggcagatttgtcagttgcggcgcctctggtgtttgccggccagacggtactgaaacatggtgggttcttcttcgccattttccccagtgtgggtgggcgtcagtatgaatctgataactttgatcagttggaaggtgtcgggcgattgctggggcaaatacatcagattggtcgccagaaaatattttcttcccgtccaaccattggcttagatgaatatttatatcagccataccactatttatctgcatgtaaattaattccggctaaacataaaaaagtcttctttgctgcgttggatgagttaaatcaaacggtggaaggagcatggtattttgatgggcagatacggctacatggagattgccatgccggcaatattctgtggcgtgatgaggcatggttcgtggatcttgatgatgcccgtaatggcccggcgattcaggatttgtggatgttgctcaatggctcacggcaagaacgcttgatccaattggatatcctgcttgagtcatatagccagtttacggattttgatccaaagacattggcactgatagaaccacttcgtgcgatgagaatggtctattatttggcttgggttgcccgtcgctggcaagacccggcttttccaaaagcttttccgtggatggccgacagcgacttctggcatggtcaagttagtcttttttctgaacaaattcggctgttacaggaatcacctttacagctaaatccgatgtattaa

SEQ ID NO: 1335 - DNA, 114 bp, Xenorhabdus bovienii
  Coding sequence Name=Xb4151_4152.C425.gene97.dna; Position on contig =44979..45092bp; Strand=-
ttgctaatttgtatagccatttataaggaattaaaaatgaagaaaattttaagactgctttgctgcgtaccagaggcattattaaagattaatgaagagagagcagggttgtga

SEQ ID NO: 1336 - DNA, 264 bp, Xenorhabdus bovienii
  Coding sequence Name=Xb4151_4152.C425.gene98.dna; Position on contig =45086..45349bp; Strand=-
atgtgttggtataatggtgtgccgtcgaattgcagtaatcctttatcatctccccccatgcgggtggatagtcctccggccagaattgcgccactcatttttggatgcgtcatgttaactcacctgatatttggcaatgaaatattcaattatttggtttataacctttgtaaatcaatatgtaacaatgctttcatggaggggagtataacctttacgcttattgacagaccaattctttctctaaatcattatccttgctaa

SEQ ID NO: 1337 - DNA, 588 bp, Xenorhabdus bovienii
  Coding sequence Name=Xb4151_4152.C425.gene99.dna; Position on contig =45237..45824bp; Strand=+
atgacgcatccaaaaatgagtggcgcaattctggccggaggactatccacccgcatggggggagatgataaaggattactgcaattcgacggcacaccattataccaacacattgccacaagattgcagccgcaggtgcaagagctgttgattaacgccaaccgtaatcaggcggtttatcagcagagtggttatcccatcataccggatatcatcaccgatttttctgggccgctggcaggtatgctggcagtattgaagaaggccattcatgaatgggtgatctttgtcccctgtgatgtaccagatttccccgatgaccttgtggaaaaactgtggcgttatcgtcagcattcatgggcagtttatgtccatgattgccaacgtgcccatcccacactggctttaatgcaccgcagcttgatcccccgactggaaagctatctggcattgggagagagaaagctgatgttttttatgcaaatgattaaggcaaaagcggtttattttccctatcccagcgccttcaccaatttaaatacaccggaagaataccagcattgggaatattttcaggagtcagcatga

SEQ ID NO: 1338 - DNA, 558 bp, Xenorhabdus bovienii
  Coding sequence Name=Xb4151_4152.C425.gene100.dna; Position on contig= 45797..46354bp; Strand=+
ttgggaatattttcaggagtcagcatgaaaccaacgacattgccgctgctcggcatcaccgcctacagtggaacaggtaaaacaacactgctcaaacagatcattccgctattgcgccaacaacatatccgggtgggattgattaagcacactcaccataatatggatgtcgatcaaccgggcaaagacagttatgagctgcgtaaggcaggagcagcacaaacgttggtcgccagccagcagcgctgggcattgatgacagaaacaccagacttgccaaagctggatctgcactatctcgccagtcggttcaacgctgattctctggatctggttctggtcgaaggcttcaaggaagaggccattgcaaaaatcgttctctatcgccacggcctgaatgttgcctttgatcagatcatggatacccatgttattgctattgccagcgatatcccgctggcaacatcgcttcctctgcttaatatcaaccagccacagcaggtgacagcatttattgtggcatggttgagggcaggcagcgctagcaagcctggctaa

SEQ ID NO: 1339 - DNA, 114 bp, Xenorhabdus bovienii
  Coding sequence Name=Xb4151_4152.C425.gene101.dna; Position on contig= 46351..46464bp; Strand=-
atgatttctgaaatcaactctcatcagcttcatttatgtcggaagcgccgtacattacatgtgttcataaggaaatacatttcttccttatctgccagttctgatggttcttag

SEQ ID NO: 1340 - DNA, 105 bp, Xenorhabdus bovienii
  Coding sequence Name=Xb4151_4152.C425.gene102.dna; Position on contig= 46581..46685bp; Strand=-
atggtgttgcacttattatatggaatcgccagtgttaattttattttatatataattggagcattaatggccgagccaagaaaaaaacctcttttattggtttaa

SEQ ID NO: 1341 - DNA, 126 bp, Xenorhabdus bovienii
  Coding sequence Name=Xb4151_4152.C425.gene103.dna; Position on contig= 46711..46836bp; Strand=+
atgtgtatttcttctttttttaattccatatggcatgatttttttaaatattctcaaataagtttgtttcaccaatattactttcatgttgaaaatatccagatctgtactatgattttattatga

SEQ ID NO: 1342 - DNA, 120 bp, Xenorhabdus bovienii
  Coding sequence Name=Xb4151_4152.C425.gene104.dna; Position on contig= 46855..46974bp; Strand=+
ttgctcttgacgcttattgaaaatttgtttttgttgttttttataaaacaagtctcagtcaaagacaaattcataaattatgctaattttttaacaaactggaatctgggagggcgatga

SEQ ID NO: 1343 - DNA, 477 bp, Xenorhabdus bovienii
  Coding sequence Name=Xb4151_4152.C425.gene105.dna; Position on contig= 47110..47586bp; Strand=+
atgaaaaaatcattatctactgaatcagaatcttccttgcttgttggaaaaggactgaaaattatcgaatctttatctgaggaaacagcagataggttaaagcacaaaacgacagatgattcgatcacaaagttatctgaatcaaacacacatatatattatgaggctactttgtccttagttagttactttttttactatacatgtaccctagatgttcaaggtgcgaaaacattttacggaaaagcaggaggaataggatctgtgggaaaaggaaaattttccggtgagtttttttttggtacgaatgatattaatctaatttatcagaaagcaacattctttgttgcaatgataacacctttaactataagtatggcttttctagatccacctatagataaattggcacagtttaacggatccggattaggcacgatatctgccacaatcacaggagcgggttattgggaataa

SEQ ID NO: 1344 - DNA, 159 bp, Xenorhabdus bovienii
  Coding sequence Name=Xb4151_4152.C425.gene106.dna; Position on contig= 47907..48065bp; Strand=+
atggcagacatattgcacatgaaattctatatcatcattatgctgttccgacttttctctggcatgctctatcattattattactcccctgataaacagataatgataatcgctccgattttctactatgcagttgaagggggcttcatatctttatga

SEQ ID NO: 1345 - DNA, 114 bp, Xenorhabdus bovienii
  Coding sequence Name=Xb4151_4152.C425.gene107.dna; Position on contig= 48132..48245bp; Strand=+
atgagcagcattaagcaactgcattttcagaaaacagcccacagattatgttgcgggctgtgcatatatcaatcatgttataacgctatttcccttccggtatcaagccaataa

SEQ ID NO: 1346 - DNA, 300 bp, Xenorhabdus bovienii
  Coding sequence Name=Xb4151_4152.C425.gene108.dna; Position on contig= 48217..48516bp; Strand=-
atgcaagtcacgttagttgaaatcaacgttaaagccgacaagctcgacgaatttatcgaggtctttcgcgataatcaccttggttcggtcaaagagccgggcaacctacgctttgatgtgctgagagatgaaaatattccgacccgcttttatgtttatgaagcttatgccgatgaagcatcagtggctgcccataaaaaaacacctcattacttgcgttgtgtcgagagattggaagcgttgatgaccgagccaaggaaaaaaacaacgtttattggcttgataccggaagggaaatag

SEQ ID NO: 1347 - DNA, 885 bp, Xenorhabdus bovienii
  Coding sequence Name=Xb4151_4152.C425.gene109.dna; Position on contig= 48518..49402bp; Strand=-
atggcagatttagatgacatcaaagacggtaaagattttggtattgatacaccacaaaagaacactctgtttgaattgaaaggcagcggtgcgctggattggggaatgcagtcgcgtttgtcgcggattttcaatccaacgactaataaaacggtgatgctggcgtttgatcacggttattttcaggggccgactacgggattggagcgtattgatatcaatatcgccccgctgtttgagcacactgatgtattgatgtgtacccgcggtattctgcgcagtcaggttccacctgcaaccaataagccggtggtactgcgtgcatccggcgctaattcgattttgactgagttatccaatgaagcggtggctgtagcgatggaagatgcgcttcggctgaatgtatgcgctgtggcggcgcaagtttatattggttctgagcatgaacatcaatccatcaagaacatcatcaagctggtggatcagggaatgcgctatggtatgccgacaatggccgtgacaggcgtcgggaaggatatggcgcgtgaccagcgttatttctcactggcgacccgtattgccgctgaaataggggcgaatattatcaagacctattatgttgacagcggttttgagcggatcgccgcgggctgtcctgtgccgattgtgattgcaggcggtaagaaattaccagagatagaagcactggagatgtgctatcaagcgattgatcagggtgcgtccggcgttgatatgggacggaatatcttccagtccgaagcgccggtagccatgctgaaagcggttcaggcggtggttcatcacaatgaaaagccagcacaggcttatgaattgttcctgagtgaaaaggctaagggggaataa

SEQ ID NO: 1348 - DNA, 273 bp, Xenorhabdus bovienii
  Coding sequence Name=Xb4151_4152.C425.gene110.dna; Position on contig= 49433..49705bp; Strand=-
atgcgaccttacgttgaaaacggcacggtcaaacagttcggcctgtgggatgtcgttaagcagggcaagatagccattcatgttgccaatgaaatgctgaaaaaaggcgatctgaatgtaggggagcagttagatattccagatatcggtaaactggcgatctcacccaacagcgtacagggataccgctacgaagcgaaaggcaacggtattgttgtgatgccggagcgtgtaatttttaccagcgaaaacatcaaccaatacgatttctaa

SEQ ID NO: 1349 - DNA, 270 bp, Xenorhabdus bovienii
  Coding sequence Name=Xb4151_4152.C425.gene111.dna; Position on contig= 49625..49894bp; Strand=+
atgaatggctatcttgccctgcttaacgacatcccacaggccgaactgtttgaccgtgccgttttcaacgtaaggtcgcatcacattcggcgtactgaacccgacgatcgctatattccggcgtttcaggttttccgcggcctgtgcagcccgcgtataatttccactaactgcttatccgccacattcaggttgccagcaggggtattcagatccatcgaacaattcagctggttcagtaattgctgcatccggcttttgctgacctga

SEQ ID NO: 1350 - DNA, 321 bp, Xenorhabdus bovienii
  Coding sequence Name=Xb4151_4152.C425.gene112.dna; Position on contig= 49860..50180bp; Strand=-
atgttcaattgctatgtccctcttttggcggttcgtggagtcagtaagcaattttccggtctggcggtattgaaacatattgatttcaccctgattgcggggcaggttcatgctttgctcggcggcaatggcgcaggtcaatcgacgctgatgctggatggtcgtactatcagtcatctgacacctgctaagcgcatcaattgggcatctatctggtgccacaggaacctttgttatttcccagtctttttgttcaggaaaacattttattccgtctgcctaaacatcaggtcagcaaaagccggatgcagcaattactga

SEQ ID NO: 1351 - DNA, 1107 bp, Xenorhabdus bovienii
  Coding sequence Name=Xb4151_4152.C425.gene113.dna; Position on contig= 50283..51389bp; Strand=+
atgttcaaatttttgcgatcgccctctagcacatcagaggcttttatgcttaattctttgccagtggataaacaagttgttatgtcgatcaaaccaaccaagaagcaatcagtatcagagagaagcgggttatccgaggaactttcttattcagataataaccattcaggtcatggctattcaggaaacagcatgagtgaagaagaactactggctcgcatagcctggttttactatcacgatggtctgactcaaggagacatcggtgaattgctcggcctcagccgcctcaaaatctcccgcctactggagaaagggcggcagacgggcgtgatccgcgtgcagatcaattcacgctatgaagggtgtctggaattggaagatacgctgcaaaaacgctttaatctcaagcaggttcgtgtactgccggctcttgacgaaataaatatcaacacccgtcttggcgtcggcgctgcccacctgctaatggcactgattgagcctagtcagctactggctatcggatttggcgaaaccccgatgtgtactttacagcacctgagtgggtttatttcgtcccaacaaatccggctggtgacgttgtctggcggcgtcggaccttatatgacggggattggtcagcttgatgcagactgccctgtcagcatcattcctgcaccgctgcgggcgtcaactcaccaagtcgccgctacgttccgcgaagaacgcagtgtgcgggatgtgatcctgactgcctgtgccgcagatatcgccgtggtgggaatcggagcgatcaaccagcgacagcaggcgaccatcatgcgttccggctatatcagcgacggagaacaattgatgtttggccgcaaaggcgcgattggggatatcctcggttatttcttcaatgcagaaggtgagctggtcagccatatcgatatccatcaggaactgatcggtatctccctgccagaactgaaaacgatcccgaatgtgatcggtgtggcgggtggtattgaaaaagccggtgccatcattgccgcactgaaaggcggctatattagctcgctggtaaccgaagaacagaccgcaagagccatgctgacgtaa

SEQ ID NO: 1352 - DNA, 1593 bp, Xenorhabdus bovienii
  Coding sequence Name=Xb4151_4152.C425.gene114.dna; Position on contig= 51461..53053bp; Strand=+
atgaatcaacgcgctcacgctcacccatcagggaagtatctgatggcgcttgatgcaggaactggcagtatccgtgcagtaatatttgatctcgaaggaaatcaggttgccgttggacaggctgagtggatacaccagcctgtaccgaatgtctcaggttcaatggaattcgacctgaaaaccaactggcaactggcgtgtcaatgtattcgccaggcactgcaaaaggcggaactgcctgccagtgcgattcagggcgttgccgcctgctcaatgcgggaaggcattgtcctgtataatcgcagtggcgatcccatctgggcctgtgccaacgtcgatgcccgctctggccatgaagtcagcgaattgaaggagctttacgacaatacctttgagtatgatgtttaccgttactccggccagacactggcgctgggagcgatgccccgtctgctgtggcttgcgcatcatcgcgcggatatctatcggcaggccagtacactcactatgatcagcgactggctggcttatatgctcagtggcgagctggcggttgatccctccaacgctggtacaacgggaatgctggatttagtcagccgcaactggcgccctaacctattggaaatggccggactgcgttccgatatcctttcccccgtcaaagaaaccggcaccctgctcggttacatcaccgaaaaagcggcagcagattgcgggctaaacagcggcacgcccgtcattatgggcggcggcgatgtccagctcggctgcctcggcattggtgtcgtcaaacccgctcagaccgccgtactcggtggcactttctggcagcaggtcgtcaacctgccagctccgatcaccgatcccaacatgaacatccgcatcaacccgcatgtcattcccggcatggcacaggcggaatccatcagctttttcaccggcctgaccatgcgctggttccgcgatgccttctgtgcggaagaaaaactaatggcggaacggctgggtgttgatgcttacagcctgatggaagacatggcggcacgcgttcccgcaggagcttatggcatcatgccgattttttcagacgtaatgcgctttaaatcgtggtatcacgcagctccttccttcctcaacctgtcgattgatccggaaaaatgcaacaaagcgacgctatttagagcactggaggaaaatgcggccattgtctcggcctgtaatcttgatttgattgcaggtttctctggagtgaagccagactcgctggtctttgccggcggtggttccaagggcaaactctggtgccagatcctcgccgacgtaacaggattacccgtgcgggttcctgtggttaaggaagcaaccgcattgggctgtgcaattgcggccggtgtgggagtttcattgtatgactcactgcctgaaaccggagaaaaactggtgcgctgggagcgggaatatcagccggatttgacacattgggatatttaccaaaaagcgaaaaaaaattggcaggcggtgtacgcagaccaacttcatctggtagatgacgggctgacaacatcgctgtggaaagccccgggattgtga

SEQ ID NO: 1353 - DNA, 96 bp, Xenorhabdus bovienii
  Coding sequence Name=Xb4151_4152.C425.gene115.dna; Position on contig= 53120..53215bp; Strand=+
atgatcaggttgccctgtttcttattcagcacgttaatgacaacattaaatttaagatggatttgtttcgccgcattgtttatgcctatccgctag

SEQ ID NO: 1354 - DNA, 273 bp, Xenorhabdus bovienii
  Coding sequence Name=Xb4151_4152.C425.gene116.dna; Position on contig= 53232..53504bp; Strand=+
ttgccattactggttcaggaggaaggagataagggacttgctccgggctttgaaactaagtatggcgagtatctggggattgacttccttctttttggtcaaagtatggggctgagtgaaaagctgctcagaaagctattgatggacttaaccaaagagacccagttgatagaatcaacttaccgaaattcttttatgtcgaaggaggcgatcaaagcgacacttcaatgctatcagcagcgcctcaatcgaatgcaagtgcttgatacttaa

SEQ ID NO: 1355 - DNA, 1353 bp, Xenorhabdus bovienii
  Coding sequence Name=Xb4151_4152.C425.gene117.dna; Position on contig= 53680..55032bp; Strand=-
atgagtaaacattacgattatattgcaattggtggtggcagtggtggtattgcctccatgaaccgtgctgccatgtatgggcagaaatgcgccctgattgaagcgaaagcgctgggcggaacatgtgtgaatgtgggctgtgtaccaaagaaagtgatgtggcatgccgcccagattgcggaatctattcatcaatatggtcctgattatggttttgataccacggtaaatcgttttgactggaagacattgattgccagtcgtactgcctacattgatcgtactcatcagtcttatgagcgtgtgctgggcaataataaggtcgatgttattcatggatttgcccgttttgttgatgcacatacagtcgaggtcaatggagaaaaaatcaccgctaaccatatcctgattgctacgggtgggcgtccggtgtgtcctacgattccgggagcggaatatggtattgattctgatggtttctttgaactggatgaaatgccaaagcgtgttgctgtggtaggtgcaggttacatcgctgtggaaattgctggtgttttgaaggcgctgggcagtgaaacgcatctgtttgtgcgcaaacatgcgccgctgcgttctttcgatccgctgattgtcgagaccttgctggaagttatcaagaatgaagggccgacactgcatacggaagcgatattaaaagccgtgattaaacatgctgatggcagcctgacgttgcaattgcaggatggcagagagcagacggttgatacgttgatctgggcgattggtcgcgagccgatgaccgataatctgaatctggccgtcactggtgttgagttgaatgagaaaggttatattcaagtcgataaatatcagaataccaatgtcaaaggtgtgtatgcggtaggcgataacacgggcgcagtggaattgacgccggtggcaattgcggcaggtcgtcgtctatcggaacgtctgtttaataacaagccggaagagcatctggattacaccaatgtgccaacggtggtattcagccacccgccaatcggtacggtaggtctgacggagccgcaggcaagggaacagtatggtgatgatcaggttaaggtttatacttcgtcatttactgcgatgtatactgccgtgacgcaacatcgtcagccatgccggatgaaattggtttgtacgggagcggatgagaagattgtcggtattcatggtatcggctttggtatggatgaaatcctgcaaggttttgcggttgcgctgaaaatgggcgcgacgaagaaggattttgataataccgtggcgatccacccgacggcagcagaagaatttgtgacaatgagataa

SEQ ID NO: 1356 - DNA, 843 bp, Xenorhabdus bovienii
  Coding sequence Name=Xb4151_4152.C425.gene118.dna; Position on contig= 55189..56031bp; Strand=-
atgctaagttatcgtcacagtttccatgccggcaaccacgcggatgtgctgaagcacactgtgcaaagcctgatcattgagtcaatgaagggaaaagagaaacctttcctgtatttggatacccatgcaggcgcaggccgttatcagttgagcggggaacatgccgagcgtacaggggagtatctggaaggtattgcccgtatttggcagcgtgatgatattcccgaggaattgacggcgtatatgagcgcggtaaaggcgctgaatccgcatggtgttctgcgttattatccaggttccccgctgattgcccgccatttattgcgggaatatgacgagcttaacttgagtgaattgcattccagtgattttcctttgttacgtagtgaattttcccgtgatgaacgtgttcgcctcctgcgggaagatggttatcagcagttgaaatcaaaactaccacccaaaagccgccgcgggtttgtgctgattgaccccccttatgaactgaaatctgactaccagaatgtcgtcaaaggtattttggaaggatataagcgctttgcgaccggtacttacgcgctgtggtatccggttgtactgcgtcagcaaattaaacgtatgctcaaggatctggagtcaacaggcattcgcagggttttacagatcgagcttggggtacgtcctgatagtgatcagcgtggtatgacggcgtccggtatgatcgtcattaatccgccgtggaagctggaacagcagatgaaagcggtattgccttggctgcatcaagtactggttcctgaaggaacaggtcatacttctgtggcatgggttgtgcctgaatag

SEQ ID NO: 1357 - DNA, 255 bp, Xenorhabdus bovienii
  Coding sequence Name=Xb4151_4152.C425.gene119.dna; Position on contig= 56129..56383bp; Strand=-
gtgaatggattatcgctaattacctcgaaatacatccctcagaaatctggccaagtcgatattttgatagtaacggtcaacttatcaaacgaactgcccgaaaagtttctaattagcggaaatttagttaaaaaatatctccgtggggtaacgattaccccactcagtgtgttcctttggttcggttttcatctcttccaaaataaatattcatccattactttgttactatgctttattatgtttttgtattag

SEQ ID NO: 1358 - DNA, 372 bp, Xenorhabdus bovienii
  Coding sequence Name=Xb4151_4152.C425.gene120.dna; Position on contig= 56268..56639bp; Strand=-
atggtggttcaggcaggggaggcttcggcctcgctggttatagttacccagtctgcaaaccctgtctggatcgccaccatcaatgatcaattaatggaaggagtagcaggaataagtaacgttagaaatgactggcatcaagccgatattattgctgaattacgtaaacgtggtacaaccttagcggctgtctcccgtgaatcgggactcagttcatcgacattagcgaatacacttagtcggccttggccgaaaggtgaatggattatcgctaattacctcgaaatacatccctcagaaatctggccaagtcgatattttgatagtaacggtcaacttatcaaacgaactgcccgaaaagtttctaattag

SEQ ID NO: 1359 - DNA, 123 bp, Xenorhabdus bovienii
  Coding sequence Name=Xb4151_4152.C425.gene121.dna; Position on contig= 56597..56719bp; Strand=-
atggtcaaggttttgcagccttgtgtaactatatacactggtaggaagtttctaccagtgcgtctgttatcaccctttcaatggtggttcaggcaggggaggcttcggcctcgctggttatag

SEQ ID NO: 1360 - DNA, 201 bp, Xenorhabdus bovienii
  Coding sequence Name=Xb4151_4152.C425.gene122.dna; Position on contig= 56817..57017bp; Strand=+
ttgaatgctttaggtcgctgttgttactcactcaagggaaaagccaaagttcatcagaaatacgatatgcaggttaatacacttatctgctctggccttgtgaaaggacatgtgattaatacagtttattgtttgacgtccgtgtccacataccggaagattcagttcagaatcatcgacaacaatccacagcaaaattaa

SEQ ID NO: 1361 - DNA, 1077 bp, Xenorhabdus bovienii
  Coding sequence Name=Xb4151_4152.C425.gene123.dna; Position on contig= 57026..58102bp; Strand=-
atgcaagataagaagcctgatacacctgtttccgaagatagcaatttagtgacagttaccacaccggaatatgtcaaagattcaatcaaagcagccattgatcaacatgccgcaagtcgtaatcatccctatgcaaccctgactgacagagggtttgtgactctcagtaatgatgtggatagtgatagtgaaatgactgcggcaacctctaaagctgttaaaaaagcctatgatttagcgaatatcgccaatcaaaatgctctcaataacaactccgatctctatttagagaaagcgcagaacggagcggatattccgaataaagatgagttcgtaaagaatattggtctaacggaaaccataaatctagcaaaaaattccgtacctaataatagaaaaatcaatgataaatcattaacgaatgatattatattgaattcaaaggatgtccatgctctgaatgacgttataaaatttgatggtattcctgactccaaatatattggggtgtttagtgctagcggctctgctagtggatatgcaaaaggaattaattttggattgctagattatgatacgggtcagatatatattcgctcgtcaggcgatttgtatgcctattattttgttaatggagaggatcgcgtagggggaaaagtttggtcagaagttaatactactataggtaataatggctgcattaagaaatcagcccctacaattctaatttactcagatggcaaatatactatcaacaataaatccgaaaatactattgttgagtgtctatcaaagggcacttatctcatcaaaggtgttatcgggtttagtaatgatgaagcaataggcagtatcgaaatcccacggtgtcagaatgaccttccattgatttgggtcaaccacgaagtccttcctgatggctcaatcaaattaatgacctaccaccgtgaacactcagacgtcccttctttcgccagaaatatacgtgaaggctacgcggatggtgatttgattgatatccccgaaggcaggtttgtttctgttcgagtgcaaatgcctcctgctaagggagaataa

SEQ ID NO: 1362 - DNA, 147 bp, Xenorhabdus bovienii
  Coding sequence Name=Xb4151_4152.C425.gene124.dna; Position on contig= 58041..58187bp; Strand=+
gtggtaactgtcactaaattgctatcttcggaaacaggtgtatcaggcttcttatcttgcatagtaattccctcatttaatcaacaatacacattgctaaataacatgaaggcggtgggatactactccgcctgtgaacatcaataa

SEQ ID NO: 1363 - DNA, 96 bp, Xenorhabdus bovienii
  Coding sequence Name=Xb4151_4152.C425.gene125.dna; Position on contig= 58389..58484bp; Strand=-
atgagctttggcacatggcagattgagcatgaagactttgcgttcagtctcaatgatgagcaacagcagagattggctaactttgacggagtttag

SEQ ID NO: 1364 - DNA, 489 bp, Xenorhabdus bovienii
  Coding sequence Name=Xb4151_4152.C425.gene126.dna; Position on contig= 58484..58972bp; Strand=-
atggcagaaggtttacccgctgtgatgaacgctgttaccgtcattagcgaagcggtggcttccatgccttgctatctctatcgggtacagcaccagaacggcaaagaattccgcgaatggttgagtgaccatccggtcgattatttgctgaatgaatgtccgaatgactgccagacgccgtatcagttcaaacgcaccctgatgcgtcattgcctgctgaatggcaatgcgtatgcggtgattgtctggggggggatacgtaccacacaaggcgactgcattgattatgaccgtattcgggacgacattctcaaagacagtcagcaccttgatatcaagttagtgggatttgatacatggaacgccacgcacctacgcacccaattgcagggcgcggggctggatgttgagccgttcccgcgaacgccaatatcgaaccgaacaagaagaagtccgcgaataaaatcgaccctgcaatcgcgttcctga

SEQ ID NO: 1365 - DNA, 114 bp, Xenorhabdus bovienii
  Coding sequence Name=Xb4151_4152.C425.gene127.dna; Position on contig= 59012..59125bp; Strand=-
atgacctctttttatgttgattataagttaaaaaatgttggttatttgacatgtgataaaatatcgtggatgtcaccaacaacttacgtgaaagatttatcactttgtgaatga

SEQ ID NO: 1366 - DNA, 288 bp, Xenorhabdus bovienii
  Coding sequence Name=Xb4151_4152.C425.gene128.dna; Position on contig= 59074..59361bp; Strand=+
atgtcaaataaccaacattttttaacttataatcaacataaaaagaggtcatgtattaaatggttagttgctgtgatatgcttccggctttttaaggatgaagtatggccaaagttgatgtctattgccgttattgccacaaatcaggacaggtcaaaggacatgggaaaggaaatggcggacatcctcgttatcgctgttatagctgctgtaaggtctttcagttggcgtatacctatcaggcctgcaaacccggcgttaaagaacagattgtcgatatcgcgatga

SEQ ID NO: 1367 - DNA, 279 bp, Xenorhabdus bovienii; identical to SEQ ID NO: 890
  Coding sequence Name=Xb4151_4152.C425.gene129.dna; Position on contig= 59312..59590bp; Strand=-

SEQ ID NO: 1368 - DNA, 291 bp, Xenorhabdus bovienii; identical to SEQ ID NO: 155
  Coding sequence Name=Xb4151_4152.C425.gene130.dna; Position on contig= 59582..59872bp; Strand=+

SEQ ID NO: 1369 - DNA, 246 bp, Xenorhabdus bovienii
  Coding sequence Name=Xb4151_4152.C425.gene131.dna; Position on contig= 59979..60224bp; Strand=-
atggactttcttccaactcttgctttattgtacgaaaaccctgtaacaactctggtgataaatcataataggcaaggcgcaaactactcattaataaaaccccttatctcatgtctttgtgaatgtggtaaacgatataacaatccatcaattcggataagggacaagataagtctttttagccatgacaagttatttggcttagataaaaagcagataaacagtcacacatattcagagaaataa

SEQ ID NO: 1370 - DNA, 432 bp, Xenorhabdus bovienii
  Coding sequence Name=Xb4151_4152.C425.gene132.dna; Position on contig= 60134..60565bp; Strand=+
atgagtagtttgcgccttgcctattatgatttatcaccagagttgttacagggttttcgtacaataaagcaagagttggaagaaagtccattggggctagcactgattgaattaatctatttgcgtatttcccaaatcaatggctgtgctttctgtttgaacaaacatagtcaatccttgcgggaaaatcaggaaactgaacgccgtttgtctgaactggcagggtggcgtgtcagcggtcagtttaccttgcgtgaaaaggtggctttggaatggactgaatccctcacccatgttgttacaacacatgcggatgactatgcttatttaccactgaaagaccattttacggataaagaaatcgctgatttgaccttcgcgattgcattaatgaatggaatgaatcgccttgcaatcggtatgcgtcagtga

SEQ ID NO: 1371 - DNA, 1071 bp, Xenorhabdus bovienii
  Coding sequence Name=Xb4151_4152.C425.gene133.dna; Position on contig= 60570..61640bp; Strand=-
ttggatctctttccccgcaaattatggaataccctcaccgtcaaacaactgcgtttgcaaagccgatatatgtcttacccgcaacctgcgggctatttaccgttacgagaagccattgcggcttatcttcaattatcacgtggggtgagctgctctccacaacagatttttatcaccgctggctatcgcggcgctctcaacctaattgctcacaccctgatacaaccacgggatcaaatttggctcgaagatccctgctttcctcccagtcaacattttctatctcaaataggcgctgaaattattcccgtgccagtcgatcaagagggcatgaatattgcggtggctcaagaactcgccccaaatgcacgatttgctctggttacaccagcacatcaaagcccattaggcgttacactgtcaatggcacgaagacagatgcttttagcgtgggcagaacagaataatgcctttgtcatcgaagatgattatgacagtgaatatcaatatgatggacgccctcatcctgcgctggccagtttgggatctaacaatgttttgtatatcggcacattcagtaaagttctgacgccaacactccggcttgcctatctcgtcgttcctccccatttgttaacgagctttaatgctgtatgccacactcggcaagatggctgtcctttattacagcaagccgtcgtcacggatttcatgcagggaggtcatttcgcccgtcatttacgtaaaatgcgcactgcctatgcgcagcgacgccagatagtcattgagagtttgaatcaagtttttgatagccgcctgaggttcgatattcccgcaggtggcctccatttgctggcaagacttgcgcattatgaagatgatgtagcactggctcaactcgccagagagcatgggcttggcattaccgccttgtccgcacgaagattgagctcagattgtggcaagggattactgtttagttttgccaatgaaaccactcccgaaaatgctttgaaacatgctcaattactgcaaaaatgtctgcctactgcatcaagatccagtaattaa

SEQ ID NO: 1372 - DNA, 93 bp, Xenorhabdus bovienii
  Coding sequence Name=Xb4151_4152.C425.gene134.dna; Position on contig= 61652..61744bp; Strand=-
atgataatactaccgatttacattaagggacacggcctagtatatctttattcgattctgcttcatccattcatccctcaccttatcaactag

SEQ ID NO: 1373 - DNA, 456 bp, Xenorhabdus bovienii; identical to SEQ ID NO: 1296
  Coding sequence Name=Xb4151_4152.C425.gene135.dna; Position on contig= 61771..62226bp; Strand=+

SEQ ID NO: 1374 - DNA, 357 bp, Xenorhabdus bovienii
  Coding sequence Name=Xb4151_4152.C425.gene136.dna; Position on contig= 62229..62585bp; Strand=+
gtgaccgctgggcaagctcatgaaagtcaatccgccattccgttgctcgatggcattggcgtccaacgcaaaaatggtttcatgaaacggcgcggtaaagcggtactggcagataaaggctattcgggcggaaaactccgtggttatctgcgaaaattgaggataaagagcattattccttataaaatcaatgaaaaaggtagtactgatggtcgcacgcaatttgataagcaggcttatcgtgaccggaatgtggtcgaacgctgtttcggttttctgaaaggaaatcggcgtattgcaacccgctatgaaaaatctatggtccccaccttttttgcaacactgatttttgattga

SEQ ID NO: 1375 - DNA, 175 bp, Xenorhabdus bovienii
  Coding sequence Name=Xb4151_4152.C425.gene137.dna; Position on contig= 62585..62759bp; Strand=+
atgttggcttgcttaaatctatccggcgtcactatgggcagggatgcccgcgcctcgatgagttccgcacctgataagcctaaaaaaccgcacggcttcagagagccattttttatgtcaggattccatcaggggggatctctagagtcaactgcgaggtcatgcaacgcaagac

SEQ ID NO: 1376 - DNA, 120 bp, Xenorhabdus bovienii
  Coding sequence Name=Xb4151_4152.C426.gene1.dna; Position on contig =352..471bp; Strand=-
ttgggttttgctgtttcgatttgccgtgcgtttagtttcatttttaggggcacatttaataatagaagtgtaggtgccccagattatgccccgtggtgcatgttgattgcaaaggactaa

SEQ ID NO: 1377 - DNA, 1263 bp, Xenorhabdus bovienii
  Coding sequence Name=Xb4151_4152.C426.gene2.dna; Position on contig =431..1693bp; Strand=+
atgaaactaaacgcacggcaaatcgaaacagcaaaacccaaagaaaaaacctacaaactcgctgatggtggcggactctatttggagatcacctcacgcggctctaaatactggcacatgaagtatcgccgccctaccgataaaaaagaagaccgactggctttcggtgtttatcctatagtgtctttagctgatgcacgagctaaacgggatgaagccaaaaaactcatagcccaaggttctgaccccaaagcagagaaaagggggacacaactcgaatcaaaaggggcaccatcttttgaacaggtagcccgtgaatggcacgccagcaataagcgatggagtgaagatcacagcaaccgtattctgcgcagccttgagcactatatttttcctcatattggcaagctcgacatctccactgtaagaacaagccaacttttagcgcctatcaaatccgttgatgctgatggtaaacacgatatcgcccagcgattacagcaacgtgttacctctatcatgcggtatgctgtccagaatgatattcttgaatctaatcccgcaaatgatatgtctggcgcgctttccactgtaaaagccaaacatcacccagcactccctcacgaacgcttacctgaatttcttacccgtctttctcactatcgcgggcgcttgattacccaaatcgctgtagaactgactttattaacgtttgtccgttccagtgagttgagatttgcccgttgggaagaacttgatcttgaaaatgcagtctggaaaattcccgccacaagaaaacctattgaaggcgttaaattctctgagcgtggcatgaaaatgaaaactgagcatattgtgccactgagtcgtcaggccgtatctctctttaaaatcttgcagggtttgagtggagaatgtgaggtgatgtttcctcatgaccataatccggcaaaagtcatgagcgaaagtaccgtaaataatgctttacgcgttatgggctatgacaccaaaacagaagtttggggtcatggatttagaacaatggcacgtggtgcgatgggagaatctggattatggaacgatgacgcaatagaacgccagttaagccatgtggaaagaaagaacgtccgcgctgcgtatattcatacatctaagcatctggacgaacggcggctaatggttcaatggtgggctgattatctggatgcaaatagggaaaaatatataacgccgtatgactttgctaaaaaacggcggaaatag

SEQ ID NO: 1378 - DNA, 441 bp, Xenorhabdus bovienii
  Coding sequence Name=Xb4151_4152.C426.gene3.dna; Position on contig =1843..2283bp; Strand=+
atgttatttacaatcatagagatacaagagaaattaaacgagctgggttctaaacttggcctatcaaagaattccatacaggcttttgatggccctcttggtgatggaacaccttatatttcgtttgaaaataatcggtacaatctcgttttttctgaaagaggaagtgaatttgaaagaaaaagaacaaaatcattggatgagttgttgtactggatgatgtcatctgttgttttgggtatggcattcagttatgaattggaaaatcgaattgaagatcaagattgtaggcggcttgcttttcctaaagctattgagttaatgaagcaagccaaccccgaatgggttcccaaaattgaggataagattaatcgtattctctctgaacatccttacgatgacgaaccaacaagagcactgcttaaattaaaaaacaaataa

SEQ ID NO: 1379 - DNA, 171 bp, Xenorhabdus bovienii
  Coding sequence Name=Xb4151_4152.C426.gene4.dna; Position on contig =2317..2487bp; Strand=-
atgagatcatcacataggaatagtaatccgtttcacacaaagagtatgctgcgtcttattattttgattattaactatttttggttagaaaagactatcactggaagatatgccagcccgtatattttcacgaattggcattatgtattgcgttatttttatcagttttga

SEQ ID NO: 1380 - DNA, 99 bp, Xenorhabdus bovienii
  Coding sequence Name=Xb4151_4152.C426.gene5.dna; Position on contig =2471..2569bp; Strand=-
atgtggttttccctgttaacttatctatatttgatgtttctagacgttattagaacagggacaattaaagcgaagttccaatatgagatcatcacatag

SEQ ID NO: 1381 - DNA, 219 bp, Xenorhabdus bovienii
  Coding sequence Name=Xb4151_4152.C426.gene6.dna; Position on contig =2568..2786bp; Strand=+
atgtcaataattaccacatctaaagaaagtcttattcgtttatcagaagttcaacgcagaacaggttatagcaaagcgtggatctatagacttattggagaagataaattcccgaaacaaattaaaattggcactcgctcagttgcttttcttgaatcagaagttgatggctggatagatcaacgtatagctgaatctcgcggcgtggtagcacaatga

SEQ ID NO: 1382 - DNA, 525 bp, Xenorhabdus bovienii
  Coding sequence Name=Xb4151_4152.C426.gene7.dna; Position on contig =2783..3307bp; Strand=+
atgaaagcaaaaaagggtagtacagtgaatgctacccttaacttgctatcttttagagagttagttaactatcagatttattattggttggttcagccttttggctcgacacccagtctttctaattctttgcggcctaatgtttttaaccaattacctaaagtcattcctgcatcggacgcagcatcttcaaattgtgcttttaattctggtgttattctgatttggaaagtgggagacaaaccttttcctttttcagttttgtctctttttaagattgacatgtacgtacgtaaccttatagcatgtgatttattatgtacgtactttatcacggtatatgtacaaaaagaaacgcccccgaatgatattgaccgtatcaaacgagggctaaccaccaacgataactacaatatcgaggtagctatgtttcaatatacctttctaactggaaagggcaaagcacgtttacctaaattctttcctatgtgcctcatctccattctggaggtgagccatgtttaa

SEQ ID NO: 1383 - DNA, 360 bp, Xenorhabdus bovienii
  Coding sequence Name=Xb4151_4152.C426.gene8.dna; Position on contig =3300..3659bp; Strand=+
atgtttaagctcattatcacaaccataaatcagcatactggcgagataaaaaaagaaacaatccgttacaaatacaagacattgcgcggcgcggagaaagccgctatgcgtattcgccattcttgcataccagataataaatctatcgacattgaaatagtcagaacgtacgaacgtcgagcgcctatttcacttactcaggctatgcacaacacggggctggcaacttctttattctacgtcattcttgaaaaagccaaggacgaatgctctatcgatttaaataacctgattgcgctggcctgtgatatcaatcaggacgtttaccatgcgcttcaagcggctgtttacgaggaataa

SEQ ID NO: 1384 - DNA, 2445 bp, Xenorhabdus bovienii
  Coding sequence Name=Xb4151_4152.C426.gene9.dna; Position on contig =3663..6107bp; Strand=+
atgagtcaatcatcttcatatggatataaagctcataaaagcagcgtagaaacccacccgataaacattatccgaacagtgaaacaatcagctatgaatcactggcaaagcctgttgccagcctgtggtgttgatgttccggcaaaggggaagcatggcgcttgcccgatatgcggtggcactgaccgttttcactttatagatgataaccatcacggcgactggcattgtcgccagtgtgatcagcccaatcacggtgacggtctggatttagtggcgagagctaaaggtatcactgttctgaccgccgctaagcaggttgcagatgtgctggcaatgccgttacctgaacctatattcaaaccagttaaagagcagcctctaacagtaaaacccattgcagaacggatcgcggtgctggtggcaaaatcaataaggggagaatctcagtatttggtgaaaaaggggctgcattgccccaatcagcggctactgcaagatggctctctattactggtgactcagacactaagcgataccaatacgggcgcacaaatcatcacgcctaacggcgaaaaacgccttgtttccggcacgcagaagaaagggagctttattccggtatctgagataactggaacaccggacaccatcatcattaccgaaggttacgcgacagcgctgactgtcagccagttacataatggcgtggtactggctgcgattgatgaaagcaatttactgaatgttgccgaattggtcagaaaacagtggtctgaatcaaaaattatccttgccgccgataatgattggcacgcacaaggcgaacgggacaaaaacggaaaattcaaaaagaacgtcgggaaaattgccgctgagaaagtcgccaaagctatcaatggttgggtaacactgccaccgacagggcataaggccgattgggacgattatcgccagcatcacggcatagaggcagcaaagcaggtattcagcaacggattatatcaggttggagagaaaaaactcatggaagcagaagcggcagtgatccacgaaactaaacccaaaaaggctaataacaatctggcacaaatggcagccagtcaacgtggggcactattggttgagcattaccaaaaaatcgcggtacatgctgaaagcgaagccgtttatcactataacggcccgacatgggaaactgtgtcagataacgagctgcgtcgcgcaatggtggcaatctttgaccagcacgacaccccttacagcccaaacgggatcaataacgctatctacgccatgaaattacaaattccggtcattggcgaacaacggtcagatttaatcgggttttgtaatggtgtgtatgagctatcgacacagaaatttactccccatcagcctgagcattggcttatgaatcataatggcattgagtttactcagcccgctatcggtgaaaacttgtcggatcatgcccctgacttttaccgctggttatcccatgcagcggggcagaatgaaaataagatgaatcgtatcaaagctgccctgtttatgatcctggcaaaccgttatgattggcagctctttattgaagtcaccggcgaaggcggcagcggtaaaagcgtatttacatatatcgccaccttactggcgggagagcacaataccgccagtggcaatatgagagcgctggatgaagccagaggccgttatcagtttgttggcaagagcttaattacgctgcccgatcaggttaaatatgtcggtgaaggggcaggaattaaggccattaccggcggcgacctgattgaagttgacgggaaatacgagaaacagttttctaccatcatcaaagccgtggtattagccaccaataacgaacccatgagctttaccgaacgtaacggcggcattgcacggcggcgagtgatatttccgtttaatattccggtcaaagaatccgagaaagacccacagttaccggagaaaatcagtcgtgaactgccagtgattatccgtcatttattaacagaatttgccgaccagaataaggctaaaaaactgctacaggcgcaacgcgactcgaacgaagcgttaacggtaaagagtcattccgatccgttgtatcgtttttgtggttatctggtatctgtcaatgatgtgaccggaatgaagatgggcaataagaatatcagcccacgcgcaccaagattgtacttgtatcacgcctatctctcttttatggaagcgcacggctttgaacgtccgctaacactgactaagtttggtgaatccatccccaagattatgctggaataccggaaagagtatcggaaagtgcgaaccaagaaaggttactcttataacgttgagttatcggaagaggccgaagaatggctaccgtcagtgcctgaatgccgagattttaagtcacctgtataa

SEQ ID NO: 1385 - DNA, 174 bp, Xenorhabdus bovienii
  Coding sequence Name=Xb4151_4152.C426.gene10.dna; Position on contig =6268..6441bp; Strand=-
gtgccaaaaaataaaaaaccagattacatatctgtatttgttttctctggtttacctcatttcgtttacttaccagaagcccccctaaaaatctttttcatcctctcagttattcaccctctgcacaataccctgaaagccttgctacatctgggtttgatgcaattaatatga

SEQ ID NO: 1386 - DNA, 117 bp, Xenorhabdus bovienii
  Coding sequence Name=Xb4151_4152.C426.gene11.dna; Position on contig =6479..6595bp; Strand=-
atggtttccaataaatgcccaatgatgctgaatgaaacaggatacaacagtattatttatctgttccagagtgaatacaaatgcagcaataaaattgtgattaacctctatgcttaa

SEQ ID NO: 1387 - DNA, 735 bp, Xenorhabdus bovienii
  Coding sequence Name=Xb4151_4152.C426.gene12.dna; Position on contig =6611..7345bp; Strand=+
atgtcacatattatttacttgtcgttaaagggcaagaagcaaggccttatctcagcgggctgttcaacgcccgaatctatcggaaaccgctatcaggcaggccgggaagatgaaatacaggtactaagtgttagccattcagtgagccgtgaccagaacgcgaatcatcaccctgtcagctttaccaagcccattgataaatcttcacctttgttagcgatggcaatcgatggaaacgaattgctggaagcacgctttatgcactaccggacaagcccgatggggcaactggaattcttttatgaaatcaaactaacaggcgcgacaattgtcgaatttgcctataattatccccattccatcaatgataacggcgcaataccccatgaagtggtcatgctcgattataaatctatctcatgtcagcatattgcggcaggaacttcgggctacagcattacgcaattagccgggcgtgaagaaggcaaaccgcttttatccgggttctcgaatattaaaccgctgattgaagaagctgtcgcggctctatttagccataagttcatattgaaacaccaaggggatgcctgccaagatattgcgtatggtgtggaaacgggaaagggactgattgaaggaatatgccaaacatcaggaatgacaaaacagtttgataccaaaaaagaagaagaccttgaagttaaatatttatttcaaacaaaaatagggatttaa

SEQ ID NO: 1388 - DNA, 843 bp, Xenorhabdus bovienii
  Coding sequence Name=Xb4151_4152.C426.gene13.dna; Position on contig =7348..8190bp; Strand=+
atgtcgattttaaaaactaaaacagttaaaggtggcgaaaagacagatattgaaatggatatcttttatttaaaccaaatcccagatgcaatggaaaaaatgggatgggagatggcacctaagttaatgcggcattggtttaatacaaaacccgcctatacatttacagaagaagtaaagacaaagtatgttagagataaagcaatagatataccggatgaaagaattaatgcttctatcataaaaatggaatgggcgttaaaatataaacaacctcaagacgtgatgtctgtattaattaatggttggtctagtagtgcgggcatagatcaattaaaaatacaattaaaaaaagaaggcggaaagaaagagttagggtatgaaaaggatatgcgagaaatagatactttttcagtggttaactctagaaggtttggttctaaatttgatacgattgacgattggtatggtgccatgggtaattccaatatgaaggtggctgtcaaaggttatgtggataaattaaacggtaaagatgtttttgtcaccgaacaaattgggatgtatttaaaagatacctatgattttgttggtgctaatgaacctttaggcatttggagtaaaaatggtatattagataaaattagttccgttgattatgccgctctttatgcgactggaagctggatggccttatgggttaaatacaatggatatgttcctgtaattaatgatagctttaggaaatggcagaaaaaatataatgaaggcggcgatttcattgtttattccgatgttctatggatgaacccgctatcacaacataaaattattaacttatga

SEQ ID NO: 1389 - DNA, 114 bp, Xenorhabdus bovienii
  Coding sequence Name=Xb4151_4152.C426.gene14.dna; Position on contig =8253..8366bp; Strand=-
ttggcaacttcttatataccactgcggtatattgaccatcttcacccctctcctcaaaatacttattccaattaccgaagagcaatgttgatggaaataatatccatattataa

SEQ ID NO: 1390 - DNA, 246 bp, Xenorhabdus bovienii
  Coding sequence Name=Xb4151_4152.C426.gene15.dna; Position on contig =8328..8573bp; Strand=+
atggtcaatataccgcagtggtatataagaagttgccaatatctccatattcaatgtggaggtatgtcattatgggagataaatattttattgttttatatgataataaaaacagagatatctggaagagttctccatttacatcaatatcatatgaggcattttttgcttcatttagccttccaaccactaataatgatgtttttatatacccaacagataatggatatcaaagcatccatctaa

SEQ ID NO: 1391 - DNA, 918 bp, Xenorhabdus bovienii
  Coding sequence Name=Xb4151_4152.C426.gene16.dna; Position on contig =8750..9667bp; Strand=+
atgaaaaaactactcgaattacgtcaacaaaaagctgatttaacccatcaaatgcgttcactgcttaccaaagcagaagacgaaaaacgctcacttaatgccgatgaagccaaacagttcgacgagctgcgcaatcagtctgatgcgctcaatgcagagattgcccgttatgaggcgctgtctgatgaagaacgcagtcaggcaagcaaaccccaaccgaccaacaagaacctcagtaatgacgaactgcgccactatgttctgactggtgaaactcgttccctatctacgggagttccgtctgagggcggctataccgttattcctgaactgaacaaacaaatcatgcagcaactgactgatgagtcagtgatgcgccggatctgttcagtgaaaaccacacgcagcaacgaatataagcagttggtttcggtcggtggcgcagcggttgcacatggggaagaaggcaaggcacgcggtgagactggcacgccaaaaatggaagaagtcagcattaagctattccccatctacgcctaccctaaaactacgcaagagattatcgattttagcgatgtggatatcttaggctggctgacgtctgaaattgccgacacattcgtcgataccgaagaaaccgatctcttgagcggtgacggcagtaaaaaagcgaaaggcttcctgtcttatccccgtgatactcaagccgataagattcgtgcgtttggcacattgcaaaaactggaaactacagcgctttccgccgatagcctgattgacctgaaattcttacttaaaaacaaataccgtaaaaactctgtctgggtgatgaactccagtaccgccgctcaggtgcaaaaactgaaaaatggcaatggtgattatatctggcgtgaacgttggtcatgtattaaatga

SEQ ID NO: 1392 - DNA, 291 bp, Xenorhabdus bovienii; identical to SEQ ID NO: 155
  Coding sequence Name=Xb4151_4152.C426.gene17.dna; Position on contig =9680..9970bp; Strand=-

SEQ ID NO: 1393 - DNA, 279 bp, Xenorhabdus bovienii; identical to SEQ ID NO: 890
  Coding sequence Name=Xb4151_4152.C426.gene18.dna; Position on contig =9962..10240bp; Strand=+

SEQ ID NO: 1394 - DNA, 270 bp, Xenorhabdus bovienii
  Coding sequence Name=Xb4151_4152.C426.gene19.dna; Position on contig =10191..10460bp; Strand=-
atggataaattttccctttcggaaaaagggtcatgtattaaatggttagttgctgtgatatgcttccggctttttaaggatgaagtatggccaaagttgatgtctattgccgttattgccacaaatcagaacaggtcaaaggacatgggaaaggaaatggcggacatcctcgttatcgctgttatagctgctgtaaggtctttcagttggcgtatacctatcaggcctgcaaacccggcgttaaagaacagattgtcgatatcgcgatga

SEQ ID NO: 1395 - DNA, 132 bp, Xenorhabdus bovienii
  Coding sequence Name=Xb4151_4152.C426.gene20.dna; Position on contig =10427..10558bp; Strand=+
atgaccctttttccgaaagggaaaatttatccatttatatgtccactcaacataaacaagcattttgatattcatttcaaggtattacaagcaattaaatatccaagactcgtttgggacctatttacataa

SEQ ID NO: 1396 - DNA, 177 bp, Xenorhabdus bovienii
  Coding sequence Name=Xb4151_4152.C426.gene21.dna; Position on contig =10547..10723bp; Strand=-
atgagcatctggataaatatctataagatggactctttgtgtcaagggcatttgaagttttctccccaaaaagtatgtctgcattgcaacggcattggttatgtattactcatttcatttcagattacaaactatttttgttttgtaggatgcaacttgagttgcttatgtaaatag

SEQ ID NO: 1397 - DNA, 552 bp, Xenorhabdus bovienii
  Coding sequence Name=Xb4151_4152.C426.gene22.dna; Position on contig =10640..11191bp; Strand=+
atgcagacatactttttggggagaaaacttcaaatgcccttgacacaaagagtccatcttatagatatttatccagatgctcatatgtatatttcatcaacctttcatgatggatacgtaataaatgaatttacaattgcttgtcatggattagctgtttttgatgggcggccggaaggccttgcaataaacggtcaactctggacttacgacatagtgaccagctacattcagtcaaacacaacggttgagacactgcatagaatccatcttcttgcttgcaattcagcgaattatgatattgcctctctcgcagcaaaagtgtcagcaagaataagaaatactgaagttaaaggatacataggttcagtttatataaatttcagacataacgatatttatcagtattatctaaataatgggagtaacagagtttctgtcgagcgctatcttgaacagattggaaatagtcgggttcacaccaataatgttcctaactattactgcatagtattcaaaaatggcattatggaaagacaagattacttatga

SEQ ID NO: 1398 - DNA, 120 bp, Xenorhabdus bovienii
  Coding sequence Name=Xb4151_4152.C426.gene23.dna; Position on contig =11182..11301bp; Strand=-
ttgaattcaggcttaatatcaattctgaaaagagacagcaggaggcacttccccttcgtcattaaggggggtaatagggttgtagatcctttacctaatattttccaatttcataagtaa

SEQ ID NO: 1399 - DNA, 816 bp, Xenorhabdus bovienii
  Coding sequence Name=Xb4151_4152.C426.gene24.dna; Position on contig =11298..12113bp; Strand=-
atgatagcctcggacttacagaatgcgctttatgccattgcccgtaatcaccagcaggatgaacacggccagccgttaatcaccgcgcaccggcgggcacgggcggatgaaatggcgggcgccatgtcgatgtttacccaggggtttgaaggggagctgtttaaccgtcccggcaccccgtggccggaggtggatgtcaccctgattgatctgggcacactggcccgtgaaaactactcggcccagatggcactggcaatggtgtcactgattaacaaagtcaataacctggccgaacgcgaccagtatcaggatcgcgaactgcaactggtgattgatgaagggcatatcactaccacgaacccgctgctgtcgccctatatgaccaaggtcgtgaaaatgtggcgtaagctgggtgcatggctgtggctggcgacccaaaacctggccgactatccggataccgctgagaaaatgctgaatatggcggaatggtggctgtgtctgaccatgtcaccggatgaagtggagcagatcgcccgtttcaagaagctaacggaagagcaaaaatcggtgctgctctctgccagtaaattaccccgctgttataccgagggcgtggtactggcgaaaaaaatcgaagcgttgtttcgggtggtgccgccgagcctttatctggctctgggcatgacggaaaaagaagagaaagccgagcggcgggcgctaatgcgtgagcaccagtgcagtgaactggaggccgctgtgttggtggccaggaagatggatgtggcgcgggggttgaaagcagtttattga

SEQ ID NO: 1400 - DNA, 366 bp, Xenorhabdus bovienii
  Coding sequence Name=Xb4151_4152.C426.gene25.dna; Position on contig =12162..12527bp; Strand=-
atggggtcattcatcagtaacaaaaaacggcaacgctggctgtggtacgcgtgggagcctcgcttgaaacgtattgtcgctcacgcttttggcgctcgtagcaaacagacactcaggacgttgctggaaaagttatccgcttttgatgtggcattctggtgcaccgataatttcggggcatatgacatattggctgatgagaaacatatcaccggtaaactttatactcaacgtattgaacgagaaaatctgaacctgcgtaacaggctaaagcgactcaatcgcaagacgctgggttattctaagtcagttgaaatgcatgacaagatcattggcacattcatcgaacgtgagttctattattga

SEQ ID NO: 1401 - DNA, 276 bp, Xenorhabdus bovienii
  Coding sequence Name=Xb4151_4152.C426.gene26.dna; Position on contig =12581..12856bp; Strand=-
atggcattagttgaagtgaagtgtcggttttgtggccaaaccacgtctgttaaaaaacacggtaaaggagaaggtgggcatcaacgatattattgccagtcctgtcgtagaaccttccagctcgaatacacttaccgggcttgccattcgggtatgaaagagcaaatcgtcaagcttgccatgaataacgccggtattcgtgatacggcacgggcacttcatgtcagcattaacgctgttgtacgcactttaaaaaacgcgcgccgcgatgtgtaa

SEQ ID NO: 1402 - DNA, 171 bp, Xenorhabdus bovienii
  Coding sequence Name=Xb4151_4152.C426.gene27.dna; Position on contig =12813..12983bp; Strand=+
gtggtttggccacaaaaccgacacttcacttcaactaatgccatcactatccctcacgtatttaccctcattatacgtgagaaacaacgggatgaatacgtgatccggtattcttggcggcatcatatcaccactttgagaacaatccgcctcattcactctcacgggtga

SEQ ID NO: 1403 - DNA, 216 bp, Xenorhabdus bovienii
  Coding sequence Name=Xb4151_4152.C426.gene28.dna; Position on contig =12964..13179bp; Strand=-
ttgaaaaatattgctgaacaagtgggtcgcattaacggtcgtcgctatgacgcaggtatgaaactgtcagtagatacaggtgctaaggctggaattgctgccgatagcttcaaggtctttggtccggtacaaacagctgaaataatcaacgacgatcacatccgccagataatccgtgaagagatacgccagttcgtcacccgtgagagtgaatga

SEQ ID NO: 1404 - DNA, 201 bp, Xenorhabdus bovienii
  Coding sequence Name=Xb4151_4152.C426.gene29.dna; Position on contig =13148..13348bp; Strand=+
atgcgacccacttgttcagcaatatttttcaactgtgatttaagttggttcagtgtgtcagtgtcacaattgaaatcaatgatgaaggtgtgttggggtactctgtgtcatgttctgttctccaaaaagaaaaagccacccgtgttaactgatggcatggggtattcctttaaccgctcaagggaatgggtaaaggaataa

SEQ ID NO: 1405 - DNA, 312 bp, Xenorhabdus bovienii
  Coding sequence Name=Xb4151_4152.C426.gene30.dna; Position on contig =13430..13741bp; Strand=+
atgaattttagcgtcctactaggtatcttagtgttagtgtctgcctacctttcacagcgttcatcacagaaaaaagaacaagcgcggtatctttattctttgtttaaagatcatgagcagtttatagggaaaagtccggattacattattagcaaaacaatgaagccataccaatctggcagcgtggagcatggtgtagaatttacccaatggaggatcggaaaattagtcattgaagcttggttcaaaaatcaggtatgcactggtatagatttttatttaccaaaatggctcacccgcactgccccctaa

SEQ ID NO: 1406 - DNA, 240 bp, Xenorhabdus bovienii
  Coding sequence Name=Xb4151_4152.C426.gene31.dna; Position on contig =13763..14002bp; Strand=-
atgcaagagagagtaatggaaaatgaacttaaaccgtgtccgttttgtggtagtgataatgtaggaactgaacgccattatggctttgctgataaagattacgaagagtgggtaaattgctataactgtgatgcttcgggttctcatacatgttggtttgatgatgtcggtgtcgccgactctgaggcaattaagttatggaatcggagaatggaaaatactcaaccccagcgcaaatga

SEQ ID NO: 1407 - DNA, 270 bp, Xenorhabdus bovienii
  Coding sequence Name=Xb4151_4152.C426.gene32.dna; Position on contig =14037..14306bp; Strand=-
atgttgattttgctatatgtatcagataacaacttagaaacaattcttgaccaaacactcctcattaataaagaccaattcggtgaatacactgcaaaaatggaatttgaaaactttccgagactgcagtcagagaaagaagcggcgttaagactcgcggactggatgcgacgcatgagtgaagcgatagaagatcactggcagaacaagaaacagtctccagaggctgttcagcttatagaagaagaaataattggcatcgcagagtaa

SEQ ID NO: 1408 - DNA, 405 bp, Xenorhabdus bovienii
  Coding sequence Name=Xb4151_4152.C426.gene33.dna; Position on contig =14315..14719bp; Strand=-
atgccacgtaaacaaggatattcggaaaaagggttacgctgttttggtacgcatgactggcacgtaaaaggccgtatcaacgtcattggcgccattctcgaaaataccttcgtcaccttaagcttatttaccgagaatattaatgccgatgttttttatgcgtggatgacgcaagatttgctgccaaagcttccacacggagcagtgatagtgatggataatgcgcctttccataaacggaatgacacgacacaagcgatagcagacagcagatgtcaactggaatggcttcccgcttatagtccggatttaaaccctatagaacacaaatggggcggagcaaaagcgataaggaggcaaaaaagatgttcagttgatgagttgtttacggagcatattgaatag

SEQ ID NO: 1409 - DNA, 132 bp, Xenorhabdus bovienii
  Coding sequence Name=Xb4151_4152.C426.gene34.dna; Position on contig =14723..14854bp; Strand=+
ttgagcaaaaccactttcatccaaataaacaatgggtctgccagtctgttcatcatcgctgatacgctcgataaatgcctgacgagcttgaggatcagcgcgagggggttggagcgttttttttctgggtga

SEQ ID NO: 1410 - DNA, 324 bp, Xenorhabdus bovienii
  Coding sequence Name=Xb4151_4152.C426.gene35.dna; Position on contig =14817..15140bp; Strand=-
atgggctacagcttagattttcgaaagcgagtactggcatacaaagacaagcattcgttgactttcgaacaaacgagtgcccattttgagatttccatgcgtaccttgttccggtggtgcaataaaatagaaccttgcatgacccgcgataaacccgccacgaaaatccctgatgaggtactcattgcggatgtccaaaatttttctgatgactatcaatgggaaagagcaaaacgtttaggtgtctcacaatcggctattcattacgccttgaaacggcttcggatcacccagaaaaaaaacgctccaaccccctcgcgctga

SEQ ID NO: 1411 - DNA, 93 bp, Xenorhabdus bovienii
  Coding sequence Name=Xb4151_4152.C426.gene36.dna; Position on contig =15101..15193bp; Strand=+
atgccagtactcgctttcgaaaatctaagctgtagcccatctcattttatgccttgttatcttagagttagatattatgtcatattaatatga

SEQ ID NO: 1412 - DNA, 1515 bp, Xenorhabdus bovienii
  Coding sequence Name=Xb4151_4152.C426.gene37.dna; Position on contig =15336..16850bp; Strand=-
atgtcacaacagcagcagggagctgaacaggctcctgatttaaataatgaactgaaaactcgccgtgaaaaactggttgcactgcgcggcaacggtatcgcattcccaaatgattttcgtcgtgaaaacatttctgaagatctgcatgcaaaatatgatgacaagactcaggaagaactggaagcgctgaacattgaagtgaccgtagcaggccgtatgatgactcgtcgtatcatgggcaaggcatcctttgcgaccttgcaggacatgggaggacgtattcaggtttacgtttcccgtgatgacctgccggaaggcatttataatgaacagttcaaaaaatgggatttgggtgacattttaggcgctcgcggtaaattgtttaaaaccaaaacgggtgaactttccattcactgtactgaactgcgcttgctgaccaaagcactgcgtccgctgccggataaattccacggcttggcggatcaggaaatgcgctaccgtcagcgttatttggatctgatctcgaatgacgaatcacgcaagacattccagatccgttcccgcatcatggctgcattgcgtaacttcatggtcaaaaaagacttcatggaagttgaaactccaatgatgcaggcgatccctggcggagcgagtgcgcgcccatttactacgcaccacaacgcgctggacatcgatatgtacctgcgcattgcaccggaactgtatctgaaacgtctggtagtgggtggttttgagcgcgttttcgaaatcaaccggaacttccgtaacgaaggtatttctccgcgtcataacccagagttcaccatgatggaactctacatggcttatgcggattaccaagatctgatcgtactgaccgaagaactgttccgtactctgactcaggaagtgctgggtactacgttggttaaatacggtgaacaagaattcgatttcggtaagcctttcaccaaaatgtccatgaaagaagcgatctgcaaatatcgcccggaaaccaatatcgcggatctggatgatatggataaagctgtcgctatcgcgaagtctcttggtattgatattgaaaaaagttggggcttgggtcgtattcagtgtgaaatatttgaagaaactgctgaaagccacctgattcaaccgactttcattactgaatacccagcagaagtttctccgctggcacgccgtaatgatgataacccattcattacagaccgttttgaattctttatcggtggccgtgaaattggtaacggcttctccgaactgaacgatgcagaagatcaggcagaacgttttgcagagcaagttcgtcataaagatgaaggtgacgacgaagcgatgttctatgatgatgactacgttactgcactggaacacggtttaccaccaacagcaggtttggggattggtatcgaccgtatggttatgctgttcacggatagccataccatccgtgacgtgatcctgttcccagcaatgcgcccgaataaataa

SEQ ID NO: 1413 - DNA, 861 bp, Xenorhabdus bovienii
  Coding sequence Name=Xb4151_4152.C426.gene38.dna; Position on contig =16860..17720bp; Strand=-
gtgaacggcctgctggaactggctgtagaagctgatgatgaagagactttcaatgaagccgtagctgagttggaacagttggaagaaaaactcggtcagcttgaatttcgccgcatgttctcaggtcaatatgacagcgcaaactgctatctggatttacaggctggctctggtggtacagaagcacaagactgggccagtatgctgatgcgtatgtttctgcgctgggctgagtccaaaggtttcaaaactgaaattatcgaagagtctgatggtgacgttgctggtttgaaatctgcaaccattaaaatcatcggtgaatatgcttacggttggttgcgtacagaaactggcgtgcatcgtttggtacgtaaaagtccgtttgactcaggtgggcgtcgtcatacctcattcagctctgcctttatttacccagaagtggatgatgacattgatattgaaatcaacccggccgatttgcgtattgatgtataccgtgcttccggtgcgggtggtcagcacgtcaacaaaaccgagtctgcggtgcgtatcacccacataccgactggccttgtaacccagtgtcagaatgatcgttctcagcataaaaacaaagaccaggcgatgaaacagttgaaagccaaactgtatgaactggaaatgcagaagaagaatgctgataaacaggcgatggaagaaaacaaatcggatatcggttggggcagtcagatccgctcttacgttttggatgattcccgcattaaagatttgcgtactggcgttgaaactcgcaatacgcagtctgtgctggatggggatttggacaaattcattgaagccagcttaaaagccggcctatga

SEQ ID NO: 1414 - DNA, 120 bp, Xenorhabdus bovienii
  Coding sequence Name=Xb4151_4152.C426.gene39.dna; Position on contig =17761..17880bp; Strand=+
atgttttccagtgatgaacgctctttacctaatgcctgtgcccgttccggttcattccagacatcaggctgttccagttcagcattgacttcttctaaacgttctttcttggcatcatag

SEQ ID NO: 1415 - DNA, 105 bp, Xenorhabdus bovienii
  Coding sequence Name=Xb4151_4152.C426.gene40.dna; Position on contig =17881..17985bp; Strand=-
gtgaccactacgtataagacacaaaatatgtttgaaattaacccggtaaaaagccacattcaggacttgtctgaacggacagacgttctgagggggtatctttga

SEQ ID NO: 1416 - DNA, 93 bp, Xenorhabdus bovienii
  Coding sequence Name=Xb4151_4152.C426.gene41.dna; Position on contig =17982..18074bp; Strand=-
atgaccaaaagtgattgtgtggccaatctccagaaatgctataaaccgtttgacagatccgttagaatacgcagttcgaaaatatccatgtga

SEQ ID NO: 1417 - DNA, 1749 bp, Xenorhabdus bovienii
  Coding sequence Name=Xb4151_4152.C426.gene42.dna; Position on contig =18116..19864bp; Strand=-
gtgaagcaacctccagtgaatatagaaacacaactccgccgccgcccggtggcggatgacagtcatcttcccaatagtattcatccattattgcgtcgtttatacgctatgcggggtattcgtcaggcggatgaactggaacgtggagccaaagggctactcaattatcaatctctcaatggcattgaacaggctgtttccttattgataacagcattgtacgaccattcgcgcattgttattgtcggtgatttcgatacggatggggcaaccagtacagcattgtgtatccgtgccttgcgggcgatgggctatcgcaatctagattatcttgtgccaaatcgttttgaagacggttatggtttaagtgttcagattgttaatgaggtcgttaaaaaaggcgctgatctgatcattactgtggataatggcatctcttcccacgaaggggtggcagcagcacatcagcatagcatcaaagtgcttgtcaccgaccatcacttacccggagagacattgcctgccgcagatgccattatcaaccctaacctgcatgactgtactttcccctcgaaagcgctggctggcgtgggggtggcattttatctgatgtcggcactcagggcggaattacgcagaatagcgtggtttgagcagcagggtattccgctgcctaatctggcggaactgcttgatctggtggcactcggaattgtggcagacgtggttcctcttgataccaataaccgtatttttgtgtatcaaggattgaaccgcattcgtgctggtcgctgttgcgtgggaattcgggcgctgcttgaaatttccaaacgggaatcaaccaaactggctgccagtgatttggggttttcgcttgggccacgattgaatgcagccgggcggctggatgatatgtccgttggcgtggctttactgttgacggatgatatggtgcaagctcgtcagatagcctgtgaacttgatggactgaaccaaacccgccgtgaaattgagcaggggatgcagcaggaagctttgcagatttgcgatcaattcgaacgtacctgtactcagttaccttacggattggtcatttatcatccagagtggcatcagggcgtagtgggtattctggcctcgcgtattaaagaacgttttcaccgtccggttattgcttttgctccggcaggcgatggaacattaaaaggttcaggccgttcagtaaatggattgcacatgcgtgatgcgcttgagcgcctcgatacccggcatccgggtctgatattgaaatttggcggccatgctatggctgcgggcttgtcaattgaacaggataaatttgatctgtttcagcgccatttctctgcgttaatggcagattggctggatatctcccagcttggaggggtagtctggagtgatggcgaactggccttaggggagttatcgctggaaattgcggaaattctgcgagaaggtggcccgtggggacaggcatttgccgaaccgatatttgatggtaaattcaaactgctgcaacagcggattgttggcgaaaaacatctgaaagtcatgcttgaaccattaaacggtgggccgatgttggatggcattgcgtttaatatcgatactcatcgttggccggataacagcgtcaaaacagtggaattagcctataaactggatatcaacgaatttcgcggtaatcgcgatgtccaacttttgatccagcacatctggccttactga

SEQ ID NO: 1418 - DNA, 723 bp, Xenorhabdus bovienii
  Coding sequence Name=Xb4151_4152.C426.gene43.dna; Position on contig =19886..20608bp; Strand=-
atggaaataaaggaacaaaagatgaaaaaattagcattttgtttttccttattattgacggcctttgccggcaatgtatttgctaatgacagtgcggttaataactcattggtaaaaatgggacttaaagccgaaagtatcaagccatcacaactggctggcgtgagcacggttttgacagatcagggtattatccatatctccaacgatggtaagtatttgttcaaaggccaggtttacgatattagtggcaaaataccaaagaatgtcaccaatcaggttctggtgaaaaaactggatgctttgaaaaatcaaatgattgtttacaaagcaccgaaagagaaatatgtcgtgactgtttttactgatattacctgtggttattgccgcaagttgcatgaggaaatgaaagagtataacgatttgggtatcaccatccgttatttggcatttcctcgccatagtctgcaacatcagtcagccaaagatatgcaatccatctggtgcagtgcgacaccgaataaagcgctggatgccgctttcaaaggggataacatttctccgatcaaaagctgtaaaaatgatatcgcgaaacaataccagttaggcttgcagtttggtgttcagggaacacctgcgattgtacttcaggatggcagtgtgcttggtggttttgtgccgccaaaagcgctgaaagaagatttggaacaacagagtgaataa

SEQ ID NO: 1419 - DNA, 957 bp, Xenorhabdus bovienii
  Coding sequence Name=Xb4151_4152.C426.gene44.dna; Position on contig =20621..21577bp; Strand=-
gtgccaaaaaaacacgatttatcagaaaactatgcatcgcaagataagtcatcggaaccggctccaccggctaattccctgattgagcaatttctggataccatctggctggaaaaggatctggctgaaaatacgctatcttcttaccggttggatttacaagccttgaataattggctggtatatagtggtcacgatttactttctgtggaatctattgagctacaattatttttggctgaacgggtagatagcggttataaagccagtagttcggcccgcttgctgagtgcaatgcggcggttgtttcagtatctttatcgtgaaaaaatgcgtttggatgatccaacagcacttttatctgcccctaagttgcctaaacgcttacccaaagacttaagtgaaaaacaagttggggatttgctgaatactcccctgactgaccaaccgattgaattgcgggataaagcaatgcttgaagtactttacgcctgtggattgcgggtatctgaattggttggactgacattgtcggatatgagcttacgtcaaggtgtggttagagtcgtgggtaagggaaacaaggaaagattggttcctttgggagaagaagcactttactggctggagaaatacctagagtatgggcgtccgtggttattaaatggctcggcatctgacgttttcttccccagcaaaaggggaacgcagatgacccgccagactttctggcatcggatcaaacattatgccgtattgtctggcattgataccgaacgtttatcacctcatgttttgcgtcatgcttttgcaacgcatttactcaaccatggtgcagatttacgcgttgtacagatgttgctggggcatagtgatctctccacaactcaaatttatacctatgtagcgactgaacgtcttaaaatgctgcatcaacaacatcatcctcgtggataa

SEQ ID NO: 1420 - DNA, 201 bp, Xenorhabdus bovienii
  Coding sequence Name=Xb4151_4152.C426.gene45.dna; Position on contig =21563..21763bp; Strand=+
gtgtttttttggcacaagacttcctttatctctgcgacttccgatcggctattatgcctgaaaaagcaattcttctgttacaatgcagcccctgatattcgaaatgtcctggtaaataatgatgaaaattggtctcttttacggctccagtacatgctatacagaaatggtagcagaaaaaatacgcgatatactcggtga

SEQ ID NO: 1421 - DNA, 522 bp, Xenorhabdus bovienii
  Coding sequence Name=Xb4151_4152.C426.gene46.dna; Position on contig =21681..22202bp; Strand=+
atgatgaaaattggtctcttttacggctccagtacatgctatacagaaatggtagcagaaaaaatacgcgatatactcggtgaagatctgatcgatctgcataatgtcaaagattgtgatcccaaattgatggaagattattctgtcctgattctcggcattcctacttgggatttcggtgaattacaggaagattggctggctatctgggatcagcttccatcattggatctgtcgggaaaaatcgttgccatgtatggcatgggagatcagatcgactacagtgaatggtttctggattcgttgggaatgttgtatcaccatttgctgcctgcgggtgcgcagtttgttggtttttggccaacagaaggttatgaattcaccagccccaaaccactgaccgaagatggcaaacaatttgtcggcctggctctggatgatgtaaaccagttcgagcaaactgatgaacgtttgagcgaatggtgtatgcagatactggcagaaatggaagcgctgttttaa

SEQ ID NO: 1422 - DNA, 354 bp, Xenorhabdus bovienii
  Coding sequence Name=Xb4151_4152.C426.gene47.dna; Position on contig =22203..22556bp; Strand=-
atgcttgccgcgttattggctccgtggccttccaatggtttttatctctggcttccattgtttgtcatcattatggtgagctgggtgtggagtcagacaaacattaggcggtgtcagggaaggctggtattgttcagtggccagaaaatgcattggcaaaaagcggcgtggaaactcactaggccaccgtggttaagccgctatggtatggtgatcacacttcacgcctttgacaaaacagaaagtatccgccaacggtcgttaattcggttatgggtggcatcagacagtgtgccaccaaagatgtggcgtcatttgaaccagcttatgcgtcagtatcctgatatagcgtga

SEQ ID NO: 1423 - DNA, 267 bp, Xenorhabdus bovienii
  Coding sequence Name=Xb4151_4152.C426.gene48.dna; Position on contig =22612..22878bp; Strand=-
atggatattgacaataaagcgcgtattcactgggcatgtcgtcgtggaatgcgtgaactggatatttctatcatgccattttttgaatatgaatatgactcattgaatgatgatgataagcagcttttcgtccgtttgctggagtgtgcagatcctgatctttttaactggctcatgaatcatggtcgtccagaagatgatgagctattccgcatggtgcaattgattcagagcagaaaccaagcccgtggccctgtggcactgtga

SEQ ID NO: 1424 - DNA, 426 bp, Xenorhabdus bovienii
  Coding sequence Name=Xb4151_4152.C426.gene49.dna; Position on contig =22842..23267bp; Strand=+
atgcccagtgaatacgcgctttattgtcaatatccatgtttaaaaagcctcttgattattttcattcgtgccattgagacggcaatgctgatgtcgcgaaagattaacaagtcacccgtcgtttcagacatgagcacggttgcaaaatttcacagtcaaagggaattatcaacgattctgggctgcttttcatcattcatgacagttgaatcaagatatatctataatatgcgaagagcatcgcaacaaatcatctttaactacccgtcagtaaataacaagaataactcctttgcattaagcctcatctcttttaccattagcattatttctcagatagtttactggcaggagctattatggctgaccaaattctattttctgcacaactcccatctccttcagcaacactttccctggctttaa

SEQ ID NO: 1425 - DNA, 999 bp, Xenorhabdus bovienii
  Coding sequence Name=Xb4151_4152.C426.gene50.dna; Position on contig =23201..24199bp; Strand=+
atggctgaccaaattctattttctgcacaactcccatctccttcagcaacactttccctggctttaatttctcttaatgattgggggatgattagcgtaacaggcgcagatgcggaaaagtatctgcaaggccaagtcacatcagatatcgcctctctcaaccaaaaacatgtgttgagcgcacattgtgacgccaaaggaaagatgtggagtaacctgcggctgtttcaccgtggcgaaggttttgcctatattgaacgtcgcacagtattggattcccagctgactgaattgaaaaaatacgctgtgttttccaaagtgacctttgctaaagatgaagaaagcatcctgcttggtgtagccggagcaggaagcaggaacgcactggcagaaatgtttcccaccctgcccgatgccgaaacaaccgttattcaacacgaaacaaccacccttctccacttcgctttccccgcagaacgttttcttttagtcaccgatcaggctaccgcagcccagttaacggaaacattagtagggaagcttcaggcgcaattgaacgatagtcagcagtggttggcactagagattgaagcaggcttcccagtcattgactcagccagcagcgcccagttcattccacaagcgacgaatattcaggttcttgagggcagtatcagctttaagaaaggctgttataccggtcaggagatggtggctcgtgccaaataccgcggtgctaataagcgggcaatgtactggctggctggcaccgcgtcttctcttcccgttgccggagacgatctggagtggcaactgggtgataaatggcgcagaacaggctcagttctgacagcggtcagactcgctgatggttcaatctgggtgcaagttgtcatgaacaatgatatggctgctgacagtattttccgtatccgtgaagatgaaggaagttctcttaccattcaatcgcttccttattcattcgatgaagaaaaataa

SEQ ID NO: 1426 - DNA, 609 bp, Xenorhabdus bovienii
  Coding sequence Name=Xb4151_4152.C426.gene51.dna; Position on contig =24215..24823bp; Strand=+
atgtcattagctgtaccccctgttgatttcggcccatttactaatgtcatcgcatttattatggagctggataagttaaaatcggttcatcgcaaaactaaactgctgaacaatcagcgtcatgaaaattcggctgaacatagctggcatttcgccctcgctgtcatgagttttgctccttatgtaggaaaaatgaatattggccacgttgtgcagatggcgctgatccacgatattgtcgaaatcgatgcaggagatgttatcgcattcgatttggctgcccgtgaagcaatccatgaacatgaagttaaggccgcccatcgtatttttggtttactgccggaagcgcagagagattattttctggcactgtggcgtgagtacgaagattctgaaacacctgaagcgatttttgccaaaacgcttgataggatcatgcctgtattcatgaacctgcataacaatggccaaagctgggttgagaatggtattcgctttgaacaggtttttaatctgctgcattttattgctgaggcttaccctgagctgtggcaatatctactgccacaattggaagcagcgaaagagaaaggttggctgaaagcgtaa

SEQ ID NO: 1427 - DNA, 147 bp, Xenorhabdus bovienii
  Coding sequence Name=Xb4151_4152.C426.gene52.dna; Position on contig =24868..25014bp; Strand=+
atgcaaggaatcatttactctgtcagccttaaacatatttattcgtcagacaacaacgtttcttactgcaaattttctacggttttctcagaagatacgataccatcaagactacacatcctgtcaataccactgtcagccagctag

SEQ ID NO: 1428 - DNA, 1560 bp, Xenorhabdus bovienii
  Coding sequence Name=Xb4151_4152.C426.gene53.dna; Position on contig =24944..26503bp; Strand=-
atgttggcacatcttttcaatacttcagttataacgggagaagttaaggttatgtcattaaatagaatcgtgagtactcataaacgagcagaatttcgtacttggtttggattattgatcttaatgttaccggttttattggtcacggtggacaacactattttgggatttgccttgccaaaaattaccagagctttggaaccgagtgcaaatcagcaattatggattattgatgcttattcattggtactggcgggattgttggtgtctatgggaagtatcggtgatcgtgttggtcaccgtctgctattgctatccgggtcattgggattcacggttgtttcagctctgacagcattatctacctcgccagaacaattaattgctgggcgtgcagctcttggtttttttggtgcaatgttgatgccttcgacactggctttgataagccatctttttacagatcgtgaacagcgccgattagctatcgctatttgggcgactactctcaccgttggctcggcacttggccctgttataggcggtgttttattgcagtattttaactggcaagccatttttctattggctgtgcctgtattggtgcctttgttgatttttgcacctatgttgttacctgaatcggccaaaaagcagatagggatcattgatggctatagtgtcttattatccattattgccatggctggcattgtgtatgcgattaaacattttgccagtaatggctttgagaccagtgtcattatgacgtttgcgattggtcttatcgcaggaatgttatttatacgtaggcaacagagcttgcaaataccgctaatggatatttccctgttccgtaatggtgtatttactggttcgatcatggtcaatttattgagtcttggattactgattggttttgtcttttttgccactcagtacctgcaagttgtgcttgatatgaaaccgcttgccgccagtcttgcactgattcccggacaaatcatggcaatcgttatcggcatggcgatcgtaccgattgcccagagagtgcctatccactggctcgtacccattttattggctttgtcgggagccgcatttttcttgattgcctgtgttggcagtaacctgacttcaatcgtgatcgctttcgcattattgaatattggtgtcggggcgatagcttctatttccaatgacttggttatttcagccgtaccttcttccaaggcaggtgcagcttcagcaatcagcgaaacggcctatgaagttggagttgtattcggtacaacgattctgggtggattggtgacggcgttttatcgtttaaatctgcaattgccggcaagtatttctcaggaacaagcatcattggctttggaaacgttggctggagcttatgtgatagcagcttcattgattgaaatggaaggtcggcaattgatgggtgcagcagcgcattcattcaccagcgccattcatattactagctggctgacagtggtattgacaggatgtgtagtcttgatggtatcgtatcttctgagaaaaccgtag

SEQ ID NO: 1429 - DNA, 132 bp, Xenorhabdus bovienii
  Coding sequence Name=Xb4151_4152.C426.gene54.dna; Position on contig =26663..26794bp; Strand=-
ttgaaaccaacaaaggatgacaactattttgaatatcgccactatgactatgattcgtctttcacaggcgtttctctctcaaaaaacctcaacaatgatgcctgtttggatgaaattttatttcttctatag

SEQ ID NO: 1430 - DNA, 126 bp, Xenorhabdus bovienii
  Coding sequence Name=Xb4151_4152.C426.gene55.dna; Position on contig =26753..26878bp; Strand=+
gtggcgatattcaaaatagttgtcatcctttgttggtttcaagctatttgttttaatagtacatttctacaacttaatcacattttcaagattaatgatattgaagttttcaaaataatcaattga

SEQ ID NO: 1431 - DNA, 2931 bp, Xenorhabdus bovienii
  Coding sequence Name=Xb4151_4152.C426.gene56.dna; Position on contig =27005..29935bp; Strand=-
atggggcgttttttatgtgtgccgtttttagctagtttcaggaaattatcatcaatgacccagacactaatccaacttgaaaatcaaggtgaattcactcgtcgccacattggttcttctgctgaacagcaaaaagagatgctggcgacagttggtgcaaattctcttgacgatctgacgaataaaatcgttcctcgtgatatcgcattgtcagagccacctgctgtaggcgaaggtgcgacagaacaacaggcgctggctgaactgaaagtgatggctggccagaacagacgttatcaatcttatatcggtatgggatatgcgccatcggtacttcctccggttattctgcgtaatttgctggaaaatcctggctggtacacggcatataccccgtatcagccagaagtttcccaaggccgtcttgaagccttactgaactttcagcaagttactattgatctcaccggattggatcttgcttctgcctcattactggatgaagccacggcggcggctgaagctatggcgatggcaaaacgggtcagtaagttgaaaggcgcagagcgcttctttgtggcggatgatattcatccacagacgctggacgttgttcgtacccgtgcagaaacctttggatttgaagtcattgttgataaagccgaaaaagtgctggaactggaaggtgtcttcggtgtcctgctacaacaggttggtacaacaggcgaagttcatgactacagtgctctgattacgaagctgaaagagaaaaaaattattgtcagtgtagcggcggattttatggcactggtcatgctgactgcaccgggcaaacaaggtgctgacatggtatttggtgcagcacagcgttttggtgtcccgatgggatacggtggcccacatgctgcattctttgcctgccgtgatgaattcaagcgttccatgccgggtcgcattattggcgtttcccgtgacgctgcgggtaaccgggctctgcggatggctatgcagacccgtgaacagcatattcgtcgcgaaaaagcgaattccaatatttgtacctcgcaagttctgctggctaatattgctggcatgtacgcggtttaccacggtgctgaaggcttgaagagaatcgctggccgtattcaccgattgaccgacattctggccaccggcctgcaaaaagcgggcatcacactgcgtcacaaaacatggtttgatacgctgaccgttgaagttgcagataaaacacaggtactggttcgggcggagaaagcccaaattaacctgcgtactgatattcttggtgcgattggtgtggcattgagtgaaaaaaccagccgcgacgacttgcaaacactgttccaggttctgactggctctgatgctatattggatattgatacgcttgataacgaaatggcggcaggcagccaatctattccggtttcaatgttgcgcaatgatgacatcttgatgcatgacaacttccgccgttatcacagcgaaactgacatgatgcgctacatgcacagtctggagcgtaaagatctggcattgaatcaggcgatgatcccgctgggctcatgtaccatgaaactgaatgcggcggctgaaattatgccgatcacatggcctgaattcacggatatgcaccctttctgtccaccagagcaggcgcagggttatcaccaactgatcagccaactctctcattggctggtattgctgactggctacgacgcagtttgtatgcagccaaactccggtgctcagggagaatatgctggcttactcgccattcgtcgttattacgccagtcgtggagaacaacatcgccatgtctgcttgattccaagctctgctcacggcacaaaccctgcttccgcgcatatggcgggtatgaccgtggtggtggtgaattgtgacaaagaaggtaatatcgatctgacagatttacacgaaaaagcggaaaaacatcgtggtgaactggcctgtatcatggtgacctacccatcgactcacggtgtgtatgaagaaaccatccgtcagatctgcgatattattcaccagaatggaggccaggtttaccttgatggtgccaacatgaacgcccaagtcggcattactacgccgggctttattggtgctgacgtttcccacctgaacctgcataaaaccttttgtatcccacacggtggtggtggccctggcatggggccgattggtgtgaaaaaacaccttgcaccatttgtaccggggcattccgtggtggaaatggacacagtaaccacattgggcgcagtatcagccgcaccatttggcagtgcttccattttgcccattagctggatgtatatccgtatgatgggagcaaaaggactgaaacaagccagccaagttgcgatcctgaatgcgaactacatcgcagctcgcctgaaaggggcttatgaaatcctctataccgggcgtgatggctacgttgcccacgaatgtattctggatattcgcccactgaaagacgaatttggcatcagcgaaatggatatcgctaagcgtttggttgactacggcttccatgcaccaaccatgtcattcccagtggcgggaaccttgatggttgagccgacggaatccgaaagcaaagtcgaaatcgatcgctttattgacgcaatgctggcaattcgcgaagaaatcagcaatgtggcaaaaggggaatggccgctggaagacaatccactggtgaatgcgcctcacgttcaggcagagctggtttctgactgggaacatgcatacagccgtgaaatcgctgtcttcccaacagtagaaaccaaagccaataaatactggccaacggttaaacgtctcgacgatgtatatggtgaccgcaatttacattgctcctgtgcaccgattgaagattatcgttaa

SEQ ID NO: 1432 - DNA, 402 bp, Xenorhabdus bovienii
  Coding sequence Name=Xb4151_4152.C426.gene57.dna; Position on contig =29966..30367bp; Strand=-
atggcaacgatgagtcatgtaccagcagaattaaaatatacctcatcacacgaatgggttcgtgcggaaggaaacggtgaatacactgtaggtattaccgagcacgctcaggaactcttgggtgatatggtattcgttgatttgcccgaagtcggtgtagttgtaaataatggtaatgactgtgctgttgtagaatcagtcaaagcagcttctgatatttatgcccctttgagtggtgaagtcaccgcggttaattcagagttggaaggttctcctgaattagtcaacagtgagccttataacgagggttggctgttccgccttaagatctctgacgagagtgaactcacccatctgcttgatgcggaaggttatcagtcacttttggcagaagaagaataa

SEQ ID NO: 1433 - DNA, 1098 bp, Xenorhabdus bovienii
  Coding sequence Name=Xb4151_4152.C426.gene58.dna; Position on contig =30410..31507bp; Strand=-
atgtcaaaacacaccccactatatgatcaacatctggcatgcggagcgcgcatggtagattttcatggctggatgatgccccttcaatacggttcacaaatcgacgagcatcacacggtgcgtactgatgctggtatgttcgatgtttcccacatgaccattgtggatctgcatggcacaggttgccgtgattttctccgctatcttctggcaaatgacatcaccaaactgaccgaacagggcaaggcactttataccggcatgttgaatgtctccggtggtgttattgatgacctgatagtctatttcttcactgatgatttctatcgcatggttgtaaattctgcgacccgtgacaaagacttagcttggattcaacagcatgccacgaattaccccgtcgaaattacggtgcgtgatgatttagcactaatcgcggttcaaggcccgaatgcgcagtctaaagcacaatccctgctgaatgatgaacaaaaacaggccgtggcaggtatgaaacctttcttcggcgtccagtctggtgatttatttatcgcgacgaccggttataccggcgaagcaggttatgaaattgcgttaccgaaagaacaggctgctgatttttggcagaaattgttagcagcaggcgttaaacccgctggattgggtgcacgggatacactacgccttgaagcgggtatgaacctttacggtcaggaaatggatgaaaccatttcgcctttagctgccaatatggggtggacgattgcgtggaaaccggaagatcgccaattcattggccgtgaagcgctggaaagacagcgtgaagtaggtacagaacaactggttggcttaattatgcgcgaaaagggcgtattgcgtggtggtttaacagtccacttcactgataaagcgggtgaaatgcgttctggcgtcattaccagcggaacattctctccaactttggggttcagcattgctcttgcacgagttcctcagggaattggagaacaggcgattgttcagatccgtaaccgtgaaatgcttgttcaggtggttaaaccgggttttgtacggatgggcaaatcgctcgtagagtaa

SEQ ID NO: 1434 - DNA, 111 bp, Xenorhabdus bovienii
  Coding sequence Name=Xb4151_4152.C426.gene59.dna; Position on contig =31607..31717bp; Strand=-
atgatagtaagtgttttttcaggttattactgtaatgctgctaatttattttatggttcatttctattttcagtgataacttctaaaccaaggtatcgtttgcgtcattaa

SEQ ID NO: 1435 - DNA, 105 bp, Xenorhabdus bovienii
  Coding sequence Name=Xb4151_4152.C426.gene60.dna; Position on contig =31765..31869bp; Strand=+
atgaaatacagaatacgttctttttttattagaaaaagactaaagtgtgaagtaaatcaactgaacacacttcagtcctacatgaggaaaactaatcttaaatga

SEQ ID NO: 1436 - DNA, 1233 bp, Xenorhabdus bovienii
  Coding sequence Name=Xb4151_4152.C426.gene61.dna; Position on contig =31879..33111bp; Strand=-
atgcaatcatttgatgtggtgatcgcagggggcggtatggttggccttgcgctggcctgtggtttgcagggtagcggtttgcgcatcgcgattgtagaagagcatccaccgacaggcacgtttcatgctaacgatgaacatgcgctgcgtgtttctgctatcaatgcagccagtgaacggttattaactcatcttggtgtctggcagcacattactgcgatgcgagccagtgcttatctggggatggacgtccgggatcaagatagttttggtcgcattaaattcgatgcgacagaaaatggtctgacacatcttggacacatcatcgaaaaccatgtgatccggcaggcactttggcagcaggcagaaaatttgcctgatgtgacgatttttacccccgcatctctcaaaaatgtcgcgtggggagaaaacgaagctttcattactctgtccgatgagcgaatgctgacttcacggctggttgttggtgctgatggtgcgaattcatggctgcgccaacatgcggatattccactgaccttttgggattatgagcaccatgcgctggtcgccacgattcgtaccgaagaacctcatcaggctgttgcgcgtcaggtctttcatggtgatgggattctggctttcctgccattgtctgatccccatttatgctcgatcgtctggtcactgcctgctgaagctgcgcaacagcgcaaggtaatcgacgctgtattatttaatcggcaattgggcgttacatttgatatgcagcttggtctgtgtgaattagtcagtgaacgccaggccattccattgatggggcgttatgcccgtaactttgcagcccatcggttagccctgctgggggatgctgcacatactattcatcctttggcgggacaaggcgttaatttgggatttatggatgtggcagagttgattggagaactgagccgcctgcaccgccaggggaaagacatcggtcagtatctctatctggggcgtttcgagcgccgccgcaagcacagtgcagcggtgatgctggcaggtatgcaagggttccgtcagctatttgatggcaatcatccggctaaaaagctattgcgtgatattggattaacgttcgctgatcacttaccgggagtaaaatcgcaattgcttcgtcatgccatggggctaaatgatctccctgattggctgatttctcaaacctcttcggttgaaaaaatctaa

SEQ ID NO: 1437 - DNA, 1191 bp, Xenorhabdus bovienii
  Coding sequence Name=Xb4151_4152.C426.gene62.dna; Position on contig =33136..34326bp; Strand=-
atgaacgtgattattgtggggggaggaatggctggtgcaacattggcgctggctatttcttccttaagtcgggggcaggtacaggtctctttgattgaatcgacagaaccaacacaagaacatcagggttttgatgcaagagctattgccttggcttatggcacatgccagcgcctgagccaaatcggtgtctggcctgtgctgaaagattgtgccaccccaattacccacgttcatgtcagcgatcgaggccatagtggtttcgttaacattcgagccgatgactatgctattccggcattgggtaatgtcattgaattgcacgatgccgggattcgtctgtttaatctgttaagacaggcacctaatgtcaaacttcactgtccggctaaagtgaattccgttgaacgtctggatacttcggttgtggtcaagctggacaatggcgaaaagatcacgggagagttgttggttgctgccgacggaagccattctgccgtggcgaaagcgtgcaatatcccgtggcagcagcaaacttacggtcaggttgccatgattgccaatgtcctgacgtctgaacatcctcagggacaggcatttgaacgttttaccgaacatggcccgctggcattattgcccatgtctgaaggccgcagcgctttggtatggtgccacccgctggaaaaacagacggaaatcaacggctggagcaatgaggaatttcttcaacaattgcaaaaagcctttggctggcgtttgggcaagatgctggaaacgggtcaacgacatagttatccactggctttatttacggccagccagcagatcagtcatcgtctggcgttggtaggcaatgcgtcccaaacgttacatccgattgccgggcagggttttaacttaggaatgcgtgatgttatgacactggcacgagtcatttcagcggcggcagattcagggcaagatattggtgcttatgatgttttggctcgttaccagcagcaacgccatactgatcgtgaaacgacgattggtatcacggatgggttggttagaatattcgccaatgactatttccctttgaagataggacgtaaccttggcctgatgacgatggaaacgttgtccccgttgcgggacttatttgcccatcagacactgggttgggttgcccatcattcatcggcagaataa

SEQ ID NO: 1438 - DNA, 1317 bp, Xenorhabdus bovienii
  Coding sequence Name=Xb4151_4152.C426.gene63.dna; Position on contig =34351..35667bp; Strand=-
atgactaaacaagaatatttgtcccgtcgtcaggcattattgtcaaaaatggcaccagccagtgcggccattatttttgcagccccgcctgcgaggcgtaattcagattgtgaatatccctatcgccagcacagtgatcttctttacttgactgggttcaacgagccgaaagcggttcttgttctgatcaaaagtgatgaaaaccacaatcatagcgtgttgtttaaccgtgttcgtgatctaactgcggaaatttggtttggtcgtcggcttggtcaggatgccgcaccggaaaaacttggggtggatcgcgccctgccatttgatgatctcagtaaacagctttacctgctactgaatggtttggacgtggtttatcatgcccagggggagtttgaatatgctgacaatatcgtattcagtgccttggatacattgcgaaaaaatagccgtcgtaacctcagcgcaccatcaatgatagcagattggcgtccgtggctgcatgagatgcgactgttcaaatcggcagccgaactggacatcatgcgcaaggcaggcgacatcagtgcgaaggctcatacgagagccatgcagaattgtcgcccaggcatgtttgaatatcagcttgaggctgaaatccatcatgaatttactcgtcaaggcgcacgttatcctgcttataacaccatcgttggtgcaggagaaaacgcctgtattctgcattacacagaaaacgagcgccgcatgaaagagggcgatttggtattgatcgatgcgggctgtgaatatgaaggatatgccggcgacattacgcgaacatttccggttaacggcaaattcacccgtccccagcgagaaatttatgacatcgtgctgcaatctatcaatgtctcttttgaactgtacaggccgggtaccagtatccgcaaagtgacggaacatgtggtgcgcattatggttgaagggctggtcaaattgggaattatgcatggcgaagtagaacaattgatcgagaccaatgcttatcgtcaatttttcatgcatggtttaagtcattggctggggttggatgtgcacgatgtcgggcattatggcatagatcgcgatcgcattctggaacccggcatggtgctgactgttgaaccagggctttatatcgcgccggatgctgatgtaccaccggaataccgtggtattggcatccgcattgaagatgatattgtgattacggaagcgggcaatgagaatttgaccgagcatgtcgtgaaagatccggatgaaattgaagcactgatggcacaggcgaaacagaattaa

SEQ ID NO: 1439 - DNA, 579 bp, Xenorhabdus bovienii
  Coding sequence Name=Xb4151_4152.C426.gene64.dna; Position on contig =35713..36291bp; Strand=-
atgtctatacaaaactcattacctaattatcaatcatttgatgaaattttgcatcaacagtcagttgcgctgacagccgccgaaatgcacggtctaatcagtggcctattatgtggtggaaatcatgatagtagctggcagacactaatgcatgatcttactaatgatggccttgcattttcacaggcgttggcacagtcgatcagggcattatacgaaacgacctttgaatcacttgatgatagtgattttgtttttaatctactgcttcctgatgatgaggcgagtgtttttgactgtgctgatgcattggcgggatgggtaaatcatttcctgttgggattaggcgtggcgaatccgcagttgacagaaaaacaggaaatacaggaagtcgttactgatttacgtaacatcggtatgctgggatacgatgaagacgaagatcaggaagaactgtcccaagctctggaagaagtattggagtacgtccgtgttgcagtacaactctgctacattgccttggcgacaccgaaaacggcaaatagcgtgaaaaaaaatgacaagccaacgctacactga

SEQ ID NO: 1440 - DNA, 309 bp, Xenorhabdus bovienii
  Coding sequence Name=Xb4151_4152.C426.gene65.dna; Position on contig =36290..36598bp; Strand=+
atgtatattgatcatcgttggcgatataagttcatgctatgctaccatcaaggggagtcgctataccagacagcacacaccgatataaggagggttgccttttggtattgtacggtaatggttgttgtcggccttgttttaataccaaaatctgcttttatgccagaatcaaggtatcggcacagtaataaatcaggaaggtgtcatgtctgcacaaccagtagatattcagatttttgggcgatcattacgtgtcaattgtccaccagagcaggtagaggctttgcaagctgccgcgaaggaacttga

SEQ ID NO: 1441 - DNA, 306 bp, Xenorhabdus bovienii
  Coding sequence Name=Xb4151_4152.C426.gene66.dna; Position on contig =36495..36800bp; Strand=+
atgtctgcacaaccagtagatattcagatttttgggcgatcattacgtgtcaattgtccaccagagcaggtagaggctttgcaagctgccgcgaaggaacttgatcagcgtttgcataacctcaaagaacgcaccagagtaacgaacactgagcaactggtttttattgtggcgctgaacgtttgtcacgagttagcacaggaaaagatgaaaacccgtgattactcttacaatatggaacaaaaaataaaaatgctccagcagactattgaacaagctttgttagaacaaggtaaaattacctga

SEQ ID NO: 1442 - DNA, 186 bp, Xenorhabdus bovienii
  Coding sequence Name=Xb4151_4152.C426.gene67.dna; Position on contig =36982..37167bp; Strand=-
atgccgcggcaggtggtaacccttgaacccttggttcaaggtgaacgtagtgtcgcccctattaggcttcttggtctagccaagcatgctcacaagaaacggagcaccacattctataggtatgaaatatcggctcaggggacttacctgctcacgcacacctcagagaaattttgtagcgcttaa

SEQ ID NO: 1443 - DNA, 594 bp, Xenorhabdus bovienii
  Coding sequence Name=Xb4151_4152.C426.gene68.dna; Position on contig =37229..37822bp; Strand=+
atgcaatcagatccttttttatctctccgaaaatccataagaaaacaaattcgacagttgcgtcaaaatctatccccagagcagcaatcgcgatttgcccagcaagctgcccagaatgtcgtgtctcaccctaaggtccagcaggcaaacaaggttgccctgtatctctcctttgatggtgaattagacactcgcccactgattcagcaactttggcagcaaaataaacaagtttatctgcccgtattacacccattcagtcggcaccatctgctgttcctgtattaccatgctgggactcccctcaactacaatcgttttaacatagaagagccaccattagatgtccgacaggttctgcccgtctctgagcttgatgtgatgtttattccactggtggcttttgataacacagggcagcgtttaggaatgggaggcggtttctacgacagaacgcttgctaaatggcaacagcagaatttttatccgattgggttagcgcacgatttccaattagttaatctattgccaagtgcaagctgggatattcctctgccagaaatcattacgcctgaaaaaatatggcgctggtaa

SEQ ID NO: 1444 - DNA, 1242 bp, Xenorhabdus bovienii
  Coding sequence Name=Xb4151_4152.C426.gene69.dna; Position on contig =37894..39135bp; Strand=-
atggtcaaggtatctttagaaaaggataagattaaatttttgctactggaaggcgttcatcagagcacagttgataacctgcgggcggcgggatacagcaatatcgaatatcacaaaggggcgttggagcctgaagaattgaaagaagcgattcgtgatgctcgctttgtgggtatccgttctcgtactcaattgactgaagaaatttttgaagcggctgaaaagctggttgctgtgggatgtttttgtataggcaccaatcaggttgacctgaaagcggctgaaaaacgtggtattcctgtatttaacgcaccattctccaatacacgttctgtggcggagatggtgctgggtgaattactgttgctattacgtcgtattcctattgcaaatgcgaaagcacacagaggaatatgggataaacaggccaaaggctgttatgaagcgcgaggtaagaagctcggcattattggttacggtcatatcggtacacagcttggcattctggctgaaaatatcggtatgcatgttcatttctatgatattgaaaataaactgccgttgggaaatgcacagcaagtgcatcatctatccgaactgttgaatatgagcgatgttgtcagcctgcatgtacctgaaacaggctcaacaaaaaacatgatcggcgtggaagagctggagttgatgaagccgggtgcaatcctgattaacgcctcacgtggcatggtagtggatattcctgcactccatgacgcgctggagtgcgagcacctttccggtgcggcccttgatgtgtttccgagtgaacccgcaacgaacaatgagcctttcatctcgcctctgagcaaatttgataatgtactgctgactccgcatattggcggatcaacacaagaagcccaagagaatattggttacgaagtcgcgggtaaactggtcaaatattctgacaatggttctacgctgtcagcggtcaacttccctgaagtctcactgcctattcatgccaaagatactcaccgactactgcatatccatgaaaaccgtcctggtattttgaccagcataaaccaagtttttaccgatcaggaaatcaatattgaggcacaatacctgcgtaccaacggagatattggttatgtggtcattgatatcacgacgcaaaatccggctcaggctgaaatggttctgcaaaacctgaaagctctgtctggcacgatccgctctcgcctgctttactga

SEQ ID NO: 1445 - DNA, 183 bp, Xenorhabdus bovienii
  Coding sequence Name=Xb4151_4152.C426.gene70.dna; Position on contig =39128..39310bp; Strand=+
ttgaccatttgtccgtcctatcgttgtcttaattttcagaatatccataatgaattccaccaaaataacaaaaaaaacagcaacagtaatacaatcgtttgctcacgcaacagggtaaatcgaagtaaaaaagttgttatacgtagtaatatgacttgttacagtctaaaaacagaattttga

SEQ ID NO: 1446 - DNA, 660 bp, Xenorhabdus bovienii
  Coding sequence Name=Xb4151_4152.C426.gene71.dna; Position on contig =39411..40070bp; Strand=-
atgacacaggacgaactgaaaaaagcagtaggttgggcagcattggaatacgtcaaacctggaacaatcgtaggtgttggtacaggttcaacggcatcgcatttcattgatgcattagggacaatcaaaaatcaaatcgaaggtgcagtgtccagctcggaagcatcgactgaaaaattaaaaaatctgggcatccccatttttgactgtaatgaagttgatagcttggatatttacgttgatggtgctgacgaaatcaatgaccatatgcatatgatcaagggaggcggcgcagcattgacgcgagaaaaaattattgccgctgttgcaaagaaatttatctgtgtcattgatgaatcaaaacgagtcgatgtgctgggtaaattcccgctgccggttgaggttattccaatggcgcgctcttacgttgctcgtgaactggtgaaattaggtggaacgccagtttatcgccagaatgtggttacggataatggcaatgtcattctggatgtccataatcttgctattcttgatcccattgcgttggaaaataaaataaatggcattgctggcgtggtgacggtcggcctatttgccaatcgtagtgctgacgtggtgctgatcgggacagcggatggcgtgaaaacgatcgcagaataa

SEQ ID NO: 1447 - DNA, 159 bp, Xenorhabdus bovienii
  Coding sequence Name=Xb4151_4152.C426.gene72.dna; Position on contig =40028..40186bp; Strand=+
atgctgcccaacctactgcttttttcagttcgtcctgtgtcatatcaatcacagcctataatcagttacaaggaaaaatccggccaccagtataaacaatattttgcctcacccggcgaaaaaatatggcatagtgctgtgcagcacaaaaaaatatag

SEQ ID NO: 1448 - DNA, 906 bp, Xenorhabdus bovienii
  Coding sequence Name=Xb4151_4152.C426.gene73.dna; Position on contig =40235..41140bp; Strand=+
atgaaacgtcctgactaccgatccctacaagcgttggatacagtgatccgagagcgcggtttcgagcgtgcggcgcaaaaactctgtattacccagtcagcggtatcccaacgtatcaagcaattggagaatatgtttgggcagcctttattagtacgcaccgttccccctcaccctacagaacaagggcaaaaactgctcgcactattacatcaggtagaattgctggaagcacaatggctcggtgatgaaaatggtaacgatatcccattactgctctcacttgcagtcaatgccgacagtttggcaacgtggctcttgcctgcgctccatcctgttttatccgatgttcctatccgactcaatattcaggtggaagatgaaacccggactcaagaaagtttgcggcgcggagaagtcgtcggggctatcagtattcaatcacagccgctgccaagctgtctcgtggataaattaggtgccctcgattatttgtttgtggcatcgcctaaattcgctgaacgattctttccgaatggcgtcactcgttcagctttactaaaagcccctgcggtagcattcgaccatttggatgatatgcatcaggcatttttacagcagcattttgatttatcaccgggcagtgttccctgccatattgtgaattcctctgaagcattcgttcaattagcaaaacaaggctcgacatgctgcatgatcccacacctgcaagttgacaaagagctgcaagccggcgaattaattgatttaaccccagggctatgtcagcgccgtatgctttattggcaccgttttgctccagagagtggcgcgatgagaaaagtcactgacaccctactgaaactagggcgccagatgttacgtcaggaagatgaaattagttag

SEQ ID NO: 1449 - DNA, 708 bp, Xenorhabdus bovienii
  Coding sequence Name=Xb4151_4152.C426.gene74.dna; Position on contig =41137..41844bp; Strand=-
atgatggcagtaggaagtttgtcctgtatggctgcttctgctgctgatttaccccccgccccacatatatctacttctggtaatgcgatcatcaaagcagcaccggatatagcgacgttgatgatccatgtgaaagtgactcaaaaaagtgcagcagacgcaaagcaaaaagtggatgaacgcgtcgcaaaatattttgatttcttaaaaaccaatggtattgacaagaaagatattgatgcggccaatttgcgcactcagccagaatatcaatacgaacaaaagacgggtaaatcaactattacgggttatagtgcatcacgttcagttgaagtcaaagttcgtcagttggatcaactgagtacattattggatggtgcattgaaagcaggattgaatgagatcagttcagtgcagttcagtatcgataatccacagcgttatcgtgatgaagctagacagaaagctattgaaaatgcgattcagcaggcgactgcattggcaaaaggcttcaacagcaagttaggccctgtgtatagcgtcacttatcgttcccctgaagctatgccttttccaataagccgcctgaaatacaggtcagcgcttatggccgcagctcccgccgaggattcagccagtgaaacttatgaaccacaaagtattgaattctctgatcaggttgaagtagtttttgagttgcaacgctaa

SEQ ID NO: 1450 - DNA, 174 bp, Xenorhabdus bovienii
  Coding sequence Name=Xb4151_4152.C426.gene75.dna; Position on contig =41781..41954bp; Strand=+
gtggggcggggggtaaatcagcagcagaagcagccatacaggacaaacttcctactgccatcattgcagcgaatatcagtgatttatgtttcacaaaacctccttcggatacaacaagtaaacaggcactttttacagtttacagtaagacaaagcgctttccagaaacattag

SEQ ID NO: 1451 - DNA, 624 bp, Xenorhabdus bovienii
  Coding sequence Name=Xb4151_4152.C426.gene76.dna; Position on contig =41982..42605bp; Strand=-
atgctttcgacatttatacagggcttttttcttggtgctgccatgatcctcccgcttggaccacaaaatgtttttgtgatgcagcagggaagtagaaaacagtttcatttaatgagcgcaacgttatgtgccaccagcgacattgttctcatcacggcgggagtatttggaggaagtgctttgcttgggcaatcagcgttcttgctgcaagcggtaacatggggcggagtggcatttttgctatggtatggatggagtgcttttcgagtggcgttatcagcgaatatcgaactctcccgttctgagaatatcgtccagaatcgcagtcgagtcatcgtgacgctatttgctgtaacgtggctgaatccgcatgtttatctggatacctttgtggtattaggtagcgtgggaggaggactttcatcggaacttaggtcgtggtttaccgttggagctgctacggcatccataagctggttttttgcattatcaattctggctgcctggttttcacccgtactcaatcagcctcgttcacaaagaatcattaacctctttgttggttgtgtgatgtggtatatcgcatggggtttgctcaaacagggattacagattttttattga

SEQ ID NO: 1452 - DNA, 111 bp, Xenorhabdus bovienii
  Coding sequence Name=Xb4151_4152.C426.gene77.dna; Position on contig =42562..42672bp; Strand=+
atggcagcaccaagaaaaaagccctgtataaatgtcgaaagcatgcagaagttcctaataattactcaatcagctatgttatatatgcatattaggaaagatcgtatatga

SEQ ID NO: 1453 - DNA, 873 bp, Xenorhabdus bovienii
  Coding sequence Name=Xb4151_4152.C426.gene78.dna; Position on contig =42822..43694bp; Strand=-
atggaagagatcaatctatcaggtgagattgataaagcagcaaattggtttgccagcaatcaggagctattgattcaatatgcggtgaatgttgtgtcggccatcgtcattctgatcgtaggcttgcttgttgctaaactggctaataaagcagttaagcgcgtcatgtcattgcgtggcattgatgcaactatctctgattttttgtccgcgattattcgttatgccatcatcgcgtttacaattatcgcagtgcttggaaaattgggtattcagacagcctctgtcattgcagttattggtgctgctggtttggcggtaggtttggcattacagggatcgctgtcaaattttgctgcgggtgttcttctggtaattttccggccactccgcacgggtgaatatgtcattattggcggcgtggaaggaacagttgtacaagtacagattttctctacaacgctgcgtagcggtgatgatcgtatcatagtgatccctaacggaaagattattgcgaatgacatcatcaataccagtcgtgagccgaatcgtcgtactcagattatggttggtgttgcttataacgcggatattgatgaagtgaaaagagtgctgggtaatgtggttaaagcggacaaacgcattcaacatgaaaaaggtatcaccattcgtctgcacgaaatggcaccttcatcactgaacttcattgtgcgtgtatggacaagcaatggtgatgcttggagtgtttattgggatctgatggaaggtttcaaacgtactttggatcagcataatatcagcattccattcccacaaatggatgtctatctgcatcagcagcaagctgccgtacagaagaaggtagacgaataa

SEQ ID NO: 1454 - DNA, 132 bp, Xenorhabdus bovienii
  Coding sequence Name=Xb4151_4152.C426.gene79.dna; Position on contig =43777..43908bp; Strand=+
atgcaaaaaacaaacggaaaaaccagtaatacaacatacaaaagtgatggagtatcgattatgtcaaaaaaccctctttggttgaacactaacacttatctttggtttttttgcaaaataaaatctttatag

SEQ ID NO: 1455 - DNA, 375 bp, Xenorhabdus bovienii
  Coding sequence Name=Xb4151_4152.C426.gene80.dna; Position on contig =43872..44246bp; Strand=-
atgatggaatatgaatttacgcaggatattgcgggtcacgttacaacttatttttcgatggatcatgaagcgattggtcattggttgaatgaagaagttaaaggtgatttgagtgtattggataaaataacttcagcgctggcgggcatcaaaggcagtgagcgccaatggcaattgatcggtcatgaatacacattattgatgagtgagggagaaatcatgattagggctaaccaactccagttcgatacagaaatggtggaagagggaatgagttactatgataacgagagtctggctttttgtggaacagacgattttatcggtatgttagccgactataaagattttattttgcaaaaaaaccaaagataa

SEQ ID NO: 1456 - DNA, 183 bp, Xenorhabdus bovienii
  Coding sequence Name=Xb4151_4152.C426.gene81.dna; Position on contig =44166..44348bp; Strand=+
atgaccaatcgcttcatgatccatcgaaaaataagttgtaacgtgacccgcaatatcctgcgtaaattcatattccatcatgcaccccactatattgttgatatcaaccacatctggattttaaacatttctgctgctctcacctcagagacagtccacaaactgacacaaaatctaccataa

SEQ ID NO: 1457 - DNA, 2598 bp, Xenorhabdus bovienii
  Coding sequence Name=Xb4151_4152.C426.gene82.dna; Position on contig =44392..46989bp; Strand=-
gtgctagaagaataccgcaagcacgtagccgagcgtgcagctcaaggcatcgtccctaagccattagacgcagctcaagcagcagcgctggtcgaattactgaagaatccacctaaaggtgaagaagatttcctgttagacctactgaccaaccgtgttcctcccggtgttgatgaggccgcttatgtgaaagctggtttccttgccgctattgccaaaagtgagacagcctcacctcttgttacgcgggaaaaatccatcgaattattgggaactatgcaaggcgggtacaatatccacgctttgattgatgccctcgatgaagaaaaactggccccgatcgcagcgaaagcactttctcatactttgctgatgttcgatagcttttatgatgtggaagaaaaagcgaaagctggcaattctcatgctaaacaaattatccagtcatgggcagatgctaagtggttcttggagcgtcctgagctggcagaaaaaattaccgttaccgtcttcaaggtcacaggtgaaactaataccgatgatctatcccctgcacaagatgcgtggtcacgtccagatatccctctgcatgctctggcaatgctcaagaatgttcgtgaaggtattgagccggatcaagccggtgccgttggcccaatcaatcaaatcgaagaactgaacaaaaaaggccatcctttggcctatgttggtgatgttgtgggtacgggttcttcccgtaaatctgcaactaattccgtcctgtggttcatgggtgacgatattccatttgtgcctaacaagcgcggtgggggcgtggtattgggcggaaaaattgccccaattttcttcaataccatggaagatgcaggtgcgttgccaattgaggtggatgtttccaatctcaatatgggagatgtcattgacatttacccttataaaggcgaaatccgtcaccatgacaccaatgaattgctggcaacctttgggctgaaaactgatgtacttctcgatgaagtgcgtgctggtggccgtattccgttgattatcggccgtggcttgacgacgaaagcccgtgaatcactggaattgccacacagtgatgtattccgtcaggcaaaagcaattgaaaaaagtgaaggcggtttctcactggcgcagaaaatggtgggtcgtgcctgtggtacggagggaattcgtccgggcgaatattgtgaacctaagatgacttcggtggggtctcaggacaccaccgggccaatgacacgggatgagttgaaagatttggcctgtcttggcttctctgcggatctggtcatgcagtcattctgtcatactgcggcttatccaaaacctgtcgatgtgactacacatcacacgttgcctgatttcatcatgaaccgtggcggggtatcgctgcgtccgggcgatgggattatccattcatggctgaaccgcatgttattgccggatacggtgggtacaggtggtgactcccatacccgcttcccgataggtatctctttcccagccggctctgggctggttgcatttgctgctgcaacaggtgtaatgccgctggatatgcctgaatctgtattggtgcgttttaaaggtaaaatgcaacccggcattaccctgcgcgatctggttcatgccattccttattatgccattcagcaaggtttgctgactgttgagaagaaaggtaagaaaaatattttctctggccgcatacttgaaattgaaggcttgccagagctgaaagttgaacaagcctttgaactggcggatgcgtctgcggaacgttctgcagcaggttgtaccatcaagctggataaagcgcctatcactgaatacctgcaatctaatatcgtattgctgaaatggatgattgcggaaggttatggagatcgccgaacactggaacgccgtatcatcggtatggagaattggctgaaagaccctcaattgctggaagccgatgcggatgctgaatacgctgctgttattgaaatcgatctggcagaaatcaaagagcctattttatgtgcgccgaatgatcctgatgatgcgcgtctgttatcagcagttgccaacagcaaaattgatgaagtctttatcggttcctgtatgaccaatatcggtcacttccgtgctgcgggcaaattgctggatcaacataaaggccagttaccgactcgtctgtgggttgctccaccaaccaaaatggatgctgcccaactgacggaagaaggttactacagcatctttggcaagagtggggcgcgtgtcgaaatcccgggttgttcattatgcatggggaatcaggctcgtgttgcggatggtgcaacggtagtgtccacttccacccgtaacttccctaaccgtctgggtgctggggcgaatgtttatctggcctctgcggagctggctgcggtggcttcattgctgggccgcctgccaatgccggaagagtatctgcaattcatggacaaagtcgatgaaaccgcagcagatacttatcgctacctcaattttgatcaattgaaccagtacaccgaaaaagcgaatgaagtgatcttccaaacggctgtataa

SEQ ID NO: 1458 - DNA, 132 bp, Xenorhabdus bovienii
  Coding sequence Name=Xb4151_4152.C426.gene83.dna; Position on contig =46970..47101bp; Strand=+
ttgcggtattcttctagcacgacttactcctcgctctcattgtcattttatatacccggctgtctgcacccggtaacgatcatcaaagaacaaccatcaagggtgtcaggtcagaggattttactcgcataa

SEQ ID NO: 1459 - DNA, 141 bp, Xenorhabdus bovienii
  Coding sequence Name=Xb4151_4152.C426.gene84.dna; Position on contig =47197..47337bp; Strand=+
atgttggataacgagacacaaagagagtattacagttttatacaccatttttttctacttaagcctgaaaatgcctccatttctatctgttatattttcctgttatattttctgagtcagcggagctttcaaagctgctaa

SEQ ID NO: 1460 - DNA, 132 bp, Xenorhabdus bovienii
  Coding sequence Name=Xb4151_4152.C426.gene85.dna; Position on contig =47279..47410bp; Strand=-
ttgtattgttcggagtttaaaggttttcatctgtatttcagggtgaaaatatctgtaaggggagcctggtttgttagcagctttgaaagctccgctgactcagaaaatataacaggaaaatataacagatag

SEQ ID NO: 1461 - DNA, 1431 bp, Xenorhabdus bovienii
  Coding sequence Name=Xb4151_4152.C426.gene86.dna; Position on contig =47493..48923bp; Strand=-
atgatgagtactgaaattaaagcccaggtagtggtgcttggcgcaggccctgctgggtattctgctgctttccgttgtgcggacttaggtttggataccgttctggtggagcgctactctactctgggtggtgtttgccttaacgtcggttgtatcccatccaaagcgctgcttcatgttgcaaaagtgattgaagaagcaaaagcactggcacaacacggtattgtgtttggtgagccacaaactgatatcgataaaatccgtctctggaaagaaaaagtgatttcccagctgacaggtggtctgggcggtatggctaagggccgtaaagttaatgttgttaacggcattggtaaatttacaggcgctaacactttggtagtagaaggcgagaaaggcgcaacaacgattaattttgataatgccattatcgctgcgggttcacgcccaattcaactgccattcattccacatgatgatcctcgcgtatgggattctaccgatgcactggaactgaaaactgttccggaacgtctgctggttatgggcggcggtattatcggtctggaaatgggaacagtttaccatgcactgggctctcagattgacgtggtagaaatgttcgatcaggttattcctgctgcggacaaagatattgttaaagtgttcactaaacgcatcagcaagaaattcaacctgatgctggaaaccaaagtgaccgcagtagaagctaaagaagatggcatctatgtaacgatggaaggcaagaaagcgccagcagaaccacagcgttatgatgcagttctggttgctatcggccgtgtacccaatggtaagtcgctcgacgcgggtcaagcgggtgttgcagttgatgagcgtggctttatccatgtggataagcaaatgcgtactaacgtgcctcatatttttgccatcggtgatatcgttggtcagccaatgctggcacacaaaggtgttcacgaaggtcacgttgcggctgaagtgatctctggtaagaaacattacttcgatccaaaagtgattccatcgattgcctacactgaaccagaagtggcttgggttggtctgactgagaaagaagcgaaagagaaaggcatcagctatgaaaccgccactttcccatgggctgcgtcaggccgtgcaatcgcatctgattgtgcagagggtatgaccaaactgattttcgacaaagaaagcaaccgtattatcggtggtgctattgtcggtactaacggtggtgagctgttgggtgaaattggtctggctattgaaatgggttgtgatgcggaagatatcgctctgactatccacgctcacccaacgctgtatgaatcaatcggtatggctgcggaaatgtatgaaggcagtattactgatttgccaaatcctaaggcaaagaaaaagaaataa

SEQ ID NO: 1462 - DNA, 102 bp, Xenorhabdus bovienii
  Coding sequence Name=Xb4151_4152.C426.gene87.dna; Position on contig =48938..49039bp; Strand=+
ttgtccggcgggtcagacgaaaaaaaaccatattccaccgggacgtacacaccgcgagcagtttacagaattgtaaataacctgaaaagcgcgttaacgtga

SEQ ID NO: 1463 - DNA, 96 bp, Xenorhabdus bovienii
  Coding sequence Name=Xb4151_4152.C426.gene88.dna; Position on contig =49000..49095bp; Strand=-
atgattacgatcgtgacagatattttagacttacatctagcatgttgggatttctgtcacgttaacgcgcttttcaggttatttacaattctgtaa

SEQ ID NO: 1464 - DNA, 1851 bp, Xenorhabdus bovienii
  Coding sequence Name=Xb4151_4152.C426.gene89.dna; Position on contig =49139..50989bp; Strand=-
atgtctattgaaattaacgtacctgatatcggtgctgatgaagttgaagttaccgagattctggtgaaagcgggtgacaccgtagaagcagagcagtcactgatcactgttgaaggtgacaaggcttccatggaagtcccatcaccacaggccggtgtggttaaagaaatcaaagttgcagttggtgacaaaattgaaaccggcaaactgatcatgattttcgagtccgcaaaaggtgcagcagaagctgcgcctgtgcagcagaaagcagcagcatctgcggcggctgaaagcaaagtagtcaacgtacctgacatcggtggcgatgaagttgaagtgaccgaaatcatggtaaaagtcggtgacactatcactgaagaacagtctctgatcactgtagaaggcgacaaggcttctatggaagttccggctccattcgcgggtactgtgaaagaaatcaagattgcggctggcgataaagtcaaaacgggttctctgatcatggtattcgaagttgcaggttctggcgcagcgccagcagcagctccggctccggtagcagcggctcctgcggcatcagcagcaaaagaagtcaacgtacctgacatcggtggcgatgaagttgaagtgaccgaaatcatggtaaaagtcggtgacaccatcactgaagagcagtccctgatcaccgttgaaggtgacaaagcttcaatggaagtccctgctccatttgcgggtactgtgaaagaaatcaagattgccgttggcgacaaagtcaaaacgggttctttgattatggtattcgaagtggtgggcgcagctcctgctgtagcactggcagcggcaccatctcttgcggttgaatcggtaaaagcagctccagctgcaagtcagccagcagaaggtaagaacgaattcgcagaaaatgacgcttacgtccatgcgactcccgtcattcgtcgtctggcgcgtgaatttggtgtgaatctggcgaaagtgaaaggaacaggtcgcaaaggccgtattctgcgcgaagacattcaggcttacgtaaaagatgcgattaaacgcgcagaagcggctcctactgctgctgcgggtggtggcatgccaggtatgctgccttggccgaaaattgatttcagcaagtttggtgaaatcgaagaagttgaaatgagccgcatccagaaaatttccggtgctaatctgagccgtaactgggtcatgatccctcatgttaacttgttcgatgaagcggatatcactgaagttgaagagttccgtaaacagcagaacaaagaagctgagaagaaacagctgggcgtgaagatcactccgctcgtattcgtgatgaaagcggctgcgaaagcactggaagcgatgcctcgttttaacagctctatctctgaagatggccagaagctgatcctgaaaaaatacatcaacatcggtatcgcggttgatacacctaatggtctggttgttcctgtgttcaaagatgtcaataagaaaggcatcatggaactgtcaagagaactggctgaagtatccaagaaagcgcgtgctggtaagctgacggcttccgacatgcagggagggtgcttcactatctccagcttaggtggtattggtactaccggctttgcacctatcgtgaatgcaccagaagtggcaatcatggggctgtcccgttcttctatgaaacccgtctggaatggcaaggaattcgttcctcgtctgattctgcctatgtctctgtctttcgaccaccgagtgattgatggagcagatggtgcgcgctttatcacttatattaatgaagtgatgagcgatatccgccgtctggcgatgtaa

SEQ ID NO: 1465 - DNA, 2664 bp, Xenorhabdus bovienii
  Coding sequence Name=Xb4151_4152.C426.gene90.dna; Position on contig =51003..53666bp; Strand=-
atgtcagatattttgaaaaatgacgtggatccgatcgaaactcgcgattggttacaggcgatcgaatcggtcatccgtgaagagggtgttgagcgtgctcagttcctgattgatcaggttttgaacgaggcccgcaaaggtggagttagcgttgcagcaggtgttgcaagtcgtgattacatcaacactattcctgttgaggatgagcctgcttaccctggcaatctggatttggagcgtcgtatccgctctgctattcgctggaatgcggtgatgaccgttctgcgtgcatctaagaaagatctagatctgggcggccacatggcttcattccagtcttctgctactttttacgacgtttgctttaaccatttcttccgcgctcgcaatgaaaatgatggcggcgatttggtttacttccagggccatatttctccgggcgtttatgcacgtgctttcttggaaggccgtttgactgaagagcagatgaacaatttccgtcaggaaattggtggtaatggcctgtcttcttatccgcatccaaaattgatgcctgatttctggcagttccctacggtttcaatgggtctgggcccaatttctgctatttatcaggctaaattcctgaaatatttggaacaccgtggtctgaagaatacgtctcaacaaaccgtttatgctttcttgggtgacggtgaaatggatgaaccagaatccaaaggtgcgatcactatcgcaactcgtgaaaaactagataaccttgtcttcgtcatcaactgtaacttacagcgtcttgatggcccagtgactggtaacggcaaaatcgttaacgaactggaaggtattttcgcgggtgctggctggaaggtactgaaagttctgtggggcgagcgttgggacgagctgctgcgtaaagacactagcggtaaactggttcaactgatgaatgagactctggatggtgactaccagacattcaagtccaaagatggcacttatgtgcgtgagcacttcttcggccgttacccagaaaccgcagcattggtcaaagatatgactgatgatgaaatctgggctctgaaccgcggtggtcatgatcctaagaaagtctatgctgcactgaataaagcgcagaataccacgggtcaaccaacggtaattctggctcagaccatcaagggttatggtatgggtgataccgctgaaggtaaaaacattgctcatcaggttaagaaaatgaatatggaaggtgtccgtcacttccgtgatcgtttcaatgtgcctgtgtctgatgaacacattgaaaaactgccatacgtcacttttgataaagactctgaagagtccaaatatctgcatgagcgtcgtaatgcgctgggtggttacctgccaagccgtcgtgtaaacttcgacgaaaaactggaaatgcctgcactggaagacttcagctcactgctggaagaacaatccaaagaaatttctactactatcgccttcgttcgtgcactgaacgttatgctgaagaataagtcgatcaaagatcgtctggttccaatcatcgctgacgaagcacgtactttcggtatggaaggtctgttccgtcaaatcggtatttatagcccgaatggtcagcaatatactccgcaagaccgtgagcaggttgcatactataaagaagatgccaaaggccagatcctgcaggaaggtatcaacgagttaggtgccgcctcatcttggctggctgctgcaacttcatacagcaccaacaacctgccaatgattccgttctacatctactattctatgttcggattccagcgtatcggtgatctgtgctgggcggctggcgaccaacaggctcgtggctttctggtaggtggtacttctggccgtacgactctgaacggtgaaggcttgcagcacgaagatggccatagccacattcagtctctgactatccctaactgtatctcttacgatccagcattcgcttatgaagtggctgttatcatgcatgacggtttagagcgcatgtatggtgagaaacaagaaaacatctactactatatcactacactgaacgaaaactaccacatgccagcaatgcctgcgggtgctgaggaaggtatccgtaaaggtatctacaagctggaagcttttgacagtgcgaaaggtaaagttcagttgctgggttcaggttctatcctgcgtcatgttcgtgaagcagctaagatcctatctgacgagtatggtattggttctgatgtatacagcgtaacgtccttcactgaactggcgcgtgatggtcaggattgtgagcgttggaatatgctgcacccatcagaggaaccccgtgttccttatattgcgcagatcatgaatgaagcaccagcaatagcgtctactgactacatgaagttgtttgcagagcaggttcgtaacttcgtacctgtaagcgaattccgcgtattgggtactgacggtttcggtcgttctgacagccgtgaaaacctgcgtcatcactttgaagttgatgcttcttacgtggttgtcgctgctctgggtgaattggctaaacgcggcgaagttgatgtgaaagtcgttgaagaagctattaaaaaatataacatcaacccagaaaaagttaacccacgtctggcataa

SEQ ID NO: 1466 - DNA, 108 bp, Xenorhabdus bovienii
  Coding sequence Name=Xb4151_4152.C426.gene91.dna; Position on contig =53775..53882bp; Strand=+
atgttgccgctaaaactcttgaataaagagttgacgaactgtacagacgcagcagccaagatctgtacagctaagattataaaacctacccccatccgggagttttaa

SEQ ID NO: 1467 - DNA, 813 bp, Xenorhabdus bovienii
  Coding sequence Name=Xb4151_4152.C426.gene92.dna; Position on contig =53912..54724bp; Strand=-
atgactaatccgaagcaacatttactcattgaatggcttacagcagatatggcctatagcaagattcgccaacccaagttatcagatgtgattgagcagcgtcttgaacatctcattctcgaaggctcgttacgcccgggagaaaagctgctgcctgagcgtgagctggcaaagcagtttgaggtatcacgcccttcactacgcgaagctattcaaaaattggaagccaagggttttcttttccgtcgtcagggcgggggaactttcgtgcagagtaatctctggcaaagtttcagcgacccactcgcccggcttattgcagataatcaagaatctcaatttgatctccttgaagcgcgccatgcgctggaaggtattgcggcatattatgcggctcttaggggaaccgatgaagatttcgagcgcatcgaaaaaagccactttgccattcaggaagcccagcaaggcggtgatgttaaagcggaatcagatgcagtcctgcaatatcagcttgttgtcaccgaagctgcccataacgtggtattgctacatttgctgcgctgtatgatccccatactggaacaaaatatccgacgcaacttcgaatttatctatacccgcaaggaaatgttagcagctgtcagtaaccacaggacagagatttttcgtgcgattatggcgagagaaccggaaaaagctcgtgaggcttcgcatcgccatttggcttttattgaagaagttttattggatctgactcgtgagcatactcgtcgtgaacgctcactacgccggctccagcaacatcaggaataa

SEQ ID NO: 1468 - DNA, 123 bp, Xenorhabdus bovienii
  Coding sequence Name=Xb4151_4152.C426.gene93.dna; Position on contig =55048..55170bp; Strand=-
atgacattaaggataacgctggcgggaatttttttggtcaggtgtttggaaagagtgagcccagttaatttggttgacccattaactattattgattattactcatctatcaaatttaattga

SEQ ID NO: 1469 - DNA, 123 bp, Xenorhabdus bovienii
  Coding sequence Name=Xb4151_4152.C426.gene94.dna; Position on contig =55286..55408bp; Strand=+
atgtccataacattatttttattttcgggaaaatattatcgctataatactataatgttttttattaatagctattttattagctttaatgtttctatatcgttatatattctaaatatatag

SEQ ID NO: 1470 - DNA, 855 bp, Xenorhabdus bovienii
  Coding sequence Name=Xb4151_4152.C426.gene95.dna; Position on contig =55697..56551bp; Strand=-
atgactctctttattctattgttagtactggcatgggaacgtgtttttaagatgggcgaccattggcagttggaacgctatttgtcccctttgtttgccaggatgaaattattttcattatggagcagtttgggtatgaccctactgatcgcattactgacctggaaacttattgatgttttgagtgatgtggtttttggtgtaccgggaattctgctgtatatcatgatcagcttgttgtgtattggtgcagggtctttgcgttatgactatcgggaatatcttcgagctgtacgtcttgatgaactggatcagcaaaataatcaccttgtccgtttgacgatgatacagggaactctacctgataccacaaaagatgagcgattgcgtgagatacagaatgcattgatctggataaatttccgttattatcttgcaccgattttctggttggtagtgatgggaaaattaggtcctgcaatcttaatgggatacggttttttgaggggttatcaaggatggttggcacaacacggaacgactgtgcaacgtgcacaaactggggttgatagtttgctgcactgtctggattgggttcctgctcgtctggcggggatcgcttatgctttattagggcatggggaaaaagccttgccagcttgggttgcatccctcagtgatcttcggacatctcaatataaggtggtaagtcaattggctcagtttgccttaagtaaggaacctcatcttaatccaatagaaactcctgttgcggctgttaggttagcgaaaaaggcgacattgactattgtgattattgttgcattgttgacgatctatggagcattagcttaa

SEQ ID NO: 1471 - DNA, 543 bp, Xenorhabdus bovienii
  Coding sequence Name=Xb4151_4152.C426.gene96.dna; Position on contig =56557..57099bp; Strand=-
atgaagctgcatgaagggtggattgatggtgcaaggaaggtaatctctccatattatgatctgcgtccggaaggtgaaatcccatcattactggtcattcataatatcagtttacctcccggcaagtttggcgggccttatatcgatcagctatttatgggaacgctgaattcagatgaagatccgttctttaatgagataaagggattatgtgtttctgctcattgcttaatccgccgcgatggagaaattgtgcaatatgtcccttttgataaaagggcttggcatgctggcgtatcctgctactgtgaccgtgagaaatgtaatgatttttcgataggtattgagttggaggggacggattatgagccatttagtgaaatccagtacctcagactggcggaagttacccaattgcttatctgtcactttcctgatatccgcaataatattacggggcacagtgatatcgctccgggtaggaaaaccgacccagggccttatttttattgggaacattatcggcaactattgaaggagtga

SEQ ID NO: 1472 - DNA, 171 bp, Xenorhabdus bovienii
  Coding sequence Name=Xb4151_4152.C426.gene97.dna; Position on contig =57015..57185bp; Strand=+
atgggatttcaccttccggacgcagatcataatatggagagattaccttccttgcaccatcaatccacccttcatgcagcttcattcttttactctcctcaatatctcaacagcaatattcccaaccaagtggaatggcaccactcaaagtgtaacaggttaacatgttag

SEQ ID NO: 1473 - DNA, 162 bp, Xenorhabdus bovienii
  Coding sequence Name=Xb4151_4152.C426.gene98.dna; Position on contig =57191..57352bp; Strand=-
atgtcggcatttataaggatgacaaaaacagagaaaaataaaatagcttcagtaatagttatggaaatagctcgaaaaaataactattcgttacattttttacagaggaattttcgagctggttcgcaaatgaaaaacacaccagaaatagtactcgattga

SEQ ID NO: 1474 - DNA, 483 bp, Xenorhabdus bovienii
  Coding sequence Name=Xb4151_4152.C426.gene99.dna; Position on contig =57343..57825bp; Strand=+
atgccgacatctatcggggatcatgctccataccatgagaaaacacacaaaggaggaagaatgaaccaacaagggtttacattaatggaattgatggttgttatggcgattgtgtctatccttggcgcaattgctattcccagttatcagggatatatccaaaaagcagcattaaccgatatgctacaaactattgtgccttataaatctggcgttgaactttgtcgttttgaaacagaaaactataaagactgtaatactggccatgcatcaattccatcaggtcataatagccgctatatcagcaccgttacggtaaaggacggagaaataatcatcgtcggacaacaaaatctcaatgggctcactactaccttaaaaccaacccaagataccaaaaccggcgttatctactggcgtaccatctgtgatactaaaaatgaatccttaaaattgaaatgtcaggaaacttttaagttttaa

SEQ ID NO: 1475 - DNA, 1536 bp, Xenorhabdus bovienii
  Coding sequence Name=Xb4151_4152.C426.gene100.dna; Position on contig= 57917..59452bp; Strand=+
atgagaaacaaggaaaatgtattaatggaaagggaaatcaatgaactgtgtcaacgacatcaggccattattataaaaagagagatccataccatgactattgcctgtagcaaatcacccaatgaagatttcattgctgcattacgatttatttctggctcaatcattaatgtagatatttggccaaaagcaaaaatagaatccatgctgacacaaggaagttcattggtatcttgtacagaaaatcactgtgctgaaaatgatgatgaggaacattatcgtatcgaaaaactggatgtcccccattccagtcacagtgaaatacaaacaaacgatgcttattccgaagatatggacacgccagttattcaattaattaatcaaacgatatcaacctcaatacaaaaaagagcctcagatattcattttgagcctgctcaacgtggctatcggatacgtattcgggttgatggaatcctgcatgctgtatcatcaccttctccccaaatgaataccggtattccagcccgtttgaagatcatggcaaaactcaatattgctgaaaaacgccagccgcaggatgggcaatttgcctggaatgatagcaaaaacagttatgcgatacgtatatcaacattgccaactctacatggagaaaagattgtcctgcgcgttttaaataccatacaccagctatcgctggagcaacttggcctgccagagcctcaattgcaacttttaaaacagaaaatccacttaccgcaaggtatgatcctagtgacaggcccgacaggaagcggtaaaactgtcacgctgtatagctgtctgcaatatttaaatcaggcgaagaaaaatatctgtagcgtcgaagatccggtagaaattcccttaagtggcatcaaccagacaccagtaaacaacaaaattggcctcgattttgccaaagtcctcagagcattattacggcaagatcccgatatcattatggtcggtgaaatccgtgacaatgaaaccgccgagatatcgatgaaggcagcgcaaacaggtcatctggttttatcgacactgcataccaattcgacaattgatacgttatcccgcctgcaaaatttggggatttcaggctataccacagcatcgtgcgtgaaattgattattgcacagcggctggtgcgtacactctgcccccattgccgccagcaagataaagaatgcactgtcatcaatgtcgacaatgccgctattcctataaaaaaaaccgattccgtaaaacaatctatttctataagacaatggcttgcggttggctgtgaacactgtttttctggctattatggcaggacagccatctacgaatttcttgagctccagccaacccttcagcagactctgtcagaacactcgattgataaccttccccaattactcgctgcacaacagcattcaactcttttttccgcagggctggttttggtggaaaaaggcataacaacactggaagaggtttatcagattacaggtcaggaaacagcatga

SEQ ID NO: 1476 - DNA, 1200 bp, Xenorhabdus bovienii
  Coding sequence Name=Xb4151_4152.C426.gene101.dna; Position on contig= 59449..60648bp; Strand=+
atgaaaatggaatatatttatcaatggcaagcggtcaataaaaaaggaaacattgtaaaaggggaaagcatcggccagagcagacaaaacgtgtttcaatatctgagccaccttgatttgcaaccttataccattaaatgcaaaaaactcattcattacagcgaaaaggaaatcgcttatcgcttacatttcattcatcaattaagcacattactggcatcaggtattcccctattaaaggggcttactctcttattacaggaatgtaaacaaatgctttggcgatgtgtattaacggatattattcaaaaaatcagccaaggtgagtcattttccacgacattgggacactatccccggctattttcgcccctatttcgccagcttatcgcagtaggcgaagaaaccggccagcttgaaacctgctgccaattaattatcaaccgattggaacaacaagatatattacgtaagaaaatccagaaagcttaccgttatcccttaatcgtagcctttgtaactattcttgtcattttactgatgctgatttttgttctgccggaattcaagcaagtttattcttcgtttaatgcctcactgcctctcttaacacagtggattttatccgcctctgatttactaattaatcacggtgtattacttttggcaatagcctctctattgataatcagctacctatggctgcgccatcaatttcccaaactaaaaacaagggaaaagatgttccttctgaaactccctctttttaggcaactcacaatttatcaacaaaccaaccagatatttcatattctgtttatgacacaaaaagcaggtctaacactaacaacagggttggaatgtgctctgaacgcgactcaccaccctgtattcatggcagggataaaaaatctgtacaggcaaattcagcaaggtatacccatgagtgatgctttaaagaaagagatgtactttccaccattatgtcagcagtttgtcatgataggtgaagaatcaggagaattagaattatttttggggaatctagcagcatggtatcaagaacaatcaatcagccttgctgatagtctagtgcaattacttgagcccgtactgatgctgataatggcagtgattgttggtttattattgctggctatgtacctgcctgtttttcagttaggtacgatactaacgtaa

SEQ ID NO: 1477 - DNA, 624 bp, Xenorhabdus bovienii
  Coding sequence Name=Xb4151_4152.C426.gene102.dna; Position on contig= 60781..61404bp; Strand=+
atgagttatattattgcactcacaggtggaattggtagcggtaaaacgactatctctaatgtgttttcatcccttggtgtcccgcttattgatgcagatattatcgccagagaggttgttgctccgggttcccccgccttgcaggcaatcgcagagcactttggttctgacatattgctgccggatggcagtttaaatcgcgtctttctgcgccaaaaaatttttgcagttccagcagaaaagcagtggatcaatgcacttctccacccgctgatacacacagaaacccaacagcaactaagtcaagtcactgccccttatgccatttgggtcgttcctctgttaattgaaaataatttaatgcatttggcagatcgtattttagttgttgatgttccccctgaaatacagatcagccgaacaatgacacgtgacggagtaagtcgtgagcaagtcgagaacattctggctgcacaggccaaccgtcatgaaaggctggaaaaagcggatgatgtcatattcaaccatcacaatgagcaggatatcatctcccgtgtggccgaattacaccaacagtatttgaaacaagcagaatcagtcagacaggaaaatcgtaatgagtga

SEQ ID NO: 1478 - DNA, 759 bp, Xenorhabdus bovienii
  Coding sequence Name=Xb4151_4152.C426.gene103.dna; Position on contig= 61397..62155bp; Strand=+
atgagtgatgcaacctccactattatctttgaacacccactcaatgaaaaaatgcgttcatggctgaggattgattcttcactgcaacaactggaaaaacagcagtatctagattcatcggcgagttgtctcgcgtttttccgtacaattgctgaattaatcgaaatactggaacgcggtgaagttcgctctgaattattgaaagagctggatcgccaacaggcaaaattaaagcaatggctcggttcgcccgatgttgatacggcgatgatccacctactgatagagcaactcaaggaacggagcatcgccttgaataaggctccacgtctcagccagcacattaaagaagatcgtatcatcaacattgtgcgtaaacggcttagcatcccgggaggatgttgcagttttgacttacccacgttacacctgtggctacatttaccacagtctgtcagagataaaaccgtcaaatcttggctggacagcctacacccattacagcaagcactggaaagcatcctggggttaatacgccaatccgccatattttctccaaaaatcagccacaacggtttctatcagggaaatgctgatgagtctgatttattgagattaaagttagatgtcgtactggatgcactggtctatccacaaatatccggtcacaagacccgttttgccatccgttttctgccgatggatagcgagcacggtgttgtacctgcacatttgtcatttgaattagcctgctgttaa

SEQ ID NO: 1479 - DNA, 198 bp, Xenorhabdus bovienii
  Coding sequence Name=Xb4151_4152.C426.gene104.dna; Position on contig= 62189..62386bp; Strand=+
atgtctgaagtattgaccgtcgcatgcccgacttgcgctaaaacggtaatatggggagaaatcaacccatatcgcccattttgcagtaaacgttgccaattaatcgacttaggcgaatgggccagtgaagaaaaaaaaatcgccagtcaggacgacagctcagaaaacgatagctggagtgaagaaccagatcggtaa

SEQ ID NO: 1480 - DNA, 318 bp, Xenorhabdus bovienii
  Coding sequence Name=Xb4151_4152.C426.gene105.dna; Position on contig= 62446..62763bp; Strand=+
atgagatccgcttttgttcagcaaagccactatgctgcggtttgctggcggaaactcatcagcgatcaattcggtttgcaaaacccaacgggaaggctgcccctctttaccaaatggctcatttttccattgatccacaaggtaaaaatagagtgtgatgtttctgtcagaaaattcatgagtgatggtttccaccaattcacaatgggttaccgtgatccccacttcttccttcaattcccgaataagtgcctgctccggaatttcttcctgttcaagttttcctcccggaaattcccaaaagccgcccatatgtga

SEQ ID NO: 1481 - DNA, 96 bp, Xenorhabdus bovienii
  Coding sequence Name=Xb4151_4152.C426.gene106.dna; Position on contig= 62810..62905bp; Strand=+
atgatgccggccgcaatatgcagatgttttttttccataatagtctttcttgcagttgattatttaatcaatgtgattatttcttgcggactataa

SEQ ID NO: 1482 - DNA, 207 bp, Xenorhabdus bovienii
  Coding sequence Name=Xb4151_4152.C426.gene107.dna; Position on contig= 62900..63106bp; Strand=-
atgaatgatgcttccttaatctttaaagtacggctttatgctttctatgtcggattctatttgtcggctaatgtcagataccgcttaccaaaatgtgtccacataatacgcttttatttgggtgaatcttggcaaaaagcaataagacgtgattacggctctcatgagattaatcctgtttctttctcatatgactgtttattatag

SEQ ID NO: 1483 - DNA, 1638 bp, Xenorhabdus bovienii
  Coding sequence Name=Xb4151_4152.C426.gene108.dna; Position on contig= 63105..64742bp; Strand=+
atgcaatctgaaagccaaccattgatcgaagcaaagcaaatcgcctatcaattttctggtgaaatcattcctctgttttctggtattgatatggttttgaacgcggaacaacacgctttagtcggtcgtaacggtattggtaaatcttggctagcatcaatattggctcggcaaataccaccgacagaaggcagtgtgaaccatttccgtgatgttggttatctgtcacaaggtctaacatccttttcaggtaatgcggctgagatgttaggactaactgagatcatgaatgccaatgaacgcattctagcgggcgtcggtgatgtgacagattttgacatcatggaaaatcattgggattggcaatttcaagcggagtccctattggcagaaggagaattgcgccctgaagtattaaagcagccttttagttctctcagtggtggagaacagactcgcctcagactgctggcactaaaatatcagggagcggagtttatgattttggatgaacccagtaatcaccttgatcgacaagggcgtctctggctggctcaatggctgacaaatttcagtggcggcattttactgattactcatgacccccaattattacaacatgtgtctgttgtctacgaactcagtgggttagggctatgccgcagcacaggtggatgggaaacgtggttagaaagtaaggaacagctacggttaggtgtacagcgcgaggttgatcagacgcgtaaaaacctcaaacaagccttgcgtgataagcaaaaagatcgagaaaaagccagtaaaagacaaagccaaggtaaacaacgacgggaaaatgccaatcaaagtaaaatcattcttgatcgggaattagggcgctcagaagccacgttgtcacgacaggctaaacaacatgaggaacgattacagcgaagcacttctctggccacagatgccagagcaagactggaaatcatcgatcctctgtcaatcacggttgctgcgccgcaaatagcgcctgctccgttactttatctgcaaaatgtcattttgccttttggttcaggctctcccatcagtttaacaatgaatcatagtgatcgcctcgctatcacgggaaaaaatggcagtggaaaatctaccttgctaaaagtgatggcaggtttatttcctaccaaacaaggcacttgccgaataacaccttcctatcgtctgatggatcaacatttttcatttcttgataaaaaccaatccgcactgcataactttcagttacagtcacccggttggcctgaagatcgttaccgtacccggctggcacaactgcgcattcgtggtgaagaagccttgaaaccggtaggctatctgagtggaggagaacaactcaaagtcgctcttgcctgcttgttttgtgggccttatgctcccgccctgctgctgctggatgaacctgacaatcatttggacattgaatcacgcgaactactccagaaagcgctgcatagttatactggtgcgatggtactgatttcccacgatgctcagtttattgcaaatattggcaatatgcaggaattactattgggtagcagcgaggattttcttcataaaaaaaccctcaaatcattctctgagagatga

SEQ ID NO: 1484 - DNA, 2709 bp, Xenorhabdus bovienii
  Coding sequence Name=Xb4151_4152.C426.gene109.dna; Position on contig= 64807..67515bp; Strand=-
atgctgattaaattactcactaagatttttggtagccgtaatgaccgtaccctacgccgtttgcgtaaatcggttgagattatcaaccatatggagcctgattttgagaagctctccgatgaagaattaaaagcaaaaacagaacaattccgtgcacgcctgaaagcaggtgaatcactggagaaaattttgcctgaagcctttgctactgtacgcgaagccagtaagcgtgtattcggtatgcgtcactttgatgtgcagttgctgggtgggatggtgctgaacgaacgctgtattgcggagatgcgtacaggtgaaggtaaaactctgaccgcaacactgccagcttaccttaatgccttgggtggacgtggtgttcatgtcgtgactgtgaacgactatctggcacagcgtgacgccgaaaacaatcggccattgtttgaatacctcggtctgaccgtcggtattaacctgccaaacatgccagcccctgcaaaacgcgaagcctatgccgcagatattacttacggcaccaacaatgaatacggtttcgactacctgcgagacaacatggcgtttagcccagaagagcgagtacaacgcaaactgcactatgcgctggtggatgaggtggattcgatcctgatcgatgaagcccgtaccccgttgattatttctggaccagcggaagacagttctgaactttacatcaaagtggacaaactgatacctaaactgatccgccaagaaaaagaagattcagaggcattccagggagaaggtcacttctcggttgatgaaaaaacacgtcaggttaacctcactgagcgtggtctggttctggttgaagaactgctggttggtgccaaattgatggatgaaggcgaatcactgtattcgccgaccaacatcatgctgatgcaccatgtaacagcagcgctgcgtgcccacgttttgtttactcgcgatgtagattacatcgtcaaagatggtgaagtcatcattgtcgatgagcacaccgggcgtaccatgcagggacgtcgctggtctgatggactgcatcaggcggttgaggcgaaagaaggtgttgaaattcagaatgaaaaccagacactggcctctattacatttcagaactacttccggatatatgaaaaactggcaggtatgacgggaaccgctgatacagaagcctttgaattcagttctatttataaactggatactatcgttgttccgacaaaccgtccgatgatccgtaaagatttgccggatctggtctacatgaccgaagcggaaaaaatcgatgcgatcattgaagacattaaagaacgcaccaataatggtcagcctatattggtagggacaatttcgattgagaaatcggaagtcattgctaaagcattaaccaaagcaggcattgaacataacgtcttgaatgccaaattccatgcaatggaggcggatattatcgcacaggccggacaggctggcacggttactatcgcgactaacatggctggacgtggtacggatattgtgttgggcggaagctggcagtctgaaatcgccaaactggaagaaccaagccaagagaaaatcgagcaaattaaagctgcatggcaagaacgtcatgatgaagtacttgcagcgggcggtttgcatattattggtacagagcgtcatgaatcacggcgtatcgataaccagttacgtggccgtgcgggacgtcagggggatgctggttcttcgcgcttctatctctcaatggaagactccttgatgcgtatttttgcttccgatcgtgtcactggcatgatgcgtaaacttggcatgcagccgggtgaatcgattgaacacccatgggttactaaagcgattgccaatgcccagcgtaaagtagaaagccgtaacttcgatattcgtaagcaattgctggaatatgatgatgttgccaacgatcagcgccgtgcgatttatgcccaacgcaacgatctgcttgatgtgggtgatgtcagcgaaaccattgccagtattcgtgaagatgtcttcaaggtaacgattgacgcctatattccgccacaatctctggaagaaatgtgggatatagaaggtttacatgagcgtctggtaaacgactttgatctggatatgccgatcaaggagtggctggacaaagaacctgaattgcacgaagaaacgctgcgtgaacgtattcttgaaaaggcgattgaagtttacaaacagaaagaagaaatcgtcagtacagaaatgatgcgtaactttgaaaaaggcatcatgttgcaaaccttggatacgctgtggaaagagcacttggctgcgatggactacctgcgccaaggtattcatctgcgtggctatgcacagaaagatccaaagcaggagtataaacgcgaatcttttgccatgtttgctaatatgctggaatcgctgaaatatgaagtgatcagtacattgagtaaagttcaggtcagaataccggaagaagtggaagcgcttgagaatcagcgccgtgaagaagcggagcgtttggcaaagaaacagcatttgagccatgaagttgagcaaggcgctttaatgtcagaaacagaagcacagatggcgagtggcgcacgtaaactgggacgcaacgatccttgcccatgtggctcaggcaaaaaatttaagcattgccacggcagtttataa

SEQ ID NO: 1485 - DNA, 93 bp, Xenorhabdus bovienii
  Coding sequence Name=Xb4151_4152.C426.gene110.dna; Position on contig= 67505..67597bp; Strand=-
ttgatgagacagctttgcttggacagtctagaagacacaattggttggccgcaactttggccttatctgagatgtattaattatgctgattaa

SEQ ID NO: 1486 - DNA, 537 bp, Xenorhabdus bovienii
  Coding sequence Name=Xb4151_4152.C426.gene111.dna; Position on contig= 67626..68162bp; Strand=-
atgagtattttaaatctttggcgacaatttggtaggcgttatttttggtctcaccttttactgggcatggtcgccacaggaattggtgttcctgctgttttagctggaataacagaaagccttcctcatagtaatacttcttccagccaaaagaaccaaaatcaggtattttcctcatttgatcacttatttcaattacaaagtgtccagcgtcaaccttcgaatcatttgaattactggcagcaacatgctgttcgcaacattattcgtcggctttcttttactttttctattactggccctatccaacacgaagtagcaaaagaaagcattcgattttcttctccatgcatgcaacaacttatgctggatacgttgtatgctatgctgatacaagcaccgtcacaatttgaatccatccttgatattgaaattacggcgactattcttcctgattcccacacaccggcactctgggtagctaaaactcagggaattcgcgcggggccaacagctaaccatttatctttgctttaa

SEQ ID NO: 1487 - DNA, 537 bp, Xenorhabdus bovienii
  Coding sequence Name=Xb4151_4152.C426.gene112.dna; Position on contig= 68200..68736bp; Strand=+
atgcgagatagccgaccacaatcactggatacgctatttgaagatgaggcagctgtcggtaaaagccctcttcaaatcattcaacaacatgctattgcacttttgaaactcaaccgtgccatgctcagtttattgcccgcacaactgcatccatggtgcagggtcgccaattatcgcaaacatattctggtactggaagcaggaaatgccagttggatgacaagacttcgctatgaagtgcccgttttgctttcgacactgagaagcgaaattctaccatctttatcctctatcgacatcaggattaatccatcattaatggtcaaacgtagtaataatgcgcaagatttcgcaaaatcgtcaacaacagcacctaataataataatcagaatttaccaaagcgccaattgagccatgaaagtgcagaaacattaatgatattggctgaacgcagccctgagaaattgaaaaggaaattagagagattggctgcgctggccggagagggtaccagtacagccaaaaaaaagtgctag

SEQ ID NO: 1488 - DNA, 951 bp, Xenorhabdus bovienii
  Coding sequence Name=Xb4151_4152.C426.gene113.dna; Position on contig= 68828..69778bp; Strand=-
ttggcaggatgggtaacattgcgagatataatgatgatcaaacaaaggacattaaaacggactgttcaagcgaccggcgttggtttgcacaccggtaaaaaagtcacgctgacaatgcgtccagcgccggctaataccggggtcatctatcgtcgtactgatttgaatccaccggtagattttccggcgaatgctaaatccgtgcgtgataccatgctctgtacttgtctggtaaatgaacacaatgtgcgaatttcaaccgttgagcacttgaacgcagcgttggcaggtctgggtatcgataacattgttattgacgtcgatgcaccagaaatccctattatggatggtagtgccagcccgttcgtttttctgctgttggatgcaggtattgaagagctgaatgtcgcgaagaaattcgtacgtatgaaagacgcagttcgcgtagaagatggagataaatgggctgaattagcaccatatcacggttttagtctggactttaccattgacttcaaccatccggctattgattccagttcacaacgttatagtttggatttctctgcggattcgtttgtccgccagattagccgcgcacgtacttttggatttatgcgcgatattgagtacctgcaatcccagggcctgtgcctcggtggcagcttcgattgcgccattgtggtagatgactaccgcgtactcaatgaagatggtctgcgttttgaagatgagttcgtccgtcataaaatgctggatgccatcggtgatctgttcatgtgtggttataacatcattggcgcgtttactgcgttcaaatcaggccatgcattgaataacaagttgctgcaagcagtcttggcgcatgaaagtgcttgggaatttgtcacgtttgaagatgaggctgaaatgccgctggctttccgtgctccatcaacagtgatggcatag

SEQ ID NO: 1489 - DNA, 183 bp, Xenorhabdus bovienii
  Coding sequence Name=Xb4151_4152.C426.gene114.dna; Position on contig= 69844..70026bp; Strand=-
gtgccaccacaagtatctcagtcaatccatggatcgcggtaccggcagagttctgtggaaatcccgtcattgtctgaagagaaaaaaactgctgcaaaagtggtcaatgatcaaaatgcgcagacaagcaaagagcctgattatctggacattccagcatttttgcgcaaacaggctgattaa

SEQ ID NO: 1490 - DNA, 2026 bp, Xenorhabdus bovienii
  Coding sequence Name=Xb4151_4152.C427.gene1.dna; Position on contig =1..2026bp; Strand=-
atgattcaacagactttccttgtggaaatcggcacagaagagttgccaccaaaggcgctgcgctcgctggctgagtcctttgcggccaattttgaagcagaactgaaaaacgccaatctgggtcatggtgaaattagctggtttgcagcccctcgtcgtctggcactgaaagtggcaaatctggctgtggcacaggctgatcgcgaagtggaaaaacgtggcccggctattgctcaggcatttgatgcggaaggcaagccaactaaagccgcggaaggctgggcgcgtggctgtggtatcacagttgatcaagccgagcgcatggtaacggataaaggcgaatggctgctttatcgtgcgcaggttaaaggccgtgaagcgaaagaactgctggcggatatggtgagcagttcgttgggcaagctaccgatccctaaactgatgcgctggggcgataaagaaacccagtttgtccgccctgtgcatacggtcacgatgctgctgggcagtgacgtgattgacggtgaaattctgggcatcaaatctgatcgtattatccgtggtcatcgctttatgggcgaggcggagtttgcgattgataatgcagagcaatacccgacgattttgcaggaacgtggccgtgttattgcggattattatgcacgtaaagcgttgatcaaacgtgatgcagagcaggcagcgatgcagcttggcggtgtggcagatctgaccgacagcctgctggaagaagtgacttctttggtggaatggccagtggttctgacagcgaaattcgaagagaaattccttgaagtgcctgccgaagcgctggtttacaccatgaaaggcgatcagaaatatttcccggtttacgataaatccggcaaattgatggcaaactttatttttgttgccaatattgaatcgtctgatccacagcagatcatttcgggtaacgaaaaagtggtgcgcccacggttggcagatgcggaattcttctttaagactgaccgcaagcagcgtttggaagataatctgttgcgtctggaaacggtactgttccagaagcagctgggtacactgcgtgacaaaacggatcgtattcaggctctggctggctggattgccgaaaaaatcggtgcagatgtcactcatgcgacccgcgcgggtctgttgtccaaatgtgatctgatgaccaacatggtatttgagttcacggacactcagggcgtgatgggaatgcactacgctcgccatgatggtgaagcggaagatgtggctctggcactgaatgaacagtatcagccgcgtttctctggcgatgagttgccatccacggccgtttcctgtgctgtggcgattgccgataaaatggatacccttgctggtatcttcggtattggtcaacatccgaaaggggataaagatccatttgcactgcgtcgtgcggcactgggtgttctgcgtattatcgttgagaaaaaactgccgcttgatctccagaccttggcagaagaagccgtgcgtttgtatggtgacaaactgaccaatgaaaacgtggtggatgatgtggttgagttcatgctcggccgtttccgcacttggtatcaggagcagggttacagcgttgatgctattcaggcagtgctggcgcgtcgtccgactcaaccggcagattttgatgcccgaatgaaagcggtaacgcatttccgcacactggatgaagcggtttcactggcagccgctaataagcgtgtttccaacattctggcgaagtcagaagagaagttgaatgactgtgttcttgcttctgtattgaaagccgcagaagagatccaactggcgacccatcttgtggtgttgaaagataagctggctcctctgtttgcggaaggcaactatcaggatgcgctggttgaactggcttctctgcgtgaagtggtggatgcgttcttcgacaacgtgatggtgatggatgaagatcaacaagtcagaattaatcgcctgacactgttgagtgaattga

SEQ ID NO: 1491 - DNA, 909 bp, Xenorhabdus bovienii
  Coding sequence Name=Xb4151_4152.C427.gene2.dna; Position on contig =2036..2944bp; Strand=-
atgcaaaagtttgataccaaaacctttcaggggctcatcctgacattgcaggattactgggcgcgtcaaggctgtaccattgtccaaccactggatatggaagtcggcgcaggaacttctcaccctatgacctgcctgcgcgctttagggccagaacccattgcggcagcttatgtgcaaccttcccgtcgtccaactgacggtcgttacggtgaaaacccgaatcgccttcagcactattaccagtttcaggtcatcatcaagccatctccggacaacattcaggagctttatcttggttcgttgaaagcgttggggctcgaccctaccgttcacgatatccgttttgttgaagacaactgggaaaacccaacgctgggcgcatgggggctgggttgggaagtttggctgaacggtatggaagtgactcagttcacttacttccagcaagtcggtggtcttgagtgcaaaccagttactggtgaagtcacttacggtctggaacgtctcgcgatgtatattcagggcgtggacagcgtttacgatctggtgtggagcgatggcccactgggtaaaacgacttatggtgatatttatcaccagaatgaagttgaacagtctacctataatttcgaacacgctgatgtggatttcctgttcacttgctttgaacagtatgaaaaagaagcacaggagctgttggcgttggaagcaccactgccactgccagcttatgagcgtattttgaaagccggccataccttcaatttgctggatgctcgtaaagcgatctccgtgactgaacgtcagcgctatattctgcgtattcgtaccctgaccaaatcggttgctgaagcatattatgcctcccgcgaggcgcttggcttccctatgtgtaagaagaattga

SEQ ID NO: 1492 - DNA, 588 bp, Xenorhabdus bovienii
  Coding sequence Name=Xb4151_4152.C427.gene3.dna; Position on contig =3149..3736bp; Strand=+
atggaatttatcaacaaggaaagtattcgctgtggttgggtcaccgccgatccggattatcttgcctatcacgataatgagtggggcaagccactgaagaatagccagcagctctttgaactgctctgccttgaagggcagcaagcggggttatcatggctgacgattctaaaaaaacggcagggctaccggaaatgcttccatcaatttgatccggtcaaaatcgccggcatggatgaaaacgatgtcgaacaactgctcaaagatcctgctattgtgcgcaatcgtaccaaaatcaatgccattatccacaatgcccgtatttacctgcaaatggccgatcaaggagaggatttcagttcatttatctggcattttgttgatgattccccactcattaatcactggaaatcacggacagacgttcctgtcagaacccccatttctgatgacctgtcaaatgcactgaaaaaacggggtttcaaatttattggcagcacaacctgctatgcgtttatgcaagcggcaggtttagtcaatgatcacctcacgagttgcctgtgccgaaaaattgaaatcaatgcataa

SEQ ID NO: 1493 - DNA, 1257 bp, Xenorhabdus bovienii
  Coding sequence Name=Xb4151_4152.C427.gene4.dna; Position on contig =3936..5192bp; Strand=+
atgaaattttctcaattcggaaacaaattcacacaagattcaggaattacccgcctgatgaatgatctcaaccaaggcctgagaacacctggcaccattatgctaggtggtggcaatcctgcccatattcctgaaatggatgattatttccagcagatattggctgatctggtgtcaagcggccaattgaccgaaaccctgtgcaactatgatggaccacaagggaaaaatacgctgatagcggcattggcccaagagttacaggaaaagctcggttgggagatccatccacaaaatatcgcattgaccaacggcagccaaagcgcctttttctacctgttcaatctactggctggccgcagtgaagatggctcgatgaagcgagttttattccctcttgcacctgaatacatcggctattccgattctggtctggatgaagggctgtttgtcgccaataaaccaaatattgagttgctgcccaatggccaattcaagtatcgggtcgatttcgatcacctgaatatttccgaagatatcagcctgatttgcgtctcccgtccaaccaaccctaccggtaatgtcattactgacgaagagttactgcgcttagatgggctagctcaacaacatcagatcccgctgttaatcgacaatgcctatggtgtaccgttccccggaattatcttcaatgacgcgacaccactgtggaatcccaatattatcctgtgcatgagcctgtccaaacttggcctgccgggttcccgctgcgggattatcatcgctaatgaaaaaatcatcagtgccgtcagtaatatgaatggtgttattagcctcgcaccgggcggtgtaggccccgctatcgcgttggaaatgatcagacgcaatgatttattccgcctgtctcaaaatgtcatccagccattttataaaacgcgggtagacaacgtgattgagatcattcgtcgccatatgtcagaagatctctgccttatccataagccggaaggtgcaatattcctctggctctggttcaaaaacctgccaatcaccacggaagtgctttatcagcgtttgaagaaacggaaagtgttaatggtgccgggtcatttctttttcccaggtctggagcacaactggccgcatgcccaccaatgtatgcgcatgaactatgtacctgatttggaaaagatcgaagagggcattcgcattctgtcggaagagattgagatcgcacatagagaagcgacccgctga

SEQ ID NO: 1494 - DNA, 1050 bp, Xenorhabdus bovienii; identical to SEQ ID NO: 483
  Coding sequence Name=Xb4151_4152.C427.gene5.dna; Position on contig =5651..6700bp; Strand=+

SEQ ID NO: 1495 - DNA, 999 bp, Xenorhabdus bovienii
  Coding sequence Name=Xb4151_4152.C427.gene6.dna; Position on contig =6852..7850bp; Strand=+
atgaaaaaatttattcataaaacccgggataaagattatgcacgccgactcatggcactcttaatgttacatgaaggcaagaccgtttctgccatctccagaacccttcattgttcacgttcttcggttaatcgttggataaattggtttacattatatgggctggaaggattaaaaagtttaccgtcaggaagacctgctatctggaatttagcgccactttttagtttgctgtcgttcttattacagcactccccacaggattttggctgcctgcgttcacgttggagcattgagctgattactcgaataatcaatgaattattcggtttgtcgctttcgcaaagtacgttctatcgttatttctgtcaggtcggtattgtctggcgaagggcagcacctaccgtcaaaaagcctgatcctgagtatgacgaaaaaatggcaaaaatcactgaagctttatccagcgtgtcagaacaacatcctgttttttacgaagatgaagtcgatattgaccttaaccccaaaatcggggcggactggtgtctgaaaggacaacaaaaacgggtcatgacgccgggaaaaaatcaaaaacactactttgcgggctgccttgacgcccaaacaggccaagtgacttatgtcagcggtataaagaaaaattctgatttatttatcaacatgttaaaggaactgaatggccaatatcgccatgcaaaaaacatcacgttgattttagataactatggcattcataaaagccggaaagtcagggcatggctacaacaaaatcctaaatttaatttgttgtttttaccggtctattcgccatggataaataagattgaacgcctatggcaatcattgcatgaaactgtcacacgggatcattgttgtcagtatatgtggcaactcttgaaatgcgttgaagcgtttattaacgcattttcatcagggcaacaaccgggaatgagaaaaatgagtgtatcactattatga

SEQ ID NO: 1496 - DNA, 129 bp, Xenorhabdus bovienii
  Coding sequence Name=Xb4151_4152.C427.gene7.dna; Position on contig =7928..8056bp; Strand=-
atgcaggtgattgctgccgttgtagaatttgagcgtgacctgctacttgagcgcacttattcaggtattacccaaaagcggccgggattgtctatcctcgatctttcgactctgaacagacctatgtag

SEQ ID NO: 1497 - DNA, 1179 bp, Xenorhabdus bovienii
  Coding sequence Name=Xb4151_4152.C427.gene8.dna; Position on contig =8287..9465bp; Strand=-
atgcctgcagctatttgggctctagccatagcaacatttggaattgctacaaccgaattcattatcgccggattacttcctgaaattgcaaccgagtttaatatttcaatacctatggcggggtatatggcaaccagttatgctcttggtgtatttgttggtgcgcccgttttgattatattggggagacaggtagaaagaaaaaagatgctcgccatattaatgatgttatttattattggaaatgctttgactgctttagctcccacattctatctggcaattgttggccgcatagtaacatctcttacccacggcgcttttatgggaataggcgctattattgcggccgaactggtggcagaaaataagaagacaagcgctatcgcatttatgttcagtggaatgacgcttgccaatcttattggtataccgcttggtacatggataggcaaaattatttcatggcgtgtcacttttgcaattattacctttatcggcattatcgcattactcggtattttaaaattattacctaaattcacacaacaaacgcctaccagcatcaaaaaggaattgctggcctttacaaatatccatgttctgctggcgatggggatcacggttttaggccctgctgcattctttacggctattacttatatcgcgccgttgatgacccatattgcaggtttttcagaaagtgcaatcacatggattcttgtcgtcttggggttgggatttttctttggcaatatcgtcgggggaaaactcgcggacaaggcgatgatgccattgttatattggacactcgggttacaagccttagttttatttattttctggctttatggcgacaatccattcattgcctgcttgagtatatttctgatggcggcgtttggctttgctacagtatcgccaatccagcgtctggtgatggataaagctcaagaagccggtgcgcctaatctcgtttcctcagtcaatattggtttttttaatttaggcaatgcactcggcgcatggttgggcgggattgttatcgccgctaattatggttacgcttcactcaatttagtgggcggcctgctcgcctctacagcattactattagcggtaatttcaggtttccttacctacaataaagcgcgtgtagaagtgcttaaatcttcttaa

SEQ ID NO: 1498 - DNA, 225 bp, Xenorhabdus bovienii
  Coding sequence Name=Xb4151_4152.C427.gene9.dna; Position on contig =9769..9993bp; Strand=+
atggcgcaagctttggtcaaatttctcaatcagcaatttattgacgtggatggagaagaatatccttttatccgtggcgttgctactggttttgccaagcagaaaaaacgccggcagatacctttgcctgccgccaaccctagccgtaagtggttatttacatgggaaaaagatcatcagtgggttaatggtgttgcgtatgtggaaaaacatacccgccgttaa

SEQ ID NO: 1499 - DNA, 696 bp, Xenorhabdus bovienii
  Coding sequence Name=Xb4151_4152.C427.gene10.dna; Position on contig =10213..10908bp; Strand=-
atgagtttttcctataaaaataatgaaccctatttcaagggactgatcgccatgatggagcatctaagcgatccttggggaattaaagatttagcgtcccgacatatctatatgaataaagccgcatatctttacaccaacacaccagaagattttgacatagagggtaaacttgactgtgaatttccgacacattggtctgaagatcaattttcacaagatctaaaagaacatgataggaggactgaagaatctaaagacaaagtttctattattgagacacattattggtatggaaaaaacagcttagcgcctttcatcagtgagaaattccctgtgtacaacgataaaaaagagtgcatcgggatagtttggaatgccaaaccaatgagtactctctcccctctaaaatatattaatcgccaaaaaccaagtgttctcactacagaagctacaacagatctatttaccaaaagtgaactggataccatcttttttatgttgcaaagacgttcaaataaggaaatagcccagatatacaatgtcagccataagacgatagaaaacagaatatacaccatctatcagaaagctaatgtccactccacccagcaatttgaagagttttgtatgcaatttcaattagatagatatattcctgaacgcctcattgaaaaaggcgtcctctttatctaa

SEQ ID NO: 1500 - DNA, 597 bp, Xenorhabdus bovienii
  Coding sequence Name=Xb4151_4152.C427.gene11.dna; Position on contig =11334..11930bp; Strand=+
atggaacacctgagaaaaaatttgcaatacttacttgattccagaggagagagccgggtatcgatctgtgatcgaaccgggcttaaccgcacaactatttataatattctggatgggagagttcaaaacgttcattcttcaacgatacagaaagtatccaacttttttggtgtgtcgtatagggagatagaaacgatcgatattgcagaaaaggaacgtattgatgctattgtttcttatgaaggaaacatgaatccctgtgccgttccgctatttatgcaatctgagtgtattatctctggtttttttgacagtaaaataggctcgctgattgttgaaagaaaactcacttattattttggttctggcccgaatatcgttgctattctacttgagaatgatttcccgggtaaatataatgctggtgatttattaataatcaaaagaggtaattaccagaacaataacccaaagttatgtttcgatcaaagacagcaactgtttcatattaaagaatttaatagtgaagttacgacaaatttgatggtgattggagatataatggaagagcggttcggatatgggaaaaaaatataa

SEQ ID NO: 1501 - DNA, 858 bp, Xenorhabdus bovienii
  Coding sequence Name=Xb4151_4152.C427.gene12.dna; Position on contig =11914..12771bp; Strand=+
atgggaaaaaaatataaattactgggatttaacggtcaggatagtacagcgaatgtattaattttatcaacaggaaaaattttaaaaataaacgtaaaggagcttgagaaaagtgaaatagcagacgatctagacaatcatgaaataaaatcactttatagaaagatatattctagctttccaaacgtcccctcagtctatgaaattgaagaacgtaatgaaaaatcttgggttgtttattcatttctcgcgttactactgacaattttctacactttcagtaatatagcggcagctaaacccgtttacattgattatcttgatatcattgttaccccaggtactttcatttatcctttttcatttttagtcattgatttactgagtgaattctatggattcaggctagcaagaaaagcgatatatatgtcattggcttctaatctgattattgtatccttgctgagtatctcgacaagtctacctgccatcgcaagctgggatttaaatgatcagtacaatgccctgatgagtcatattttatcggcgatctttgcttcttcgctgtcatttctagtttcagagcttgttaactcctatatattatgtaagctgaaggatgtgacaaactcccgatttttagcgttaagagtgttttttagtacctttatcgcatcaattcttgacagttttgttttctgtttcatcgcattctatggaaaacttcctgtaaatcaaattgttgtcatgatgattgttcaaattttaattaaaattttctttgcattatttaatattttccctgcttacggctcacgttatttatttaatcggtgggttggtaaaacagcaaattaa

SEQ ID NO: 1502 - DNA, 537 bp, Xenorhabdus bovienii
  Coding sequence Name=Xb4151_4152.C427.gene13.dna; Position on contig =13460..13996bp; Strand=-
atgagcaaaaaagaacatatcttagatatcgctgaatccctgtttaatgaattcggctataacgcggtaggagtcgatctgatccgagataaggcgaatgtgtcaaaaacatccatgtaccgctatttcggttccaaaaacaaactgatagagagtatgttaatcagacgacataagagatttgaagaggaactcaatacggtggtatttgccactaagggaacggaaaataagctgaatgctatccttgactggcacttctcatggttcagatcagccgattttcaagggtgcttatttatgcatgccttagccgagttcaaaggccacgatgagctgattgtcaaacaggctcaacggcataagacatggttaaaatcactcttatcttccattttctctgccaatcagacggatgcagaaatcaaaacagaagccctgatgacatttatagaagggatgatagttagagcagagtttggcgaaatgacaggccacgagaagatctatcgcctatctgccaagatactggtctga

SEQ ID NO: 1503 - DNA, 531 bp, Xenorhabdus bovienii
  Coding sequence Name=Xb4151_4152.C427.gene14.dna; Position on contig =14173..14703bp; Strand=+
atgagtaaattaagaggaggaggtggattaccacctaagccggatcttgttcaactaacgaaagggttatcaggcggctttttggggatcttgttgctcagttatttaagccaaacaacggaatatccttggttaatggcgccttttggagcgacatgtgccattttgtttgctgcaccaacttctccgcttgctcaaccacggaatgttattggtggacatttactcactacggcggtggggcttgtcgcactatatacattgggtaattccatgattgtgatgtcactggcagtcggcattgcgattatgctgatgcagttattccgggtagttcatccgcctgcgggggctaatccgttagtggtacttctcgcagggcaagaggccgtgggttttgattttcttttaacacctgtattaacgggcagcttggcactggtcatcattgcatcttttcttaataacctaggaaaagagagttgttggccattatattggtatggttttaccaaaagaaaagatagctga

SEQ ID NO: 1504 - DNA, 11367 bp, Xenorhabdus bovienii
  Coding sequence Name=Xb4151_4152.C427.gene15.dna; Position on contig =15744..27110bp; Strand=+
atggataacattctggcctcgccatttacacgcctattttggaatgaatggattcttgaacctgattcagttaaatacaatatggttatggatcaaactatccaaggtgatttggatgaaagtaaattgagatcggctatacagggattgataaatcaatatccattatttcaatatcagcttgatgaagaaaatggggaattatattggaaaccgggtccgaatagtcttaataccctacaaatttttgacagtgaggaaaaactgcgtcagtttgccttgcagccctttgatttaaggcaagggtcactgattcgatttgggttatttcagcaggcagagcgacaatttcaattagtcattgtactacaccatattgtggtagatggcgggagtaccgaagagttttatcactccatatcggatctctataatcagcgccccctgcgccacactcctctgacactggatcaaattgcggaaaagtttgcacaatatcgtcagcagataaaaacactggaagagcatcagcctgaacagttctggaaaacatgtttgacggaagtggcagcaactaatccgctaccctatctatcagaactggcggaagacgaacaagagttagtgggagaagttcgtttcaatttgccattaaatgattggttacaccttaagcgttctctccggcactgtacgccatttctggtgttcaaaacattgtgggcggcactgattgctcaatatatgcctgatggaaaggttcacgtcagttatccggttgccgtgacaggaggagaatcgctttcattgggtgcccaaatcaacaccgctgtttttcccttacagttggatgatacggtcagctttgcttcgctttaccgacagacgttacattacacctcatcattgaaggcaccctccggcctgcgtttctcatattggccgctttttaaggtgttgccctttacgccgatccgtaagttaaatgttgttgtgaatcaagcccacttcaaggatttctgtctggaactggagggttgtgaagtccattacaatcaccgtttcgacaacgacttagcagattcggaatgggcgctggaatatcagcagcaggatgatcaatggtctttccgtatccgctatccccgccgccgtttccatcctgaacaaattactgccttggccgaacagttccagcaactcttggttaatgccctgacaaatccagaaaaaccgatccgacaatttccgttcctgacaccggatcagcgtattaccttactgaaatgcggtcatcagggagaacagggggatgttcccgaaacaacgatccatgaaaaatttcaacagcaggtttgcctgcatccacaacaaatcgcgttgattgataatcagcagcaactcagttatgcggaattggaacaacgtagtaaccaactggctcatttgatacgggagcgttatctgcaagcgactggacaatcgctgtccccggacaccctattgccgatttttatgaatcgtggggttgatatggtgattgccatgttggcggtgatgaaagcgggagcggcttatctgcctcttgacccgcaagtcccaacgcaacggctggcctatatcctgaccgatagccaatcccggctggcaattacagacatgacgcatcaaaccatattgcgcgattacgggcaaaatctggctttgttgacattcggaaacgactgggatgattaccgtgatcagccagacagtgctccgcaaacagcctcagagccgagttcattagcctactccatctatacatctggtacgacaggccgtccgaaagggactctgctggagcatcgtggagtattactcatgctggatggtctatatgccagagtgattgagggtattgaacggccacaacgctggttgcagtttgcttcgctggcatttgatgcccatgtgtttgaaacttttatggcactgtgtttcggccatacattggtgattgcttcagaagaagagcgtcatgatcctgagctgctgaaaaaattaatcgaaacttatcaggttgaagtcgccacttttccccccaccttgttgaaaacaaaaccggcgttgcctgcccggttacaaaatattctggtgggaggcgaagcaacacctcaaaccattctggatcactacgccatgcagggacggcggatattcaacgcctatggccccacggaagccagcgtatgtgtcactatgcaccattatcaatgggatggcgcccaaaatattggccgtccgtttcccggcattcaggcttatgtcttggatgaacagttgcagttagtcccgatgggcatgagcggtgagctttacctctctggcgctgtgctggccagaggatatttggggcagccggaattaacagccaaggcgtttattgccaacccatttgctcaacataccgatgatcagcggctctatcgtacgggagatcaggcgcgttggttgccgaatggggaactggaatatctggggcgtaaggattttcaggtaaaaattcatggctatcgcattgagctggctgaaattgagcaggtatttattgcggcatccgggctgagtcaatgcgcagcgcaggtacgcggtcaggatcgctcgcatattgtgctctactatgtgtcagagattaccttaaacgaagataacctacgtcgtactttgcagctttccctgccggattacatgatgccatctgcattcgtgcaactggcatcgctgccgatgacgattagtggcaagttggatgctacggcgttaccagagccagattttaaacagagccgctatgtttatcgtgccgcagaaacggagttagaacaccggttgcaaaacatctggcacgggattctgggtttggacgaaatagggattgatgacgacttttttcatctggggggcgattccatttccgctatccggttggtttcggaaatgcgtcgccagcagttgccatgcagcactaaactattatatcaatgccgtacgattgctgaactggcggtacaactggctaccactcctgattcccagatgatgcattctgaacagggaatactacagggtgattttcctcttcatcctattcagcattggtttttcgaacaggtatttgctgagcctcatcactggaatcaggcttttctgattcgggtaccgcctttacaaccgcacaaactggaaacagcgattcaggcactggtggaacggcacgatatgctgcgagccagatttattcccgctgaacgccagatttatctagatatcaatcaggtcgcaccaatggcgctggaaatttgccattatgatccgttgactgatggcgcactccatgactgtctggatagctggcaacgtgatttcgacattacggctggcccactatggcgttttgcttatattgatggctatccagatggttcagcccgcatttactgtgccttgcatcatctgattgtggatgctgtgtcatggcgcatcctgcttgatgatttaaaacagctttatcatgataaaaacctcggcgccaaaacagccagctatcggcaatggcagacagccttgactgaacaactttccggctttgaatctcagtgtgaattctggcagcagcaatgtgtttcacaatctgattaccggccattattggaggccagccacactcgtcaattcctgcaacaatctttagaacctgccgccagtatccgactgctgagtgtgaccacaggtgcggcaagttttgcgcctaatgaagttttactgactgcgttcctgcacgtattgggtcatctcagtggaatagcgaaccatacgttgcttctggaaggtcatggccgccatctgccatcggtacagttggatgtgggtcgtactgtgggttggtttacggctctctatcctctgcatttttctgctgaaggtgaagaggcgatttcattgcagcaagttcatgccacccttggcggcgtacccgattcaggtatttcattcggggcactgcgtcatttgggggctgaggcgtcggcattgtctctgccatattccggggtgatattcaattatctggggcagttacaggcgcctgaaaatgactggcaaatcagtgcagaatcggccggacaaaccatcagtccgcgcaatgttgattccggtttacttaccctcaatctctggcttatcggccaagagctgcactatcgttgggatggcttactcagtcagtcgcagcttgctcagttggatcacggtttccaaacagccttgatatcgcttatcgacacgatggcaccatccgccagtaagattcagcagacagtggacgatgggattgataccgcactactggcccgattaccggcaggattgacaccagtggttgcttatccggccaacagcctacaacaaggatttatccatcattatctgagtcatcccgataactcgacttatcattttcagtttgtcctggattacgaacaaccgatcgatctgaatgattactaccgcgcttgggaatacgcccagcagcgatatccggtgttgcgtacaggctttgactggcaggaacagccacagcaaattgtgttcaggcaggctgaattattatggcaataccatgatctcagtacctgttctacacaggagcaagcattgactgcgctttgtcagcaacaataccaccaatctttcgaactgaataaaccagagctgatgcgggtttgtttcgttaaactggccgccgaccgatacagcctgatccacaccagtcatcacattattattgatggctggagcagccagatattgctggaatatgtccatcgtacttatcagcagctacaggcgggacaaatgccggatacccgtaccgatacagcttatctggcgacccagcgttattacgcgagtcaaattgcggagtgtcgtcaccactggcaacaacggaatacccggcattgggaaagcacggatatttccctgttgtttaaccataatttatccaataccacccgcaatgacgttcctgagactcaagccaccgcgcatcacacattacctcatgctgacgctttgtcattacaggaaaccgcccgtaatcatggactgacactcaatatcatgctccagttcgcctggcataagctattgcatctgttcagccaacaatcacagaccatcgtcggtatcaccttgtctggccgcaaccatcccgtatcaggtatcgaacatagtgtcggattattcatcaataccttgccactggtaatggactgggaaccgcaatcgacctgtctgcaacagcttcgcacgcttcatcaacgcatgattgatttggatacctacagctatcagccactggctgaattgcagcccgcaggtgaaaagttgttccaatctatttttgtctatgaaaattatccaacgacagcattggataccctgcggggcaatctgcggactgccagtggcaataataccgactatccgttgaacctgatcgctgagggtaatgtagagcaaggattgacgctatctctgtcctataaccagaattgccttgatgctgaacgcgccaatgccattttgcagatgctgggaacattgctggcgcgtcttccttcccatcttcactatccacatccgcagttattagcgctgagtgatgacaaacgccgacaactgctagaagaatgggcttttgcggttgatcaaggcttggaattgatgactctgcatggtttgctggaaagacaggcacgattgacaccacaaaatccggtattaatggatgatcaccggacattgagctatcaagaattggatgagatcacatcacatcaggctgttcggttgcgggcggcatatcgtcgtctttttcagcgtgaattagcgtcaggtgagctgataggtctgtgctgcgggcgcagtatcgacatggttgtagcattactggcgattctcaaagccggggctgcttatgtgccgatggatacaaatgttccggcagagagactgaattacatcctgcaggatagccaaatcaggttggtactgacagaacccgatttagcacctctgtttgagcgtcccgatctacaacagctatatctgagcgaattggcggatacagaggcaacggatgatatcccacaaccgttgccgcaggtggaaccaaggcaattggcttatgttatttacacatcaggcacgacaggccggccgaaaggtacgctggtagaacattgtggctctgctgctatggcgcgtagcctgtttgccagaatggaaatggaacagtcaggtgttcgcttcctgcaattttcttccattgtgtttgatgcccatctgatggaaattttcccggcattggttgggggacactcgctggtggtagcatctgacgcacagcgttatgacttacaggaattacaaacgttattgcagaaatggcagattggttatgcgatgttgccgccagtgctgcttaaactcaaaccgacgttgccggccagcctgcaatggctgatagtgggaggagaagccacgtctcaggatgtgttcgatcactatgcggatcagggaatcaatgtattcaactgttatggcccgactgaaagcagtgtctgctgcatcgttaacccttatcgttataatggcgcgcgcaacattggcagaccattggcgcagtgtgcggcttatgtgctggatagtgatttgcagccgttgccggtgggtgcgcctggtgaattgttcctatccggcgtagggttagcgcgtggctatttgaatcaaccagaattaagccgtgaaaaattcattcctaatccattccaacagcacccggatcatgcccgcttatatcgcacgggcgacattgtgcactggctggatggaggctcgttggaatatctcggtcgtaatgacagtcaggtgaaaattcggggacatcggatcgagcttggagaaatcgagtgtgtgctcgccaatattgagggtgtcgatcaggctgtggcgatcattcatggcaaggaatccccaaagatcgtctgttattatacggtaagcccgttaaacagtagtaatagcattgattcgtctgagatccggcagatattggcacaggtgttgcctcactatatgcaacccagtgcgttgattccattgccccgtattccgatgactatcaatggcaaactggatcgccgcctgtgtcctgcgcctgtttttacggatgtacagcaggagtacacggctgctgagacgccgctgcaacagcagtgttgtgatatctgggcggcgttgctgcaatgtgaacgtatcggcatagacgataactttttccggctgggcggcaactctattatagctatccagttgagtaatcgtttgagccagttattgcagtgcaccatcccattagtggcgttaaaccggcatcctaccgtcagatctctgagcgcgttcctgtccggtaattgcacgcaccttgaccagataccccaagcagggttgcaacgggggagcctgtcttttgcacaattacgcctctggtttatcgaaacgctgatgcaggaaaacaatgtttaccacattcccctgctattccgcttgcagacagatatccagacggacagttttgtccatagcttgcaagccgtggtacaccgccatcagatattacgttgtacctttgaacaagatgaacacggaaaatctttcctgcaagcccatgatgaggcactggctgttgtccatgcggaagtgcaggcggatgaatggcatgattttctgcaaaaagagatcttccgtgtatttgatttacgctgtgaataccctatcagagcgacgctgttacaacggactgaatcagatgggcaagtgtctcatttctgcctgctcaacattcatcacattagttttgacggctggtcgttgaatgtgttcttaaaggagctggccgagttctatggcgctgaattgaataaccgcccacccgcactgccgccgttatccatccaatatatggattatgcagcctggcagcagcagatgttgtccagcgataaactggaacagttaaaacaattctggctgaaacagttacaggattgtcctcagttggaacttccctgcgactatccgcgccccgatatttttgatcatcgtggcagcacgactttcttctccctgactcctcagttaagccaccagttgcggcaactggcgcgccaactggatgtgactttacatgcggttttgttgactggcatgaatctcctgttggtcaggtattgcggcaagcacgatattgtcatcggtagcccgatagccaaccgttcacatccgcagttggagccattgattggcatgtttgtcaatatgctggtactgcgtaatcaggtatcgtcagagtggagcgttgctgaacaaattcgtcaggtttttgccagcacgattaccagccagcagcatcaagaaatgcctttcgaaaaactggtcgaatttctgaagttaaaccgtgatttatcacgccacccgctgtttcagatctctttctcgctggaacagaaagcgacggatgttgatgcacctttcagcatgcaaaatctggcggagttatatgatgtcgccaagtttgacctcagcttcggatttgaagaggggaatgatgcgctgtccggcaatattaactacgccaaagcgctgtttgcaccagaaacgatcaatgaaatggtcaggcacttccagaatatattgatgcagatggtggctcatccggaacaattagtgcaagacattagcctgtattcaccggaagagagaatagctctgttgcaaccgccaatggaaacgcaggatgctgctctctacagttatccattgtatcaggggcttctcgattggactcggcagcagccgaatgatatcgccctgattgatactctcggtcagtgcagctatgccgaagtacttcaggctgcgcagacactggccgcgcagatccatcaacatccgcgtaatcaatctgagctgatcgtcattcaggtaagcaaaggtagggcgcagattattgctgttctggccgtcttactggcgggacgagcctacgtccccgttgatatttcatggccgcagcagcgctgtcagcagatcattgatcagactgacacgcagttggtgatcagcagcaaagcgtgggcaaccgaaacctgcggcatcatccaacttgatccgtacggctgcgccattaacttaactgagcctcagccgatgtcattacccgtgccgatcgcctgtgacagtctggcttatgtgatcttcacctctggctctacgggaacaccgaaaggcgtagctgttcggcatgacacggcctgtaacacattgatagacatcaaccgtaaattgaacgttgtgcggggagataccttactggctcttaatgccctgtgctttgatttatcggtatatgacatgttcggtattctgggcgtggggggaaggctggtgatcccaagcgaagagcagcgataccagccagagatcttactcagattaatttgtgaacacagtgtcacgatctggaatgcggcaccggcgttgttcgaattgctattgcaggaagtagaaaatctggcagagcggcctactgttgcgatggatcgcgttctgttatccggcgactggataccggttaatcatataccgcgctgccgtgactggctccccggttgccgcgtctttagcggtggtggcgtcacggaaacttcggtgtggtcgattctattcgaagtgccacaaggcgccggctatagccagagcatcccttatggcaaggcactggttaatcaatactttcttattctagataaagatctggaacctgtacccgctcaggccatcggtgagatgtatatcggtgggataggtgtggccattggctactatcgtgatccggtacgtacagaagaacgttttctgtatcatccgatcagtggtgaacgcctgtaccggacgggagatttagggcgttggctaccggatggcaacattgaatttctgggacggatagacagtcagatcaaaattaatggttatcggatagaactgggggaaattgaaaatacgctgatggcaataccgggcattcgccagtgtgctttggttaaagtcagtggcttatctgatagtctggctgcctattatgtcagtgacgaaccgctggatgaaaccgatgtgcgtcagcatctcgcacaagtgttgccgccgtatatggtgccgtctgtgttgacgcatctgccaaaactgccgttgaatgccagtggcaagatagaccgtaaacaattgtcggcattaaattacattgcgccaagacagcatcagtatcaaccgcccgagaccgaacaggagcaacaactctgtcagttatggcagcagaaactggagctggatcacgttggtgtaaacgatgacttttttgaatgtggcgggacttccattctggctattcctgtttgtcagcagatgtcggtcttgttgggacaggcggtcactgtgatggaactgttcaagcgacgcagcatccgtggcattcttgcaagccttgaatatcaactgatccaaccattgaataacggttcagctaaagaaacgttatggatgatccatccggctatggcgggatgtgaagtttatctggacatcgccagaacgctggatggcaaactgacgtgtctgggtgtggataattacaacctgtaccaccggccgttaatcatgtcactgcgtgacatagccagtttctatctggagcagatggaacggtatcagccattgacacaaggcccggtacgtattctgggatggtcaatggggggattaattgcgctggaaattgccgcacaactggaagccagaggaatacgtgatatccatctctacctgctggacagcttctatcgggtcagtctgggggctttacatccaagctggcggcagatgctattacaggagctggggctggaaggggatgcggcggtacgagcgctggaggccggccctgcggacgatgcgatttgtcagcatgagcttttgcaacctctacaacatagcccggtcacgctattcaaagcgactcagttgccggagttccacgctcaattaaacgagcagggaaaaatcccggcagcattgcacgctgatgataaccagataggacaggcttgccggcatctgtctgtcataccactgccttgtgaccaccacaatattatcgaactgaaatcacagattattgaaggtgtgttggagctggtggattga

SEQ ID NO: 1505 - DNA, 2088 bp, Xenorhabdus bovienii
  Coding sequence Name=Xb4151_4152.C427.gene16.dna; Position on contig =27827..29914bp; Strand=+
atgaatatagcgtctgttttctctgatccatttaaggaagataatgatcctaatctcgcatttctatttagccaactggaacgtatcgatcttgtactgcaataccatttccattgtataaccgatcagcgcagtgacctccttgatgaatttctgttaagcgaagaagacgtcatagccaggttagataaaccgctgggtaaacctcattgggtcaatgatgattatttggcaataccccagacagtcaaccccgtggcatcccgattaactgacttgattgcccgttttgatctgacagattttgaaagggatgtgttgctgttaggtttattgccccatttcgatagccgctactatcacctgtttgcgttgattcaaggagagcaacaatcccgactcccttgttttgcgctggcattggaactgttttgccactcgccgctggagaaacaggcgcagcaggccagtttcctgcatcgggcacctttgattggctgccaactcttatccgtcgatagccgtcaaaaaaccttgacctggctccagaccgcctttgtgactgacagcggcgtgtatcattttttacttgggcatcactatattacaccagctttagaacattatgctgagtggataacgcccatagaaactggtggttatccgacaggcttaaaacaggcattgggtaacttattgttacctgaccacgaggatattcgatctattgttttattacgcggcactgccggcagtgccagggcccatgtcgtcgccaatatgatggcgtcggaaaagcgacaaacgctatgggtggatatcgctaaattggctgatggcgatgataaaacaactcttttccagataaagcatattttgcgggaaatccgtatgcgtggagcttgtttattattacggaatttctgtttattagccgagaaaaataaacagctactggattccctgtcagcgttattgaatcagcctgaattaagggttatctgtctggtcgaaccgtattctccactgatatggttgaaaaaactcccgacactactggttgaaatgcccgttttcacgtcagtagaaaaaaacagactattaacggccaatttaccgcataactgttcagaggatattgatgttatcactttaagccagcgttacgcgtttaaccctgaaaccctgccattgattttacaagaggcgcagatttatcagcagcagcgagatccttcgggtattttgcagcaatgtgatatacgcaaggcactcaatttacgtgcccagcaaaatttcggccaattgggacagcgcattacccctaaacgttcattaaaggatttgctggtatctgatgaagtggctcaacagatacaggagatactgatggcaattaagtatcgggaacagatcttggcgggagggtttaaagataaaattggctatagcgccggtatcagtgccctgttttatggtgattcaggcactggaaaaaccatggcggcggaggttattgctgactgtattggcgttgatttaataaaagtcgatttatctaccgtcgtgaataaatacgttggtgaaacggaaaaaaacttatcccgtattttcgatttagcaaaacaggatgcgggcgttttattctttgacgaggcggatgctctgtttggtaaacgtagtgaaaccaaagatgcacaagaccggcatgccaatatcgaagtctcttatttactacagcggttggaaaactttccgggtttggttattttatccacgaataaccgtaaccatttagacagtgcatttaaccgacgttttacttttattacccgctttacttatccggatgagaaaattcgtaagaaaatgtggcaatcaatctggcctaaaaatataaaattatcaaaagatatcgatttcaataaattagctaaagaaacaagcgtgacaggtgcaaatattcgcaatgtcgctttgttgtctttatttcttgctgctgggaaaggtaatgatgaagttaataacgaaattattgaaatggcattggtacgggaattagctaaaatggggagattaagtttttga

SEQ ID NO: 1506 - DNA, 291 bp, Xenorhabdus bovienii
  Coding sequence Name=Xb4151_4152.C427.gene17.dna; Position on contig =30382..30672bp; Strand=+
atgtttacttcaaaagaattactaaattttattgctgtagctaaaaataaatcaataaataaagcaacacaggagcgttttatcacacagtcacccatttgtcgtagcttaaaaaaattggaattttcattaggtgtcaaactttttcaaagaaaaagccacggattagttttaacagaggaaggagaatgcttatataataaagtttcaccaatttgtgagcagcttgaaaatattgaaaatgattacaagaatcataaattaccctattgttctgtttatcaaaaatag

SEQ ID NO: 1507 - DNA, 288 bp, Xenorhabdus bovienii
  Coding sequence Name=Xb4151_4152.C427.gene18.dna; Position on contig =30935..31222bp; Strand=+
ttgcttggcacggggattggtacaggaatcaatcttcttggtaatatggcggttgacaaattagatgagaaattgaagattgcacacccttaccctaaaacaatgaatatgatatttgatataaataattatgataaaaattttgttactaaaaccattaaaaataattttcaaaaagataacctaaaagacaccgttggcagcgggatagtatcaggaattgcaggtaaattaagtccagtaaaaatccccatatataaaatttccgactttggctgtatcacataa

SEQ ID NO: 1508 - DNA, 177 bp, Xenorhabdus bovienii
  Coding sequence Name=Xb4151_4152.C427.gene19.dna; Position on contig =31300..31476bp; Strand=+
atgaaagccattcttcatcgtcttcttggcctaaaaatattaggttgggcgtattcgaatgaactctctgagaacaatgaaagtagtactgaaagacatacaagagggtatttaagtggtaattcagtatcaattcataaaacaggacggcagaaatgtttatgtcatgttgagtga

SEQ ID NO: 1509 - DNA, 180 bp, Xenorhabdus bovienii
  Coding sequence Name=Xb4151_4152.C427.gene20.dna; Position on contig =31768..31947bp; Strand=-
atgctttcgttatgtgcttattctgactttaaagagattacgttagatttgtttatgaaggtgactatatcaggtgtatttaatctaacagagggttttgagattagtcaaccgcaatataacactgacagaacagacacaaatattcatgtggtggttagctttggtcagagatcctga

SEQ ID NO: 1510 - DNA, 1437 bp, Xenorhabdus bovienii
  Coding sequence Name=Xb4151_4152.C427.gene21.dna; Position on contig =32060..33496bp; Strand=+
atgaattatgatgtgattgttgtaggatctggtgctatcgcaggttcaattgcttatgaacttgttggtcgccaattgaaagtatgcaggttggggcgtcttgatcgtagcaatgcggcatcgagagccgcaggggcaatgaatggttgttttggtgaagtgaccagtggacttattgcgagcgattacggaaaactgaaactcaaaatggaccgtatcgcgaaggatcgctggtcaacatgggcacagcgtttggccgcttcttcgggagatactcgccctctgtttaccgcaaaagggactcatgtcattcttaataccgccggaatggaggttgttgatagtgttaattatgatgctatagagagtgttcttcgtgaatataatgagccttatgaagttattgagccgcgatcgattaagggaatgaaacctaacgatttggtgcgttcgcttaaagggctttatattccagaagaacatgcccttaattcccatctattgcttgaaatgttggatgcggcattgctccgggaaggtggagaaatcgtcgataacaacgttaaacgcgttctcacagaaaatggaatcatagtgggcgttgaaactgtcgatggagtacgttttaccgcaaataaagtgattattgcggcaggtgtgcaatccctcgatatattatcagaccagacttctattgtgcagaaaattccaccactctttgccggctatggtgtgtctgttttactcaaagttaaaaatcctgatgagttaccgacatccgttattcgtacacctaatcgggcatttgcttgtgggttgcattgtgttccgcgtagtgatggtgttctctacgtcggcgcgactaaccttttgtccaaccagcctcgtacacatgcgacagttgctaccatacagttccttttggagtgcgcttacaaccagataaatgttgatctgtttgaatcagagatccttgccattcaggtgggtaacagacccatctctgcggatggttttccattaattgggtcgtgtggcatagacgggctgtggcttgtaacgggtacataccgggatggcctgcatcaatccccgcttttagcggattatgttgcgaatgcactcatggggctacctaatctggagattgatttggcggattttacacctattcgccggcctttagtggggctgagtcgagatatgaccatttcggaagcggcaaagcaaacggtagcgatggggtatgaatttatctggaatcttaaaccagggtgggatgaattaatctataaatctttactcaatatttatggtgcacaagttgaatctattgatgctatttatacgcctcccccggatttggttgcattctcttgcaaggatgaacagataacaaagcggctacgtgattactaccgttgttggaagaaataa

SEQ ID NO: 1511 - DNA, 99 bp, Xenorhabdus bovienii
  Coding sequence Name=Xb4151_4152.C427.gene22.dna; Position on contig =33861..33959bp; Strand=+
atggaggcttttcaattttattaccactgggaattagattatctgcggcaactcgaaaaactggtcggtgaggaaaagggtcatgtattaaatgattag

SEQ ID NO: 1512 - DNA, 276 bp, Xenorhabdus bovienii; identical to SEQ ID NO: 154
  Coding sequence Name=Xb4151_4152.C427.gene23.dna; Position on contig =34377..34652bp; Strand=-

SEQ ID NO: 1513 - DNA, 1011 bp, Xenorhabdus bovienii
  Coding sequence Name=Xb4151_4152.C427.gene24.dna; Position on contig =34705..35715bp; Strand=+
atgaccccggattatgtcaaagattcggttagagaatcgattgaagatcatgctaaaagtcgtaatcatccagatgcaacactacaagataaaggatttgttactctgagtaatgatgttggcagtgatagcgaaaataatgcagcaacaccaaaagcagtgaaagcagcgtatgatttggctaacacagcaaaccaaaatgctaataatgcaggagctaatgccaatactcgtttagccaaggagcagaacggggcggatattcccaatacgccggagtttgtgaaaaatattggcttagataatgcgctaaaggttggggattatggaataggaggccctggtatcacagtagaaccaggtcaaactgtggaggatttggcaggaaaaacaggattttatcagagggggtcatcgccaataccacctgattccccgcgaggaacggaggcaatgaaatatttgtcaataggacccggttggtgggctacgcaattggcattcgatgcatatcgtaatatagcatggatacgctccagaatagcagcgagcaaatcttttcaaaaatggagccaattctccatattgggagtaaacaccttcatggatgcaaatggtaacttcaagttatcctcatccataatcaatctttggagtgatgggaaatttgaaacaaataatgagtccaaaggagctacagtagaacgtatttccgagggtatataccttattaaaggtgttaagggatttaatatcgatggaacaatgaataatatagagatcccattatgccagaacaagctgccattaatttgggtcaaccatgaagtactctccgatggtactgtcaaactgatgacctaccaccgggaacactccgacgcaccagcattcgccagaaatacacgagaaggctactctgatggtgatttgattgatattcccagcggccgatttgtctctgttcgagtgcaaatgccagccactgaggataaagaatcacaggcttaa

SEQ ID NO: 1514 - DNA, 372 bp, Xenorhabdus bovienii
  Coding sequence Name=Xb4151_4152.C427.gene25.dna; Position on contig =35758..36129bp; Strand=+
atgtacgattggtctggaagtgttcccgcgaacgctgaacaaggtcaacccaccggacttattcttctaaaaggggatataatatctatcattgccaagggatggataaagttcgggagtgcaaataatgaatggagtgcgccccaaggtgatacaagaagcattccaaaaataagctatgatctaagagcaaaaattgctgacaaaacttacgggattggtaatggggttcttcataaaacggttccagtagatggcgagttaatccttttatatgatgattcccccggtgaatataataataactctggtgaatttcacgtcaacgttataatagagtcccgatattctcctctcgaagaaataaaataa

SEQ ID NO: 1515 - DNA, 126 bp, Xenorhabdus bovienii
  Coding sequence Name=Xb4151_4152.C427.gene26.dna; Position on contig =36308..36433bp; Strand=-
atgacacaaagtacaggcacagcaacatatgacatcactgttggtatcaaatatgacactgacacactgaaccagcttgagacacaactacctaagatccagacaaaacacagccccatgcgatga

SEQ ID NO: 1516 - DNA, 372 bp, Xenorhabdus bovienii
  Coding sequence Name=Xb4151_4152.C427.gene27.dna; Position on contig =36908..37279bp; Strand=-
atgacaaaccaagatattgaaaaagaaactcaagaaaaaggcaaaacagcaccgcgtattactccgcagcacattgaagatactattacttatgaaatgtatttcactgcttacgatggattctctgcttcagctaaagacaatccagatgcggtgtatgctcctattggagtgagaataaacgcaaagactctcactttttgtgttcttacactgaaaaacggcttcactgtcaccggtgaaagtgcatgcgcaagccctgaaaacttcgatgccgaaatgggtcgtaagattgcccgtcaaaatgcagttaataagatttggtcattagaaggttatttgctcaaacaaaaactgcatgatgagaaataa

SEQ ID NO: 1517 - DNA, 441 bp, Xenorhabdus bovienii
  Coding sequence Name=Xb4151_4152.C427.gene28.dna; Position on contig =37308..37748bp; Strand=-
atgaagtggaaagttaaagctgtttcagtggtagtcggtatcgttctgattggttcggctgcatattccatctattcagtgtatgtggaaaatggacggctcacagatgagaaaaagtcactgactactcagctatcagagaaaaacgccatcatcaccaatcagcaagagcgcatccagcaccttgctgaactggacaccaagcacactcaggaactcaccaatgccaaatctgaaattgacactcttcgggctgatattgccgctggccgtcgcaagttgcgcgtccaagccgtctgcccagtgcctgaaaccacttcctcccgcagcatgggcgacgcaggaaccccacaacttacagaagcagctcgacaagattattacgatctcctccgaatgatggcggagaacgagcggcagacgaagtacttgcaggattag

SEQ ID NO: 1518 - DNA, 174 bp, Xenorhabdus bovienii
  Coding sequence Name=Xb4151_4152.C427.gene29.dna; Position on contig =37745..37918bp; Strand=-
gtgaactcctgtgctggatggcctacgaccaaggcgttaggtgtcgatcatcatcaggtgattacggtcgataaagtgacgttgattgtgttggccaagtccatcatccggcacgagaacggcaagcaaccttattcagaggcaacgtttgagaaagcgtttgagcttttatga

SEQ ID NO: 1519 - DNA, 984 bp, Xenorhabdus bovienii
  Coding sequence Name=Xb4151_4152.C427.gene30.dna; Position on contig =38470..39453bp; Strand=+
atgaccatgaccatgaccatgaccatgaccataagcattaggcttactgttgcagtaacactgcttgctgcaacgctgcctgtattagctaaaatgccagaaaactttatttataccagctctggtgacctcgaaacagcgtctgtcattatggcgcgtagcgacattggcggtgcgcagatcgtttacaattggcgtttactcgaacctgagaagaacaaatacgacttctcgcagattgagagggatctggctcgcctcaaggtagctaataaaaaacttttcatccaaattcaggaccggtttttcgaacaagatgcccggtacgttcctgattatctgatgaatgatgccaggtatggcggtgggatatcgccacaatttgataatcctggcgaagggaagccaattgggtcgggttgggtagcacagcaatgggatcctgctgtgcgccaacgttatcaggctttgttggcagcgattgcagagcgtttcgatggtcaagtctatggtgtcaacttacccgaaacagctattgattttgacaagaaaaagctacccaaaggattctcctgcgataactatttcgcaggagaaatggaaaatctcacctttgcgcgaaaggtgttcaccaaatcacatgtagtacaatatgtcaatttctggccgtgcgaatggaacaacgaccacaattacatgggccggctgtttgagttcgccagtgccaataatattggacttggtggcccagatattgttcccaaccgcaaggcgcaaatgaagaactcatacccgttcttcaataaatacaaaagcaaactggcactcattgccatggcagtacaggagccgaccttgacctacaagaaccctaatacgggtaagccatttagcaaggatgagtttgtacaatttgcagaagattatctcggtgcagatatcattttttggagcacgacgtctccctggttagctaagaaatag

SEQ ID NO: 1520 - DNA, 642 bp, Xenorhabdus bovienii
  Coding sequence Name=Xb4151_4152.C427.gene31.dna; Position on contig =39548..40189bp; Strand=-
atgaaaacaggcattccatggcgcggcctgccttccgaattcgggaaagggaatagtgtctttcagcgttttgatgcctggtcaaagaaaggtgtttttgatttattattcaaagaattatctaaagactctgatacggaatggctgttcattgatagcagcattgtccgcgctcatcaacacagttcaggcgcaacatcaaagaaagatgaagcgattgggaaaagccggggaggacgctcaaccaaaatccatttagccgtagacagttatggactgccggtgaattttgaattgtccggagggcaagttcacgatattgttcatgcagaaagtttggtggtgcagtcaccgccttcgggcgttgtgatagctgacaagggggtacaatgtcaggcattcagaactgatatcgaacaacaaggggcaacaccagtcattccctaccgaaaaaataatcgaaaattggatcaaaagattgacaaatgtttatattgttaccgacatttggtggagaatacctttgccagaatcaagcattttcgtgtaatagcaacaagatacgataaacttgaacggaattacaccagcacattggtactggcgtttattattgtctggttgccaatgtgggttgattga

SEQ ID NO: 1521 - DNA, 543 bp, Xenorhabdus bovienii
  Coding sequence Name=Xb4151_4152.C427.gene32.dna; Position on contig =40456..40998bp; Strand=+
atggatagtcaactgtctggaatactgctgcttttggttggattatttttttctgcaaccgctatggcgatgccaatacaaaacgacgagatggcttcattggttaatcagcgtttgtcttacatgaaggatgtagcaggatacaaagcgaacaatcatcttgccattgaagatttacgtcaggaagccaaagtattatccagctcagtgctcgaggcagaaaagttggggttagatggtgagtcggtaaaacccttcatacaagcgcagatggatgctgccaaggcgattcaatatcgctaccgtgctgactggctatctatatcggaaaaaggttggcaacctgagccactggagcaggtaagatcaaaaattagcgtcttaaacaccgacattcttactgaggtcagtacgagattaacaacgggtgatctatttaccgacaaaactgcctttactaaagtacttgaccaaactcacttaaaagacggcgataaagaacgcctatggtcctcaatgaaacaaatcactttgaaaaagtag

SEQ ID NO: 1522 - DNA, 912 bp, Xenorhabdus bovienii
  Coding sequence Name=Xb4151_4152.C427.gene33.dna; Position on contig =41430..42341bp; Strand=-
atgatcgcaataccatcacccattaatcaaacagcttatatgtccaccatcaaagaactccaagtcgctatctcaaacctttctatttggcgcaaaggcgatcaacgcgcaccacataagccattgttgttgctttatgtgctctctcaatatcagaaaggccatgagcgactgtttgattatggtgaggagatccaccagccattactggcgttgctcaataactttggcccaagacgcaaaagccactatccctctttgcctttctggcgcttacgcggcgacgggttttgggaattgcaaaatagcgaacgctgtacgccacaaaaaggtagcaaagagccgccaaaacgtgagttgattgagtttggcgtcaaagggggcttcgaccaacaaagttatcagttactacgcaagaaacccactaccattaataaactggcacaacaaatcctgagtgaacacttccctgacagcatacaggagcttctcgctaatcaattggatttttctttaagtgatatccgcaaaatacgtgatccgcattttcgccagcagatactgcgcgcctataactacgaatgtgcaatatgtggctacaatctgcgccatgacagtactcctgttgggctggaggcggcacacatcaaatggaaacaatacggcggcccctgtaccgtcaataacgggcttgccctctgttcactgcaccattccgcatttgatatgggttcaatcagtattgacgataatatgaaattattagtttcagaaagtattaatggtggcccgatggtaaaacaacttttttggaattttgcaaaacagccgatattacttcccaaaaacagagattatttacctttagaaagttttattacctggcatcgcagccaggtatttaagcaataa

SEQ ID NO: 1523 - DNA, 918 bp, Xenorhabdus bovienii
  Coding sequence Name=Xb4151_4152.C427.gene34.dna; Position on contig =42564..43481bp; Strand=-
ttgtataaacagaaaaaaaagagagataatcgagtaatttccctgagagatcccatcagaaataaaaagatagaaatcaccctgcatcaggagatggattttacagattgttatcgtgataataaagttatcttatccaagagttatatttgtggcattaagctcaaaatcttcggcaaggatgaagaacattccaaggatgaagaacattctaaacaaattaaaatggagtttcttcttcccatttgttacgctattaataaaattcatgcaaaagttaataacttatctaaaatagtgagaagtattcacatttatatagaagaggaaaaaggaaaaactgaagttagatggccagcaagagaagacaaaatagcagataatacatcgataacaaaaacaggaggtacagtaggtattggcctcccccatcttcatataaatgctaaaaaagttaaggaaataaaatctcctcaatattccttctggagaaggaataagaatataacaaatcaaattggatggggtgtaccagatcaacttcatcacgaagctatatcagtaagcaggaagtcattggaattgaactccgaaaactcaacaaaggtcattgctaccatcgtacatgaaattggacatatcattcatgcacaacgaactgaatcagaagaaaaattttggctagccaaaaggattgatcaaaacaatatacatattattccggcaaaaattgttgaacaagtgagcggttatgctatagagaaacagaattctaatgagtttgttgcagaagtttttactggtttagtgtatggaaaaaaatacagtcaagaggtattagaatattatcaatattattcagggcctgaactcactggaataaaacttcccaaattaccacctaattggagtccctaa

SEQ ID NO: 1524 - DNA, 1050 bp, Xenorhabdus bovienii; identical to SEQ ID NO: 483
  Coding sequence Name=Xb4151_4152.C427.gene35.dna; Position on contig =43701..44750bp; Strand=-

SEQ ID NO: 1525 - DNA, 276 bp, Xenorhabdus bovienii; identical to SEQ ID NO: 154
  Coding sequence Name=Xb4151_4152.C427.gene36.dna; Position on contig =45087..45362bp; Strand=-

SEQ ID NO: 1526 - DNA, 978 bp, Xenorhabdus bovienii
  Coding sequence Name=Xb4151_4152.C427.gene37.dna; Position on contig =45473..46450bp; Strand=+
atgaaaatagcatttgtcttatacgataaagcgttgcaaagcgggataacgttagcatcggatatgttaaacagtgccagcagcttgagaagccgggtacagcagagagaagaacctttctatatgtctgttataggtgatgtgaaggaaaataacgaacacatagcgcagattacgctacatacccaccataaattttcggatcctgtcgattttgatttggtttttttacctccgatgtggggaaatccgtcaccttctatggctggcagggaagatattatcgaatggttgcgtcggcaaaaagaaaatcaagctattattgttgcgactggcaccggggtatattggctggcgaaagcgggattacttgaagaaaaaactgtaacaactcattggtctttctatggcaagtttgaacgtcggtttccgacggttggtgtaaatcgtaaggcaagcatcacgtattgtgacaacatttattgtgtgagaagcattaactcccaaaccgaactacttgtttacttgatcgcccagtttttcagtgcaccgattgctaagatcattgaaaaacatttcatgcatgaagtatcaaattttcagtcagagccgttttttcaagtgggaggcaacacgcaatttgatgaaatggtgtcgatagcacaaagctatattaagcagcatgtgacttcacaaatcacgattaaggatattgctactcacgttggtgtgtcggagagcaccctgatacgtaggtttaagggacaggtaggtatctcaccacataaatacatgctcgatcagcgtttattaattgccaaacagcttctgcaagataatagcctgactttactgtatatagcgcaattagtgggcttcaaggatccccattactttagtaaagtatttgagcaacactttaaactgactcccgttgcttaccgtaaactggtgaaagccaaagttttccattcctga

SEQ ID NO: 1527 - DNA, 1197 bp, Xenorhabdus bovienii
  Coding sequence Name=Xb4151_4152.C427.gene38.dna; Position on contig =46653..47849bp; Strand=-
atgaaacaagccatgcgcaaacaaataggcgatgttgaaagcctgttcgctcaggtatgcgacagaatagaaaaagagatcgccgccacccgtgtggatgaaaaaaacatcggtagcgcttggccggaaatacacgggagtgatgtggcggaacgcaaagtaacagaacaaaccctacaaaagatcaaacgtcgtggatgtttggtcgtcagacagaactttccacgagataaagcactggcatgggatcagtccatgcttgattacctcgctatcaataacttcgatcgcgtttatcaagggccgggagataacttcttcgatagccttgaagcatctcgcccagagatttaccccatttactggtctcatgcacagatggaggccagacaaagtgaagaaattgcgcgggtacagtcttttctaaaccgtttgtggaaatttgagtcaaacggcataagttggtttgatcccgatatcaacatgatttatcccgaccgcattcgccgtcggccaccaggcacaacatcaagagggctaggtgctcatacagattcgggtactttagagcgctggctgcaacccgcctaccaaaaagtgtttaataaaattttcaccaaccgattcggagaatacgatccttgggatgcagcctaccgtccagaagtaaccgagtacgataacacaacaaaatgctcagtttttaggacatttcagggctggacggcgctgtctgatatgaccctcggtcaaggacttctgcatgttgttcctgtgccagaagcgatggcatacattctgttacggccactgctgaatgatgtccccgaagacgaactgtgtggtgttgcccccaataaggcgcttcccatctccgagaaatggcatcctcatcttgtccgaggattgtgtagtattccatcattgcaggctggtgattctgtatggtggcactgtgaccttatccactccgtcgcaccggtgaaaaatcagcaaggctggggcaatgtgatgtatatcccggcggcaccactgtgtgacagaaatctggcttatgctcaccacgttgcagatgctcttgaacatggcacatctccggccgattttcccaaagaacactatgaaaagaactggaaaggtcgttttacggctgcggatttgaacatcatcggcttgcgtggccttgggttgaattga

SEQ ID NO: 1528 - DNA, 1695 bp, Xenorhabdus bovienii
  Coding sequence Name=Xb4151_4152.C427.gene39.dna; Position on contig =48164..49858bp; Strand=-
atgaatagtattcatagattttctaacgcagatatcaaggcattattcctatttgtagcattcatgttactttatttattgccgggaatttatagtcatactccttggaaacaggatgaaaattatagttttggtgtgatccaaacaatgtatgaaacaggtcattggctagttcccaccaatgccggtgagcctttcatggaaaagccaccgctatattattggacagctactacatttattcatttattgtctcaatggctgcctatgtatgacgccgcaagaacagccactctatttttctccataattaatttttcatttttcattcttctggctcgccgtgcatttaatgtacagaatttcaccaatagtcgcatatggatcgcctttgcactgtatgcctgtgctccggggatcgttcgtcatagccacgatatgttcaccgatacctctctgattaccggcacgacgattgggttatatggtttattggggttgattaaaaacgaaaaaaaatgctattccatattatggctggctattggaactgctatcacaatgttatcaaagggggtattcatccctgggttattatggatttgcctactattaacaccggtttttctaaaaagctgtcgggctaaacaatattggctaaatgcctttttcgcaggggtgattgctctcattttaattttaccgtggccagccatgttattagttgaacacccggacttatttaaagtttggttttgggataacaatatcggccgcttcttagggttttctgttgaagatttgggtgcaagagctgctccaagtcgaattccagaagctgtgttattattcgcattcccggcaggcctattagccttcatcgttattgttaaaaacccgataaaaacacttaccgatcaacggtattttatttttgcagcatttatattactcggtatcatcctgttacaaatatcagcctccagccgtgcgctgtacctgttaccctttattgccccgatggctattttagccacgggcatttttactaaattacccgaaaaaatgtacagcgttctgagtctctgtttttcaatgctgtggtctattctgatcctctttgtatggtcagtttatttactatcactctcttctgattacaaacattggttggcaccttttggaaaatggctgccaatgggctatcagatgcatttttccggttttatattcaccagcgctgttattattaccattatctgggtaactaaaaacaaaatactgtcaaaatctcccgttttgcataccgcacaaaactggctcttagggattgctgttgtttggggattggtatttaccttgtttatcggctggattgattataccaaaggctataaagaggtatttactgatcttaagcagcgtttagcaggggaatataaaaccgatgattgcatgtcatcttattctatcggcgaatcagaggcgccaatgctttattatttcgcccatatactccatcaaagacagaaagattttgcagttccacaaacatgccgctggcttatcgttttatccgaagatattgaatccgctccgacaggcatggcgttgttctggtctggacatcggccgaatgataaaaataaaaatttagtggtgtataaaaaagtaacgtctgaaacagcgcagtga

SEQ ID NO: 1529 - DNA, 1209 bp, Xenorhabdus bovienii
  Coding sequence Name=Xb4151_4152.C427.gene40.dna; Position on contig =51085..52293bp; Strand=+
atggctaatccttaccgcgaacttctcacaacccccggcgtcatggggttagtgatcgcgagttccattgtccgtctgccacaggcaatgataggcatcagcatcattaccatgttggtgcagaagacaggtctttattggctggctggctcaatcgccggtacatttgccctgacgaatgcgcttatcggcccacaggtatcgaaactcgttgatcagcggggtcagggtcgagttctgccctttatggccgccttcagcattggtatgttgctggcgctgataattgctgtctatatgaatgcgccgactctactgctttttattcttgcggtattggtgggtacgatgccaagcatgcccgctatgataagagcacgctggacgcagcttttccgtggtaagccacaattacacacggccttttccctggacactgttctaactgaactcgcttttataatcggcccaccactcgccattggcctgagcaccagttttttcgccgaagccggacctcttgttgccgtgttgcttctgatcatcggcgtgacaacatttcttctgcaaagggagacagaaccgaagatcgccgtaggtatcaggaggaacgcaagctcgaccttacttatccccggcgttcgtaccatcgttctggcgcttctggcgatggggacgattggcggatctatcaatgtggctgtggttgccttcgccaacgcacaaggctggccagcgtctgccagtttcattctggcagcctatgcgctcggctcaatgatcgcgggtctgatgttcggcgtattaagggtttccttaccgattgaaaagcagttcttcattggtgtactggtaacttcagtcacagctgtattgactattttttcaccgaatgtctacatcttgtctgggatgctctttgtggcaggcgtgtcatttgccccaacgatgattatcgtcatgaatctcggtacgatcattgtgccaccgtccaggatcaccgaaggactcacgtggatgacgactggcttcagcatcggcgtagcgctcggtagcatatttacgggcattgtcatcgacgtctatggcgcgcggacagggttcggtgtagccattgtcgcgggattggtcatggtggttattgtgcttttagggctgcgtacacttcgtgccacgtcatcggctggcgccgagccgaccttccactaa

SEQ ID NO: 1530 - DNA, 684 bp, Xenorhabdus bovienii
  Coding sequence Name=Xb4151_4152.C427.gene41.dna; Position on contig =52347..53030bp; Strand=-
atgaagacgattaatcgtacctctcatgctcttagcgaaatggcggatttcgccaagacacttggacattcacatcgattgaccttgattgaggcaatctttcggcacgaaagctcggtggagcatttggcagagatatccggcctatccatcaccaatacttcacaacatttgcagcaattgcgacgtgcagggttcgtccaaacccgtcgcgaaggcaaacatgtcctgtatcggattggtgacggcccagttgcaaatatactggctgcgttacgagactatcttgcttatcagcaaacggagattcagcgtgtcgtctccgacagcattcatcatccagagcacttagaaggtgtctctattgaagaactgctccgcaggcaggaggaaggagtactacttctggacgtgcgctcggaagaggattacgccgcagggcacattccgggagccatcaatattccaacagacgctctcgtacaccatcttggagaactgcctcgcaatcaggatattctcgcttattgtggtgggcgatattgtgtgctctctactcaggcggtttcattactgcgatccaaaggattcaaagccctacgccttggagatggattcccaggatggcaagcagcaggtttacgtgtagaagtttctccaattaggttgaagaagctccagtga

SEQ ID NO: 1531 - DNA, 258 bp, Xenorhabdus bovienii
  Coding sequence Name=Xb4151_4152.C427.gene42.dna; Position on contig =53384..53641bp; Strand=+
atgaatgaagctcaaatcatcttaacactgaacgcatctgttcggacccgcgtcaaagttcctatacatcctcgtacccgtcaccagaggtttgaagccgagatggtaacgttatctggcccttgcgacaccagcgagtatcctgtgatcgtctttgaaccgctcggtaactcaccgcacgttcgcatgcattccgaatacctaacagacgatgtattcggctctgagcgttgtgactgcggcagagaactccaatga

SEQ ID NO: 1532 - DNA, 1698 bp, Xenorhabdus bovienii
  Coding sequence Name=Xb4151_4152.C427.gene43.dna; Position on contig =53638..55335bp; Strand=+
atgatcactcatcatgcaccgatcagcgggattgccgcgtaccgcgataagtacgttttaacagccggctacgataaccagatcattctgtgggatgcaaaaacccagcgtccgctcgcccgtgcgatgcacgatcaccttgcgaatcagggcgtattctcacccgatggtgcttacgccgtaacgtcatcatccgattatagtgctcggctctggactgtacccgacctgcggttggtcgccgtgttcgccgatcatgaggacgatgtagaaatgagcgtatttcatcccgataagcctctggtcgcaaccgcttcacgcgaccatcatgtccgggtgtacgatttcagtggcaagctgttgcagacgttcaaaggccattcagctgacgtaatctcggttgaatggatgcataatgctgacgagcttgtctcgtcaagcgacgatggtacgatcaagcgttggtcacttgagaaaaactgcctcgtcgctgacatcgatctcggtggcattgagaccgatactatcgctatcgcagcagacggacgcatcttcgctggcaacgacgaaggagagataattttaatcggtactgacggctcgcaggtgacgttcagggcgcatgatgcgggtgtgaagcgtctcgtgcttgaccacaacagggggcttctggtgtcactgtcatacgaccgcacaatgcggctatggaaagtggagccatttggacagttagaagaactcgtgagcgcgtcgctgccgcctgaagtatggccacgttcatgttccttcgaaggtgacgatcacattgtgttcgcgactttccaagcaagctatcgtctgtataactggaagaccgatgaatgggatttggctgaactcgcgccgacactcgtcgtcaatgcagccgcgttagtcgacggccaacaatggacgattggtgatgcaggcatcgtgtggatcgaccagcgtgagcacacacacacgggcagtctgtgcaactttcttacgcccgtaggtgacgtgatcctgacaggtgggcagctcggtaaagtgtttgatgcgcgtactggtcacgaattgtaccagcatcgttcgccactaaactgcggcgtgtcattcaagcgtaatggcatcgatcatgcggtgatcggtgcatacacgggcgaaggtattgtgctgcgtatcgatggttctcaggtaacgcacgtcgctgatctgccactgcatgataacgccgttaagggcgtcgctatctctggtgatctgcttttctccattgcggcagacgcgtcagcggcttggtatcgcgtgtcaacacttgagcaggtgtatacgcttaagcgcgcacacgagaagatcgcgaatggctgtataggcctcggtgatggctattttgcgtcggtgagccgcgatctgaaattgcggatatggtcaccagatcaccaggcagatgtcatcgcgactccccacacgcactcgctcaaatgtgtttctgcgggagttaacggtcgctatatcgcaactggcagctataacggccgtgtcgctatttacgaccgtatcgatgacctctgggtgatcaatatgtgggtgacgactgcgggcgtgtcatccctcagctacgatccgatcacacatgtgtttcttgcgagttcatatgacggcaatgtctatcacatcccgatggagcccatatga

SEQ ID NO: 1533 - DNA, 696 bp, Xenorhabdus bovienii
  Coding sequence Name=Xb4151_4152.C427.gene44.dna; Position on contig =55332..56027bp; Strand=+
atgagcagtaacaccaaaccacattatattgatgctcagcggacaatcgttcctgttgacgttccaagcacggcaccgcgtgattatgaaaaggtgttacgctcggattttgtgtcgagttataacgaagggcgcgatgtctggaccgaagaggctgcaatgcagcaggcaagtgcaatcttgcatgctcatctcggtcgttcttccgatgtcctggacgctggcgcaggtcgcggacgtgatactgggttcttactcgcgcaaggtcatcgggtcactgcggttgacctcgtcgaacttcccgagtggacacaactagtacagaactggggtagccaggtgcaattccgcataacgccagtgactgaactagacggtgagaacctttttgatggtgtgctcgacaatggctgcctacatcatcaacatccagacgcctacgttgtgtatctcaggcgcatccacaagcttttacgcccaaccgggctcttcacaatatcagtgtttgagtcgaaagagccgggtcggctgtacgcaaataaaatgcgacggctttatcgcgagttcaccgattctgagcttaccgagttgctgcgcgccgcgcatttcactcttgtcagtgtgcaccgagtaccgcgcccaacagccggactgaactatttggttctgacagttagaaaatcttcttcctactaa

SEQ ID NO: 1534 - DNA, 984 bp, Xenorhabdus bovienii
  Coding sequence Name=Xb4151_4152.C427.gene45.dna; Position on contig =56043..57026bp; Strand=+
atgaaacctattctcgccgacaaccctaaccatctcagtgaccgtgcagcgatggcgttgcctgaaaatatattcgttgcccgcatgcccacgacggtgttttcaatgcatctcgatctactgcaatctgagccggcagagtggatcgcaatcgcgcagaatccgtccacatcatttgaacgccgttacgcagcgggtacattgctcagcttttcgggcgatccacgtattcgtccgtttgatccagaaatgtgtgacgtacccggcgcaagcgtttggctcggcactgcaccggaacgggttccacagatcgttgctgaatggcagcgtgtcggtgtaatcgaggaatggatagctaaggaatgcccatgctacaacgtggaaatcaaggcattccggattatgcgttatcctgtcaccaatctcgaatatcggctctttcttgagcagacgcgagcgccatggtttccgacatcctggcccttcggtgtctatccagtcgaacgggcaaatcatcccgtctggtctgtccctccggaagcagcagaagcgtatgcagattggctgagcgaggctacaggtcggcgttttcggttgcctggagaagccgaatgggagtacgcagcttctggaggcactggttccgagtatccgtggggtaacgagttcgatccttacgcagccaatacggtcgaagctgggcctttgtcgacaacgcctgtcggtatctttcctcttggtcgtagcacgtttggcatcgacgatctcgccggcaatgtcgaggaatatgtcgccgacgattactctccctaccctggcggcgaagtcattaacgatgacctcgcaagcactcagggtagctatcggatcgcacgtggtggcagcttcacgcgctttggtgatctgacacgctgtgcacgtcgtcacggccactaccagcgtgacatctacgcgatgggttttcggctcgtggagtcgctttga

SEQ ID NO: 1535 - DNA, 1053 bp, Xenorhabdus bovienii
  Coding sequence Name=Xb4151_4152.C427.gene46.dna; Position on contig =57118..58170bp; Strand=+
atgagcgagctagccactgagacaatctatgagtcgacaaacgataaagttgcactgacttcagtcgtcgacttggttaaattgtccgatcaataccggcaatcggcagtcctgcactatgccgttgctgaaaagctatttgatttgacgcaggaaagctgcacgtcagccaaagttgccgggaatctcggcatggtcgagggtaaggtgttaatcctgttaaacgcgcttgttgctctcgggcttctgaagaaggctggcaacgagtttttgaatactgagttgactacgcgatacttgacaagtaagagttctgattacataggtgcgattgttgagcatcagcatcttcagtgggacaactggccccggcttggcgaaattttacgcagcgaaaagcctctcgatttccaacaggaaaaccgtttcatgcgcgatgaacgcgctcgcgatgcgtttaatgacgcgatggtacgtctgagccagcccatgcgtgatgtcgtaagcggcctcaatatcttcacgaacgcgaatacatcgatcgaccttgccggtgggcatggtacctaccttgcggaggcgttactccgtcatccacagctaacaggccagatatgggatctacccacgacccgcgacgcggcgcaaaaaacgattgaagcatacggcctcagtgggcgactcaagttttgtgagaaaaacctgcttgacgctctcaattttgagagagccgccgccgacgtcgttatgttgaacgattgccttcactactttaatgaaacagaggcgcttgcggtgatccgtcacgctgcctgtcttgtgaagccaggtggtgcactcttgctcctcacaatgacaatggatgaaaatcgtgtcacgcctgcgctatctgctgacttctcgcttcacatgatggttaataccaatcacggcgagctacatccgacgcagtggatagctcgcgctgtacatggaaatggcttgtctatcagtgagctatcaattggccgctacacacttctcatcggtcaacgccctgccagtgaggtataa

SEQ ID NO: 1536 - DNA, 864 bp, Xenorhabdus bovienii
  Coding sequence Name=Xb4151_4152.C427.gene47.dna; Position on contig =58173..59036bp; Strand=+
atgcttaccttcaaactgatcaatcttgatattaatcccacagacgcagaacagatcactcgtgtgttatccgagcaatgcgcagcggccggctaccgattgagtatggcagaggtggacaatacaacgccggatgggatgtttgtgctttctcatggtgcgtcgactgcgataaataatgagcgactcgctggagttgggtggattgctgtcgcgcagatcggtatcgatccgaaaaataccggcggtgaagcttctgcgatatggcacgaaaatcctcagggcgtgttctgctatcctctcgcgcttgagatggaatctgtgggtacgtcatctgatgtcgtacgcgactggctcgcaggcttcgctacgtttactgcctgcatcaaaatgtggcggcgcttacgcgacaaacctgaagatggcaggccgcacgagctacgtgtgaaccatatcaatatcctcgcccgggatctcgacaaatctgtcgatttctaccatcgtatcttaggcgcttcctattgctacaacctaggtccaaagaaggttgtgatggagctaaacggattcgatttctttatcgaacaaacagatactgttacctacccacccggctaccattttggtgtgcgcacagaccccgaaggtgtcaagtcgatcgcagcaatagtaggggcggacggtggtatcaagatcgtaaagggtaacggtccaactattggctaccatactgggccggatcgtgtgcgtaccgctttctactttgaagatccggacggtcttgtcatcgagatctattctccggaaattgaaatgcttgagagtaacccgcatctcatctcacagcatttttcgcaggcctga

SEQ ID NO: 1537 - DNA, 1404 bp, Xenorhabdus bovienii
  Coding sequence Name=Xb4151_4152.C427.gene48.dna; Position on contig =59074..60477bp; Strand=+
atgagttctaacaatgccccctcttggggggaactgctttccggacgcaacggcttgctttcaatcgcgcttgcaggaggagtcgcgctacatgcgatcaatatctatatcgcgacgacaatcctaccgtccgtcgtacgagatattggtgggcttgagtactatgcatggaacaccacgctgttcatggttgcatcgattattggcgcgccattgtccaaaaacgtgctaagccgtttcggaccacgtgctgcttatctcgtcgctctcatcgtgttttgtgtgggaacgctcgtgtgtgcaagtgcaaaggacatgttgtggatgcttgttggacgatttgtgcagggcttcggcggtggcattctgtttgcactcagctacgcactcatccgtatcgtattcgacgggcggttgtggccccgcgcaatggcgatggtgtccggtatgtggggtatcgcaacactctgcggccctgcaatcggcggcatctttgcgcactcagacacttggcgtcttgcatttatcgctcttttgcctgttgccgccgtgcttgctgtgatcgtactcgtccagttgcccgcctatgagaaatctagtgcacagacggatcgggccgcaattggcaaaatcctgctgctcggtgtatcggtacttatcatatcggtcgccagcctgtcgaaggagatttttgcaaacatcgccggtgtcgcagctggactcgtgatcgtcgtgttgattgcgcgcgttgatcgtaagtcgaaaattaaactactgccgaccggcgcatacgatgtgcgcgcatctcttggtgcaatttatgcatgcatgagcctgcttgtaatcgggatgacgaccgagatattcgtgccgtattttctgcagaccatccacggctatcagccgttaatcgccggctatgcgactgcactgatggcggcgggttggacagctggctcgctattcagctccggacgcagcgcacatactgcgcaggcgcttgtgcggcgaggcccaattctcgttgtgcttgcgctcatcatgctcgcagtcatcatgccatcgcagcatctgctcagcccggtttctagccttacgttgatgtgcatagcgctcgcagcggttggagctggtattggtgccgcctggccgcatctgctcacgcaggtgtttacaaacgcgcctgctggtcaggaagatcttgcgtcgacgtcgatcacgacggtgcaactgtatgcgacagccattggctccgcatttgcaggcatcgtagcgaatcttgccggattctctgacccaggtggtttggctggcgcgcagaatgccgctatgtggctgttcgctgtctttgcaattgctccggtgctcgctacgtttgtcgtacgccgtgtacgcctcacatag

SEQ ID NO: 1538 - DNA, 513 bp, Xenorhabdus bovienii
  Coding sequence Name=Xb4151_4152.C427.gene49.dna; Position on contig =60513..61025bp; Strand=+
atggatccgataaccggaattgctctatttaaggctctgcatgcgttcgggatagccggatgggcgacaataggcatgatcaataatgtgcagtcattcacagtgacgacgggcacagtaggtcgcatgatgagcatgacgctgctcaaacaggaaccgcccgtgaataccccgttgctgcgtcgtgcaacaacatcacgggcgatacatagcgctgcgcttgccgtcattgtgatattgcaggcactgaccgctatcgctatgtggatcagcggctatttgctactgacaacggctgcatcacacccggacacgctattatggctcagcgtgggtattaccggctttgctgcgtgcgcattcgtgctgttactggggggattgtggtatggctactggatacgccaagaaggtctgcaacttacacacatcgctatcatcatctggtcgatagccgcatttttgttgttccatctcagtatgacatccgagttgataggagacattcgatga

SEQ ID NO: 1539 - DNA, 1356 bp, Xenorhabdus bovienii
  Coding sequence Name=Xb4151_4152.C427.gene50.dna; Position on contig =61022..62377bp; Strand=+
atgataaattcccttcctcttcacgacggtgattgcttcgtgcaggttgatgatgacgttgccgctaagctcgatggatttgaactgcggcttctcgcaagccgcgttgtcgcgatccgtgacaatcaattcttcgatctacaaaacctgattgcgggaggagggaccattacacgaaacggcaatccatacgacctacgacgccaaaatcttgcagtgctgtattacgatctcagccgtcatggcgaacttgaatggcgtgagtctgatgctgacggtgctcgccttgccgtgctcacgccgaaagttaccgttgcggcctcgtcatcacctatccaagcagtacggttatcgcccagcgatcgcctcgctttcctgccgttcgaagagacgcgcaacgtgccgaatatagcagccgacgcgatccataatacagccacacggcttacactgtcgcactggccagcgaaccggactcccgcacgctaccaagcaaacctgtcgactgagagcgtactgcgctttttgcctgacatgtcagagtatcctgatgtgcggcacgtgacgaccgaccactttgatttagacgggctcgcatctgtctacgcactgatcgcgcctgaacatgcgcagagtcatggacaacttctcgccgacgtcgcacggttcggtgatttcgcgtgtggtcatagcacgaaggcgcgccgactcgcattcgcgctgaacgcaatcactgagcaagcattgcacgccgcgggaacggtaccaaacgaaagtgtgcgcattacggcacttttccgcacgctgctgccggcattgcgtgacttactggatgcttctgtgatccatgatgcgctttggcgtgacgccgagcagcatcatatggaaacggaagtgctactcgacagtccgaacgtgatggttgagcagtatcctgagattgatcttgcggtattccgtctacctacttctaatgtgccatatgtacgcgtaccgcaacgttacttcggactttcgtctattgccttccacaaccgcacgccattatcgacgattgcactcgtcacgcagggcgacatagtcgtccatcagcgttatgaaggatgggtggagttacattccgctgcgccacggccgcgtcgtgatctatcgattttagcgcgggcgttacagtcagccgaaacgaaagattgccgctggcactacgatggtgtgcaacacattatgccacggcttggacgcgacggcgcatcgctgagtagcttgtcggtagagacgatagtatgtgaactgaaacgcttcctcgcgattgcaccggccgcttggtcgccaagtgtgtatgctgcgccaaagtag

SEQ ID NO: 1540 - DNA, 117 bp, Xenorhabdus bovienii
  Coding sequence Name=Xb4151_4152.C428.gene1.dna; Position on contig =2..118bp; Strand=+
gaggctgcgtatcttacgctttcctcgccgggtgtaagcctttattttagggcttttctcccgctgtcctcggcggcgtgtcttcgctcagcgtcggtcagtggtggcgcattatag

SEQ ID NO: 1541 - DNA, 1902 bp, Xenorhabdus bovienii
  Coding sequence Name=Xb4151_4152.C428.gene2.dna; Position on contig =102..2003bp; Strand=+
gtggtggcgcattatagggacttttccgtgcctgacaatagtttttttcataaaagattatcgtttgctgcattacacagcaaaaggctgatttatacctacttatacacaaatttatccacaaatggatatttcggtaaaatttgtcgagcatcacgcaaacgttttcgttacaattatcgcaggaaaaaacaccacgtgattttttctgattgttttgaaatgttattgcgaatgccattttttctctcaatacccggtttttttctcaatagcacagtcttgttttatgaaattcaagggatcacaccaatgcaacagcttcgtccaatccgtcgtgccctgctgagtgtttctgacaaagcggggattgttgaattcgccaaagccttatccagtcgcggtatcgaactgctttcaacgggcggcaccgcacgcctgctggcggaagcagggctgaatgccactgaggtttctgactatacgggcttccccgaaatgatggatggacgagttaagacgcttcatcccaaagtacatggcggcatccttggccgacgtgggcaggatgatgaagtcatgtcactacaccagatttccccgattgatatggtagtcgtcaatctttacccttttgcacaaactgttgcgaagccagattgtcctctggaagatgctgttgagaatatcgatatcggtggcccaacaatggttcgttctgccgccaagaaccataaagatgtcgcgattgtggtcaacagtcaggattacggcaagattattgaagaaatggatagccatcaaaattccctgacccagctaactcgttttgatttagcgatcaaagcctttgagcataccgcggcttatgacagtatgattgccaattactttggcaaactggttcctgcttatcatggtgagacgaatcagccatcaggccgtttctcccgtacactcaatctgaacttcattaaaaagcaggatatgcgctacggtgaaaatagccatcaagatgctgccttctatatagaggagcaaattgccgaagcttctattgccacagcaacacagttacagggtaaggcactctcttacaataatattgctgataccgatgctgctctggaatgtgtgaaaacgttcgccgagccagcctgtgtaattgtcaaacacgctaacccttgtggcgttgcggttggtacagacattcatacagcctatgaccgtgcatttaaaactgatccaacctctgcattcggtggcattattgcttttaaccacgagttggatgccgatactgccaaggcgattattgagcgtcagtttgtcgaagttattattgcgccttctattaatgaaaaagctctgccaattctggcaaccaaacaaaatgttcgtgttctggcgtgtggcgaatggcattcgccagttgctggtctagactttaagcgcgtcaatggcggcttactggttcaggatcgtgacttaggtatggtggcagaagctgatctgaaagtggtttccaagcgcaagccaacagaacaagaaatgcgggatgcgctgttctgttggaaagtagcgaagttcgtcaaatccaacgcaattgtttacgccaaagataatatgaccgttggtattggtgcaggccagatgagccgtgtttactctgccaagattgcaggtattaaggctgccgatgaaggattagaagttcaaggctgtgccatggcatccgatgcctttttcccattccgtgatggcattgatgcggctgcggcagtcggggtgagctgtgtgatccagccgggtggttccattcgcgatgatgaggtgattgctgctgctgatgagcatggtatcgccatgattttcactggcatgcgtcatttccgccattaa

SEQ ID NO: 1542 - DNA, 1284 bp, Xenorhabdus bovienii
  Coding sequence Name=Xb4151_4152.C428.gene3.dna; Position on contig =2019..3302bp; Strand=+
atgaatatattgattattggcaatggcggaagagaacatgcactggcatggaaagcagcgcaatctcctttggcagataaggtttacgttgcaccgggtaatgcaggtactgcactggaagcaaatctggaaaatatagacattgctgcgacagatattgctggattgttggcttttgctcaaagccaacatatcggtctgactattgtggggccagaaactccgctagttatcggtatcgttgatgctttccagcaagcagggctgaccatttttggcccgaccaaagccgccgcccagctggaaggctctaaagccttcactaaagattttctcgcccgccatcagatcccgaccgcggcctaccaaaatttcacggaaattgagccggcattaacctatctgaaaaagatgggagcccccattgtcattaaggcagatggtctggcagccggtaaaggtgttgttgtcgcgatgacaatggaagaagcacagaatgcggttaaagacatgctggcaggaaatgcgttcggagatgccgggcatcgtattgtcattgaagaatttctggatggagaagaagccagttttatcgtcatggtagatggtaaaaacgtagttcccatggcaaccagccaagatcacaagcgagtcggtgatggcgataccggccccaataccgggggaatgggagcttattcacctgctccagtggtaacagatgaggttcaccagcgtgtcatggagaaagtcatctaccctactgtagaaggaatggctgccgaaggtcatacctacaccggctttctttatgcaggtttgatgatcgataagcagggagagccaaaagtcatcgaatttaactgccgctttggtgatcctgaaacgcagccgatcatgatgcgcctgcgttctgatctcgtcgaactgtgtctcgctggagcacaaggccagttaagcggaaaaacatccgaatgggacacccgtccggcattaggtgtcgtactgtccgcaggcggctacccggccaattatgtcaaaggtgacgttatcagcggcctgaatcaggaaacggatacagacgaaaaggtttttcacgcaggcactgctttcaaggataaagacgtcgtaacagcaggaggccgtgttttgtgtgtcaccgcgctgggcgacgatatcgcagaagcacagaaaaaagcttacttgagagctgagaaaattggctggcaaggatgtttttatcggaaagatattggataccgagccattgcccgtctgaaataa

SEQ ID NO: 1543 - DNA, 654 bp, Xenorhabdus bovienii
  Coding sequence Name=Xb4151_4152.C428.gene4.dna; Position on contig =3349..4002bp; Strand=-
atgctacaggggctgctagcattgggttttatctcattgctcagcgcctgctcggttcaacccaaggttccactcttcagtgccagtggttttattacagacggaggtgttatccgtttatggcgcttgaatgatcaaaacagtaatcctcaagtcattatgagtgtttacagcccttaccgtaatacagatacctctgtgactttctatgaataccgttacggtaatttgtggcagatccgccgctctgtacttgatagtcatccaatagaagaaacattgcggattgataaagataacaaggttatttttatgcagcggcagacaaaagaacacaatgaaccactttccaacgatgagattgtccgtttgcggtttgatgccaaacggataaaagaaatcagtgacgctttaattgccggaaatgtccatctggtacagggacattggcaggatggtaaagtaactacttgttcggagaaacaattatccattcaatttgagcctgaagatcgggcatggctcaagggaagggaaaagaatagtgctggcatattgaccattgcatggctggatgcgccagaaggaaaacagttactattggtagccaatgatgatttttgtcgttgggaaccgacgaaagataaactgtaa

SEQ ID NO: 1544 - DNA, 273 bp, Xenorhabdus bovienii
  Coding sequence Name=Xb4151_4152.C428.gene5.dna; Position on contig =4053..4325bp; Strand=-
atgaataagactgaattagttgatgcaatcgcagaacaagctggtctgactaaaactcaggcaaaaactgctctggaatcaactctgaatgcaatcactgaatctctgcgaaatggtgattcagtgcaactggtgggctttggtactttcaaagttaatcatcgtgcagaacgtactggtcgtaacccacagactggtaatgaaattaaaattgcagcagcaaacgtacctgctttctctgcgggtaaagcactgaaagacgcagttaagtaa

SEQ ID NO: 1545 - DNA, 174 bp, Xenorhabdus bovienii
  Coding sequence Name=Xb4151_4152.C428.gene6.dna; Position on contig =4318..4491bp; Strand=-
gtgcttgaattgccggatttaaagacttcacatttaccctcactctgttctacattgggggtgaaaagaagtggctatcggtgcgtgtatgcaggggtgctgtcaaatcggcatatccgtcgcactcgatgctttgcaaacgataaacacactgtaaggataatctatgaataa

SEQ ID NO: 1546 - DNA, 591 bp, Xenorhabdus bovienii
  Coding sequence Name=Xb4151_4152.C428.gene7.dna; Position on contig =4510..5100bp; Strand=-
atgttaagaaacccgatccacctgcgattagagaaatttgaaagttggcaacattggacttttatggctagtctatgtgagcgaatgtatccaaattatcaggtgttttgtcgtcagacagggtttgctgaccccgcccagtatcgtcgtattttagatctggcgtgggagacattgatcgtcaaagatgcaaaagtaaattttgatagtcagctggaaaaattagagaccattattccatcagcagatagctatgatatttatggtgtgtatccagcaattgatgcgtgcattgcattaagtgaagtcattcattctcgtttgagcggtgcaacgttagaacatgcaatagccgtcagtgaaacatctatccgtaccgttgctatgctggaaatgacgcaggccggtagagaaatgactgaggatgagttaaaggcattgcctgccattgaagaggaatgggatattcaatgggaaatttaccgtttattggcagactgcgaagaacgggatatagaattaattaaaggattaagggctgaccttcgcgagactaaggttagcaacatcggtataaatttggagcaataa

SEQ ID NO: 1547 - DNA, 93 bp, Xenorhabdus bovienii
  Coding sequence Name=Xb4151_4152.C428.gene8.dna; Position on contig =5113..5205bp; Strand=+
atgatgcctaatttgcgtcgaagtttacctgaaaatcaagaatatccacacatttccgctgcaattatagatttttctgcattgtttgcttaa

SEQ ID NO: 1548 - DNA, 885 bp, Xenorhabdus bovienii
  Coding sequence Name=Xb4151_4152.C428.gene9.dna; Position on contig =5177..6061bp; Strand=-
atgctgctccagcgcgaattgaagaggaagtttcgacgattttgcaggattttggtacgggtaatgggcatgttttcaatctggggcatggcattcatcaggatgtcccaccggaacatgctggcgcattcgtcgaagcggtacacagactttcagaaaaatatcaccgatgactttatgattgatacaaaggcgttacgccaggaacaaatagaaaaagcacggcaggttatccgtcatgattctttcatgacgacttctacttccgcaatgcctgcgtctacgccttttatgccagaattaattgccggcgctgacgtcgggtttgaaaaaaacggtacggtgactcgtgccgctattgctgtcctgcattatccttcgcttgaattgctagagtatcaggtcgccagaattgatactgtgcttccttatattcctggtctactctcatttcgtgaataccccgcgctgatggcagcatggcaaaaactcagcctacggccggatctggtaatggtagacggtcagggaattgctcatcctcggcgttttggtgtcgccagccattttggcttattggcggatatcccgactatcggtgtggctaaaagccgtctgtgtggtgagcacccgcctgtgggagatgcggtgggaagttatcaatcattgatggatcatgcggagcagattggcgttgtatggcgaagtaaaaaaaggtgcaatccgctctatatttccattggtcataaggtcagccttgacagtgcggtcttctgggttgaacagtgcatgaagggatatagactgcctgagccgacccgttgggcggatgggattgcctcaaatagattgttttttaagcaaacaatgcagaaaaatctataa

SEQ ID NO: 1549 - DNA, 1065 bp, Xenorhabdus bovienii
  Coding sequence Name=Xb4151_4152.C428.gene10.dna; Position on contig =5889..6953bp; Strand=-
atgaatgagttgaaaaacgaccgctatctgcgcgccttattacgccagcctgttgatgtcacaccagtatggatgatgcgtcaggcggggcgatatttgcctgaatataaagcaacgcggcaggaggcgggagatttcatctcgttatgcaaaaacactgaactggcctgtgaagtgacgctccagcctctgcgtcggtttccgctggatgcagcaattctgttttccgatattttgactattcctgatgcaatggggcttgggctgtatttcgaaactggggaagggccgcgttttcactctccgattctcaatcatacagatgtggaaaaactccctgtacctgatccggagatggagctgggctatgtcatggatgctgttcgtgcgatccgtaaggcactggcaggccaagttcctctgataggtttttcgggtagtccgtggacactggcgacgtatatggtcgaagggggaagcagtaaggcgttcaccaaaataaaatccatgatgtatgcccaacctgctacgttgcatctgttactggataaattggcaaacagcgttattctatatttgaacgcgcaaataaaagcaggagcacagtctgtcatgattttcgatacttggggtggtgttctgtctcatcgcgattatcgggagttttcgctgcaatatatgcataaaatcgttgacggattgatccgcgaacatgatggccgtcgtgtgcctgtcaccttgtttaccaaagggggcggacaatggctcgaagcgatggtggcaactggctgtgatgcccttgggcttgattggacaacgaatatcgcagatgcccgtcgtcgtgtaggcgataaagtcgctttgcagggcaatatggacccatctatgctgtatgctgctccagcgcgaattgaagaggaagtttcgacgattttgcaggattttggtacgggtaatgggcatgttttcaatctggggcatggcattcatcaggatgtcccaccggaacatgctggcgcattcgtcgaagcggtacacagactttcagaaaaatatcaccgatga

SEQ ID NO: 1550 - DNA, 153 bp, Xenorhabdus bovienii
  Coding sequence Name=Xb4151_4152.C428.gene11.dna; Position on contig =6973..7125bp; Strand=+
ttggccgcaaaattctttggttacggtcggtttaactttcactataaaaaaccgacgcattgtaacatgccagaaatcgaacttctggcacaactgccaataacatgcgccattcgctcatcatctcagagcagttcacatgttacggcatag

SEQ ID NO: 1551 - DNA, 771 bp, Xenorhabdus bovienii
  Coding sequence Name=Xb4151_4152.C428.gene12.dna; Position on contig =7108..7878bp; Strand=-
atgattcaacaaaaactgacaggtatggaacgaggctggtgggttatcagtcttgagaatctagtttggctgccacagggcgaattgccgtcagggacagccagacaatggtcattacaaggccatatggcgcggcctattggtgagtggttaggcgagactgtgtggctggtgtgccagaagatggcatcagagatggcatctccccgcatggttgtttctcaacaccctaaattgtttcaactggtagggcgtggcgtccaactggctgagttttatcgatcacaccattactgcggctattgtggccatgaaatgcagcatagccagcatgaatgggcctgtttgtgcaatcattgccatgaacgttattatccgcaaattgcgccctgcgttattgttggtatccgtcgtgatgaccatattctgctggcgcaacatcagagccatcgcaatggtattcacacggtgctggccgggtttgttgaagtgggagagatgctggaagaagcagcacaccgcgaggttatggaagagagtgggattaagatccgcaacctgcgttatgtggcttcccagccgtggcctttcccgcaatcattgatgatggggtttctggcagattatgacagcggtgagatccaacatgatcccgttgagcttatcagtgcagattggtatcgctatgatgaccttcccttgatccctcagtcggatacgattgcacgccgtttgatcgaagagacggttgcgctatgccgtaacatgtga

SEQ ID NO: 1552 - DNA, 105 bp, Xenorhabdus bovienii
  Coding sequence Name=Xb4151_4152.C428.gene13.dna; Position on contig =7875..7979bp; Strand=-
ttgattaaattagggcgatgttcagacaggatacgacgaaaaggagtatcctgtctgatgctgaatttggacacaatgtcattggaactatggtgcggtagatga

SEQ ID NO: 1553 - DNA, 102 bp, Xenorhabdus bovienii
  Coding sequence Name=Xb4151_4152.C428.gene14.dna; Position on contig =8007..8108bp; Strand=+
atgaaaggccgttataacgctcacatttcccaatctgtcatcgatactttccttgaccaacaaatttggggcaatatcattcactggcatgtcagtcgatga

SEQ ID NO: 1554 - DNA, 663 bp, Xenorhabdus bovienii
  Coding sequence Name=Xb4151_4152.C428.gene15.dna; Position on contig =8168..8830bp; Strand=+
atgtcacagcagattgcggtatttgatctggatgatacattgatttgtggggattccagcctgctttggacggaatatttgtgggaaaaaggcattattaccgatcatcgttttatcgaggcagaccagaaaatgatggctgactacagtgccggtaaactggatatgcacgattatctggcgttcaatttacagtcactgaatcaagtacaccatgaacaggtggatatttggctgacagattttgtggaaaccaaaattaaacccatctcttatcccgcagccaaaaaacaattagatatctatcggcaacagaacattcctatcattattatttctgccactgtttctttcgtggtgaaaaaagtcgcggccgcattgggtgtgctgacagctatggggattgatatggtcatggaaaatggctgctatacgggcagtattttgggaacccctaccttccgtgaaggaaaagtcgtacgtttgcaacaatggttgacagaacaaaacttatcacctcagcatatctccttttacactgattccataaatgacctgccgatgtgtttatttgccaacgaagtgtttactgtcaatgctgatatacggttgcaaaaggaagctggaaatcatggatggaaacagttgaactgggtgttataa

SEQ ID NO: 1555 - DNA, 117 bp, Xenorhabdus bovienii
  Coding sequence Name=Xb4151_4152.C428.gene16.dna; Position on contig =8953..9069bp; Strand=+
atgataataaatattaaattaaatacaataaattatgaattgataatacacttcattaataaaaaacctctattccactatacaaaaaccatcaaaccactcctaattaaaatataa

SEQ ID NO: 1556 - DNA, 258 bp, Xenorhabdus bovienii
  Coding sequence Name=Xb4151_4152.C428.gene17.dna; Position on contig =9278..9535bp; Strand=+
ttgtcggagtgcctagcgttcaacgtatatcacgatgaacacaggctgagaccgttgattcgggatccgcagaacctgatcgggctaatacccgcgaagggaacaagagtaattaccccgctgacatatcctcctgtttctatagagatattattcagcaccaaccattactccctgcgagctccagacaagcaattttctcaacttaagcccattccagcaggcaacgctcccgttcgcatgatggacaggctataa

SEQ ID NO: 1557 - DNA, 1974 bp, Xenorhabdus bovienii
  Coding sequence Name=Xb4151_4152.C428.gene18.dna; Position on contig =9554..11527bp; Strand=+
atgtctaataatattgttatcccaactactgatgtcatccctgcggccgatatcgcccccaaaacctatcctgcacggccacgcaaggcacaacgggatgcagcacaggaatttatcaattccgttcaaggcgttaccttccccaactcacgcagaatttaccttgccggctcccgcaaagatattcaagttccgatgcgtgaaatccagttatcaccaacactgattggcggcaccaatgaaaatcctcaatttgaggaaaacgaacccgtgcccatctatgatacctctggctcttatggagatcccgactcggtgctggatgtgcgagctggcttgaagaaaatccgtcagctttggatcgaagagcgtaatgataccgagccagtcgctgttctcagttctgactttacccagcagcggcttgcggatgccggactggatcatctgcgcttcaaccagcttcctcatccattgaaagccagacaaagcaagcgtgtcacccaattgcactatgcacgccaaggcattgtcacacccgaaatggaatttatcgccctgcgagaaaatatggggcgtgaacgcatccgcagtgaagtcctgctccagcagcatccggggcaaagtttcggtgcaaacttgccggacaacatcacgccagagtttgtccgtcaggaagttgccgctggccgggcgattattcccgccaacatcaaccatcccgaatccgagccgatgattattggccgcaattttctggtcaaagtgaatgccaacatcggtaactcctccgtcacatcctccattgaagaagaagtggaaaaactgatttggtctacccgctggggagcagatacggtgatggatctctctactggccgttatatccacgaaacccgcgaatggatcttacgtaacagtcctgtacctatcggtacagtgccaatttatcaggcgctggaaaaagtgaacggcgtggcagaaaacctgacatgggaaatgttccgcgatactttactggaacaagccgagcaaggggtggattatttcaccatccacgcaggcgtcctgctacgttacgtgccgatgacggccaaacgtctgaccggcatcgtctctcgtggaggttccattatggcaaaatggtgtctctcccatcatcaggaaagcttcctctatacccattttcgcgaaatttgtgaaatctgcgccgcctatgacgtttctctgtctttgggagatggactgcgtcccggatcaattcaggatgccaatgatgaggcgcaatttgccgaactgcatactctcggcgagttgactaaaattgcctgggagtacgatgttcaggtgatgatcgaaggaccggggcatatcccgatgcaattaatccgccgcaatatgacggaagaattggaacattgccacgaagcgccattctatacgctggggccactgacaaccgatatcgctcccggttatgaccatttcacctccggcatcggtgcggccatgataggctggtttggttgtgcaatgctgtgctacgtcacaccaaaagaacaccttggtctccccaacaaagacgacgtaaaacaagggctgattacgtataaaatctcggcacatgcggcagatctcgccaaaggccatcccggagcacaaatccgcgataacgccatgtcaaaagcacgttttgaattccgctgggaagaccaattcaatctggctcttgatcctgaaaccgcccgcgcctatcacgatgaaaccctgccacagcaatccggcaaagttgctcacttctgctctatgtgtgggccaaaattctgctccatgaaaatcacgcaggacgtgcgcgattatgcagcaaaactggaacaggaagctggcatggaacagatgtcagaagaattcctcgctcatggcagcgagctgtatcacagtgctgaggacataagcgatgaaaaatcagcctga

SEQ ID NO: 1558 - DNA, 675 bp, Xenorhabdus bovienii
  Coding sequence Name=Xb4151_4152.C428.gene19.dna; Position on contig =11511..12185bp; Strand=+
atgaaaaatcagcctgaagcctcatcaattccacaagccccttttgccccaaccgtgcaccgtttggggctttatcccgtcgtggattccctgacgtggattgagcggctactgaaagcgggtatcagaaccctgcaactacgcatcaaagatctccccgaagatcaggtagaagaggatatccaatccgccattgtattgggtcgccaatacaatgcccgcctattcatcaacgattactgggatctggccatcaaacatcgcgcctatggtgtgcatttggggcaggaagatctggatatcgcggatctcaatgccatccggcaagcaggactgcgtcttggcatttccacccatgacgaatatgaactggcgcggacaaaagcactgaggccttcctatattgcactcgggcatattttccccaccacgacgaaagagatgccttcaaagccgcaaggcctttcggcattgaaacatcaagtggaaataaccccggaatatcctaccgttgccatcggtgggatttcgctggatcgtgtgcctgatgtcgttgcaacaggagtgggtggcgtggcattggtcagcgccattactaaagccaaagattggcggcaggtaactgaccaattacttcatttgattgaaggaagtgatcgggagctcttatgttaa

SEQ ID NO: 1559 - DNA, 810 bp, Xenorhabdus bovienii
  Coding sequence Name=Xb4151_4152.C428.gene20.dna; Position on contig =12179..12988bp; Strand=+
atgttaaacgaccaagaatttatgcggtacagccgtcaattgctactggaagacatcggctctgatggacaggaaaaattaaaagcaggaaaagtactgattgtcggattgggtggattaggttcacccgcagcactctatctcgcagcggcaggcgtcggccacctttatctggcagatgatgatacgttgcatgtctcaaacctgcaacgccagatcctctatcgcacagcagatattcccgcaggaaaggcggttttagcagcgaagcaactgaaggccctgaatccgctggtcgaaaataccgtgctgaccgagcggcaggatcgtgaatcactggaaaatctcgtccgtcaggccgatctggtgctggattgctgcgataacatggcgacgcgctatgctatcaatgccgcctgtgttgcagaaaataaaccgctcatcagcggtagtgccgttggtttcagcgggcagcttatcgtattcgaacccccttacttgcacggctgttatgcctgtctctaccctgatcaggaagagccgcatcgcaactgtcgtacagccggtgttttagggccggttgtcgggatgatcggtacgttgcaatcgttggaggcaatcaaaatgctggtgggtctcccctctcccctaagtggaaaactacggttgtttgatggcagacagcagagttggagcacgttacaactaacattgttatcgcagtgtcctgtgtgcggaacccatgccgcaaaatctgatcgcgcagaaaccatttcaggcaaaacacgctcagggaaagaagtcgcatga

SEQ ID NO: 1560 - DNA, 201 bp, Xenorhabdus bovienii
  Coding sequence Name=Xb4151_4152.C428.gene21.dna; Position on contig =12985..13185bp; Strand=+
atgaacattatcgtcaacgatcaaccgatcacactgagtacgtcgatgacggtgcaacagttactggagcatgtacaacgtccccaatcaggcaccgctttggccattaatcaaactattattccgcgctcagagtggaacagccatcagattaatgacggagatattatcctgctgtttcaagccattgccggaggttaa

SEQ ID NO: 1561 - DNA, 768 bp, Xenorhabdus bovienii
  Coding sequence Name=Xb4151_4152.C428.gene22.dna; Position on contig =13188..13955bp; Strand=+
atgttaaaaatcgctgatacttcctttcattcccgcctgtttacgggaacaggaaaattcgccaatgcaaatttgatgatcgaggcgatacgtgcctctggtagccaattggtcactatggcgatgaagcgcatcgacctgcatggcaatgacgacggcattcttgccccactgcaacagttaggcgttaaattactgcccaatacctcgggggcaaaaacagcagaagaagcggtgtttgccgctcacctggcacgggaagcgctgggaactcactggatcaagttggaaatccatcccgatgtaaaatatcttttgcctgacccgatagaaacgctgaaagctgccgggcagttggtaaaagagggattcgttgttctgccctattgcggcgctgatcctgtcctgtgtcgccgtctggaagaagtcggctgtgctgccgtgatgccattaggcgctcccattggctcaaacaaggggctgctgacgcgagattttctgcaaatgatcatcgaacagtccaacgtgcctgtcgtcgtggatgccggaatcggagcgccaagccatgcactcgccgctatcgaaatgggtgctgatgcggtactggtcaatactgctatcgccgttgcccgcaatcccatcaaaatggcacaagcattcaagacggcgattgaagccggcgagctctctcatcaggcgggtgtggcaagccagaaatcacatgcagaagcttccagcccactgaccgattttctgggggcgttatga

SEQ ID NO: 1562 - DNA, 1143 bp, Xenorhabdus bovienii
  Coding sequence Name=Xb4151_4152.C428.gene23.dna; Position on contig =13952..15094bp; Strand=+
atgacagacaacacagtgacgactgatcatacattccgccagcgctggcagcagttggattgggacgacattacactgcgtatcaacagtaaagccacgcaggatgttgagcaagtattaaaccgcgatcgtctgactctggatgattttatggccttgctctctcccgcagccctgcctttccttgagccgctcgcccaacgagctcaacaactaacgcgtcagcgattcggcaataccgtgggattttatatcccactctatctttccaatctgtgcgctaatgactgcacctattgtggtttctccatgagtaatcacatcagacgcaaaacactcaatgaacaagagattaaagctgaatgccaagccatcaaaaagctggggtttgaacatatcctgctggtcacgggagaacatcagaacaaagttggcatggattatttctgccgctatctccccatgatccgcagctatttcagttctatcacaatggaagtccagccattggcacaggaagaatacgctgaactgaaaacgctggggttggatggcgtaatggtctatcaggaaacctatcatgctcccagttatcaactgcaccatttgaaagggaaaaaacaggattttcactggcggctggaaaccccggaacgcctgggacgtgcaggtatcgacaaaatcgggttgggtgctttgatcgggctgtcccctagctggcgtaccgattgttacatggtggcagagcacctgcttttcctgcaaaaacaattctggaaaagccgttactctatttcctttccaagattgcgcccctgcgcaggtggcatagaacccgcttccctgatgagcgaagctgaactggtacaactcatttgtgcatttcgcctgctggcaccggatgtggaactgtccctatccacccgtgaatcaccgtttttccgcgatcacgttgtaccgctggcaatcaatcatgtcagtgccggctccaaaacccagccggggggttatgccgacgatcattacgaactggaacaatttgcacctcatgataatcgctcggtggttcaggttgccgcagcactggtgaaatcaggtttacagccagtctggaaagactgggataattatctgggacgttag

SEQ ID NO: 1563 - DNA, 597 bp, Xenorhabdus bovienii
  Coding sequence Name=Xb4151_4152.C428.gene24.dna; Position on contig =15163..15759bp; Strand=-
atgaattttcagcactgccattggcttaatgagcctgcctcgtggaagcatcgagaagatatactccatgtgacgacagatattaaaactgatttttggcgtgatacatggtatggctttcagcgtcatagcggccatgtttttggtcgctatgttgatgatgttcatattgaagccggttttaccttccagctttgtatcgaagggcgttttgaacatttatacgatcaggctggcattatgctactggtggatgagcaacattggttaaaagcgggtgttgagcattctgatgggcaggcaacgatcggtagtgtgctaacgaattcttgctctgactgggcgatgggcgtatttccggggaatcctgataaattctggttaaggctgacgtatagtgagggagtgatcaggctgcaatattccattgatggggtgaagtggccgttactgcggttatcgccttttgcggttggcagtcagcgggtttttgtcggagcaatgtgttgttcgccagaacgagaagggttgcaggtaaagttctccgattttagcctgaaatcatgtctgaaaagacacctgcatgatttgagttag

SEQ ID NO: 1564 - DNA, 1218 bp, Xenorhabdus bovienii
  Coding sequence Name=Xb4151_4152.C428.gene25.dna; Position on contig =15774..16991bp; Strand=-
ttgtgcgtcagagtacattgttttggaacagatggttttagagaacagggttatggaggaattaagttgtctgaggaatatgcagtttcttcgataaaacagccgatcatcgcgacacggctcgctttttttattgccggattcagtatggcagcttgggcacctcttattcctttggttaaggagagatttgcacttgatgatggtgccatggggttgctcatactggtatttggcattggttcctttatcacgatgcctttggcggggatgctggccagccgtttcggttgtaggaaaatttttcccttgtttgccctgctggcaattttgatgctaccggggttaagtatattgccaaccccctgggcactggcttgtgcgctgtttatgttcggcgtggggattggtgcgacggatgtggtgatcaatattcatgcagtcaatgttgaaaaaatggcacagcagccaattatgtctggttttcatgcgttgttcagtctggggggaattgcgggtgcagggtcagtcagtttcctgttattgatgggaatatccccatttcaggtaatggccgcagtgtcattattcattattctgttgttgctgccagcatggagcggattattggatcatacagaaacgggtaatacaccattttttgccttgccgcgtgggattgtgatcctgcttggttttctttgctttgtcgtttatctgatggaaggctccatgttggattggagtgggatcttgctgagtagtgtccataatatagatagccatcaggcgggacttggttacacgcttttcgccattaccatgacatgtggccgctttctgggcgataaaattatctcaatgtttggataccggcgggtttttttggcaagtgcaattctggctacttcgggttttgtcctgatctatctggcatccagcatgatggtattgggtatttctttcctgatgataggagcgggtttatccaatctggctccgatgtttttcactgcttcagggcagcagaaagtcatgcctgattctcaggcagtttccgccgtctctacgatgggatattcgggtatcctgctggggcctgcaattatcgggggtttggctcatcaggtcacattgcatggcgcttttgcctgtattgctctactttctcttacattgttagcgggctatggattgattcatcccgccagaaaataa

SEQ ID NO: 1565 - DNA, 93 bp, Xenorhabdus bovienii
  Coding sequence Name=Xb4151_4152.C428.gene26.dna; Position on contig =16974..17066bp; Strand=+
atgtactctgacgcacaatcatgccctccgcaggttttgctggagggcatcaatatttacattgttatcacactgaagttatcatcacgctga

SEQ ID NO: 1566 - DNA, 639 bp, Xenorhabdus bovienii
  Coding sequence Name=Xb4151_4152.C428.gene27.dna; Position on contig =17058..17696bp; Strand=-
atggataaattcaatgtcatttttgatatcgatggggtcattgtcgatagtgaacaactgcattttgatgtgctgtgtgaactggcacctgatcacacgcgtgatgttcagccacagcaattaattggtttgagtctggctgaaacactgaatgaaattggtgttccattacccgagcagcaaggcattaccgacaggattatctcggtttatcaggaaaagttatctgcacattatctacgcccgggggttactcgcctaatcgcggccttacagcaaaatgacattgcttttgggtttgtttccaccgcaccgcgtgccgtttgtctggcgaatctggggttactggatttgtttgatgaacctgctttgatttccggtgatgatgttgaaagaactaaaccttttcctgatccctaccttgctatgctaaagctgaaaaggatggatgttcagcagactttggtgattgaagacacggatctggggatcgcagcggcaaaacaggcagggatcccgtgggtatatgcttggcctcatgatttgtcggtagctgaacagtacgggcaggcgacttgcattattggtgaattgacggatattccgcaattttctgggataaattcgctgtcagcgtga

SEQ ID NO: 1567 - DNA, 1062 bp, Xenorhabdus bovienii
  Coding sequence Name=Xb4151_4152.C428.gene28.dna; Position on contig =17710..18771bp; Strand=-
atgaaagccctgaaattcaaccaagtatggaatgtccagattcagcaagttgaacccttgcactgcattgaaccggatgatgtggtagtcgatattgcagtatgtgggatttgcggcacagatataggaattattactggttcttatcctgtagcggtgccgggaaccacattggggcatgagaccacgggagtggtgacgcaaatcggcagtcatgttacccgctttcagattggcgatcgtgttgttatcaatccgacatactcctgcggacattgcagaatgtgtcagacaggtaatcccaatcactgcgagaagaaactagggacggaagcgggggtttcttacgatggggcatttgccgagcagtatttggcgaaagaaagctcgctgattaagcttgatgatcatgtcagtatggaagcggcttcgttgactgaacctttgagctgcacactgacgggagtggataaactggggatcacccataccaatattcgggccgtggtagccggtgctggccctatgggaatgctgtatctttgggcgttgcatgaacggggtgttaaggcattcatgatcgagaaaaacccgagtcgtgtgcaatttgctatcaacaacctgccggcagaatgtcggttatatactgattttgatgaagcgttgatgcaggaatacggtgataaatcagccctgatcgatttatgtgtagatactacgggacaactgaccgaatatgttttcgaccatttagccgcaggtggtaagttgctgaatgtcgctttaaaagataaacatgccaatcttgatattctgaaaattgccgacaaaagtctttctgtcatcggctcgattgactccttgaacaacagttttgagcgtgcttacgccatgatccgggatggtgtgatcccagccgaacgcctgattagtcagatctttgattttgaggattatcagcaggcttttctcaccgtgggctgtgatattgccgcgaaagcccaagtaccgctcagtacaccaaactgcaaaatattgatccgtttggctgactttaagtaa

SEQ ID NO: 1568 - DNA, 1251 bp, Xenorhabdus bovienii
  Coding sequence Name=Xb4151_4152.C428.gene29.dna; Position on contig =18771..20021bp; Strand=-
atggaaaatagaaaacatcttgacgatatgctttcccgttttgttggtcacggtccttatttggaaattgatggcgaaaagcatattgatgcggcatcaggtacgtttaatttgccgcttggctacactaaccacagagttgcggaaaaactcaagcaacagattgatagatgtacgcatttaagttctgcttatacgcgagaaatgtcacaatatattttgaccaaattggtgaaacatacaccagaaggcattgaccgaatgtggctgcgggatgtttccggttctggggctgttgaaggtgccattcgcatcgcccaaaaagccacaggacgctccggcattatttcgttctttcttgcccaccacggccagtctcttgcgactgcgcagatttctggcaatgcgttcagaattaaagatttccatatcagtattgatggttcgataaaaattccagcacctgccagtgtcatggcagaacctgacccgaatgagacagagaaccaatatgtcgatctggaacagtttattcagttgggctccagtgacaatatcgcatgtctgattattgaaccgattcagggcaatggcggcaacaccgttttccccgtggagttctatcgcaaaatcagggaaatctgccatcagcacggcatcatcattattgcggatgaaatacagacagggtttggccgtaccggaactttctttgcgtcgacaggttatgccaaggaattagagccagatatcattgtatttgcgaaaggggcagggggtattggtattccgacagggggtgtgctgatgcgcagctcgctggatgtgctggaatcatttgagcattccagtacttctggtgctaatcccttgtctttagtcgctctcaacgaaatcattgatattattgaagatgatgcgattctggaaaatgtgcagcagaacgaggctttcctgcgtgatggactgttggccttacagcataaataccctgaaatcacgggggtcagaggcatgggctacatgttcggttttgatactccaaccccagaatttgcggcacaggtgattgaaaccgccagccgtcaccgattgatcctgcgcggctcccgttatggcaaagggcgggcacttaaggtacgtcctcctttggtttgtacacaggaacacttacatgaaattctccataaattggatctggcattcgctgaactgacggtttctgcaccgaagcacagagaggttgcataa

SEQ ID NO: 1569 - DNA, 2877 bp, Xenorhabdus bovienii
  Coding sequence Name=Xb4151_4152.C428.gene30.dna; Position on contig =20225..23101bp; Strand=-
atgaaatcaatcaacctgtttgcaaaagacagacgtttctctaaatttggttgggcattaatgaatgttagtggtgaaaatgaatcaataacattgaacagggttttggtatcagttttattcattgcttatgaagggaagaaaccaatgcttatcccatcgaaactcagtcgcccccttcgccttaataatatggtcatgcgtgagcgtctgttagaactgctcagtgaagtacagcactatcgtctggtattgataaccagccccgcagggtatggcaaaactacattgatgtcacaatgggctgccggacagagtaatctgggatggtattctctggatgacagtgacaatcagccggaacgttttgccagctacctgatcgcggctattcagcaggcaacacaggggcattgtgtaaaaagtgacgtgctggctcagaaacatcagtatgccaatttacccgcattatttgcgcagttgtttattgaacttagtgagtggaaacagccgatctttctggtgattgatgattatcacctgatagagaataacctcattcacgaagccatgcgctttttcctccgtcaccagcctgaaaatctgactttgacaatactatcccgtcatttgccatcgttgggtgtagctaacctacgtgtgcgtgaacagttattggagttcgacagccagcaattggctttcgattatcgggaaacccagcagttttttgataaaagactggccagcccactggatgcggataattgcaaacagttatgcaatgacgtcgcgggttgggcgacggccttgcagcttattgctctttctgcccgtcaatcaggcaatacggcggaaatgtcggcaaaacgcctttcagggattaatgccagccatctcgcagattatcttgtggatgaggtgttaaatcgtgtggatcaggctacgcgggatttcctgctgcgcagttctatcctgcgttcgatgaatgatggtctgattgtttgtctgacgggagaggataacggccagcaacgccttgaagatattgaacgtcaggggctgtttatccaacgtatggatgattctggcgaatggttctgttttcatcctctgtttgcctcattcctgcgtcaacgatgccagtgggagatggcagcgaaattgccagaattgcacagagccgcggcagaaggctggctgatgcagggttttccgggggaagccattcaccatgcgctggctgccggagataccgtactgttacgtgatattttgctgcaacatgcttgggatctgtttaaccacagcaaactgtcactattggaagagtgcatgaatgcattgccatatgagcaattactggaaaatccgcgtctggtactgttacaggcatggctggcacagagccagcatcgttattatgaagtgaacgctttattgaatcagacagaacagtcgctgaagcagaaacaaatcattatagagccggaattgctggcagaatttgatgccctgcgtgcccaagttgcgattaatgatggccggccggacgatgctgatactctggctgagaaggctctggcagcccttttgcccgacaatgaatatggccggattgttgcgatgtcggtgaaaggggaagttctgcattgtaaaggagaattatcccatgcattggcactgatgaagcaaacggagcaacttgcccgacgctgtcatgtttatcactatgctttgtgggcgttgttgcagcaaagtgagatcttattggctcagggctatttgcaggcggcctatgaaattcaaaatcacgcttttgatttgattagtgagcagcatttggaacagttgccgatgcacgaattcctgttgcgcattcgctcacagcttttgtggtgttgggcgcggatagacgaatctgaagaagcggcgcgtcgaggcctggaagtgttatccagcgtccagcctcagcagcaattacaatgcctaacccaactggcgaaatgttccttgatccgaggggatattgataatgcccgccgttacctgtcccgctgcgaaaatctgttgaataacgggcattatcatcgtgactggcgaaccaataccgacaagctacgcgtcattatctggcagaatttggaagatagcagctcggcgactcagtggttggtacaggcggaacggccagaaagtttcaataaccatttcaatcagaatcaatggcgcaatatcgcccgtgcacagatcctgcttggtcagtatgaggaagcggaatctatcttgggaacgctgaataagtacgcgagggaattgctgctgataagcgatttgaaccgcaacctgctgctgtgcaatctgttgcactggcagcttgggtacaaggctgaagcacaggctgttttgatggaagccctgagtttggctaaccgcacgggatttattagtcactttgtacttgaaggtgagttgatggctcaacaattgcgccagcttattcagctcaatattctgcctgaacttgagcaacaccgtgcccagcgtatcctgcgggaaattaatcgccagcatcggcataaattcgcccattttgatgaaacgtttgttgagcagcttcttacacaccctgatgtaccggaacttatccgaaatagcccgctgactcagcgtgaatggcaggtattggggttgatttattccggctacagtaacgatcaaattgccgcagaactggaggtcgccgcgaccacgatcaagacgcatatccgtaatctgtatcaaaaaatgggtattacccatcggcaggatgctattcaacaggctcaacatttgatgcaaatgatggggttgagtgttgcatcaatgaatatttaa

SEQ ID NO: 1570 - DNA, 279 bp, Xenorhabdus bovienii
  Coding sequence Name=Xb4151_4152.C428.gene31.dna; Position on contig =22977..23255bp; Strand=+
atgaataaaactgataccaaaaccctgttcaatgttattgattcattttcaccactaacattcattaatgcccaaccaaatttagagaaacgtctgtcttttgcaaacaggttgattgatttcattgtgttaagttgcaccctgtcacattctttgcttgcaatttttcctgttcccaatgaaattgcgaaaagcctcgaaaaaacaggacaagtaggaaatttttcctatcaagttgttggtcaatttcttcagccacccgccttgctgtttatttaa

SEQ ID NO: 1571 - DNA, 135 bp, Xenorhabdus bovienii
  Coding sequence Name=Xb4151_4152.C428.gene32.dna; Position on contig =23215..23349bp; Strand=+
ttggtcaatttcttcagccacccgccttgctgtttatttaattacagccaatggctacgcccttgcactcctccctgtgaatatccccgtaggatgatgcctaccgcttcaagaatcttcagcatatcccgataa

SEQ ID NO: 1572 - DNA, 2409 bp, Xenorhabdus bovienii
  Coding sequence Name=Xb4151_4152.C428.gene33.dna; Position on contig =23394..25802bp; Strand=+
atgcaacagcccaaattagatagagccgtctttcaggccgcgcttacacgccagtggcagcgctttggccttagttcagcacaggaaatgaccccacatcagtggtggcaggccatcagtgctgcactattagaattacttccctcttccagcccgaaccatggtcatcagttgcataactctaagcgtcatgtgaactatatttcgatggaatttctgataggccgtctgacagccaacaatttgctgaatcttggctggtatgacgatgttcaggcttatctggcagaggatgggctgactttgagtgatttacttgaacaagaagctgatcctgcattaggcaatggtggtctgggtcggctggcagcctgttttcttgactcaatggcaacgattgatcaacccgcaacaggctatggccttaattatcagtatggcctgttccggcaatcctttgatcaaggattacaaattgaggcacctgatgactggaagcaaggctcctatccgtggtttcgccataatgcccaattgaaagttgacgtgggttttggcgggaaaatcgtgatgacagacgaaggtcatgaaacttggcttcctgcctttaccttgattggcgaagcttgggatctgccggtcgttggctatggtaatggcgtcacacaacccctgcgcctgtggcaggcaacacacgataacccttttgatctgtcacttttcaatgacgggcagtttctgaatgctgaacaacaaggcatcgaagccaccagcctgaccaaagtgctttacccgaacgataaccatcaggacggaaaacgcctgcgcctgatgcagcaatatttccagtgtgcctgtgcggtggccgatattctgcgtcgtcatcagcaggcgggccgcaaggtggaagaattaccacgctacgaagttatccagcttaacgatacccacccgactatcgccgtccctgaaatgatgcgtctcctgctggatgagcacagattggattgggaaaccgcatgggaaattacggggcagactttcgcctatactaaccatactttactaccagaaggtttagagcgttgggatgagcatctagtcagtgaactattgccacgtcatcaccgcattattcaggaaatcaaccgtcgcttccagaaaaccgtggagcaaacctggcccggcaatcaacaggtgtgggaaaaattagccgttactcacggaaatcaggtaagaatggctaacctctgcgtagtggcctgttttgctgtcaacggtgtggcagcactgcattcatccctaatcgtgacggatctgtttccagagtattatcacttatggccgaaaaagttccataacgtaaccaatggcgtcacaccgcgtcgctggttaaaacagtgcaatccagcactctcctcactgattgaccaaaccttgaatcatgaatgggttaatgatcttgagagcctgaaacaactcgaaccttatgccaacgatacagctttctgcgaagcttatcgcagcatcaaacaggaaaataaaatccggttgtccaactacgtcaataaagtcatggggcttaagattgatccccacgccatttttgacgtgcagataaaacgtctgcatgagtacaagcgccaacatttgaacctgctgcatatcctctcactgtatcggcagattcaggaaaatccgtcactggatgtccacccccgcgtcttcctgtttggtgccaaagcagctccgggatactatctggcaaaaaatattatttcagccattaaccatgcggctgaaaagatcaatcatgatccgatcgtccgtgatcgtatcaaaattgcctttattcccgattacaacgtttccaccgcagaattgatgatcccagccgccgatgtctcagagcaaatttctaccgcaggtaaagaagcctccggtacaggcaacatgaaactggccttaaacggtgcactgaccatcggtacgttagatggcgccaatgttgaaatcgccgaacaagtcggcaatgatcatatttttatcttcgggaataatgttgaagaagcaaaagccttactgaaaagtggctacaatccacggcacatcctccagcagaaccctcatctacaaggcatactggatgcacttgccagtggtgaattcagccacggagacacacaagcattcaatctcatgctgcatagcttggttgatggcggtgatccttatttggtactggcggattttgactcctactgccaggcccataagcagattgataccctataccgtaatcctcaacactggacacacagtactattctcaatactgcccgcatgggtaaattcagttctgaccgagctattcaagattaccaacagcgtatctggcaggccaaataa

SEQ ID NO: 1573 - DNA, 2109 bp, Xenorhabdus bovienii
  Coding sequence Name=Xb4151_4152.C428.gene34.dna; Position on contig =25811..27919bp; Strand=+
atggaaaataaacacctcgacaatttggcaacagaggctggcatagccgccgaatatattaatgcctacgggaaaccgcaggctatccctgccgaaattcggcatcggatattggcagccatgtatacagacccaccggccaataggccggtttctgatgcatctattcttaccctgcctgtggttaaagtgatgactcaaggtcagacaatcactttacctttgagcagtacagaaaattatcgatggcaaatacagacagagcaaggagagacatttcaaggggactgccaatatcaaatcactctgccgaccaacctccctctgggctatcacacactgacattaatgccagtaaaatcaatatcagtaacagaacctcatagccaacacccggttatgcagattattgtgacgccagaacgttgctacgagccagagacactgataaatggcgaaaaactctggggagcctgtatccagctctataccttgcgttcagaaaataactggggaatcggcgattttggcgatttgaaatatatgctgcaagaactgacgcaacggggtggcgcatttatcggcctgaatccacttcatgccatgtatccagccatgcctgaagacgccagtccctacagcccttcttcccgtcactggctcaatatcatttatattgatgtgaaccaagtagaagatttcacatacagtgtcgaagctcaaaaatggtggcgattgccggaaactcaactcaagctccagcatgtccgccaaacaggattagtcgattacaccagcgtgatgacattaaaaataacagcgctgcgtctggcttatcaacagtttcaaacccgatccgctacagatcccctgcatattgcttttcaacaatttgttaccaaaggtggtaaaagcctttattctcaagcagcctatgatgctctgcaccgtaaactctacgacgaagacagcgcttactggggctggccggtatggccagaaaaatatcgtgaacctgatagcgatacggtgaaagaattctgccagtcacattggccggaagtggagtttttcctctggttacaatggctggccgatacccaattagctggctgctttaccgaaagccagcacaatcatatgcccatcggcatttatcgtgacttggctgttggtgttgcacaaggcggctcagaaacatggtgcaaccgaacggtgtattgcaccaaggcatctattggcgcaccaccggacatactcggcccactcggacaaaactggggcttacctccgataaacccccatgtattacgagtccaagcctatcagccttttattgaattactgcgtagcaatatgcgccactgcggggcattacgtattgatcacgttatgtcactactcagactatggtggataccacaaggagaaactgccgataaaggggtttatgtccattatccagttgacgatttgctggcgatactggcgctggaaagccaacgccatcactgtatggtgattggcgaagatttagggatcgtgccagaagaaattgtcggcaaattacatacccgaggtgtctattcctataaggtgttctattttgaacgggatgggcacggagaattccgctcacccgatgagtaccccacgcaggcaatggcaaccattactacccatgatttacctacattacgcggattctggcaaaacaaggatttgatattgggggaatcgatcggcttatacccagataaaactctacttgatgggttatatgatgaacgtaagcgttgtaagcagaagttattggacggtctgaaccgccatggttattcatctgcatcactgagtatgacagacacgccagctccgatgtcagcctctatcaatcaaaacatacatcactacattgcccacagcaccagtgccttattgggattgcagcccgaagactggctagatatggaactccccgtcaatattccgggaacgtccacagagtatcccaactggcggcgcaaactaagcattacgctggaagctatgttccaagatgaacatatcaaccaattacttcaaacggtaggagagtaccgaaggtaa

SEQ ID NO: 1574 - DNA, 891 bp, Xenorhabdus bovienii
  Coding sequence Name=Xb4151_4152.C428.gene35.dna; Position on contig =27992..28882bp; Strand=-
atggcgatggtgcaaccaaaatcacaacggtggcgggtaggggcaacacatatgttaatgctgtcttttattgcattgattttattgccaatgttgatggtgattgctatttctttgcgacctggaaattttgccacaggtagtcttatccctgaaacaatttcatgggaacactggaaactggcgcttggttatagcgtagagtccccagatggacgtatcacccccccaccattccccgtcatacaatggctgtggaattcagtaaaaattgcattcattacggctacggggattgtggctctgtcaacgacctgtgcttatgcctttgctcgaatgcgttttcgtggcaaaagcactttgttaaaagggatgttgattttccagatgttccctccggtactttcgctggtggcgctatatgcgctttttgatcgattaggtgcctatattccatttatggggcttaatactcacggtagtgtgatttttgcctatatgggagggattgcactgcatgtatggacgatcaaaggttatttcgaaacgttagatgggtctctggaagaagccgcaatgttggatggtgcgacatcgtggcaagtttttcgtttgatattattaccgctttccgtaccaatactggcggtggtgtttatcctgtcttttattggtgtcataaccgaagttcctgtggcgtcactgctgttgcgggatgtagacagttatactctggcagtaggaatgcaacagtaccttcatccacaaaactccctatggggggattttgctgccgcagcggtgctttctgcaatccctatcaccgtgatgttcctgcttgcacagcgctggttagtcggtgggctaacatcagggagtgtgaagggatga

SEQ ID NO: 1575 - DNA, 1566 bp, Xenorhabdus bovienii
  Coding sequence Name=Xb4151_4152.C428.gene36.dna; Position on contig =28895..30460bp; Strand=-
atgatgtcagcgagattggacaaaacagaatggtggtcgcatcctgtcctaaaatggttcggagtcagtctgtgcctattttttaccggttatttgattgtattgatgtatgcccagggtgaatatctgtttgccatgctgacactggtattactgggaagtggtatttatgtctttgccaatcgtaagtcttatgcttggcgttatacctatccgggaattgcgggcatgagcctgtttgtattgtttccacttatttgtactgttgctattgctttcacgaactatagcagtacaaatcaactgacttttgaacgggctcaaacggtgttgatgagtcgtcaatatcaggcaggtcagacacttaatttcaaactttatcctgaatctgaacagtgggtactggccttgagtgttcctgatagctctcaattactggtgtctgatcctttttctttatctacatctgcgggggaagaggtcattctgcctttgcataagcaggaaaaggtttttgagagtgatgccgctgcattgcgaaccataacccagtaccggcaggcgttaggtcagcttgttactgttctgccggatggcagtaagttacgtatgagttcattgcgtcaattctccggcatacatcccctctattccattggggaagacggcatcaccctgaccaataatcaaacggggacagaataccgaccaaatatggatacagggttctatcaagccacgaacgctgagggcgtctggagtgagggaacattaagcccgggattcacggtttctgtcggttggaaaaactttttgcgggttattcaggatgacggtatccaaaaaccctttctttcgatttttgtctggactgtgatcttttccctgctaacggtgatattgacggtggcgctgggtatgatccttgcgtgtattgtgcagtgggaggcgctcaaaggacgggcaatttatcgtgtactgcttattttgccgtacgctgttccttcgtttatttccatcctgatttttaaggggttatttaaccagagttttggggaaatcaacctgctgcttaacgggctgtttggtttgaaaccggagtggtttaccgacccaacactggcgcgaacgatgttgattatagtgaatacgtggctgggatatccctatatgatgatcctttgcatggggctgctgaagtcaattcctgatgatctttatgaggcatcggctattgatggggccgggccattacataatttttccagaattacttttccattgctgattaagccgctgactccgttgataattgccagtttcgcttttaattttaataactttgttttagttcagttgctgaccaatggcaggccggatcgcattggtacaacaacccctgcgggttataccgatcttttagtgaattatacttatcgtatcgcttttgaagggggcggaggacaggattttggtttggctgcggctattgctacgttgatttttcttttggtcggggcattagccatcattaatctgaaagcgactcgtattaaatttgattga

SEQ ID NO: 1576 - DNA, 1200 bp, Xenorhabdus bovienii
  Coding sequence Name=Xb4151_4152.C428.gene37.dna; Position on contig =30593..31792bp; Strand=-
atgacaaaaacaactctgaaagtgggatctcgcgctctgatgctttccgttttaacaacatggatactctctgcccctgcttttgcaaagctggaagaaggcaagctggtgatttggatcaacggtgataagggatacaacgggctggcacaggttggtgagaaatttgcaaaagaaactggcattcctgttgctgttgagcatcccgataaattcgaagaaaaatattctcaaatagcagcgaacggtgatggaccagatatcattttctgggcgcatgatcgttttggtggctatgcccaatctggtttattggccgaagtgacacctgaccaaccgttcatggacaagttatttccttttacctgggatgcggttcgttatgatggcaaactgattggttatcccattgcagttgaagcgctttctcttatctacaataaagatttagtgaaatctccgccaaagacatgggaagagatccctgcgctggataatgaactgaaaaagcagaataaaagcgcaatcatgtttaatttgcaggaaccttatttcacttggccactgattgctgctgatgggggctacgctttcaaagtggagaatggtgcttataacaccaaagatagcggcgtgaataatgcgggttccaaagcgggaatgcaattcttggttgatttggtgaaaaacaaacatttgagtgctgatatcgattactccatcgctgaagccgccttcaataaaggcaaaacagcaatgaccatcaatggcccgtggacttggacgaatatcgacaaaagtaagatcaattatggtgttactttattaccaacctttaaaggaaaaccctctaaaccgtttgttggcatcttaaccgccggaatcaatgcagctagtcctaataaagaattggcgaaggagtttctggaaaattatctgctgaccaacgaaggcttggcaaccgtggataaggacaaaccgttgggggctgtggcgctgaaatcttatcaggatatccttgcgaaagatccacgtattgctgccacgatggcaaatgctcagcaaggtgaaattatgccaaatgtttcgcaaatgagtagtttttggtatgccatgcgcagtgctgttcttaatgcagtgaatggtcggcaatctattgatgctgcgcttaatgatgcagaaaatcgaatagctaaataa

SEQ ID NO: 1577 - DNA, 282 bp, Xenorhabdus bovienii
  Coding sequence Name=Xb4151_4152.C428.gene38.dna; Position on contig =31732..32013bp; Strand=+
atgttgttaaaacggaaagcatcagagcgcgagatcccactttcagagttgtttttgtcatcattccgtccttttcgtcgtttgcaggttcaagatgaatttctcgttacaccgctagaaaatggttcccagtgtgcaatcaacagaaagcaagctcatcctcccctgttctacgcctcaccacaaatgagtgtgaagttgattacaaaaatactgaaaatcagtatgttaaccttaaagagacatcgatttttgggattaaaatcacatcttgctcagtga

SEQ ID NO: 1578 - DNA, 1296 bp, Xenorhabdus bovienii
  Coding sequence Name=Xb4151_4152.C428.gene39.dna; Position on contig =32003..33298bp; Strand=+
ttgctcagtgatttttcacagaatatcccaatcacattaatctcatcctccttatgcctcccccataaaaaattatgggatggaggatttttattcctgttattttgcacacaattttgctaccagtttttcactaagttttttactacaaacataaaactagggtggcaactccgaggggaacacatgtccagcgtcacactccgcgatgtatctaagacttatggtgaaactgtcatttccaaaaacttcaaccttgagattgaagaaggggaatttgttgtttttgttggtccatcaggatgtggaaaatcaacactgttaaggatgattgcaggtctggaagacattacctccggtgatttactgatagcagggcagcgaatgaatgatgttcctcctgccaaacgcagtgtaggtatggtttttcaatcctacgcgctatacccccatttgtctgttgctgacaatatgtcattcggcatgaaactggccgggatcaaaaaaagcgatattcagaagcgagttcaacaagttgcagaaactcttcagctcgcccatctgttggatcgtcgccccaaagcactatctggagggcagcgtcagcgagttgccattggccgcactctggtcgctgaaccgaatatatttcttctggatgaaccactctccaatctggatgctgcgctgcgtgtccagatgcgcattgagatttcacgcctgcatcaacgcctgcaacgtacgatgatctatgttacgcatgatcaaaccgaagccatgactctggcggataaaatcgtcgttctggatgcaggcaacattgctcaggtcggtaagccactcgaaatttatcactaccctgccaaccgttttgttgcgggcttcatcggttccccaaagatgaatttcctaccagtcaaagtctctgccacagcaatcgatcaagtacagattattttgcctaacgggcagcctgtctggctacccgttgaaagtaaggatgtcactgtcggtagcaatgtatctctaggtatccgccccgaacacctgttgcctaatgatgtggccgacgtaacgctggaaggaacagtgcaaatcgtagagcaactggggaatgaaactcaggttcacatccgcatacctgcaattcaccaaaatttggtttaccgccagcctgatgttgttctcgtggaagaaggagcaaccttcactatcgggttagctccccatcgctgtcatctattccgcgaagatggcactgcatgtcagcgtttgcataaagagcccggagtctga

SEQ ID NO: 1579 - DNA, 1278 bp, Xenorhabdus bovienii
  Coding sequence Name=Xb4151_4152.C428.gene40.dna; Position on contig =33332..34609bp; Strand=+
atgcgtatcttacctctttcattggccatactgactggtttgttatccatgcaggccactgcggtggagttccacggttatgcccgttctggcattggctgggcaggtaaaggaggagaacagaaatgtgtccaaagtaccggtgcacagagtaaataccgtctgggtaatgagtgtgaaacctatgcagaactaaaattagggcaagagttatggaaagagggtaacaagcgtttctattttgataccaatgtggcctattccgttgcacagaaagatgactgggaatcaaccaacccagctttccgcgaagtcaacgttcaggcaagtaacgtcattgactggctgcctggttcgacgctatgggcaggtaagcgtttctaccagcgacacgatgtgcatatgatcgatttttactactgggacatctccggccctggagcaggtctacaggatattgatttgggatttggtaaactttcccttgccgtgacccgcaatacggaatccggtggttcggttggctggatcgccgataaacgcgatgaaattccgacttccaatgatgttttcgacgtacgactggctaatttacaggtgaatgaaggcggcactctagagcttggcatcgactatggacgtgccaatgcacgcaagggttaccatctggatcaaaaagcatctaaagatggtgtaatgctgacagctgaacatactcaaagcatgttaggtggctttaataaatttgtcgtacagtacgccactgatgccatgacttcctacaatagtggtcattcagaaggtgccagcgtaaataatgatgggaatatgttacgcatcctgaatcatggtgctatcaatattacggataaatgggatctgatgtatttggccatgtatcagaatatagatcgcgataatcgcaacggcaacacatggtacaccgttggtgtccgcccaatgtacaaatggacgcccatcatgagtactttgctggaagtcggctatgataatgtgaaatctcaacgcaccaaagacaccaacaatcaatacaaaatcacgctggcacagcaatggcaggcaggtgacagtatctggtcacgcccagcaatccgtttgtttgcaacttatgccaaatgggatgaaaaatggggctatgcaaacaaaaatggcagttacacgaaaggtgttgcctacagtgattcgtcatcacatcgtttcagccgtggtaacagtgatgaattcacctttggcgcccaattcgaagcttggtggtaa

SEQ ID NO: 1580 - DNA, 993 bp, Xenorhabdus bovienii
  Coding sequence Name=Xb4151_4152.C428.gene41.dna; Position on contig =34609..35601bp; Strand=+
atggattcagacaaggctaatacaatgaaaataaaactgctttcagtttgtctcagtactctgctttgctatgcacttcccgcagcgagctatgcagcacctgatacagcaatgcctgacagttctgacaatatagttgtgcccgatagcaaactgcacaataccacagcacctgcgctgactatatcgtccttacagaaattaaagtggttgccagctaatactcatgccacacagactattatcctgaatagtgcatcatcccggattcatgaaggggatattcaaggagcggtagctgcatttgcattgccagccaatcagggtgcattagagatcaccctgaatagcctgataaaggataagcaggtttattcgcctaatgtgttagtacttgatgagcaattgcgccccgcagccttttacccaagtcattattttcaatatcaacgaccgggcatcatgtcagttgacaggcttgaagggacgttaaaattaacccccgcattagggcaacagcaaatttacctgctggtttataccacccgtgctgatttacagtcatctacacaaatggtcgatccagctaaagcctatgctcagggagtaggtaatgccgtacctaatattcctgatccgatggctcgccatacggaaacaggaatattaacgctaaaagtgaaatcagaacgcgatgccggtaatgtcctgattggtcaggccttctcagcaccagcgccaaaacctgtcatagtcggctccatgcaaacagcaacgacggccgttaccgcactacaacctgttgtgccggctattgcacccaaaaacaaaccagttctgggtgataccgaaaaatatttcaataacgccattaagaaagcgattaatgacggtgatattgataaagcactacatctgctggatgaggctgaacgcttgggatcagcaaccgcaagagatacctttatcaaaaggataaaaaatctcaaatag

SEQ ID NO: 1581 - DNA, 96 bp, Xenorhabdus bovienii
  Coding sequence Name=Xb4151_4152.C428.gene42.dna; Position on contig =35604..35699bp; Strand=-
ttggcaaaaattctaatagagtatctggttaataaagggattatagattgtaaaatgaatatttcatttcttactataaccccaataataaattga

SEQ ID NO: 1582 - DNA, 1254 bp, Xenorhabdus bovienii
  Coding sequence Name=Xb4151_4152.C428.gene43.dna; Position on contig =35822..37075bp; Strand=-
atgagacaaatcgtctatgttattgaagtcgctttattactgttttttagtttcttttccaattctgtattagcacagcaccacaatttatcaaactatcgttacatggaggtgactaaagacagtgaaatatatgctcgggtaggtgaacatattgtgcaggttggattattaaagaaaggtcattttctaaaagcggctcaggaacaaggcaagcagaacgatcattacgaatttcattttggtaatggtcaaggctatattgataaagaaaatctaaaagaagtcaaacaatctgtatctttcaatggttcgctcgctactcttgataaaaaaactagcgaaaatttaatgatttttaaggatattcgggtttatagcacgcctgaagttaatagttcatcgattgcgattctgaatgctaatctccgctatccaattttagacaaactgaaagatccctcatatcagacgtggtatgaagtgaatctggggggtcgcgtcggttacattagtggtcaggatgccgaattggatcatggtattcctttgctgacttatcaccatattctgaaagataaagagaacaagcgttttctccatacctcaacaacgacctctttatcggcttttcgcgagcaaatggattatttgaaacaggcaggttacaccacgatttcattgtatgagttggaaggttacctgaacgggactctcaacttacctgcaaaagtggttggtctgacgtttgatgatggattgaaatccatttaccgttatgcctacccaatcttgaaaaagaatgggcagaaagcgaccctttttattatttcatccagaattaagcggtatccgcaggaatggaattctgaaaacctgcaatttatgagtctttctacattatatgctacaaaggatgtgtttgattttcagtcccatacccactttttgcatcgtctggggaaaaacaaaggaccaatattattcagccgttcataccacactattctatatgattttgaacgttctcgtcgtgcgttatcacaattcaatccccatgttctctatctctcttatccctttggtggatataaccagcaagctatagatgcagcccgaaatgcagggtttcatttagcggtcacaaccaaacagggtaaagtaaaactgggagataacccattttcactgaagcgtttatatatattacgaaccgattctattgaaaaaatggaaaaaataattgctaattaa

SEQ ID NO: 1583 - DNA, 4272 bp, Xenorhabdus bovienii
  Coding sequence Name=Xb4151_4152.C428.gene44.dna; Position on contig =37169..41440bp; Strand=-
atgggccactcacctaacaggtctaactccgacaggagccatttcgtgaaagacttattgaagtttctgaaagcgcaaactaagaccgaagagtttgatgcgatcaaaattgctctggcctctccagatatgatccgttcgtggtcattcggggaagtaaaaaagccggaaaccattaactaccgtacgttcaagcctgaacgtgacggtcttttctgcgcacgtatcttcgggccagtaaaagattacgaatgcttgtgtggtaaatacaagcgtttgaaacaccgtggtgtgatttgtgagaagtgtggcgtcgaagtgacccagactaaagttcgtcgtgaccgtatgggtcatatcgagctggcatctccaaccgctcatatctggttcctgaaatctttgccatcccgcatcggtttgctgctggatatgccactgcgcgatattgaacgcgtactgtacttcgaatcctatgtggttgttgaaggcggcatgaccagccttgagcgtgcacagatcctgacagaagaacagtatctggatgcattggaagagttcggtgatgaatttgatgcaaaaatgggcgcagaagcgatccaggctttgctgaaaaaccttgatctggaaaacgaatgtgaaaccttgcgtgaagagttgaacgaaactaactctgaaactaaacgcaagaagctgaccaagcgtattaaactgttggaagcattcattcagtctggcaacaagccagagtggatggttctgaccgttctgccagttttgccaccggatttgcgtccattggttccactggatggcggccgttttgcaacttcagacttgaacgatttgtatcgtcgcgttattaaccgtaataaccgtctgaaacgcctgctggatctggctgcgccagacatcatcgtgcgtaacgaaaaacgtatgttgcaggaagcggttgatgcgctgctggataacggccgtcgcggtcgtgcgatcaccggctctaacaagcgtcctctgaaatccttggcagacatgatcaagggtaaacaaggtcgtttccgtcagaacctgctgggtaaacgtgttgactactcaggccgttctgtaattaccgtagggccatacctgcgtctgcatcagtgtggtcttcctaagaagatggcattggagctgttcaagccattcatctacggcaagctggaactgcgtggtctggcgacgactatcaaagccgccaagaaaatggttgagcgtgaagaagcggtcgtatgggatatccttgatgaagtgatccgtgagcacccagttctgctgaaccgtgcaccgacccttcaccgtttgggtatccaggcattcgagccagttctgatcgaaggtaaggcaatccagttgcacccactggtgtgtgcggcctataacgccgacttcgatggtgaccagatggctgttcacgtaccgctgacactggaagcccagttagaagcgcgtgcgctgatgatgtctaccaacaacatcctgtctccagcgagcggtgagccaatcatcgttccctctcaggacgttgtattgggtctgtactacatgactcgtgactgtgttaacgccaaaggcgaaggcatggttttgaccggtcctaaagaagctgaacgcgtttatcgcgccggtctggcttctctgcacgcccgtgtcaaagttcgtatcactgaagaagtgagagatggtgaaggcaatgtcaccaccaatacgggtctggtggataccaccgtcggtcgtgccatcctgtggatgattgtaccgcgtggtctgccttactcgctgattaaccaggcgttgggcaaaaaagctatctccaagatgctgaacacctgttaccgcattctgggcctgaaaccaaccgttatcttagctgaccagaccatgtataccggttttgcttacgctgcccgttcaggggtatccgtaggtattgatgacatggttattcctgagaagaaagaaggcatcattgcagaagcggaagcggaagtggccgaaattcaggaacagttccagtcaggtctggtaactgcgggcgaacgctataacaaagttatcgatatctgggctgcggcaaacgaacgtgttgccaaggcgatgatggaaaacctgtctactgaagctgttattaaccgtgatggcgaagaagaacagcaagtttctttcaatagcatctttatgatggctgactccggtgctcgtggttctgccgctcagatccgtcagctggcgggtatgcgtggcctgatggcaacaccagatggttccatcatcgaaaccccaatcaccgcgaacttccgtgaaggtttgaacgtactccagtacttcatctcaacccatggtgctcgtaaaggtttggcggataccgcattgaaaacggcgaactccggttacctgactcgtcgtctggttgacgttgctcaagacttggtcgtgactgaagatgactgtggtactcacaacggtatcttgatgactccggttatcgaaggtggtgatgttaaagaaccactgcgtgagcgtgtactgggtcgtgtgacggctgaagacgtcctaaaaccaggtacagcggatattttggttccacgtaacactctactgaatgaaaaatggtgtgatctgttagaagaaagctccgttgacagcgtgaaagtacgctccgtagtaagctgtgagacagacttcggcgtctgtgcaaactgttacggccgtgaccttgcccgtggtcatatcatcaacaaaggtgaagcagttggtgttatcgcggcacagtcaatcggtgaaccaggtacacagttgacgatgcgtacgttccacatcggtggtgcggcatctcgtgcggcagcagaatccagcattcaggtacgtaacaaaggtcatctgaagctgttcaacgcgaaatacgtcactaactcagcaggcaaactggttattacttctcgtaatacagaactgcgtctgattgatgatttcggccgtaccaaagaaagctacaaagtcccttacggctcggtattgtcgaaaggtgatggcgagacagtgactggcggcgaaaccgttgcgaactgggatccacacatcatgccagtcgtgagtgaagtgtccggtatcatccagttctatgacatggttgatggccagaccattactcgtcagacggacgaattgaccggtctgtcatcactggtggttctggacagtgcagaacgtacaggtagcggtaaagacctgcgtccggcactgaaaatcgttgacgctcagggtaaagatgttctgatctcaggtactgatatgcctgctcagtacttcctgccgggtaaagcgattgttcagctggaagatggcatgtctatctctgcgggtgatacgctggcgcgtattcctcaggaatctggcggtactaaagatatcaccggtggtctgccacgcgttgcggatctgttcgaagcacgtcgtccgaaagagcctgcgatcctggcagaaatcagcggtattgtttccttcggtaaagaaaccaaaggtaaacgtcgtctggtaatcagcccattggatggtagtgatgcttacgaagagatgatccctaaatggcgtcagctcaacgtattcgaaggtgaagttgctgaacgtggtgacgtgatctccgatggcccagaatctccacacgatattctgcgtctgcgtggcgttcacgcggttgcccgctacatcaccaacgaagtacaggaagtttaccgtctgcaaggcgttaagattaacgataaacacatcgaagttatcgttcgtcagatgctgcgtaaagtgactatcgcgaatgcgggtagttctgagttcctcgaaggcgagcaggttgaatacgcgcgtgttaaagtcgcgaaccgtaagctggaactggatggcaaattagcggctaccttccatcgtgacctgttgggtatcaccaaggcatcactggcaacagaatccttcatctctgcggcgtcgttccaggaaacaacgcgcgtactgactgaagcagctgttgcaggtaaacgtgatgaattgcgtggcctgaaagagaacgtcattgttggtcgtctgatccctgcgggtacaggttatgcgtaccatcaggagcgcatccgccgtcgtcacgcaaacgaagtggttgaagcgccaccagtcagtgttgatgaagcgactgcaaaccttgctgaattgttgaatgcaggtttcggtagcagcagcgataaagagtag

SEQ ID NO: 1584 - DNA, 120 bp, Xenorhabdus bovienii
  Coding sequence Name=Xb4151_4152.C428.gene45.dna; Position on contig =41432..41551bp; Strand=+
gtggcccatgccactcccccctatgaccagtgtaaccactggctggtaaactgcccggcatattcataccggacagtaccagcgggaaaacgatttattcgtcttccagctcgatgttga

SEQ ID NO: 1585 - DNA, 4029 bp, Xenorhabdus bovienii
  Coding sequence Name=Xb4151_4152.C428.gene46.dna; Position on contig =41526..45554bp; Strand=-
atggtttactcctataccgagaaaaaacgtattcgtaaggattttggtaaacgtccacaagttttggatattccatatctcctttctatccaacttgactcgttccagaagtttatcgagcaagatcctgaaggccaaaatggactggaagcggccttccgttctgtgttcccaattcagagttacagcggcaattccgagctgcaatatgtaagctaccgtcttggtgagcctgtttttgatgtgcaagagtgtcagatccgtggtgtgacttattccgcaccgctgcgcgttaaactgcgtctggtgatctatgagcgcgaagcgccagaaggcacagtcaaagacattaaagaacaagaagtctacatgggtgaaattccactcatgactgataacgggactttcgttatcaacggtactgagcgtgttatcgtatctcagttgcatcgtagcccaggcgttttttttgacagcgataagggtaaaacccattcatccggtaaggtactgtataacgcgcgtatcatcccttaccgtggttcatggctggatttcgaattcgatcctaaagataatctgtttgtgcgtatcgaccgccgtcgtaaactgccggcttcgattattctgcgtgcaatgaattatagtactgaagacattctgaacctgttcttcaacaaaacgatcttcgaaattcgcgataacaaattgcagatgactctggttccagaacgtctgcgtggtgaaacggcttcatttgatattgaagcaaacggcaaactttatgttgaaaaaggccgtcgtatcaccgcacgtcatatccgtcagttagaaaaagatcaggtagaccgtattgaggttcctgtcgaatatatcgcgggtaaagtcgtcgcaaaagattacatcgatcaaaatacgggtgaaatcctctgcgctgctaacatggagctctctctggatctgctggcgcgtctgagccagtctggtcacaaaaccatcgagactctgtttaccaacgatctggatcacggtgcatacatctccgaaactctgcgtgttgacccaaccaatgatcgtctgagcgcgctggttgaaatttaccgcatgatgcgtccgggtgagccaccaacacgcgaagccgcagaaaatctgtttgagaacctgttcttctctgaagaccgctatgatctgtctgcggttggccgcatgaagttcaaccgttctctggatcgtacagaaattgaaggttccggtatcctgagcaaagaagacatcaccgatgtgatgaagaagctcatcgatattcgtaacggtaaaggcgaagtggacgatatcgaccacttgggtaaccgtcgtatccgttctgttggcgaaatggcagaaaaccagttccgcgttggcttagttcgtgtagaacgtgctgtgaaagagcgtctgtcactgggcgatctggataccctgatgccacaggacatgatcaacgctaaaccaatttctgctgcggtaaaagagttctttggttccagtcagttgtcccagtttatggatcagaacaacccgttgtctgaaattactcataaacgtcgtatctctgcattgggcccaggcggtctgacccgtgagcgtgcaggcttcgaagtacgtgacgtacacccaacccactacggtcgtgtatgtcctatcgaaacgcctgaaggtccaaacatcggtctgattaactcactatccgtttatgctcgtaccaatgagtatggtttccttgaaaccccttaccgtttggtgcgtgacggcgtagtaaccgatgaaattcattatctgtctgctatagaagaaggtaactacgtcattgcacaggctaacaccgtgctggatgaagaaggccacttcgtagaagatctggtgacttgccgtcattatgatgaatccagcttgttcaaccgtgatcaggttcagtatatggacgtttcgacacagcagatcgtgtccgtcggtgcttctttgatcccattccttgaacacgatgacgccaaccgtgcattgatgggtgcgaacatgcaacgtcaggcagttccgactctgcgtgctgacaagccgctggttggtacaggcatggagcgtgcagttgctgttgactccggtgtaacgtcagtcgccaagcgtggtggtgtgattcagtacgtggatgcatcccgtatcgttattaaagttaacgaagacgaaatgtacgcgggtgaagctggcatcgatatctataacctgaccaaatacacgcgttccaaccagaacacctgtatcaaccagatgccatgtgtttctctgggtgaattggtagagcgtggcgatgtactggctgacggcccatccactgatttgggtgaactggcgctgggtcagaacatgcgcgtggcgttcatgccatggaatggttataacttcgaggactccattctcgtatctgagcgtgttgttcaggaagaccgtttcacaaccattcacattcaggaactggcttgtgtgtctcgtgacaccaaactggggcctgaagagatcactgctgacattcctaacgtgggcgaagctgcactgtctaaactggacgaatccggcatcgtttacattggcgcggaagtgaaaggcggcgatattctggttggtaaagtgacaccgaaaggtgaaacccaattaacgccagaagaaaaactgttgcgtgcgatcttcggtgagaaagcatctgacgttaaagactcttcactgcgtgtgccaaacggtgttgccggtactattatcgacgtgcaggtctttacccgtgacggtgtagaaaaagacaagcgtgcgttggaaatcgaagaaatgcagttgcgtcaggcgaaaaaagacctgacagaagaactgcgtatcttcgaagcgggtctgtttgcgcgtattcactccgtactggttgccggtggagttgaagcagaaaaattaagtaaactgccgcgcgagcgctggttagagctgggtctggctgatgaagaaaaacagaatcagttggaacagctggcagaacagtatgacgaactgaaaactgagttcgagaaaaaactggatgctaaacgccgtaagatcactcagggcgatgatctggcaccgggtgtgctgaaaatcgttaaagtatatctggctgttaaacgccagatccagcctggtgataagatggctggtcgtcatggtaacaagggtgttatctctaagatcaacccgatcgaagatatgccttacgatgaaaacggaacacctgtagacatcgtattaaacccgctgggtgtaccatcacgtatgaacatcggtcagattctggaaactcacttgggtatggcggccaaaggcattggtgacaagatcaatgccatgctaaaacaacagcaggaagttgccaaactgcgtgaattcatccagaaagcctatgaccttggtgacgatacccgtcagaaagttgacctgaatactttcactgatgaagaagttttgcgtctggctgaaaacctgaaaaaaggtatgccaatcgcaacaccggtcttcgacggtgcgaaagagactgaaatcaaagagctgttgcaactggctggcttgccgacttccggtcagatcacgctgtttgacggccgcactggtgagcagtttgagcgtcaggttactgtcggttacatgtacatgctgaaactgaaccacttggttgatgacaagatgcatgcccgttctaccggttcttacagcttggttactcagcagccgctgggtggtaaagcacagttcggtggtcagcgcttcggtgagatggaagtgtgggcattggaagcatacggtgctgcgtacaccctgcaagaaatgctcaccgtcaagtccgatgatgttaacggtcgtaccaagatgtataaaaacatcgtggatggtaaccaccagatggagccaggcatgccggaatctttcaacgtattgctgaaagagatccgttcgttgggtatcaacatcgagctggaagacgaataa

SEQ ID NO: 1586 - DNA, 147 bp, Xenorhabdus bovienii
  Coding sequence Name=Xb4151_4152.C428.gene47.dna; Position on contig =45517..45663bp; Strand=-
atgagtattacggaaaatattctattttctgttcgaacaaatagtgttgcagagtgctgtcctaaagggcgggcagagtgggtcactgatcagcgagctgaggaaccctatggtttactcctataccgagaaaaaacgtattcgtaa

SEQ ID NO: 1587 - DNA, 366 bp, Xenorhabdus bovienii
  Coding sequence Name=Xb4151_4152.C428.gene48.dna; Position on contig =45892..46257bp; Strand=-
atgtctatcactaaagaacaaattctggacgcagttgcagaaatgtctgtaatggacgttgttgaactgatcactatgatggaagaaaaattcggcgtttctgctgctgcagctgtagctgttgttggcggtgctgctgaagccgttgaagaaaaaactgaattcgacgtaattctgtctagcattggcgctaacaaagttgctgtaatcaaagcagtacgtggcgcaactggcctgggtctgaaagaagcgaaagacctggttgaaagcgcaccagctgctctgaaagaaggcatcagcaaagacgacgctgaagctctgaaaaaatctctggaagaagctggtgcttctgttgagatcaagtaa

SEQ ID NO: 1588 - DNA, 498 bp, Xenorhabdus bovienii
  Coding sequence Name=Xb4151_4152.C428.gene49.dna; Position on contig =46321..46818bp; Strand=-
atggcactaaatcttcaagacaaacaagcgattgttgctgaagtcagcgaagtagccaaaggcgcgctgtctgcggttgttgcggattctcgcggcgttaccgtaggtaaaatgactgaactgcgtaaagcaggtcgcgaagctggcgtttacatgcgtgttgttcgtaacaccctgatgcgtcgtgctgttgaaggtacggattatgagtgcctgaaagaagcgtttgttggtccaaccttgattgctttctctagcgaacatccgggcgcagctgctcgtttgttcaaagaattcgcgaaagcgaacccagcattcgagattaaagcagcagcctttgaaggtgagtttatttcaggtgaaaatatcgatcgcctggcaacactcccaacttacgaagaagcaatcgcacgcctgatggcaaccatgaaagaagcctctgcaggcaaactggttcgcactctggctgcgctacgcgatcagaaagaagctgcttaa

SEQ ID NO: 1589 - DNA, 123 bp, Xenorhabdus bovienii
  Coding sequence Name=Xb4151_4152.C428.gene50.dna; Position on contig =46778..46900bp; Strand=-
gtgtttcagcgctcaggcacgcttggtgctttgagtgaagtgagtcccgggttttcccggttaatccaggagcaagaagctaatggcactaaatcttcaagacaaacaagcgattgttgctga

SEQ ID NO: 1590 - DNA, 153 bp, Xenorhabdus bovienii
  Coding sequence Name=Xb4151_4152.C428.gene51.dna; Position on contig =46902..47054bp; Strand=+
gtgagcagaatccagaaaataaatttcatttggctctgtcaccgtctacgcaggatattaagtaatcacttacgcctgcggtcttggacggggcttggattaggccaagctccaaccgaaaactgttttctacctaatataggttttatataa

SEQ ID NO: 1591 - DNA, 702 bp, Xenorhabdus bovienii
  Coding sequence Name=Xb4151_4152.C428.gene52.dna; Position on contig =47157..47858bp; Strand=-
atggctaaactgaccaagcgcatgcgcactatccgtggtaaagttgatgcaactaaacaatatgacatcaacgaagctgttgctctgctgaaagaattggcaactgccaaattcgtagaaagcgttgacgtagctgttaatcttggtatcgatgctcgtaaatctgaccaaaacgttcgtggcgcaactgttctgccacacggtactggtcgttcagtacgtgttgctgtatttgctcagggcgcaaacgctgaagcggctaaagctgctggcgctgaactggtaggtatggacgatctggctgatcagattaagaaaggcgagatgaatttcgacgtagttatcgcatctccagatgcaatgcgcgttgttggccaactgggtcaaattctgggtcctcgcggcctgatgccaaacccgaaagtgggtactgtaactcctaacgtcgctgaagctgtacagaatgctaaagcaggtcaggttcgttaccgtaacgacaaaaacggcatcattcacaccaccatcggtaaagttgactttgacgctgacaaactgaaagaaaacctggaagccttggtagttgcgctgaaaaaagcaaaaccatcttcagctaaaggtattttcatcaagaaagttagcctgtctaccaccatgggtgcaggtgttgcgatcgaccagtctggtctgaacgcaacagcctaa

SEQ ID NO: 1592 - DNA, 429 bp, Xenorhabdus bovienii
  Coding sequence Name=Xb4151_4152.C428.gene53.dna; Position on contig =47862..48290bp; Strand=-
atggctaagaaagtacaagcctacgttaagctgcaagttgcagcgggtatggctaacccaagcccaccagttggtccagctctgggtcagcagggtgttaacatcatggaattctgtaaagcgttcaatgcgaaaactgaaagcattgaaaaaggcctgccaattccagttgttattactgtttacgcagaccgttctttcactttcgttaccaaaaccccaccagctgctgttctgctgaaaaaagcagctggcgttaaatcgggttctggtaaaccaaacaaagaaaaagttggtaaagtaaccagcgcacagatccgcgaaatcgcggaaactaaagctgcggacatgactggtgctgacgttgacgcgatgatgcgttcaatcgaaggtactgctcgttccatgggcctggtagtggagggttaa

SEQ ID NO: 1593 - DNA, 105 bp, Xenorhabdus bovienii
  Coding sequence Name=Xb4151_4152.C428.gene54.dna; Position on contig =48255..48359bp; Strand=+
ttgcagcttaacgtaggcttgtactttcttagccatctatatttcctctatatgggtattatcgcctcaaaaagaggctcccctaacgattcaggccccgtctaa

SEQ ID NO: 1594 - DNA, 546 bp, Xenorhabdus bovienii
  Coding sequence Name=Xb4151_4152.C428.gene55.dna; Position on contig =48460..49005bp; Strand=-
atgtctgaatccccaaaaaagcgttggtatgtcatacaggcattttctgggttcgaaggtcgtgttgctcaatctctgcgtgaacatatcaaattagatggtatggaagattctttcggcgaagttatggtgccgacagaagaagttgttgagatccgcagtggccaacgccgtaagagcgagcgcaaattcttcccaggttatgtcttggtacaaatggtaatgaacgatgcaacttggcatctggttcgtagtgtaccgcgcgtaatgggttttatcggtggtacatctgaccgtccggctccgatcagtgataaagaagtcgatgctattatggatcgtcttcagcaggttggtgataaaccacggccaaaaaccttgttcgagccaggcgaaatggttcgtgtcagcgatggcccgtttgcagatttcaatggcgtagtggaagaagtcgattacgaaaagagccgcttgaaagtttcggtttctatctttggccgtgctacgccagtcgagttggatttcagtcaggtagagaaagcctaa

SEQ ID NO: 1595 - DNA, 384 bp, Xenorhabdus bovienii
  Coding sequence Name=Xb4151_4152.C428.gene56.dna; Position on contig =49009..49392bp; Strand=-
atgagtgcgaatagcaatgctcaagaaagcaggcgtggtcttgatatagcaaaatggttactggtggctgtgctgctagtagttgctattgtgggtaattattattaccgggagtataacctggctctgcgcgcgatagccgtcgtggctattgttgctcttgcaggagcagttgcattctggactgcgaaaggtaaagccacattagcatttgcccgtgaagcccgcgttgaaatgcgtaaagtcatttggccaacacgccaagaagctctgcacacaacattgattgttgcagcggtgacagctgtcatgtctctgattttgtgggggctggatggtatactggtgcgtttagtttcatttattacaggcctgaggttttaa

SEQ ID NO: 1596 - DNA, 123 bp, Xenorhabdus bovienii
  Coding sequence Name=Xb4151_4152.C428.gene57.dna; Position on contig =49407..49529bp; Strand=-
atgcagatacgaaaagtcctactgaattatggtgccaagtcagatacaattacaattatctttgggttcggtctgatttgttttgctcttgcgaggcaagctggctatctatttacatcatag

SEQ ID NO: 1597 - DNA, 132 bp, Xenorhabdus bovienii
  Coding sequence Name=Xb4151_4152.C428.gene58.dna; Position on contig =49560..49691bp; Strand=-
gtgttcattctggaagggcatcgacagatgccctttttatacgttgtcttaagaagaacctatctcatcaatagttgtctgataatgaatggatcattactcaatggttgtagcgaattattggtgagatag

SEQ ID NO: 1598 - DNA, 1185 bp, Xenorhabdus bovienii
  Coding sequence Name=Xb4151_4152.C428.gene59.dna; Position on contig =49702..50886bp; Strand=-
gtgtctaaagaaaagtttgaacgtaaaaaaccgcacgttaacgttggtactatcggccacgttgaccacggtaaaactaccctgactgcagcaatcaccactgttctggcgaaaacttacggcggtagcgctcgtgcattcgatcagatcgataatgcaccagaagaaaaagcgcgtggtatcaccatttctacttctcacgtagaatacgataccccaactcgccactatgcgcacgttgactgcccaggccacgccgactatgttaaaaacatgatcacgggtgctgctcagatggatggcgcagttctggttgttgctgcaactgatggcccaatgccacagactcgtgagcacatcctgctgggtcgtcaggtaggcgttccatacatcatcgtgttcctgaacaaatgtgacatggttgatgatgaagagctgctggaactggttgaaatggaagtccgtgagctgctgtctcagtacgatttcccaggcgatgatacgccaatcatccgtggttctgctctgaaagcgttggaaggtgaagcagagtgggaagcgaaaattatcgaactggcagatgcactggattcctacatcccagagccagagcgtgacattgacaagccattcctgctgccaatcgaagacgtattctccatctctggccgtggtactgtagttactggtcgtgtagagcgtggtatcgttaaagtgggtgacgaagtttcaatcgttggtatcacagatacagtgaaaacaacttgtactggcgttgaaatgttccgcaaattgctggacgaaggccgtgctggtgagaacgtaggtgttctgctgcgtggtactaagcgtgacgaaatccaacgtggtcaggtactggctaaaccaggttcaatccagccgcacactcaattcgaatcagaagtttatattctgagcaaagatgaaggtggccgtcatactccattcttcaaaggttaccgtcctcagttctacttccgtacaactgacgtaaccggaactatcgaactgccagaaggcgttgagatggtaatgccaggtgacaacatcaacatgatcgttaccctgattgctccaatcgcaatggacgaaggtctgcgtttcgcaatccgtgaaggtggccgtactgtaggtgctggtgttgttgctaaagtgattgcataa

SEQ ID NO: 1599 - DNA, 2109 bp, Xenorhabdus bovienii
  Coding sequence Name=Xb4151_4152.C428.gene60.dna; Position on contig =50956..53064bp; Strand=-
atggctcgtaaaacacctatagcacgttaccgtaatatcggtatcagtgctcacatcgacgccggtaaaaccacgacaactgaacgtatcctgttttacacaggcgtgaaccataaaattggtgagactcacgaaggttcagcgacaatggactggatggagcaggagcaggagcgtggtatcacaatcacgtctgctgcgacaactgcattctggtctggtatggctaaacagtatgagccacaccgcgtcaatatcatcgacaccccaggccacgttgacttcactatcgaagtagaacgttccatgcgagttcttgacggcgcagtaatggtttactgtgcagttggtggtgttcagccgcagtctgagactgtatggcgtcaggctaacaaatacaatgttccacgtatcgcgttcgttaacaaaatggaccgtatgggggcaaacttcctgcgcgtagtagaacagatcaaaacccgtttggctgcgacccctgttccacttcaactggcaatcggcgctgaagataccttcaccggcgttgttgacctgttgaaaatgaaagcgatcaactggagtgaagcagatcagggcgtgactttcgagtacgaagagatccctgctgacatggttgagctggctcaggaatggcaccagaacttgatcgaatccgctgcagaagcatcagaagaactgatggacaaatatctgggtggtgaagagctgactgaagaagaaatcaaatcagctttgcgtaagcgcgttctggctagcgagattatcctggttacctgtggttctgcatttaagaacaaaggtgttcaggcgatgctggatgcagttatcgattacctgccagcgccaactgacgttgagtctatcaaaggcatgctgccagacggtaaagataccccggcagagcgtcattccagcgatgaagaacctttctcggcactggcgttcaaaatcgcgactgacccattcgtgggtaacctgactttcttccgtgtttactctggtattgttaactctggtgatacagtacttaacccagtgaaagaccggaaagaacgttttggccgtatcgttcagatgcatgctaacaaacgtgaagaaatcaaagaagtccgcgcaggcgatatcgctgctgcgatcggtctgaaagatgtcactacaggtgatactctctgtgacctgaactctccgatcattctggagcgtatggaattcccagaaccagttatctctgttgccatcgaaccaaaaactaaagctgaccaagaaaaaatgggtatcgctttaggccgtctggctcaggaagacccatcattccgcgtaaccagtgacgaagaaactggtcagactattatcgcgggtatgggcgaactgcaccttgatgttctggttgaccgtatgcgtcgcgaatttaacgttgaagcgaacgtaggtaaacctcaggttgcttaccgtgaaactatccgaaatactgttgagcaggaaggtaaacacgctaagcagtcaggtggtcgtggtcagtatggtcacgtttggatacgtgttgagcctctggaaccaggtggcgaaggttacgtgttcgagaacgcaatcgtcggtggtgttgttcctaaagaatatattccaggcgtagataaaggcgttcgtgaacagctgaaaggcggtgttctggctggttatccaattgttgacgttaaagttaccctgtttgatggttcttaccatgacgttgactcctcggaaatcgcctttaaaattgctgcatccatggcatttaaagaaggcttcatgaaagcgaaaccagttctgctggaaccaatcatgaaagttgaagtggaaacaccagaagactacatgggcgacgtcatcggtgacttgaaccgtcgccgtggtatgatcgaaggtatggatgatctagcaacgggcaaaattgttcgtgctcaagtaccattatctgaaatgtttggttatgctactgacctgcgttctcagacccaaggtcgtgcttcttactccatggagttcttgaagtacaacgaagcgcctagcaacgtcgctcaggctattatcgaaactcgtaaagctagataa

SEQ ID NO: 1600 - DNA, 150 bp, Xenorhabdus bovienii
  Coding sequence Name=Xb4151_4152.C428.gene61.dna; Position on contig =53054..53203bp; Strand=-
gtgaagacgttcaccgtatggcagaagctaacaaggcgttcgcacactaccgttggtaattccttcgtagtgaatatgttctgggtagcttctcggggctacccgttctcaaaattgaacgcccacgagagaggaaaacatggctcgtaa

SEQ ID NO: 1601 - DNA, 471 bp, Xenorhabdus bovienii
  Coding sequence Name=Xb4151_4152.C428.gene62.dna; Position on contig =53145..53615bp; Strand=-
atgccacgtcgtcgtgtaattggtcaacgtaaaattctgccagatccaaagttcggatctgaattgctggccaaattcgtgaatatcctgatggtagacggtaaaaaatctaccgcagaagcaattgtatacagtgcgctcgagaccctggctcagcgttctagtaaaggtcatctggaagcattcgagctggcgctggataacgtgcgcccgactgtcgaagttaagtcccgccgtgttggtggttctacctatcaggttccagttgaagttcgtccggttcgtcgtaatgctctggcaatgcgttggatcgttgatgctgctcgtaaacgcggtgataagtcgatggctctgcgcctggcgaatgaattatctgatgcggctgaaaacaaaggcactgctgttaagaaacgtgaagacgttcaccgtatggcagaagctaacaaggcgttcgcacactaccgttggtaa

SEQ ID NO: 1602 - DNA, 375 bp, Xenorhabdus bovienii
  Coding sequence Name=Xb4151_4152.C428.gene63.dna; Position on contig =53714..54088bp; Strand=-
atggcaactattaaccagctggttcgcaaatctcgtagctcgaaagttgtgaaaagcaacgttcctgctctggaagcttgcccgcagaaacgtggcgtatgtactcgtgtatatactaccacccctaaaaaaccaaactcagcattgcgtaaagtatgccgtgttcgtttgactaacggtttcgaagtttcttcctacatcggtggtgaaggccacaacttgcaggaacactccgttatcctgatccgtggcggtcgtgtaaaagacttgccaggtgtgcgttaccacactgttcgcggtgcactggactgttccggtgttaaagaccgtaagcaaggtcgttctaagtacggtgtgaagaagccaaaggcttaa

SEQ ID NO: 1603 - DNA, 105 bp, Xenorhabdus bovienii
  Coding sequence Name=Xb4151_4152.C428.gene64.dna; Position on contig =54082..54186bp; Strand=+
ttgccattattaaaaaaactcctggtttttttgcttcgtaaacacggattttatcctctgtcagccatcatgacaaaacatgaggacgcggaattttattgctga

SEQ ID NO: 1604 - DNA, 114 bp, Xenorhabdus bovienii
  Coding sequence Name=Xb4151_4152.C428.gene65.dna; Position on contig =54149..54262bp; Strand=-
ttgtcagtaaataccttgtcattgcaggtattttaccagcatagaaaagctgtatatttcttgacacctcgtcaagtcagcaataaaattccgcgtcctcatgttttgtcatga

SEQ ID NO: 1605 - DNA, 288 bp, Xenorhabdus bovienii
  Coding sequence Name=Xb4151_4152.C428.gene66.dna; Position on contig =54277..54564bp; Strand=-
atgttatatactgtgagtcgctcaccttaccatgatgatttcaatgcaatgctgagccttgtttctgatgcagatgatgttctgttaatgcaaaatggcgtgctgctggggatcaatgacaatcgctatctggctgaattgatccgtacgggagccggtgtttatgctttgcaggaagatctgactgcacgggggcttgttgagcagatttcagaccgtgtacaggtgatagactacaaaggctttgttagcttaacagcgaaacatccgcaaaattttggctggtag

SEQ ID NO: 1606 - DNA, 360 bp, Xenorhabdus bovienii
  Coding sequence Name=Xb4151_4152.C428.gene67.dna; Position on contig =54584..54943bp; Strand=-
atgaaaaaaatcgccttcgtttttactgaagctccccacggatcttctgctggcagggaagggctggatgcgctgcttgcaacatcggcattgactgagaaaatcggtgtattctttatttctgatggcgtgttccaactgttgaccaatcagcagccagagacaattctggcgcgtgattacatctcaacatttaagatactgcccctgtatgacattgataaatgctacatttgcctcgatgatttgaacgctcggggaggcagcccagcaagcgatcttgtgctggaggcggaatttctcccggcggctgcaatacgtgaagtactatcagaatatgatgttgtgttgaaattttaa

SEQ ID NO: 1607 - DNA, 396 bp, Xenorhabdus bovienii
  Coding sequence Name=Xb4151_4152.C428.gene68.dna; Position on contig =54970..55365bp; Strand=-
atgtcatcgctgtcttattgcctgttggtaactggaccggcttatggtactcagcaagccagcagtgcctatcaatttgctcaggcgctggttgcttcagaccataaactgcacagcgtgtttttttatcgcgaaggtgtccaaaatggcaatcgactggtggctcccgccagtgatgagttcgatctggtcagggcgtggcaggcaatggctacccagcaccaatgcaacttgtttatttgtgttgctgcggcattgcgtcgcggtgtcgctgatgaacagcaggccaacgaactcaatctgtctgccgcgaatctggcggatgggtttgagcttagtggattgggctcgttggccgaagccatgatgctgtgtgatcgcgtggtacagttttag

SEQ ID NO: 1608 - DNA, 735 bp, Xenorhabdus bovienii
  Coding sequence Name=Xb4151_4152.C428.gene69.dna; Position on contig =55365..56099bp; Strand=-
atggtgtattgcatgtctaccccactattatccggtgataacagtgatattgatttactggaaaaccaaccgttcagtgaaacggatcatgaaattttaaaatcttacgaagctgctgttgatggtttggctatgctgattggtgggcattgtgaaattgttcttcattcactggaggatcttaaatgttcagctgtcagaatagctaatggtgagcataccggccgtaaaattggctctcccattacggatttggcattacggatgctgcacgatattacagatgaagactgtaatgtttccagagcgtatttcacgcgggcaaaaagcggtgcattgatgaaatccgtcacgattgccattcgtaatcgctctcgtcgggtcattgggcttttgtgtattaatatgaacctggatgtgcctttctctgagattattcaaacctttattcctgaaaaaacgcatgaggtgtcttcaaacgttaattttgcctcttcagtagatgatcttgtggcacagacactggaatttactatcgaagaagtaaacgctgatcgcaatgtttccaataatgcgaaaaacagacaggttgtcctgaatctctatgagaaagggatttttgatattaaagatgcgattaatcaggttgctgatcgtctgaatatttctaaacataccgtatacctttatattcgccagtttaaaaatggtgaatacgcaagttcggagaaataa

SEQ ID NO: 1609 - DNA, 129 bp, Xenorhabdus bovienii
  Coding sequence Name=Xb4151_4152.C428.gene70.dna; Position on contig =56086..56214bp; Strand=+
atgcaatacaccatccttcaagctcagactttgcctcaccgaaaatatcagggcgagatttattataaaatcacattaatgcaacttaacagaaaacattttaaatgttctgtgttctattcagaataa

SEQ ID NO: 1610 - DNA, 93 bp, Xenorhabdus bovienii
  Coding sequence Name=Xb4151_4152.C428.gene71.dna; Position on contig =56186..56278bp; Strand=-
gtgataaaactctgcggtctgtgcagcaagggcttgacggcaattcaatgtggttttaacgtcattattctgaatagaacacagaacatttaa

SEQ ID NO: 1611 - DNA, 108 bp, Xenorhabdus bovienii
  Coding sequence Name=Xb4151_4152.C428.gene72.dna; Position on contig =56236..56343bp; Strand=+
ttgccgtcaagcccttgctgcacagaccgcagagttttatcacagcttttatactcaatatacctgaaatatgaaaaagttatttcatttaataccgttaaaaaataa

SEQ ID NO: 1612 - DNA, 759 bp, Xenorhabdus bovienii
  Coding sequence Name=Xb4151_4152.C428.gene73.dna; Position on contig =56473..57231bp; Strand=-
atgaaatcattgttaaaaacaactttattggcagcgtcactggcgatggcatttagtgtaccgcaggcattgtctgctaatacagaaaacgaagtaaaactgaatagtgcgtttaaaacagaaaatcagcaaaacgcttatgcattgggttcttctctgggccgctacatgggcgcttcgttaaaagagcaggaatcgctcggtattaagttagatcagtctcagttattggctggtgttgaagatgcattaaaggataaaagcaaactgaatgatcaagaaattcagcagatccttggcacttttgaagctaaagtgaaaagtgcagcacaggccaaggcagagaaagaagccgatgaaaatgctgaaaaagggactaaatacagtcagcagtttgccaagacatcgggggttgtaaaaactaaaaccgggcttctctataaaatagagaaggaagggagtggtaaaacaccaacggaaaaagatacggtggttgtaaactacaaaggaagtttgatcgatggcaaggtgttcgacagctcctatgagcgcaaagaacccctgacaattggtttggatcgtattattcccggctggaaagaaggtttacagcatgtgaaaaaaggcgggaaaatcactctggtcattccaccggatttggcttatggtaagacaagtcttcctagtatccctactaattctactttagtctttgatattgaattgctggatatcaagccggctgccaaggcaaaataa

SEQ ID NO: 1613 - DNA, 108 bp, Xenorhabdus bovienii
  Coding sequence Name=Xb4151_4152.C428.gene74.dna; Position on contig =57278..57385bp; Strand=+
gtgaacgaactcactataactgtctgcggaaaccgaacacaatactcgtcatacattggcttcagaaccattaaaacaaaaaggtttcatggcaaccctcttttatag

SEQ ID NO: 1614 - DNA, 219 bp, Xenorhabdus bovienii
  Coding sequence Name=Xb4151_4152.C428.gene75.dna; Position on contig =57470..57688bp; Strand=+
gtgttattatccgaatttgaacaaaaatttgaacagttagaaaccaaactggcctaccaggaagtcactattgaagaactaaataaagaagtgagaaaacagcagatagaaactgaaaagctcaaaaaacaactacagttaatgtccgaacgcctgaaaacccaccagtcgtcgatcatcgcgccactctcagaagaaacaccgccccctcattactaa

SEQ ID NO: 1615 - DNA, 153 bp, Xenorhabdus bovienii
  Coding sequence Name=Xb4151_4152.C428.gene76.dna; Position on contig =57659..57811bp; Strand=-
atgctgtggcggcggctgccattaatcgttaagcagaaaaagggaagcgcagatgagcttctcttttttgtgttcccgccttccttggcaagtatttttctgcctgaaaaggcgggaacagtattagtaatgagggggcggtgtttcttctga

SEQ ID NO: 1616 - DNA, 537 bp, Xenorhabdus bovienii
  Coding sequence Name=Xb4151_4152.C428.gene77.dna; Position on contig =57787..58323bp; Strand=-
atgaaagtagcacaagacttggtggtcagcctggcttatcaagtaagaacagaagagggtgttttggttgatgagtctccggtgagcgcaccgttagactatctgcatggccgtggttctctgatcagcggtttagagaaagcggtggaagggcgtgaggcgggtgaacggtttgatgttagcgtcgaagcaaatgatgcgtacggtcagtatgatgaaaatttagttcaacgtgtaccaaaagatgtttttgttggtgttgatgaattgcaggtgggtatgcgtttcctggctgatacagacatgggacctgtgccagttgaaattaccgctctggaaggtgatgaagttgtcgttgacggcaaccacatgctggctggacagaatctgaaattcaacgttgaaatcgttgctgtccgtgaagcgaccgaagaagaattggctcacggccatgtgcatggtcagggtggctgtggtgatcacgaccacgatcatgatcatgaagaacatgcatgctgtggcggcggctgccattaa

SEQ ID NO: 1617 - DNA, 114 bp, Xenorhabdus bovienii
  Coding sequence Name=Xb4151_4152.C428.gene78.dna; Position on contig =58282..58395bp; Strand=+
ttgataagccaggctgaccaccaagtcttgtgctactttcatgacatctcctacatacccgaggggaaaaaaccccgtgagggaaaatttttacggctaaaaaaatgctgctga

SEQ ID NO: 1618 - DNA, 132 bp, Xenorhabdus bovienii
  Coding sequence Name=Xb4151_4152.C428.gene79.dna; Position on contig =58386..58517bp; Strand=+
atgctgctgattgtaacggaattctacttatctgtacctagcgacagcaaaatttatccattatttgttgttcatatatttaattattgtggtgtgaagataccgataacctgttcctgctctctaacatga

SEQ ID NO: 1619 - DNA, 264 bp, Xenorhabdus bovienii
  Coding sequence Name=Xb4151_4152.C428.gene80.dna; Position on contig =58465..58728bp; Strand=-
atgagcgtcgccggccggaaggctgggacgaatataaatagcaatgggggtgagtcatgtcaatcagtcgtaaacgttttattgcaggagcggtttgtcccaagtgtcagtcgcgggacacactggcgatgtggcaggaaaataaagtcgatattgtggagtgtgttcattgtgggcatgtgcagcggcaaaccgatgaaaccgtggcgcctcatgttagagagcaggaacaggttatcggtatcttcacaccacaataattaa

SEQ ID NO: 1620 - DNA, 1848 bp, Xenorhabdus bovienii
  Coding sequence Name=Xb4151_4152.C428.gene81.dna; Position on contig =58688..60535bp; Strand=-
atggctgaaatcgcctttgtctttgggaggaatgtaattatggagaattcagcgctgttaagcgccggaacactgtttttgtctgctgctgttgtggctgttccccttgcccagaaattcaagattggggcggtattaggttatctgatcgtcgggattgtgcttggcccgtgggggctggggtttatcaaggatgtcgaggaaattctgcatttctctgaactgggtgttgttttcctgatgtttatcattggccttgagctgaatccggcaaaactctggcagctcaggcgatctatctttggtgcgggtactgctcaggttgtattgactgcgctggtgctgattttattcctgtgtctgacgaattttgcatggcaggctgccgttatcggtggaataggccttgctatgtcatcgacagccatggcgctacagttgatggaagagaaaggaatgaccgatagtgaaggcgggcaactcggtttttctattctgttgtttcaggatatagctttgatcccctctctggctctgatccctctgctggctggcagtacggcatcgagtgactggtatcgggtcgggctgaaatttgttgcttttgcgggcatgttgctgggagggcgttatctgctgcgcccactgtttcggttagtagtgaaatctggtgtcagggaggtgttcacggcagcagcgctgttggtggtgctgggagcagcgattttcatggaggaactgggtttttcaatggcgctcgggacttttattgctggggttttgttggctgacagtgaatatcgccatgagctggaaatttctattgagccatttaaagggctgctgctggggctattttttatttccgtcggaatgtccttgaatatgggcgtattgttgactcatttgtcaggggtattgttcagtgttttggggctggttctgataaaaactttcatactgtatgtgatcggcaggtttgctggtctgaaaaaagcatcgtgttttcagttttccggcgtgctgagtcagggcggggaatttgcatttgttttattctcaacggcactggggcagagagtgctggatcagaatcaaatgtcacttttgctggttgtcgtcacattgtcgatgatgacgacgcctctggtgatgcagttgatccaaagtattttggctcggcattataatgctcaggaagaaaaaagcagtgaacagccatttgtggaggataatgagccgcaagtgattctggtgggattcggccgttttgggcaggtagtggggcgccttctgatggcgaataaaatccggatcacggtattggaacgtgatgccagcgccatcagtacgctgcgtcgttatggctataaggtgtattatggcgatgcgagagagcgggaactgctgcgtgctgcgggagcggcaaacgccgaggctatcgtgattgccagtgatgaaccggaagaaaccatggcgatagtacatctgtgtcagaagcattttcctcagctgcatattattgcgcgggcgagagggcgtctggaagctcatgagctgttgcagaacgatgtcaaagatttcagccgtgaaacgttttccagtgccctggagcttggtcgtaaggcattgattaagactggaatgcatccacatcaggcttatcgtgcacagcagcatttccgacgactggatatgcgtatgttgcgtgagctgatgcctcagttacatggcgatgtggcgcagatatcccgtgtgaaagaagcccgcagggaattggaagaactgtttgaacgggaaatgcttaatgagcgtcgccggccggaaggctgggacgaatataaatag

SEQ ID NO: 1621 - DNA, 549 bp, Xenorhabdus bovienii
  Coding sequence Name=Xb4151_4152.C428.gene82.dna; Position on contig =60499..61047bp; Strand=-
atgctattgccgcctaaaatattgctgttatatatccatccagaaccacagatctctgtggctaataatgttttgctacagcccgtgcgggcgttggagcatgttactcttcacgacctatacggctgctatcccgatttttttattgatgtgccgttagagcagaaattgctgcgtgagcatgaaatcattgtttttcagcatccattatatacttatagttgccctgctttactgaaagagtggatggatcgtgtgttgagccgtgactttgttagcggatcagagttggcgctgacaggtaaatattggcgctctgtcatcaccacaggagaacccgaaggcgcttaccggaaaggtgggtataacctctatccgatggaagaaattctccgtcctttcgaattaacggcatcgatgtgtcatatgcattggttatcacccatgatcatttattgggccaggcgccaacgacctgaagtgctcgccagtcacgcgaaggcttatcggaaatggctgaaatcgcctttgtctttgggaggaatgtaa

SEQ ID NO: 1622 - DNA, 1953 bp, Xenorhabdus bovienii
  Coding sequence Name=Xb4151_4152.C428.gene83.dna; Position on contig =61166..63118bp; Strand=+
atgattgttttctcatctctgcaaatccgtcgcggcattcgcgtcctactggacaatgccagcgcaaccatcaatcccggtcaaaaagtgggattggtgggtaaaaatggctgtggtaaatctaccctgctttcattactgaaaggtgaactccagtctgaaaatggctccgtcacatttcccaacaactgggcgctggcgtgggtgaatcaagaaacgccggctttggaaatttcagcactggaatatgtgatagacggtgaccgtgaattccgacaactcgaacagaagctgaaaatcgccaatgaacagaatgacggtcacgccattgcccatcttcacggccagcttgataccattcaggcatggacaattcgtgcacgagcatccagcctgctgcatggcctgggattttcccaaaccaagttagaacagtcagtcagttcattttccggtggctggcgtatgcggctcaatctggctcaagcgctgatttgtcgttccgacctgctgctgctcgatgaaccgaccaaccacctggatttagacgcggtcatctggctcgaaaagtggttgaaaaactataccggcactttgattctgatatctcacgatcgggactttctcgatccgatcattgataaaatcctgcacattgaacagctgatcttggctgaatacaccggcaactactcctcctttgagcggcaacgcgcggctaaacttgcccagcaacaggctctgtatcaaagccagcaggaaaaagttactcacctgcaaagctacattgaccgttttcgtgccaaagcctccaaagcgaagcaggcacaaagccgtatcaaaatgctggagcgcatggaactcatcgcgcctgctcatgtcgataacccatttcgtttcagctttcgccagccagacagcctgccaagcccgcttttggtcatggaaaaagtcagtgccggatatggtgaaaaaaccgtgctagattcgataaaattaaatctcgtaccgggatcacgtatcggcctgttagggcgcaacggggcgggtaaatctacactgatcaaacttctggcgggtggacttgccccacagcggggcgagatcgccttagccaaaggtatcaaactcgggtatttcgcccaacatcagctggaatacctacgagcagatgaatccccgctgcaacatttggtcagaatcgcaccacaggaaacagaacagcagctccgtgactatctgggtggctttggcttcaaaggtgatcaagtaaccgatccgagtgggcgtttttccggtggagaaaaagcccggctggtattagcgctgattgtctggcaacgaccgaaccttctactgcttgatgaaccgaccaaccaccttgatctggatatgagacaggcgctgactgaagcgttaattgatttcgacggtgcgctggttgtggtatcgcacgacagacatttattacgctccacaaccgatgaactttatctggtacatgatggcgaagtagaaccgttcaccggcgatttggaagactaccagcaatggctgactgaacaacaacgccaacaaacgcgggaaaatcaggaaaaggaaaaagcgacctcaagtcctgatgcttcaatgaatggcgctcaaaattacagtgctcaggagcgcaaagatcaaaaacggcgtgaggctgaatttcgcaaccagacgcagccattacgcaagcaacttactgcccttgaaaaacagatggaaaaattgggcgcaacattggccggatgggaagaaaagctgtcagataacacaatctacgaaaatgatcgcaaaactgaattaaccgaatgcctgcaacaacagactcaaaccaaatccaagttagaagatgtggaaatggagtggctggatattcaggaacaacttgaacagatgagcgaaacatttaacgtgaatcagtaa

SEQ ID NO: 1623 - DNA, 120 bp, Xenorhabdus bovienii
  Coding sequence Name=Xb4151_4152.C428.gene84.dna; Position on contig =63158..63277bp; Strand=+
ttgatattcaatgcccaaatcttgaaaaaagctggcccttgtttacaaaacaaaaaagtaaacacatgcagacgaacagctattctattgacagtaaaaaatgataactcatttatctag

SEQ ID NO: 1624 - DNA, 669 bp, Xenorhabdus bovienii
  Coding sequence Name=Xb4151_4152.C428.gene85.dna; Position on contig =63462..64130bp; Strand=-
ttgcatcatgaaacagtttatcgattgatttataaggataaacttaatgatggtaatttatggcaacatcttaggattgcgaaaaaaccgtatcgtaaacgctatggaagttatgagcgcagaggaaaaattaaaaacagagtcagtattgataagcgccccaaacttgttgataaaaagcagcgtattggtgattgggaaggagatactatcgtgggtaaaaatcataaaagtgcattattgacattagttgaacgaaaatcgttatttactattataattaaacttgaaaataaaacagcagaaggggtcgcaaaagcggcaacaagacatttatcactgataaaacataaaattaaaacaatgacctttgataacggcctcgaatttgccgaacacgaactgatcagtaaaaatttagagacaaaaatttattttgctcacccgtattccccctgggaaagagggataaatgagaacacgaatggattaatcagagattacttcccaaaaggaactgattttaataaggtgtcagagcgggagattaaccttgtggcaaaccgattaaataatcgtcctcgtaaaacacgagattacaaaacaccgaatgagttatttaaaggaataccctctcatttacttcgtccattacggtgttgcgcttaa

SEQ ID NO: 1625 - DNA, 183 bp, Xenorhabdus bovienii
  Coding sequence Name=Xb4151_4152.C428.gene86.dna; Position on contig =64262..64444bp; Strand=-
atggcctataaacaactgaccgaaacagaaagatatcagattttcagcctgaaagaagccggtttttcacaacgggagatttcaaagtcactcaatcgaaacccatcaacgattagccgggaattgagacaaatcgggaggcaaagaaatatacgcctgaacaagctcagcttaaggccgtag

SEQ ID NO: 1626 - DNA, 891 bp, Xenorhabdus bovienii
  Coding sequence Name=Xb4151_4152.C428.gene87.dna; Position on contig =64530..65420bp; Strand=-
atggatatacgcaatcttgaagcttttatcgttttggctgagactcttaattatcataaagcttcagagaggctttatctttctcagcctgccttgacaaagaaaatacacgggttggaagatattcttggtgcttcattattcataagggggccaaatggaacgagattgacagacttcgggcataagacgctggagaatgcccgaaaatttttatctcactatgagcagtttaaaagcagagttcattttgattcaaaggaagatattatcaggcatttatatgttggatcttgttttcctatccataactattctcagatagaaaagcagatcgcggataagaaagggaatgtcatattggcgctgatgaccgggctgtcggttgaacagcagatcagtttgttgaatgcaggaatgctacatgtcgcggtgatgcctctggttgcgataactcagttggagccgaaaaagatttttactgaaaaattgatctatatttttaaaagaaggagccacctgatacctaaatttagaacggagaaaagtcaatttggaaatgggaatgttccggtttattcatcagaaaaaaaagatattgttgagttaaccgattgccttaacgtattccctgtttatacgggtgacagtaagcatttgttattaaagactaatgacattatgctcatcatggaaatgattacaaaaaatagtgcatatgcgtgtgttcctcaacgtattatcagctcgatccctgagtattatatgaatttgctggaaattgttgaaacggataaaaaaatagaactcggcgtaatatggggtaaatcaatagatgatcatctgattgatgatgttgaaagtttttctgcattggttgctaatttgtaa

SEQ ID NO: 1627 - DNA, 123 bp, Xenorhabdus bovienii
  Coding sequence Name=Xb4151_4152.C428.gene88.dna; Position on contig =65364..65486bp; Strand=+
atgataattaagagtctcagccaaaacgataaaagcttcaagattgcgtatatccatgttctctcgctcaatgattgtttaatagctacaaaacattacagattcatggtgatagcattttaa

SEQ ID NO: 1628 - DNA, 99 bp, Xenorhabdus bovienii
  Coding sequence Name=Xb4151_4152.C428.gene89.dna; Position on contig =65547..65645bp; Strand=-
ttgtgtatttggatttttagtttctgttgcaattgtttatgtagtaaattaaaatgccgcattaataaatcttttgctaattgtgcccttattaactaa

SEQ ID NO: 1629 - DNA, 129 bp, Xenorhabdus bovienii
  Coding sequence Name=Xb4151_4152.C428.gene90.dna; Position on contig =65676..65804bp; Strand=-
ttgccaatagataaaagttatcaattgataacttgcaggtcattatttttttctggtgatagtcaaaattgtacgacatataaaataaccagtaatgtgattatgtgtatggtgtattggcaggtatag

SEQ ID NO: 1630 - DNA, 117 bp, Xenorhabdus bovienii
  Coding sequence Name=Xb4151_4152.C428.gene91.dna; Position on contig =65922..66038bp; Strand=+
ttggaacaaaccatagataattcacattcactttattacattatctattttagatctttaattttatggctatttttatatttactcttattacgtgttaataagccccagctttaa

SEQ ID NO: 1631 - DNA, 93 bp, Xenorhabdus bovienii
  Coding sequence Name=Xb4151_4152.C428.gene92.dna; Position on contig =66238..66330bp; Strand=-
ttgagcgtaaacactattttcaatgctcaatctaaccatttaacatataacctacatatcactaaaacccaatacatcaccaccataaaataa

SEQ ID NO: 1632 - DNA, 201 bp, Xenorhabdus bovienii
  Coding sequence Name=Xb4151_4152.C428.gene93.dna; Position on contig =66296..66496bp; Strand=-
gtgtatggccgccttcctgaggaagatcaccttaccggaaagacgtttacccaacgtatagagagaactaatttaacgcatcgtacacgaatcaaaaggctgaaccgcaaaacgatgggttactctgaatctgaggaaatgcataacaaagtgataggcactttcattgagcgtaaacactattttcaatgctcaatctaa

SEQ ID NO: 1633 - DNA, 204 bp, Xenorhabdus bovienii
  Coding sequence Name=Xb4151_4152.C428.gene94.dna; Position on contig =66436..66639bp; Strand=-
atgtattttaatatcaagatgaataacggcggtattcacgacaccgtccgtgttctaaacgtcgccatagccaccgccatgaaaacattcgacaagttttatccccctttaatattcggctttactgtacggatgattatagggtgtatggccgccttcctgaggaagatcaccttaccggaaagacgtttacccaacgtatag

SEQ ID NO: 1634 - DNA, 171 bp, Xenorhabdus bovienii
  Coding sequence Name=Xb4151_4152.C428.gene95.dna; Position on contig =66623..66793bp; Strand=+
ttgatattaaaatacattaagaaagattttatctttatatccaatgaattttatattaaatccagtacgataatcatgctccccatgaatagcatattcacttttccatcacatacaacaggaacaaataatgaaaatcgatctgagcaatatggtgacagaaagccgtaa

SEQ ID NO: 1635 - DNA, 903 bp, Xenorhabdus bovienii
  Coding sequence Name=Xb4151_4152.C428.gene96.dna; Position on contig =66753..67655bp; Strand=+
atgaaaatcgatctgagcaatatggtgacagaaagccgtaaccctgccagtacccatattgatgagctatccacactcgatatgctgcgcgttatcaatgatgaagatcaaaaagtggcgctggccgttgcagaaacgctgccacagattgcccgggtggtcgataaagtggccgaggcatttcgtcacggcggacgattgatatatagcggagccggaacttccgggcgtctgggcattctggatgcgagtgagtgtcccccgacttatggtacaaagccggagtgggtggtcggtttaattgccggcgggcatcaggcgattttgaaggcagtcgaaaatgcggaagataatcagcaatcaggcgtagaggatcttaagggactacacttcaatgaaaaggatgtgctggtcgggattgccgccagtggccggacgccttatgtgttgggtgcgatgaaatatgccagatcggttggagcaaccatagcctgcatcagttgcaatccggacagcccgatgacgcagttggctgatatcgccattacgcccgttgtggggcctgaaatcgtgacgggttcttcccgtatgaaggcaggcacagctcaaaagctggtgctgaatatgatcacaaccggggccatgatccgcatgggtaaggtgtatggcaatttaatggtggatatagaagccaccaatgctaagttgatcgaacgtcagaagaatattgtcatggccgccactgagtgcagcagagaaatggcagaacaggctctgagtgcctgtgacggtcactgcaaaaccgcaatcgtgatgattttatcgggaacctgtgccgaagatgctaaaaggttactggcagaacaccaagggtttatccggcccgctatctcaaaatcctga

SEQ ID NO: 1636 - DNA, 1449 bp, Xenorhabdus bovienii
  Coding sequence Name=Xb4151_4152.C428.gene97.dna; Position on contig =67685..69133bp; Strand=+
atggctaaaatcagccaggaaatgctggtagaaatactcagggcgatgggtggcgcggataatgtcgtccattgtggcaattgcatgactcgcctgcgcttaacactgcatgatgattcactggtcgataaaactgtcttaaataaaatttcaggggttttaggtgtcattgaaaatgacgaacagctccagattgtccttggccccggcaaagcacaaaccgcagcggataggttgaacgggctattgagtactgctgatcactccgccgctggacaccagcccgcagatttgaaagagattgcgtcttccaataaaaagcagctcaaagaaaaacaaacccgttcagttcataagtttctggctaaattcgccaccatttttaccccgctgatccccggttttatcgccgttggcctgttattggggtttgctaccttgctagaacagattttcattcagggaaccggacatcccaatgccgtattggttgagatggtcggctatatgaaagttttcagcaaagggatgttcagtttcctgagtattctgatcggttataatgcgcagaaagccttcggtggctccggcgtcaatggtgccattatcgcttccctgttcgtgctgggttataacgccagcgccaccagcggcttctattccggtatcagtgatttctttggcttcgccattgacccgcgcgggaatatcatcggtgtactgattgcctgcattctcggcgcttgggtggaaaaacagatccgcaaaatgatgccctctgatctggatatgatcctcacttccacccttacccttcttatcatgggcgctgtcgcgtttattgtcatcatgcctgtgggaagctacctgtttacggcgatgtcatggctgttcatgcatctgaacggtaatccattcggtgcggcaattctggcagggttatttttaatcgcggtgatgtttggtgtacatcagggctttgttcccgtctattttacgttgatggatgtgcaaaactttaactcgctgttcccgattctggcgatggcgggagcaggacaggtcggctctgcgctggcgttatatatgaaagcccaaaaaggttcgctgctacgcactcaaatcaaaggcgccatcattccgggttttctggggatcggagaaccactgatttatggagtgacactgcctcgcgtcaaaccctttgtcacggcttgtttcggtggcgcaatcggcggcttttttatcggtctggttgcctggctgggagtccctgtcgggctgaattctgttttcggcccatcgggtctggtcgccctgcccctgatgacgtccgatagtggcatcttcacgggcatggcagtgtacggtgcaggtttaatcatcgcttatatcagtggttttatactgacatttttctttggcagtaaaaatattgatttaagctga

SEQ ID NO: 1637 - DNA, 675 bp, Xenorhabdus bovienii
  Coding sequence Name=Xb4151_4152.C428.gene98.dna; Position on contig =69135..69809bp; Strand=-
gtgaataacatactgttattttcgtcgaaaggaaatgttaaccatttgggtaagaggaacaatccccccatgaccgcaagtctgatattctcactaagcaccttcttattaatctctgggattacaccgggcccgaacaatatgctgctgacttcatcgggtgctaattttggtttccgtcgttcgttaccgctttgggtgggtatccttcttggcatacagaccatccttctgctgtctgcttttggcgtgggagcagtgctgctgttgtatccggcgatgcacaccgtgttgaaagtgctcggtagtctgtatttattaaggttggcgtggaaaacgtcgacagcacattataaacggttggaaacggcaaatttggcggctgttcccatcaaaagccatcaaggctggttattacagtttctgaaccccaaggcgtggatgatgggattgggtgccgtcggcagttacagcctacagggagacttatataaccactcagtggtcgtgatcagtgtggtgatgctgatctccaatatgatcgctggtacagtgtggattgttctgggctcgctgattggctccctgttgaaaagccgcaatgcctggtttattttcaatatcaccatgggtattcttactgctgtctgtgtccctttgctttggattagctga

SEQ ID NO: 1638 - DNA, 219 bp, Xenorhabdus bovienii
  Coding sequence Name=Xb4151_4152.C428.gene99.dna; Position on contig =69913..70131bp; Strand=+
atgatgatcccgtggcaacaactggcacccgaaaccctactcgatctgatcgaaagttttgtcttgcgggaaggcaccgattacggtgaagatgaaaaaacgctggagcaaaaagtacaggatgtaaaacgtcagcttgaacggggagaagtcctactggtttggtctgaactgcatgagaccgtcaatatcatgcccaaagagatgtttcgcccttag

SEQ ID NO: 1639 - DNA, 171 bp, Xenorhabdus bovienii
  Coding sequence Name=Xb4151_4152.C428.gene100.dna; Position on contig= 70049..70219bp; Strand=+
ttgaacggggagaagtcctactggtttggtctgaactgcatgagaccgtcaatatcatgcccaaagagatgtttcgcccttagcgccttctttttatcaggctgttccgtttgccttattttgctctgtattgctgattacgagaaagatagtcccaacttttttggataa

SEQ ID NO: 1640 - DNA, 870 bp, Xenorhabdus bovienii
  Coding sequence Name=Xb4151_4152.C428.gene101.dna; Position on contig= 70233..71102bp; Strand=+
atgtctgccaaacaccctgtcattgcaataacgggttctagcggagccggaacaacaacgaccagtgtggcgttccgcaagatttttcaacaacttgaagttactgccgcactcatcgaaggggatagtttccaccgttacacccgtcctgaaatggatgccgagatccgtaaggcgaaggagcaaggcagacatgtcagctattttgggccagaagccaatgatttcagcatgttggaaaagacattttacaactatggtgaaacaggcactggccgctgccggagatatctccacacctatgatgaagccgtgccttacaatcaagtaccgggtacattcacgccgtgggaatcactgccatcaaacaccgatattctgttttatgaggggttgcatggtggcgttgttactccacagtataatgtcgccagctatgttgatttgctgattggtgtcgtccccatcgtcaaccttgagtggatacagaaacttatccgtgataccagcgaacgtggccattcaagagaggcggtcatggattccgtggtgcgttcgatggatgattatatccgctatattacgccacagttttcccgtactcatatcaatttccagcgagttcccaccgttgatacctctaaccctttctccgccaaggctattccatctctggatgaaagttttatcgtgattcgtttccgtggcctgaaacaaattgatttcccttatttactatcaatgcttcagggatcatttatttccagtataaataccattgtcgttcccggcggaaaagtggggctggccatggaattaattatggctccgtgggttcagcaattactggaaggcaaaaaaatttcttga

SEQ ID NO: 1641 - DNA, 105 bp, Xenorhabdus bovienii
  Coding sequence Name=Xb4151_4152.C428.gene102.dna; Position on contig= 71284..71388bp; Strand=-
ttggagcgtcgtctttattgctctacgacttataggaaatcgaataatgccagtatttccaaagggaaaaggagaaacaacataaagacgggaacggctgaatga

SEQ ID NO: 1642 - DNA, 129 bp, Xenorhabdus bovienii
  Coding sequence Name=Xb4151_4152.C428.gene103.dna; Position on contig= 71354..71482bp; Strand=-
ttgccagcttcgcttgtaacctcgtttgtaacacaggaaaacgtttctgtcttcccctgtatcgcttcagcccgccagattaacagaaatctatttggagcgtcgtctttattgctctacgacttatag

SEQ ID NO: 1643 - DNA, 111 bp, Xenorhabdus bovienii
  Coding sequence Name=Xb4151_4152.C428.gene104.dna; Position on contig= 71567..71677bp; Strand=-
ttgccgagaaccattcgctttatcctctgttgttatttccgccttgatgacgtgaggaacagtttttcctcacccggctggctttataaagtcaatagtttaacatattaa

SEQ ID NO: 1644 - DNA, 633 bp, Xenorhabdus bovienii
  Coding sequence Name=Xb4151_4152.C428.gene105.dna; Position on contig= 71664..72296bp; Strand=+
atggttctcggcaagccacaaacagaccctactcttgaatggtttttgtcacactgccatattcacaaatatccatccaagagcacgcttattcatcaaggcgagaaagcagaaacgctttactatattgttaaaggttcagtcgctgttctaataaaagatgaagaaggcaaagaaatgattctctcttatttaaatcagggagatttcattggtgaacttggattgttcgaagaaggaaagctgcgtactgcatgggtacgagctaaaagtgcctgtgaagtcgctgaaatttcctacaagaaatttcgccagctcattcaggtcaatcctgatattctgatgcgtctatcctctcagatggcaagacgcttacaaacaacctcagaaaaagtcggtaatctggcatttctggatgtcacaggtcgtattgccaagacgttaatgaatctggccaaacagcctgatgcgatgacccatcctgatggtatgcaaataaaaattacacgtcaggaaattggccagattgtcgggtgttcccgcgaaacagttggccgcattctcaagatgttagaagatcaaaacctgatctctgctcatggcaaaaccattgtagtatatggaacccgctaa

SEQ ID NO: 1645 - DNA, 222 bp, Xenorhabdus bovienii
  Coding sequence Name=Xb4151_4152.C428.gene106.dna; Position on contig= 72197..72418bp; Strand=+
gtgttcccgcgaaacagttggccgcattctcaagatgttagaagatcaaaacctgatctctgctcatggcaaaaccattgtagtatatggaacccgctaatttctgaaattactcttgaaactgagccagcgcaacccttatcctgcactggcttttttgttgcttcctttgtcttatcagtgcaatggcagcatcaagccccgttacgccgctttctgtaa

SEQ ID NO: 1646 - DNA, 102 bp, Xenorhabdus bovienii
  Coding sequence Name=Xb4151_4152.C428.gene107.dna; Position on contig= 72391..72492bp; Strand=-
atggcaaatataaaaataaggtgggggaaatcacgtctgtcccagcggaatatcagggcaaggccagtgaagtattacagaaagcggcgtaacggggcttga

SEQ ID NO: 1647 - DNA, 576 bp, Xenorhabdus bovienii
  Coding sequence Name=Xb4151_4152.C428.gene108.dna; Position on contig= 72585..73160bp; Strand=-
atgctattaataatagataactacgattcttttacattcaatttatatcaatatttttgcgagttagggacaaatgttttagttaagcgtaatgatgaattacagcttgaagatatcgagaagttggcgcccacacatttagtgatttcgccggggccttgtacgccaaatgaagcagggatttcactagaggccattgcgcattttgccggcaaattgccaatcctcggtgtgtgcctagggcatcaggctattgggcaggcttttggtgcgagtgtggtcaaagcccgcgaggtgatgcacggaaaaaacagcttgatccaccataatcaacaaggagtattcaaaggattgaaccgtccactgactgttactcgttatcattctctggtgattgctgctgaaaccctgccagcatcgtttgaagtgaccgcatggagtcagcataacggtaatgtagatgaaattatgggaatacgtcaccgtactttgccattggaaggtgtgcaatttcaccctgaaagcattctcagtgaacagggacatgatttgttgaataattttctcagatattaa

SEQ ID NO: 1648 - DNA, 183 bp, Xenorhabdus bovienii
  Coding sequence Name=Xb4151_4152.C428.gene109.dna; Position on contig= 73203..73385bp; Strand=-
gtgccgtcttcccctctcacctgcgttatcttttcacgtcaagctctcaccacgggtgaatgctgctgtttgtatcctactattttaaaaatacgtctgtggtatgatgagcgtcccgctgctgttgatgctgctttacctgattttatcgaaatacagaatgcacaatgcccgctagggtag

SEQ ID NO: 1649 - DNA, 567 bp, Xenorhabdus bovienii
  Coding sequence Name=Xb4151_4152.C428.gene110.dna; Position on contig= 73464..74030bp; Strand=-
atgtttaaacgtatttttgtgtcgcttatggctgcatgtgctatcagtgtgatggcaactccggcattggctgccgaaactcatgtgaagctggtaacatcagcaggggaaatagagcttgcgctggatagtaacaaggcgccaatcactacaaaaaatttcattgagtatgtcaatgaaggattttataacaacaccatttttcaccgcatcattcccgggtttatggttcaggggggtggctttacgaaagatatgaagcagaaggtgaccaaagcaccaatcaaaaatgaagcagataatggtttgcgtaatctgcgtggtacgatagcgatggcacgcaccgcagataaagacagtgcaaccagtcagttcttcattaatgtcactgataacgccttccttgatcacggtcagcgtgattttggttatgctgtctttggtaaagtcataaaaggtatggatgtggttgataaaatttctcaggtcaagacagaaaatgttggcccttatcaaaatgtacccgtgaaaccgattgtgatcctttctgccaaagttgcaccttaa

SEQ ID NO: 1650 - DNA, 105 bp, Xenorhabdus bovienii
  Coding sequence Name=Xb4151_4152.C428.gene111.dna; Position on contig= 74180..74284bp; Strand=-
ttgcgcgatatctgtattgtataccctttggttgaatactctatatttctcgccatttataacgttattccccacataaacaaaattcaggttatgagaccataa

SEQ ID NO: 1651 - DNA, 108 bp, Xenorhabdus bovienii
  Coding sequence Name=Xb4151_4152.C428.gene112.dna; Position on contig= 74327..74434bp; Strand=-
gtggcgaatgtcaggtgcactcgtgacaaagtgggtcatgtgatagttgtagtttttgatggtcaaaatggttatctccctgaggaatacacgaaaacagcgcgctga

SEQ ID NO: 1652 - DNA, 597 bp, Xenorhabdus bovienii
  Coding sequence Name=Xb4151_4152.C428.gene113.dna; Position on contig= 74396..74992bp; Strand=+
atgacccactttgtcacgagtgcacctgacattcgccacctgcctcaagatgtgggtattgaggtcgcgtttgccggtcggtcgaatgcgggtaaatccagcgccctgaatgcactgactaaacaaaagagccttgctcgcaccagtaaaaccccggggcgtactcagcttatcaacctgttcgaagtggaagacggtattcggctggttgacttaccgggttatggctacgctgaagtgccagaagagatgaaacgcaaatggcagaacgcactgggagagtatctccagaaacgtgagtgtctgctggggttggtggttttgatggatatccgtcatccactgaaagatctggatatgcagatgatcgaatgggcagtcgtgatgcaagtacctgttatggttttgctgacgaaagcggataaactggcatccggcgcccgtaaaagccaattggcgaaagtccgtcaggagctgacttctctgggtggcgagattcaaattgaaaatttctctgccctgaaaaaaatcggcatcgaccaacttgagcagaaacttgactactggttcaaccagcctgccattgaggtggagtga

SEQ ID NO: 1653 - DNA, 207 bp, Xenorhabdus bovienii; identical to SEQ ID NO: 1041
  Coding sequence Name=Xb4151_4152.C428.gene114.dna; Position on contig= 75074..75280bp; Strand=+

SEQ ID NO: 1654 - DNA, 264 bp, Xenorhabdus bovienii
  Coding sequence Name=Xb4151_4152.C428.gene115.dna; Position on contig= 75306..75569bp; Strand=-
ctggtaccacgccagtacagcacgggtggcaaaaatacgcttttagggataagtaaacgcggagacaaaaatctgcgacggttacttgtccagtgcgccagagtctttatccagagaatcgattatcagtcaggaaggctggctgaatgggtaaaggctcagcttgagcgaaaacactcaaatgttgtggcctgtgcgctggccaacaaattagcccggatagcctgggcaatcacaacacggcaaactgtgttcgaaaggtaa

SEQ ID NO: 1655 - DNA, 1458 bp, Xenorhabdus bovienii
  Coding sequence Name=Xb4151_4152.C429.gene1.dna; Position on contig =49..1506bp; Strand=-
atgaattatattaaaaacattcttcttaaaataaaagagaaaaataaattttactataatgtgctatctttggcaggaggaacattattagctcaattaattacaatagcttttatgcctttaatgacaagattatattcaccgaattcctttggagtattggcaacatatataagtataatcgctatactcaatgtaattgtaagtctgcgttatgaattagctattgttttgcctaagtatgataatcaagctaaagttattttatttttagccttagcattcactataattacatctttcacatccatattaataataatatttttcccaaaaaagttactagggaatatgggactacaagattttaataactatttatacctaatcccagcgtcattattattcattggaatttatcaggcattaacttattgggccagcagaaataaaaatttcactctgattgccagaacaaaattcagtcaaactctatcaatgcttattgcccagctgtctttatataaattacaagatttaggcttgatattagggcaattattaaatcaattcatgggaagtctaaaattatataaatattcaaaaaaaaccaaatcttttgtcataccatcgcggaaaagattaatatggggcatacgaaaatataaagatttccctaagtacattttaatgggttccctattagataatactagctctaggatacctatatttttattagcaatacattttaatccagcatatgctgggttctatgcaataacagatagaatcctaacacttcctgttcaattaattggaaaatcactatctaatgtctattatgctgaggcttccaatttttacagggaaaatagactaaatgaattaacctatcaaatatataaaaaacttgtaacattagcttttcctttcgtaatattgataatgctaatttcaccaaccatgtttaattatatttttggaaacgaatggaaaactgcaggacattatgcaaggatactttgtatgttgatgtacatagtatttattacatccccaataagttcagcatatatgatattaggaaaacagaaaatctggacattatttcaagcaataatactactaacaagcatagttacattatatattggtatatatttagataatgacatatatactatcctgttctattctataggaaacatgctatgttggagtatcattttagtttatctttttagaatattaaagataaaattcaaacaatacttcaaagaccagtatataaattttatattatcattactcacaaactctcctttaataatatatatgttatacatacacctaaataatactcaagaaaatactatatattgggctggatgtataattatctcattaatattaattatatttagatacatgcatatgttaaagaaaaaggtataa

SEQ ID NO: 1656 - DNA, 1074 bp, Xenorhabdus bovienii
  Coding sequence Name=Xb4151_4152.C429.gene2.dna; Position on contig =1511..2584bp; Strand=-
atgcaattcacagatctagcagcacaacaattaaaaattaaagataaaatagacgaaaatatccaaaaagtattagcacatggaaaatatattctaggtccagaagtctcggaattagaagaaaaactcgttgaatatactggagcaaaatattgtatcacatgtgcgaatggaaccgatgctttgcaaattgctttaatggctattggtatcaaacccggcgatgaagttattactcctggatttacttatattgctacagctgaaacagtcgctcttttaggcggtattcctgtatatgttgatgtaaagccaacaacttataatttagatccagcactattagaagctgcaataactcctaaaactaaagcaattattcctgtttctttatatggtcaatgtgctgattttgacgaaatcaatgcaatagcagaaaaacataatattaccgttatagaagatgcagcccaaagttttggagcaacatataaaggtaaacgctcttgtaacttaacaactattgcatgtacaagcttctttccaagtaaaccactaggatgctacggtgatggtggtgctatttttacaagcgatgaaggattagcaaaaattattcgtcaaattgctcgtcatggacaagatagaagatatcatcatataagagttggtgttaatagtcgtttagatactctacaagctgcaattcttctaccgaagttagaaattttcgatgaagaaatgaaatcacgtcaaatagttgctaaaaattataatagagctttaaatcaaattggcatcctgactactccatatatcgaatcccataatgtaagtgcttatgcgcagtatacaattcgtgttagaaatcgtgatgaactacagttgcgattaaaggaacaaggcattccaacaactgttcattatcctataccattaaataaacaacctgctgttgctaataatacaatccttccagttggagatataatttctcaagaagttattagcttgcctatgcacccttatttggaaaattcagatataagaaaaataataagaagcataaaataa

SEQ ID NO: 1657 - DNA, 591 bp, Xenorhabdus bovienii
  Coding sequence Name=Xb4151_4152.C429.gene3.dna; Position on contig =2602..3192bp; Strand=-
atgtcaatcacagaagaagtcatgatccatacgagtgccatcgttgatgatggtgctaaaataggaaagaatagccgaatttggcattttacacatatttgctctggtgcccaaattggtgaaaactgttctctaggtcaaaacgtatttattggaaataaagtaattattggaaaccactgcaaaatacaaaataatatttccatctatgataatgtttatttagaggacggtgttttttgtggtccaagtatggtttttactaatgtctataatcctcgatctttcatcgaaagaaagaatgagtataaaaatactttagtaaaaaaaggagcaactttaggtgccaactgcaccatagtttgtggaacaacaattggttcttatgcttttatcggtgctggagctgttgtcaataaagatgttcctgattacgcactgatggtcggggtaccagcaaaacaaataggttggatgagtgaatttggtgaacagttagatctaccattgcatggaaaatccactacaacatgtccttatacagggcatatctatcacttagatgataacagtgtaaaaaaaatcaaataa

SEQ ID NO: 1658 - DNA, 1050 bp, Xenorhabdus bovienii
  Coding sequence Name=Xb4151_4152.C429.gene4.dna; Position on contig =3209..4258bp; Strand=-
atgtttgatattatcaaaggtagaaaaataaaatttgcactggttggatgtggaaggattgctaaaaaccattttaactctttagatgcacataaaaataatgccgagttagttgctgtttgtgatacagaccctgttgccctcaataccgctatggaaaaaacaggcgctaatggatttaataacctacatgatatgctggataacatttcagctgatattatcatcctaactacaccttcaggactccatcctgaacaagccattgcttgcctagaaaaaggtttccatgtagttactgaaaaacccatggccactcgtttttctgatggagagaaaatggttaaagctgcggacaaagctggcaaacgcttattcgtagtcaaacaaaatcgcttaaacgcaactctccaattgctgaaacgcgcagtagaagaacaacgttttggtcaaatcaatatggttcacctcaatgtattttggactcgccctcaagattactacgatcaagctgcatggcgtggtacatgggaatttgatggtggtgcatttatgaatcaggctagccattatgttgatttgctagaatggctgattggcccagtcaaagacattcaagcaatgatgtctacacacttagacattgaagctgaagatacaggtgtactaaatattagatggcgaaacggcgcgctaggctcaatggctgtcactatgtgtacttatcctagcaacctagaaggctctatcactatattaggggaaaaagggagtgttagagttggcggtttagccgttaatgaaattcaagagtggaattttgccgacgaaaaagattatgaccaacaagtaaaaggtgccaattacgaaaccacttcagtatacggttttggacatccattatattataaaaatgttatcgatgtaatgagaggagaagcagaaccaatgactgatggaagggaaggattaaaatctcttgaattactaattgctgcttacctttctgccagagataataaaacggtgtctttacctttgatatattaa

SEQ ID NO: 1659 - DNA, 1311 bp, Xenorhabdus bovienii
  Coding sequence Name=Xb4151_4152.C429.gene5.dna; Position on contig =4272..5582bp; Strand=-
atgtcatcactgaataaattagttaacaaatttaataacaaaagtgcaaatatagctattgttggactagggtatgttggtttacctttaatgctacgctacaacgatattggttttaaagttatcggctttgatatagataaagataaaacagaaaaattaagccgaggtctaagctatattgaacatatttcctcttccagaattcaaaaagctattgaaactggctttgaagcaaccactgatttttcaagaatatcagaatgtgatgcaattattctctgtgtgcctaccccattaaataaatatagagaaccagatatgagtttcgtcataaatacaacagatatggtgaaaccatttttaagaaaaggtcaagtgctttctttagaaagcacaacttacccaggcacaactgaagaagagttattacctagagcagaagaaagtggcttaagagttggtgaagatatatttctagtatattcaccagaacgtgaagatccaggtaacccagatttcgaaacaagaactattccgaaagtaataggtggtcacacagaaaattgcttaaacgctggcattgcagtttaccaaccagctattgataaagtcgttcctgtcagctccacaaaagctgctgaaatgacaaaactacttgagaatatacatcgagcggttaatatcggattagtcaatgagatgaagctagttgcagataaaatgggcattgatatacatgaagtaatcagagctgcagcaacaaaaccatttggctttgttccttattacccaggtcctgggttgggtggtcactgcataccgattgatcctttttatctaacatggaaagctagagaatacggcgttaatacccgtttcattgaactttctggtgaagttaattcatcaatgccagattatgttgttactaaaacagtcttagctttaaataaagttaataaatcaattaatggtagcaatgtgcttgtcttaggcatttcatataagaaaaatgttgatgatatgagagagagcccatcagtccatataatggaaaaattaagagacttaggtgcattcgtagaatattcagatcctcacgtacctgctttccctaaaatgcgtgaacaccagttcgatctaataagccaatctataacttcaaataatttaaaagaattcgattgtattattttagcaacagaccacgataaatttgactatgacttaataattaacaatgcaaaattaattgttgatactcgtggaaaatattctcctaatcataataacgtgataaaagcttaa

SEQ ID NO: 1660 - DNA, 1371 bp, Xenorhabdus bovienii
  Coding sequence Name=Xb4151_4152.C429.gene6.dna; Position on contig =5960..7330bp; Strand=-
atgatcaatagtttgacagcccgtatttttgcgattttctggcttacactggcgctcgtcctgatggtggccttgatggcaccaaaactggattcacggcaattgacaccgctgttggacagtgaatatcaacagggcatcatactcgcgaaacagatagaaaaagagttaacccgctaccctgctaatgaactgttttggtggctacgactggatcgcgcaattgcaaagtggacgccgccggggcaacttttactgctcgttaccagtgaaggacgtatcgttgatatccagaccagtgaaaagcaggttgtccgtaacttcattggtcaatccaataatgcagatcatcccaagaagaagaaatatggtcgctctgaaatactcgggcccttttctatccgcgatggtgaagatcactaccagctttacctcattaggcccgcaggtagcccccagtctgactttattaacttaatgtttgaccgaccccttttattacctgctgcaaccatgttaattagtgcgccattactattatggctggcatggagtttagccaaacctgcccgtaaattgaaaaatgcggcagatcaggttgcgaaaggcaatttacggccacatcctgaactggaatcaggcccacaagaatttttagccgctggcagcagcttcaaccagatgatcaacgcgctggacagaatggtgacagcccaacaacggctgatttccgatatttctcatgaactgcgcacaccactgactcgcctgcaattggctagcgccctgctgcgccgacgtcatggtgagagcaaagagctgcaacgtattgaaacagaaactcaacgattagatgagatgatcaatgatcttctggtactttcccgcaatcagcataagaatgaactgctgcgagaaaatatcaaagccaacgatatatggcacgatatcctggagaatgccaaattcgaagtcgaacagatgaacaaaacgctggatatcgtctcccctccgggttcttgggttatctactgtaatccggcagtactcggtagtgcattcgaaaacatcgtccgtaatgccctgcgttattctagtagtcatatcgccgttgcgtttaaggcggataaccatggagtgacaattacggttgacgatgatggcccaggagtcagccctgaagaccgtgaacaaatcttccgcccgttttatcggacagatgaagcgagggatagagaatcgggtggaacaggattggggctggcgattgttgaaacggcagtgagccagcaccgaggatgggtgaaagcagaagatagtcctttaggtgggttacggctgataatttggttgccgttgcatgggagatga

SEQ ID NO: 1661 - DNA, 693 bp, Xenorhabdus bovienii
  Coding sequence Name=Xb4151_4152.C429.gene7.dna; Position on contig =7327..8019bp; Strand=-
atgcataaaatcttattagttgatgatgaccgtgaactgacatcgctattaaaagagttgctcgagatggaaggattcactgttgtgctcgctcatgatggcgaacaggcattacaatatatcgattcttcaatcgatctgctactactggatatcatgatgccacgtaaaaacggcattgagacactaaaagagctacgacaagaccatcagactcccgttattatgctaacggcccgtggaagcgatttagaccgtgttctggggttagaactgggtgctgatgattatcttcctaagccgttcaatgatcgtgaactggtggcccgtatacgtgcgatcctgcgccgttccaactggagcgaacaacaggctgatagtgggacacctgtactcgaggtcgataaactacagctcaaccctgggcggcaggaagccagctttgacggtacaattttggatcttaccggaacagaattcaccctgctttatttattagcgcaacatttaggacaagtcgtttcccgcgaacacttgagtcaggaagtcttgggaaaacggttgacaccctttgacagagccattgatatgcatatttccaacctgcgccgtaaattgccgaaccggactgacgagttaccttggtttaagacattacgcggtcgtggatacttaatggtctctgcaaaatga

SEQ ID NO: 1662 - DNA, 159 bp, Xenorhabdus bovienii
  Coding sequence Name=Xb4151_4152.C429.gene8.dna; Position on contig =7977..8135bp; Strand=+
atgtcagttcacggtcatcatcaactaataagattttatgcatgttttcttcctccgagagcaaaatacgataacaaactttgctattccataactttacgttcttttacatgctctgacgctagtttgcagcagcagggttatagtgatccgcactga

SEQ ID NO: 1663 - DNA, 498 bp, Xenorhabdus bovienii
  Coding sequence Name=Xb4151_4152.C429.gene9.dna; Position on contig =8175..8672bp; Strand=+
atgcgtaacatagcaatcttggctttagcgtcaatgtttgttcttggggcaaccgatgctttagctggaactgctggtactgataatgttattgcggatgacttctctcaatattgtatgccatatggtaataagaataacgttagttattgcctgaatgatgaacgtaactataactatagttgtatcttcgctggagtcagcttaacagagcagcaacgccagcagatatgggatttagtgaaaaagcaacgtctgcatgagaaacccgtggcagatattagagctgaacgtcggaagatgtatagccttttggattcaacgaattttgatgaggctgcggtcaggtcgcagcttgaaaaaatagcgaaagaaaatgttgatttgagtgtagagatcgctcgtattcgcaatcagatttatcaattgttgacaacagagcagaaagtacagctccagagacgttatgaagtgcgtgttaatcgagaaatgaactga

SEQ ID NO: 1664 - DNA, 111 bp, Xenorhabdus bovienii
  Coding sequence Name=Xb4151_4152.C429.gene10.dna; Position on contig =8794..8904bp; Strand=-
gtgtcatttgtccataaattgtacggaaagattatttgttcaacactaatttgtgatacaacacttgaaaattttcaagttgcttataaaatttttatagctgatttttaa

SEQ ID NO: 1665 - DNA, 582 bp, Xenorhabdus bovienii
  Coding sequence Name=Xb4151_4152.C429.gene11.dna; Position on contig =8959..9540bp; Strand=+
atgagaatcagcaaaaataacatttcttctatcgccgctgctatggctttatcactcgcaccagtccctgctgatagcgttggtagttacatggcaacatcgacaacacagaatacgttaatgttacaaaatgttaatgattctatggtgtatatgcctattgctgaagcacagaaatacgttgctgatatggctaaccgtatgagagggcatttgcgaaatctgcgtgcggaatgggaagaaaaacgtattcctattgatgataaaagtatgtctaaatttgccagagataatctgaattatttaacaagacatatcacgctttgcgctgtattagttagagcatcaaaagtggctttaaatcaaacaagtgatcaagaacttcgaaatacgattatgcagtttggccggtcagcagcggatttgcgttatacatatgaagaaattctcacatttactaaaaatacacatgaatcacctaatgtgcttgaaatggcagatcagttcagtaaagaaggtgttcaagcattaattagctctgaacatcaagcgctgggccttgataagccaatgtttcattaa

SEQ ID NO: 1666 - DNA, 312 bp, Xenorhabdus bovienii
  Coding sequence Name=Xb4151_4152.C429.gene12.dna; Position on contig =9617..9928bp; Strand=+
ttgaaagaatggaaaaatggtgggttgaggccgattatttttggtgatgaggggcgctgggaagatcatgcatccctatgcgcctcttttgttttcaaaatacatatcaaattacctgatgaggaaccgtggtcagctaagatgcccgttgttgcacgtaagagtaatagctatcttgtgtatacccgtcattggtgtgagccgaaaaaatatcaactcattagtatcatgaccccaaatgcccatgaacttgccagaacctcttttttatctgtattggttgatcgcgcagaagatttccaaaataactga

SEQ ID NO: 1667 - DNA, 168 bp, Xenorhabdus bovienii
  Coding sequence Name=Xb4151_4152.C429.gene13.dna; Position on contig =10025..10192bp; Strand=+
ttgattgtcgttattgtcaccaatcagaagatgtcaaaggacagggaaaaggtcatagaggttatccccgctaccgctgctatgcctgcagtaaagtctttcagttggcatacacctatcaagcttgcaaaccgggagtcaaagagcagactattgatatggcgatga

SEQ ID NO: 1668 - DNA, 174 bp, Xenorhabdus bovienii
  Coding sequence Name=Xb4151_4152.C429.gene14.dna; Position on contig =10143..10316bp; Strand=-
atgaatgtcatccccgtcaagaggaagcgtcgtcacgttccgggggttgagtttttaagcgttttcatcacagtagctgttgccaccttcaatacgcgggccgtgtcacggatgccgctgttattcatcgccatatcaatagtctgctctttgactcccggtttgcaagcttga

SEQ ID NO: 1669 - DNA, 423 bp, Xenorhabdus bovienii
  Coding sequence Name=Xb4151_4152.C429.gene15.dna; Position on contig =10281..10703bp; Strand=+
gtgacgacgcttcctcttgacggggatgacattcatcttatctgtgaagtggatgagcaggagtcgtttgtggggagtcagaaaaatcagcgctggctctggtatgcctgggagccgcgtatgaaacggatagtggcacatacttttggggatcacagcagaaaaacatgggaaaaactactggcactcttgtcaccctttaatatccggttttactgtacggatgattatgccgtttatgattgtcttcctgaagaagtccatcttactggaaagatatttacccaacgtatagagagaaccaaccttacccatcgtacccgaataaaaaggctgaatagaaaaacaatcggttattccaaatctgaagaaatgcacgataaagtgataggcactttcattgagcgtgaaaactatatttag

SEQ ID NO: 1670 - DNA, 150 bp, Xenorhabdus bovienii
  Coding sequence Name=Xb4151_4152.C429.gene16.dna; Position on contig =10681..10830bp; Strand=+
ttgagcgtgaaaactatatttagtgagcattctaactatttaatacacgaccgtctattgagccgtctttcagccccaaaatgtcaggagaaccgctcatggccgcatttttggtgggctaggttcttattttttattttaccgcactaa

SEQ ID NO: 1671 - DNA, 642 bp, Xenorhabdus bovienii
  Coding sequence Name=Xb4151_4152.C429.gene17.dna; Position on contig =11041..11682bp; Strand=+
atggctaactctcataaaataagcctgttagcaagatgcatgggcgcgacgttattgggcctgtgccgtgtcttgaccggtgtacaagtacgatggattggctgtcagccatcgacctcaagccgtatttattatgcaaatcataccagccatcttgatggattggtgatctggtctgggcttccccccaaattgcgttatcagattcatcctgtagctgcacgggattattgggataaaaccaagctgcgtcgctatcttatgtataaggtatttcgtgcagtcttgattgaacgtaaaggagaacatacttcaaaatccggggttcttgcacctttggaagctattctggcgaaaaaagagtcgttgattttctttccagaaggtacacggggagatggtgaacaactcaatccgtttaagggaggtttgtatcatctggctcgtcagtaccctgatgctgaaatgatccctgtctatctggaaaattcgaatcgtgtcctgccgaaaggaaaaagattattggtaccgattatttgttcggcaacatttggcaagcctctggataaattgggtgaaaatgaaagcaaagtcgccttcttgcaacgtgctcagtctgcattggaggagttgatgcgatga

SEQ ID NO: 1672 - DNA, 945 bp, Xenorhabdus bovienii
  Coding sequence Name=Xb4151_4152.C429.gene18.dna; Position on contig =11679..12623bp; Strand=+
atgatcaagattgataatggcctgatgcttctgctgggtgggatatttggggtattgattatcgccagtgcgattggtggcatattgtcgcttcggtattcgggggcaaagcgcagtgcgactatcgataacctgaatgccagaattcgtggctggtggatgatgtgtatcatctgtgtgctggctgttatcgttgggtctgtggggtcggtgatcctgtttacggtgatgtcattttttgccctgcgtgaattcatcacattgacaccgactcgccgtggtgatcatgaggctcttttctggtgtttctttgtctttatgccaatccagtatgtcttgattgggatgcaatggtacggcttattctcagtttttattccggtttacgtttttctgtttttgcctgtgcgtattgctttggttggggataccacccgctttctggaacgaaccgctaaaatccaatcggcaatgctgatcacggtgtttgccctgagccatgctccggccttgttgatgttgcatatacccgattatgaggatcagaatatcaagctattgctgttcctgatgattgtcgtgcagatgtccgatattttgcagtatgtattcggcaagttattcggtaagcgcccgattgtgccgaaattaagccccaataaaacggttgaaggatttattggggggattttggcctcttcgctgctagggatgtcactgtattgggtgacgccgttttcaccgtgggaagcggggctgatgtcattggctatcacgttgatgggctttattggtgggttgtgtatgtcagcaatcaagcgtgacagtggagtgaaagactttggcggaattattgaggggcatggcggtatgttggatagaattgattcgctttgttttgctgcccctatatttttccatctaacacgctatttttatacctga

SEQ ID NO: 1673 - DNA, 900 bp, Xenorhabdus bovienii
  Coding sequence Name=Xb4151_4152.C429.gene19.dna; Position on contig =12651..13550bp; Strand=+
atgagtataaattatgggcgatgggtcagtgctgctgcgttgttggcaacggtgctggccagtgtgttgctggtcgtgaaaatttttgcgtggtggttgacggggtcggtgagcttattggcggcgctggtggactctttagtcgatctggccgcttctttgactaattttttcgctgtacgctattcgctccagcctgccgataaagaacataccttcgggcatggtaaggcggaatcgctggcggcgcttgcccaaagcatgtttatttccggatcggccattttcctgtttttaacgggttttcagcatttggtttcccccgagccattggagcatgcgacgataggtatctgggtgatcgtcgtcgccttgatttcaacgatctgcttggtgacgttccagaaatgggtgatcaataaaactcaaagtcaggctattcgcgcggatatgttgcattacaaatccgatttgttgatgaatggggcgattcttctggcactggtcttgagtatgtatggtttccggcgtgcggatgccctgtttgctttgggaatcggggcttatatcctctatagtgcgttacggatgggatatgatgccgtacaatctttgcttgatcgcgctttgcccgatgaggagcggcaagagattattgagatgatcaagtgctatcccggaatcgcgggtgggcatgatctgcgaacacgccagtcaggtccaacgcgttttattcagttccatctggagatagatgatcacctgccgctggtggacgcgcatgctttggctgaggggattgaaaataaattgcgggataggtttccgggcgccgatattattattcaccaagatccttgttccgttgtgccagaggagcataaaaaccgttgggattaa

SEQ ID NO: 1674 - DNA, 138 bp, Xenorhabdus bovienii
  Coding sequence Name=Xb4151_4152.C429.gene20.dna; Position on contig =13492..13629bp; Strand=-
atgatacggaaaaacacccagtctgcattaagattatgtttattttctgacgctcttttgattatgaataaattccccgttaatcccaacggtttttatgctcctctggcacaacggaacaaggatcttggtgaataa

SEQ ID NO: 1675 - DNA, 978 bp, Xenorhabdus bovienii
  Coding sequence Name=Xb4151_4152.C429.gene21.dna; Position on contig =13756..14733bp; Strand=+
atgatcaacaagattaaaagaatcggagtcttaacgagtggcggtgatgcgcctggcatgaacgccgctattcgtggagttgttcgtgtcgctttaaccgaagggttggaggtttacggcatttatgatggctatctggggttgtatgaaaaccgcatgaagaagctagaccgtttcagtgtttccgacatgattaaccgtggtgggacgtttctgggatcggcgcgttttcctgaattcagggatgataaagtccgtgaaattgccattgaaaatatgcgtaaaaatgacattgatgcgctggtggtgattgggggagatggttcttatttaggggcgaaaaagctgactgaagcgggttttccttgtattggcctgcctggtacgattgacaatgatgtggcaggaacggattacactatcggttattttacggcgctggaaacagttgtagaggcgattgaccgtctgcgcgatacttcgacgtcccacaagcgtatttcgattgtagaagtgatggggcgctattgtggtgatttgacgttgtctgcggcaattgcgggtggatgcgaattcattgttttgcctgagaatgaaatcccgttcgatcgtgaagaattactggcggaaatcaaggcgggtatccaaaaaggtaagcgccacgccatcgttgccattactgagcatgtctgcaatgtggatgaattggcgaaatacattgaagcagaaacacgtcatgaaacccgtgcaacagtactggggcatattcaacgtggcggtgcgccggtggcgtatgaccgtattctggcttctcgcatgggggcttattctgtccagttgctgatggaaggttttggtggccgttgtgtgggtatccagaacgagaaacttgttcatcacgatattatcgatgcggtgcaaaatatgcagcgtgttttcaagaaagactggctggaaacggcgaagcagctttactaa

SEQ ID NO: 1676 - DNA, 153 bp, Xenorhabdus bovienii
  Coding sequence Name=Xb4151_4152.C429.gene22.dna; Position on contig =14666..14818bp; Strand=+
atgcggtgcaaaatatgcagcgtgttttcaagaaagactggctggaaacggcgaagcagctttactaaacctttctcacctgcaacatactttttcaagggctgccatattttatggctgctcttttctgcactatattccacttatgcataa

SEQ ID NO: 1677 - DNA, 108 bp, Xenorhabdus bovienii
  Coding sequence Name=Xb4151_4152.C429.gene23.dna; Position on contig =14779..14886bp; Strand=+
atggctgctcttttctgcactatattccacttatgcataagcagaaattttaaattatttctgcgtcatactgctttctgtcagcttttatggcgataccataaatag

SEQ ID NO: 1678 - DNA, 1014 bp, Xenorhabdus bovienii
  Coding sequence Name=Xb4151_4152.C429.gene24.dna; Position on contig =14906..15919bp; Strand=+
atggtcacgagatgggcagcaagaaggtgtgccgtattgacggcattattgatggtcttggcaggaggtagtgcatgggcaaaagaggtgcaactcttgaatgtttcttacgaccctacccgtgaattgtatcagcagtatgatcaggcattcagtcagtattggcagcaaaaaaccggagatcacgtaacagtccgccagtcacacggtggttcgggtaagcaggcaacgtctgtcatcaacggccttcaggcggatgtggtgacattggcgctggcatatgatgtgaatgcgattgcagagcgtggccgcattgccaaggattggattgatcgcctgccggagaattccgcgccttatacttcaaccattgtttttctggtacgtaagggcaatcccaaacatatcaaggattggtcagatttggttcgtcccggtgtttctgtcgtgacaccgaatccaaaaacgtccggtggcgcgcgttggaattatctggcggcttggggatatgggctggcacagaataatcaggatcaaggcaagactaaagccttcgttaaggcgctttataagaatgtcgaagtgttggattctggcgcgcgtggtgcaactaatacttttgtggagcgtggaatcggggatgtattgatcgcatgggaaaacgaagcgttattggctacccatgcactggctcagggtaagtttgagattgttacaccgagtctttccattctggcagagccaaccgttgccgttgtcgataaggtggttgataaacggggaacacgtaaactggcaacggaatacttgaaatacttgtattctcctgtcggacaggaaattgcggcaaataattattatcgtccccgtgataaagccattgcagaaaaatatcacgctgtttttcccgtactgaaattgttcacgattgatgaagtatttggtggctgggataaggcccagaaggtgcattttgccacgggtggcattttcgatgaaatcatccggcgttaa

SEQ ID NO: 1679 - DNA, 957 bp, Xenorhabdus bovienii
  Coding sequence Name=Xb4151_4152.C429.gene25.dna; Position on contig =15983..16939bp; Strand=-
atgactaaaacgatttgtatcggtattgatgttgccaaagcttcacttgaaattgcacttggtgctcagggaaccgtaatgacatatccaaatacccctgaaggtcatgatgaactagcggctacactgaccaactatgagattgatttagttgtattagaagcaacagggggttatgaggtatccgttgcttgtgttttacagaccatagggctggctgttgctatcgtcaatccccgacaagcccgtgactttgctaaggcaatgggtaacttagccaaaaccgataaaatagatgctcaggtgctggcacagttagccctggttttatctcaacgaacagaccgggataaaatagtcaggatattgccctctgctcagcaacgagtcttgcaagccatgatcgcacgtcgtcgccaattggtcgtactttccatctcagaacgccaaaggttggggaattgccatccagacattcgagaaagcatcactttaatgatcagctttatacaggaacagcttaaggtcattgaatctgccttgtctaaacacattaaaacctatcatcgttccaaactcgatttattatctacagtaaaaggcgttgggcctgccacaatagccactttgatcgctgatgtaccggagttgggtaagttaacacgccgggaaattagtgccttgattggtgttgcaccgtttaatcgagattctggatttttccgggggaaacgaacaatctttggaggaagagcaatggtgcgtcgaatgctatatatggccacgttaacggcaattagatttaaccccgttctctgcgctttctacaagagattgaccgaagcaggcaagccaaacaaagtcgccatcgttgcgtgtatgcgtaaattactggtcattctcaatgcaatgataaaaacaaatagaccgtgggacgaatcattccacacggtgtaa

SEQ ID NO: 1680 - DNA, 165 bp, Xenorhabdus bovienii
  Coding sequence Name=Xb4151_4152.C429.gene26.dna; Position on contig =16902..17066bp; Strand=+
ttggcaacatcaataccgatacaaatcgttttagtcatggttcttcggctcccattcttgcaaatacgaattgtgtttcaagcaactgttcgggtttctcgaagaaaagtcacaatcatgcgtcgaaagctcattaacgggcttaatcccttgatggttatctga

SEQ ID NO: 1681 - DNA, 1041 bp, Xenorhabdus bovienii; identical to SEQ ID NO: 1291
  Coding sequence Name=Xb4151_4152.C429.gene27.dna; Position on contig =17149..18189bp; Strand=+

SEQ ID NO: 1682 - DNA, 207 bp, Xenorhabdus bovienii; identical to SEQ ID NO: 1041
  Coding sequence Name=Xb4151_4152.C429.gene28.dna; Position on contig =18215..18421bp; Strand=-

SEQ ID NO: 1683 - DNA, 135 bp, Xenorhabdus bovienii
  Coding sequence Name=Xb4151_4152.C429.gene29.dna; Position on contig =18421..18555bp; Strand=-
gtggagtttgagtcagggggatttatagccgtgataggtgtgaaaagccatcgcgtagtggcgggtaaagttagcggcagaaaaacaaaaaaatctatggtccccaccttttttgcaacactgatttttgattga

SEQ ID NO: 1684 - DNA, 183 bp, Xenorhabdus bovienii
  Coding sequence Name=Xb4151_4152.C429.gene30.dna; Position on contig =18619..18801bp; Strand=-
gtgggcgagaatggtttacctgcatggggcgatatcccgccgttacaggatgcggttgatttggatatggccaccgactcggagaaatccgcactaaccgaatggcgtaaataccgggtgctgctcaatcgggtggattgcactaccgcacctgatatccaatggccggagcagccgaagtga

SEQ ID NO: 1685 - DNA, 216 bp, Xenorhabdus bovienii
  Coding sequence Name=Xb4151_4152.C429.gene31.dna; Position on contig =18743..18958bp; Strand=-
ttgactgcgtggttatcgagaatcacagttcaaatctacgcattactgaaaaccctatcgaatcgggagcggcaattgctgaccatgctgttctggaaccaaaagagattacgattgcagggatcatggttggtcacccgagggcaagcgccgcgtagtgggcgagaatggtttacctgcatggggcgatatcccgccgttacaggatgcggttga

SEQ ID NO: 1686 - DNA, 282 bp, Xenorhabdus bovienii; identical to SEQ ID NO: 740
  Coding sequence Name=Xb4151_4152.C429.gene32.dna; Position on contig =19121..19402bp; Strand=-

SEQ ID NO: 1687 - DNA, 177 bp, Xenorhabdus bovienii
  Coding sequence Name=Xb4151_4152.C429.gene33.dna; Position on contig =19435..19611bp; Strand=-
atgctactcatgggaaaatccgaatccgttatccccataacagagaaggatttaaccatgagtagattcaagaaagcatcgcatgtgctttggtgttgtcaataccatatcgtatggacacccaaataccgatttaggatcctgaaaaataatgtaggaaaggaaataagcagataa

SEQ ID NO: 1688 - DNA, 129 bp, Xenorhabdus bovienii
  Coding sequence Name=Xb4151_4152.C429.gene34.dna; Position on contig =19574..19702bp; Strand=+
atggggataacggattcggattttcccatgagtagcattattggcagagccaacctgttgctaaccacctccgcaggaggtggttttcagttaagaataaaaaaggtcgcaaatgcgaccttatattaa

SEQ ID NO: 1689 - DNA, 153 bp, Xenorhabdus bovienii
  Coding sequence Name=Xb4151_4152.C429.gene35.dna; Position on contig =19719..19871bp; Strand=-
ttggcaggttgcttcaaaataaagcttcgctcttctggatttcgtcttgtctatcaggtgatagatgaagatattgtgatatgggttattgctgtaggtaaaagagaagactctaaagcctataagatagccagtgaacgtattgtacgataa

SEQ ID NO: 1690 - DNA, 96 bp, Xenorhabdus bovienii
  Coding sequence Name=Xb4151_4152.C429.gene36.dna; Position on contig =19850..19945bp; Strand=-
gtgaacagtttaaaaagaagctacggaagctacaggataatccctatattgaatctgccagattacacggtgatttggcaggttgcttcaaaataa

SEQ ID NO: 1691 - DNA, 102 bp, Xenorhabdus bovienii
  Coding sequence Name=Xb4151_4152.C429.gene37.dna; Position on contig =19948..20049bp; Strand=+
atgctgttatccagcttctaccattcttttaaagcgcgttcgtcaaactcaatattaaatgtcatcgagatttacccgaattcgtttggcgggattttttag

SEQ ID NO: 1692 - DNA, 255 bp, Xenorhabdus bovienii
  Coding sequence Name=Xb4151_4152.C429.gene38.dna; Position on contig =20002..20256bp; Strand=-
atgagcacaattcagatcagagtggatgaagaactaaaaaagaatgcatatcaggcatttgagaaactgaatctatctccttccgatgcaatgcgactcttcctgcgttatgtggcagagaatgaaaaactgccatttactgaggtatcagtgatggttgcagagcatgatgaagatgaagatattttggatgtagtacgcgatcgcctaaaaaatcccgccaaacgaattcgggtaaatctcgatgacatttaa

SEQ ID NO: 1693 - DNA, 102 bp, Xenorhabdus bovienii
  Coding sequence Name=Xb4151_4152.C429.gene39.dna; Position on contig =20363..20464bp; Strand=-
gtgcaatcaatacttaagagattgaccgctcatcttacgctgaacacttttgataactcgcggattctaaataatctcaggcaggagtctttaccagtataa

SEQ ID NO: 1694 - DNA, 93 bp, Xenorhabdus bovienii
  Coding sequence Name=Xb4151_4152.C429.gene40.dna; Position on contig =20448..20540bp; Strand=-
gtgcatcttgcaagatttggacaatttcggagttcattgatcttccccgagagaaagcgaatggaattccggagaggtgcaatcaatacttaa

SEQ ID NO: 1695 - DNA, 210 bp, Xenorhabdus bovienii
  Coding sequence Name=Xb4151_4152.C429.gene41.dna; Position on contig =20504..20713bp; Strand=+
atgaactccgaaattgtccaaatcttgcaagatgcacttgatactggtgttagccagatcgacccaagtatgtcgccagaggatgctcaggccacgttcgaggatggaatggaagaattgagaagattgcttaccaaaaaacaggaagaaatattaaatacagccagagtgtttgcaaagttaaccagctccaacaaaaaagccccgtga

SEQ ID NO: 1696 - DNA, 264 bp, Xenorhabdus bovienii
  Coding sequence Name=Xb4151_4152.C429.gene42.dna; Position on contig =20936..21199bp; Strand=-
atgacctttaaaaatggggctatgacaattcatgggatgaaatcaggtgattatgtcggtcatgagatggctatgactgcgccgccagtaacgcgggatggcaggaagctaatgtcagaaagagaatttaaatatgacgatggcgaatttagtgaagatttttctccaaaataccgcatagcgacacttacgattggtaatccacgttatggcgggataacgcagcatctaactaactgtaaaaaagagcaagaacaagaataa

SEQ ID NO: 1697 - DNA, 126 bp, Xenorhabdus bovienii
  Coding sequence Name=Xb4151_4152.C429.gene43.dna; Position on contig =21242..21367bp; Strand=-
atgaaaaggatactaatagtatgtacagcgcttaccttaatagggtgcggtgataactacagtgaatttaatggcgtttatacttgtaaaataggtctgtcaatgaatgccgtagcagtagactaa

SEQ ID NO: 1698 - DNA, 477 bp, Xenorhabdus bovienii
  Coding sequence Name=Xb4151_4152.C429.gene44.dna; Position on contig =21464..21940bp; Strand=-
atgatgaatactaaaaaattacttttatcagcttctcttttaggcgctttgtttctcaatggttgtgccagcgtacctcttgcaactgaacaaaaatcagcacaagctaaaagcttttctgccccagaggaaagcaaatctggcttatatatctaccgcgacagctttgtcggtaaggctctaaaaaaagacatttatgttgatgggaagtgtattggagaaacagcagataaaacgtttttctacacacaagtatcaggcagccaaaaccacaaaatatcaaccgaatcagagttctcccctaatgacctagtaattttcaccgaatctggaaaaaattacttcataaggcaatacataaaaatgggagtttttgttggtggtgctggtttgagtgcatcaacagaggaagaaggaaaaagggtaatatctcaggcgggtgttcgtcttgcaaaggaaggacattgtgatagctga

SEQ ID NO: 1699 - DNA, 123 bp, Xenorhabdus bovienii
  Coding sequence Name=Xb4151_4152.C429.gene45.dna; Position on contig =21882..22004bp; Strand=+
ttgagaaacaaagcgcctaaaagagaagctgataaaagtaattttttagtattcatcataaaaaacagaaccttttgtataaaagtaaaaaaactaacctcgcaactgaggttacttagatag

SEQ ID NO: 1700 - DNA, 360 bp, Xenorhabdus bovienii
  Coding sequence Name=Xb4151_4152.C429.gene46.dna; Position on contig =22082..22441bp; Strand=-
atgaaaaagtcagtttgtttattgttgtcattaatggcattagcagggtgtggcgaaaaagaacaaaagacacctgagcaaacatattcggatttggttataaaatctttgtctaacattatcataatggatcaggataaagggattgagaaaacatgtttggttacatttgatattgatgccaatgcaaatccctcgaacatcctatcagaggggcgagataaagtattttgcggtaaagtcgaagctatgattgatataagcgatacgcctcgtcctccaaactcattgatagttaatgggatagctcatattagaatggaaataaataaatccgatttatacgtcattgagcgttag

SEQ ID NO: 1701 - DNA, 144 bp, Xenorhabdus bovienii
  Coding sequence Name=Xb4151_4152.C429.gene47.dna; Position on contig =22487..22630bp; Strand=+
atgataagtgttactgattatttgatcagcaatttcagaagtgtgagaggagttacaaaagtcggtcatgactctattttattgatagtgatgaatgttcagataatatcctataattctgtcatgcatttctatggattttga

SEQ ID NO: 1702 - DNA, 504 bp, Xenorhabdus bovienii
  Coding sequence Name=Xb4151_4152.C429.gene48.dna; Position on contig =22565..23068bp; Strand=-
atgtcgggcgacagcacgagtgatggggattggcctgaataccgtacttcggcatttaaaaaactcaaacccaaatcggtaacagaagcgattaaacctggcactgaagtgattgtctgctgcgaaatggatgaacaatggtcttacgtaaagtcaaagaagccgcctcgttggctcttttatgccgacgacaggataagacgaaaagtgatcgcccatgtttttggtccaagaacaaaaaagacattaatgcgcctattagctttactggcacctttcaacattattatttatatgacagatggctggaaaaattacgaaaaagcactcgcagggaaacgccatgtggccagcaagcgttatacccaacgcatagagaagcataacctgaatcttcgtcaacatttggcaagactgactcgcaaaacattgtctttttcaaaatccatagaaatgcatgacagaattataggatattatctgaacattcatcactatcaataa

SEQ ID NO: 1703 - DNA, 291 bp, Xenorhabdus bovienii
  Coding sequence Name=Xb4151_4152.C429.gene49.dna; Position on contig =23014..23304bp; Strand=+
atgccgaagtacggtattcaggccaatccccatcactcgtgctgtcgcccgacatcccattccattcatagccatatcgacgatttgcttatgggtaccgagacgacaagcggcataagtgaactcctgttgccaggagtgacggcaggattggcaaagataacgttggtgaccagaacgcgagcgcccattgcgatggatccctttcactgcggaacaagaggggcaagttacatcaatctttgccatttgaatgttttccaaatagacagactatacatgattcaataa

SEQ ID NO: 1704 - DNA, 1194 bp, Xenorhabdus bovienii
  Coding sequence Name=Xb4151_4152.C429.gene50.dna; Position on contig =23421..24614bp; Strand=-
atgaatatgaataatccacagcaaaaattcgatatcgtcgtcgtgggtgcgggtatggttggtgcagcgacggctttgggactcgcacaagagggctggcgtgtcgcgttactggagcatcagttgccgcagccttataatgaaggtaatgaaccggatattcgcgtatctgcaattagctgcgcttccgtggatttattgaaacaattgggtgtttggaaccatgttttgcggatgcgcagtgcaccttaccggaaattggagacgtgggagcagcatgattccaacgtgactttcgatgttcaaagtcttgggctgacagagttgggctatatggtagagaactacatcctgcaattggcactgtggcaggagtttgaacgttacccgaatctgacactgttttgcccggccgccctgaaatcgatgcaacggcagcatgcacatcaaatatggcaagtaacattgatggatggcacggaaatgaatgcgcgtctgatcattggtgcagatggtgcccgctctcaggttcgacaactggccggtattggcagcaatgggtggcaataccggcagtcatgtatgttaattaccgtcaaaactgaacaacctcagcaggacaccacatggcagcagtttttcccttctggcccgagagctttcctacctctgtttgatcagtgggcttcattggtctggtacgattctcctgcccgaattcgtcaattacaatcgatgacgatggtacagcttgagcgagaaatctttcaggcatttccctcccgcttgggcaaagtgactccaattgctgtgggttcgtttcctcttactcgtcaccatgccagccactatgtgcgtgagggattggccttgcttggcgatgcggctcataccattaatccattggccgggcagggcgtgaatttaggttatcgagatgttgaggttttgcttaaggtgctgataaacgctaaagaattacaggaagagtgggattctcaagcggtattggtgcgttatcagcgtcgcaggatgccggataatttagtgatgcaggcgggtatggatctcttccacaccgcattcagctatgatttgccgggcttgaaaaccatgcggaatttagcgctgatggcggcacaacgttcaggggcgatgaaaaagctggcgctgaaatatgcattggggttgtag

SEQ ID NO: 1705 - DNA, 204 bp, Xenorhabdus bovienii
  Coding sequence Name=Xb4151_4152.C429.gene51.dna; Position on contig =24525..24728bp; Strand=+
ttgtgcgagtcccaaagccgtcgctgcaccaaccatacccgcacccacgacgacgatatcgaatttttgctgtggattattcatattcatcacgccattaacttcctgattaaaatagtgtaccggaattttccctttccggctgtgaatatccgatgttacagtctggtcactggtgcctcaaatgactacaatagcctgtaa

SEQ ID NO: 1706 - DNA, 1431 bp, Xenorhabdus bovienii
  Coding sequence Name=Xb4151_4152.C429.gene52.dna; Position on contig =24812..26242bp; Strand=+
atgtcgacgataaaaaaactgtatatcaaaacctggggctgtcagatgaacgaatatgattcatccaagatggccgacttactggaaaccactcacggttatcagttaaccgatgtcgccgaagaagcagatatcttactcctgaacacctgttcaatccgtgaaaaagcccaagaaaaagtcttccatcagctcgggcgctggaagggtttaaaagacaaaaatcccgaaattattattggtgtcggtggctgtgttgcatctcaggaaggggatttcatccgccaacgcgctcctagcgttgatattatcttcgggcctcaaaccctgcatcgcctgcctgaaatgattaatcatgtgaaaggcacccacagtccaatagttgatatcagcttccctgagatcgaaaaattcgaccgaatgccagaacctcgggcagaaggcccgagcgcattcgtctccattatggaaggctgcaataagtactgtacattctgcgtcgttccttacacccgaggagaagaagtcagccgtccttgtgatgatattttgtttgaaattgcccagcttgctgctcaaggcgtacgtgacgttaacctgctcggtcagaacgttaacgcttaccgaggcgcagcattcgacggggatatctgcacatttgcggaattactgcgtctggtcgcggccattgatggtattgaccgcattcgcttcaccaccagccatcctattgaatttaccgatgatattatcgcggtttacgaagacacaccggagttagtcagctatctgcacctacccgtacagagtggctctgaccgtatcctgacccagatgaaacgtgcacataccgcactggaatacaaagggatcatccgccgtctgcgcaaagcacgtcctgacattctgatcagttctgacttcatcatcggtttccctggtgaaacacaggatgacttcgaaaaaaccatgcaactgattgccgatgtgaatttcgacatgagtttcagcttcatctattcagcgcgtccgggaacccctgcggccgatttgccggatgacgtgagtgaagaagaaaaaaaacagcgcctgtatctgctccagcagcgtatcaatcagcaggccatgagcttcagccgcgcaatggttggcagtacacagcgtattctggttgaaggcacatcccgcaaaaatatcatggagctttccggccgtactgaaaataaccgcgtggttaattttgaaggaacgcctgacatgattggcaagttcgttgatgccgaaattgttgacgtgtatgccaactccctgcgcggtaaagttatccgtacagaagatgagatgaatttgcgcatccatgagtcacctgagtcagtcatcgcccgtacccgcaaggaagatgaaatcggcgttggcatttatcagccttaa

SEQ ID NO: 1707 - DNA, 168 bp, Xenorhabdus bovienii
  Coding sequence Name=Xb4151_4152.C429.gene53.dna; Position on contig =26187..26354bp; Strand=-
gtgggccacacagactcatcagccgttgattatctgcgggttccagaaagatctcttgtgttgctacttgtgagtttatttgtgtcactgattatctctatgttagggcctgttaaggctgataaatgccaacgccgatttcatcttccttgcgggtacgggcgatga

SEQ ID NO: 1708 - DNA, 978 bp, Xenorhabdus bovienii
  Coding sequence Name=Xb4151_4152.C429.gene54.dna; Position on contig =26336..27313bp; Strand=+
atgagtctgtgtggcccacttgatgacaacctgaaacaacttgagcgtcgtcttggagtagagatcagccgccgcgacaatcgtttcaaactggtgggtaagccattgtgtgtcagtgcagtagccggtatcctgcgccatctttacgtcgaaaccgcacctgtccgcagcgtgatcccaaacattgaacctgaacagattcatctggccatcacagaaagccgcgtgctggagcaatcggcagaaagtattcctgactacggcaaggctgtgaatatcagaaccaagcggggtgttgtgaagccccgtacgcccaaccaagcacaatacattgccaatatccttgattatgatattacctttgggattgggccagcagggacagggaaaacttatctggccgttgccgccgccgttgattcactggaacgtcaggaaatccgtcgtatcctgctaactcgtccagcagttgaagcgggtgaaaagctgggatttctgccgggtgatctgagccagaaggtcgatccttatttgcgcccgctttacgatgcgttgtttgagatgctgggatttgaaaaagttgagaagttgatcgaaagaaatgttattgaagtggctccactggcctatatgcgtggacgtaccctcaatgatgcctttattattctcgacgaaagccagaataccaccattgaacagatgaagatgtttttaacccgcattggcttcaattccaaagcggtgattaccggtgacgtgactcagattgacttgccaaaaggccagaaatccggccttagccacgcagtagaagtcttgtctgaagttgatgaattaagctttaatttcttccatagcgaagacgttgtccgccatccggtggtcgccaaagtcgttatcgcctatgaagcatgggaatctgcggaacagaaacggaagcaagagcttaatgataaacgcaagcaggaagcgcaatga

SEQ ID NO: 1709 - DNA, 468 bp, Xenorhabdus bovienii
  Coding sequence Name=Xb4151_4152.C429.gene55.dna; Position on contig =27310..27777bp; Strand=+
atgaattcagttatattagatttacaaattgcatgtgaaaatccagaagggctgcctgatgaagcccttttccagcgctggctggagagtattctgccacaatttcaggcagaaagtgaagtaacaatccgcttggtcgatgaggcagaaagccacgatttaaacctcacttatcgcgggaaagataaaccaaccaatgtgttatcctttccgtttgaagcaccgcctgaagtggaattgcctttgctcggtgatttaatcatctgtcgtcaagttgttgaacaagaagcagaggaacaacaaaaaacagttgaagaacactgggcacacatggtaattcacggttctctccatctgcttggatacgaccatatcgaagacgatgaagcagaagaaatggaatctctggaaacagaaattctacaaaaaatgggttatgctgatccctatcttgcggaaaaaaaataa

SEQ ID NO: 1710 - DNA, 903 bp, Xenorhabdus bovienii
  Coding sequence Name=Xb4151_4152.C429.gene56.dna; Position on contig =27827..28729bp; Strand=+
atggggaattttcattcaaacgccatgagcgacgaccatccttcaaataacgatagccctggccctaagaaaggctttcttgcgcttcttaatcaactttttcacggtgaaccaaaaaaccgtcatgatttggttgaactgatccgtgattctgaacagaacgatctgatcgatcccgatactcgagagatgctcgaaggggtaatggatattgctgaccaacgcgtgcgcgacattatgatccctcgctcacaaatcgttaccttaaaacgaaatcaacctctggacgaatgtctggatgtaattatcgattcggctcactcacgctaccctgtaatcagcgaagacaaagatcacatcgaaggcattttgatggcaaaagatcttctgccattcatgcgcacgaatgcagagactttcagcattgataaagtgctgcgtcaggctattgtggtgccagagagtaaacgtgttgaccgcctgctgaaagagttccgctcccagcgttaccatatggcaattgtgatcgatgaattcggtggtgtttccggtctggtcacgatcgaggacattcttgagctgattgttggcgaaatagaagacgaatacgatgatgatgacgataacgatattcgtgccttaagccgccatacttattcagtacgggcattggctcaaatcgaagatttcaacgatgttttcggcaccaatttcagcgatgaagaagttgataccatcggtgggctagtgatgcaggcatttggtcatctaccttcccggggtgaatctatcgacataaatggttatcttttcaaagtagcaatggcagatagccggaaaatcattcaggttcatgtcaaaataccggatgatgctgacgttcctggccttgataaacaataa

SEQ ID NO: 1711 - DNA, 1590 bp, Xenorhabdus bovienii
  Coding sequence Name=Xb4151_4152.C429.gene57.dna; Position on contig =28680..30269bp; Strand=+
atgtcaaaataccggatgatgctgacgttcctggccttgataaacaataataggatctggatgaacaaagcctcattactgagttgccagcggctgcgcgccttgctggcacttttcttaggagccagtggaacactggctttttcaccttttgatttctggcctgctgcatttctgtcccttttcggcctgcaaattctgacactcaacagaaccactcgacagtctctctttattggtttctgctggggatttggcttatttggcagtggtacaaattgggtttatgtcagcatcgctgattttggcggcatgcccactgtcgtcaatatctttctggttatcctgctatctgcctatctcgctctttatcccactctgtttgctggcctgctcaaccgtttttttccggccgccaacgggatcaggctggtcattgccagtccagcactgtggcaattgactgaattcctgcgtggttgggtattaaccgggtttccatggctgcaatttggctacagccagatcgatggcccaatgaaagctattgcccctattctgggggtagaaggcattaccttcctgatgctaatgatcagtggtctgctggtgcttgccactacccggaaaaaactttcactagctatcgctgcggttattctgctgctactgccgtggccaatgagatattatcagtggtataccctattgccggagaaatctgccgatatcgcactggttcagggcaatattccccaagtcatcaaatggaatccctcagaactggaaaatacgctggacacctatctgaataatagccgtccttttattggtaaaatacccatcatcatctggccggaatctgccattactgcttacgaaatcactcaaggtaatttcctgaccgaactggattctttgctaagacagcgtaatacccgcctgattaccgggattcctgatgctcgtcccacattggaaggctataaattctataacagtattatcgtgttgggagataaaacaccttaccgatatccagcaccgatccgctatgataaacatcatctcgttccgttcggtgaatttgttccgctggagtcaatattgcgcccattggcccccttcttcaatttgccaatgtcttccttcaatcgtggtggttatatacagccacagctttctgtagcagggcataacataactgctgcaatctgctatgaaattattttgggcgaacaagtacgtgataatttaaagcccgatactgaatttttactgacaatttccaatgatgcctggtttgggcgctctattggcccgtggcaacatttccaaatggcacgaatgcgctctcttgaattgggacgcccattgcttagaggaacaaataacggtattactgcggttatcaggccagacggctcaatacaagccagacttccacagtttacccgtcaggtgttggaagctaaggttactccagctagtggtaacacaccttattttcgcgttggttattggccgatatggggattagcactgctgttcattagcttcggattgataagcaaccgccgccgaacttaa

SEQ ID NO: 1712 - DNA, 138 bp, Xenorhabdus bovienii
  Coding sequence Name=Xb4151_4152.C429.gene58.dna; Position on contig =30274..30411bp; Strand=-
gtgtatttggttaaatttgtggtaaatgtaatgaattattgcattttattggggttttctgtggagtgtattaggcatagagaagataagggtataaataatatacccttatcttctattgagggatctactgaatag

SEQ ID NO: 1713 - DNA, 99 bp, Xenorhabdus bovienii
  Coding sequence Name=Xb4151_4152.C429.gene59.dna; Position on contig =30461..30559bp; Strand=-
atgtttctgtttcgcgacctgcctcgcactataaataaacaattttacttatgtacgattaaagagaaaataattttggactctgttcacagtttgtaa

SEQ ID NO: 1714 - DNA, 1011 bp, Xenorhabdus bovienii
  Coding sequence Name=Xb4151_4152.C429.gene60.dna; Position on contig =30583..31593bp; Strand=+
atgaattacttttttacagcatataaacaaaaagattcaggaaatcgtttctacaaaaatgtaaacgccactatctgcaagcaaacccaatcttcaaagaataacccgataaaggagctgtatatgcgtaagttgatgttaaccatgatgttgcttagcgcggtaggagctgcccatgctgaggaattaactggaacactgaaaaaaatcaaagacaatgggattatcgttgttggacacagagaatcttctgttccattttcttattacgataatcaacaaaacgttgtcggctatgctcaagattattccaacctgattgttgatgccgtcaagaaaaagctggatatgcccaacctgcaagtcaaattaatcccgattacctcccaaaaccgtattccgttgctgcaaaacggcacttatgattttgaatgtggctctaccaccaataaccttgagcgccaaaaacaagctgcattctccaacactatctttgtcgtcggtacgcgtctgctgaccaataaggattcaggaataaaagggtttgacgatctggccgggaaacacgttgtcgttacgtctggtacaacatctgaaattctgctgaacaaactcaatgacgagaagcaaatgcagatgcgtataatcagtgccaaagaccacggtgattcattccgtactctggaatcaggccgtgctgtcgctttcatgatggatgacgcattgctggcgggcgaacgcgcaaaagcgaaaaaacctgatcagtgggttattgttggtaaaccacaatcagaagaggcttatggctgtatgctgcgcaaagatgatcctcagttcaagaaattgattgatggcacgattgtgaaagtacaaacctccggtgaagcagaaaaattctttgatctctggtttaaacaaccgattccacctaaaaaactgaatatgaacttctccatgtcagatgagatgaagaccttatttaaatcaccaaatgataaggctttaaattaa

SEQ ID NO: 1715 - DNA, 741 bp, Xenorhabdus bovienii
  Coding sequence Name=Xb4151_4152.C429.gene61.dna; Position on contig =31747..32487bp; Strand=+
atgtctgttgattggaattggggcatctttctacaagctgccccttttggtaataccacctatttggggtggcttatttctggatttcaggtgacggttgcactttccgtctgcgcttgggttattgcgctcgctgttggatcgttgttcggtatcctccgcaccgttccgaacaaatttctagcaacattaggcgcttgttatgttgagctattccgcaacattcctttgatcgtccagttttttatatggtatctggtggtaccagaattcctgcccaaaaatttgagtaattggttcaagatggaactggatcccaatattcaattttttatttcctcggtaatctgtctggggctattcactgccgcccgtatctgcgagcaggttcgagctgccatccagtcactgccacgggggcaaaaagccgcaggccaggccatgggcctgactctgccacaaacctaccgttatgtcctgctgccaaacgcctatcgtgtcattattcctccgatgacctcagagatgcttaatctggtgaaaaactctgctattgcctccaccatcggactggtggacatggcagcacaggcaggcaaattactcgattattcagcacatgcttatgaatcatttacggcgatcacgctagcttacgttggtatcaatctggtgatcatgcttgccatgactctgcttgagaaaaaagtgcgcttgccaggcaatcttggagggagatag

SEQ ID NO: 1716 - DNA, 723 bp, Xenorhabdus bovienii
  Coding sequence Name=Xb4151_4152.C429.gene62.dna; Position on contig =32444..33166bp; Strand=+
ttgagaaaaaagtgcgcttgccaggcaatcttggagggagatagaaaaatgtatcagtttgactggagttctattattcccagcttgccatttctgctgaatggattggtgataaccgccaaaattaccgtgatagccattatcattggcattgcttggggaaccttgctggcaatgatgcgcttatcttctatcaaaatactgagctggtttgctactctgtatgtcaacctctttcgctcagtgccactggtgatggtattgctgtggttctacttgattgtgccgaacttattacaaaatgttctaggcatatcaccaagaaccgatatccgtttaatttctgcaatggtcgcgttttcgctatttgaagcggcctactactccgaaatcattcgggcgggtattcagagtatttcccgggggcagtcatctgctgcgctggcgctgggtatgacccacatgcaaagtatgcgtctgattatcctgccacaggcattccgcgcaatgatcccattgttgttaacgcaaggcattgtattatttcaagatacatcgctagtatatgtactgagtctggccgattttttccgtacagcaacgaatataggtgagcgcgacggtactcagattgaaatgattctgtttgccggcgttgtttattttgtgattagttttgccgcttccatgctagttaactatttaaagaaaaggactgtttga

SEQ ID NO: 1717 - DNA, 726 bp, Xenorhabdus bovienii
  Coding sequence Name=Xb4151_4152.C429.gene63.dna; Position on contig =33166..33891bp; Strand=+
atgatttccctgaaaaatgtatccaagtggtatggccaatttcaggttctgactgactgctcgactgaagtcaaaaagggcgaagtagtcgtggtctgtggcccctctggctccggtaaatccacactaataaaaacggttaatggccttgaacctgtccagcagggtgaaattcgggtaaacaacacgccagtcaatgacaaaagcaccaatctggctcaattgcgttctaaggttggcatggtgttccagcattttgagctgtttccccatctgtcaatcattgagaacctgacactggctcagattaaggttttgaaacgcgataaaaaatccgccaccgaaaaggcgttgaaactcttggagcgagtcgggttgaccagtcatgctgataagttccccgcacaactttctggtggtcaacagcagcgtgtcgccattgcccgtgcactctgtatggatcccatcgccatgctgtttgatgaacccacatcagcgcttgatcctgaaatgatcaatgaagtactggatgtgatggttaagctggctaatgaaggcatgaccatgatggttgtgactcatgaaatgggatttgccaaaaaagtggctcatcgcgtcattttcatggatgaaggaaaaattgtcgaggacagcaaaaaagaagatttcttcgccaatcctaaatcagaacgtgcccgtgattttctggcgaaaattctacactga

SEQ ID NO: 1718 - DNA, 126 bp, Xenorhabdus bovienii
  Coding sequence Name=Xb4151_4152.C429.gene64.dna; Position on contig =33845..33970bp; Strand=-
gtgagatcgctgaaatttacctattttcggagcagattaaggtcggcggaagtcgtgttatccgccgacagggagaaaatcagtgtagaattttcgccagaaaatcacgggcacgttctgatttag

SEQ ID NO: 1719 - DNA, 120 bp, Xenorhabdus bovienii
  Coding sequence Name=Xb4151_4152.C429.gene65.dna; Position on contig =34027..34146bp; Strand=-
ttgccagtgaagctgtacttgtcgctctatgtcttctggacgatattgttcttgcatggcaccgataatcctatggtgagtaataaagctgcgcctgtaacgcgcatagtttgtttatga

SEQ ID NO: 1720 - DNA, 2583 bp, Xenorhabdus bovienii
  Coding sequence Name=Xb4151_4152.C429.gene66.dna; Position on contig =34090..36672bp; Strand=+
atgcaagaacaatatcgtccagaagacatagagcgacaagtacagcttcactggcaagagaagcaaacttttaaagtgacagaagacagtaacaaagaaaaatactattgcctgtccatgctaccttatccttctggccgactacatatgggccacgtccgtaactacaccattggtgatgtgatttcccgttatcagcgtatgcttggcaaaaacgtcctgcaacctattggttgggatgcattcggtctgccggcagaaggcgcagcggtcaaaaataataccgcacctgctccatggacctattccaatattgaatacatgaaagcccagctgaaaactctgggatttggttatgactgggatcgtgaagtcacaacctgtacgccagaatactaccgctgggaacaatggttcttcaccaaactgtacgagaaaggtctggtttataaaaaaacctctgccgtcaactggtgtccacatgacctgaccgttctggctaacgaacaggttattgacggctgttgctggcgctgtgatagccaagttgaacgcaaagagatccctcagtggtttatcaaaatcactgcctacgctgaagaactgctgaacgatttggataagctggaagattggccagagcaggtcaaaactatgcagcgtaactggattggtcgttcagaaggtgtcgaaatcacctttaatgtggctgacagtcaggaaacactgacggtttatacgactcgtccagatacatttatgggaacgacctatgtcgctgttgcggcaggtcatcctctggcaaaacaggcagcagaaaataatcctgagctggctgagttcatcaacgaatgccgtaataccaaagttgccgaagctgatatggccactatggagaaaaaaggtgtgtcaacaggcatgtttgcaattcatccattgaccaacgaaaaaattgctatctgggtcgctaactttgtcctgatggaatacggtacaggcgcagtgatggcagtcccagcccatgatcagcgcgactgggaatttgcaaccaagtacaacctgccaatgaaaaccgtcattctggacaacgacggcaatgtgccaaccgttcaggaaggtgcagctaccgataaaaacgcactggttaattccggtgagttcagtggactgagcaatgaagaaggcttcagtgctatcgcagataaactggtcgagatgggggctggcaaccgtaaggttaactatcgtcttcgtgactggggcgtttcccgtcaacgttattggggggcgccaattccaatggcaacactggaagatggcactgtcgtccctgttccagaagatcaactgccagttatcctgccagaagatgttgtgatgaatggtatcaccagcccaatcaaagcagatcctgagtgggccaaaacgactatcaatggtcaaccagcgctgcgtgaaaccgatactttcgatactttcatggagtcatcatggtactacgcacgctatacctgcccagattatgacaaaggtatgctcgatccggccgctgctaactattggctgccagtggatcaatacatcggtggtattgaacacgccatcatgcacttgatgtacttccgtttcttccacaagctgatgcgtgattctgggatggtcaattctgacgaaccagccaaacacctgctgtgccaaggtatggttctggcagatgcgttctattacaccggcaacagcggcgaaaaaatctgggtatccccagctaacgcgattgttgagcgtgatgataaaggccgcatcgtgaagtcggtggatcaagacggtcatgagctggtctatactggcatgagcaaaatgtctaaatccaagaataacggtatcgatccacaaattatggtcgataaatacggcgctgataccgttcgcttgttcatgatgtttgctgcgccaccagagctgacactggaatggcaggagtctggcgtagaaggcgctaaccgcttcctgaaacgtgtctggcgtctggtttatgagcacagcagcaaaggtacaacccagccgctggatatcgccagcctgacgactgaacagaaagatttgcgtcgtgacttacataaaacccttgcgaaagtcaccgatgatatcggacgtcgtcaagcattcaataccgccgttgcagctatcatggagctgatgaacaaactgactcgtgtcccacaggaaaccgagcaagatcgcgctttaatgcaggaagcactgactgcggttgtacgtatgctttcccctatcacgccacacgcttgtttcgtgatgtggaaagaacttggtaatgaaagcgatattgacacggctgcatggccacaggctgatgagcaggcaatggtggatgataccaagctggtcatcatccagattaacggtaaggttcgtggtcgtattaccgtacccgcagatgtgacaaaagagtatgttcaagagatggcggcaaaagagtacagcgttgcgaaataccttgaaagcatcagtattcgtaaagtcatctatgttccaggcaaattgctgaatctggtcgtcggctga

SEQ ID NO: 1721 - DNA, 561 bp, Xenorhabdus bovienii
  Coding sequence Name=Xb4151_4152.C429.gene67.dna; Position on contig =36690..37250bp; Strand=+
ttggtaggaaataatgtgcggcatggtattttcacgttgtttctggggttagcggtgctggtcaccgctggctgtggttttcatcttcgtggcacaacacaggtaccaaaagaacttcaaacattacaattaagttcagctgatccctacgggcctctggccagagcagtacgccagcaacttcgtctgaacgacgtcaagattgttgaacgtggcgatgcctcagtaccgatcctgaaactcttgggctctaatgagcacaaagagaccgcttctgtatttcaggatggtaaagcggcggaacgtcaactagtcctgtatgttgatgctcaagtgcttatgccgaatggcggtatctatccattgcgggcaagagttgatcgttctttcttcgataacccgctggaagcactggcaaaggatgcggaaaatgaactgattcagcaggaaatgcgtgagcaagcagcccaccagcttatgcgccagttgctaactgttcacagtgcagaactcttgaaaactgaagaaaaacagcaagcagcgactgcacaaaaacaatga

SEQ ID NO: 1722 - DNA, 1041 bp, Xenorhabdus bovienii
  Coding sequence Name=Xb4151_4152.C429.gene68.dna; Position on contig =37247..38287bp; Strand=+
atgatccgactctatcctgaacaactcctttcgcagctcaatgaagggctgcgaaacaattacctgctatggggcaacgagccgttgctgttgcaggaaagtcaggacagcatccgcagagtggctgaacagcatggctttctggagcatttcaccttttctctggataaccatactgaatgggatgaaatattcagcctgtgccagtcactcagcctgttttcctctcgccagtcacttaccctgctactgccggaaaatggcccaaatgcagcaatggtagaacggctaaccaagctgtctggattgctgcacgcagatatcttattgatattacgtgggcacaaactcaccaaagcgcaggaaaacagtccgtggttcaaaacacttgggcagaatggtgtgtacgtcagttgtctgactcctgaacaaaaccgtcttcctcaatgggtggcacaacgagccagaagcatggggctatcactggaagatgaagctaaccaactactgtgctattgctatgaaggaaatttattagcactggctcaggcactggaacgtctttctctgctccatcccgataatcggctgacgcttccccgagtcgaagaagctgtcaacgatgcggcacattttgccccctatcactgggttgatgccctgctggcaggcaaaatcaaacgggcgtggcatatactgaaacaacttcgacaagaagatactgaatcgatcatcctgcttcgcaccatacaacgggagctgatactgctgttaaccctcaaacgtcaggataagacaactcctttgaagacactgtttgatcagcacaaaatttggcaaaaccggcgatcactgctgacagccgcattacagcgcttgtcacagcaagatcttcaatcagccatacatttgctgactcagatggaactgtgcgtcaaacaggattatggccaatcgatttgggctaacctggaaacactttccatgctgttatgcggaaaaacattaccagagagcttcttgaatgcttcattccactga

SEQ ID NO: 1723 - DNA, 681 bp, Xenorhabdus bovienii
  Coding sequence Name=Xb4151_4152.C429.gene69.dna; Position on contig =38271..38951bp; Strand=+
atgcttcattccactgattcaacaatagacccgagttccccgattattcaggcgctgtttggtggcacattcgatcccattcattatggtcacttgcgccctgtggaggcattagcgaaacaggtggggctaaaacaggtcattttactgccaaaccatgttccgccacatcgtccacaacctgaagcaaccgccagtcaacggttggagatggttcgtctggccgtacaggacaacccgctttttaccgtcgatacccgtgaactggaacgtcagacgccctcttatacgatagaaacgctgaaatcctttcgtcaagaagtcggcgaacaacggccactggcattcatcatcggacaggattcactgcaatccatccatacatggtataaatgggaagaattactgggtatctgccaccttctggtctgctcacgtccgggttatcaaagccaactttcaacctcagatatgcaaaagtggcttgaacagcacaaaattgacactccgatatcattaagacaaaagccacacggttgtatttatctggccactactccgttattaaacatctctgcaactgatatccgtcaacgccatcagcaagggctgagctgtgatgatttactgcctccagcgatacaaaattatgtcaattcacaggggctatatcgacaataa

SEQ ID NO: 1724 - DNA, 405 bp, Xenorhabdus bovienii
  Coding sequence Name=Xb4151_4152.C429.gene70.dna; Position on contig =38969..39373bp; Strand=+
ttgccgctgagtcgcttacttttacagagattggcatgctattattctgcattattcaaccaatttgatgaaattaaggtgatccttttgcaaggcacagaactacaaaaatttgttattgataaacttgaagattccaaagcacaggatattgtttctatagatgttcgtggaaaatccagtattaccgactgcatggttatctgcacaggcacatcaacccgtcacctgatgtcagtggcagacaatctggttgatgactgccgcgaagccggaattatgccactgggtgttgaagggcaaggcatctcagactggatagtcgttgacctcggcgaaataatgatacatgtcatgcaggaagacagccgtcgcatgtatgaactggaaaaactctggagttga

SEQ ID NO: 1725 - DNA, 438 bp, Xenorhabdus bovienii
  Coding sequence Name=Xb4151_4152.C429.gene71.dna; Position on contig =39409..39846bp; Strand=+
atgccggactgggttcagaccggctttatcgattatttgcatcgttttcccaaggatatgccttttgagctgattgaagtcccagcaggaaaacgaggtaaaaatgccgacatcaaacgtattcttgaaaaagaaggcgaacaaatgctgtcggctgtcggcaaaggcaatcgcattgtgacactggatattcccggatctcattgggataccccacagttagcacaacagctagaacgctggaaacaagacggcagaaatgtcagtttgcttattggtggcccagaaggtctggctccggcctgcaaagctgccgcagcgcaaagttggtcactttctccactgacgctgccacaccctctggtacgggttctggttgctgaaagcctttatcgggcgtggagtatcacgactaatcacccctaccatcgggaataa

SEQ ID NO: 1726 - DNA, 1914 bp, Xenorhabdus bovienii
  Coding sequence Name=Xb4151_4152.C429.gene72.dna; Position on contig =39865..41778bp; Strand=+
gtgaattctggcaatgggatgaagaataaacgaaccccttttcgcgatcatacggctgaatcagccctttttatgcgccgcgcactcgtggcgttcattggcattatcattttaacgggaattctgattgccaatctttataatctccagatcattcgccacgaagattaccagacccgctcaaatgggaaccgcattaagctcgttcccattgctccaagtcggggtatcatttatgatcgtaatggaacaccattagccactaaccgcactatttaccaattagaaatcattccacagaaaatcgataatcttgacaaaacgctggatgaattgcgcgccatagttgatctgaccgatgaagatatagaaaacttcaagaaagaacgtcaacgcgcacgtcgttttacctccgttcctttgaaaacatccctgaaccaagtacaggttgcccggttttacgtcaaccaatatcgttttccaggactggaaatcaaaggctatcagcgtcgcgagtatccttttggttctgctctcacccacgtgattggttatgtcgccaaaatcaatgataaggacgtagaaagacttgagaaagagggtattctcgctgactatgcagctacccatgatatcggtaagctgggcattgagcgctattatgaatcaactctgcacggcaaacccggctatgaagaagttgaagtcaacaaccgtggcagagtgatccgacagttacatgaacaacccccacaggcaggtaaagatgtttacctgtcgatagatttgagtctgcaaaactatattgaacaaatcctgacaaccagccgggctgctgtcgtggtcactgatcctcgtactggtgaagtgttggcaatggtatcgaacccaagctatgaccccaacctgtttgtggatgggatttccagtaaggattataaaaatctgctcaacgatcctaaccgtccgctaattaaccgcgcaacccaaggggcttacccaccggcatcaacggtcaaaccttttattgcctctgcggcactgagtagcgatatcatcacaaagaataccacgatattcgatcccggctggtggcagctacccggttcagaaaaacgttatcgtgactggaaacgctggggacacggtaagctgaatgtgcataaagctatcgttgaatcgtcagatacttttttctatcaagtagcctatgatatgggtatcgaccggctttccgaatggatgtcaaggtttggttatggtcaatttacgggtattgatttgagggaggaaactcccggcaacattccaacccgagaatggaaagtgaaacgctataaaaaaccgtggtatcaaggtgacaccatttcggtcggcatcggtcagggatactggacagccacccctatgcaaatggtgaaggctctgatgacattaatcaatgatggggaagtaaaaacgccacatttcttgctggggactcgcgtgaatggcgaaatgcatccttaccaacctcctgtaaatcattcgattggtgatatccattcaggctactgggaaattgccaaagatggcatgtacggtgttgccaatgccccaaacggcaccgcacgcaggttctttgccggtacaccatacaaagcagccgtaaaatcaggtaccgcacaagtattcagctatgaaacctataatgcaagcaaactggcagaacatctgcgtgaccacaaactaatgatagccttcgcgccctatgacagcccaacagttgccatttctattattctggaaaacggcggctcaggacctgcggttggaacgataatccgtcaaatcctggatcatattttaatcaaggatagcaagcgcatcactcccgttgcagctccggccgtaaccggaacacaagctaattga

SEQ ID NO: 1727 - DNA, 1113 bp, Xenorhabdus bovienii
  Coding sequence Name=Xb4151_4152.C429.gene73.dna; Position on contig =41787..42899bp; Strand=+
atgacagactctcagaaaaaggttcctttctggaccagagtacatatcgatatcccactgctgctgtgcattctagcattgctagtctacagccttttcattatgtggagcgccagcggacaagacgttgacatgatggaacgtaaagccgggcaagttatcatggggctgatagtcatgatcgtcttggctcaagtcccgccacgcatatacgagaactgggcaccttatctttatattggatgcgtgttcctgctaatccttgttgatgtttttgggcaaataagtaagggtgcgcaacgttggctggatctgggcattgtgcgcttccagccatcggaaattgctaaaattgccgttcctttgatggttgcccgtttcatgaaccgtgatctttgccctccctcgttgaaaaatacggggattgcactgattctgacattcttgcctaccctactagtcgccgcacagccagacttgggaacttctatcctgattgccgcctctggtgtattcattctgtttctggcaggaatgaactggcggttaatcaccattgccattttactgattgcctgttttcttccaatattgtggttctttttaatgcatgactaccaacgtgccagagtcatgatgctgctggatcctgaaagtgatccgctgggtaagggctatcacatcatccagtccaaaatcgccattggctcaggaggggaatttggcaaaggctggttgcaaggaacacagtcgcaattggaatttctacctgagcgccatacggatttcattttcgctgttctctctgaagagctggggctggtgggtgttcttgtcttgctggctctctatctgctgctcatcatgcggggtttggttattgccgccagagcacaaaatacttttgggcgggtgatggcgggtggtttaatactaattctatttgtctatgtcttcgtaaacatcggcatggtgagcggtatcctgcctgtagtcggcgttcccctaccgctgattagctatggcggctcggcattaattgtcttaatggcaggattcggcattattatgtcaatacatacgcatcgcaagttattgtccaaaagcttataa

SEQ ID NO: 1728 - DNA, 1044 bp, Xenorhabdus bovienii
  Coding sequence Name=Xb4151_4152.C429.gene74.dna; Position on contig =42912..43955bp; Strand=+
atgcgtcaacaatggcttatactcggcatcgtggctgtactgatatcaggctgtacaacaacaggtaataaaagggaggactcctccattcctcctgttccaacccgtgaggtattgggtgcagaacctcaatatgagccttatcatccaagtgccaaccaagactatcaaagggatgggcaaacctatcgcatcgtgcaggactcagctaacttcacccagacgggttatgccagtgggttcggtgaagaagcgaatggaaaactgacagcaattggtgaacgggctagtccttatgctttagcggctgcgcaccccacattacctattccaagctatgtgcgggtcactaatttgagcaacgggcgcatgataattgtcagaattaatgaccgtggcccttacaataagccgggcaaaatcattgaattatcgcgggcaacgacggaacgcctgaacctgatgccacaaagcagagtcaaactggatggaattcaagttgcacctgatggatcaatttctggcttggggacagaaggcgcgattatcgtcaaacaaagttatgctttacctgacagacccgatattggcgcaccagctatgatggacagcccatctgaacaaaatatcgcagagcaaaatacggtgagccaacctgctgttgagcagaatctgtctgggaatacagaaaatccgtttctcacttcaccgtccgcaggaacaccatctgcaccaaagcaatcagagacaaaatggatattgcagccacagactgaacctgttgcgacttcccccgttatacctgaatctgccgccacatcaacgggcggtttcatggtacaagttggtgccatcagttctgaacagaaagccaaagagtggcaacaatcattaagccagcgctttaatgtacagggccgtgttatgcaatttagtaatatctatcgcgttcaactggggcctctcagtcgccagcaagcaacggaactacaaaagaaattaactgaccagatgcatcaatcctcctttattgttgccccctga

SEQ ID NO: 1729 - DNA, 114 bp, Xenorhabdus bovienii
  Coding sequence Name=Xb4151_4152.C429.gene75.dna; Position on contig =44056..44169bp; Strand=+
ttgtttaatgtcagcttttttatcatttgttattatgtcgcttattatcaatccctttctcacggatgctacctaatcaatcatgaaatacatagttacttcccgttttattaa

SEQ ID NO: 1730 - DNA, 1209 bp, Xenorhabdus bovienii
  Coding sequence Name=Xb4151_4152.C429.gene76.dna; Position on contig =44138..45346bp; Strand=+
atgaaatacatagttacttcccgttttattaaaaatgccactttaggcatcgctctggctaccagcgcttctgcattcgctaacacggatgataatttcaaaaccatgatccccggcgttccacaaaccgatgcagaagcctatattctgattgattacaactcaggtaagatattggcagaaaagaattcagatatccgacgtgatcccgccagtctgacgaagatgatgaccagctatgtgattggtcaagccatcaaatcagggaaaatcggtccgaatgacaccgttaccgtcggtaaggatgcttgggcaacgggcaatccggtgtttaaaggctcctcactgatgtttttgaaacccggtgatcaggtttctgttgccatgctatcccgtggtatcaacctgcaatccggtaatgatgcctgtgtcgcaatggctgactatgtcgcaggcagtcaagatgcgttcgtcaacctgatgaataagtatgtgcagaatctagggttgcaaaacacacactttgagactgtccatggcctagatgcagcaggccaatacagttctgcccatgatatggcactgattggtcaggctctgatccgtgatgtaccggatgagtatgccatctacaaagagaaagaatttacttacaacaatatccatcaacccaaccgtaacgggctgctatgggataaaagcctgaatgtggatggcatcaaaaccggccacaccagtggcgccggttacaaccttgtttcttccgccaccgaaagtaatatgcgcctaatttctgttgtcatgggcagcccaacattcaaagggcgtgaaaccgacagcaaaaaactactgacttggggattccgcttctttgaaacggtctcaccattgcaggtaggtaaagaatttgcctcagagccagtctggtttggtgatgctgataaggtacaattgggcgtcgataaaaatgtttatctgactattcctcgtggccgcctgaaagatctgaaagccagctacgtattgaacaataccgaattacatgccccactcgccaaagatcaagtcgtcggtactatcaacttccagcttgatggtaaaaccattgaacaacgtccattggtcgtgatgcaggaaatcaaagaagggggtttcttcagccgtatgatcgattacatcaaattgatgttccatcattggtttggttga

SEQ ID NO: 1731 - DNA, 108 bp, Xenorhabdus bovienii
  Coding sequence Name=Xb4151_4152.C429.gene77.dna; Position on contig =45391..45498bp; Strand=-
atgagcaggggaactcaagcagttcatttaattttgttttcatgggcactcctagtttacttgccacggcaatgtggtagtttttgccgtggcgtgattattttctaa

SEQ ID NO: 1732 - DNA, 264 bp, Xenorhabdus bovienii
  Coding sequence Name=Xb4151_4152.C429.gene78.dna; Position on contig =45456..45719bp; Strand=+
atgaaaacaaaattaaatgaactgcttgagttcccctgctcattcacttacaaagtgatgggtttagctcaacctgagctggtggatcaagttattgaagtggttcagcgccatgcgccgggcgattactccccagtggtgaaaccaagcagcaaaggcaattaccactcggtttccatcaccatcaatgccacacatattgagcaggttgaaacgctgtatgaagagttgggtaatttggagctggtgcgagtggttctgtga

SEQ ID NO: 1733 - DNA, 120 bp, Xenorhabdus bovienii
  Coding sequence Name=Xb4151_4152.C429.gene79.dna; Position on contig =45817..45936bp; Strand=-
ttgatcatattgattcaaactatcaaagaaactgcatcagtatttgcttcagggacgtcatttagatcgttcattaatcaatttcatggcgtattggtcgaaatcttcatccgaggatga

SEQ ID NO: 1734 - DNA, 93 bp, Xenorhabdus bovienii
  Coding sequence Name=Xb4151_4152.C429.gene80.dna; Position on contig =45929..46021bp; Strand=+
atgatcaactatatatcaaacacaacccgctcgtgtttactgccacctcaaaaacgccagaatgccttcgaacagaggatcaggatcggataa

SEQ ID NO: 1735 - DNA, 1461 bp, Xenorhabdus bovienii
  Coding sequence Name=Xb4151_4152.C429.gene81.dna; Position on contig =45976..47436bp; Strand=-
atggtcagaaaaaaccaactcctgattgtggggcatctttgtagttttctggtgctcctttacagcctctctatgttgctgcctatttttgttgcactattttataaagaaaaaagtgtgtttgccttttttgatacgttgctcattggattgagtatcggaagcgttggttggtattttacccgcaaaaccaaagcacaacccagtacccaagatggatttcttattatcgtgctgttctggctgctcttttcgctgctcagtgctttgccttttgtccttgataaaagcctgaatatcaaccttgtggatgcggtgtttgaaggtgtgtcgggtattacaacgacaggagcaacggtactgaatgatgtgtctgcattacccaagtctatgctctattatcgtgcacagcttaattttattggtggattgggagttatcgtactggctgttgcgattctgccattgctcggtattggtggggtaaaactctatcaatcagaaatgcctggcccctttaaagaagagcgcctgacccctcgccttgccgatagtgctaaaagtttatggctggtttatctgctgttgggcgctttatgttcggtgagttttaaagtagcgggaatgtcgtggtttgatgccgtttgtcatggaatttcgaccgtttctttaggtggattttcgacccgcaatgaaagccttggttattatgacagtgccgctattgaaatggtggggggtattttctcggtattggcggcagtcaactttacgctctattttgttgcactgacacgcagaagcctaaaaccactattgaaaaatgccgaactgaaattttttctgctggtactggcggcggtagtttgcattatctggctggagttatatcgctcgggtatgtatggtgtgaaggaagctttcgttcatggttttttcatgaccagttccatgatgaccgataatggtctggcgacttcagattatgcccaatggccctctcacacgatattgatgctattggcagtcagtttctttgggggctgtgtgggatcgacgtgtggcggtattaaggcactccgtttcctgattctggcaaagcagagtatcagcgaaattaatcaacttgttcatccgaatgccatttcaacgattaaagttggccagtcttcggttcatgaaagggtattgcgctccgtctggggttttttctttttgtatgtttttttcagttgtttttttatctgggcattgaatttgttgggttatgatttagtaacctcgtttgctaccgttgcggcctgtatcaataatatgggagtcggttatggcgcaaccgcgcaaggttttggtgatcttgatgctatcgcgaaatggatgatgtgtgcggccatgttattggggcgtcttgaaatttatccgatcctgatcctctgttcgaaggcattctggcgtttttga

SEQ ID NO: 1736 - DNA, 201 bp, Xenorhabdus bovienii
  Coding sequence Name=Xb4151_4152.C429.gene82.dna; Position on contig =47401..47601bp; Strand=+
atgccccacaatcaggagttggttttttctgaccatctgttagctcaaacagagattaaaggagaaatcatcgaaatatataaccatcataatataaaatttaaatatattcgtctaattaacaatattagtgcattaaagcattctcaaactggtgggaatccttttagggcgttatactggcggataattttttgttaa

SEQ ID NO: 1737 - DNA, 651 bp, Xenorhabdus bovienii
  Coding sequence Name=Xb4151_4152.C429.gene83.dna; Position on contig =47605..48255bp; Strand=+
atgatgaagtttccattgcaacataacaccgttattttacgccagttgggtatccagccttacgaaccagtttctgatgctatgcaccagtttactgagcaacgtactgcggaaacatctgatgaaatctggctcgtccagcacgaaaaagtgtttacgcaaggtcaggcaggtaaagccgagcatgtgcttacgccaggtgagattcccgttattcaatccgacaggggcggccaagtaacctatcatggtcctgggcaacagatcatgtatgtcttagtcgatttaaagcgggcaaaaattggtgtgcgtcagttggtgacggcaatcgagaatgccgtaatcgaaaccttggctcattttggtgtagaagcgcatgcccgtccagatgctccgggtgtctatgtccagaacaacaaaatatgttcacttgggctgcgtatccgtaaaggatgctctttccacggtctggcactgaatattgcaatggacttacagccatttttacgcattaacccatgtggttatgcgggaatgcagatgactcaactcagtgacctcgcagcagaggtcactgttgaagatgtacaacctgttctggtggaaaaattctgccggatcttgggatttcaactaatcaatgaaagatga

SEQ ID NO: 1738 - DNA, 966 bp, Xenorhabdus bovienii
  Coding sequence Name=Xb4151_4152.C429.gene84.dna; Position on contig =48373..49338bp; Strand=+
atgagtaaaccaattcagatggaacgcggtgttaaatatcgcgacgcagataaaatggctctgatccctgtaaaaacagtggccacagaacgtgaagcactcttgcgtaaacctgagtggatgaaaatcaaacttcctgcggattccagccgcattcagggcatcaaagctgcaatgcgcaaaaatggcttgcattccgtctgtgaagaagcctcctgccctaatctggccgagtgctttaaccacggaacagccacctttatgatccttggtgcgatttgtacccgtcgctgcccattctgtgacgtggcacatggccgcccgactgcaccagataccaatgaacccactaagctcgcgcaaaccattcaagatatggctctgcgttatgtcgtgatcacctctgttgaccgtgatgatctgcgtgatggcggcgcacagcatttcgccgactgtatctctgccattcgcgaaaaaaatccatcaattaagatcgaaacactagtacctgatttccgtggacgtatggatcgtgcgctggaaattctgacagccacaccacctgatgtatttaaccacaatctggaaaacgtaccacgggtatatcgtcaggttcgcccgggtgctaactacgagtggtcgttgaagctactggaaaaattcaaggaaactcatccaaatatcccaaccaagtcaggtttgatggtgggattgggcgagaccaacgaagaaattttagaagtgatgcgtgatttacgtcgtcatggcgtcaccatgctgacattaggccaatacttacagccgagtcgccatcacctgcctgtccagcgttatgtcagccctgctgaatttgacgagatgaaagaagcagcactggagatgggctttacccacgctgcctgtggtccatttgtccgctcctcttaccatgctgatatgcaggccaaaggcatggaagtcaaataa

SEQ ID NO: 1739 - DNA, 282 bp, Xenorhabdus bovienii
  Coding sequence Name=Xb4151_4152.C429.gene85.dna; Position on contig =49274..49555bp; Strand=+
gtggtccatttgtccgctcctcttaccatgctgatatgcaggccaaaggcatggaagtcaaataacctacctaccgtcaccatcatgataaatattatttttgctgtatttataggtggtggcttgggcagtgtattacgctggttaattagtctccgcctgaataatgcctctactcctcttgccgttggtacgctgacggctaactgcgttggggcatttatcattgggttgggactggcttattttaataaggccacacatcttgatccagtttggtaa

SEQ ID NO: 1740 - DNA, 249 bp, Xenorhabdus bovienii
  Coding sequence Name=Xb4151_4152.C429.gene86.dna; Position on contig =49593..49841bp; Strand=-
atgaatccaaaggattcggttttatcactccagaagatggtagcaaagatgttttcgtacacttttccgccattcagtctaatggtttcaaaactttggctgaaggtcaaagagtcgagtttgaaatcactgagggtgcgaaaggtccatctgctgcaaacgttgtcccaatctaatttctatccccgtattttgaaaacccgtttattacaacgggttttttatgtttttaagttcaacttgatttag

SEQ ID NO: 1741 - DNA, 102 bp, Xenorhabdus bovienii
  Coding sequence Name=Xb4151_4152.C429.gene87.dna; Position on contig =49796..49897bp; Strand=+
ttgctaccatcttctggagtgataaaaccgaatcctttggattcattaaaccacttaacgttacctttaatttttgacatcaaacttacctttaataaataa

SEQ ID NO: 1742 - DNA, 486 bp, Xenorhabdus bovienii
  Coding sequence Name=Xb4151_4152.C429.gene88.dna; Position on contig =50061..50546bp; Strand=-
atgtatcatcattacctgaatactccagaaggctttcctaagccttatgtacatatcactgcagatgatgaaggagtcactagcatctactttgttaatgaaaagaaagaattagaatctaaaaacacgattactaagcagtgtgtaaaagagttacaggaatatttcaaaggaaaacgacatacattcacggttcctttgagcatgaagggaacagaattccagaagcgagtctggcagcagctctgcaacatcccttttggcgacatgtggagttataaacaattggcattgactttgggatccgttaattattgccgtgctgtaggaatggcaaactcacgtaatcccatttccctgattgtaccttgccatcgagtgattgggcatgatggtaagttagtcggctatactggtgggctggatatcaaaggatggctgctggaacatgaaaagaataaaaaaattaaagctaaacagagttga

SEQ ID NO: 1743 - DNA, 219 bp, Xenorhabdus bovienii
  Coding sequence Name=Xb4151_4152.C429.gene89.dna; Position on contig =50759..50977bp; Strand=+
gtgtcttttataaaaaaagacaacgtatattgtatttatttcataaatagattatccgaatataatacaaagatgttagtttttattattagctacagcgatactcagaaagtaattttaccagaagcgttatcatttatggcaaacacagttgtgttcggtacaattttgtctgcctcctctacaacgcaagatctgtctgatgagatatttaagtaa

SEQ ID NO: 1744 - DNA, 174 bp, Xenorhabdus bovienii
  Coding sequence Name=Xb4151_4152.C429.gene90.dna; Position on contig =51053..51226bp; Strand=+
gtggctagagtaagtgaaagctgtcataataaattaaaatatcttatttattccaatatttttattgccagtgaaatcaaaatacagattaattcaaatttcctgcaatatttcaaaaatcgacacatcaaaaaaaataaaaaacaattatataacagatatatatatcactaa

SEQ ID NO: 1745 - DNA, 141 bp, Xenorhabdus bovienii
  Coding sequence Name=Xb4151_4152.C429.gene91.dna; Position on contig =51285..51425bp; Strand=-
atgatatattttctttattactccgaatcatttttttcacatatctaccctagcacactgaaatatgttgacaaccccttgtttagaattattaatcaaatagacatttattatggcgtaatgtttgtgactgcaatttga

SEQ ID NO: 1746 - DNA, 1203 bp, Xenorhabdus bovienii
  Coding sequence Name=Xb4151_4152.C429.gene92.dna; Position on contig =51450..52652bp; Strand=+
atgacaattaaactcgaagttagaaatctatataaaatattcggagatcatccagaacccgcatttaagttattagaatccggttttaacaaggaacagatttttgaaaaaaccggtctggcgattggagtgcaaaatgccaatctggccattgaagaaggcgaagtatttgtcatcatggggttatccggttcaggtaaatctacgctggtacgccttctcaatcgtctgatagaacccaccagaggtcaggttatcattgatggaaaagatattgctgctatttcagacacccaactgagggaggttcgccgcagtaaaatcagtatggttttccagtcatttgcactcatgccccatttaaatgttctggaaaataccgcgtttgggatggaacttgccggtattcccaaaaaagagcgtcactacaaggcacttgaaaccttgaaacaagtgaatctggaaaactatgctctgtcatatcccgatgagctttccggcggtatgcaacagcgtatcgggttagctagagcattagccaatgatcccgatattctgttgatggatgaagccttctctgctctcgatcctctgatccgcaccgaaatgcaggacgaagtactacgtctgcagggcgagcaccagcgcacgattatctttatttcccatgacttggatgaagcaatgcgcattggtgatcgcattgcgatcatgcaggggggcatcattgtacaagtgggtacacctgatgagatcctgaataatcctgccaatgattacgtcaaaacgttcttccgaggtgtagatattagccatgtattctcagcaaaagatgttgctcgtcgtcggcatgaagctctgctccatatagccacaggttttggccctcgctcggctctgaaagttctggatgatgaagacaggaattatggatatctgatcgaaaaaggccaaaaatttattggcgtggtttcggtctgctctttacaaaaagcgctgacagaaaagcaaccgattgaatatgccacgttgaaagaacccgccgccgtctcggctgatatgccgctgcatgaattgatatctatcgtggcgcaatccccctgtgctgttcctgttgtgggtgataatgaccgttatttaggtgtcatttccaaagggatcctgttacaggctttagataaggaaacaccgaatgagcagtaa

SEQ ID NO: 1747 - DNA, 1095 bp, Xenorhabdus bovienii
  Coding sequence Name=Xb4151_4152.C429.gene93.dna; Position on contig =52642..53736bp; Strand=+
atgagcagtaaaaccctacagacagcatctgatcaggcaaccttcagtgatccttggatcaatagtgccacagtcgatccatcatcaaataatgattggctggatacttccgcaactgagatttcatcagaacacttcaatattatggcgccttttcagcataaattgattccgtttgattcatgggtaacccacgctattgactggctcgtcctgcatttccggcctatttttcagggtgtacgtattccggtggattttatcttaactgggtttgaacagtttctgatttccatgcctgctcccgtgactattctgattttcgcactgcttgcgtggcagcttacaggagcgggaatgggggtcacttccttcatttcactgatcctgatcggtgctattggtgcatggtctgaagccatgataacactggcactggtgctcacggctctgctgttctgcattctcattggcttaccgctcgctatctggctagcacacaatgaacgggttgcccgaattgtccgccccttgctggatgcaatgcagacaacgccagcttttgtctatctcgttcctattgtgatgttgttcggcatcggtaatgtgcctggggtcatggtcacgatcatttttgccttgccgcccattgttcgcctgacaattttagggatcaaacaagttccggcagatctcatcgaggcagcccaatcctttggtgcaagtccacgccaaatgttgttcaaagttcagcttccccttgctatgcctacaattatggccggcgtgaatcagacattgatgttggcactctccatggtcgtcattgcctccatgatagccgttggtggtttggggcagatggtattgcgcggaattggccgtcttgatatagggctggcagccgttgggggcgcaggaattgttattcttgccattatccttgatcgcctgacccaatctctagggaaaaacaaccgtgccagaggaggactttggtatcactcggggccgatagggctgttcatcacactttttgcccgaaaatgggcacaaaagtcctcctgtgacaataacactcaaaccgataaataa

SEQ ID NO: 1748 - DNA, 1035 bp, Xenorhabdus bovienii
  Coding sequence Name=Xb4151_4152.C429.gene94.dna; Position on contig =53751..54785bp; Strand=+
atgcgtatcataactcggtgtaaaaaaatcatgaataagaatacgatcttgggattagccctgtcatcattagtgagcataccgctatttgcctctgaactgcccggtcagggcatcagtgtacaaccgcttcaaagcaccatcagcgaagaaactttccagacattaattgtctgcaaggtattggaaaaactcggctatgacatcaaacccatcaaagaagtcgattataatgttgcctatgcttccattgccgctggtgacgccacattcatggccgttaattgggttccccttcataactcgcaatacaaagccgcaggtggtgataaaaaactctatcgcaaaggaacatatgttgaaaatgctgttcaaggttatttgattgataaaaaaacggcagaaaaatatcgcatcaccaatatcgcacaactgcaagatccccaacttgctaagttgtttgacagcaatggagatggtaaggcagatttaaccggttgtaaccccggttggggatgcgaaaaggcaattaacagccaactaaaagcctatggattggagaataccgtcgaacataatcaagggaactatgctgctatgatggctgatacaatcgctcgctatcgagaaagcaaacctatcttctattacacgtggacaccttactgggtcagtgatgtactgaaactagatacggatgtgatatggctacaggttcccttctctgcgctcaatgatgacgaagtggttgatacccaattgccaaatggccgcaactatggttttcctcccagtactatgcatattgtggcaaacaagatctgggcagagaaaaacccggcggctgcaatgctttttgctgttataaaattgccagttgctgatatcaacgcgcaaaatctgcgcatgcacagagataaagtttctgaaatcgatattgagcaccatgctgaaggttggctcagagcacaccagacaatcgttgatgaatggcttgaggctgccagaaaagcgactgaccaaaaaacaagctaa

SEQ ID NO: 1749 - DNA, 120 bp, Xenorhabdus bovienii
  Coding sequence Name=Xb4151_4152.C429.gene95.dna; Position on contig =54736..54855bp; Strand=+
atgaatggcttgaggctgccagaaaagcgactgaccaaaaaacaagctaatcctgaactcttaaaaaatagttgtaaattcattaacaaaaatttatggcttttatctccatactgctaa

SEQ ID NO: 1750 - DNA, 123 bp, Xenorhabdus bovienii
  Coding sequence Name=Xb4151_4152.C429.gene96.dna; Position on contig =54838..54960bp; Strand=-
ttgttaataggtgaaacaacattaacaaaatatggtgaaagtgaaaatataaaatatataaattatttaattaatattattaagtcccgtgtttttgataggtttttagcagtatggagataa

SEQ ID NO: 1751 - DNA, 831 bp, Xenorhabdus bovienii
  Coding sequence Name=Xb4151_4152.C429.gene97.dna; Position on contig =54939..55769bp; Strand=+
atgttgtttcacctattaacaaaaaaactagtcagttccatgccaatacctgataaacctgtgcccgatatcccaaaatctggtgcatcgatacctgagcctcccattccgaacaaaatttcttcgttctcagaaggcattattgatagcttacccattgccattggctatattcccatcgccttcgcatttggcctgagtgccgtgaagctgggctttgctcccctcgaagccatatttttttcatgtgtcatttatgcaggggcaagccaatttgtcatcaccgctttgcttagtgcaggtatgtctttgtgggtttctgctttgaccgtcctggcgatggatatccgccatattctatatggcccagctctgcgttatcgcatcaaacaaaaattatcagaaaagaaaactgcgatctgggcttttggtctgactgatgaggtttttgccgcagcgaccgctaaattgattaaagaccagcgtagctggagtgaaaactggatggtcgcgatcgctgtgtgttcatggctatcttgggtactcggaaccgtagcaggctccctactgggaaatggttatctggactcatatccagccgttgaagccgccatgacctttatgcttccagccctgtttttaagttttttattggcatctgtcaaaaaacaaaatagctactgcgttactgcgtctttggcgggtgcgttgataggtgtcacatacttttccatcccgattgccattcttgcgggaattttgggtggttgcctggcagcacttcttcaatttcacaccacacagttgaataagaataaaactgatgattga

SEQ ID NO: 1752 - DNA, 336 bp, Xenorhabdus bovienii
  Coding sequence Name=Xb4151_4152.C429.gene98.dna; Position on contig =55762..56097bp; Strand=+
atgattgataatagaatacttctaatcggtattgttgtaggggtagccaattttttattccgttatctacccttgcgctttggtgtcaatcgctcgcctatgaccaaagcgggaaatactggggttgtactggatagtattggtattgcatcaatttgttcgctccttattgtttcaggtattcctgaagtcatacgcgaacataataaattttttccgactttgatcggcagcctgactatctgtttactgttctataaaacacgaagtatcagcattgccacactgtctggagccactgtttttggattaacattcaaggtatttatgaattag

SEQ ID NO: 1753 - DNA, 153 bp, Xenorhabdus bovienii
  Coding sequence Name=Xb4151_4152.C429.gene99.dna; Position on contig =56141..56293bp; Strand=+
ttgctaaatttaacttttaatatagtatttgtagggtttttaacagaagttactttaccggttgaaactaataaggtatctaaacaatggaaagttcattcactcccactgaagagttgcttaattgccgtgttacacagcaaaaagagttga

SEQ ID NO: 1754 - DNA, 528 bp, Xenorhabdus bovienii
  Coding sequence Name=Xb4151_4152.C429.gene100.dna; Position on contig= 56227..56754bp; Strand=+
atggaaagttcattcactcccactgaagagttgcttaattgccgtgttacacagcaaaaagagttgaacaaaagtttgccctatcaagagatattactcactcgcttatcgatgcatgtccagggtaaattactggaaaatcgtaataacatgctgagagcgcaaggaatcaatgaaaccttgtttatggcactgatgatcctggataccaaagaaagtcgtagcattcagccatcagaacttagtgctgcattgggttcttcccgcacaaacgcaactcgaattgctgatgaattagaaaagcaaggctggatagaaagaaaagagagccataacgatcgtcgttgcctccatcttcatctaacagataaaggtacagatttcttaaatagtttacttccacctcaacatgactgcctgattaaactttggtctgcgcttgaacaggaggaacaaaaacagttagagaaattgatgagaaaattattggctcgattggataatatcggggattgttttaaaaagtga

SEQ ID NO: 1755 - DNA, 144 bp, Xenorhabdus bovienii
  Coding sequence Name=Xb4151_4152.C429.gene101.dna; Position on contig= 56780..56923bp; Strand=-
gtgtgcatttacactactggaaagggtgaattacatggattcaaatattatctgaggataatagtcagccatatgaagtatcagatgatacaggctagcagaaaagattttttaggtcatgttgccataacacgtttttcttga

SEQ ID NO: 1756 - DNA, 1179 bp, Xenorhabdus bovienii
  Coding sequence Name=Xb4151_4152.C429.gene102.dna; Position on contig= 56997..58175bp; Strand=+
atgaatatcaaagaggaaataaaatccccgacagctacaggccgcaataagaaaagacagcgccgaaatataatcatattactgactttactctttcttatccttggtgccgcttatactgtttattggttcctcgttttacgtcatcatcaggaaaccgacaatgcctatgtgacaggaaatcaggtacaggtcatgtctcaggtcactggcagcgtgactaccgtctattttgacaataccgattttgtaaaaagcggcagtgttctcgtacaactcaatccccttgatgctgaactggtactgaaaaaagccgaaaatgagttagctatagccgttcgaactacccaccagcgcatactcgataatcaacaatatcaagccgtcatcaacctgaaaaagattgctctcagcaaggcacaaaacgatctaaaccgcagggaaatactcggtattaaggaagtcattggtaaagaagagctgcaacatacgcgtgagagtgtcgcgattgccaaagctgatctggatgtagcaatcgcgcagtacaacagcaatcaggccaccattctggatactccactggataaacaacctgcggtagaaaaagccgcttccggggttcgtgatgcctggctagccttgcagaggactaaaattgtcagtcctgttgatggatatgtttctcggcgtcatgttcaggtaggctcccgcattaattcaggaacacctttaatggtcatcgtccctgccagcaacatgtggattgaagccaatttcaaggaaacccaactcgccaccatgcgtatcgggcagccagtaaaaatcatcagcgatttttacaatgatggtgtcgtgtatactggcaaagtagcaggccttgatatgggaaccggtagtgcgttttctctattacccgcccaaaacgccagcggtaactggattaaggttgttcaacgcttgcctgtccgtattgagctggatcctgagcaattaaagcagtatcccctgcgtattgggttatcgacaaaagtcacagtagatacagcagatacccgtaaaatgacactggcaacctctgaacgccatcatcccgcttatcacacgaatgcactgacgatcgatatggctcctgccaataaaataattaatgacgtcattaatagtcattcaagaaattag

SEQ ID NO: 1757 - DNA, 1542 bp, Xenorhabdus bovienii
  Coding sequence Name=Xb4151_4152.C429.gene103.dna; Position on contig= 58191..59732bp; Strand=+
atggtgacacgagaaccacttacaggcgctaaattggcgctactgaccatttcccttgcaatggctactttcatgttggttctggactccacaattgccaatgtcgccataccgacgattgcgggcaatctgggggcatcaaactcacagggaatatgggtcattacctcctttggtgttgcaaatgcaatctccattcctattaccggctggttagcaaagcgcattggcgaggtcaagctgttcatttggtctacagcactctttactttctcctcatggctatgtggtatctccaacagtttggaagtactaattttctttcgcgttatccaaggagtggtcgcagggccgataattccgctttgtcaaagcctgttattgaataattattctcctgccaaacgaaatatggcactggcactctggtctgtggtgatcattgttgcgccgatttgtggcccgattctggggggatatatcagtgataattaccactggggatggattttctttattaacattccccttggaatcgccattatctttgtcgcaagacacacactgcggaacagggaaactaaaacagaaatccacgccatagatactgtcggattagtactgttgatccttgggattggttgcctgcaaatcatgcttgaccaaggaaaagaacttgattggttcaactccactgaaattattgttcttaccgtgatcgccgttgtctcattaaccattctaattgtctgggaactcactgacgatcatcccattatcgatctatcactgtttaaagagcgtaacttcaccattggtacactgtgcctcagccttgctttcatgttttactttggcacgatagtcttgttgccacagctattacaggaagtcttcggttataccgcgacatgggcaggtttagctgccgcaccaatcggattgatgcctttactgctctcaccgctcattggaaagtatggccataagatcgacatgcgttatatcgtgacagccagtttcattatttacactgtttgtttctattggcgggcatatacatttgagccaggcatgaattttgccgcgattgcatggcctcagttttttcagggatttgccatggcttgcttcttcatgcctctgaccacgatcactttgtcaggtttaccaccggaacgtatggcgtcagcttccagcctgtccaactttatccgcatattgtcaggttcaatcggagcctccattacaactacgatatggacacaacgtgaagctatgcatcactcctattttacagagcatatcaatccgtatgattctaattatcagcaaacgtatcagcagttgacgcagttgggcatgaatgatcagcaaatttcagcttatctggcaaagcagatcactcatcaagggttaattatctctgccaacgaaattttttggcttgcggcgggagtatttttggttttggtgctactggtatggatggcaaaacccccatttagcgtaggaagcaaagatagcggaggcgcacattag

SEQ ID NO: 1758 - DNA, 468 bp, Xenorhabdus bovienii
  Coding sequence Name=Xb4151_4152.C429.gene104.dna; Position on contig= 59829..60296bp; Strand=-
atgctgaaagaggctagtttcaaaaactgtgatttgtccatggcagacttcaggtatattaatgcccttggtatagagatttgcgggtgcaggcttcaaggcgctgattttcggggtgccagttttatgaatagggtgagtgccaacatccagttctgctctgcttatatcaccaaaagtaacttaagttacacaaactttgcggatgttattcttgaaaaatgtgaattatgggaaaaccgctggcatgaaacccatattctgggagcgaggctcagtggttccgatctttccggtggtgaatttatctcttttgattggaatgcggccgactttacttattgtgatctgaccaattctacactgggtgagcttgatattcggaaagttgatttgaaaggcgttaaattagagtcttatcaggtcgcagaactgttagaacgaattggtattgtggtaatggattaa

SEQ ID NO: 1759 - DNA, 201 bp, Xenorhabdus bovienii
  Coding sequence Name=Xb4151_4152.C429.gene105.dna; Position on contig= 60198..60398bp; Strand=+
ttgaagcctgcacccgcaaatctctataccaagggcattaatatacctgaagtctgccatggacaaatcacagtttttgaaactagcctctttcagcatagcgtgtttgaaattacagcccagataacttgttggctcataaaactagcaatcgataaactgagtatctctcaaatcgctactcgaaaagtcgcaatttaa

SEQ ID NO: 1760 - DNA, 135 bp, Xenorhabdus bovienii
  Coding sequence Name=Xb4151_4152.C429.gene106.dna; Position on contig= 60342..60476bp; Strand=-
atgcaaggacttgaattatatgaagagaaaatcgaacgtgaccaatttcgtggggaaattattaaaaacagtaagtttttaaattgcgacttttcgagtagcgatttgagagatactcagtttatcgattgctag

SEQ ID NO: 1761 - DNA, 2409 bp, Xenorhabdus bovienii
  Coding sequence Name=Xb4151_4152.C429.gene107.dna; Position on contig= 60876..63284bp; Strand=-
atgtctgccgttgctactatttcatttgaaaaaacgctgcctgatttgggcaccttttcattgcgtccactagatctgacagaagatattgctgctattaccgattgggttaatcaggaatatgcctattattgggggatgcaaagtcataccgaacaacaggtaaaaactttttatcaagatctgttgaatcgccagcctgattctgtctttatcggaatttaccaagagcagcctgtatttttactggagtgttattgggcgcaggatgatcaaataggaaaatactatccagcccgttcggatgacatgggaatgcatattctggttgcgccatctgaacaaaaaatcagtcaattcacatggggaattttccagaccattatcgcgtttatttttaaaaatcctgctgtgaacagaattgtcgtcgagccggatatacgaaatgaaaaaatccatcggctcaacttgcgggctggctttgtttacgacaaaactgtgcagttatcccacaaaaccgcagggttggcattttgtactcgggagcaacatcaaatggcattacaatcagctaaattaacagtaccttctaaccagactcattctcttgtcagccatttacatcccgccatctggcagaaggttaatcggctgcatttgaggaaagccatttctgaattttcccatgaatgtttactgttccctgaacaattgacagaaaaagcagatcaagacggttatcaccactatcgtttggataatcctgaatgctcagttaattatcatttcagagcgcgccgattggctttagatcactggttgattgatgctgattcgttgcggaaaatgcaggcaggtgactggtgcgagctggactttatcagttttatcattgaattcaaacaacagcttggtatcagtgataccgtgatgccgacttacctggaagaactgacgagcacactgcatagcagtgcattcaaatatcaccgaaacggtatcgatgtagaagagctggtcaatgctgattttcagacaatcgaagctgaaatgatggaagggcatccgatcttcgtcgctaacaatgggcgtatcggctttgatgcggaagatttccacaaatttagtcctgagtcagcttctgacatgcgtttggtatggttggcggcgcataaaagtaaagctcactttgcttgtattgagcaacttagttaccaacaattgatggagcaggaactgggggaggcagaaatagccaagtttaaccatcaactgctccttcttgggcttaatccagaagaatatctgttgatgccattccatccgtggcagtggcaaaataaactaccatccgtatttgcgcacgaccttgccaaccgaaaactggtctatttggggcaaggaacggatgtatatcaggctcaacaatcgatacgaaccctgttcaatcgcagccacccacaacggtattacgtaaaagtagcattatctatcctcaatatgggatttatgcgtgggttgtcaccttattatatggcaacaacgccaggtattaatgactggctgtttgatttggtacaaaaggacgctgttttacagggctatggttttcggttgttgagggaagttgcgagcatcggttttagaaacagttattatgagcaggccattcatggtgatacgccttataagaaaatgatggcgatgctgtggagggaaaatcctctgccattgattgaaccaaatcagaagctgatgacgatggctgcattattacatcatgatcagcaggggaaagccttcctgccagctttgatatctgcctcaggtctgccgagtcaggaatggatacgtcgttatctggattgctatttgtcgccattactgcactgtttgtatgcttacgatttgatgtttatgccacatggtgaaaatatcattatggtgctggagaatcatattccgcaatacatcttcatgaaagatctggcagaagaaattctggtcgtaaaccccgatgcggatttgccagaaaaggccagccgagtgaaagtcagtatgccggaagagatgaaaacattgactattttatctgatgtgttcgatggtgtgttccgctatttatcggcaattcttgatgagcagggcggatattcgcaagaacgattctggcaggctgtggcggattgcattctggattaccaatctcatcatccagaatttagtaaacaatttttgcgttatgaactgtttacgccagaaataaaacgctgctgcttgaacagattgcaaattgccaataatcgacaaatgctggatttatctgatcccgcactgagttttaagtttgctgataatctgactaatccaattgccccgtttgttaagaacattgcaaatgttgtttaa

SEQ ID NO: 1762 - DNA, 1320 bp, Xenorhabdus bovienii
  Coding sequence Name=Xb4151_4152.C429.gene108.dna; Position on contig= 63284..64603bp; Strand=-
atgacaactaaaacttatgattttatcgcgattggaatcggcccatttaatctgggattggcttgtctggtgcaaccgataaaagagattaccagcctgtttattgatcaaaaagccggttttaactggcatcccggcatgatgcttgagagttccacaatgcaaacgccgttcatggcggatttagtgacattggcatctcctacccatcctttgagcttcctcaattatattaaacaaaaaggccgtatttactcgttctatattcgggaaagttttttcctgatgcgcaaagagtataaccaatattgtcagtgggcggcggaacaactatctaatctgcgttttaatacgcaggttgagaatatcacttatgacgcctctacttcactttataccttgcattgcgctgatactctgactgggcaaaaacaccaattttcctgcaaaaaattggtgttgggaaccgggccgtcttcctatattccaaaatgttgcagaccgtttgctgatcatatggtgacatcgggagattacttagaaaataaggctgctttacagcagaagaaatcgattactgttttgggaagtggccaaagtgcagcggagattttctacgatttgcttgaggatattgatgcccatggttatcaactcaattgggtaactcgttccccacgttttttccctctcgaatataccaagctaacgttggaaatgacttcaccagaatatgtggattacttctatagcctgccggagaacaaacgtgaagcattgaatcgttcacaacagtcactttataaaggaattaacagttcgcttatcaatgaaatttttgacttgatgtataccaagcgattgagtggggaattagatgtctcgttgtataccaacagcgaattgcgacaagtacattttatagcggaaagacaaggcatcgtagaagaacagaaattgatactggatttattccagcatgaacaggaaacggcattttctttggaaacagagggattggtactcgccacgggttatcaataccagatcccaagttttatggagggtatccagcatcttatccgctgggataagcaggggcgttatgatgttcagcgtaattacagcatcgattgcagaaacgaaatttttgtacagaacgtcgagcttcatacgcatggttttgtgacgccggatttaggcatggccagttaccgtaactcctgcctgattcaggaaattactggaacggcacattatgatatagagaaaagtattgcgtttcagcagtttggtgttgctagtgaaggagtattctga

SEQ ID NO: 1763 - DNA, 768 bp, Xenorhabdus bovienii
  Coding sequence Name=Xb4151_4152.C429.gene109.dna; Position on contig= 64890..65657bp; Strand=-
atgataaacaaaaataatgacatctctagtgaatgggcatctaaaatagagattgaagatattattagactatttgatagcgcattcagtcactttaattcatcaatgaaagtgaatgcggagaatattccttcagatagtatggaattttatcaatggtcgagcgaaaaagaattctcattattgatgaaacgctatcaagatgcatattatggtaataatgaacagaaaccaaatcagaaagggctttattctctatgggcacaatggtattttggtttaactattcctcctatgatgctaatgttgctggaatatccccaacctatagatacagattatcatctttttcagattgaatttcatgaaagtggcaggccagatattgtgtattatcaattaacgtggttgaacgaatctttatctctattggaacgttatcattctttgcttgatcgtcatattattcctgtgtgtgagaaaatcgaatcttatcggggaataaatgggcgcttattatggaacaatattggttatgtgattcactggtacttggataatttcaagggaagaatgagcactgaacaatatgaatcgttgatacaaaatcttttcttcgaacaggcactaccagatggtagggataatccgctttatcgtactatgatcttgaaaaataatatcatacagcgtcgcagttgctgccaaagaaacaaattgccgggtgtggggaattgtcacgattgccctcttgaatctacagcataa

SEQ ID NO: 1764 - DNA, 114 bp, Xenorhabdus bovienii
  Coding sequence Name=Xb4151_4152.C429.gene110.dna; Position on contig= 65635..65748bp; Strand=+
atgtcattatttttgtttatcattaaaaattcccctattatatattttcatcctaacccaaacacgcgctatataaaaatagcattgttggttatttattcattttgtatttag

SEQ ID NO: 1765 - DNA, 816 bp, Xenorhabdus bovienii
  Coding sequence Name=Xb4151_4152.C429.gene111.dna; Position on contig= 65726..66541bp; Strand=-
atgtcatcggatgctaattccccagtggttacttcacggctgaaagcccatgatctttcactggcatacggtaaaagaaccattattgagggggtgaatctcgcgattcacgatagtgaattcagtgtcattattggctctaacggatgtggaaaatcaacactgttgcgcgctatcagccgaaatatgcagccacagcgaggtgaagttcagcttgatggaatcaatatccatcgttataagccaaaggcggtggcgcgcgagctatcactgctgacgcagggcgctaccgtgacggaagcaatgacaatctatgatttagtttcccgtgggcgttatgcctatcaatctttcctgcggcaatggtcagcagaagatgagcgcgtggttaatgaagcattgcaggcggtggatttagatgagatgtcgcagaaattggtcagtgaactttcaggcggtcagcgccagcgcgcttggtttgctatgacattggcacagcaaactccgatcattctgttggatgagccgaccacttatctggacattacgcaccaaattgagttactcgatttatgtcagcgtctgcacagacaagggaaaacgctggtgttggtattgcatgatatcaatttggcactgcgttatgcgtcacgtttgatcatgatgaaaaatggtcagatttatgccgaaggtgtacctgaagatattgtcactgaacaaagtattgccgatgtttttggtttagagtgcagaattatccgggatcctgaatcccacaaaccattgatcattcctaaatacaaaatgaataaataa

SEQ ID NO: 1766 - DNA, 1047 bp, Xenorhabdus bovienii
  Coding sequence Name=Xb4151_4152.C429.gene112.dna; Position on contig= 66541..67587bp; Strand=-
atggcgcagataaatttcacggcagggcagccaaaaatcaaaaccttcacgttgggcaatgccgtttttattgcaccttcattgcatacgagtagagtgattctgtcgatattgctgctgcttgtggcgctcttttatctggctttgtcgttaggccgagaaggcatggataatccttttctggcgatggaaacgccttatcaggaatttatcctgttgcagatccgcttacccagagcgctggtggcaataggtgcaggcatgacgctggcactgtccggctccctttttcagttgacgacccgcaatgcacttggtagcccggatatcattggcattaatgcaggagcggctgtcggtatcatggttgtattgcttttctggccaagtatattgccggttcctttgggagcgttattgggtgcctgccttgctgtattgctggtttatatcggcaatggttcaggtgttggcaacatgcaggctaacaaaatagtgatttcggggattgccgttgccgcatttttcatggcatttgtcgattttgctatctcgaatattcgtattgagcaggctcagcagatcagctcgctattgagaggcagccttgccagccgacgctggcaggatgtcgggcttatcagtggcatggtgatttttattccctttttgtgttggctgggtaggcaattgaactatacccattttggtgatgatattgctaatacccttggtgtacctgtccgtttcatccggattgtcagcatattgctggccgtaacctttgccacaatgtcggtattagtcgtagggcctgtcgctttcattgcgctatctgcaccacaaattgcccgacggttggtacgggcgaaaggagccgcattgttttgctctgctctggtgggggctttgttgatgctggcttctgatttaattaccctgatattaccaacggtagctcgcttgcctgtaggagtgattactgcggtggttggtggtatctatttgatgtatttactgtatgccgaattaaggagaacgcgataa

SEQ ID NO: 1767 - DNA, 1008 bp, Xenorhabdus bovienii
  Coding sequence Name=Xb4151_4152.C429.gene113.dna; Position on contig= 67591..68598bp; Strand=-
atgaacgctaaacggcgaactgccctcatattgggtttggtattaatggcattgctaacctgtctttgcattgctgccagcttgagtttgggttcaaaatcattgccgctgtcagcgatctggcagcattattggttgggagatcaaggcagttattacgatttggtcattaatgcccgtgaacctcgcacactgattggtttaatggcgggagcggcactggcgcttgcgggaacagtaacccaagggctgctacgcaatccgctgggtgatcccggtctgctcggtatcaatgcaggtgcggcaactgccgtagtctgcttctcttttattcctgctctggacatactgccgcgtttttggaccgcttttattggcgcaagtctgtcaacattgttgttctatttgttgagtggagggcctcgcaatacaaaccctgtacgtttggttttgacgggagcgtctatcaatatctgcctgtttgcgttggtgcaaggtatcgttctgataaatgcacaggccatggacaactatcgtttctggacaattggttctttaagtgcaatgtcgttgaacgaagccagtttgttgatcccttatttgctggtggctgtggtcgtgacactttcgctcagtgcttctctgaatgtgatggtctttggtgaagggattgccagttccctgggggcgaatgttgcccgtacccgcatattatcgctggtgatggttaccatgctggcagccacagcgacggcaatggccggccccatcgcatttattggtctggccgcaccgcacttaatgcgtgcactggtaggcagtgattttcgttggttgttaccttactgcctgttcgctggcccctgtctgctgcttatttcagatgtcgtggcccggttgctgattgcaccacaagagatcatggtgggtattattacggctggcatgggtgctccgttgctttatctggtcgctaaacatcgttcacagaaaataatggcagagtag

SEQ ID NO: 1768 - DNA, 1029 bp, Xenorhabdus bovienii
  Coding sequence Name=Xb4151_4152.C429.gene114.dna; Position on contig= 68588..69616bp; Strand=-
atggtattaacacgttgcaaaatgctggtcgccgtaccgttgatattgctggtaagtttgctggtaggctgtgataagccgacggcctcaaagaatttaccgacggatgccgttggctaccctaaaacgattaccaccgcgctgggaacggcggtaataaaccaatcgccgcaaaggattgtggcgttgggaacgggcagcgaagatatcttgctggatttgggaatcattccgattgggattgaatctcatcgctggggcggggacgctgaaggctatttgccatggtttagggatgagatagaacggcgtggcgaaaaactgccagccattatcgagatgtaccctgaactggatatcgaaaaaattatcagtctgaagcctgatttaattttggcaacgcaatcaggcatcacgcaggaacagtacgatcatctgtcctattttgtccctgtgattacttatccggaaaaaccgtggcagacgacaccacagcggcagatagcgctggtagctcatgcattggataaaatacaactgggagaaaaactcagtgccgaactggataccatgctgtcgcaggcaggcagtacggttcccaatatagagcgttatcgttttgcctatattaaggcgggaatgacagggagcattttgtcgatctatgtcaaaaatgatccacgagttgatacgatggtacatcttggcctgtctttgctcccattggctgacaccttaactgcaccttttggtagtttttcagtcgatatcggtttggaaaatgccgacttgctcaatggtgcggatattctggtgacttggtattccagcgaaaaagagcgtcaggatacggaatcacagcctctgtttagctctatccgtgctgttcgccaagggggatatattccgttgaccgatcaatcaattgtcgtgtccatgtcctatggctcaccactcagtctgcgttgggggttgccaaggtttatgccgttgctgaagcaggagatagcaaaacataatgaacgctaa

SEQ ID NO: 1769 - DNA, 2274 bp, Xenorhabdus bovienii
  Coding sequence Name=Xb4151_4152.C429.gene115.dna; Position on contig= 69687..71960bp; Strand=-
ttgagacagataactgatgggaacgtcaaagtaaatataataacaaatcaatttggtaatgggataagtagagtgataaatccaattttgcaaccgaatcatttaaccaagaaaaaagtgctttctctcatgatcccgctgattttagcggggaatagcacggctatggcagaagaagcacagagcaaaaacgataaaattatcgtaacggcaggtgcaccaaggcatgaaggtgtaacggaagacactggaatgtacaacacatcttcaatggtgacagcgacaggtttgaatatgtctgcgcgtgaaacaccacaaagtgttagcgtaatgaccaaacagcggatggtagatgaaaatctgaacagcgttgagagcgctattggtagtattacaggtatgactgtccgtcaggctgacagtgatcgttttactttcacttcaagaggcatgacgatcaaaaacatgctacgtgatggtgtgccaactttttatgatatccgttttaattatggtgataacctgatggataccaccatttttgatcgccttgaagtggtgcgtggagcggctggtttaatggtggggccaggcacaccttcagcagcggttaacgtgatccgtaaacgtccaacccaaaatttccggggtgaaataacgctgggcggtggttcatgggataaatggcggactggtcttgatctgtctggcccactaaatgaagacgggacagtcagagggcgttttgtcaccgcttatcaacgttccaattcttttattgatcgtgataaacatgagaagtatcccttctatggcattcttgaagcggatctgacagaaaatactttgctgaccgtcggtgcggattaccagatcaaccatacccgtggcggcatgtttggtggtttgcctatttattttaaagatggcagtaaaaccgattacaaacgcagtaacagttatgcgcctgattgggcgttttctaaagtccgctcattctctacctttaccagtctgcaacaccaatttgataacggctggagtgcgaaaggaacctttacttatgatcacggtactcttgaccaaaaagtattgtgggcaacgggttttcctgatcgggcgacgaatgagggaatgtatccgggcaacatgacattgattgatggaactcgtcgccagcgtaatttcgacttgcaggtaaacggtgactatagattgcttgggcgtacccatcacgccagctttggtctgaattatcagaaacagaatttccagaatgattattactgggctgcctgtatgccacgtaattgttcaacttctccaataggtgattttactaattcgtcatggggttatgctgagccaacatggaacaaaactagaaacaatggctctgatggctataacgaacaaactgcgggctatgccgtcactcaaatctcactggctgatcctgtaacattgattcttggtgggcgagtcaccagttggaaaactcgtggcgataattttagtatgccacaaaatgccagctacagtgatgaatttgtaccgtatggtgggttggtttataacattacgccagacttctccgtttatggtagttataccaaaatctttgatccagaaagtcgaattaaccgtaatggccgactccttaagccagtcacaggtgaaaactatgaactgggtttgaagggggttgctctggacaacggtcttgattactcattggcaatttttgatatccgtcaggataattttacggaattggatagtactgctccacgacgtccagataacatcagaacttattatgtgatcaatggggtaaaaacccggggtttcgaagctgaagttagtggtcaaattaccgatgattggcgggtttatgcgggttacacccaattccgagcgactgatccaaagggtaaacgtatcaatacggataacccaagtcgattattcaaactgttcacaacttatactttgccgggtgccatgagcgatttaacgcttggtggtggtgtcaactggcaggacaaaacatggttggagcttgatacacctactggtaaacgccaagatgagcaaggcagctttgccacggttaacctgatgggacgttatcaatttacaccggatctctccctgagcgtgaacttgaagaacctttttgacaagaaatactacacctcgttcggtggttatacccagtactactacggcgcaccacgtaatgttgaagcaacattgagttataaattttaa

SEQ ID NO: 1770 - DNA, 1821 bp, Xenorhabdus bovienii
  Coding sequence Name=Xb4151_4152.C429.gene116.dna; Position on contig= 71944..73764bp; Strand=-
atgagtccgttgtacactaaattgagtcctcaaacctcgcatttaactagagaaaactggttacatgccaacaggcatcttgtagcaaaaatattgcgtgaacttttgcatgagaaattaatctttccggtaaatcagagtacggataaatcttactcgattgaaattgataaatttcaataccattttaaggcacaatcctaccaacttgaccatctagatattgatgctgcgtcaataacgaaattcagtcataaccagccagagcctcttgatgctattcaactgattattgagttgcatccactgttggatatttctgagaagatgctgcctatttatcttgatgaaatatccagtacgctttatggctgcgcttttaaatatcaaaataatcggttgaccgcacaggacttgactcaagctgattatcaggctgtagaaactgcgatgaccgaagggcaccctgtctttattgctaataacggtcgtattggttttgatgctgatgattacttagattatgcaccagaaagcgcaaatccagtgacattaatttggattgccgtacatcggaataaaaccgttttttctgcattatcttcgctctcttattcacagctggtggcagaagaactggaaaaatatttgccagcccgctttgaacaacacatgcagacattgggattaaatctgtcagattattacctgatgcctgtgcatccttggcaatggctgcaccgtattgccatcagttttgcggcagatattgccaaccaagaaattgtttatcttggtgaaggccatgatcgctatcttgcccagcaatcaattcgcacatttttcaatatcagccagcccaagaaaaattatgtgaaaacggcactgtcagtccttaatatggggtttatgcgtggcttggacccacatagcatggtgacgacaccgcaagttaatgaatggctcaatcatttagtagaatccgatattttctttcaggaaaaagggttcaccatattgcgggaacgtgcagcaataggctatttcaatcattactttgaagcagcaattaaaaaagataatccgcataaaaaaatgttgtcagcgttgtggcgtgaaagcccaatgacgatcctgaaagagactcaacgtctgatgactatggcttcattgttacatgtcgatagagaaggtgatgcggtcgttgctgccttggttaaggattcgggtttatcggcggaaaagtgggtaacgcgttatcttgatgcctatttttctccactgctacattctttcttcacttatgatctggtttttatgccacatggcgaaaatctgatgctggtattggaaaataatgtgccggtaaaaatgttaatgaaagatattggtgaagaaattgcaattttgaatggggatatccaactccctgaagagattgatttcctgcatgtgaccatcaaggatgaaatgaaaattaattatatcttccttgatatctttgactgcttcttccgctatctgacccctctgttacaaaaacatcttgcattaccagaagcgcgtttttgggagttagtggctcagtgtgtttacaactaccagtcacaacatctgaaccagatagaaaaattccgcaaatttgatctgtttaagcatgattttgtgcgtacttgcttgaatcgtctgcaaatggcgaacaaccaacagatgattgatctcgatgatcgtgaaaaaaacctgaaatttgccggaaccttagttaacccacttcacgccctacgcgaaaaatacgctgtcactgttgagacagataactga

SEQ ID NO: 1771 - DNA, 102 bp, Xenorhabdus bovienii
  Coding sequence Name=Xb4151_4152.C429.gene117.dna; Position on contig= 73723..73824bp; Strand=+
atgcgaggtttgaggactcaatttagtgtacaacggactcatttaataaaacccttcattcatatccagcatcatcccgtttccatgcataaacatgactga

SEQ ID NO: 1772 - DNA, 123 bp, Xenorhabdus bovienii
  Coding sequence Name=Xb4151_4152.C429.gene118.dna; Position on contig= 73911..74033bp; Strand=-
atggttaattcggtcgttacttatcttgtgccccattctttagtaaaatttcatttaaagtctttacattttatggttgttaatagtaatgattttaattatcattcatgcaagaaaaaatag

SEQ ID NO: 1773 - DNA, 1020 bp, Xenorhabdus bovienii
  Coding sequence Name=Xb4151_4152.C429.gene119.dna; Position on contig= 74250..75269bp; Strand=-
atgaacgattcctatagtggtaaaaatggcaaagtcaaagtgatgtatgtccgcagtgaggacaacaatgaccgccgcagcaataatgacagccgtagtaacaataaacgcccgtcgtctggtaaaggacgagatcaggggcgccgtcgtgataatgaacgtccagcgtattcagatgatcgttctccttggaaaaccgtctcccgaccggtggaagaatccctgacgcctgaccatggcggtatcagtggtaaaagccagattgatcctgaacagcttcgccgtcagcggctggaagagactcggatctatggtgaaaatgcctgccaggcgatgttcaagaaccgtccagaagccattgtccgagcctggtttgtccaatcagtgacacctcgttttcgtgatgctttgaaatggatggcggcaaatcgcaaggcttaccacgtggttgatgacgaagagctggtcaaagcatcaggcactgagcatcatggtggcgtatgcttcctgattaaaaagcgtaatgggctagatgtagaaacttatttgcagcaagcaccagcaaaagactgtgttctggcattggaaaatgtgggcaatccgcacaaccttggagccattatgcgcagttgcgctcattttggcgtgcagggcgtgatattacaggatgtggcgatgctggaatcgggtgcggcagttcgtactgctgaaggtggggctgaacacatcaaaggcattgatgctgatggtttcacaacgacgttgaaccaattccgctgtgcaggttataccattgtgaccacctcaagccataagggaagcacaacgctggccaaagcggatcttcctgaaaaaatggttttggtattgggtcaggagagtgatggtctgagtgacagtatctgggaagatggtgatatccgactctcaattggtggcacgggtcgaatagaaagcctgaacgtttctgtcgcaacaggtattatgctggcggaatggtggcgccagaataaagcctga

SEQ ID NO: 1774 - DNA, 822 bp, Xenorhabdus bovienii
  Coding sequence Name=Xb4151_4152.C429.gene120.dna; Position on contig= 75289..76110bp; Strand=+
atggcgcgcagattacccgatgtgcgcgcccgaagctacctctggcaacgacaatccattaaaatacccgctaattttttatccgctttattcacaaacatgtttgagttcaaaatgagaaataacaacaccgtttatcaacttcgccaacagcgtctagcccgttctacccgtccctttcaggcaaggggctgccgagtgcagcgttgcctgcattgtttattaccccaaaaaagctgcctgtgtgaaacaatttcaccagtaaccgcgactagccgcttctgtctcatcatgtttgatactgagccaatgaagcccagcaatacgggaaagttgattgctgatattctgaccgatacacacgcttttctctggtcaagaaccgagcctgatcaacggatgcttgaagtgctgcgcgacccaactcgacagccctatttgatcttccctgagagttatgccacacctccccgtactgtatatcagcaactccctgataaccagaaagcgccgctattcattatattggatggcacttggccagaagcaaggaaaatgtttcgaaaaagcccatatttggacggtatccccctattatctatcaataattgcgccaaaatggattatttactgcggataccatccagaaaagaacagcattgtactgccgaagttgcagccgctgcacttgagctggctaatgaccttgacgcatcacaaacactactccgccatttcaatcattttcgtgaacaatatctggcagggaaacctcatcgtcaagaggagtcaatcacagtaattcttgacaatccccgctaa

SEQ ID NO: 1775 - DNA, 102 bp, Xenorhabdus bovienii
  Coding sequence Name=Xb4151_4152.C429.gene121.dna; Position on contig= 76136..76237bp; Strand=-
ttgggtgtaataatgcttccagtccgcgctgactcatttctggggttcctcattagttatcacatcaataaacaatcacccttgattaaacaattactatga

SEQ ID NO: 1776 - DNA, 2643 bp, Xenorhabdus bovienii
  Coding sequence Name=Xb4151_4152.C429.gene122.dna; Position on contig= 76201..78843bp; Strand=+
atgagtcagcgcggactggaagcattattacacccaaaatccattgcagtgattggtgcttctgaaaaaccagagaaagctagctccatgttgatgcgaaatctgctaatggggcattttactggcccaattcttcctgtaacaccaaataaaacagctattctaggagtactggcttatccctctattgataaattaccactgacgccggatttagccgtgatatgcactcatcacagccgtaacctatctttgctggaacaattggcgcaacgaggatgcaaaacggttattattctctcctcaccgccttcacagtttgccgaactgaaacagttcagccaaaaacatcacatccgcatgctgggacctaacagcctcggtattctggctccatggatcgggctgaatgccagtttttcccctattcctatcctcaagggcaaactggctttcatctcacagtcagcagcaatatccaataccattctggattgggccaaccaccgtaatattggtttttcctatttcattgcattaggagacagtgttgatatcgatattgacgatctcctcgattttctggcgcgagacagcaaaaccagtgcgattctgctacacctcgaacatatcagtgatgcccgtcgttttctgtcagcctcacgtagcgcttcgcgcaataaacccattctggttgtaaaaagcagccgcacccgcaaagctcaggaattattgggagaacaacagaatttcgatgcagcttatgacgctgcgattcaacgtgctggattattgagggtacaagatacacatgaaatgttttctgcggtagaaacattaagttttatgcggccactgcgcggggaacgcctattgatcgtcagtaacggttcagcacctgcggcaatggcactggatgagctactcaggagaaccggcaaacttgcagtgttaggagacgaaactagcaatcaattgtctgctattctccctgataccctgatcctgcgtaaccctctggatctcggtgatgattcttcatccgaacaatatattgccgcacttaaactccttctggatagctatgattatgatgctttgttgttaatccattcaccctgtgccatctcccatagtatgaatactgcaatcaaagtcattcagactattaaggaacatcctcgcgggaagtggctaacaatttttaccaattggtgtggagagtattcttctctggaagcgaggcgtttattcagtgaagctggtatcccaacctaccgtacaccagaaggtgctatcacggctttcatgcatatggtggaatatcagcgcaaccaaaagcaactcaaagaaacgcccgctatgccaatcagcattacatcaaatactgcacacgcccatgagtgtatccagcaagtccttgatagcggaaatacgctattggatacccacgaagtacagcctattcttgaagcctatggcttaaataccttaccgacatggatcgcatataccagcgatgatgcagtcaatatcgccgaaaagattggctatccggtcgcattgaagctacgctctcccgatatttcccataaatcagaagttcagggagtaatgctctatctgcgcaattctgatgaggtaaaaacctcagcacaagcgattattgaccgcgttaaacagaacttcccccaagccagaattcatggcttatttgtgcagagcatggctaaccgtgcgggtgctcaagaacttagggtagctattgagcaagatgagatattcggccccttaatcatgcttggagaaggtggtatcgattggattaatgaaacgcagactgctgtcgccctgcctcccctgaatatggcgctggcccgttctttagtgattcaagcgattaaaggcggcaaaataaaatccggtggctcgctgctaccactggatattcctgcactcagtcaattattggtcagagtatccaatcttctgattgactgcccacagatctctcgtatgaacattcatccactgctggcatcaggtaatgaattcactttattggatgtctcaatggaattaacgccagtaacaggtgatcctcacagtaaacttgcgatccgaccttatcccaatgagttggaagaaactatttatcttaaaaaagattttgaatgtctgctgcgcccaatcctgccggaagacgaacccctgttgaagacatttattagtcaggtaacaaaagaagatctctattaccgctatttcagtgagatcagcgaattcacccatgatgatctcgccaatatgactcaaattgattatgaccgtgaaatggcattcgtcgcaattcgccatgcagcaactacaccagaaattattggtgtcgcccgagcgatggctgatcccgataatatcgaagcagaatttgctgtattagttcgatcagatttaaagggcattacgttaggctatcagctcatgactaaattgatccattatacgagaggccatggtatccagatactgaccgccattaccatgccagaaaaccgtaatatgattcaacttgcgaagaaactgggatttactattgatattcaattagaagacggcgttgtcaatcttgtattaagactttaa

SEQ ID NO: 1777 - DNA, 96 bp, Xenorhabdus bovienii
  Coding sequence Name=Xb4151_4152.C429.gene123.dna; Position on contig= 78952..79047bp; Strand=-
gtgttgttggtgtttggctcgtttaaatttagacaacatcacagtgcgttttttctcttagtttggatggttggagttccatcatcaggtgtatga

SEQ ID NO: 1778 - DNA, 1356 bp, Xenorhabdus bovienii
  Coding sequence Name=Xb4151_4152.C429.gene124.dna; Position on contig= 79009..80364bp; Strand=+
atgttgtctaaatttaaacgagccaaacaccaacaacaccttgcacaactgcctaaattaccgcagtcagttgctgacattaagacactttatcaatcaaaagtgttccgcagcaccttactggaacacattgcgaacgctgaaaaatatatttatatcgccgctttatatttagaaaatgacgacgcagggcgagatattatggatgctctgtatattgccaagcaaaaacgccctaagctggatatcaaaattttcgttgactggcatcgtgctcaacgtggccgtatcggcgcagaagcagcggcaacaaatgcagattggtattgctctatggccgaaagctaccctgatgccaacatttccgttctaggagttccggtgaatacccgcgaagcactgggggttttgcatctaaaaggctttatctttgatgatacggtaatttatagcggtgccagtattaatgatgtctatctgcatcgccatgaaaaatatcgttatgaccgttaccatttgctgcataatgcaaaactcgcagccattatgaagcagtttattgatgataatattcttaccgctgatgccgtaaaaaatttagcctgccacagtcgccctcgtagtcttgaaattaaaaatttgattcgacagttccgtacttcattacgcagtgttgaatacaacattgagaatcaggcatcaaatgaggaattggcagtcacacctcttgtcggattaggtaaaaaaaatctactaaataaaacgatatgccacctgatctccagtactgaaaataaattggtcatctgcacaccttatttcaatttaccggcggttctggtacgcgcaatatcacgattgctccgacaaggaaaacaggttgagattatcattggcgataaaacggccaatgatttttacattccaccggaagaaccctttagaattatcggggcattaccttatctgtatgaaattaatctgcgtcgttttactagccgactgcaatactttatcgataaccagcaattaaccattcggctatggaaagaggcagataatacttatcacttaaaagggatctgggttgataacaaatggcaattaattaccggcaataatctcaatccacgagcatggggactagatctagagaatgctattctcatccacgatcctcatcaggaaatgcaagaacaacgcacattagaactagactgcattcgtactcatacaaaaattatcaatgattaccaggagctggaaagtatacagctttatccggtcaaggttcgcaaactgatacgccgtttacgccgtatccgagtcgaccgattaattagccgcatactgtaa

SEQ ID NO: 1779 - DNA, 183 bp, Xenorhabdus bovienii
  Coding sequence Name=Xb4151_4152.C429.gene125.dna; Position on contig= 80378..80560bp; Strand=-
ttggaacacgcgattgtaaataggagaggagagattaccaatacattttttattatatttatgacaggttttatcattgtgatttacgccatgatttatatttctgtaaatcatagcttgttgataaataagatacaaaaaattccctctagcgatagcaagaaaggattgatgagtcgataa

SEQ ID NO: 1780 - DNA, 354 bp, Xenorhabdus bovienii
  Coding sequence Name=Xb4151_4152.C429.gene126.dna; Position on contig= 80484..80837bp; Strand=+
atgataaaacctgtcataaatataataaaaaatgtattggtaatctctcctctcctatttacaatcgcgtgttccaatatgtatcaggccaacgataattggacaggtaaagataaagctcaacattttctattttcttcggctatggcggctgcgggtaatgcttatggggagcggcaaaattggacacatcaggaaagtgcacagtttggcctactcctgtctatcagccttggtacagcgaaagaattttatgatagtcgaccaccaggaacaggctggagttggcaggattttgtttatgatatcgccggagcaatggctggctatagtttgtatcagtctttgaagtaa

SEQ ID NO: 1781 - DNA, 192 bp, Xenorhabdus bovienii; identical to SEQ ID NO: 153
  Coding sequence Name=Xb4151_4152.C429.gene127.dna; Position on contig= 80895..81086bp; Strand=+

SEQ ID NO: 1782 - DNA, 180 bp, Xenorhabdus bovienii
  unsure (1)..(180): unsure at all n locations
  Coding sequence Name=Xb4151_4152.C430.gene1.dna; Position on contig =160..339bp; Strand=+
atgccacgccatctanccatatgtttttcaataaaaaatagcgataattatcattcagttactactgaattacatattgataaaaatctcagaacaggtgatatagttagctttgatattgtacctaacgctcatgctgttggcttttcgacaaaaacgattnaattatactgctcatga

SEQ ID NO: 1783 - DNA, 525 bp, Xenorhabdus bovienii
  unsure (1)..(525): unsure at all n locations
  Coding sequence Name=Xb4151_4152.C430.gene2.dna; Position on contig =293..817bp; Strand=+
atgctgttggcttttcgacaaaaacgattnaattatactgctcatgaggtggacttggattcattgggtatttattttgaggaagatgttatacccgcattgatgacagatgaagttaatatacctccaaatgggaaattatatactcgggccattgcaatggtcaaaaacataaacggttatccactttctgaagtgccaattactatcattggaggatatttacctaatttagataaagtcaagatattcctttctaatcaagatccaaatacagaggtatcgaaacagtcgttatacggagagcagtctattgttttaaacacagataaaagtggcaaactggagttttatatctacttaagtgataagtctcaatttgtacttgattttaaagcgagagtgtccggtaaaacaggttttgtattttcaagaaataagttatatattattgatgacgatcctggggcgccatccaatattgctaaacagacgttgaactctcctaantattatagattatag

SEQ ID NO: 1784 - DNA, 135 bp, Xenorhabdus bovienii
  Coding sequence Name=Xb4151_4152.C430.gene3.dna; Position on contig =820..954bp; Strand=+
gtgagcttaggggaaatgatagttcttctacatttttggtttcaattgatagttataataatgccgaagagagacgataccaatttattttactgtagatgggaaagtatttcccaaaagaagaattgttgttaa

SEQ ID NO: 1785 - DNA, 558 bp, Xenorhabdus bovienii
  Coding sequence Name=Xb4151_4152.C430.gene4.dna; Position on contig =1057..1614bp; Strand=+
atggaaatatccaatcttcagctggatcaatatgttaaatatgttggtggaggaaaaaatcaaccactggatgatttgacaagagtttatgatatgtgtactgtatattccagctttggtccttttatcccatctaatttggtctttaaagacgatatagtacactattttacaatatctcgttacatgaataataaagagcatgatggattatttgttgtcattacaggaaccaatgatcctacagataaaactaaagtgccatttggttctgaggttacattaagttttcgcatcgactcttataaaaaacaagtctataaaacattcactaaaacaatgccaactcagccagatcagggaagtaagaatacagcaacattaatttttggtatttcttatgaggatgttagtcatgtagagtcagattctaatagtgtagctggccgtatttattttgattatcagattaatgagttaggtaaaataacttatggtaaaatttggaaagcaaggatagatactgtacctcctagtcctgatggcgatactgattaa

SEQ ID NO: 1786 - DNA, 771 bp, Xenorhabdus bovienii
  Coding sequence Name=Xb4151_4152.C430.gene5.dna; Position on contig =1927..2697bp; Strand=+
gtgcaatttattctattgctgttgaaaaacctgcgggttatatttcaaatggatattaataaaaagagtgataacatgaggatcttcatgagtataaaagaattcatttataatgttagattgaattctcttttaatagaattgatgaatctagatcatagattgaagataaatgattcatcattaaaagaagaaatcggatataaacaatttaaatatcattttaatccagttacgtcgaaagtgtattttttattggggataattggatttagtttggtcttatcatcttcaatgcttttggcggttctgatttcttatgtaatagatagtggagttaataagttagctatcatcacatgtatgttattggttttttctattctttcattaatattttttggttttttatctttaggtaagggaaataaggaagggatttacatacatcgtatactatatcaatctacattagtcattagtgttttattattattatttgatagttcgccatttttgcattttttctattatgcattagttatggttttttctttattaattaaatttattatgaatagttatttttattttaatgcggtaagagatatgaagcttttcagaattactcatatttttttgactaaagatacacaagaaatattaaacatgactcggaaagagtctaaaaaacgtattaaagaagttgaatttcagagacggcgtgagattaaagagaagaaaagagtcaaagaagcagcaggaaaataa

SEQ ID NO: 1787 - DNA, 168 bp, Xenorhabdus bovienii
  Coding sequence Name=Xb4151_4152.C430.gene6.dna; Position on contig =2675..2842bp; Strand=-
atggttccgcaatgccttctgtatagattctataagataacgtttaatgtaccaccctgttctatcctatctttaattgcttggttaacattatctgatttgaatgagaaatcaagcatctccaatgacgataggtatataaattttattttcctgctgcttctttga

SEQ ID NO: 1788 - DNA, 156 bp, Xenorhabdus bovienii
  Coding sequence Name=Xb4151_4152.C430.gene7.dna; Position on contig =2831..2986bp; Strand=+
ttgcggaaccatctgagagactctctcatcgcaactggtgggtttgtaggtagaggaatgacaggaacaattaggaattcagaaaatatattaacgtcaggtaattatatgattggttctattgtctctgttgcttacgaaaaccctgttagttag

SEQ ID NO: 1789 - DNA, 102 bp, Xenorhabdus bovienii
  Coding sequence Name=Xb4151_4152.C430.gene8.dna; Position on contig =2943..3044bp; Strand=+
ttggttctattgtctctgttgcttacgaaaaccctgttagttagttatctgaataattatattgattgcattaatacattgattgtgataacaactatatga

SEQ ID NO: 1790 - DNA, 651 bp, Xenorhabdus bovienii
  Coding sequence Name=Xb4151_4152.C430.gene9.dna; Position on contig =3041..3691bp; Strand=+
atgaatatgaaagattttattttaaatacagaatttaaaaaacttttgggtaaggctaaggatctggaagcaaaaataaaaaatgctgatccagtgttaaaaaatatcacgttgaatgatcttagttataataaatatttttcttaccctggtcggtttaagataggttttataatattttttattatgatagtttatatggctttcttttcaggtgtagcggtagctatacctagtttattaatggaaaatccaagttatgaaataaaagcattttcttttattttgtcattaataattagtgcttttatttcattttctcatattgggcttactttgagtggttattattatggtcctgttgtccaaaaatatacaaatactgttgtattcttttttagtttgtttatatcttatttgaaaggagtgtatgactctgatttcttctatttttctgctatagcgttatgttgtttgtttatcaagttaatgttgaatagtaaatattattctggttttatattggctaaaatgttcatcagggttgaacgtgttatttttaatgatgaattggataaaataaaaggatttaataaaaagcagttaagggaatattcaagatctataaaatcgaaaaatcgtaagaaataa

SEQ ID NO: 1791 - DNA, 189 bp, Xenorhabdus bovienii
  Coding sequence Name=Xb4151_4152.C430.gene10.dna; Position on contig =3735..3923bp; Strand=+
atggacataaaacatatattaactaacaaccaattcagaagtattttgactctgtataaaatcacagataatagaatcagaaatagtgattctttacttgtcgacgaaccggatatcgtcaggattaaggataaaataacgtctgccaatgaatccgcacaaaaatcattatgttatttaactcattga

SEQ ID NO: 1792 - DNA, 147 bp, Xenorhabdus bovienii
  Coding sequence Name=Xb4151_4152.C430.gene11.dna; Position on contig =3917..4063bp; Strand=-
ttgatttgcaggaccagaattaagtgtgctcatatgatatttattcccaaaaaacgaagttttcgacctatcctacaggaaacttattcaaatcgttaccctgaaaagataaaaaaagtaaacgattgcggcaagcataatcaatga

SEQ ID NO: 1793 - DNA, 1338 bp, Xenorhabdus bovienii
  Coding sequence Name=Xb4151_4152.C430.gene12.dna; Position on contig =4031..5368bp; Strand=+
atgagcacacttaattctggtcctgcaaatcaacagggtctgcttcagcgcgtgtttaagttagaggaacatggcacgacggttcgtactgaaatgatcgccgggtttacaacctttctgactatggtttacatcgtctttgtcaatccgcaaattttggcggtggcgggaatggatatcaaagccgtatttgttaccacctgcctgattgccgcatttggcagcattatgatggggttgatggccaatcttcctgttgctgttgcacctgcaatggggctgaatgcgtttttcgcttttgtcgtcgtcggagcgatgggcatttcgtggcaggtcgcgatgggggcgattttctggggcgcggtagggttgttgatcctcaccatttttcgcgttcgttattggatgatcgctaatatccctttgagcctgcgcatcggtatcactagcggtatcgggctttttatcgccatgatggggctgaagaatgcgggcattatcgtgccaaatccagacactatcgtctcaatcggcaatttcgcttcccataatgttctgctgggaacattgggcttttttatcattgccattttggcagcgcgtaattttcatgccgccgtgctggtctccattgtcgtcacaaccgtcatcggcctgatgatgggttatgtggagtatcacggtatttttgacctgccgccaagcgtgatgagcgttgtcggaaatgtcgatgtcaaaggtgcattggatatcgcattgtccggtgtgattttctctttcatgctggttaacttgtttgattcttccggtacgttgattggggtaacggataaagcgggtattgcagacagtagtggtaagtttcctcgcatgaaacaggcgctgtatgtggatagtatcagttcggttgcgggttcttatgtcggaacgtcttcggtgacagcctatatcgaaagctcttctggggtttctgttggcggacgtaccgggctgacggctattgtggtgggtatgctgtttctgttggtgatgtttgcttccccgctggctagtatggtgccggcgtatgccaccgcaggagcgttggtttatgttggcgtattgatgacatcgagcctgacacgagtgaagtggaatgatctgactgaatccgttcccgcttttatcactgcggtcatgatgccattcagtttctctattacagaaggtattgcgctggggtttatcgcttattgcgctatgaaactgggaacggggaaatggcgtgaaatcagtccttgcgttatcgtcgtaacattattgtttgtgctgaaaatggcgtttgtcgatgctcactaa

SEQ ID NO: 1794 - DNA, 1470 bp, Xenorhabdus bovienii
  Coding sequence Name=Xb4151_4152.C430.gene13.dna; Position on contig =5426..6895bp; Strand=-
atgcgtttttttgatacttcgtcttatcgcatgccgttgtttctttggatcacgggctatgcgcttttgtgggtagtcgcaagctacacactcgaccctactgtaccttatgatgctgtcgaagccttaaattggggtataaatggagaatggggatcacccaaaaatccgtggctagtgggctcagtgatgctacccgccattcacatcagcacaatttccctcagtttttactggtatttgacccactttcttgccattgccatcggaatgctgggtgtctggcgattagctttccggttgacaggcaaagttgaactggcgtggcttgccatgctgacactgaatctgtccggcatcatcaacttcgatatcattccttataatgataattacctgttagtcatgctctggccgtgggcactactgtttttcctacgagccattgacgatcatcccaaatggtggctggcattcgccctcaccacagggctggcaacgatgggaaaatattcttcactttctatcattggctccgtatttttgctctctctgttcgtacccagagtacgccgtagctatagagagcccctgttttatctcgctatcgcactctggttcatgctgatattgcccaacgtctggtggctggtgcataacgacttcgccgcatttaaatgggtcgactcccagattcagcaaggctttaacctgcacaccacgcgagcggtactttccgtgttctatcccttgctcatcgttggtgcgttcatttacctgtcaggcggacggattggctggccgaaacagcaatccaacgcgctggccaatatcgttatcctgctgcccctgctgctgatttatggctggttttccttcaatcagggcgggcgaatgaccgagtggctacaaccatttatgacggtagcacctgcgctgctcgtcggttcactgacggtactcccccgcaagcccctgaaaaacacactacggggtttggcagtctttgcggtattggtttggattggctatgtcggtgtgatgataaccaatgtccgtggtgccgggcaaaagttcgttggtataaaaacgttcgctaaccaactggatcagcgctggaatgagctttatccgactccattgcgttatgttggcggagaatatctgcatcaatggctgacgttttacagtcattaccgcccagaaacaatacagccttgggagttaggtaatggtgagccccctaatgtgtataatcgccatatcaaagagagcagtattgtgaaagagggtgcgttattggtgggagagaaaggtaagagctgcgaacaggaaaacttccagtctacactcaagcaatggccagtgttggtcatcagctacaaggaagaattctccttccggccacagccgagtgccaaaactgaaaccgtctgtatcggtttcgttacccctgaaaataatcagtaa

SEQ ID NO: 1795 - DNA, 600 bp, Xenorhabdus bovienii
  Coding sequence Name=Xb4151_4152.C430.gene14.dna; Position on contig =6962..7561bp; Strand=+
gtgaatgacattggatgttataggtggtttctgttagattccgcgaaaaatattctgattaagcgagtaggatcacaagctatgaaccagttaaagaaaaagtcaccagcgaaattttcggctggtaagcaaaaaagaaaaagccgtgaagagttgaatgctgaagggcgtgagcgtaaacgccagaaaaaacacagtggtcacccatctggtaaccgtaatcacggtaatgacagtaacaagaatcgttctggagacaagcaggggcaagatccgcgtatcggcagtaaggttccggttcctttgattattggcgaaaaagtcgtggtaaaaccggttgtggaaaaaccgaaagccagccagaagccccgtctgtcaccacaggaggagctggcaatgctggagcaggatgagtatctggatgagttgctggcacgtctcgagaagggtgaagaactctctcaggaagaaaatgcttatgttgacgagaagctggatcgtatcgatgagttgatggaagaactgggcatcaatctggaagaagatgacagcgaagaagagaagaaagaagatatcatgcagttgctgaagggtaagtaa

SEQ ID NO: 1796 - DNA, 177 bp, Xenorhabdus bovienii
  Coding sequence Name=Xb4151_4152.C430.gene15.dna; Position on contig =7616..7792bp; Strand=-
atgactggctctgacatactgattccttccgttgttttcgccccccgaaacgcaacgcttttactgaattacagcgctgtgttccgatggcacgagtcaaccaatttttacgtctcaatagctgccatagtttacccaataaccacaataaataacatactaatactgtggttataa

SEQ ID NO: 1797 - DNA, 1374 bp, Xenorhabdus bovienii
  Coding sequence Name=Xb4151_4152.C430.gene16.dna; Position on contig =7776..9149bp; Strand=+
atgtcagagccagtcattgtttgggatttacctttggttcagaaatataactattcagggcctcgttacacttcatacccaacagctctggagtttaaccagcagtacgataatactgcttttgcacaggccgccgcgcgttatcccgatcgtccactttccctctatatccacattccgttttgccacaagctctgttatttctgtggctgcaataaattggtcactcgccagaagcataaggcagatgactatctgaatattctggaaaaagaaatcacggcacgagccagattattctcccagcggaaagtcagccaaatgcattggggtggcgggacgccaacttatctcgacaaaacacagatcagccgattgatgtcggtgctgcgtagccactttgattttctgccggaatccgagctttctattgaaattgatccacgtgagatcgagctggatgtgattgaccatctgcgccatgagggttttaaccgcctgagcatgggagtacaggattttaataaggaagtgcagcatctggttaatcgtgagcaggatgaggattttatcttcgaactggtcaatcgcgcccgcgaaacgggttttatttcgaccagcattgatttgatttatggcctgccgaagcagacatcagagagttttgcctttacattgcagcgggtgctggcgttgtctcctgatcgcctgagtgtgttcaattatgctcacctgccggacttgtttgcggcgcagcgtaaaatcaaggagcatgatttaccgagtgcggaacagaagctggatattttgcagggcaccattgctaccctgacgggcaatggttatcagtttattgggatggatcactttgcccgccctgatgatgaactggcgattgcccagcgggaaggtgttttgcaccgcaattttcagggatacaccactcagggagagtgtgacttattgggcatgggcgtttctgctatcagcatgttgggcgatagttattcccagaaccagaaagatctcaaaatctactacgcggcggtggaagaacagggtcatgctttgtggcgtggtttagtgctgacacaggatgactgtattcgccgtgatgtgatcaaagatcttatctgcaactttcggctgacttttgcggatatcgaacagcgttatgggttgaattttgccaactattttgccgaagacctgcaactgttggctccgctagtggaagatgggctggtagatatcacggagaagcagatccaggtattgccaaagggacggttgctgatccgcaatgtctgtatgtgttttgatagctacctgcgtaatcagatgcgtcagcggcagttttcacgggtgatatga

SEQ ID NO: 1798 - DNA, 1431 bp, Xenorhabdus bovienii
  Coding sequence Name=Xb4151_4152.C430.gene17.dna; Position on contig =9166..10596bp; Strand=-
atgcaacgaggaaaagtctggatcgttgatgatgacagttctatccgctgggtacttgaacgggcgctgagtggcgcaggtctggagtgcgtcagttttgaaaatgccgattccgtgctgacagcactctcacagaactgcccggaagttctgctgtcggatatccgtatgccgggtttagatggcctgaatctgcttaaccagataaaacagagccatccacagcttcccgtcattatcatgacggctcattccgatctggatgctgccgttagtgcctatcagcaaggtgcattcgattatctgccaaaacccttcgatattgatgaaactgtcacattggttgagcgggcattgagtcattaccgcgaacaacatcaatcatcgcgcaatccgcaagtggcagcctctgtttctgagataattggggaagccccctccatgcaggaggtataccggattatcggccggctttctcgttcctccatcagtgtcttaatcaatggtgaatcgggaacgggcaaagagttggtcgcccacgcgctgcaccgccacagcccacgagcttcatccccttttattgccttaaatatggcggcgatcccgaaagacttgattgaatcagaactgtttggtcatgaaaaaggcgcttttacgggtgccaatcaagtccgacacgggcgtttcgagcaagctaatggtggctcgctattcctggatgaaattggcgatatgccgctggatatccagactcgcttactgcgagtgctggcagaagggcagttttatcgggtgggtggctatgcgccggtgaaagtggatgtgcgcattattgccgccacccaccagaaccttgaacagcgtgtgacggaaggtaagttccgcgaagatctctaccatcggctgaatgtgatccgtgttcaattaccccctttgcgggatcgcgtggaagatatttcccgtctggcacaccattttctgcaacagactgccaaagaattgggcgttgaggccaaagtgctgcatcccgataccgaaatcgctctgatgcgcctgtcatggtcggggaatgtccgccaattggagaatgtctgccgctggctgacagtgatggcagccagcaaagaagtgctggtacaggatttgcctgccgatctgattgagaaccctccaacggaacaaatcggcaatcttccctcctcctgttctgcactgcctgaacactggccgcgacaattggctgagtgggcacagaacgccttaaaagaaggacgcactgatctcctttccgatgctttgccgttgctggagcgtaccttactcaattgtgcgttggaatatacgaacggtcataaacaagaagccgcacgtttgctgggatggggaaggaatacgattacccggaaattgaaggagttagggatcgcgtaa

SEQ ID NO: 1799 - DNA, 1044 bp, Xenorhabdus bovienii
  Coding sequence Name=Xb4151_4152.C430.gene18.dna; Position on contig =10621..11664bp; Strand=-
atggttgattttcccaaagcagaacacatactcgactcactgattaacagtgtcttggtactggataacgatttgattatccgctatgccaaccattcagccatgcaactactggcacaaagtacgcgtaaattattcggtactccccttccggtgctattcagctatctctcactggacacagaattgatgcgttccagtttgattaggggtcatggttttaccgataacgaagtgatattggtgatcaacaatcactctcatgtaatgtcgctcagtgcccaacccatttccgaacagtttattctgctggaactcgctcctatggatagccagcgtcgtttaagccaagagcagatacaacaggcacagcaggcggctgcgcgggaattggttcgggggctggcacatgaaataaaaaatccccttggaggactgcggggagcggcgcaactgcttgcaaaagcgttgcccgatccctccctgcgggaatatacccaagtgattattgagcaggctgacaggctgcgcgccctcgttgatcgattgttgggtccacagcatccgggaacccgaatcagccagagcatccactatgttgttgaacgggtttatcagttggtatcattggaaatgcccgccaatgtcactttgatcaaagattatgatcccagcctgccagagctggcgcattatccagatcaaattgagcaggttttactgaatatgacccgcaatgcactacaggctctgggggaaaaaggtggaacgatcatcctgcgaacccgaaccgcgttccaaattaccttacatggtgaacgctatcgtctggtagccagaattgatattgaagacaacggcccgggcattcctcccaacattcaggatacgctattttatcccatggtcagtgggcatgaaggaggaactggacttgggttatccatcgcccgtaaccttatcgatcaacacgctggcaaaatcgaattcaccagttggccgggtcacacggaattttccatttacctgcctatcaagaaataa

SEQ ID NO: 1800 - DNA, 246 bp, Xenorhabdus bovienii
  Coding sequence Name=Xb4151_4152.C430.gene19.dna; Position on contig =11691..11936bp; Strand=+
gtgcattgtaccttagttaagcataaaccgggcagtctctccgtgcagtctgtgatttgtttatcaagtgtcatctgccgtcgcaaatgtgcaggaaaaggacccatccgaagatgggtcaaaagtttcacggcaacaaaaagggcaattgtgatgctatcaagtattacacgctgtaatacagttcaaattccagcggatgtggcgtcatgcgtactcgttcgatttcaccatgcagtaatttga

SEQ ID NO: 1801 - DNA, 1410 bp, Xenorhabdus bovienii
  Coding sequence Name=Xb4151_4152.C430.gene20.dna; Position on contig =11857..13266bp; Strand=-
atgtccgttgaacatgttttgtccatgattgaagaacatcaggtgaagtttattgacttacgttttactgataccaaaggtaaagaacagcacatcaccattccttcccaccagattgatgaagatttcttcgaagatggcaaaatgtttgacggttcatcgatcggtggctggaaagggatcaatgaatctgacatggtgttaatgccagatccaacgaccgcaatgcgagatcccttctttgatgacgccacgctgatcctgcgctgtgatattctggaacccggtaccatgcagggttatagccgtgacccgcgttcgattgccaaacgcgcggaagatttcctgcgtgcaagtgatattgccgatactgtcctgtttgggccagagcctgagtttttcctgtttgacgacattcgtttcggcaattccatttcgggcagttattaccatatcgatgatattgaagctgcatggaacagtgggacacgctatgaaggcggtaacaaaggtcatcgtccgggcatcaaaggcggttattttccggttcctcccgtggattcctctcaggatctgcgttcagccatgtgtctgacaatggaaaaaatggggctggtggttgaagctcatcaccatgaagtagcgaccgcaggccagaatgaaatcgcgacccgctttaatactatgaccaaaaaagcggatgaaacccagatttacaaatatgtagtgcacaatgtggcccattcattcggtaagaccgcaacgtttatgccgaaaccgctggtaggcgataacggctctggtatgcactgccacatgtcgctgtccaaaaatggtactaatctattcgccggtgataaatatggtggcctgtccgaactggcgctttactatatcggcggcgtaatcaaacatgcccgtgcattgaatgcctttaccaacccaaccactaactcgtacaaacgtctggttccgggttttgaagcgccagtgatgctggcttactcagcccgtaaccgctctgcctccatccgcattccggttgtggcaagcgccaaagcccgccgtattgaagtgcgtttccctgatccggccgcaaacccttatctgtccttttctgccctgctgatggcaggtcttgatggcatcatcaacaaaatccatcctggcgatgcgatggacaaaaatctatatgacctgccggcagaagaagctcaagagatcccaaccgtcgcctcttctctggatgacgcgttagccgctctggatgcagaccgggaattcctgactcgtggtggtgttttcactgatgatgccattgatgcttatatcaaattactgcatggtgaaatcgaacgagtacgcatgacgccacatccgctggaatttgaactgtattacagcgtgtaa

SEQ ID NO: 1802 - DNA, 165 bp, Xenorhabdus bovienii
  Coding sequence Name=Xb4151_4152.C430.gene21.dna; Position on contig =13278..13442bp; Strand=+
ttggttgacgtcagcctgataattcggcgcaagggacatgcggcgttatctaatgggctgaaatgggctgatgatgtgtgtctctgtatagggtcaatgtttataaaattgatgcttatgagaagagtattgcgagaagtgtgccaactttttaaaagtctttaa

SEQ ID NO: 1803 - DNA, 108 bp, Xenorhabdus bovienii
  Coding sequence Name=Xb4151_4152.C430.gene22.dna; Position on contig =13429..13536bp; Strand=-
ttgctcacctacttcactaaattagtgcaattttacttaaaacttgactgtgatttcttccgtttttacccactaacccactcatccgctgatcttaaagacttttaa

SEQ ID NO: 1804 - DNA, 108 bp, Xenorhabdus bovienii
  Coding sequence Name=Xb4151_4152.C430.gene23.dna; Position on contig =13670..13777bp; Strand=+
atgatctcaactagaaacattgctcttgctcatataaaaactctgaaaatgcttaccgtgggaggccattcccacggttttctgttaattccggtggcattttcttaa

SEQ ID NO: 1805 - DNA, 2955 bp, Xenorhabdus bovienii
  Coding sequence Name=Xb4151_4152.C430.gene24.dna; Position on contig =13778..16732bp; Strand=-
atgaaaatatacagatacgctgtattgccaatggctcttaaagtagctttatttttttctggaataagcggtaatgcaatagctgcatcaacatgtggacccacaatttcccaaaataggacgacaccctgttatctctcaaataatgaaaatcttactatcgataaaggtgtatcaattattgttcccacagaagggttcatggcaagccaatatgataaatactctgggaaaacctctgctgtcaatgtcggtaatgaggatattaaggatccgcttattacggttcataacattgaaaataacggaattttgaaaggaactaatggactcgtagtaactcccagtggtcttgttgaaaaactggttaatcgtggaaccataagcaccataagcggcggccctgcactatcaggtgtaactgttgctggtaccctgaagacactggagaattatggttcaatcatagaccctgctggtgctggtggttcaatatttatcatacctgagcttgttattaaaaatcctcattacggaaaaatagataccatccagaatcagaagggaggatcgattcaggggatcattatgaacgggggaacacttacaaatcttaataattatggaatattgtctcagtcgagtagtagtaacttcttgcctcccggagctttgactgctgcatacggcgctgatgtcggaattttcaataattatggaacagtggctgtatccaataaaggcattatagttagccaagggtcgactctcaaaggcctcaataatcaggttgggagtaaaggaataattgccggtgtgaatgccattgaagttactgggcaaggcccggctagtgatagtaagaaaatccagccgtccagaattaaaaagattaccaacgcttccaccatatatggaaatacaaaaggtatttatgtcgacgataaaggtgttattgagacaatcacgaatacggatacaggcgtgataaaagggattatattctctatccataataagggaactatcaccaacggcattgataatgcgggcacgattgacggcaatgtcgagcttggaagcgccagactttatctgtctggcccgaaggcaatccttaaaggagatgtttctgggacgaaagattcgattgttactattgggaatatgaaccgtactgataaagcgaaaaatctagattttacatacacccacaacatgaatgtcggaactgttaagatatcatcgggaaataagttacgtttaggcgacggacatacaacgggaaaaatttctggcaatatagttaatgatggagagttttatttcaatcgcagcgataaagtgatttatggtcataatataagcggtgcaggctctgttcaccaagtgggtagcggcacaaccatttttcagagggcaaacaactatgcaggcgcgacaacagtccaacaaggaacacttctccaaggcgcagagaagtctttcagcccattatcatcctatacaatcgggcaacgtggtacgcttgatatggggggatttaatacgacaattcccgctttaaataacagtggtagagtcgtgatgggcggagatagcaacgctgtagggagtatgctgacgattacgggtgactatagaagtaataacggtacggtgagtttatcaactgtattgggagatgatagctcaaagactgacagacttgtggtgaatggcaaaacatcgggtacaactcatctcgtgatcaaaaatgttggtggaaagggtgccaaaacgaacgaaggtatcaaagttgttgatatgaaaggtgcagcgggcggaaatttcagtttggctggtgactatagccataagggtaatccaactcttgtaacgggtgctcatgcctaccgtctttataagaatagcgccgacaattcgttgtatctgcgctcatcgtcggataattcaaaacccacatatcaggcaggcgttagcgtttacgagagttatggacggatgttgcagattatgaatgcgccagagtccttgcgtgaccgaaccggaggacgtaaggatcgggtgcttggcacaggtgaattcagaagctctgctgccgaagacagcactgacgatagtacaagccagatgcccactggggtatgggggcgaataaccgcttcttacggtaaattgtcgccacgtgtctctacatccgatgcgaatgcaaccacctataacatggttcgtgctcagattggtatggacaaacgtttttatgaaaataaccagggttcagtcacgggcggtggcttcctgcaatattcgaagattgatgcagacgtaggctctccgcatggtgacggtaacattcgtgcaaatggttatacgtttggtgcgaccagtacgtggtacggcaagaataagttttatgtggatggcttagcccagatgacctactttgacaacgatctgcattcaaagactgccggccgagctttgggaaatagtaaatccgcgctggggtatgcattgggtctggaagcaggacaagagattggcttgaatcagaaatggtcaatgaccccacaagcacaactcgtatattcttccataaatatgaatgggtttcatgatccgtttggagccaaaatccgttttgaccgaagccaaagtctgaaacttcgtgtaggcacgacgatagactatcgtcaaaaagccacacgtttatatggttttttcaatattaatcaagaggttttgggaagaaatgactcggctaaagtcgccgatgttgcctttatcagtggcaatgatcgcacttggggagacggaggggcgggtggttcctatagttgggataatggaaaatctttcgtctatgctcaggcttcagccagcaccagcctgaataattttgcagacagctacgatctgaagggccaagtcggactaaggacaacgtggtaa

SEQ ID NO: 1806 - DNA, 126 bp, Xenorhabdus bovienii
  Coding sequence Name=Xb4151_4152.C430.gene25.dna; Position on contig =16983..17108bp; Strand=-
ttgtctgtcattcaatataaaattaaatattatattttaagtagcgagggaagccggccttacctgttccgtgtttgcgtacagattcagcttggtcgcaatatcaataagtcacttctatcgtaa

SEQ ID NO: 1807 - DNA, 1827 bp, Xenorhabdus bovienii
  Coding sequence Name=Xb4151_4152.C430.gene26.dna; Position on contig =17389..19215bp; Strand=-
atgattgttaatagaattgatattaatacattatcatatcaacaatataatagagagaaaattatgagtaataaacttccagccccaattttgccacaaatcaataatgatactttagatttaaaaaaaattgagggtgatattattataaaaatagacaacagcgctcaagtcttctttgatcgtgatagtattatggcctgtttcaacactatttgtggggaatcttatacagtccgtaattatactgaatcttattttgagattaaaatacccaaaaataaaatttcgcctggccaatacttggttcattatactgtaataaataatgacgataatatatcgtattctcccataactcacataaaagttatcgatggcacaccgacaaccccaccatcagacaaagaaccctttatcgttatgggtgctcgttatgctgaccttgctgtagctaatgggcttaaaacaccacagaggctgactgcctggactaaagagggtaagccacatccagtaacatggacttatataggtggaacaccatcatttacttctcctttttcacatattaattccccatttttctatgattctgctccgtggctccccatttcagttcaagacgagcaaggtaacaagctcaaaataaacccaatcaatgtgtttggtaatggtggtacgctaggtcttccaaaggcagattttaacgatccattggaagagcaatatccctctgcttttgctgtgctgctcaatgacaacaccatggttggttggggaggaaccttcggtaattcctatactcaatctggagttaaaaccattactacaaatggcccctcttatgctgggcttaatgtggattcagggacattatggtatcacggtgattctaatcactctaacttccctactggttcctttgatgatgtgggggcaggtggaaatagcttttttgctatctcgcacactaaccagcagatggaagcctggggagcaatgacgggtatttttaattatcctggagatggaaagaatgtttttgtaggaaatagttttgctattactatatataatcccggtacggaacagatacaaagtttgtggggctcatcaatggagaactggcagttagatccagatccacgttattcttctgtttcgaaaccacgttacattacatcaatggcaaggggattcgccgttatagacgaaagtggtgatctttctacttggggtgattcaagtgtatttgtcggctttaatccctcacatcaggatttcatacaagctgcttcaattactccctttcttatgaattttaacgtcccattcggtaattacgcagttcaccgtgatggtacattatatgcttggtcggttccagccagcagctccgatggcgattcatgtagtaatggagtagatatagcaaccactaaacaaaaatttcttatgccaggaggcacccctccacatggaaaaatatattgggatggaatacagaattataacgacggcccagtgttcgaagaatttatggctctcaaagatgtggttcaaataacttgctcagctaatgcatctgcggcattacgtcaagatggtaccgtattaacctggcaaaatgctgaacctagtaacgttaactttataccccaacctgaaataaagaatgtaagagccatctactcaacaggaacagcatttcttgctctgacagcagataacaaagtccatacctggggtggttctgatggtggtggagatagcaatgaagtacaagcactattacagggtaagctgacctattatatggattaa

SEQ ID NO: 1808 - DNA, 1560 bp, Xenorhabdus bovienii
  Coding sequence Name=Xb4151_4152.C430.gene27.dna; Position on contig =19205..20764bp; Strand=-
atgagtagtcctgtttctctttctgtcccttatggttctagcgttataataggtcaaagattgaatttgaatgtaactctgacatctgatgttaaaatatcagataacacttatattcaaattataaatgcagataataaggttacattattagactcttcccgttcagatgaggattctgggttatttacgctttttttagaaatatctccagatataaatgatggggatagcatcaactttggactatatatatcaagtaacgtttccttcccaaatacaacagttatgtatactggaagaacattaaaaaatgattcattaacactttcttatgacaaaaatgctttagaggtgccaactcaaccaaattatccacctagtggaaatgagggtaaatcacggactagagttatggcaacagttagagatgagcaaggtaaccctatacctaaagtctttgtatttatttcttctttaaatccaaaagatatagaaaaagtcaatttgtatcaatctgacaacaaaacaaaaataggaatagaaaaaaatattaacgacgaagggatttttctgtccaccgactggcacggtaatttagtcttttatatttatgctaaagaactgcagcctatatctcttgaattttatacaagaatatttggtattacgaatgagattcctgctgatagtgcattgaatattgtaaatgataaaccagaaaatccgaatgattatttagccgctcctggaattgaagggtatgataatggcggagaactaacaaaccatggacaaacaaatttcttaatagatattcctccttaccccggtgcgcaaaaaggagatatgattaaaattcgcattaataatgtcagtacaatatatgaatatcctcttttgcaattaagtgagcttgggaattactcttctttttcaatgccttattttgcctttacagtaggcgcagtttctaccttttcctacgtagtttttcgccaaggcagagatacgttatattcaagatcccttacactaacatatacaggagagtcatggcctaagccagtttattatgacaaatgcgtagtttattctagttttggggttaatgatcccaataatattatagaagaagcagaccctaaagattgtgagcacgccacttcacataatactgtgaattgtaaagcaatctctaaaagtcatgaccttgatgatcccgcattatttgttcaaattactggaacaaatgatatcactgataagaccaagccaccattaggtagtatggtagacttaacattgcatataaaatctaatcctagaactgtaataaaaacttattctaaacagataccttctgtagctggccctgatggtcaaactacaactactactataaatattgccagaaaatttgttagggactgccatgaatttaaggactgcacggctggccgtatcgagtttagctatcaagtacgatcagaaaatacccattctcagacttggataggaagaatagataccgcctctaccggagaggatgattgttaa

SEQ ID NO: 1809 - DNA, 1518 bp, Xenorhabdus bovienii
  Coding sequence Name=Xb4151_4152.C430.gene28.dna; Position on contig =20866..22383bp; Strand=-
atgattaaagttagtgtttctgtaaaaccaaactctgatgtaatcatcagtcaagaattcatagcagaaataaaattaacatccaatatacctatagataattctatttccatctctttagaaaatacgagttatatctcccctgttggaaaaatttcgtccttcaccccatcttataataatacatcaggatcattttttgtcagattattggtatctgataagatcacctcaggtgagcttgtttcttttgatatcaaatcctcatattttggcacaaaacatgttgaatatgtagctaaacatatacaacaagaaacattatctcttaaattttataaaaaatatttacctacaccagatcaacctaattttccttcacaaggagaaatctgcagtaaggtcatgacaactattaaatcttcagatggacaaccattatctggaacgccaatatttattccttatctatataattttaaggatttcgatatctatgactctgagaaaaataaaattgaagttacttctgctcctatgaaaggtttttttataaactcaaatgaaaagggtgaagtgatattttatgtttatcctcatataggagtcgctactaagataactttagattcaatgatttataatgcaacatcttctattcattctatgaacgaattatatgttgccagtagccaacctcaaggtaatgatagcttattagatccccctgatattgaaaatatacatggagaaaacttgacatcgcctaattcttttatattcaaaaccaaagtagaccagtatgataatgcaaaatctcaagacacaatattgttctttgttaacaatatatttactggttatgcatttactatcgaaagcattgatgatttaggtgggtattctataaaactaccctataaaattttcgagaaatataaagacgtcgcttgctcattttattatattattttttctgttaacgaaaatgtttattattcatatccattgagtattgtttttaaaggaggagttcctaatacaccccagccagacatcaatagaatatacaatacttgtgtagtttataatagtgctggtatttcccctgataacattctacaagaaatggattatgttgatagcactgaaatatctaactataggaacaatcctgacaatgctggattatttgttcaaattatgggaaccaacgatctaaaagacaattcaaacgtgcctcttggttcagaggtttttctaaatttatatattaattctagtactaaaacagttcatcattcacttaaaaaaacaatgcaaaacttaccagacggaaataataattcggcaaagttaatatttaatataccccatagctgtttaattgattgtttagcttatccagatagaggcggtgatatttactttgattatcaaattggatttgataatgacgatgatctcacatatggtaaagtctggcaaggacgtatagacaccccaattattgattga

SEQ ID NO: 1810 - DNA, 267 bp, Xenorhabdus bovienii
  Coding sequence Name=Xb4151_4152.C430.gene29.dna; Position on contig =22405..22671bp; Strand=+
atgcattacgttatgagtcattcttcttttttaaataaaatagatttaaaaatgaatttaggtttatattctattgttttttcttcttcaatttttatggttgtaataattgttttatttttagtaatctttaatttaaggtctttctgtgtcaatttttccttgccaaattttcccataatatttagttccagagtttcctgggtcagatggatcataagcataatagtcaaaatagatgtttccagcagaactattaggatatga

SEQ ID NO: 1811 - DNA, 1530 bp, Xenorhabdus bovienii
  Coding sequence Name=Xb4151_4152.C430.gene30.dna; Position on contig =22540..24069bp; Strand=-
atgacaattacttttttaaaaactcctgaaggaaatttttcacctaatgcctcatttgacatcataaaatcagttaatcttaagccagtacatcctagttatacaatacagacaggaggctcaatagagattgcatttactcttgaaaaagaattagcagaccgaagtacagttagttttgatattgtacctcataatgcaagtggatttcttacaacatcttttagttatactgttgtggaaatagacaataactcattatcccttacctttggaaatgaatatttaaatgccataactaaagtagaaaatgttagttctaatattccaccaactggtaaaatatactctaaagtttttgccacaataaaagctaaaaacggtggtcaaagtgtatctggaattcctatcactataatgtcagatcataatactagtttagataatgttagaactttcagagaaaataaaagtcagtcatctgaaataacaaaaaaaaccttatataacagaccagttttttatttagaaacagaacaagatggtatggttgttttttatgtatatccggataacaataccgaatttatacttaatttacaagccagagtaactgacacacaaagttttcaactatcaaaaaacagtttatttgttattgatgatgatccaactaatccgggtaatctatcaaatattaatactgattttttagcccctccctctattctagaagtatcagatggtgcgttaataggagaccctgattcaacaactttttctgttgaagttgatccatacaatcatccaaatagaaatgatactatattattctatgtcaatgggagttactcaaatcaaaaaatcattgttgaaaataaaaataatctaggtaattattttattgatttaccttactcgattatacccaaaaatgaaaatattgaattatcttatatcgttgttacacatgatgcaaaaataaaaaaatcagcatcactaggattcacctacagtggaggaggtaagagcgcacctcttgatgatatcaataggatttacgatccatgtgttgtttattctagttttggtgcttcacaaggaacggctctaatccatcaaggtgatttaataaattatttctctatatctcatgattctaataagaaaaaaagcacagcgttatttattgaaatagaagggactaatgatattactgacaaaaccaaagtaccactgggttataatgttgtagtgacattatatatagattcttataacaaacaatttcaacattcatttaaagttattactatgcctgcaacccctgttccacacagcagtcatacagcaacacatatatttgagattcctattgattatctaaataatatagagtcatatcctaatagttctgctggaaacatctattttgactattatgcttatgatccatctgacccaggaaactctggaactaaatattatgggaaaatttggcaaggaaaaattgacacagaaagaccttaa

SEQ ID NO: 1812 - DNA, 138 bp, Xenorhabdus bovienii
  Coding sequence Name=Xb4151_4152.C430.gene31.dna; Position on contig =24005..24142bp; Strand=+
atgatgtcaaatgaggcattaggtgaaaaatttccttcaggagtttttaaaaaagtaattgtcatttttagtaattggactttggctatatttgattttgttggtattgatgaaattatagtattttccactgtataa

SEQ ID NO: 1813 - DNA, 123 bp, Xenorhabdus bovienii
  Coding sequence Name=Xb4151_4152.C430.gene32.dna; Position on contig =24470..24592bp; Strand=-
atggatgctttttttggtttagcgattaatcagatcgtccaattcggattgagttctctgcaagtgatctattatttggaacagctatttagagaattttacaatgaacttatatttaattga

SEQ ID NO: 1814 - DNA, 309 bp, Xenorhabdus bovienii
  Coding sequence Name=Xb4151_4152.C430.gene33.dna; Position on contig =24646..24954bp; Strand=+
atgcaaaaaactattcagaaaacccgcgataaaatcatgcccaaagaattatcgccatactcatgctgtatcgcggagacaccgtcagctatgtcacgcgctcgcgtgcagtcgttcttctggcgctcgctggatacactttatggcctggaaggcttgaaaccactctcttctggtcgtccacgacgttggccatttgaattgatttgttctttgctacgtcaccttatttcagattctcccgacgtattgggttatcaacgctcacgcggggtcattgatataatcaattataaatcaatgagataa

SEQ ID NO: 1815 - DNA, 189 bp, Xenorhabdus bovienii
  Coding sequence Name=Xb4151_4152.C430.gene34.dna; Position on contig =25050..25238bp; Strand=-
atgaaaaatcaagcatcttcaatgacgacgggtatagaaggcataaataatggacaaataaagataaaaaaaccaatgattttacaaatatatgatgacatatataaccacccaaaagtacatcaaattatgattaacagcctaatcctcaatattagaaaatatttttattattgtgatgaaagataa

SEQ ID NO: 1816 - DNA, 1050 bp, Xenorhabdus bovienii; identical to SEQ ID NO: 483
  Coding sequence Name=Xb4151_4152.C430.gene35.dna; Position on contig =25251..26300bp; Strand=+

SEQ ID NO: 1817 - DNA, 114 bp, Xenorhabdus bovienii
  Coding sequence Name=Xb4151_4152.C430.gene36.dna; Position on contig =26314..26427bp; Strand=+
atgggaagacagagtattgtaaaaaacaaactaagcatatgtaaccatatgcttagttttatatttttaattacacaccttcatatttttgacatatttattaggtgcaattaa

SEQ ID NO: 1818 - DNA, 369 bp, Xenorhabdus bovienii
  Coding sequence Name=Xb4151_4152.C430.gene37.dna; Position on contig =26380..26748bp; Strand=-
atgtcaattattttcttatttattacaacattgtttttatatttttcttggagggacttcatgtcattcattaacatgaatgacataatatatttttcttggagggtgttttttgcatgttttggcttgccaatagtttactatatgtttggtttggcaataaaaaattgtttattaaataaaccatcgccattttatggtttttttttgaatttatgcgtgttgatttttatattatctatcgtggctagttttcctgtatctatatatgctgatcataaattgaaaaaatctggttatattaaatgtgaaaaaacttctttaattgcacctaataaatatgtcaaaaatatgaaggtgtgtaattaa

SEQ ID NO: 1819 - DNA, 174 bp, Xenorhabdus bovienii
  Coding sequence Name=Xb4151_4152.C430.gene38.dna; Position on contig =26812..26985bp; Strand=-
ttgattgtttttggtttagttgtagccggtgtattatattatcttgatgataaatatcaagtaagtgagaaactcatagaagcattgagaaatgaagaagcaaaaaaaaggtttcgggagcacttagcaaacccaaaatataatatgccaagacctccaattttttataggtaa

SEQ ID NO: 1820 - DNA, 138 bp, Xenorhabdus bovienii
  Coding sequence Name=Xb4151_4152.C430.gene39.dna; Position on contig =27010..27147bp; Strand=+
atgtttctaattctaatgataagactctgccatcagaaacacgcatattcaccccatctgtctgagttgatgacaatagttgaaaacaaaacatcatcatcacagccagcttatcctctgatttcaccggactattga

SEQ ID NO: 1821 - DNA, 150 bp, Xenorhabdus bovienii
  Coding sequence Name=Xb4151_4152.C430.gene40.dna; Position on contig =27693..27842bp; Strand=+
atgggtctgtcaggagccggatgcggtagctctgcaagtccggatttcatcgatagcctagacacacacgctgttcagtttgttcgtactatccagtccgtcaaatataagatcctcgatcttgctcacagatctacatatttttcctga

SEQ ID NO: 1822 - DNA, 105 bp, Xenorhabdus bovienii
  Coding sequence Name=Xb4151_4152.C430.gene41.dna; Position on contig =27876..27980bp; Strand=+
atgacttctttattttacatttttgctacaagtttgacgaaaatgcaactattaaatatattaaatcataggttatattttatgcattcaatccatcgggggtaa

SEQ ID NO: 1823 - DNA, 1431 bp, Xenorhabdus bovienii
  Coding sequence Name=Xb4151_4152.C430.gene42.dna; Position on contig =27983..29413bp; Strand=+
atgccggtaccaacgtttaagcatttcattaatggtcagtatattgagtctcaaggttccgagtattttgatctggtcagcccggtcactggtaaagcttatgcgcgttctcctaacgcgactgtagcggatgttgatgatgcttatgcatcggctaaagaggcatttaaaatatggggacgcagtacaccctctgcacgtcagcaggcgttactagcgctggctgatacggtggaaaaaaacgctgaacgtctgattgagtcgcaaagccgtaatacagggcagcttaagcacctgattgcctccgaggagattgcgacgtcggtggatcatatccgcttcttcgccggtgcagctcgttttctggaaggcaaggctacagcggaatatctttctggtatgactagcagtatccggcgtgaaccgctgggcgtggtagggcaggttactccatggaactatccgttgatgatggcggtgtggaagatagctcctgctctggcagcaggtaataccgtggtgcttaaaccgagcgatactacgccggaaagtactctgttgctggctgaactgtccgctccgttcttccctgccggcactttcaacgtggtgctgggtaatgccagcgcaggttctctggtcgtttcacacaaaacgccggctatggtttccatcaccggttccgtacgtgccggtttgcaggttgcgtcttcggcggcagctaatctcaccagagcgcatctggagctgggtggcaaagcgccggtggttatttttgccgatgcggatatagacaaagccgtgggaaccattgttaccgcagggtatttcaacgccggtcaggactgcacggcagcttcacgtgtgctggtgcatgaatctgtttacgatattttcgtcactaaactggtggcggcagctaaagctacccgttttggcgatccagaagataaagaggcgctgtatgggccgcttaataatgttcgccagttggagcaggtcacagggttccttgcacgtctgcccgctcatgcccgtatcgaaacaggaggtcgtcaggctgatcgttcgggatattactttgaacctacggtgattactggtctggagcaagaagatgaaatgattcagaccgaaatttttggccctgttatcacagtacagaagtttctaacagaacaggatgctatcgagaaagctaacgatgtgaaatacggactggcctccagtgtctggacccgcgaccatggtcgcgcgttgcgcctgtctcgtgagcttgactttggaacagtctggattaacacccatattcctcttacggcagaagcaccccatggcggcttcaagaactctggatacggtaaagatctgtcggcttatggtttcgatgaatatacgcgtatcaaacacgtgatgagttccaacgactaa

SEQ ID NO: 1824 - DNA, 774 bp, Xenorhabdus bovienii
  Coding sequence Name=Xb4151_4152.C430.gene43.dna; Position on contig =29429..30202bp; Strand=+
atggttcaaaatagatcttcacgtgacttggtatcgcgtgcgcaccacgagctgtttactgatcgtgatgtgagggcgcttgaacgttattttgcgccaaatttcatcgaacattctccgttggttaaagaggggttcgccggattgcgtgagcgggttcaggcacatcctgaactgcaccatgaaatgtatcgcgtactacaggatggtgacttagttgctattcacggccgttttacgggattagatgagcagccgttggtcggtttcgatctgtaccgggttgccgatggtttaattgtggagcactgggacggcttagtgccgcagtccgcgcccaacaccagtggccgaactcagttagacggcccgactgaaacgggctatagccatgacagagagaagaaccgcgagctggtggttaactttttcacccgtaccctgatcgaagaacactatgatgagtttggaaactacaccaatggtgaagagtttcgtcaacacagcccggatattcctgatggtacggttgcggtcattgagtttcttaagcaactcaaggatgaagggcagggcctgcattatgccaaaatccaccatacagtcgccgacgggcagtttgttctgagccactcggagggaagtattgccggagtacgtcacagctactttgagctatggcgcattgagaacggcaaagtggctgagctttgggatgctatcacaccggtaccggaggatgcgcaagcgctgcatcgccacggtatgttttaa

SEQ ID NO: 1825 - DNA, 756 bp, Xenorhabdus bovienii
  Coding sequence Name=Xb4151_4152.C430.gene44.dna; Position on contig =30256..31011bp; Strand=+
atgacggattattccatcatctatgcaccgctcgatcaggctacccggactgaacaggttgtcgaacgtttaagtaacgcaatcatctccgggatattacagactgatgcacagctgcctaacgaaaatgaactgtcgcggttgttaggtgtgtcaccggtaactgttcgtgacgccctgaatacgctgcgcgccagacagttgatcgatactcggcgcggacgtcatggtggtagttttgtatgtcaggttcctgttgaggcaatgcggaaataccatccgttgcggctgatggcttcaggtgaactggcggatttcagtgaatttcactgtgccgtgatcggccacagcgcgaggcttgcggctcaacgttcaacgcagggtgaactgagaaagcttgagcaactgatcgacagctttgcggccgcgacacaaccggatgcccgtattcagacagatatgcgctgtctgttaacgctggcatcccagtcacagtcggctaggcttgccaatcaggagctggagattcaggccgaatggacgcctttgatggggcttctgtaccaagaggctgccgttcacagcgaggttgtcgccgcctggcgtacactcttggctgcgctgtatcagggtgatgatctggcctgttaccagttggcgcagaagatgattactcaaattactgaccacctgcttgaatgcaaattgcgtgtggatactgatgcgccattcttgcagagatctgatcgcgagtaa

SEQ ID NO: 1826 - DNA, 750 bp, Xenorhabdus bovienii
  Coding sequence Name=Xb4151_4152.C430.gene45.dna; Position on contig =31048..31797bp; Strand=+
atgtacaacgatatacacgtagaacgggccaggagcatcctgaacgatattctggtcacggcgcagcaggccaccgcagctctagcggataagacagcgcgtattttattggaactgccgttatgtcatacggtaggtgtccgcttggcgcgggagcaacgcggcgcattgcaaaaacatatccacgatgtactgcgtaataacgtctggtgtaacggggcgggatttgccagttatgcagtcccgaagacggttgggaaggagggatactggacgctggagtggtggcgtcaggaaggggataccattcaatatgcgccactggaacacaatcaggagcagcgcaggcgcctggatttccggttgtttgagtggttcaggcagccggccaactgtcatcttcccgtcattgacggcccctatgtggattatgtctgtaacggtgcctacacaattacgatagcccatccggtgcttatcggtgaggaatttgccggtgttgcggcggtggatatgctggtctcgacgctggatcggttacttctgccggctctgggcgctatcggtaagccagcattgattattaatgacgatgcgcgtgtcgtgacctcgacagtgccgggagtgcgttcaggttcgctattgaagagccaaggcgttaaccggtcggtcgatggtgaagtcccttcactgcgtctggtaattttgccgtcatcacacactgaatcacacagggcatttgtctgctga

SEQ ID NO: 1827 - DNA, 1284 bp, Xenorhabdus bovienii
  Coding sequence Name=Xb4151_4152.C430.gene46.dna; Position on contig =31834..33117bp; Strand=+
atgactgaatctatgttagctaaaaggcgcagcgcggctatcgcaaaaggcgtcggcgtgacgacacaagtctatgttgaacgtgcggaaaatgctgaaatctgggatgctcaggggcaacgctatattgattttgccgcaggtatcgctgtggtgaataccggccaccgccacccgcgcgtcattgccgcagccagagagcagctggaacaatttatccatacctgtcatcaggtcgtgccttatgaaaattatgtagcgttagccgaacgactgaaccgtctggtgccgggtaatttcgtgaagaagaccgtttttgttaccaccggggctgaggcggtagaaaatgctgtgaagatcgcgcgtgccgcaaccgggcgcagcggcgtagtggctttcagtggcgcttttcatggccgtactttcctcggtatgtcattaaccggcaaagtcgtgccgtacaaaatggggttcggctcgctggttagcgacgtttatcgtgttccgtttccggtagcgctgcacggtatcagcgtggaacagacgctgaacgcgctggataatctcttcaaaaccgatattgagccgacgcgtgtcgctgccatcatcattgagccggtacagggagaaggcggtttctatcctgcgcctcccgaactgctcaaatccctgcgcgaaattgctgatcgctacggtattgtccttattgccgatgaaattcagaccggtttcgcgcgtaccggcaaactgtttgctatggaacatcatgaggttgcagccgatctgaccacgatggcaaaaggtctggcagggggatttccgctggcggctgtaacggggcgagcagagctgatggatgcggtagcaccgggtggcttggggggaacctatggaggtaatccggtggcgattgcggctggccatgcggtgctggatgtgatcgaagaagagaagctggctgcgcgtgcgacgcagctgggagagcggctaaaacaatgtctgaatgaactgcggccgcgtgtcccgcagatcgccgacgtgcgtgggcttgggctgatgattgctgtggaatttaaccgtgcggacagtcaggaacccgatgccggctttaccaacgccgtgcgtcagaaagcgctggagcggggtctgattctgttggcgtgcggtatacacggtaacgtgatccgttttcttccaccgctgactatacaaaatgatgtttttgacgaggcgctcaacgttctggagtctgtactgctcgatctgaaccgtaccgccgtttaa

SEQ ID NO: 1828 - DNA, 399 bp, Xenorhabdus bovienii
  Coding sequence Name=Xb4151_4152.C430.gene47.dna; Position on contig =33200..33598bp; Strand=+
atgcactggtatttaaatgtattaaataactatgcctgtttcagggggcgagcccagcgtaagacgttctggtattttgttctgtttcagattctggctgttctcatcatttctttcttggaaaggctgtttgctgttgccaatcccgaaatttatatggggtggttcagcgctatctatctgctgctcacctttttaccagcgctggcggtaaatgcccgccgcctgcacgatatcaactgtagcgcctggtggctactgttacatcttatcccgtttgtcggcactgttatcttactgattctcgccgctctgaaagggcaggcgggcagcaataaatacagttcagagagccgggtccattcacagggaaatacccagagccaagctaacgggtga

SEQ ID NO: 1829 - DNA, 1542 bp, Xenorhabdus bovienii
  Coding sequence Name=Xb4151_4152.C430.gene48.dna; Position on contig =33624..35165bp; Strand=+
atggcaatgaacagaagagattttatctctactactgctgcccttgcaggggcgggagtgctttcatctttacttcccaccacttctctgctcgcccggactttaactgcggccgatgcttcggctgttaatattgaccaactccggccgacactgttgaaggatgcacagtacagaaccagccggttggggttggatccgcgcatttggaactggcatagagacgtggctgccacagccatgccagccaactattatgaagcctctctggctgattggccggcttttggaagctttcccatagaccagaattgtgaggttgtggtcattggcggtgggttgctgggggcttccactgcgctgcatcttgcagaagcgggtgtggatgtgattctggttgaaaaggataacattggttcgggagcctctggccgtaatggagggcagatgacccccggaattgcccgctgggaagctgaaactatgctggaaaaactttcacccgatgaggccaaacgtttatggcgttttgcatcggttgaagcgatgaatcttgtggatgaactccgcgaacgttacggttttgaatgtgatcgtaaatatggtcatattacagcagcgatacatccgggtcatatggggccattggtggctaatgccgatgcccggcgccagctgggagatacggcggtgaaggttattgggccacacgaattgcaggaaaggtatgtgcgttcgggtatctatcatggtgccaatatcgacagcatcggtggacaggttcagcctctggcgctgctgcgaggcctaatttatagctttgctaaactgggggggcgagtttatgacggcacgaaagtgaagggcatcaggcaggatgccagcagcgcggtcatagaaactgaacggggagtcatcagggcgagtaaagccgtggtactgggggtacatggctccaccgaagagtttatctctggcccttccactaccgtgccttttttcacctatgtggcggtaactccgccgttgccggtggatatcaaagagctgatcccgtcagatctgccagtctatgatacacagttacagatagattattatcgcgcggtgcgtgacaaccgcctgctgtttggtgggcagggcaccggcaattcctggtcatcgcgtgatgtgaacaactatttgcttgagcgtatcagaaccgtgtttccacaactggaaaaacccgaattggaatactcttggggcgggatcagcgatctgaccctgaatggtgccaccgatgcccgcaaaagcggtgacagcgtccctgtgtatatggtgcatggctggagcggtcatggagtggcgcagacggttcgtattggcaaagccatcagcgacgatctcaccgaacgcaatcacgactttaccatgcttactcgcatcgaacactcgagtattccgctgggttcctatttctctccggtggctatcccattgattaaaggcgctctgggggtgataaacacagtgaatccggcagatatggtttcgttctga

SEQ ID NO: 1830 - DNA, 183 bp, Xenorhabdus bovienii
  Coding sequence Name=Xb4151_4152.C430.gene49.dna; Position on contig =35205..35387bp; Strand=-
ttgtatctaggggttgcctcagaaaacgggaaaaatcgtactataaaggcttccccggatggtcaacaccagtttgttattttcctgctggctcagcgcagtcgatttcgtctagtgaaactaacatttattgtctctgcacagagccatcgaaactttcaatttacaaataacttattttga

SEQ ID NO: 1831 - DNA, 846 bp, Xenorhabdus bovienii
  Coding sequence Name=Xb4151_4152.C430.gene50.dna; Position on contig =35549..36394bp; Strand=-
atgaatagaatcctgaatgtatgcgtggcgttgtgtcttacaatgattccagttgaagcagtaaaggcagatattactgcgccgattgtttaccttgagcatgtcactccttctgtttcgctcaatatcaatggtaaagaagttaataggctttcaattgatactggggcttccggcgctttttatctccctcgaaccgtctttgattcgattttttcagagctaaaccatcgcacaacaaccgtgcaaaattccattgatgtttttggagttgagaagtctgctgtaacggcaagagcatcccatattactgttaatggtgaacgcctttcagatgttaacgttgaaattttcaaaacgtggggtaacggcggtatgttagacgacaacggacaacttatcataaatggagtgctagggctgggtgtcgccaaaaacaaaacgcttattatcaactacgcttcaaagatgctgacgatagctgaccatcttaaagcgcttcctgatggctaccgctggcaatctatcccgtttacccgcacaaggaacgggatagaaatcagtgtgtcatctggtaatgagaaaatacgtcgtatggttattgatactggcgcaagtcatacaatgcttttcacgcgctcaaaggagggatgtgctaagttatcgcagcactgcccgaagaaagccattgtgacgcctgacggtgttaagctctctgcgtttctctttcaaattccagatgaacggatagattttgatggcctgttaggcgatgactttctttcaaacagagttcttatcatatcgaatgatcgattgttaattagcttgcctaataacagttaa

SEQ ID NO: 1832 - DNA, 99 bp, Xenorhabdus bovienii
  Coding sequence Name=Xb4151_4152.C430.gene51.dna; Position on contig =36511..36609bp; Strand=+
ttgattgattttagatgtaatagacaaataaagcatgtgagtatgagcttaggtcttttttcttatagacggcttttagatcatagaaccaagaattga

SEQ ID NO: 1833 - DNA, 228 bp, Xenorhabdus bovienii
  Coding sequence Name=Xb4151_4152.C430.gene52.dna; Position on contig =36675..36902bp; Strand=-
atgggcgtggagttccgcatgggcttgcgcacaggcactggttgttgtgtagaaagtataccgttgcacgtttgtaactctggaaatcaaaaagatactggttgtatgtactacgtatgcagccagtatctttttgtactcagaaggaagacagcatggcaaaactcattcaatcagccgatgtctatcgagactctgatgtatcgttcacacccggtggtgaagtag

SEQ ID NO: 1834 - DNA, 1194 bp, Xenorhabdus bovienii
  Coding sequence Name=Xb4151_4152.C430.gene53.dna; Position on contig =36851..38044bp; Strand=-
atggaaaaatttgatgtagtgattattggtgctggcgcggccggtttattttgtgcggctcaggcagggcaagaggggttaaacgttctggttctggataacggcaaaaaagcaggtcgcaaaattttgatgtccggtggcggacgctgtaatttcaccaatatgtacactgaacctgccgcgtatctttctgccaatccgcatttttgtaagtcagcacttgctcgctatacccaatgggattttattgacctcgttcaacaacacgggatcgcctatcacgagaaagctttgggtcagcttttctgtgacgactctgctcaacagattatcgacctgcttttgaaagagtgtgaggcaggtcaggtgactgtccggttacgcagtgaagtgacacaaatcgaaaaagacgagcagggttttgtgattacgacggcagggaaaaaagtaagtgcacactcacttgttgtggcatctggtggcctgtccatgcctgggttgggcgcgtctcctttgggttatcgcattgcggaacaattcggcctcaatatcttgcctacccatgcagcactggttccttttaccctgcataaaccgttattggaacagctacaaacactttccggtgttgcggttccttccattgttaccgcgaaggacggcacggtattcagagaaaatatcctgtttactcatcgcgggctttctggccccgctattttgcagatttccagttattggcaacccggtgagtatgtgagtattaacttactacctgatatggatctggatgcgtttttggataaagagcgggaatcccatcctaatcagaatctaaagaacacattggctaaattgctgcctaaacgcttggtagagtgtctgcaatctcttgagcaattgccggatgtttccctgaaacaaattaatcctgctcagcaaaaggaactgatcgctaccctacaatactggcaggtacaaccgaatggcactgagggatatcgtacagcggaagtgacgatgggtggcatagatacgaatgagctatcgtcaaaaacaatggagtctcataaggtgaagggactgtattttattggtgaggttgttgatgtaaccggctggctggggggatataacttccaatgggcgtggagttccgcatgggcttgcgcacaggcactggttgttgtgtag

SEQ ID NO: 1835 - DNA, 93 bp, Xenorhabdus bovienii
  Coding sequence Name=Xb4151_4152.C430.gene54.dna; Position on contig =38179..38271bp; Strand=-
atgaccttttttcgatttaatgacaatgaaatgacagccaaccagttatttttatcaattatatcaattgattatttggttttaatattttga

SEQ ID NO: 1836 - DNA, 1530 bp, Xenorhabdus bovienii
  Coding sequence Name=Xb4151_4152.C430.gene55.dna; Position on contig =38306..39835bp; Strand=+
atgcgccgcgttcatgtcctactaactggcttaacgtttatgctacatctgtttactggcctggatttttataccagcctaatgttagtacttgctctgttgtttgtgcttttctatgaagccatcaatgggtttcatgataccgcaaatgcagtagcaactgttatttatacccgcgcgatgcgttcgcagtttgccgttgtcatggcaggggtttttaactttttgggtgttctccttggtgggttaagtgtcgcttatgcgattgtacatctattgcctacagatcttctgttaaatgtcagttctacccacggcttggcgatggttttctccatgctgttggcggcaattatctggaatttgggcacatggtatttcggcattccggcatccagctcccatacgttgattggttccattatcggcatcggcctgaccaatgcgatagtggccgattcttcggtagttgatgcgctgaatatctccaagatgatacagattttcatgtccttgatcctgtctcctctcgtgggtttggtgattgctggagcgatggtatttttactgcgccgttactggagtggtactaaaaaacgtcgtcgtatccatatgacgcctgctgaacgtgaaaaacaggatggtaaacgtaaacccccattctggacacggactgcgctgattctttctgctgtaggggttagtttctcccacggtgcaaatgatgggcagaagggtatcggcttgatcatgcttgtgctgataggtgtcgcgcctgccggcttcgtggtcaatatgaactcaacgagctatgacattacccgtacccatgatgcagttgcttctttgcaaaagtattatgtgcagcacggcccggcactttcccatgctattgagcagactccggcagtgtcttcggtagaagattcggcggatcagatgctccattgcgacagctcacaagcgcaggatgtgctgaatacggctgctgtgatgctgggaagtattcagaacttcagtgagttgaccccagatcaacgtaacaatatgcgccgtatgttgatgtgcgctgctgatacggcaagcgctgtggctaaattgcctgaaaccagtcttgaagatgcccgtttcctgaataaattacgcaaggatttgctgaataccgttgaatatgccccgatgtggatcatcattgctgtggcacttgccttgtctctgggcacaatggtaggttggaagcgtgttgctgttaccatcggtgaaaaaattggcaaaaaaggcatgacctatgctcaaggtgtttctgctcaggtcacggctgccgtttccatcggggttgccagttatacggggatgccagtgtctacgacacaggtactctcttctgcggtagcaggtacgatgctggttgatggtggtggtgttcaaagcaagaccattaagaacatcatgctggcgtgggtactaacattacctatttcaattggattatcaggcattttgtattggattgctctgcaactgatctaa

SEQ ID NO: 1837 - DNA, 516 bp, Xenorhabdus bovienii
  Coding sequence Name=Xb4151_4152.C430.gene56.dna; Position on contig =40027..40542bp; Strand=+
ttgagcagttatagtataaacagcaaatcgtggcgttttagtgttgccaatccatttaatcagcattatggaaggagttcacttatggcttacaaacatattcttgttgcggttgatctatctccagaaagtcaggttttggtagaaaaagctgtttcaatggcgaaaccgtacaatgccaaagtttccttgatccatgttgatgttaactactccgatctttataccggtctgattgatgtgaatcttggtgatatgcagcagcgtatcgcggatgaaacccgcaatgctctgaaagatctgtctgttaatgcagactatgagattcaggaaacattgagtggttgcggtgatttagggcaggttcttgttgatgctatcaagcaatacgatatggatttggtcgtgtgtggtcatcatcaggatttttggagcaagttgatgtcgtcagcccgtcagctcattaacaccgttcatgttgatatgctgatcgtgcctttgcgtgatgaagaataa

SEQ ID NO: 1838 - DNA, 243 bp, Xenorhabdus bovienii
  Coding sequence Name=Xb4151_4152.C430.gene57.dna; Position on contig =40544..40786bp; Strand=-
ttgtcattcagaggtgatgtcccccagccattttccatattatttttttgtcgaaaatgtgaggtaattgtggtttgctttctgaatataccactttcttacgcttatatttcaacaactatttttataagtttccttaaaaatagttttgacaatttccaaaacagtttcatcatcttttcttcagacaaaaaaatcgcctgcataagccggcgattttatagaataaaatttcaactgtag

SEQ ID NO: 1839 - DNA, 1344 bp, Xenorhabdus bovienii
  Coding sequence Name=Xb4151_4152.C430.gene58.dna; Position on contig =40800..42143bp; Strand=+
atgaatatttcaccctctttggtctcatttcttgattcgattcagtctcacaacccacatcaaccggaatatttgcaggcagtgcgggaagtgttgacatcactctggccttttcttcaacaaaatccgcaatatcgtgagcaaagcctattggaacgtctgatagaaccggaaagagtgatccagttccgtgtctgctgggtcaatgatcagggtaaagtacaggttaaccgtgcatggcgggtacagttcaattctgccattgggccatttaagggagggatgcgttttcacccttctgttaacctttctatcctgaaattccttggttttgaacagaccttgaaaaatgcgttgacgacactgccaatgggcggtgcaaaaggggggtctgatttcgatcccaaaggtaaaagccacggggaagtaatgcgtttctgtcaggcattgatgacagagctttatcgccatctggggccagataccgatgttcctgccggagatattggcgtgggaggccgggaagtggcctttatggcaggtatgatgaaaaaactgtccaacaatacggcatgtgtttttaccggtaaagaactctcttttggtggcagcctgatccgtcctgaagccacgggctacggtctggtttatttcacccatgagatgctcaaacgccacggtatggggctggaagggatgcgggtatcggtctctggcgcgggaaatgttgcccaatataccattgaaaaatgcatagagctgggggcgaaagttgtcaccgtatcggattcaggcggcactgtgctggatgaagaaggcttcactccggagaaactggctcatctcgaagagattaaaaatcaacgttacggccgtgtggaagagtatgccaaagagcacggattgaccttccttaaaggccaggatccgtggtcaatacctgtcgatatcgcattgccttgcgctacccagaatgaactggatctggatgcggcgaagacgctgatcaaaaacggcgtgaaagtcgtcgcggaaggggcgaacatgcctgcgaccatttctgccacagacgctttccttgaagctggcgtcttgtttgcaccgggtaaagcagccaatgcgggaggtgttgcaacgtccggtcttgaaatggctcagaacgcagctcgtctgagttggaaagcagagaaagttgatgtgcgcttacaccacattatgctcgatatccaccatgcctgcgtggaatatggcggggaaggcaagcagaccaactacgtacagggcgcgaatatcgctggttttgtcaaagtggctgatgcgatgctgtcgcaggggattttgtaa

SEQ ID NO: 1840 - DNA, 135 bp, Xenorhabdus bovienii
  Coding sequence Name=Xb4151_4152.C430.gene59.dna; Position on contig =42100..42234bp; Strand=+
ttgtcaaagtggctgatgcgatgctgtcgcaggggattttgtaattctcgtgtaatcaaatcaatggtgttttggcggataagccccatgtacaaacacggggcttgttttcttaatcgcagccgtatcgattaa

SEQ ID NO: 1841 - DNA, 744 bp, Xenorhabdus bovienii
  Coding sequence Name=Xb4151_4152.C430.gene60.dna; Position on contig =42231..42974bp; Strand=-
gtgaagatttgtttaatctgtgaacaaggcgctgatagcagcgccttatctcaattggctgaacgctggaatctggttcacgatgaagattccgtcatggcgctggtcttgacacctgaacggctggaactgcgcaaactcgatgagccaaagctgggcggtatttatgtcgattttgttgccggcacgatggcacatcgccgccgttttgggggtggccgtggtgaggccgtcgccaaggctgtcggcatcaagaaaggttatctgcccacagttgtcgatgccaccgctgggttagggcgcgatgcctttgtactggcgtccatcggttgtcaggtcagaatgctggaacgccatccggtggtagcagcactgctggatgacggcttacagcgcggctatcagaatgaagagattggtagctggctgaaagaacgtatgacgctgatccacacctcaagtattacggccttgacggatattacaccgccacctgatgtcgtttatctcgatcccatgtatccccatcggcaaaaaagcgcgctggtcaaaaaagagatgcgcgttttccaatcattagtgggcgccgatgaagacgcagatggtttgctggagcctgcccgtgcgctggcaaaacggcgggttgtggtaaaacggcctgattatgcggaaccgctggcaggggctaaggcttccgcagcgattacgactaaaaatcatcgtttcgatatttatccttgttaa

SEQ ID NO: 1842 - DNA, 1641 bp, Xenorhabdus bovienii
  Coding sequence Name=Xb4151_4152.C430.gene61.dna; Position on contig =42981..44621bp; Strand=-
gtgattttgagttgtctggcattggtctgccgaaggaaaaacagaaacgctacggtgagatctccgcccgtttatctgagcttggctcccagttcgggcaataatttgctggatgccacgatgggatggaccaagctgatcacggatgagtgcgatctggagggtatgcctgacagtgccaaagccgccgccaaggccgcagccgaagccaaagggttagagggctggttgctgacactgaatgggccaagctatttgccggtcatgacctatgccgatgacagtgaactgcgtcaggaaatgtattacgcctatacgacccgcgcttctgagcaaggaccaaatgccggtcagtgggataacagtgccgtcatgacggaaattctcgcactgcgtcatgagctcgcactattgctgggtttcaaaaactatgctgagaactctctagccaccaaaatggctaaaacacctaagcaagtactcgatttcctgaacgatctggccaaccgtgctcatgctcaaggtaaaagagagctggaagaactcaccgattttgccgaatcacactattgggtcgatgagctggaagcgtgggatctggcctattatagtgaaaagcagaaacaacatgatttctctatcagcgatgagcaacttcgcccttatttccctgaacagcgtgtcattgaaggtctgtttgaagttatacgccgcatttatgcgattaccgctaaagagcgccgcgatgtagaaacatggcatcctgatgttcgtttctttgaactgtatgatgaaaaacagacattgctcggtagtttctatctggatctctatgcccgtgagcataagcggggcggcgcatggatgaacagttatgtcggcagaatgcgtcatacttccggcgaattacagacgcctgtcgcttatctgacctgtaacttcaataagccggttggcgatcagcctgccctgtttactcacaatgaagtaacaacgctgttccatgaatttggtcatggcctgcaccatatgctgactcaggttgaaacgttagatgttgcgggtatcaacggtgtaccgtgggatgccgttgaaatgccaagccagtttatggagaactggtgctgggagccagaagcactggcgtttatctccggccactatgagacgaaagaacctctaccgaaagagatgttggataatatgctggccgccaaaaattatcaggcagcgatggcaatcctacgccagttggaattcggtctgtttgatttccgcctgcacgttgaatatgacccggcaaaaggggcgcaaatcctgccaaccttgcagtcagtgaaaaaacaggtcgcggttgtgccatcaccggaatggggacgtttccccaacaccttcagccatatttttaacggtggctatgcggcgggttattatagctatatgtgggccgatgttctggctgcggacgcttattcccgctttgccgaagagggaattttcaatcgcacaaccgggcagtctttcctcgataatatcctgacccgtggcggttcagaagacccaatgacgctgtttgtacgcttccgtggtcgcgagccgaaactggatgcaatgctgaaaagctctggcatcagtggataa

SEQ ID NO: 1843 - DNA, 600 bp, Xenorhabdus bovienii
  Coding sequence Name=Xb4151_4152.C430.gene62.dna; Position on contig =44518..45117bp; Strand=-
ttgaactcgctgtatcttatccccatcttatcgacaacaacccattgggatatagcggtttatatacccaaacatacaactaaggcgctcactatgactaacccgttactgactccttctgtattgcccaaattcgctgccattgaaccaaaacatgtcgtgccagccgtgaaagagacgttagccaactaccgtcaagtgattgagaaagttctggccggaaatgtcacatttacttgggataatctgtgccagccaatttctgaagcgaaagatcatctttcccgcgtgtggtctcctgtcgaacatctcaatgcggtcaaaaatagcccagaacttcgcgaagcctatgaacaaagcctgcctctgatttctgagttcgaaacttggatggggcagcacgaagggttatatcaggcttataaggctctgaaagagagcgaagcctttaaagcactatctcagccacagcgtaaagctatcgaaaatacgctgcgtgattttgagttgtctggcattggtctgccgaaggaaaaacagaaacgctacggtgagatctccgcccgtttatctgagcttggctcccagttcgggcaataa

SEQ ID NO: 1844 - DNA, 231 bp, Xenorhabdus bovienii
  Coding sequence Name=Xb4151_4152.C430.gene63.dna; Position on contig =45117..45347bp; Strand=+
atgctgatgccgcacttttatgcggataatcggggtctttttatatcagatatctgtgagatgacgaatgagtttagatgtttcgtggggcgggctataatccctgctcttcattattttttatggaagatcatcgcccccggtggggcggctgggcttcaaatccagacgggttcgccagcggctcccggcaggttgactacgttcatttgctgctgttcagtaatttga

SEQ ID NO: 1845 - DNA, 123 bp, Xenorhabdus bovienii
  Coding sequence Name=Xb4151_4152.C430.gene64.dna; Position on contig =45393..45515bp; Strand=+
atggcaagagccaatgttgcggcaataacctctaatacgttattaatatggacaatgttgggatactccgtttttgtaataatatcgcgttatataatttatattttattgtcgttggcttaa

SEQ ID NO: 1846 - DNA, 138 bp, Xenorhabdus bovienii
  Coding sequence Name=Xb4151_4152.C430.gene65.dna; Position on contig =45498..45635bp; Strand=-
atgcaatttataactcaatccagaagccgatatagttatcctcttcgtctttcaggttacagccagcaaagcagcaacttggaagacggaggatataaactcatcctgccccttatccaattaagccaacgacaataa

SEQ ID NO: 1847 - DNA, 327 bp, Xenorhabdus bovienii
  Coding sequence Name=Xb4151_4152.C430.gene66.dna; Position on contig =45601..45927bp; Strand=-
atgagatatacattatttatgctgcttattctgtctcctcttagtttggctgccagttttgactgtgcaaaagccaaggtaccagatgaaaaagcaatctgtactgatcaccggcttaatgatctggatatagaaatgagcgtcaaatatcatttcctacgagggttatttgctatgggcatgtcgggtgaaatgtatgacagccaacaggcttggctgaaacaacgccagaaatgcaaaggcgataagacatgcctgctacaacgttatcaccagcgtattaaccagcttgatgcaatttataactcaatccagaagccgatatag

SEQ ID NO: 1848 - DNA, 480 bp, Xenorhabdus bovienii
  Coding sequence Name=Xb4151_4152.C430.gene67.dna; Position on contig =45928..46407bp; Strand=-
atgtcttacttaaaatgtttgaattattttggtgccagcttttttctcttttccgtattcgtacaagcacaatcgtcatcgtcccaattgtctacaagccaacaaaaatacctgcaacagcaaatagataaacaaatgacagataaatcagcggtcaaagaggtagaaagctggtcagatactaaaaaagtagccgagtttatttgcaggcctttagcactctctgttattcaacaagagcacaaagaggctgacaaagtgtttctcggtgatgaatcgccaaacagtatcagattggttgattcccacctcataggtacagggatgtatcgccaaggatttggctggaaaaatatcagattctcctgtgagttagatcccaaaaccggcgaagcgcggtcattcaaattgttaaaagcattaccaccacaattacagaccgggccagagccggtgatccttcctaaaaaaggggagtag

SEQ ID NO: 1849 - DNA, 1050 bp, Xenorhabdus bovienii; identical to SEQ ID NO: 483
  Coding sequence Name=Xb4151_4152.C430.gene68.dna; Position on contig =46416..47465bp; Strand=-

SEQ ID NO: 1850 - DNA, 396 bp, Xenorhabdus bovienii
  Coding sequence Name=Xb4151_4152.C430.gene69.dna; Position on contig =47613..48008bp; Strand=-
atgattggaggtaatactatgtacgattggtctggagctgttcctgctaaacttgaacaagatcaacctacaggacttattctcaaaaagggggatgttatatctattgttgctaagggatgggtgaagtatggccatccagacaactactgggcagccccccaaggtactctacttagaaaaccaacgctacgcgactcactcattgctaaaatcggtaataaaacctatggaataggaaacggcgtgcttcataaaacggttcctgaggatggggagttaatatttgtgttctttgactccccaggtgattacggtgataattctcgtgaattccttgttaatgttaaaatagagtcacgctattctcctctcgaagaaataaaaaataactaa

SEQ ID NO: 1851 - DNA, 228 bp, Xenorhabdus bovienii
  Coding sequence Name=Xb4151_4152.C430.gene70.dna; Position on contig =48273..48500bp; Strand=+
gtgggaatttctcaccttttaattcaatctttccgtttcaaacggaatgcctactttggttttatacttacggtgaaggtattgggatttcctcaataccttttgtttgtgcagataccccgtatgtcaaagggcagatttctgccctatagtgacagtagttttctttcccgccgttccacaatctcgggactctccattttttggcaaaaagcgtacgtcagctaa

SEQ ID NO: 1852 - DNA, 147 bp, Xenorhabdus bovienii
  Coding sequence Name=Xb4151_4152.C430.gene71.dna; Position on contig =48524..48670bp; Strand=-
ttgcctgttttgggtctgatttacccctcagatcactctctctggaattcatatcgaagaacggacatcattatttattcgaaaaattcaccgccaaaatccctctctaaactgacgcatttctgtacacataaaccgtgcttttaa

SEQ ID NO: 1853 - DNA, 162 bp, Xenorhabdus bovienii
  Coding sequence Name=Xb4151_4152.C430.gene72.dna; Position on contig =48652..48813bp; Strand=-
atgacagtaaaaggacttaaaaagatacgcaaaagatacgcggctctttttctaaacgcctcagactccccctctgaggtgtttttatttctgactaatgtatttccacttgtaaaaaagtgtaacaaaaatacacgccatttttgcctgttttgggtctga

SEQ ID NO: 1854 - DNA, 189 bp, Xenorhabdus bovienii
  Coding sequence Name=Xb4151_4152.C430.gene73.dna; Position on contig =49168..49356bp; Strand=+
ttgcggcttttaacgaggccaaccgcccctcggcatgcaccttgggtttcgcgaatcccgtcgaatccagaatcagccccaagtatgttaaaagcgagtatatcagaatattggatgataatgccagtgattaacgccctgaattcttcattattcttgctttgtctactttccactcacgttctttga

SEQ ID NO: 1855 - DNA, 483 bp, Xenorhabdus bovienii
  Coding sequence Name=Xb4151_4152.C430.gene74.dna; Position on contig =49298..49780bp; Strand=-
atgacaaagaaaaaagcacacaaacccggttcggcaacaattgccatgaataagcgagcccgccatgaatacttcatcgaagaagaattcgaagctggcttatcgctacaaggttgggaagtaaaatcgctgcgcgctggcaaggcaaacatcagtgagagttacgttttgctcagagatggtgatgcttatctttttggtgccacaatcacaccattaaatgtcgcttcttcccatatagtctgtgatccgacacggtcacgcaaattactccttaacaagcgcgaacttgattcactatatggtcgagtcaatcgtgaaggttatacaatcgttgcgctttccatgtactggaagaacgcttggagcaaagtcaaaattggcgttgcgaaaggtaaaaaagcgcatgataaacgttcagatatcaaagaacgtgagtggaaagtagacaaagcaagaataatgaagaattcagggcgttaa

SEQ ID NO: 1856 - DNA, 102 bp, Xenorhabdus bovienii
  Coding sequence Name=Xb4151_4152.C430.gene75.dna; Position on contig =49792..49893bp; Strand=-
atgtggttaaataaaaacctgatggcgtttggaacaataaatatgcatttattgctaaatatcactcagaagagatttatttcattaacgcatacagtataa

SEQ ID NO: 1857 - DNA, 435 bp, Xenorhabdus bovienii
  Coding sequence Name=Xb4151_4152.C430.gene76.dna; Position on contig =49938..50372bp; Strand=+
atgccacagattagtcgctctgcgttagtgccttacagcgtggaacaaatgtacaaattgatcaacgacgtgaagtcttatccggattttttaccggggtgtgtgggtagcagtgtaataagccgtagtaataatgaaatgacggctgccgttgaggtctccaaggcagggatcagtaagacgttcgtgacgcgtaatacgttatctgataataaaagtattagtatgcagcttgttgatgggccttttcgaaagctgatgggcgggtggcattttaccccacttagcgaggatgcctgtaaagttgagctacatctcgattttgagtttaccaacaagttgattgagttagcttttggtaaggtgtttaaggaattggccggtaatatggttcaggcttttacccaacgtgcgcgtgaggtttacagtgtctga

SEQ ID NO: 1858 - DNA, 366 bp, Xenorhabdus bovienii
  Coding sequence Name=Xb4151_4152.C430.gene77.dna; Position on contig =50293..50658bp; Strand=+
ttggtaaggtgtttaaggaattggccggtaatatggttcaggcttttacccaacgtgcgcgtgaggtttacagtgtctgatatcaatgtcgaagtcgtttatgctctgcctgaacgtcaatatctgtgtaatgtgaaagtacctcagggatcgactgtcgaacaggcgattgtcgcatctggtcttttgacattacgtagtgatatcgatttgattaagaataaaatcggcatttatagtcgtccggttaaattgaccgatacgatggtagaaggggatcgtgtagaaatttatcgtccccttcttgccgatccaaaagaaatgcgtcgtaaacgggctgaacgagctaaaaatagcactcaataa

SEQ ID NO: 1859 - DNA, 345 bp, Xenorhabdus bovienii
  Coding sequence Name=Xb4151_4152.C430.gene78.dna; Position on contig =50723..51067bp; Strand=-
atgcgctgtaaattgttgactgccgctaccgtatcacttgttatgctgactgcgggttgctccatgtttgagcgagttgtttatcgtcctgatattaatcaagggaattacctgacaccggctgcggtatcaaaaatccacaaaggaatgactcaacaacaagtcgcttacactttgggaacaccaatgctgactgatccgtttggaagtcaaatttggtactacatattccgtgatcagccaggccataagaaggccacacaagaaacattgacgctcacctttgatagtaatggtgtgttgactgatatcaagaatgaaaaagcttttccagaggatcagtaa

SEQ ID NO: 1860 - DNA, 1674 bp, Xenorhabdus bovienii
  Coding sequence Name=Xb4151_4152.C430.gene79.dna; Position on contig =51181..52854bp; Strand=-
atgctgactcagttaaccatcagtaattttgctatcgttcgcgaactggaaattgatttccgctcaggaatgactgcaatcacaggggaaaccggcgcaggtaaatccatcgccattgatgctctgggcttatgccttggcaatcgaggcgaagccaatatggttcgtgctggtgctacccgtactgacatctgtgcccgtttttcactggcggatgcaccttctgcccgtaaatggcttgaagcccaccaacttgatgaaagtcgtgatgacgacaatgagtgcctgttgcggcgcacaattaccgcagatgggcgctcccgtggttttatcaatggcacggctgtccccctttcccagctacgtgaattaggttcacacctgatccaaatccatgggcaacatgcccaccagttacttttagaaaaccgtcaccaaaggcgtttactggacatttacgctggcgaatttgaacggcaacatgaaatgaagcaggcttaccaacaatggcggcaaagctgtcaggcactcgcccgatttcaacagcaggctcttgaacgccgctctcgccagcaattactcgaatatcatttgaaagaactaaacgaactggcaccacaagtgggtgagtaccaagaacaggatagcgaatataagcggctggcaaattgcgggcagtttctatctgtcagtcagaacgttctccagatcttaaatgataatgatgaacagaacattgtcagccttctgaattacgcacgaaacgaactgactgaactggccagcatggatcacaaattcaacgaactgcttaacatgctggaagaagcagccattcaaattaatgaagtcagtgatgaattacgccattacagtgatctactggaattagaccctaaccgcctgtttgaattggaacagaaaatttcacaacagatcagcatggctcgtaaacatcacgttgctccagaagaactacctgccctgcaccaacaacttttggaagagcagcatcagctctcccaacaggaagatgattgcgcccatctcagtgaacttgtcagcctgcattatcaacaagcgctcaatgtggcagaaaaactgcatcaggttcgccaacaatatgctgcggaattaagccaactgattaccaacagcatgcatcaactctccatgcctcatggtcgttttaccattgacctcacatttgaacccgaacatttgaatattgatggtgccagcaaagttgaatttaacgtaacaactaacccgggccagcctcatcagtcactggcaaaagttgcttctggtggtgaactttcccgtatcgcactagctattcaggtcattacagccaaaaaaatggaaacgcctgcattaatctttgacgaagttgatgtcggtatcagtggcccaaccgcggcaatcgttggccgattgctacgcgaattgggagagtcgacccaagttatgtgcgtaacgcacttaccgcaagtcgcaggatgtgggcatcaacatttttatgtcaacaaacaaaccgacggggaagaaacagaaacccatatgcaattattggacaaaaaagcccgacttcaagaactggcgcgacttctggcgggtaatgaagttacaaaaaacacactggccaacgcaaaagagctattagcggcataa

SEQ ID NO: 1861 - DNA, 900 bp, Xenorhabdus bovienii
  Coding sequence Name=Xb4151_4152.C430.gene80.dna; Position on contig =52951..53850bp; Strand=-
atgctgaaggaaacaacagcaatgaataacgaattcaaatgcatcggtattgtcggccgtccacgtcaccctgaagcgctggccacccatgaaatgctttatcactggctggtatccaaaggatactacgtcatcatggatagacaagttgctagagacattggtttaaaaggtgttcagactggaggattgaccgaaatcggcaaaatagctgatctggtgattgttgttggcggcgatggcaacatgctgggagcagccagagtattgtcacgctatgacatcaaagtaattggcattaaccgtggtaatttaggctttctgacggatttagatcccgataatgccttgcagcagctttccgaggtactcaatggagaatatcgagacgaaaaacgtttcctattagaagctcaagtcacgaaaaaaggacagaaatcacggcgcagtacggcgctgaatgaagtcgtgctacatccgggcaaagtcgctcacatgattgacttcgaagtttatattgatgagcgttttgcgttttcccaacgctccgatggcttaatcattgcgactcctacaggctcaacagcctactcgttgtctgctggtgggccaatattgacaccaaacttgaacgccattgtgctggtaccgatgtttccacacacgctttcagcgcgccctcttgttatcagcagtgaaagcagcatccgtctgaaattctcccggaacagcaatgactatgaagtaagctgtgatagccagatagtgttaccgatccaggacagtgaagaagtcattatcaaacgcagtgaatataacctgcatttgatacacccgaaagattacaattatttcaatacattgagtacgaagctgggttggtcgaaaaaaatgttctaa

SEQ ID NO: 1862 - DNA, 774 bp, Xenorhabdus bovienii
  Coding sequence Name=Xb4151_4152.C430.gene81.dna; Position on contig =53761..54534bp; Strand=+
atgggtggccagcgcttcagggtgacgtggacggccgacaataccgatgcatttgaattcgttattcattgctgttgtttccttcagcatatggttttgccctcacaatatgattgttcccttgaatccctcgttttgatccccataataagcgggagtagcgcaaataatacaaaatacgcggagatattcatgagtagtaaagaccaaaaagtacctgacgagcaagtctcagaaaatacagaaaatgtatttgagcaacaaatggatgcagaaaaggcagacacgccagagactgagagcattgttgacccgcgtgttgccgagttggaagaacagctaaaacaggctcaaattggcgaacgcgatgcaatgctgcgtgctcgtgctgaagtggaaaatatccgtcgtcgcacagaactggatatagaaaaagcacataaattcgcactggaacgttttgcgaatgagcttctgcccgtgatcgacaatctggaacgcgcactggaagcggttgatcgctctaatgacgcgctgttgccaatgattgaaggcgttgagttaacattaaaatcattcactaatgctgtaggtaaattcggcattgaagtggtgggtgacactaatgttcctttcaatcctgaagtacatcaggcgatgaccatgatggaatccgatcagcatgaacccaatcacgttatgttagtgatgcagaaaggttataccttgaatggtcgtttattgcgccctgcaatggttgctgtttctaaataa

SEQ ID NO: 1863 - DNA, 93 bp, Xenorhabdus bovienii
  Coding sequence Name=Xb4151_4152.C430.gene82.dna; Position on contig =54538..54630bp; Strand=-
ttgattggtatcccacactgcctgagtgacaatagaataaccacaaaaatgccgccctgtgtatggcggcattgtaatcacgggatagcgtaa

SEQ ID NO: 1864 - DNA, 681 bp, Xenorhabdus bovienii
  Coding sequence Name=Xb4151_4152.C430.gene83.dna; Position on contig =54602..55282bp; Strand=-
atgtccgcatctctcacatggcacgaagtcatcggccatgaaaagacacagccctatttcgttgacacattgacctatgttgccaatgaacgtaaggccggaaagacgatttatccgctacagcaggatgttttcaatgcattccgctataccgaactgtccgatgtaagagtcgtgattttggggcaagacccttaccacggcccaaatcaggcacacggtctggctttctcagtacagcctggtattcctgcaccaccttctcttgtcaacatgtataaggagctggaatcggatattactgggtttagccgccctaatcatggctgcttggtcagttgggcaaagcagggcgtattgctgctcaatacggtgctgaccgttgaacgtggcaatgcgcattcacatgcgaatttaggctgggaaaccttcactgacaaagtcattgcggcaatcaatgaacatcgtcacggcgtcattttcctactttggggttcccatgcccagaaaaaaggacacttcatcaatacccaacagcactatgttctaaaagcaccacacccttctcctttgtcagctcatcgcggttttctgggatgcaagcatttttcacaggcaaacagtctactggaagctcaaggattgacgccaattgattggtatcccacactgcctgagtga

SEQ ID NO: 1865 - DNA, 93 bp, Xenorhabdus bovienii
  Coding sequence Name=Xb4151_4152.C430.gene84.dna; Position on contig =55251..55343bp; Strand=+
atgacttcgtgccatgtgagagatgcggacatcgcgaatccctttctatatgattgtcagataggcttaagcttaccgattcccttcgtatag

SEQ ID NO: 1866 - DNA, 1152 bp, Xenorhabdus bovienii
  Coding sequence Name=Xb4151_4152.C430.gene85.dna; Position on contig =55601..56752bp; Strand=+
atgactttatcaataaatggcagttttttcagcgaattagggatttattcattacagggaagtccactacaacttcaatcgagttctccggccaaatcatcatctgacaaggctgatgtgactcactccacaacacaacccacaacagctccgctttcagaaaatacccagcaaaataataatctttatcaatcattgattcgcgatcgtcatctaagtgccatggcattacctgaattacatgccaatgatattgcaggaaaacattctaaacgcatcgattatgatctgtctctggtcacccgtgatgtttaccgtatgaatagcatgggaattggtgattatgtgcgtcttacgaaagatgaaatatcaaaagcgggcattgatcctgctatcttggaggatagttcaacaggatttcaggcaggcgtttatcgaaataagggtttatatatagtgtcatttactggctcgaacgaaatacaggatttcatggcaagtattcgtcaagggcttggatttaaagaagagcaatatggtcaggctgtaacgttggcacaagcagcgttaaaagcatttggtgaaaatgtcattttcacaggtcactcaatggggggaggattggcatctgtggcagcgctgacaacaggaaaacccgcagttatttttaatgctgcaggtgtgtcagattcgacattgagaagtatggggttatcaccggaagcaagtcgtgaagtggcagaaaatgggttaatccgaaattatattgttgaacatgactggcttgataacctgcaaaaaactttgccaattccccagcccatgggaaataaaattttgcttgaatatgagtacgaaccggaagggatattagattccatttttgcctatcggtatgcttttcactcattcaaggcgcattttatggaagccgtgcaggaattgctgaccgtccataaaccttggttgaataaagcaggtgaaatgatagctgctactgaggacagtatgcaaaataaggctatttctatgcaaaaacaggctttgaatacatggggaatgaatatgaatgaggccgaaatcagcgaccagctaagggaagagcgtcatcaattggtttcacaacagcttgagaagtattattcagtataa

SEQ ID NO: 1867 - DNA, 174 bp, Xenorhabdus bovienii
  Coding sequence Name=Xb4151_4152.C430.gene86.dna; Position on contig =56740..56913bp; Strand=-
ttggaaaacgccgcactccttccggtgatcccaaaccagaaacgtcagaaccaaccaacgattaatctcactggcaaaagcgggcaaacagcccgctttattatatccgacaaacagaaacaatggattcagccttactcattattccatttgtacgaatattatactgaataa

SEQ ID NO: 1868 - DNA, 1344 bp, Xenorhabdus bovienii
  Coding sequence Name=Xb4151_4152.C430.gene87.dna; Position on contig =56849..58192bp; Strand=-
atgactgcgacaaacttttccgaattcgaacttgatgaatgcctgcttaatgcactgaacgaaaaaggctacgaacgcccgacagcaatccaggctgaagccattcctgctgccatggatggccgtgatgtacttggctccgcgccgactggcacaggcaaaaccgctgcgtacctgctaccagttctacagcatttactggattttccacgtaaaaaatccggcccgccacgtatcttgattttgacccctacccgcgaactggcaatgcaagttgcagaacaggcacaatcatttgcggctcatactaatctggatgtcgccacaatcactggcggtgttgcttacatgaatcacgcagaagtgttcagtgagaatcaggatattgttgtcgcaactacaggacgcctactgcaatacatcaaagaagaaaattttgattgccgtgcggtggaaacgctgatccttgatgaagcagaccgcatgctggacatggggtttgccaatgatgtcgagaccattgccggtgagacacgctggcgcaaacaaacgttgctattttccgcaacgttagaaggtgaaaccatccgtgattttgcagagcgtctgttaaccgatcctgttgaaatcgatgcagaaccttctcgccgtgaacgcaaaaaaattcagcaattctattatcgtgccgataatctggagcataaaacagctttactgtgtcaccttcttcagcaacctgatgtaacaaaatcgattgtttttgtgcgcaaacgtgagcgtgtgcgtgaaattgttgattatctacataaggcaggcattcaggcctgttttcttgaaggtgaaatggtgcagaccaaacgtacagatgccgtcaagcgactgaatgatggcagagtcaacgttatggttgcaactgatgttgcgtcccgtgggttggatattgaaaatatcagccatgtctttaactttgatttaccacgtactgccgatgtttatctgcatcggattggccgtactgcccgtgcaggccgtaagggaaccgctattgcactggttgagtctcacgatcatccactgcttggtaaagtcacccgttatctcaacgaaccattgaaagtacgggttgtcgatgaattgcgcccacaaactaaagcacccagtgagaaaaagagctataagccttctaagaaagttctggagaaacgtaaagagaagaaaaaggtagaagaagaagcgaagaaaacacgagtgaaagttcgtcatcgcgatagtaaaaacattggaaaacgccgcactccttccggtgatcccaaaccagaaacgtcagaaccaaccaacgattaa

SEQ ID NO: 1869 - DNA, 114 bp, Xenorhabdus bovienii
  Coding sequence Name=Xb4151_4152.C430.gene88.dna; Position on contig =58180..58293bp; Strand=+
ttgtcgcagtcatcatatacctctatttgggtcgccgattataaacaggttggtcgtattcttcatcctataaaaatatcctgtgggcaggtcgcttttatccgtgggctataa

SEQ ID NO: 1870 - DNA, 741 bp, Xenorhabdus bovienii
  Coding sequence Name=Xb4151_4152.C430.gene89.dna; Position on contig =58336..59076bp; Strand=+
atgggattgatacataaacccgcttttcgctgcggtggttttacatttaaacagttttttgttggacatgataaatgtgcaatgaaagttgggacagatggcgtgttattaggcgcctgggctccggtgggtaatcggaaaaaatgtctggatatcggttgtggcagcggtttggttgccttgatgatagcacagcgtactgacgatcattcggttattgatgccgtggagctggatactcatgctgcgagacaggcaatcgagaatgtgcaggaatccccatgggctgatcgtgttaaagtatatcagcaggatattcatgattttactcagcaaaaccatttgcaatatgatttgatcgtgagtaatccgccctattttgaacctgccaacgcgtgtagaaatgaagcacgtagtcaggcgcgctacacgggatcattgacgcatcgtggattattggattgtgctgaacatttgattaagcccacagggctattttgtgttgtattaccctataacatcggcgagacatttgagcaaatggcggcagaacgggggtggtttactcatcatcgtgtcaatattcgtgataggcaggataaaccgctgcatcgtttgttgctggcattttctcgacaagggcaggagactcaggtgagtgaattgaccattcgtgtctcaaatggcgtatattcaaccgaatttcgtcagttagtaacagatttttatctttattattga

SEQ ID NO: 1871 - DNA, 120 bp, Xenorhabdus bovienii
  Coding sequence Name=Xb4151_4152.C430.gene90.dna; Position on contig =59190..59309bp; Strand=-
atgatgcctttcttcccaaacaagcatgacttcgagtttctatttcgtgtgaagttcaactttgatcgtaattttatcttacaaccacctgttatttcgtatctcaccttttatgtatag

SEQ ID NO: 1872 - DNA, 633 bp, Xenorhabdus bovienii
  Coding sequence Name=Xb4151_4152.C430.gene91.dna; Position on contig =59308..59940bp; Strand=+
atgactggcgtaattaagtataaatgtggagttttacctcaggagagtgagcctcggatgagcgagcagttaacggatcaaatgctggtcgaacgggtacaaaagggcgaccagaaagcatttaatttgctggttataaaatatcagcacaaagtggcgagcctggttgctcgttacgtacctcaaggcgacgttcctgatgtcgctcaagaggtgtttattaagacttatcgtgcgctttattctttccggggtgatagtgctttttatacgtggttgtaccgtattgccgttaatactgcgaaaaactatttagttgctcagggacgtcgcccaccatccaatgacttggatgccaacgatgcagaaaattatgatgcgtcaagttcattaaaagaaatttcgaaccctgagaacttaatgttgtctgaagaactaaaggaagtggttttccgtaccatcgaatcgctcccagatgatttgcgggtagcgattacgctcagggagttggatgggttgagctatgaagaaatagctgagatcatggagtgtcctgtcgggactgtccgttcacgaatcttccgggcaagggaagccattgataataaagtcaaaccactgatccaacagtag

SEQ ID NO: 1873 - DNA, 651 bp, Xenorhabdus bovienii
  Coding sequence Name=Xb4151_4152.C430.gene92.dna; Position on contig =59973..60623bp; Strand=+
atgcaaagagagaaacttttcgcattaatggatggcgaagctcttgatagtgaagtcgttcgtttgatcgctgaagacactgtgatgcagaaacagtgggaaagatatcacctcatccgtgacacattgcgtggtgatgtaggtgatgtattacatttggatatcgcgagccgagtcgcattggcacttgaaaaagagccggctcatatcaatccagccgctattccagaatctcagccaaagcctgaaacatggcagaaaatgccgttctggaacaaaattcgcccgtgggcgagccagatgacgcaagtcggcattgctgcgtgtgtgtcactggcggtgattgttggagtccagcaatataacagcgatggcagtgttgatgtggatacacaatccgatacgccagtcttcaatacattacctgttatgggttccgcttcacctgtcggtttagctgcgcctgtagatgatgaagctttaggcagtgatttgaacatgcaagtgagggaaagcaataaacgcattgatgctatgctgcaacagtatgaactttcccggcgcatttattcagaacaaaaccagaggttgccaccggttgataatactcaacctgtagcagcaaaaatacaacaggctccacagcaataa

SEQ ID NO: 1874 - DNA, 960 bp, Xenorhabdus bovienii
  Coding sequence Name=Xb4151_4152.C430.gene93.dna; Position on contig =60645..61604bp; Strand=+
atgaaacatatttgttttttcatcttcttgttggcaggtagcctgttcaatcctttgaaagcctcggcgcagcaaagcgacaccgaggctttgttacaggatatgggaaatgccgtacacactctgaattatgagctcgctttcattaatctagggcgagaacttctgatccccctgcgttaccgccatgctattattgatggtcaacccattgctcaaatcatacagatggatggatcgcgtcgcgaaattatccaacgcggtaaccaaatcagctattacgagccaggcttggattcttttagtctacgtggcaaccacattgtggattatttcccaccgattatttttgcggatttctcgcgattacagaagtattatcgcttcattgatgcgggcagtacccacgttggtgatcaccctgtgtactttgttcgtatcatatcgaaagatgaaactcgttataattataacctgttgattgatgcaaaaagtcatcttcccttgctgattgatctgttggacaaggatcataatattgttattgagcaattccgcgtagtgtcatcaacagtgaatgacagtataaaaaaagatctgattgctattgtcgatttgaaattaccgccaatgctggctatttcgccgtctgaaaaagtgaaattcgattggcaggtggaaaaaatacctgaaggtttcaaagaaatctcccgtaatagactcaaactatcagaaacagaatcgttggaatccatcatgtatagtgatggactgtttcaattttctgtaaatgtgacccatgctgataaaggaacggtcaataaacaaccatttagacaaggtcggcgaacggtttatactttggtcagaggtaaaaataccattgcaatcgttggcgaactgcctttcgcaaccgccaagcagattgtagcaagtgtgacgtttacgggagatcattga

SEQ ID NO: 1875 - DNA, 465 bp, Xenorhabdus bovienii
  Coding sequence Name=Xb4151_4152.C430.gene94.dna; Position on contig =61604..62068bp; Strand=+
atggttaaagaatgggcgacggttgtccgttggcaaaaaggtcgtgcactattgcgttatggctcatcttcaggttgtggcagttgtcaggccaacgccgtctgtggctcttatttattggaaaaactggggccagagaatattcatcagttggaactagaaatttaccaacctcttcaacccggtcaaaaagtagaggtaggtatacctgaaagtagcttactgcgttcagcaatgttagtttatttgaccccattattagggttgttcttagggggggggctcttccaatattgggtaactgaccagttatgggtagttatgggaggcgttatcggcggggttactggtttcttctttgcccgcaagatagctaagtattgggatgatcagcaagtgtaccaacccgttgtgttacaaattggtttacctcctgatacgattaaggttctacagcaggaataa

SEQ ID NO: 1876 - DNA, 159 bp, Xenorhabdus bovienii
  Coding sequence Name=Xb4151_4152.C430.gene95.dna; Position on contig =62126..62284bp; Strand=-
atggagaaatttcttatttgcttcattattaaacttttttgccttaatatttctgaatcattcgcctatggacacacagatggacataaagcgacagtttataggtttggccacaggccaaagaggcgtattctacatgccaaacctgtgaaaacctag

SEQ ID NO: 1877 - DNA, 1797 bp, Xenorhabdus bovienii
  Coding sequence Name=Xb4151_4152.C430.gene96.dna; Position on contig =62259..64055bp; Strand=+
atgaagcaaataagaaatttctccattatcgcccacatcgaccacggtaaatccacactctctgatcggattattcaaatctgtggggggctgtccgatcgcgaaatggcagcacaagtactcgactcaatggatcttgagcgtgaacgcggtatcaccatcaaggcacaaagcgtcactcttgattaccagtcaattgacggacaagtctatcaactaaattttatcgacacgccaggccatgttgacttctcttacgaagtttcccgctctctggctgcctgtgaaggggctttactcgttgttgatgcggggcagggtgttgaagctcagacactggctaactgctataccgccatcgaaatggatctgcaagtcgttcctgtcctgaacaaaattgacttgcccgccgctgaaccagagcgtgtagctgaggaaatcgaagacattgttggcattgatgcgacagatgctgtccgctgctctgcgaaaacaggtgtgggtgtgcaggatgtcattgaacgtctggttaaagagatcccgtcaccagagggggattccgatgcaccattgcaggccttgattattgactcatggtttgacaattaccttggtgttgtttcgcttgtccgtgttaaaaacggtgtattgcgtaaaggcgataaaattaaagtgatgagcacgggacaggtatataacgctgaccgtctggggatctttacaccgaaacgtatcgaccgtgatatattgaactgtggtgaagtaggttggttggtctgtgcgatcaaagacattttgggcgcgccagtcggggatactctgacaactgcgcgccagccagcggacaaagcgctgccaggtttccaaaaggttaaaccacaggtttatgcaggtctgtttcctatcagttctgaagactatgaagcctttcgcgacgctttgggtaaattgagcctaaacgatgcttcattattttacgagccagaaagttctactgcattgggctttggtttccgctgtggcttcttgggcttactgcatatggaaatcattcaggaacgcctggaacgtgaatatgatcttgatctgattactactgcaccaacagttgtttatgaagttgagacagtcagtgatgatattatttacgtggacagtccgtccaaattaccgccattaaacaatattaaagaactgcgtgaaccggttgcggaatgtaacatgctgttaccgcaggaatacctcggtaatgttataacactgtgtgtggaaaagcgtggtgtacagactaatatggtttatcacggtaatcaggttgcactgacttacgaaatacctatggctgaagttgtgctggatttctttgaccgtctgaaatctacttctcgtggttatgcgtctctggattataatttcatccgttttcaacactcagacatggtacgagtagatgttttgattaacggtgaacgtgttgatgcattggcattaattactcatcgtgagaactcacaatatcgtggtcgtgaactggtggataaaatgaaagagttgatcccgcgtcagcaatttgacattgcgattcaggctgccatcggtgctcacattattgcgcgtgctactgttaaacagttacgtaaaaacgtacttgcgaaatgttatggcggtgatgttagccgtaagaaaaaattattgcagaaacagaaagatggtaaaaaacgtatgaagcaggtaggaaacgttgaactaccgcaagaagcgtttttagcaattttgcatgttggaaaagataactaa

SEQ ID NO: 1878 - DNA, 969 bp, Xenorhabdus bovienii
  Coding sequence Name=Xb4151_4152.C430.gene97.dna; Position on contig =64076..65044bp; Strand=+
atggctaacacttttgccttgatcttaacgttagcaacgttaatcactggtattatctggtgtatagatcggtttaaattcgcccctgaacgcaggaaaaaacttgctcagattcaggaacaaacagcaggtgcggaatctcaggaagctttggctacagagattaacaaaccttcatgggttgagacatttgcatctgtctttcctgtgttagccattgttttgcttctgcgttcttttgtttatgaacctttccagatcccttcaggttcaatgatgccaacgctgctgattggggatttcatcctagttgaaaaattcgcctatggtctgaaagatccaattacacagacaactttgattaaaacaggtaagcctaagcgtggagatattgcagtttttaaatatcctgttaatccgagtctggattttgtaaagcgtgtcattggcttgcctggagataaaattgtttacgatgacataaataaagaacttcaggtttttcctggttgtggttggaatacggtgtgtaagaatttacctgttacttatcgagatatgttcccaagtgaatggactatcaaagaggatattactcctgaaggcgcacgtgtgagaggagtttatccaattcctatcgaagaacaactggggtcaaacagtattcgccagggggaacgggttgagcatttaggtaatgtgtcacaccacattttgattgtccctggagcatcaaatatcccgtttttcagtcagccaggattgccacttggaacttgggttgtccctgaaggccattatttcatgatgggcgataaccgtgacaatagttcggatagccggatatgggggtttgtgccggagaaaaatctggtagggcgagcaacagccatctggataagttttgaaaaacaggaaggcgagtggcctactggcgtacgcctgagtcgaattggaagaattcactaa

SEQ ID NO: 1879 - DNA, 108 bp, Xenorhabdus bovienii
  Coding sequence Name=Xb4151_4152.C430.gene98.dna; Position on contig =65134..65241bp; Strand=-
atggagttcatgtgctaccaattcagtcagaattcatcaaaaaagcacacgcaacagacctgtggggatagatcctacaaaactgttgcgtttgcactggcttcctaa

SEQ ID NO: 1880 - DNA, 681 bp, Xenorhabdus bovienii
  Coding sequence Name=Xb4151_4152.C430.gene99.dna; Position on contig =65231..65911bp; Strand=+
atgaactccataataattaataggttacagcgtaagctgggatatacctttatacagcatgatttgttacttcaggcgctcactcatcgtagtgccaacagtaagcataatgagcgtctggaatttcttggcgactcaatcctgagttttgttattgccaatgcactttatcaccgttttccccgtgttgatgaaggggatatgagccgtatgcgggcaacactggtgcgaggcaatacgctggctgaattggccagagaatttgagctaggtgaatgtctgcgtttggggccaggtgagttaaaaagcggtgggcatcgccgcgaatctattttagcagatagcattgaagctttgattggggccatttttctggatagcgatattcagacaattgaaagaattatattgagttggtatgaaactcgtttgaatgaaattagcccgggcgacaagcaaaaagatcccaaaacacgtttacaggaatatctgcaagggcgtcatttgccgttgccatcatatctggttgttcaggttcgtggggaagcacacgatcaggaatttacaatccactgtcaaatcagtggatttgaacaacctgttagaggagtaggttccagccgtcgcaaggcagaacaggcggctgcggaacaagcattaaaacaactggagcttgaatga

SEQ ID NO: 1881 - DNA, 906 bp, Xenorhabdus bovienii
  Coding sequence Name=Xb4151_4152.C430.gene100.dna; Position on contig= 65908..66813bp; Strand=+
atgagcgaagaaaaaaactattgcggatttgtggcaatagtcgggcggcctaatgtcggtaaatcgactttattgaatcagttactgggccagaagatatccatcacttcccgtaaaccccagacgacgcggcatcgtattatgggtatccatacggaaggagtttatcaagccatttatgttgatacaccggggcttcacatagaagaaaaacgtgctattaaccgtttgatgaaccgtgcggcgagcagctcaattggtgatgtggaactggttattttcgttgtcgaaggtacacactggactgcagatgacgaaatggttgttaataaactgcgtaatttgcattgcccagtgatattggccattaataaagtggacaatgtcacggataaagccatccttctgccccatatcggttttctcagcaaacagatgaatttccttgatgttgtgccgattagtgcagaaaaaggcatgaatgttgatactattgccaaaattgtgcgtgctcatatcccggaagctggacaccatttcccagatgattacattactgatcgctcacagcgttttatggcatcagaaatcatccgtgaaaaactgatgcgttttctgggtgatgaactgccttattctgtgacagtggaaattgaacaattcgttactaatgaacgcggtggttataccattcacggtttaattttggtagagcgtgaaggccagaaaaaaatggttattggtaataaaggcagcaaaatcaagacgattggcatagaagcccgtcaggatatggaaaagctgtttgataataaagttcatttagaactgtgggtaaaagtgaaagcgggttgggctgatgatgagcgagcgctgcgcagcctcggttacatcgacgacttataa

SEQ ID NO: 1882 - DNA, 738 bp, Xenorhabdus bovienii
  Coding sequence Name=Xb4151_4152.C430.gene101.dna; Position on contig= 66823..67560bp; Strand=+
gtggacggctggcagagagctttcgtacttcatgggcgcccttacagcgagactagtttactactggatttctttactgaaaatgaagggcgggtacgtgttttagcgaaaggtgtacgccgtcgtcgctcccatctgaaaggttgtctacaacctttcaccccgttgcttgttcgttggagtggacggggtgaaatcaaaatattacgggatgctgaacctatctcattagcgcttcccttgacaggaagtgtgctatacagcggtttatacgtcaatgagctattatccagagttcttgaacaaggcgcggcatatcctgcgcttttctttgattatcttcaatgtttacaaattcttgcggcgagtgaatacacgcctgaatatgctttacgtcgttttgaactcgccttgctaactaatatggggtatggagtagactatcttcattgtgcaggtagtggtgaacctgtgtcagatacaatgaattatcgttaccgtgaagaaaaaggctttattgctagcctggttgttgatcacttcagttttactggtaatgaactaaaagcgttggcaaccggtgaatttactgattcgcttactttgaaagcagctaaacgttttactcgcattgcgctgaagccttatttgggggggaagcccttaaaaagtcgtgagttatttcgccaattcgtacgtaaaaaaactgatattcctaataagaaaaatgaaaattga

SEQ ID NO: 1883 - DNA, 753 bp, Xenorhabdus bovienii
  Coding sequence Name=Xb4151_4152.C430.gene102.dna; Position on contig= 67608..68360bp; Strand=+
atgttattacaggagttaaaaatggctgaggtattattaggtattaacattgatcatattgcaacggtacgtaatgcccgtgggacacagtatcctgatccggtacaggctgcatttgttgcagagcaagcaggagctgatgggatcactgttcacctgcgtgaagatcgccgccatattactgatagagatgttcaactattagcaaaaacgattcaaacccgtatgaaccttgaaatggcagtaaccgatgaaatgattgatattgcttgccaaattaaacccgttttctgttgtttggttcctgaaaagcgccaagaagtgacaacggaaggtggcttggatgtattagggcaaaaagtgcatattgctgctgccgttaagcgtttatcggaagcaggtatttttgtttccctgtttatcgatgcagatcaccagcaaattgccgctgcggctgaagtgggagcgccatttattgagatccacacaggtgcgtatgcagatgcagaaaatgatatccagcaggaacaagaatttttgcgtattaaagaagcggtgacttacgccgcgggtaaaggcatcaaagtaaatgcgggtcatggtttgacgtatcacaatgtacagcgtattgctgccttacctgagatttatgaattaaatatcggtcatgccatcattggccgtgccgtatttagtggtttgtctgctgctgtggccgatatgaaaacgttgttgcgggaagcgcgcagttaa

SEQ ID NO: 1884 - DNA, 96 bp, Xenorhabdus bovienii
  Coding sequence Name=Xb4151_4152.C430.gene103.dna; Position on contig= 68360..68455bp; Strand=+
atggctattgttggattaggcacagatatagttgaaattttccgcattaaaaaaattgtcgagcgttctggtgaacgcttggcaaacgtgttttaa

SEQ ID NO: 1885 - DNA, 282 bp, Xenorhabdus bovienii
  Coding sequence Name=Xb4151_4152.C430.gene104.dna; Position on contig= 68617..68898bp; Strand=-
atgaaattgactcagaacgctgtactgaatgcgtcggacactatgaaaaaccaacctgccagtccgtctgcccgatcaccaatactattatccttaaccctgactatcaggaaagtgaagagcaactgtgggataagttcgtgctcttacatcacgcagataagatataaaatcaactttccaatatcaccgtcgcacaggcataacgccgttcatccggcagggatcttacattcagtttgtcagccagagtttctgctttactatgaagttttaatgtag

SEQ ID NO: 1886 - DNA, 111 bp, Xenorhabdus bovienii
  Coding sequence Name=Xb4151_4152.C430.gene105.dna; Position on contig= 69021..69131bp; Strand=-
atgtgttgcggttttgtgttacggtatacggtttttcaatgtaaaccatactgtataaaaacacaagaaccggacaaacgtaacgaatacggaagtgatttaattatatga

SEQ ID NO: 1887 - DNA, 162 bp, Xenorhabdus bovienii
  Coding sequence Name=Xb4151_4152.C430.gene106.dna; Position on contig= 69160..69321bp; Strand=+
atgtgtgagctattatatcaacgtaatgatattacggagttcttaatgaaaaatgcagtaacacatttacccaaatctcatcaaaatgacgaatatttaagcgctctagctagttgggagtcatgcaaacccctttattgccaacaacaaatatccgcttga

SEQ ID NO: 1888 - DNA, 237 bp, Xenorhabdus bovienii
  Coding sequence Name=Xb4151_4152.C430.gene107.dna; Position on contig= 69294..69530bp; Strand=-
ttgggagcggttgtgacacgccaccaagtgccggaaatttatcttgatgcggtcaattttcccaatggcaatccacaggcagacccaaccagagaagccgtgagtaagtacctgatagagcagaagcaggattcaaacgctgattttgttacctatgtgctggcgttacccagtgaaaccgatggtgccttgattccggcgagagtgattcaagcggatatttgttgttggcaataa

SEQ ID NO: 1889 - DNA, 93 bp, Xenorhabdus bovienii
  Coding sequence Name=Xb4151_4152.C430.gene108.dna; Position on contig= 69595..69687bp; Strand=-
atgccagtactcgctttcgaaaatctaagctgtagcccatctcattttatgccttgttatcttagatttagatattatgtcatattaatatga

SEQ ID NO: 1890 - DNA, 324 bp, Xenorhabdus bovienii
  Coding sequence Name=Xb4151_4152.C430.gene109.dna; Position on contig= 69648..69971bp; Strand=+
atgggctacagcttagattttcgaaagcgagtactggcatacaaagacaagcattcgttgactttcgaacaaacgagtgcccattttgagatctccatgcgtaccttgttccggtggtgcaataaaatagaaccttgcatgacccgcgataaacccgccacaaaaatccctgatgaggtactcattgcggatgtccaaaattttcctgatgactaccaatgggaaagagcaaaacgtttaagtgtttcacaatcggctattcattacgccttgaaacggctgaatatcaccccgaaaaaaaacgctccaaccccctcgcgctga

SEQ ID NO: 1891 - DNA, 324 bp, Xenorhabdus bovienii
  Coding sequence Name=Xb4151_4152.C430.gene110.dna; Position on contig= 69866..70189bp; Strand=+
atgggaaagagcaaaacgtttaagtgtttcacaatcggctattcattacgccttgaaacggctgaatatcaccccgaaaaaaaacgctccaaccccctcgcgctgatcctcaagctcgtcaggcatttatcgagcacatcagcgatgatgaacagactggcagaccccttgtttatttggatgaaagtggttttgctcaatcgatgccacgtaaacagggatattaggaaaaagggttacgctgttttggtacgcatgactggcacgcaaaaggccgtatcaacgtcattggcgccattctcgaaaagaccttcgtcaccttaa

SEQ ID NO: 1892 - DNA, 228 bp, Xenorhabdus bovienii
  Coding sequence Name=Xb4151_4152.C430.gene111.dna; Position on contig= 70246..70473bp; Strand=+
ttgctgccaaagcttccacacggagccgtgatagtgatggataatgcgcctttccataaacggaatgacacgacacaagcaatagcagacagccgatgtcaactggaatggcttcccgcttatagtccggatttaaaccctataaaacacaaatggggcggagcaaaagcgataaggaggcaaaaaagatgttcagttgatgagttgtttacggagcatattgaatag

SEQ ID NO: 1893 - DNA, 180 bp, Xenorhabdus bovienii
  Coding sequence Name=Xb4151_4152.C430.gene112.dna; Position on contig= 70445..70624bp; Strand=+
atgagttgtttacggagcatattgaataggtcaggttatgttaattctgctatatcacaacgtccgaaggcggtgactgcaccaccaaactttccgcatgaacaatattgtgaaattgccccccggacaattcaaaacccattggtagtccatcactgtctacggctaaatggattttag

SEQ ID NO: 1894 - DNA, 117 bp, Xenorhabdus bovienii
  Coding sequence Name=Xb4151_4152.C430.gene113.dna; Position on contig= 70717..70833bp; Strand=+
atgaaccaccattccgtatcagagtctttatataattacttgaataataactccacaaccaccgactttagtcggtggttgtggagtttagcggccaatgaacggggtgaagaatag

SEQ ID NO: 1895 - DNA, 237 bp, Xenorhabdus bovienii
  Coding sequence Name=Xb4151_4152.C430.gene114.dna; Position on contig= 70840..71076bp; Strand=+
atggcgactttattggctaattataaggcacaacaaaaaccggatcggatagaagcgctattaatggtgatgacctgttgtctgatggtctatgcagcgctggagcataagatccgccgcgaactgaaaaaaagcgtcccgtttttccctgatatgaggaacaaacggacacaatcgccagccgcgcgtgaggtctttctgattatagaagggataaactcctttgaatttcaataa

SEQ ID NO: 1896 - DNA, 423 bp, Xenorhabdus bovienii
  Coding sequence Name=Xb4151_4152.C430.gene115.dna; Position on contig= 71476..71898bp; Strand=+
atggaaattcgggtatttcggcaaaatgattttgaggccgtcaccacactttgggaacgctgtgatttgattaatcccggtgatgatccagaagtagatattgagcgtaagttaacccatgatgctgatttatttctagttgctgaagttgcgggagaggtagttggtacagttatgggcggctatgatgggcatcgtggacatgcttattatctgagtgttcaccctgaattcaggggcaggggaattgctaatgctttgatatcccgcttggaaaaaaaattattggcgagaggttgtccgagtattttgattttggtttcagaagaaaatgatgcaacgatttgtatgtgtgaaaaaatggaatatgattatttggggcaagaaaatactatttttagtaagcgcctgattattgattaa

SEQ ID NO: 1897 - DNA, 423 bp, Xenorhabdus bovienii
  Coding sequence Name=Xb4151_4152.C430.gene116.dna; Position on contig= 71925..72347bp; Strand=-
atgaatgaaaaggtgattattgcggtatttattatctctttaagcgtatctgtcatggcgagagcctcagatcaaaaatcggttttgccttctaatattcatgacaagttgaatcacattacaaatcaggaaaagcatcaggaaaaaaccacgatatttcaggagagaaaatttcatattcaatctccttgtagctttattatattagaagggaaatcagaatctcccatccatgatcattatcaactatatagaaataacgaaggaaaaattcaagttagaattgtctctagtatcggagataatatccccattgcgtcaaaaaaattatttattttacaaaataaacatcagatattcttgagtcatcttattataaagataattaatttagtactgtataattcaataatggctgaataa

SEQ ID NO: 1898 - DNA, 144 bp, Xenorhabdus bovienii
  Coding sequence Name=Xb4151_4152.C430.gene117.dna; Position on contig= 72376..72519bp; Strand=+
atgaaagtgatgttatcggtcattgtgtcaatctatcatcaatgttgtattgttcttgttttttttgcatttttgttgatgaaatttttcgtatttacaaatgaatgtttttttaagagtgtgttttgcataacccgtcaatag

SEQ ID NO: 1899 - DNA, 621 bp, Xenorhabdus bovienii
  Coding sequence Name=Xb4151_4152.C430.gene118.dna; Position on contig= 72540..73160bp; Strand=+
atgggtaaattttttgtatttaatttattgtccaaacagcgagttgtagccgttagtagtttattgggaagttcgctgttactaagtgcctgtgctggaataccagaattttcatggtcttcgttatcaccttgggagtggtttggcagtgccttacgtgtctctgaacaaggtgttggggaagtgaataaacagacagacatggatcaatctgcgattgaacaaggcttgaaaggcaaataccgcctgcgcagtgggatggaaactcaaaatggcaaattcgtcagcatcattcagggaatggagggtgatcaggtaaaaatcgaattgtctggtttggctaaggggaaagttaatcgtattgatgtgttggatgatagggtgaaaaccgtatggggaacaagaataggcacacctttctccgagctgtatggcaaagcgtttggtgtatgtcatcgttccagtgatttcattatgcagccaaccgtgatttgtattgcaccgcaaagccagcatatcagctatgtgtttaccgggcagtgggatggcccagaagggttaatgccttctgatgatgccctgaaaaattggaaaatttcgcggatcatttggaaatcctga

SEQ ID NO: 1900 - DNA, 204 bp, Xenorhabdus bovienii
  Coding sequence Name=Xb4151_4152.C430.gene119.dna; Position on contig= 73269..73472bp; Strand=-
ttggcactgtatgcgttgataagacccaaaaatgctaaggcaaccaacccgcccaataatttattgtttattgccactattttcatccaacaccttacccgtcacgcctattcgacaacgatttcttcatactgtatccagaatatttataacagggtagtttactatcccctgttttatataccgagtttttatgagaaatga

SEQ ID NO: 1901 - DNA, 1038 bp, Xenorhabdus bovienii
  Coding sequence Name=Xb4151_4152.C430.gene120.dna; Position on contig= 73387..74424bp; Strand=+
atgaaaatagtggcaataaacaataaattattgggcgggttggttgccttagcatttttgggtcttatcaacgcatacagtgccaacgcttatgccgtcggattattgaatagttcttacgatatttcgcgagagttattttctaccttgaaccctcaatttgaaaaacaatggaatgcacagcatccgcaagataaattaattattaagcaatcccatgcaggttcatccaaacaggcattgagtattctacaggggttacgggctgatgtcgtgacgtacaatcaggttacggatgtccagatcctgcatgatcgcggcaatcttattcctgccgactggcagcaacgtttgccaaataacagttcaccttactattccactatggcttttctggttcgcaaaggtaatcccaaacagatccatacttgggatgatttggtacgtcatgatgtgaagttggtttttccaaacccgaaaacgtcgggtaatgggcgttatacctatctggcggcatggggcgctttccaacagcaaaatgagcatgacccggtgaaagttcgccaactgatgcggcgtcttttgcaaaacgttgtggtatttgatactggggggcggggtgcaacgacttcatttattgagcggagtctgggtgatgttttgattagttttgaatctgaagtcaataacattcgtaaacagtatggtactgacaattatgaagttattgtgcctccggtagatattttggctgagttccctgtgacttggattgataaaaatgtccgcagaaatggaactgaagcagtggctaaagcctatttgaattacctttatagccccgcagcgcagcagattattgcgagcttcaattatcgagtgaatgataaaaatgtcatgaaagcacagaaacctcgttttcctgaaaccagactgtttcgtctggaagaacaattcggtaactggccgctggtgatgaaaacacatttcaacacgggcggtatgttggatcagttattggcggaaggacataaatga

SEQ ID NO: 1902 - DNA, 837 bp, Xenorhabdus bovienii
  Coding sequence Name=Xb4151_4152.C430.gene121.dna; Position on contig= 74421..75257bp; Strand=+
atgatgttagtggcatccggtaaacgcgtcctgcccggatttgggctgagtttgggcagtagcttgttttatacctgtctgatcttgttattgccattaagcgctctggctatacagctttcgagtatgacatggactcaatattggcaggtgattgtaaatccgcaggttgttgccgcttatcaggtgacattgctggctgctgcggccgccagtttcttcaacatggttttcggaatgttgatggcgtggatactgacgcgttatcactttcctggtcgcagtttgcttgacgggttgatggacttgccctttgctttgccgactgccgtggcaggcttaactttggcgaccctgttctctgcaacaggatggtatggcgcttggctgggcaattttgacatcaaggtagtgaatacttggctgggaattgcagttgcgatggcatttacaagcctgccgtttgtcgtccgcacagtgcagcccgttcttgaagaacttggccctgaatatgaggaagcggcgcagacattgggcgctagccgctggcagactttccggcgagttattctgcctgaagtttcacccgcattgatggccggaaccgtactctctttcactcgcagcttgggggagtttggggcagtaatttttattgcaggcaatattgcatggcaaacagaagtggtttccctgatgatctttgtccgtttgcaagaatttgattatccggctgctagtgcgattgcttctgtgatccttgcggcatcgttgttactgctgtttagcgtcaatatattgcagagtcggtttggtaaacggatcggggggcattga

SEQ ID NO: 1903 - DNA, 840 bp, Xenorhabdus bovienii
  Coding sequence Name=Xb4151_4152.C430.gene122.dna; Position on contig= 75257..76096bp; Strand=+
atgactgagttatctgcatacacagtggcacagcgctctcctatcaactggggaaaatgggtactgattggtacgggtatactcgtttctactctgctgctggtaatcccgataatgtggatttttttgaccgctttttcgaaaggtttcgatctcgttaaacagaatcttcttgatcccgatatgctgcatgctatctggttgaccgtgatgattgcgcttatcacagtccctatcaatctgatttttggtgtgatgactgcttggctagttactcgattccaatttcccggtaggcagttattgctgacattgatcgatattccgtttgctgtttcacctgttgtggcagggctgctttatctgctgttttacggtgtcaatggttggatgggaggctggctgggttcttatgatatgcaattaatgttttcatggccgggtatggtactggtgacggtatttgtgacatgcccatttgttgtccgtgagttggtgccggtgatgttaagtcagggtagtcaggaagatgaggcagcaatattgctgggcgcttctggctggaagatgttctggcgtgtgacattaccgaatattcgctgggcattgctatatggcatcgttttgaccaatgctcgggcgattggggaatttggcgcagtttctgtggtatcaggggcgattcggggtgaaacctatacgctgcctttgcaggttgagctgctgtaccaagattacaacactgtgggtgcatttacggctgcggctttattggcagtgatggcgattatcactctgatggtcaaaagtgctgtgcagtggcgattaagccaccagtaa

SEQ ID NO: 1904 - DNA, 1089 bp, Xenorhabdus bovienii
  Coding sequence Name=Xb4151_4152.C430.gene123.dna; Position on contig= 76117..77205bp; Strand=+
atgagtattgaaatcagtaaaatcagcaagtcttttggccgggtccagatactgagtgagatttcattaggtattgaatctggtgaaatggttgcgctacttggcccgtccggttctggtaaaacgactctcctgaggatcattgcagggcttgagcagcaaagtgcagggcaattgaagtttaatggtcaggatgtcagtcgagtgcatgcgaaagatcggcgagttggctttgtattccagcattacgccctatttcgccatatgaacgtctttgataacgtcgcttttggtttgactgtgcttccgcgtcgtcaacgcctcagtggtgaggcgctccgcagtaaggtgatggtattgcttgatatggttcagttatcccaccttgctgatcgttacccgtcacaactttctggtgggcagaaacagcgtgtggcattagcaagggcattggcagtggaaccgcaaatcctgttgctggatgagccgtttggtgctttggatgcacaggtacgtatggaattgcgccgctggttacggcaacttcatgaagaactgaaatttaccagtgtattcgttacccatgatcaggaagaagcgatggaagtagcggatagagtggtggtgatgaatcaagggtgtattgagcaagttggtacgccgcaacaggtgtggagagagccagaaagccgttttgtgctcgaatttatgggagaggtcaatcaattacacggtgaaataaaaggttcccaattatgggttggggggaaaattttcccattgaatgtgacaccattacatcagggaaatgttgacgtgtttctccgcccatgggaaatgactcttagtacccaacaaactgcatcttgtcctttacctgttcaaattgtggaaatcagcccacgcggccatttttctttgttgtctgtcttgccagtagggtggggaaaagacctcttatcggttatctggcagggtgattcacctgttcctgttaggggaaaccagtattttatgggaggcactggagctagactgtatgcaggtgacctgccattaaaagtgctcagactcgctgaatcagcttga

SEQ ID NO: 1905 - DNA, 129 bp, Xenorhabdus bovienii
  Coding sequence Name=Xb4151_4152.C430.gene124.dna; Position on contig= 77269..77397bp; Strand=-
gtgagtcgttgtaatttaaccagcggagtattgcctataaaatcttccaagcttgccacagcattacctaattcatatgagagtggacaacaaaataatcatattcagaaaactgtagcaagatcttaa

SEQ ID NO: 1906 - DNA, 882 bp, Xenorhabdus bovienii
  Coding sequence Name=Xb4151_4152.C430.gene125.dna; Position on contig= 77339..78220bp; Strand=+
gtggcaagcttggaagattttataggcaatactccgctggttaaattacaacgactcaccgaaagtgttgatgcggaaatttgggtaaaactggaaggtaacaatcctgctggttccgtgaaagacagggctgcattttcaatgatccagcaggctgaattacgaggagaaattgcgccgggagatgtgctcatagaagcaacgagtggcaatactggcattgcactggctatgattgcggcagttaaaaattataaattgaaattattaatgcctgaaaatatgagtcttgaacggcaggcgtcaatgcgggcttacggtgcagaattgattctggtcagtaaagaatcaggcatggaaggtgctcgggacttagcgcagaaaatggaacaagagggagaagggaaggttcttgaccaatttaataatatggataatgcactggcgcacttcaatacaactggtccggaaatctggcagcaaacgcaggggcgcataacgcattttgtttccagtatgggaacgacggggacaattacaggagtgagccgctacctgaaatctcaatcagataaagtgcacactacgggattgcagcctgcagaaaatagccagatccccggtattcgccgttggtctcccgcttatatgcctggtatttacaaaaaagagttagtggatcagctcttggatatcacacaaatggaagctgaaacgacaatgcggctattggcgcagaaagaaggcattttttgtggtgtcagttctggcggtgctgtttcaggggcactgcgcattgcggctaaaaatccaggggcagtcattgtagcgattgtctgtgatcgtggtgacaggtatttgtctactggggtatttaattaa

SEQ ID NO: 1907 - DNA, 102 bp, Xenorhabdus bovienii
  Coding sequence Name=Xb4151_4152.C430.gene126.dna; Position on contig= 78171..78272bp; Strand=+
ttgtctgtgatcgtggtgacaggtatttgtctactggggtatttaattaaacgcctatcccctttgggtatatgttatttggcattaaacgtcgctttttga

SEQ ID NO: 1908 - DNA, 114 bp, Xenorhabdus bovienii
  Coding sequence Name=Xb4151_4152.C430.gene127.dna; Position on contig= 78245..78358bp; Strand=-
ttgattaatcgcccctgtattatcaggcattttaccggattaagcctgataatacaggggcgatttttttgtggtttgctgctcagtcaaaaagcgacgtttaatgccaaataa

SEQ ID NO: 1909 - DNA, 105 bp, Xenorhabdus bovienii
  Coding sequence Name=Xb4151_4152.C430.gene128.dna; Position on contig= 78355..78459bp; Strand=-
gtgaatctgtcatcatgcgtatcaaaagataacagaaaaatcatcgggaacacgttttccgctcttttcctgtttacagatccttcttatttttcagatggttga

SEQ ID NO: 1910 - DNA, 510 bp, Xenorhabdus bovienii
  Coding sequence Name=Xb4151_4152.C430.gene129.dna; Position on contig= 78428..78937bp; Strand=-
atgggtctgcttgataaactgaaatctctggtttcagacgataaaaaaaacagcggcagtattgaaattatcgccccattgtcaggtgaaatagtcaatatcgaagatgttccagatgttgtttttgccgaaaaaatcgttggggatggtatcgcgattaaacctgccggcaacaaaattgtcgctcctgttgatggcaccattggtaaaatcttcgaaactaaccatgctttttctatcgaatcggatagcggagttgaactgttcgttcattttggtattgataccgttgagctgaaaggtgcgggctttaaacgcattgccgaagaaggtcaacgagtacagaaaggcgatctggttttagagtttgatctggcatttctggaagaaagggctaaatcaacattaactcctgttgttatttctaacatggacgaaattaaagaattgtctaaagtgagtggatctgtagttgtaggtgaatctgtcatcatgcgtatcaaaagataa

SEQ ID NO: 1911 - DNA, 1728 bp, Xenorhabdus bovienii
  Coding sequence Name=Xb4151_4152.C430.gene130.dna; Position on contig= 78986..80713bp; Strand=-
atgatttcaggcatcttagtatcaccaggcattgctttcggcaaggcattattgctgaaagaagaccccatcattatcaatcagaaaaaaattactacagaacaaaccgaacaagaaatttcccgttttaaacaaggtcgagacaagtcttccgtacagttagaaataattagaaaaacagccgaaaaaaatttaggtgcagaaaaggctgagatcttcgaaggccatattatgttgctggaagacgaagagctggaacaggaaattgttaccctgattaagaaaaatctggcaacagcagatgccgctgtttattccgttattgaagatcaggctaaggcactggaagaactagacgatgaatatttgaaagaacgtgcggccgatgttcgcgatattggtaaacgcctgctgaaaaatattctgggtatgccgattatcgatttaggcactattgaagaagaagctatcctcattgccaatgatttaactccatcggaaaccgcacaactcaatctggacaaagtgctaggtttcatcactgatttgggtggccgaacatcccatacctcgattatggcccgctctctcgaattacccgcaatagtcggtactaccaatgcaacaactcaaatcaaaaatggcagttacctgattctggatgcagttaataaccagatttatgtgaacccgtctaatgctgaaatcgatcaactgaaaaaggcaaaacacgagtatctgtcagaaaaaacagaactggcaaaactgaaagatttacctgctattacactggatggccatcaagttgaagtttgtgccaatatcggtacagttcgtgatgtcatgggtgcagagcgcaatggtgccgaaggtgtaggactataccgcaccgaattcctgtttatggatcgcgatacgctgcctactgaagacgagcagtttgaggcatataaagcggttgcagaagccgttggcaaccaagccatcattatccgtaccatggatatcggcggtgataaagatttgccttacatgaacctgccaaaagaagagaacccattccttggctggcgtgcaattcggatttgccttgatcgtaaagaaatcttacattctcaattgcgtgctatcctgcgagcctctgcatttggtaaactccgcattatgttcccaatgattatttcagttgaggaaattagggagctgaaagcagaactggcgttgctcaaaaaccagttacgtgatgaagacaaagcatttgatgaatctattgaagtcggcatcatggtggaaacacccgctgctgcaaccattgctcatcatcttgcaaaagaagttgacttttttagtattgggacaaacgatctaactcagtatactcttgcggtagaccgtggtaatgagctgatttctcatctttataacccaatgtcacccgcagtgttgagcctcatcaagcaggttattgatgcctcacacgcagaaggtaaatggacgggaatgtgtggagagctagctggtgatgaacgtgccgcgctgttactcttaggcatgggattggatgagttcagcatgagtgcgatatcaattccacgcatcaagaaaatcattcgtaatgccaattacgatgatgcgaaagcgctggcagagcaagccttatctcagccgactgcaaaggaattgatggatttggttgacacctttaccagagaaaaaacactctgctag

SEQ ID NO: 1912 - DNA, 177 bp, Xenorhabdus bovienii
  Coding sequence Name=Xb4151_4152.C430.gene131.dna; Position on contig= 80643..80819bp; Strand=+
atggggtcttctttcagcaataatgccttgccgaaagcaatgcctggtgatactaagatgcctgaaatcatactatatgaccttactgcgggtgattaccttccattaagccttcaggggggaggctataaatatccccaaattttatttatctggggatggaactcggtgaaatga

SEQ ID NO: 1913 - DNA, 258 bp, Xenorhabdus bovienii
  Coding sequence Name=Xb4151_4152.C430.gene132.dna; Position on contig= 80847..81104bp; Strand=-
atgttccagcaagaagtcacgattactgcaccaaatggcctccatactcgccctgctgcgcagttcgtcaaagaagcaaaaggtttctcttctgacatcactcttacttctggtggcaaatctgccagtgcgaaaagcctgtttaagctgcaaacgctgggactgactcaaggtactgctgtaacaatttccgctgaaggcgaagatgaacagcatgctgttgaacatttagttaagctgatgggtgaattggaataa

SEQ ID NO: 1914 - DNA, 144 bp, Xenorhabdus bovienii
  Coding sequence Name=Xb4151_4152.C430.gene133.dna; Position on contig= 81143..81286bp; Strand=-
gtgtttattaacataaaatcaacaattgaatgcatcgagtatgttaattttttgataatgcctaaatacaccttatttcattatcaatttaacggttgtacaagccagaacgggttcagctacactagttttagaattttctag

SEQ ID NO: 1915 - DNA, 171 bp, Xenorhabdus bovienii
  Coding sequence Name=Xb4151_4152.C430.gene134.dna; Position on contig= 81216..81386bp; Strand=+
gtgtatttaggcattatcaaaaaattaacatactcgatgcattcaattgttgattttatgttaataaacactatccgagtatttgttgaattggatggtgcttttcattctggctcagcgattaatttcgtgcatcaaaataattactggttaaatactaaagctacttga

SEQ ID NO: 1916 - DNA, 108 bp, Xenorhabdus bovienii
  Coding sequence Name=Xb4151_4152.C430.gene135.dna; Position on contig= 81383..81490bp; Strand=+
ttgaataaatcatctaggaaagttttaaactttgatctgatgcacaaaaaagcacccttaaggtgcttttttgtcaatgaaattgcaaaaactcagagtgatttttaa

SEQ ID NO: 1917 - DNA, 954 bp, Xenorhabdus bovienii
  Coding sequence Name=Xb4151_4152.C430.gene136.dna; Position on contig= 81487..82440bp; Strand=-
atgagcaaaatttatgaagacaattcgttgactattggtcacactccactcgtacgtttaaaacattttggtaatggccgcattctagcaaagatagaatcccgcaatccaagtttcagcgtaaagtgccgaattggtgccaacatgatttgggacgctgaaaaacgtggcatcctgaccaaagataaagaacttattgaaccaaccagtggcaacaccggtattgctcttgcttacgttgcggctgcccgtggctataagctgacccttactatgcctgaaaccatgagtcttgagcgccgcaagctgctgaaagcgctgggagccagtctggtgctgaccgaaggcgcgaaaggcatgaaaggtgccattgataaagctgacgaaatccgtgatagcgatccagaccattatattctcctgcaacaattcagtaatccggcgaaccctgaaattcatgaaaaaaccacaggcccagaaatctgggaagctaccgatggcaatatcggtgctttcgttgcaggtgtagggactggaggcacaatcacaggggttgctcgttacctgaaaaatacacaagccgcacaagtcactatcgttgctgtagaaccagaagattctcctgtaatcagccagaaacttgctggtgaagaacttaagcctggcccacacaagattcagggaattggagctggtttcatccctgataacctagatttaacattagttgaccgtgtgtttaaagtcagtaatgaagaagccattaaaatagcgagagaagtcactgaaaaagaaggaattcttgctggaatttcctcaggagccgctgtcgctgccgccgtcaggttatctcaggaagacgaatataaagataaaaatatcgtggttattttgccttcttcggctgaacgttatctcagtaccgccctgtttgccgacttagccaatgattaa

SEQ ID NO: 1918 - DNA, 777 bp, Xenorhabdus bovienii
  Coding sequence Name=Xb4151_4152.C430.gene137.dna; Position on contig= 82728..83504bp; Strand=-
atgacgaattcgacaaaactgccaaaacatttgagcgggtttcattatattgtacaaggttggcatctgataacccgctctggcatcaagagattcgttttattacccttactggccaatattttattgctgggtggttcattctggtggttgtaccataaactggatggttggatactatgggcgctcgataaaataccagattggatgcaatggctaagttatttgctgtggccattggctgtcgtctcaattttgctgatctttacctattttttcagcatactggctaattttattgcctcaccattcaatggattactggccgaaaaattggaagcggaattaactggcattccagcgccggacactggcatggtcgatttgataaaagatacaccccgtattttgaaacgtgagatagtaaaaatcctctactatattccgcgtgcgctcgtactgctgttgctatatttcattccgggtattggtcaaactgtcgctcctgtcctctggcttattttcagtgcctggatgttgactatccaatactgcgattatccgtttgataatcacaaaatcagtttttctactatgcgcagtaccctgcgacaaaacaaaattgacaatcttcaatttggtgcagccgttagtgtattgaccatgatcccggtagtaaacctgttcattatgcccgttgcagtctgtggagctacagccatgtgggttgatcgctatcgcgctcaacacgccttacaccataacccatcccattaa

SEQ ID NO: 1919 - DNA, 306 bp, Xenorhabdus bovienii
  Coding sequence Name=Xb4151_4152.C430.gene138.dna; Position on contig= 83521..83826bp; Strand=-
gtgacgaacgctctttgcggctggtccacaacccatgtaatagcaaagctattatggctatcgcaccaacaacgattaatatcagacgcaaatcctgcatcattgctatctctgttgtttaaattaattgccaccacggcagaatattctttagataagagtatttgtcaaatagcacaagtgcaagtctctacatacttttcttaccataaaggagatataccctgttttttcggatattttttacgcacaaaactactggtcagtagaaaatcctgcctatatcataccgtctcaatcatctag

SEQ ID NO: 1920 - DNA, 927 bp, Xenorhabdus bovienii
  Coding sequence Name=Xb4151_4152.C430.gene139.dna; Position on contig= 83727..84653bp; Strand=+
atgcaggatttgcgtctgatattaatcgttgttggtgcgatagccataatagctttgctattacatgggttgtggaccagccgcaaagagcgttcgtcactctttcgtgatcgcccagttaaacgtcataaacaggagcgtcaggaagagctcgacgataatgatggcgataaactgtttgataattcgtcaaagtcgcatgttcaagagtcagtcaagcctcgtaatgaacatcgtgaagagcctgttattaaacgctctgtacctgagttatcagcggaagcgcctgatgaggcttttgatcctttgctttcaaatcagcaatctgaagcatcagcggcaaaagtaaaaaccgctgaggaatatcaggaagagccacagcttggcttatttgagtctactgagcagagtgctgaggcagcagaatcggttgtcaatacagcagttgtggaagaacaactgaacgtattggaaaatgaagctgtgggtgaagttgagcaagtcaaaaaagaaacagtgctggtattacatgtctctgcccatcatggtcaggagcttgatggcgaagcactgcttcaaagtattttgcaatctggcttccggtttggtgatatgaatatctttcatcgtcatttgaacccggcgggcagtggagcggtgttgttcagtctggctaatatggtaaaaccaggctcgtttaatccagaactcatggacgatttcagcacccctggagtttccatgtttatgcttgtgccatcatatggtgatgctaatcagaactttaaactgatgttgcaggcagcacagcggattgcttctgatgtgggtggcgttgtgttggatggtgagcgaaaaatgctcacgccacaaatgatcgaacactataaggcgcgtattcgcaatacgctcaatgcctgcgaataa

SEQ ID NO: 1921 - DNA, 2019 bp, Xenorhabdus bovienii
  Coding sequence Name=Xb4151_4152.C430.gene140.dna; Position on contig= 84715..86733bp; Strand=+
atggaaagtattatcgaaaaaatcaacaaactaagagcaacattgcgtcatcacgagtatttgtatcatgttatggatgcgccagagatccctgatgcagaatatgatcgcttactgcgagaattaaaagtactggaagagcagcatccagagttgattacggctgattctccaacccagcgtgttggtgcggcaccattaacggcatttggtcaggttcgtcatgagatcccgatgctgtctttggacaatgtttttgatgaagaaagttatctggcatttgacaagcgtgttcgtgatcgtctgaaagatagtcgggatttggtgttttgctgtgaattgaaactcgatggactggcggttagcttgctgtacgaagatggtgagttggtacaggctgcgactcgtggtgatggtacgacaggggaaaatatcactgttaatgttcgtactattcatgctatccccctgcgcctgaaggggaataatattccagcccgtgttgaaattcgtggtgaagtttttatgaagcagggtgggtttgaaaaactcaatgacgaagcgcgtcgtaagggtaacaaagttttcgctaatccacgtaatgcggcagcaggatcactgcgccagcttgatccgcgtattacggccaaacggccattgaccttttattgctatggcgtcggtgttctggaaggtggagaattaccggcgagccattacgaacgtctgatgcagttcaaacaatggggtttgccagtcagtgacaacgtgaaattatgccagggaactcagcaagtcatcgacttctaccataacattgaacagcagcgcccgatattgggttttgatattgatggcattgttatcaaagttgactcccttgaattacaggaaacgttgggttttgttgccaaagcgccccgttgggcaacggctttcaagtttgctgctcaggaacagatgaccatcgtgcgtgacgttgaatttcaagtgggacgtactggcgctatcacacccgttgcacgtttgaagccggtgcaagttgcaggggtaatagtcagtaatgccacactacacaatgcggatgaaattgaacgtttggggctgcgtattggggataccgtggttattcgtcgtgcgggtgacgtgatcccaaaagttgttggtgttgtacaggataaaaggccagccgaaagtcaggaagtgatttttcctgaatactgcccagtttgtcgctcggatattgagcgagtcgaaggggaatccgtggcgcgctgtactggtggattgttttgcggtgcgcagcgtaaagaagcgctcaaacatttcgtttcccgtcgagccatggatgtcgatggtatgggagaaaagatcattgagcagcttgtcgataaagaatatgttaaaacacctgccgatcttttccgtctgagcgctggaaaattaacgggtcttgagcgaatgggacctaaatctgctcagaatacgattgatgccttggaaaaatccaagaaaaccacattcgctcgttttatctactctctgggaattcgtgaagtcggggaggcgactgcagctaatttggttgcacattttgtcacattagaaaaactgcgggcagcagatactgaagcgttaatcgcggtgcaggatgtgggaggtgtagttgctagccatgtcgtgaatttctttaatgaaccgcataatcagactgtgattgatgacctcattgacaatatcggaatttactgggaatcagttgaaacgttgcagtcagacacagttggtaactcatttgctggcaagactgtggttttgacaggctcgctaaaccgtttatcccgggatgaggccaaagataagctgacagcgctgggcgcgaaagtgacaggcagtgtttccaagaaaacggatttagtcattgctggcgaagctgcgggttctaaattagccaaagccacggaattaggaatagaagtcattgatgaagaagaaatgcttcgtctgttaggtgaataa

SEQ ID NO: 1922 - DNA, 255 bp, Xenorhabdus bovienii
  Coding sequence Name=Xb4151_4152.C430.gene141.dna; Position on contig= 86722..86976bp; Strand=-
gtgaattattgtgataacaataattcactattatgcggaaacaaattcccatttagcaaactcgttcacactttagtcaggaacgtgttggctgggtatgcaaaaagaaacatcaagtatagggtgctatcaagatctattctcagtagccccccttatttttatttaataaatcatttttatccccttcatctttcaagtcacccgctttattggctgcaacttgaaatctattgggtatatttattcacctaa

SEQ ID NO: 1923 - DNA, 120 bp, Xenorhabdus bovienii
  Coding sequence Name=Xb4151_4152.C430.gene142.dna; Position on contig= 86981..87100bp; Strand=+
atgcgttacataaaatgtaattataaatttgtgcttcgccatgtctgggattctctttatgtctcatataagtactatcaattatcattcgtgcgattggtactgtgttgtccaaagtga

SEQ ID NO: 1924 - DNA, 231 bp, Xenorhabdus bovienii
  Coding sequence Name=Xb4151_4152.C430.gene143.dna; Position on contig= 87106..87336bp; Strand=+
atgggtaaactggagtctttcaatgcggttggctcgttgattctggggcagtcagaaaacttcgttgcttataaaaatgtgctggatagaatgtctgagtgtcgtatgtacacgatggcggcggcaatgtctacggtctctatgtttatcgtagtcgctgcactggtacttaacatgttcagtagctttatcgttctgtcactgatcaacccttactctgtcgagagctaa

SEQ ID NO: 1925 - DNA, 279 bp, Xenorhabdus bovienii
  Coding sequence Name=Xb4151_4152.C430.gene144.dna; Position on contig= 87349..87627bp; Strand=+
atgaacaatctgcacgaatggcaaagtttgattcgcattcaaattaaaaaggctgacatgatgaataaagaaaatctactggagattgccaacacggccatgccgttcggcaaatataaggggcggatgctgatagacctcccagaagaatatttactctggtttgcccgtaagggagagtttccacaaggcaaacttggggcattaatggagataactcttgctatcaaaattgaagggttggattcgttggtcaagccattaaaaaatcgtgactaa

SEQ ID NO: 1926 - DNA, 201 bp, Xenorhabdus bovienii
  Coding sequence Name=Xb4151_4152.C430.gene145.dna; Position on contig= 87620..87820bp; Strand=+
gtgactaaaacactctttgtttccggcatttgtccttctcaaacatacagtacaataacatacagagctaaacacaccagagataggcatataagaaaaatccctgaaaacttgcgtcttcagggattcagaattttggtggagctaagcgggatcgaaccgctgacctcttgcatgccatgcaagcgctctcccagctga

SEQ ID NO: 1927 - DNA, 168 bp, Xenorhabdus bovienii
  Coding sequence Name=Xb4151_4152.C430.gene146.dna; Position on contig= 87799..87966bp; Strand=+
atgcaagcgctctcccagctgagctatagccccacaaatgtggttcaagttttgaattccaagtatcgattatcgtttttcattacgaaaaaggataagtatttggtggagctaagcgggatcgaaccgctgacctcttgcatgccatgcaagcgctctcccagctga

SEQ ID NO: 1928 - DNA, 165 bp, Xenorhabdus bovienii
  Coding sequence Name=Xb4151_4152.C430.gene147.dna; Position on contig= 87981..88145bp; Strand=-
atgacacaaaatagtaaaggcactcaacttattgcagtgcctttattgttactatcgcaggcgaatattgatgactttttcagcgcttacacagagaatattaatgaatccattgacagaattctctgggtttcatattatgcgccccgttccacaggattttga

SEQ ID NO: 1929 - DNA, 1395 bp, Xenorhabdus bovienii
  Coding sequence Name=Xb4151_4152.C430.gene148.dna; Position on contig= 88174..89568bp; Strand=-
ttttgcaccaagtcctactggctatctcacgttggtggtgcgcgtactgctctttattcctggttatacagtcgccacaacaaaggtgaatttgtactgcgcattgaagacaccgatctggagcgttccactcaagaagccatcgatgcaattatggacggaatgaactggttaaatctgaattgggatgaaggcccttattatcagaccaaacgttttgaccgttataaccacgttattgatgaaatgctggagcaaggtactgcttaccgctgctactgttccaaagagcatttggaacaactgcgcgaaacccagatggcgaatggcgaaaagccacgttatgatggctgctgccgtgatagcgaatgccagcacagccatgatgagccacacgttgtgcgtttccgcaatcctcaggaaggttccgtcatttttaatgacagcatccgtggcccaatcgagttcagcaaccaggagctggacgatttgatcattcgccgtaccgacggagcgccaacttataatttctgtgttgtaattgatgactgggatatggagattacgcacgttgtacgtggtgaagaccacatcaataacacgccacgccagattaatattctgaaagccctcggtgctcctgttccagaatatgcccacgtttccatgatcctgggtgatgatggtaaaaaactgtccaagcgtcatggcgcagtcagtgtgatgcaataccgtgatgatggctatctgccggaagcgctgttgaactatctggttcgtctgggttggtcacatggcgatcaggaaattttcagcgttgaagaaatggtcaatctgttcagccttgatgccatcagcaaatcagccagtgcattcaatactgaaaagctgcaatggttgaaccatcactacatcaataccctgccagctgaacaagtcgcggtgcatttggcatggcacattgagcagcagggtatcgatacccgtactggcccagaactggttgctctgatcaaactactgggtgaacgctgcaagacactaaaagaaatggcaggttcctgccgctacttctacgaagaatttgcagaatttgatgctgatgccgcgaagaaacatctgcgccctgttgcccgtcaaccactggaagttgctcgagcgaaactggctgctgtcactgaatggacaccagaaaatatccatcatgccattcaggcgactgctgatgaactggaagttggtatgggtaaagtcggtatgccactgcgtgttgcagtcaccggtgccggccaatctccaagtgttgatgtcactattcatgccatcaatcaagcacgttcattgtctcgcattgataaagcactggcctatattacccagcgtgaagtgcaataa

SEQ ID NO: 1930 - DNA, 198 bp, Xenorhabdus bovienii
  Coding sequence Name=Xb4151_4152.C431.gene1.dna; Position on contig =36..233bp; Strand=+
atgccagctgattatcacctctgtttaacggaagaatcgcggagcgttgctgtttgtcgatctgattaccccgacagagaagaaggtgaagtacgtcagtttttgacagagcggggaatgtcactgtccgagactcctgctgatcagttcggctcttctattgctggctgtgtcatggttggaagatcaggcagctga

SEQ ID NO: 1931 - DNA, 189 bp, Xenorhabdus bovienii
  Coding sequence Name=Xb4151_4152.C431.gene2.dna; Position on contig =214..402bp; Strand=+
ttggaagatcaggcagctgaagatgaagtccaagcacaaattatgttgtttgatgagtatcttttaccttggtgtgggcagttcctcggtaaagttgaagcccatgcaaccagtggtttttatcgaacgctggcgattgtcactcgtgaagcgttgcaggcattgcgtgatgaattagaatctgagtga

SEQ ID NO: 1932 - DNA, 564 bp, Xenorhabdus bovienii
  Coding sequence Name=Xb4151_4152.C431.gene3.dna; Position on contig =527..1090bp; Strand=-
atgaaaagatttttcttaggggcagcattagtgctggtaggattagtcagcggctgtgatcaatttaaagacttcagcatcaacgaaggtctgatgaatgattatttgctcaaaaaagtgcattatcagaaaaaaatcagcattccgggtatcgcgaatgccaatatcacgctgggggatttatccagccagataggccgtcatgatcctgaaaaaattgaactatccacgcaagcaaaaattcaacttgcaacgctcttgggtacgattcaggctgatatgaaactcactatcaaggctaaacccgtatttgatgcagaaaaaggcgctattttcgtgaaagggctggaaatcgtagactaccagacaacaccggaaaaagcagcggctccggttaaggcattgattccttatctgaatacctctttgagtgagtttttcgatactcatccggtttatgttctgaatccagaaaaaagcaaggccgaggcagcggcctcacaattcgccaaaaggttggaaattaaacccgggaaattagttattggattgaccgataaataa

SEQ ID NO: 1933 - DNA, 1206 bp, Xenorhabdus bovienii
  Coding sequence Name=Xb4151_4152.C431.gene4.dna; Position on contig =1143..2348bp; Strand=-
atgtcgttggtttcacaagcacgtagcttgggtaaatacttcctgctatttgataatttattagttgttttaggtttttttgtcgttttccccctaatttcaattcgtttcgtcgaacaacttggctggacagcattgattgttggtttcgctctggggcttcgtcagcttgttcaacaaggcttggggatcttcgggggtgccatcgcagaccgatttggtgccaagccgatgattgttactggtatgttattgcgggcactgggttttgctctgatggcaatggcacatgagccatggatattgctactttcctgcgttctatcaggattgggaggaaccttgtttgatcctcccagagcggctttggtcattaagttaacccgtccccatgagcgagggcgtttttattcaatcctgatgatgcaggacagcgcaggtgccgtggttggcgcactcctcggaagctggttgctgcaatatgatttcaatattgtctgctggattggtgcatccatttttgtgctggccgcgttatttaacgcctggctactgcctgcataccgtatttctacaatccgtactcctatcaaagaaggtattatgcgggttattagagatcggcggttcttttactatgtgctgacattgacgggttattttgtcctgtcagtacaagtgatgctgatgtttccgattattattcatgaaattaccggcactcctaccgccgtcaaatggatgtatgccattgaaaccgttatctccctgacattgctttaccccatcgcacgctggagtgaaaaacatttccgactggaacagcgcttgatggcgggcttgtttttgatgagcatctgtatgtttccgatcggctgggtcaatcaattacatacactgtttggcctgctttgcctgttctatttaggcttggtaacagcagatcctgctcgtgaaacgctgagtgcttcactatctgatccacgggcgcgtggcagttatatgggatttagccgtctgggtttagctctgggtggtgcgataggttacaccggtggaggatggctctatgatactggccgtgtcttgaatatgccgcaattaccttggattttgctgggattgtctggtttgattaccatttatgctcttcatcaccaattcaataaaaagaaaattgatcctgtgatgcttggcagacactaa

SEQ ID NO: 1934 - DNA, 201 bp, Xenorhabdus bovienii
  Coding sequence Name=Xb4151_4152.C431.gene5.dna; Position on contig =2323..2523bp; Strand=-
atgccttctcctgatgtttgtcttgaaaaattctggataatttatctcttattaaaattattgcctattacccacgataaaaaaatatcatctataaccctctaccttaaagaagagattagggtcagaataataagaactttatatttattctctcatatttcaatggtgcgcaatgtcgttggtttcacaagcacgtag

SEQ ID NO: 1935 - DNA, 588 bp, Xenorhabdus bovienii
  Coding sequence Name=Xb4151_4152.C431.gene6.dna; Position on contig =2522..3109bp; Strand=+
atgtttggttatcgttctgcatcgcccaaaattcgatttattacggataggatggttattcgtctggtatatgaacgtgatgcttatcgattggctgagtattattcagacaataaaaatttcctgaagccatgggagccaacaagggatggcagtttttatcaaccctctggatggacaaatcggttgaactatatcgctgagttacaacggcagaatgcgacatttaattttgtattattggactctgatgagcgtgaaattatggggatggcgaattttactaatgttgtacgcggcgcgttccattcttgttatcttggttattctctggcggggaaattgcaaggacaaggattgatgtatgaagcactgcaacctgcgattcgctatatgcagcgctatcagaaaatgcatcggatcatggctaactatatgccacacaaccatcgcagtgggaatctgctcaaaaaattggggtttgagcaggaaggttatgccaagaattatttaatgatagatggtatttggcaggatcatgtgctgacggcattaactgatgatgcatggggtaaagtggatttatga

SEQ ID NO: 1936 - DNA, 1539 bp, Xenorhabdus bovienii
  Coding sequence Name=Xb4151_4152.C431.gene7.dna; Position on contig =3292..4830bp; Strand=+
atgaacttattgaaatcactggcagcggtcagttcaatgacgatgttttcccgcgtgctgggctttatccgtgatgccattattgctcgtatatttggcgcaggaatggcaacggatgctttttttgttgcgtttaaattacctaacctgttacgtcgtatctttgcagagggcgctttttcgcaagcttttgttcctattcttgccgaatacaaaaatcaacaaggggatgaagcaacacgtacttttattgcgtacatctcaggtatgttgacattgattctggctatcgtctcagtgataggtgtaattgctgcaccttggatcatctatgtgactgcgccgggatttacggatacaccggataagtttgttttaacccgtgatttacttagaattacgtttccttatatctttttgatttcgctggcttctttggctggtgcaattctgaatacctggaaccgcttttcggtgcctgcttttgccccgacactgcttaatgtcagtatgatcttttttgcattgtttgtggctccctattgcaatccgccagtgttggcactgggttgggcagttgttgccggagggattttgcaattggcctatcagcttccccatctgaaaaagatcggcatgctggtattgccgcgggtttctttccgtgacagtgctgtatggcgggttatccgtcaaatggggcccgcgattctgggggtatcggtcagccagatttcattaatcattaatacgatttttgcctcatttctggtttcaggctctgtttcatggatgtattacgctgaccgtttaatggaactgccttctggtgtactgggtgtagcgttagggacgattttgctgccttcactagcgaaaagtttttccagtggtaatcacgaagaatatcgaaaactgatggattgggggctacgtctttgttttttgctggcgttaccctgtgcagttgctctcggtattctcgcggagcctctgacggtatcattatttcaatatggtcacttttctgcttttgatgctgagatgactcagcgggcgttaattgcctattgttttggcttgatgggattgattgtggttaaagttctcgccccgggtttctattcccgtcaggatattaaaacaccggtaaaaattgctatcgctactttaatcctaacccagttgatgaacttagcctttattggcccgttgaaacatgcaggtctggcgctttctattggtctggctgcctgcttcaatgccagcatgctttattggcaactgcgtaagcgtgatattttcacacctttggcgggatggggaatatttctgtttaaattggtggtggcaattgctgtgatggtcggggtactgctggcagtattgtgggttatgccagcatgggaacagggcaatatggcaatgcgcctactacgcttaatgggcgtagtgattgcgggagcaggtagttattttgcagctctggccttgatgggatttaggctaaaagattttgcccaaaggggattgcagtga

SEQ ID NO: 1937 - DNA, 654 bp, Xenorhabdus bovienii
  Coding sequence Name=Xb4151_4152.C431.gene8.dna; Position on contig =4922..5575bp; Strand=+
atgctggcagggtgtttctttcaggagaagaccatcatgcaaaacgttacgcttattggtattgatctcggcaaacattctttccacgttcactgtcaggacaaatcaggaaaggccctgctgcgtaaaaaatttacccgcgccagactgatggagtttttagcgggatcgccatcagcgactgttgtaatggaagcctgcgccggtgctcactttatggctcgccggatcgctgcttttggtcacgaagcgaagctgatttctccacaatttgttcgtccttttgtaaagagcaacaagaacgattttgtggatgctgaagccatatgcgaagctgcatctcgtccctccatgcgatttgtgcaaccacgaacagaggcgcaacaagctatgcgcgccctgcatcgggtcagagaatcactggtcagagacagggttaaaaccactaatcagatgcacgcttttttactggaatttggcatcagtatgccgatcggaaccgccgtgataaaaagactttcaaccgtcttggcagagaacgaacttcctccctatctggcacagttgctgatgcgcttacatgcccattatctttatcttgtggaacagctcaccgagcttgagacggcactggagcaggagctgagcacgtga

SEQ ID NO: 1938 - DNA, 255 bp, Xenorhabdus bovienii
  Coding sequence Name=Xb4151_4152.C431.gene9.dna; Position on contig =5515..5769bp; Strand=-
ttgtctccgcgtttacttatccctaaaagcgtatttttgccacccgtgctgtactggcgtggtaccagaccggttgaagcagcaaaatcccggctacagccatactgcttaccatcgcccagctgcgatgataagacgctgggcaggttatcggacccacgcccgggattgtctgaagacgctgtcctgtttcatcacgtgctcagctcctgctccagtgccgtctcaagctcggtgagctgttccacaagataa

SEQ ID NO: 1939 - DNA, 207 bp, Xenorhabdus bovienii; identical to SEQ ID NO: 1041
  Coding sequence Name=Xb4151_4152.C431.gene10.dna; Position on contig =5991..6197bp; Strand=-

SEQ ID NO: 1940 - DNA, 276 bp, Xenorhabdus bovienii
  Coding sequence Name=Xb4151_4152.C431.gene11.dna; Position on contig =6197..6472bp; Strand=-
atgaaacggcgcggtaaagcggtactggcagataaaggctattcgggcggaaaactccgtggttatctgcgaaaattgaggataaagagcattattccttataaaatcaatgaaaaaggtagtactgatggtcgcacgcaatttgataagcaggcttatcgtgaccggaatgtggtcgaacgctgtttcggttttctgaaaggaaatcggcgtattgcaacccgctatgaaaaatctatggtccccaccttttttgcaacactgatttttgattga

SEQ ID NO: 1941 - DNA, 135 bp, Xenorhabdus bovienii
  Coding sequence Name=Xb4151_4152.C431.gene12.dna; Position on contig =6488..6622bp; Strand=+
ttggacgccaatgccatcgagcaacggaatggcggattgactttcatgagcttgcccagcggtcactatcaggttgaggggaaatccctttcggtcggttgccaggtggattttggtgccataaccaccgcgtga

SEQ ID NO: 1942 - DNA, 456 bp, Xenorhabdus bovienii; identical to SEQ ID NO: 1296
  Coding sequence Name=Xb4151_4152.C431.gene13.dna; Position on contig =6556..7011bp; Strand=-

SEQ ID NO: 1943 - DNA, 99 bp, Xenorhabdus bovienii
  Coding sequence Name=Xb4151_4152.C431.gene14.dna; Position on contig =7079..7177bp; Strand=-
atgctgagatggctttattttttatattcaaattttagccattcctatatgctctatacgaatcctttcgcacttttccggtgtccctacacaaaatga

SEQ ID NO: 1944 - DNA, 108 bp, Xenorhabdus bovienii
  Coding sequence Name=Xb4151_4152.C431.gene15.dna; Position on contig =7185..7292bp; Strand=+
atggcttgggtatatctaactcccgacttgattaattgcggctttcttgcaattaagatttcgtttccgcttggtgaaagttgttcattaaacggcgaatcgggatga

SEQ ID NO: 1945 - DNA, 303 bp, Xenorhabdus bovienii
  Coding sequence Name=Xb4151_4152.C431.gene16.dna; Position on contig =7289..7591bp; Strand=+
atgattaaagcaagcagaatagcagaacagataatcaacgatagtgagacgttggaaaacaattctggcaggctatcaagtttatttgcacgcacgttaccaccaatcaggccagcagccagatttcccagtgcgctggcacagaatcataatcccattacctgtccacgcatgcgggaaggtggcagtacagtcatggttgccagcccgattggactgaggcaaagttcacccagcgccagcaaaagaatacaaaatgcaggttggaaatggctgccattcgatgaaatgacagccggataa

SEQ ID NO: 1946 - DNA, 942 bp, Xenorhabdus bovienii
  Coding sequence Name=Xb4151_4152.C431.gene17.dna; Position on contig =7598..8539bp; Strand=-
atgatacaagcaccatcttttgaacgttcatttttacacccccgttattggctgacttggctaggtatcgggatactttatttactggttttactcccttatccggtgatttattggataggaacccggcttggccggctttcacaacgctttttgaaaaaacgagccaaaatcgctgaacgcaatttagctctctgtttccctgatatgtcaccagagaaacgaaatgaattactagtcaaaaattttgagtctgttggtatggggttggttgaaactggcatggcatggttttggcctgactggagaatcaagcgttggttcaaaatcacaggagaagaaaatctccaaaaagtgctatccagtaatcagggattcattgttatcgggatccattttctgacactggaattgggtgcacgtatcttgggtctgttaaatccggggatcggtgtttatcgcccaaatgacaaccccgtcatggattggctgcaaacttggggacgactgcgttccaataaatatatgctggacagaaaagatgtgaaaggcatgatccgttgtctgaaaaacggcgaaatggtttggtatgcgccggaccatgattatggcccacgtaaaagcgtattcgctccattattcgcagttgaacacgcagcaacaacgatgggtacttcgattcttgtccgtttgtccgacccagctctgctcccttttactccccgtagattgccggatggaaaaggttatgagctaatgatccagccagcggtggaaggttttccaaaaaacgatgaagttgaagcggcagcatttatgaacaaggtggttgaacgagagattatgcaggcaccagaccagtacatgtggctacaccgtcgttttaaaacacgtcccgaaggtatgccatccctgtacgatgacaataaaaacattcactga

SEQ ID NO: 1947 - DNA, 204 bp, Xenorhabdus bovienii
  Coding sequence Name=Xb4151_4152.C431.gene18.dna; Position on contig =8571..8774bp; Strand=-
atgtccaacagatgtaaaacagcatttgaatataatgcgcaggaatatcataatcatggcctggcgcagcattacccgatagtggatatggtgtttgatttatcgacaattaagcatttaatgtatcaatatttcgatattccactaaaaaatgtcacaatacaccaatattacttcctggagcctggcgagttcggcttttag

SEQ ID NO: 1948 - DNA, 108 bp, Xenorhabdus bovienii
  Coding sequence Name=Xb4151_4152.C431.gene19.dna; Position on contig =8789..8896bp; Strand=+
atgaggagcaagcacgaattattatcacagaatagcaaggttaaaaatcactattctctaaaggccattttcgttatgatatccagctatcaatgggatagccattga

SEQ ID NO: 1949 - DNA, 1059 bp, Xenorhabdus bovienii
  Coding sequence Name=Xb4151_4152.C431.gene20.dna; Position on contig =8949..10007bp; Strand=+
atgccagtgttacataaccgtatttctaataaagagctgaaagagcgcatgttggctgaaattgagccgcgcacgactatctctttttataaatattttacgatttccgaactacaggcttttcgcgatagcctgtatcaaaaatttaccgagttgtctgtttttggacgggtttacatcgctaaagaaggcatcaatgcgcaaatcagcgtaccttctaaaaatgtcgatgctttaaaagcgttactggatgcgactgatccggctttatgccatctgcggctgaatattgcgctggaagatgatggcaagtcattttgggtattgcgcatgaaattgcgtgagcgcattgttgctgatggtattgaagatgaaacctttaatccatcaaacacaggcgaatacttaaaagcggaacaggttaaccaaatgctggatgatcctgataccttattcgttgatatgcgtaaccactatgaatatgaagtggggcattttgaaaacgctattgaaatcccttcagatacatttcgtgagcaattgccaatggcagtagaaatgctgaaggataataaagacaaaaatatcgttatgtattgtactggtggaattcgttgtgaaaaagccagtgcttacatgctgcataacggttttgacaaagtctaccacgtagaaggtggcgttattgagtatgcccgtaaagcgaaagaacaggggttacctgtccgttttatgggtaaaaactttgtttttgatgagcgtatgggtgagcgcatttctgaagatatcattgcgcattgtcatcagtgcggtacagcctgtgatagccatatcaattgtaaaaatgatggttgtcacctgctgttcattcagtgtctctcctgtgcagagcagtttgaagggtgttgcagtgatatttgtcgggaagagatgaaactgcctgaagaagaacagcgttttcgtcgggcgggaagagaaaatgggacaaaaatttttaataagtctcgctatcgtttaaatgatggcctgaatattacatcactacaatccattaagtaa

SEQ ID NO: 1950 - DNA, 594 bp, Xenorhabdus bovienii
  Coding sequence Name=Xb4151_4152.C431.gene21.dna; Position on contig =10099..10692bp; Strand=-
atgaaactgttagtcattgataagtgccattatacgcgtttggggattattgaatccctgaaagaaaatatagatatcctctcaatcggggctgtatcaattcatgacgccataaatattttgcctatatttcctccagatatcatcttagtgaatttgacgagttatggccaccataaggaatattgtgaacaactgaaattgtttatttcgttagttaatgatgcccgtatttatacctatatcgataaaccataccccttgtgcgatacgagcattcaattgacaaataaggattttattttaccaaaaaagaatctgagcacattattggttaggatacaagaaatgacagcacatgatattcaacgttattttgccaattttaatacacaaagttctattttcagtcttcaggaaaaccgaatcatccattattggatgcaagagaccgatacacataaaattgctaaaatgctaaaaattagcaatagtacggtctattcacacaaaagacatattatagaaaaaatcggtatttctaacaaaatagagttactttttatttacaatatttttaaatatatctgttaa

SEQ ID NO: 1951 - DNA, 255 bp, Xenorhabdus bovienii
  Coding sequence Name=Xb4151_4152.C431.gene22.dna; Position on contig =10907..11161bp; Strand=-
atggaacaaaaaaatgaaattattcaaactcatcctgttgtaggttgggacatcagtactgttgatgcctatgacgctatgatgatacgtcttcattacttatcctcccaagatcaagcctctggcaatgtcaatattgacaaaacattgtggttgacaacaggagtagccaaacaactcatcctaattctgcaggctgggattgaaaagatagaagcatcagaatacagtcagcttgatcatattaagcattaa

SEQ ID NO: 1952 - DNA, 96 bp, Xenorhabdus bovienii
  Coding sequence Name=Xb4151_4152.C431.gene23.dna; Position on contig =11206..11301bp; Strand=-
gtgataatacaaaaaatctcgctctttccccttcttagattgctaaaaagggttatactgctattgctcatccttgatgagattttctgctcttag

SEQ ID NO: 1953 - DNA, 141 bp, Xenorhabdus bovienii
  Coding sequence Name=Xb4151_4152.C431.gene24.dna; Position on contig =11264..11404bp; Strand=-
gtgactaattttttcattactacccgtgcggaaaatatttttatttccgcacgtttacgcttacctaataagtcgctggcatcacttacaataatcccaattagtgataatacaaaaaatctcgctctttccccttcttag

SEQ ID NO: 1954 - DNA, 1053 bp, Xenorhabdus bovienii
  Coding sequence Name=Xb4151_4152.C431.gene25.dna; Position on contig =11397..12449bp; Strand=-
atgaccactgaatcatacacaattaaaatccgccgccctgacgactggcatgtccatttccgcgatgatgatatgctaaaaatcattgttcctcataccagccgtttctttggccgagctattgtcatgcccaacttagcccctccagtaacagatgttgccagtgccaaagcctatagggatcggataatcgctgccattccgtcaggccatcatttccaccccctcatgacctgttacttgactgactcaacagacagttcacaaattgaaattggttatgaagaaggggtctttactgcctgcaaactttatccggccaatgcaacaaccaactccagccacggtgtttctgataccaaaaagatctatcccttattggaaaccatggaaaaattgggagtacctttgctgattcatggtgaagtcactgcatcccatattgatatttttgatcgggaagctcggtttatagagcaggtgatggaaccattgcgtaagcagtttcctgaattgaaagttgtttttgagcatattacaaccaaggaagccgccgaatacattcttgcaggcaatgataaattagcggcaacactgacaccgcaacacttaatgtttaatcgtaatcacatgttggttggcggtattcgtcctcacctctactgtttaccggtattaaagcgcaatatccatcaggaagcattgcgttccgcggtagccagtggctgtaatcgattctttctaggaacagactcagcccctcatttacagcatcgcaaagaatcttcctgtggttgtgcgggcgtcttcaatgcgcctactgctcttgcagcctatgccaccgtttttgacgaaatcgatgcaatagctcactttgaagcattctgctctttaaatggccctaagttttatggtctgcccgttaatgaaggcttcgttgaactcacacgtaaacctacgccagtgacagagtatatcgaatgcggtgatgagaaattaatcccatttctggccggagaggatgccaagtgggaagtaaaggtatgtgactaa

SEQ ID NO: 1955 - DNA, 117 bp, Xenorhabdus bovienii
  Coding sequence Name=Xb4151_4152.C431.gene26.dna; Position on contig =12555..12671bp; Strand=+
atgataaaactctatgaatttcgaaaagttagtcttttaaatattatatgcagggtattcagaggaaatttatcgtatcaaaaaacggaaaaaatagaagtaataacacgagggtga

SEQ ID NO: 1956 - DNA, 282 bp, Xenorhabdus bovienii
  Coding sequence Name=Xb4151_4152.C431.gene27.dna; Position on contig =12686..12967bp; Strand=-
atgtatttctggacattgcaagattcttgctatcatcccctactattagtgcctctgcttatacatattatgctcgcagttcttctggtgcctcccctacggacacaaacaagttcaataaaagctaccgaagtacagattatctgcgaacaaatagtattgtattttttcttttacaaaagtgaagctaccgttaaatgcatccgttctgagggattcctccatagttcagttgtagaacgccgaattgtaatccgtatgtcactgttcgagtccagttga

SEQ ID NO: 1957 - DNA, 240 bp, Xenorhabdus bovienii
  Coding sequence Name=Xb4151_4152.C431.gene28.dna; Position on contig =13011..13250bp; Strand=+
atgttagaaagcccgactagcagagctaaatcgggctttcttaaacttggctcctccaactggactcgaaccagtgacatacggattaacagtccgccgttctaccgactgaactatggaggaatcgcttcattcctgagaacgaaacgaatactaacgatattgttttcgtttgtcaaagcagaaaatagcaataactgtttgtttgctgagaatatagacttgttgtggtatttttag

SEQ ID NO: 1958 - DNA, 228 bp, Xenorhabdus bovienii
  Coding sequence Name=Xb4151_4152.C431.gene29.dna; Position on contig =13164..13391bp; Strand=-
atgtcactggttcgagtccagttggaggagccaaattcgagaaagcccggtttagttccactaaccgggctttttgttatctattttctgcaaacttatctgctccagatgtatttttttccatccaaatacaaattcagactaaaaataccacaacaagtctatattctcagcaaacaaacagttattgctattttctgctttgacaaacgaaaacaatatcgttag

SEQ ID NO: 1959 - DNA, 165 bp, Xenorhabdus bovienii
  Coding sequence Name=Xb4151_4152.C431.gene30.dna; Position on contig =13499..13663bp; Strand=+
atggaaaataaatttaagtgtctaactgatgtgcaaggtgatgatattttgttattttttacagcaaaatatgaccatattgtaattttccataccttactcaatctcttattacttctttgttaccaccttgataaaaattcagcaaatcgatgtaaagagtaa

SEQ ID NO: 1960 - DNA, 117 bp, Xenorhabdus bovienii
  Coding sequence Name=Xb4151_4152.C431.gene31.dna; Position on contig =13673..13789bp; Strand=-
ttgcttttgattttatcaatcagctaccctccttactcagatgtacttttaaccgactgtattcaagttttttgtcggtcagatcgatatcaaagtgctcttttctcacgttggtaa

SEQ ID NO: 1961 - DNA, 591 bp, Xenorhabdus bovienii
  Coding sequence Name=Xb4151_4152.C431.gene32.dna; Position on contig =14037..14627bp; Strand=-
atgtcctccgagcatgctagccttaaaaatggcataaccttcaattcgataacgcgtttttacaataatcgggttagtattatgaatatcatcaaacagatattgattcaggatcttaagcggattaatctcgaagaacaccgtgatggtaaagtacatttcaatagtacctttattcatcatcatccatacctatgcttggcaatggttattgcttatgctttccttgtcatgctcatggggtattctccctattttggtacttggtcactgattttatttacagtgctttttgtcgccatggcagccgttttacttttcgatataaagccggtgtatcattttgaagacattgatgtactggatttacgtgtctgttataacggagaatggttcgtcaacgaaaaagtatcccataaagccatcaataaaatacttactcatcctaaagtacccagtgaaatgaaagatgagatcaaaagaatcatgaggaaaaaagacggaatttgtttttatgatgtatttatagttgccttttcagaacaatcaccctattttcatccttccgaaatggtgaataaaagtgcttaa

SEQ ID NO: 1962 - DNA, 108 bp, Xenorhabdus bovienii
  Coding sequence Name=Xb4151_4152.C431.gene33.dna; Position on contig =14593..14700bp; Strand=+
atgccatttttaaggctagcatgctcggaggacatatctgtatatcaattgccttattttatttataaaattgttattgtctggaaacaatatcgatatttttgctaa

SEQ ID NO: 1963 - DNA, 243 bp, Xenorhabdus bovienii
  Coding sequence Name=Xb4151_4152.C431.gene34.dna; Position on contig =14894..15136bp; Strand=-
ttgaatggcagagaagtgaacgaatacgtctttgctaccatcagctggagtgatgaaaccaaagcctttagactcgttgaaccacttcacttgacctttcattttgtcagacatttgactttcctatatatcaaaaaaaactcgccacctcgggcatgtgttggccagtatcagctattacttatggaggcactaagaaggaaacggtcaacaaaggctaccggagatagcacttacacataa

SEQ ID NO: 1964 - DNA, 213 bp, Xenorhabdus bovienii
  Coding sequence Name=Xb4151_4152.C431.gene35.dna; Position on contig =15023..15235bp; Strand=+
atgtctgacaaaatgaaaggtcaagtgaagtggttcaacgagtctaaaggctttggtttcatcactccagctgatggtagcaaagacgtattcgttcacttctctgccattcaaggtaacggtttcaaaactctggctgaaggccagaacgtagaattcaccattgaaaatggtgccaaaggcccagcagcagcaaacgtaactgctatctaa

SEQ ID NO: 1965 - DNA, 138 bp, Xenorhabdus bovienii
  Coding sequence Name=Xb4151_4152.C431.gene36.dna; Position on contig =15274..15411bp; Strand=+
atgtcgtggcgggctttttgtttttttatcttagttacttttatgccaatttatttggatgagaaaaataacaggatgaagaatgcgtttgtcacctatcccccagactcagataaaaatgagtcacacgctatttaa

SEQ ID NO: 1966 - DNA, 150 bp, Xenorhabdus bovienii
  Coding sequence Name=Xb4151_4152.C431.gene37.dna; Position on contig =15356..15505bp; Strand=+
atgcgtttgtcacctatcccccagactcagataaaaatgagtcacacgctatttaagacctatgattttttaatgaaaaaggcgatatctagtcgaattaagtattcggcattatattccatgtgcaagataaataggttatctctttag

SEQ ID NO: 1967 - DNA, 147 bp, Xenorhabdus bovienii
  Coding sequence Name=Xb4151_4152.C431.gene38.dna; Position on contig =15513..15659bp; Strand=+
atgtggtgttcagcgggtattggcgtgttatgcagactgggtcaatattggtctgcgagtattgccacaagcattattctgtgtgcgaacattctcttgagagaggcccacaacggattaatgcccaaccttattaacaagctttag

SEQ ID NO: 1968 - DNA, 111 bp, Xenorhabdus bovienii
  Coding sequence Name=Xb4151_4152.C431.gene39.dna; Position on contig =15630..15740bp; Strand=-
ttgcttgtaggatcagtgtccttactaggatttcatcatgaatatcacaaacaatatagatcttatagcgttgttctaaacctaaagcttgttaataaggttgggcattaa

SEQ ID NO: 1969 - DNA, 147 bp, Xenorhabdus bovienii
  Coding sequence Name=Xb4151_4152.C431.gene40.dna; Position on contig =16019..16165bp; Strand=-
ttgatcaatcaaatctatagtgccacttatttagccatgctcaatgaggtactgaggtatcttccctgtcagaacaagaataagccactcaatgaaattatcatcaatataataataatatcggttatatttattccattttcatga

SEQ ID NO: 1970 - DNA, 174 bp, Xenorhabdus bovienii
  Coding sequence Name=Xb4151_4152.C431.gene41.dna; Position on contig =16179..16352bp; Strand=+
atgggaacgaaaaatctggtatttgtttcctcagcagctccagaaaaattgatgagttatcttttgattttgttagacctagcttgccaatttctgtttaagaacagtagaaaaagtactaatcgacgggcaatgggacgactgagtaaattccatcagtatgctctcatatga

SEQ ID NO: 1971 - DNA, 219 bp, Xenorhabdus bovienii
  Coding sequence Name=Xb4151_4152.C431.gene42.dna; Position on contig =16420..16638bp; Strand=-
atgacagggctatctccgttaagcgccttagctgaaacgtcattttcccttaatgcagtaattgccatcgccgcactcacttttggcaaatctaaaaatgttaataaaacttgcagtactatctccttttcatcagcaacagaaaatagatgtttcacttcatcaagacttaactcccctgtcactaagattaaccctctgaaaccttactctttatag

SEQ ID NO: 1972 - DNA, 99 bp, Xenorhabdus bovienii
  Coding sequence Name=Xb4151_4152.C431.gene43.dna; Position on contig =16673..16771bp; Strand=-
atgcgtgacttttccgtagggttaacttacaaaatgctgttcttaattccacttcttttgaaaggtcttcatcactcgcaaattcaatatcaaaactaa

SEQ ID NO: 1973 - DNA, 93 bp, Xenorhabdus bovienii
  Coding sequence Name=Xb4151_4152.C431.gene44.dna; Position on contig =16773..16865bp; Strand=-
gtgtcaatagaaatatcgatatcagcataccgcaatgtagacatatcatttattccattacagaaaaaactaactgtgtgtcaattattttaa

SEQ ID NO: 1974 - DNA, 183 bp, Xenorhabdus bovienii
  Coding sequence Name=Xb4151_4152.C431.gene45.dna; Position on contig =16822..17004bp; Strand=+
atgtctacattgcggtatgctgatatcgatatttctattgacacgagaaccgatactgcaaaagggtcagaggatatcattttgtttgataaaaatctgatggtattaggggaacgagtaataaagagtagggaaacgtttgggaataagtatttaaatatgacagccagtcggatttcatga

SEQ ID NO: 1975 - DNA, 117 bp, Xenorhabdus bovienii
  Coding sequence Name=Xb4151_4152.C431.gene46.dna; Position on contig =17063..17179bp; Strand=-
atgtcctatattctttatatctatttgcgaaaaattctcaataagtttttatccattttgtcttacgcaaaagacagttgtgaaatatcgtacattaggttttgtacaagcaaatag

SEQ ID NO: 1976 - DNA, 264 bp, Xenorhabdus bovienii
  Coding sequence Name=Xb4151_4152.C431.gene47.dna; Position on contig =17183..17446bp; Strand=+
atgattgggttaggggcgatattttctatcttagatattacaatattcgctatgattctatgtgtatttatagtgagctgtgtggaacatcagctttattccaatagactaatttatggaaggtcagttgtctcaggcactggctgtacatatgttgcgtacataaaaagttctgtttgtccaaagtatcgtcgcattatctgtgttattaacggaatcaataactatgacactaggtatatacctgccatttttaccatttga

SEQ ID NO: 1977 - DNA, 99 bp, Xenorhabdus bovienii
  Coding sequence Name=Xb4151_4152.C431.gene48.dna; Position on contig =17407..17505bp; Strand=-
gtgttcttattcaccaaaaaaaatatttttaaggcaatgactgtaatccaattagtacatcaaatggtaaaaatggcaggtatatacctagtgtcatag

SEQ ID NO: 1978 - DNA, 93 bp, Xenorhabdus bovienii
  Coding sequence Name=Xb4151_4152.C431.gene49.dna; Position on contig =17505..17597bp; Strand=-
atgttaattaatgagaattatttacaactatccaccaacgtgatgaatgtaaaattgcttcatcatttggatgataacgaaatcgcatattag

SEQ ID NO: 1979 - DNA, 144 bp, Xenorhabdus bovienii
  Coding sequence Name=Xb4151_4152.C431.gene50.dna; Position on contig =17799..17942bp; Strand=+
atgttctattgttacttatattttaaattaagtaagataatttcctttttcatgtttatttattctgtttacatttcctgttttttatttaaagtgttttttcttcttttaattgtattttatgttataagaatttattgttaa

SEQ ID NO: 1980 - DNA, 138 bp, Xenorhabdus bovienii
  Coding sequence Name=Xb4151_4152.C431.gene51.dna; Position on contig =17936..18073bp; Strand=+
ttgttaaatttgtatttgggagttattttgtttctattttttatgttatttaaggaaattaattttctgttaatgggggatttttcttttgcgtacacggtcagtcactccgttctgtataaatggcataaacattga

SEQ ID NO: 1981 - DNA, 117 bp, Xenorhabdus bovienii
  Coding sequence Name=Xb4151_4152.C431.gene52.dna; Position on contig =18352..18468bp; Strand=-
ttggtttacgatcgtattcttttcacacagaggaaaaggtggcattcaagccactttacgcataaatatcacacagatcacaaaaataagataaaatacagtatgatgttgaaataa

SEQ ID NO: 1982 - DNA, 120 bp, Xenorhabdus bovienii
  Coding sequence Name=Xb4151_4152.C431.gene53.dna; Position on contig =18761..18880bp; Strand=-
atgctaattaactttactcctgaatcatcaacttatacaacggagaatatatgccattttaaatactatgtgacatgcatcacaaaactgacactttttattatgattctagctcattaa

SEQ ID NO: 1983 - DNA, 351 bp, Xenorhabdus bovienii
  Coding sequence Name=Xb4151_4152.C431.gene54.dna; Position on contig =19135..19485bp; Strand=+
atgagtacggttgaattgctcaaacatatttatgacataaatttatcgtatttgcttttagcgcaacggctaattaaccatgagaaagcatctgcgatgttccgtttaggtattagtgaatcgatggctgatacgttggccgagctgacattgcctcagttagtaaaattagctgaaactaaccaactgatttgccattttcggttagaagaccacgaaacggtgctgcagttaacgaaggaatcgcgggtggacgatctacaacaaattcacacaggtattttgctgtctactcatctttttcagcagttatctgcgctggatgacatttcaatcaaaaaaagagcgtga

SEQ ID NO: 1984 - DNA, 582 bp, Xenorhabdus bovienii
  Coding sequence Name=Xb4151_4152.C431.gene55.dna; Position on contig =19488..20069bp; Strand=+
atggttgaaaaaagtattgttcaggaagcgaaagatattcatcttgcaatggaactcatcactttaggtgcacggttgcaaatgcttgaaagtgaaacacaattaagcagagggcggttgatcaggctgtataaagagttgcggggaagccctccgcctaaagggatgcttcctttttcgacggattggtttatgacttgggaacagaatattcactcttctatgttctacaatgcttatcgtttcttgatgaaaagcgggcattgtgacggtgttgaagctgttgtaaaagcttatcgactgtaccttgaacaatgtcctccaagcagcgaaggtgggtctgttctggcattgaccagagcctggacacttgtccgtttcgttgacagcgggatgctacagccaacagagtgtcgctgctgtggtggcactttcatcacgcatgcccaccaaccggtgaacagctttgtttgtagtctttgccagccaccttcacgagcggtaaaaaaacgtaaactttccgttctgcctgccgatactaattcacaactgctggatggatttgctcagcaagctatgtga

SEQ ID NO: 1985 - DNA, 132 bp, Xenorhabdus bovienii
  Coding sequence Name=Xb4151_4152.C431.gene56.dna; Position on contig =20066..20197bp; Strand=+
gtgaatttaaatgggaaacttaaaagcaggttacaggttttttatgtgcagacctgtaacttgctctgtcataccgttcttcgtttactaattcgccctgttcaaatcccatctgctcaccaacttagctaa

SEQ ID NO: 1986 - DNA, 882 bp, Xenorhabdus bovienii
  Coding sequence Name=Xb4151_4152.C431.gene57.dna; Position on contig =20208..21089bp; Strand=+
gtgttagtacttttaggatatatagtggtttttggtgcggtaattggtggctatctgcttgtcggtggccacatgggcgcactttatcagccagcggaatttctgattattgcaggtgcaggtattggcgcctttatcgtcggcaataatggcaaggcgataaaggcaacactgcgtgttttaccaaaaatattgcgcagatcaaaatacaacaaagcgatgtacatggatctcatggcgctgctgttccgcctgttatccaaatcacgccaaaatgggcttctggctttggaacgggatatcgaaaatccacaccagagcgacatcttcacacagtatccccgtttgttaaaagatccctatttgatggatttcaccactgattatatgcgtctgatcatcagtggtaacatgaatccccatgaaattgaggccttgatggatgaagaaatcgagacttatgaacaggagagtgaagtccctgcgaccagtctggctatggttggagattcattgcctgcatttggcatcgttgccgccgtcatgggagtggttcatgcactcggatcagcggatcgtccggcaggggaactgggtgcgttaatcgcccatgcaatggtgggaacattcttagggattttattggcttacgggtttgtttctcctctggcaaccttgctgcgtcaacgtagcagcgaacaggtaaaaatgatgcagtgcatcaagattacactgctttccagcctgaatggttatgctccacagattgcggttgaattcggccgtaaaacattattcctcacagatcgcccttcatttacggaacttgaagaacatgttcgtcgggttaaatcgcctgtacaacaagaagttgaagaataa

SEQ ID NO: 1987 - DNA, 1002 bp, Xenorhabdus bovienii
  Coding sequence Name=Xb4151_4152.C431.gene58.dna; Position on contig =21092..22093bp; Strand=+
atgagagcgaataatgttactgtcatcagagtaaaaaaacgcaaaaaacacggtgagaagcactgtggtggatcatggaagattgcatatgccgatttcatgactgcgatgatggcgttttttctggtcatgtggctgctatcgatcgccagcccacaggagttaaccagcattgcagactattttcgcactcccttgcaggtagcgataaaccaagggccgcaaagcagcgatagcacaaatccgattcctggaggaggggatgaagtttttcagcaggatggagaggtttttcgcgaatctaaacttgttgaatccaataaagaaaaacgtcgtctgaatcgcctgcaccaacaacttgatcaacttattatcaccgatcctcgcctaaaagaactacgtcctcatttgttgatcgacatgatggatgaagggttgcgcattcagatcatcgatagggaaaaccgcccgatgtttatgatcggcagcgcaaaggttgagagctacatgagagatattttgcaggcaattgcaccgattttgaatgaaattccgaacaaagtcagcctttctggtcataccgataatttacagtatgccaatggccaaaggggttatagcaactgggaactctctgcggatcgtgcaaatgcttcaagacgagaattactgaacggtggcttggatgaagtcaaaatcctgcgggttgttggtatggcatccactgtgagtatgcagaaaggcattgatcctaatgcaccggttaaccgccgtatcagcattgttgtcttgaataaagatgcagaaaaacggattgagcaggaaaacagtggtggtgacgccatgaccgctaacaatagtatggatatgcaagaagtcatcagaacggattcgaataagggagcgccttctcagcaatccaccgaacaatccaatgaaatcacaatatcggtgcagactcagattgaaccgtccagtgatactaataaggtgacagagtaa

SEQ ID NO: 1988 - DNA, 2169 bp, Xenorhabdus bovienii
  Coding sequence Name=Xb4151_4152.C431.gene59.dna; Position on contig =22100..24268bp; Strand=+
atggatattaccgcgttttatcagaccttctttgatgaagcagatgaattattggacgatatggagcagcatttattgctgctcgatgccgatgaacctgatcatgaacaactaaatgcaatttttcgcagcgcccactccatcaagggaggcgctgcaacttttggttttgccaagctgcaacaaaccacgcatgttttggagaatctgctagacagtgccagacgtgacgaaatacgcctgactactgacattatcaacctgtttttagaagcgaaagatattatgcagcaacaattggatgcctataaaagttctcaggagccggatgaagatacattcaattatatctgcgagacattgcgtcagcttgccttagagctacaggacgataagcaggataagagtgctgacgctgccgccccggcaattcagtctgaacctgcattgaaagagactgtactggaagctgaagaagaacagacaatcgtgatcaatcagccagaagaaaaaaatcttccggcaggcaaagctgatcaagggagaatccgcgttcatctatccgggctaaaagaacgcgaagtctccttgatgaaggatgaattggggcatcttggtgatgtttatgatgttgaacagaccgcagacagccttgaagcttcattgatcacatctgcaacagaggatgacatcaccgctgtaatgtgttttgtgattgaacctgaacagataacatttctgcctgttgcggactcgcatccggcagaagaaactgaagcagacactcagtctgaaaaaaaaccagcggcagaaggtgtggcaatcgaaagtcgagtagctgcaagtacaataagtaccgataagccacagcctgctgatgtgccacaaaaatcagaaggacatggagtagggcgtccggcctcgcgtccggtagctggttcaccacgtcaacgtgctgaatcttccagtattcgtgttgctgttgagaaggtggatcaactcatcaatctggtgggagaactggtcattacccaatctatgctggcacagcattgtgatggattggagcagacaaaacatagcgagctgctgagttgtatggctcaattgcagcgaaactcccgtgatttgcaagaatccgtcatgtcgatccgtatgatgccgatggagtacgttttcagccgatatccacgtttggtgcgggatttggcaggtaaactgaacaaaaaagtggaactgacgctgatcggcagctcaacggaactcgataaaagcttgatcgagcggattattgatcctctcacgcatctagtacgcaacagcctcgatcacggtattgaaaacccggaaaaacggattgcagccggaaaatcagaaacgggtaacttgacactctcggctgaacatcagggcggcaacatctgcattgaagttatcgatgatggagcaggcctgaatcgcgagaagatcttggcaaaagcgcggtctcaaggcctgaatatcagtgaaaacatgagtaatgaagaagttgctatgttgatttttgcgcctggattctctaccgcagaagtggtaacggatgtttctggtcgcggcgtcggaatggatgttgttaagcgcaatattcaggatatgggtggccagattcagattagtttccaagaagggaaagggacgatcattcgcattttactgccgttaacattagcaatactggatggcatgtccgtcaaagtcaatagcgaagtcttcattctgccattgagtgctgtggtcagttcattacagccacaggaagaagatatctatcctctggcgggtgatgaaaaactgctgcaagtccgtggagaatatttaccgctactggaattgtaccggatatttgatatttcgagcggagaaacctcgccaaccaaaggtattgccgtcattgtccagagcgcggggcgccgctatgctttgctggtggataaactggtcggacagcatcaggtggtcgttaaaaatatcgagagcaattaccgtaaagtacctggcatttcggctgccaccattatgggagacggtagtgttgccctgatcattgatattcctgctttgcagaaactcaatcatgaacagttggctacgcgtaaggcggagctggtgaataaaaaaataacacagtga

SEQ ID NO: 1989 - DNA, 498 bp, Xenorhabdus bovienii
  Coding sequence Name=Xb4151_4152.C431.gene60.dna; Position on contig =24280..24777bp; Strand=+
atgtcagccatagaagaattcagtaaattatcgggggaaacaaccggaaaggaatatctggttttcaccttgggtgacgaagagtatggaattgaaatactgaaagtgcaggaaatacgcggttacgaccaagttacccggattgcaaatacaccttcttttatcaaagggataaccaatctgcgtggggtgatagttcccattattgacttgaggatcaaattctcgcaggaaaacgtcacttataacgacaacaccgtcgtgattgtcctgaacctgcttaatcgtgtggtgggaattgtggtcgatggtgtgtccgatgtgctgtctctgaaggacgatcaaatttgtccagcgccggagtttgcggttaccttgtcaactgaatatctgacagggttaggttccattgatgaacgaatgctgattctggtagatatcgaaaaactcctgaacagtgaagaaatggcattggtggattctgtcgctaagagctga

SEQ ID NO: 1990 - DNA, 147 bp, Xenorhabdus bovienii
  Coding sequence Name=Xb4151_4152.C431.gene61.dna; Position on contig =24782..24928bp; Strand=-
atgccagtgttatcggcacccttaaagggaactttatgtgtaatccaaaaaattgagtttttgcactatttttttgatctaaaacaagtaaggctgccgttttgctcgactggctataatgagtggcaacaatcacggcagccctga

SEQ ID NO: 1991 - DNA, 1704 bp, Xenorhabdus bovienii
  Coding sequence Name=Xb4151_4152.C431.gene62.dna; Position on contig =24954..26657bp; Strand=+
atgtttaaccgaatgaaaatagtgacggggctaatctcagtcatcatattatttggtgctctgcaatttatctccgggggactgttctttaatggtttaaagaacgatacagaagcctttgatttattggataaaatgcggcagcagcaaaaattattggatgaaagctggatcaacctgctgcaagcccgtaataacctgaaccgcgttggcatcatctatataatgaaagaacgcgatcttgatggtacttaccaaattgatgatgttttggctgaatctaaagtcagtctcgctcgtggggaacgccgcttcgagcaatttgaacagctcaaaaaattgcccatacatgatccagaccatctccaacgtttaaaacaaactcatcatgaatatcttaacgcgctcaaagaattggatggatttctggcaaaaaaacagtataaagaattttttgctcagaaaaccaccgactatcagaacgcttttaatgtggaatatgactactatctgaaccagaatcaaaaactgtatgatgaagtggcgcgcgaagcagatatcgcttatcgcaatatcatcattagcttaatctccgtgtttgtgctgctgatttcggttatgacagtaagctggattggcttgcgtaaggcattgatcaatccattgaataagctactggaaaatattaaagccttctcgaaaggtgacttgactcaaaccatcaatgtgtccggtactaatgaaatgggcatgctggcggttggtttgaggcatatgcaggatgagctgatccataccgtcagaagtgttcatcagagtacggaaaccatctataccggcaccagtgaaattgccgcaggtaacaacgatctctcttctcgtacagaacagcaggtggcctcgctggaggaaaccgctgccagcatggaacagttgacggcaacggtcaaacagaatgctgacaatgcccgtcaggccagtaatttggctgacaacgcctccgatatcgcccgtcagggaggtaaagtggtggcgaatgtggtgcaaaccatgcatgacattgctgatagttcccgcaaaatttctgatatcactggtgtgattgatgccattgccttccagactaatattcttgcccttaacgctgcggtagaagctgcccgtgcaggtgagcatggccgcggttttgcagtggttgccggcgaagttcgcaatttggcacaacgcagtgcggaagcggccaaagaaatcaaatccctgattgaagactctgtggatcgtactgacaccggctctgtgctggtggaaagtgccggcgaaacgatgaataaaattgttgattctgtgacccgcgtgactgacatcatgggggaaattgcatcggcatctgatgaacaaagtagaggaattactcaagttggtgtcgctatttctgaaatggatagagttacacaacagaatgcgtcactggttgaacagtctgcggccgcagcagcggcactggaagagcaggccatgatcttgaccaaagcagttgcgttgttccagctaccggagcaggccgaaaggaagcagtctgaaaaaagaaaacatgaagttttatcgacgataaaatcgccgactcctccagctaataaaacgaatcctcctgtgctgaagaaaggcagcaatgtggaagacccctctaattgggaaacattctaa

SEQ ID NO: 1992 - DNA, 1632 bp, Xenorhabdus bovienii
  Coding sequence Name=Xb4151_4152.C431.gene63.dna; Position on contig =26713..28344bp; Strand=+
atgttaggcaggcttcgcatatcaaccagtttatatctattactcatgatgttttgtgttatgcaaattatttcgagcggtttgtctctgggaataattcatacagaccagtcatatattgaaagaattgatttgggaactaaacgaagagatacccttggattgagctgggcagcaatgctgcaaacgcgtaacactctcaacaaaattgctattggccaaaaagtgggtcagtcgcaggatcagatcgacgcgatggaagcgttgctcaaaagctcattgaatgaagctgaaaggaatttcgcacagttcagtgccttacctcagatagaaaagaatgaccaaagtgtcgccttattggctgcggttgaacgttcttaccaagaatatattaatgcgttgaaagagctgaaaatatacctttatgaagggaatttccaggcatttcttgatcagccaacagaaaattaccagcgtcagctagaagtcgcatacaacaattacatgcagtatctcggccataacatcagcacagcggtttccgatggtgccttttactataaagtttccatcgccatgtttttcggttctatcctgatggtatttgttgtttcggcatcagcgcactggtggatgcgacgtaatctgctccggccgtttgataatatgcgagcctgttttcaggatgtagcagaaggccgcctgaataaagaaattgctgtcacgactagtgatgagattggcgatatattcagaaaactgcgcgatatgcagcaatctctgattaagtcgattgcctctgtacgggacaataccaaccagatgtatgccggtattcaggaaattacacaaggcaataccgacctgtcatcacgcactgaagaacaggctgcatcgctggaagaaaccgctgccagcatggaagagctcactgttactgtcaaacagaacgctgagaacgcacgtcaggccagtgagctggcagtatctgcttcccagacggcttcgaaaggcggtgaattgaccgtcagcgtggtggctactatggatgaaattgccaacagttcgaagaaaatcagcgctattatcagtgtcattgatggcattgccttccaaaccaatatcctggcattaaatgcggcggttgaagcagcgcgtgccggtgagcagggacgtgggttctctgtcgtggcgggcgaagtgcgtgacttggcgcaacgcagtgctgaggcggcgaaagaaatcaaaaccctgatcgatgaatctgtccatcgagttaaccaaggttctgagctagttaatcacgccggaaacaccatggatgaattagtcaaatcagtaaaccaagtcactgaactgatggctgaaattgccgctgcttctgatgaacaaagccgtggtattcatcaggttgcccaagctgtcagccagatggatcaagtcacacagcaaaatgcggctttggtggaacaatctgcggcagcggctgctgcgcttgaagataaggccgacacattagtgaaaaccgttgctttatttgaactgtctgaaagcttagataatgagtatgaccatcagacatcctctgcttcaaaaatgaccgatgagtatatcgcaagtcaagtacgctga

SEQ ID NO: 1993 - DNA, 891 bp, Xenorhabdus bovienii
  Coding sequence Name=Xb4151_4152.C431.gene64.dna; Position on contig =28351..29241bp; Strand=+
atgaaatccaatttagcagcctcagatactgatgctatttcaccgctgaactttatgtttcagcggcatattttgtcggatgcacaatttgaacgcatctgccagttcatctatcaacgggctggtattgtactggccaaaaataaacgtgaaatggtttacaaccgcctggtcaggcgcttgcgtgtactgggaatcaatgattttggtcaatacctgtcgattctggaacagaatattcatagcaaagaatgggaattattcatcaatgcattgactaccaatctcacggcatttttcagggaagctcatcattttcccattttggcagcgcatgccagcagaaaaaatgcaggcacatatcgagtttggagcgcagccgcttcgacgggagaggaaccgtattctatcgccatgaccctgtgtgatgcattagggcatcggacaaatcggataaaaatcattggcagcgatattgatactcatgtgctggaaaaagcccgtcagggagtatatcgactggaagaattacagcacatgagtaatagccaaaagaaaaagtattttttcaaaggcattggttcctttgaaggatatgccagagtgcgtcccacactggctgaactggttagctttcagcacttgaatctattggattctgactgggcgctcgagggtaagtttgatgcgatattctgtcgcaatgtcatgatttattttgacaaaaagacgcaggaaagaattttgcgtcgttttgccaattacttaaaaccggatggtttgctctttgcggggcattccgaaaacgtcactcaaatcagccgagagttctacttgcaaggacaaaccgtttacggtgtaggtcgtcgggcaggaaggggtcatgaataa

SEQ ID NO: 1994 - DNA, 1053 bp, Xenorhabdus bovienii
  Coding sequence Name=Xb4151_4152.C431.gene65.dna; Position on contig =29234..30286bp; Strand=+
atgaataaaataactgtactgtgtgtggatgattcggcgctgatgcgccaaatcatgcgggaaataatcaatagccacccggatatggaggtggtggactgcgcgccagatccgtttgttgcccgtgatttaataaaaaaacacaatcctcaggtattaacactggatgtagagatgccacgcatggatggcattgattttcttgaaaaattaatgcgtttgcgtcccatgccggttgtgatggtttcgtctctgacggcgaaaggatcagaaattacattgaaagcactggagctgggtgcggtcgattttgtgaccaagccgcaactgggccttcgcgaaggaatgctggcctatagtgagctgattgccgaaaaaatccgcgctgcggcgcaggcaaaaatcagtaccatgccatccagtcctgtgattgctaccccattgaatttcaagccactattatccagcgaaaaactgatcgcagtcggcgcttcgacagggggaacagaggcaataaaaaacctgttgcaacctttgcctgtcaccagcccggcgttactgatcactcagcatatgccgccgggttttacacgttcatttgcagaaaggctcaataaattaagccaaatcaccgttaaagaggcggagaatggtgagcgggttctgccggggcatgcttacatcgcaccgggggatcaccatatggaactgtgtcgtagcggagctaattatcaaatcatgactacccgcgctccgccggtcaatcgtcatcgtccttccgttgatgtgctgttccgctccgttgccaaacatgcgggacgcaatgccgttggtgtcatcttgaccggaatgggtagtgatggagctgccggcctgctggaaatgaaacaggcaggtgcttatacgctggcacagagtgaagcaagctgcgtagtctttggtatgccacgagcggcgatccagctgggagctattgatgacattatggatattcaaaaaatcagtaaagcgatgctggccaaaatcagcgcagggcaatcgattcgtatttag

SEQ ID NO: 1995 - DNA, 411 bp, Xenorhabdus bovienii
  Coding sequence Name=Xb4151_4152.C431.gene66.dna; Position on contig =30334..30744bp; Strand=+
atgaaattccaaggagtgtttatggcaagtaaggatctgagatttctggtcgtcgatgattttgcaactatgcgtcgcattgtacgcaatttattgaaggaactgggcttcaacaacgttgatgaagctcaggatggagctgaagcactcgctaagcttcgtgctgctgaatttgattttgttatttctgactggaatatgcccaatattgatggtcttgaactgctgaaaatcattcgcggtgaagaaaagctggctgccttacctgtcttgatggtaacggcagaggcgaagaaagaaaacattattgcagcagcacaggccggagccagtggttacgtcgttaaaccgtttactgcggcgatcctggaagagaaactcaataaaatatttgaaaaattagggctctaa

SEQ ID NO: 1996 - DNA, 657 bp, Xenorhabdus bovienii
  Coding sequence Name=Xb4151_4152.C431.gene67.dna; Position on contig =30754..31410bp; Strand=+
atgagtgaaaatccagtcatgccgagagatgaggcagttactaccagtgaaataatcagtcgtattgggcagttaacgagaatgctgcgcgatagtctgcgtgaactggggttagatcaaaccattgctcaggcggctgaggcgatccctgatgcgagggagcgattgaattacgttgtccagatgacggcacaggcggctgaaagggtgctgaattgcgttgaagaggcacagccccaccagaatgaattggaatcttcggcgaaatccttaacccagcgctgggatgagtggtttgcaaacccgaacaatctggaattgacagaggctcgctcactggtgacagataccagagattatctcaatcttgtacctgaacatgtctcatttaccaatactcaattgcttgagatcatgatggcgcaagactttcaggatctgacagggcaggtcatcaaacggatgatggaagttattcaggagctggaaaaacaactggttatggtgttaatggaaaatatgccttctgaccagatggccaaagcgaaaaaagaaaacgacagccttcttaatggccctcaggttaatcagaatggagcaggtgttattgccaaccaagcacaggttgatgatttattggatagtttaggtttttga

SEQ ID NO: 1997 - DNA, 162 bp, Xenorhabdus bovienii
  Coding sequence Name=Xb4151_4152.C431.gene68.dna; Position on contig =31358..31519bp; Strand=-
atgtgccatgtgaaaaaactcaatgaattgatcaaaccacaactgcaagtggtagaaaccccctatttcgccttctgtactattcgttataaagtcccgtcattcgttatcaaaaacctaaactatccaataaatcatcaacctgtgcttggttggcaataa

SEQ ID NO: 1998 - DNA, 288 bp, Xenorhabdus bovienii
  Coding sequence Name=Xb4151_4152.C431.gene69.dna; Position on contig =31511..31798bp; Strand=+
atggcacatcggcacaccttggtggaaatgatgtgctgtgtggatgtgattaccgttcacgtaccatgcgatgagccggttagtgctctttgtttgaaaaatagccctctttttcgggtgatttttgggattttgctcttagctactatacctttagtattcattgaaggttatttgccaacatttttcaaagtgaagcagggaaagtcagccatgtcggtggtagtagaggttttattaagtagtttgttgaagtattttcagtttctggagggatgtattgaataa

SEQ ID NO: 1999 - DNA, 105 bp, Xenorhabdus bovienii
  Coding sequence Name=Xb4151_4152.C431.gene70.dna; Position on contig =31932..32036bp; Strand=-
ttgaatcaacatgattttacattaataaaaaatcatttattcatttcattagctgcaatgaatgaattgcaatacattaataaaataagtaagttatatttttaa

SEQ ID NO: 2000 - DNA, 102 bp, Xenorhabdus bovienii
  Coding sequence Name=Xb4151_4152.C431.gene71.dna; Position on contig =32200..32301bp; Strand=+
atgtatagcataaaactctatataatttatttaattaataattattttgtgcgttttcttaggattataattcatggcggtgtttttagacgtcttatataa

SEQ ID NO: 2001 - DNA, 237 bp, Xenorhabdus bovienii
  Coding sequence Name=Xb4151_4152.C431.gene72.dna; Position on contig =32403..32639bp; Strand=+
atgtacaatacagaaaatatattgtttaggcttaataggaacaatccccaaaaaccgatgacattgattcatattatgtcaatgtcattctcagcattcaggaaagaagccaaagatacactgaattggggagagaatcatcacctgtatctaaccgccaagaaagccgaaaaagaaaacaggatttttgacgcacgtttattatcccgcaccaattcgcagttacctgccatttga

SEQ ID NO: 2002 - DNA, 228 bp, Xenorhabdus bovienii
  Coding sequence Name=Xb4151_4152.C431.gene73.dna; Position on contig =32625..32852bp; Strand=-
gtgaatcttgtgtcatatcatcgtgctccttcagtctcctccgtagggagcctgtttgcagtaagtaagcaattatttgcaaatggtgtagcaaacgttaaacagaaaacgatgccgttcaaactgagaaacattgttttctgtttaacgttcacattggggaaactcagcaccagtgcacttgtatctttatctttcggaatattaatcccttcaaatggcaggtaa

SEQ ID NO: 2003 - DNA, 4599 bp, Xenorhabdus bovienii
  Coding sequence Name=Xb4151_4152.C431.gene74.dna; Position on contig =32759..37357bp; Strand=+
ttgctacaccatttgcaaataattgcttacttactgcaaacaggctccctacggaggagactgaaggagcacgatgatatgacacaagattcacaggacatgacagtaacacaactgtctctacccaaagggggcggtgcgatcagtggtatgggtgacgccatcagtaatgcagggccggatgggatggcttcgctttctgtgcctttgcctatctctgccggtcgggggagcgcaccgaatttatccctgaactacagtagtggggcaggaaacgggccatttggtattggctggcaatccagtaccatggctatcagccgtcgtactcaacatggcgtaccgcaatatcacggtgaagatacttttttatgtccgatgggagaagtgatggcagttgccgtcaatccgagcgggcaacccgatgtacgtcagaccgataaactattaggcgggcaactgcctgttacttatactgttacgcgtcatcagcccagaaatattcagcatttcagcaaacttgaatactggcaatcgctaacggatgtggaaaccacgcctttttggttaatgtattcacctgatgggcaaattcacattttcggaaaaactgagcaggctcagatcgctaatccggcagagacgtcacagattgcccaatggctattggaagagaccgtaacaccaacgggagaacacatttattaccagtatcgggcagaagacgatatcggttgtgatgacagcgaaaaaaatgcccaccctaatgccagtgctcagcgttatctggctcaggtgaactacggtaatatcacacctgaatccagcctgcttgtgttgaagaatacgccacctgctgatcacgaatggctattccatttggtatttgattatggtgaacgaacgcaggaaataaacacggttcctcctttcaaagcaccttcaaacaactggagaatacgcccagaccgtttctcccgctttgaatatggttttgaagtacgaacccgccgcctgtgccaacaaattctgatgttccatcgcctgaaatctcttacaggagaacagattgacggagaagaaactcctgccttggttgcccgtctgcttctcagttatgacctgaacgacagcgtggcaaccctgactgccattcggcaaatggcgtatgaaacggacgcaaccttaattgctttaccgccactggagtttgactatcagcgctttgaggcaaaagtcacgcaaaaatggcaggaaatgcctcaattggctggattgaatgcccaacagccttaccaactcgtcgatctctatggtgaaggtatttccggcatcctgtatcaggatcggcctggggcatggtggtatcaggcccccatccgtcagaaaagtgttgaagatattaacgcggtaacctatagcccagtaaaacccttacctaagatccccagtcagcaggacagggcaacgttgatggatatcgacggtgatggacatctggattgggttatcactggcgcaggcattcagggacggcacagtatgcagccgaatggcgaatggacacactttattcccatttctgcactgccaacagaatattttcatccacaggcacaactggcggatctggtgggagccgggttatctgatttagcgctgattggtcccagaagtgtgcgtttgtatgccaacgaccggggaaactggaaagcgggtattaatgttatgccacctgatggtgtgaatttgccgacattcggcggtgatgccagcagtctggtcgcattttctgatatgttagggtcgggacagcagcatttggtagaaattgccgctcagagcgttaaatgctggccgaatctaggacatggccgttttggtgaagctattctgctgccggggtttagccaaccgagtggaatattcaatgctaaccaagtttttctggcagatctcgatggctccggcaccgccgatatcatctatgcacacagcaagtatctggaaatttatctgaacgaaagcggcaaccgttttagtgcacccgttcgacttgatttgccgaaaggggtgatgtttgataatacctgccagttacaggtgtcggatattcaaggattgggcgctgccagcattgtactgaccgtacctcatatggcaccgcgccattggcgttatgattttacttacaataaaccttggctgctcaatgtcatcaacaataattctggtgcagaaaccactttgttttatcgtagttccgcccaattctggctggatgaaaaaagtcagatcgaagaatcggggaaatttgcagcgagttatcttccttttcccatacatttgttgtggcgcaatgaggttcttgatgaaattaccggtaatcggctgactaagggcatgagttatgcccacggtgcatgggatggcagagaaagagaattctgcggatttggccgtgtaacgcaaattgataccgacgaatttgccaagggaaccacagagaaaacgccggatgaaaatatctatccttcccgtagcataagctggttttccacgggtctgcccgaagtggattctcaacttccggcagaatactggcgtggtgacgatcaggcatttgccggctttacaccgcgcttcactcgctatgaaaaagcggatgcagggcaagcggggcaggatatcccgattaaagaaccgaccgaaacagaagcgtattggcttaaccgcgccatgaaaggccaattactgcgcagtgaagtctatggtgatgacaaaacagaaaacgctaaaattccgtacaccgtcacagaagcccgttgtcaggtcagattaattcccagcaatgacgaagccgcgccgtcgtcttgggcatcgatcatcgaaaaccgcagttatcactatgagcgtatcgtcgtcgatccgagttgcaaacaacaggtcgtgctcaatgcggatgaatatggctttccgcaggcaaaagtggatatcgcctacccacggcgtaacaaaccgacacagaacccctatccggattcgttaccggatactctgttcgccgatagctatgacgaccagcaaaaacagttatatctgacaaaacagcagcagagctactaccacctgactcatcaggatgattgggtgctgggtctgacggatacccgatacagcgaagtttatcattatgcacaaactgacgctcaaagtgatattcccaaggcagggctgacattggaagacctgctgaaagttgacggcctgataggtaaagacaagacgtttagctatttagggcagcagcgagtagcttacgtgggtggagatgcagaaaaaccgacacgtcaggtgcgggtggcttatacagaaaccgcagcttttgatgacaacgcgctgcatgcctttgatggcgtgatgacttctgctgaactgacgcaacagttgctggcgggtgggtacctgtacgtaccgcaggtttctgatgcggcaggtagtagtggaaaggtatgggtagctcgacagggatataccgagtatggtgatgcttctcagttctaccggccactcacccagcgcaagagcttgctgaccggaaaatatacactcagttgggatactcactattgtgtggtggtaaaaaccgaagatggtgcgggaatgaccacgcaagcgaagtacgattaccgcttcctgcttccggcacaattgacagatatcaatgataatcagcatattgtgacattcaatgcattgggacaggtgacttccagccgtttctggggtacagaaaatggcaaaatgagtggttactctacgccggaaaataaaccgttcacagtgccagataccgtcgaaaaagcctttgctttgcaaccggcgatcccggtttcacagtgcaacatttatgtgccggatagctggatgcggcttctgccccaacagtctctgactggccggctaaaagagggggaaaccttgtggaacgtattatacagggcgggtgtagtgacggaagatggtttgctctgtgaactggcctgccgtcgttggctcaaccgtcagacaacgtcttcaatggcagccgtgacattacagcaaatcttggctcagactccacgacaacctccccatgccatgacgatcacgacagatcgttatgacagtgattctcagcagcaacttcggcagtcaatagcattgagtgatggttttggtcgtgtactgcaaagcgcgcagcgtcatgaagcaggaaaggcatggcagcgtgcagaagatggctctttggttgttgatagtaccggtaaacccgttgttgctgataccacaacgcgctgggcagtatctggtcgcacagaatacgatggtaaagggcagacgatcagagcttacctgccttattatctcaatgattggcgctatgtcagtgatgacagcgcacgggatgatctgtacgccgatacccatttttacgatcctctggggcgtgaatatcaggtaaaaaccgcgaaaggcttttggcgtgaaaacaggtttatgccgtggtttgtagtcaatgaagatgaaaatgacacggcagcacgtttaacatcttag

SEQ ID NO: 2004 - DNA, 147 bp, Xenorhabdus bovienii
  Coding sequence Name=Xb4151_4152.C431.gene75.dna; Position on contig =37366..37512bp; Strand=-
atgaaggcttatcgggaattaaccaaaacgaaactgcagttagccaccttgctgaccgatactggcgatttaccgaccactggcactcgcatcattgacgttaaaagaagtctgaaccttccccgcatatataacagggaaggttga

SEQ ID NO: 2005 - DNA, 555 bp, Xenorhabdus bovienii
  Coding sequence Name=Xb4151_4152.C431.gene76.dna; Position on contig =37509..38063bp; Strand=-
gtggcaagagtcggttatatcagagtgtcaacaaatgaccaaaatagtgatttgcaaaaaaatgcgctggtcaatattgactgcgagcgcatttttgaagacaaaatcagtggaaaaaccgccaatcgtccggggctgaaacgcgctttaaagtatctgcaatccggtgatacgctggtggtctggaaattggatcgtctgggacgcagtgtaaaaaatctggtgacgttgatttcagagctgcatgaccgcggaattcattttcagagcctgaccgacagcattgataccagtaccgcgatgggacgttttttctttcatgtgatgagcgcattggcggaaatggagcgagagttgattgttgaaagaaccaatgcagggttagccgcagcgcgggaacaagggcgcattggtgggcggccggtgatatttaccgaagaagatcggcagcaggccgccagattgctggataaggggcataccagaaaacaactttcccttatttatcatgtttctctgtcaacaatttataaatatttgcctgtgggattatga

SEQ ID NO: 2006 - DNA, 201 bp, Xenorhabdus bovienii
  Coding sequence Name=Xb4151_4152.C431.gene77.dna; Position on contig =38261..38461bp; Strand=-
atgccaatgcccagaataccaaccagcataggtattccccatactatcccgtttatcgcatttaaccattgtgtaatcagttccatatacactcccataatcttgcataacaaattggcaacaaaattgtttcaattaaataaagagcattttgggaaaataagcgaggacaattggttatcattggtaagaaaaaattga

SEQ ID NO: 2007 - DNA, 1389 bp, Xenorhabdus bovienii
  Coding sequence Name=Xb4151_4152.C431.gene78.dna; Position on contig =38364..39752bp; Strand=+
atgggagtgtatatggaactgattacacaatggttaaatgcgataaacgggatagtatggggaatacctatgctggttggtattctgggcattggcatttttatgcaaatccgcctgtccttcttaccgatccgaaaattgggaacggggtttaagttactttttcagaaaaatgaacagcgtggtgaaggtcagatctctcctttcaatgccttgatgactgcattgtctgcaacaataggaacaggaaatattgccggtgtggcgacggctgtcgtaatgggcgggccgggagcattgttttggatgtggatgacggcattattgggtatggcaactaaatattctgaagccgtgttggcggtacgctttcgtgaaacagataaaaatggcaactacgttggcggccccatgtattacatcaaaaatggcttggggaaaaaatggatttggttgggaacactgttcgctttctttggcagcatagccggttttggcattggtaataccgtacaggccaactccgtggctgatgtactgcaaagcaactttggtattgaaaaaactgcgactgcgggcattctggtgattttggtcggagcggtactgattggtggtatcaaacgcatttctgatgtggccggcaagttggttcccgtcatgactgtcggctattttggtgccggcatcatcgtactggcactcaatatcaccgccatcccagaagcctttgtcttgatcattaaatctgcattcactcccgttgcagcacaaggtgggtttgccggtgcagcagtctgggcggcgatccgttttggtgttgcccgtggtgtattctccaatgaagctggtttgggtagtgctccgatagcccatgctgcggcaaaaacccaaaatcccatccgtcagggtttgattgctatgctggggacatttattgacaccatcatcgtctgttccgtcaccgggctgaccatcgttatcactggcggttggttgacaggggaaacaggggcaacgctgacagcctcctcattctctacggtgattccgggaggtaattacattgttgctgttgctctggctattttcgcctttactaccatcttgggatggagcttctacggtgaaaaatgtatccaatacttactggggccaaaagccattgtgcctttccgtattgcctggatcatagcactgccgattggtgccactcagtcgctgaactttgtctggttgctggcggatacactcaatgccatgatggcgatccccaacctgatagctcttgcgctgctaagccctatcgtgtatcgcttgaccagagaccatatccgtgacgttaacgccgatagcatcgaagttaaaacagcagccaaaacagattaa

SEQ ID NO: 2008 - DNA, 132 bp, Xenorhabdus bovienii
  Coding sequence Name=Xb4151_4152.C431.gene79.dna; Position on contig =39759..39890bp; Strand=-
atgacaaaaaccaagaaattcaatggcgggaatactgcaaagtttgcagaggtatttgggggatcacacgatgccggagcttgggaggctccggcatcgtgtgattggtgttacttatcactgataatatag

SEQ ID NO: 2009 - DNA, 1236 bp, Xenorhabdus bovienii
  Coding sequence Name=Xb4151_4152.C431.gene80.dna; Position on contig =39884..41119bp; Strand=+
ttgtcatgcttaacacaattttatttgctctttcccaaaagcaatttttctgcatgcaataacgaacgctcaccaaggaaagtcgtggctgaagatagcgatctcgaaaaaaccgaagaacccacgccccataaacgggaaaaagcccgcaaagacgggcagattgcgcgttcaaaggaactgacttctatcctgatgctggtgggaggggtaagcctgctctggatgagcggaaattcgatcactcatgaactttcactgatggtttttgaagggtttaactttgaccataatatggtcagcaacgataagcagatgattcagcaggtcggtcgcttattgaaacaggcagtatgggcattgctgccagtattcgttggtctggttctggttgccctcagtgcaccgacattgatgggggggctgatattcagttcaaaatctatcaaatttgatttggctaagctgagcccgatctctggattgaagaagatcttctccatgaacgcactggcagaattgttcaaggccatattgaaagcctcgctggtcggtggtggaactgccctgtttatctggctgaattggccggctatgttgaacttgactgcccagcccccgctgatggcgttgagtgatgccatgatgatgctgatctttgctggctacattgtcttatttatgttgataccgatggtggcgtttgatgtgctctatcaaatccgcagccacttgaaaaagctgagaatgacccgtcaggagatcaaggatgaattcaaggagcaagaaggtgacccacatgtaaaggctcgcattcgtcaacaacaacgggcggctgcgcgtaagcgtatgatgagcgatgtgccgaaggctgatgttattgtgaccaacccgacccattatgctgttgccttgcagtatgacagcaaaaaaatgggtgccccaaaagtattggcaaaaggggcggggcttattgccttacgcatcaaagagattggtgcagaaaaccgaattccgttattggaagcgccaccactggcaagggcgttatttcgtcatgccgaagtggggggctttattcctgcgacgctttatgctgccgtcgctgaagtgcttgcctgggtttaccaattgaaacgttggaaacgagaaggtggcctgaaaccgaaaacacctgaaaatctgccggtgccatctgcactggattttgctggagaaaataatcgtcatggctaa

SEQ ID NO: 2010 - DNA, 2088 bp, Xenorhabdus bovienii
  Coding sequence Name=Xb4151_4152.C431.gene81.dna; Position on contig =41112..43199bp; Strand=+
atggctaatctggcctcattacttcgtttaccggggaatataaaaggctcccagtggcaaatgcttgcggggcctgtactgatcctcatgattttgtcaatgatggtgctgccgttaccaccattcctgcttgatctgctattcacttttaatattgcactttccatcatggtcttgctggtagcgatgtttacccgtcggacactggattttgccgcatttccgactattctgctgttctcaacattactgcgcctgtcactgaacgttgcatctacacgtatcattctgatggaaggccatacgggttcagcggcagcgggacaagtggtggaagctttcggacactttttggttggtggtaatttcgcgattggtatcgtggttttcgttatcctgatcctgattaactttatggtcattaccaaaggtgcggggcgtattgcggaagtcggtgcgcgttttgtgctggatggcatgcccggtaaacagatggcgattgacgctgatttaaacgctggcttgattggtgaagatgacgccaaaaaacgccgcgccgaagtgacacaggaagcagacttttacggctcaatggatggtgcgagtaaattcgtgcgcggagatgccattgccggattgatgattctggtgattaacattatcggtggactgattgtcggtgttgcccagcataatatgaatctgggagatgcagcggaagcttataccctgctgactatcggtgacgggttggtagctcagttgcccgctctgattatttccacggcggcgggtgtgattgtgacccgagtggcgaccgatgaagatgtcggtcagcaaatggtgactcagcttttcaataacccacgggtgttgatgttgagtgcaggagtactgggcttgcttggtctggtgccgggaatgcctaatttagtttttctattattcacggcggcattggcgggtttaggatacttcctgctgcgcaaagataaaaatccgcttgcggcacagcacgaagagatgaaagccgtagaggaacagcaacaaaccgcagaagcctcatggtctgacgtacaactggaagatccactgggcatggaagtgggctatcgtttgatcccaatggtagatttccgccagaatggtgaactacttgggcgtatcagtggcatccgcaaaaaatttgcgcaagaagtgggctatttgccaccggtggtgcatatttgcgataacctggagttggcgcctgccagctaccgtattttgatgaaaggggtcgaaattggccgtggtgaagctcacccaggacgctggctggcaattaaccctggtggcgcagttggcgagttacagggagatttgacgcaagatcctgcttttggtctgtctgcggtctggattgatgattccctgcgagaacaggcgcaggtacagggttataccgttgttgcggccagtaccgttgttgcgactcacctgaaccacctgctatctcaacattccagcgaactgtttggaagacaggaagcacagcaactgtttgagcgtgtcagccaggaaatgccgaaactgacggaagatttcatacctgacgtggtgagtttgaccaccttgcacaaagtattgcagaacttgttggcagagcaggtgccgatcagggatatgcgtaccattatcgaaacactggctgagcatgcgccaacacaagctgatccttatgaattaaccgccacgattcgaattgcgcttggcagagccattgcccagcaatggttccccggggcggatgaaatcaaagttattgggttggatgcaggccttgaacgcctgttacttcaggcattgcaaagcggcggagggctggagcctggtttggccgaaagcctcgaacggcaggcggcagaagcgctggagcgtcaggaaatgttgggtgcaccgcctgtactgttggtcaatcatgcactgcgtccgctgctgtctcgtttcctgcgccgcatattgccgagattggttgtgttgtctaaccttgaaatcaccgataaccgtcagatcagaatgacggcaacgattggtggagcaagataa

SEQ ID NO: 2011 - DNA, 210 bp, Xenorhabdus bovienii
  Coding sequence Name=Xb4151_4152.C431.gene82.dna; Position on contig =43357..43566bp; Strand=+
gtgggacgtccatcttatcagatcagggctgagctaatatatgagactctgtttttcggcctaaaaagcggttccagatatcgaatttttactattcgtagagtacaaagtcttttttttataccgcttagcatatattttcatcttgttgcaactctcggttatggaggggttttttctaaattagattcacttacacagtgtatttag

SEQ ID NO: 2012 - DNA, 822 bp, Xenorhabdus bovienii
  Coding sequence Name=Xb4151_4152.C431.gene83.dna; Position on contig =43550..44371bp; Strand=-
atgaaaaatgaaagaagacattttctgaaacaggctagtgttactggtgcaatattttcattattacctctgcttccagcaggagccttcgcctcttcacctagtcaaccagaaaaaggagatggtattggcatcggtgtttgcgagttgactccagaggaaatgtcaggcccatattttataaataacaaactgctgagaaggaatatcacagaggatgaacaaggaatacctttgttattgacaatgaaaatcattgattctgtaacctgtaaacctttagatgatatccttattgatatatggcattgtaattcaatggggaaatattcaggttggaaatatattaatccagacctcgaggctccatctagtgatatcgggacgatttcaagaacggatgaaagcatatttcttcgtggggcacaaagaacagataaagaaggcatagtcagattcaccacaattttccctggattttatgctggaagagctatacatatccatttatcagcaaggagtgcgaatgtacaaaaaagacaggaagataaattctactttgtaggccaactctatttccctgagaatatttctaaagaagtcatgattaatgatatgtattctccaagagatattaataggcttaaaaatgaagatgactctattttttccggagttaaaaatagagctgcaattttgacggtaaaaaaaataggtgataatcctttggatggattacatggaaaaatagttttatctattaataaagaccatgtgtcaaagaaaataacccctaaagacttagctaaatacactgtgtaa

SEQ ID NO: 2013 - DNA, 108 bp, Xenorhabdus bovienii
  Coding sequence Name=Xb4151_4152.C431.gene84.dna; Position on contig =44502..44609bp; Strand=+
atgttaaagttaaataaaataaattctctatttaattttttattatttttaataagatggatttattattatcagaaatatttatcagtgtctagtatttatttttaa

SEQ ID NO: 2014 - DNA, 168 bp, Xenorhabdus bovienii
  Coding sequence Name=Xb4151_4152.C431.gene85.dna; Position on contig =44610..44777bp; Strand=+
atggtttttattttcgagataagtcacaaaaaaccgttatttataattttatgttgtttttttattataatatttatatcaattattattagtgttcctaaattgaagttattaattactatgaaatcttctaatttacgatttttgatatggggatcatttttctga

SEQ ID NO: 2015 - DNA, 123 bp, Xenorhabdus bovienii
  Coding sequence Name=Xb4151_4152.C431.gene86.dna; Position on contig =44759..44881bp; Strand=+
atggggatcatttttctgatgataaatattgatagaagtgctcaaacgattgatgcagataaggggcttgaaaaaagaatttatatgctaaaacggataatgagagcgcatgtctgcggatga

SEQ ID NO: 2016 - DNA, 99 bp, Xenorhabdus bovienii
  Coding sequence Name=Xb4151_4152.C431.gene87.dna; Position on contig =44868..44966bp; Strand=+
atgtctgcggatgaagtttttgaacaaaatagctggattaaagggacggagaatttattgactggcaagagcatgggaactttccgcgtttttatctga

SEQ ID NO: 2017 - DNA, 102 bp, Xenorhabdus bovienii
  Coding sequence Name=Xb4151_4152.C431.gene88.dna; Position on contig =45245..45346bp; Strand=+
atgttaatttatcttatcctgtctgcttttatatggttaatgagtgatgatttaaaaaattatatttatatgctatccattttatggcaccgcacttcatag

SEQ ID NO: 2018 - DNA, 96 bp, Xenorhabdus bovienii
  Coding sequence Name=Xb4151_4152.C431.gene89.dna; Position on contig =45310..45405bp; Strand=-
ttgtttacgtacaaattctatccgttggaattacatacaaataacttcgttcgtggcagctatgaagtgcggtgccataaaatggatagcatataa

SEQ ID NO: 2019 - DNA, 123 bp, Xenorhabdus bovienii
  Coding sequence Name=Xb4151_4152.C431.gene90.dna; Position on contig =45742..45864bp; Strand=+
ttgacacatcatttatacgtaataggcataagtcatcaggtcaagctcaggattcctgaccagatgtttagaggattacaaaaattgtttgtgcgtataaaagcagctctcattagtttttaa

SEQ ID NO: 2020 - DNA, 549 bp, Xenorhabdus bovienii
  Coding sequence Name=Xb4151_4152.C431.gene91.dna; Position on contig =46184..46732bp; Strand=+
atgtttgtaattaaaggaataaaaatgaaattattaaaattatttatcgcagcagttatttctggatctatggctgcaccggcattcgctgctgatggcacaattaactttaacggtaggattactaaggcgacatgtactgtcagtgccttaacggataatagtgtcaatttacctgaagtaggcgcgactgcccttgcaggaaaaggtacaaccgggggagaaactctctttagaattggtctggagaactgcgggatagtgggtggttcggctaatgtgcaggtgaagtttggcggtgttaaagatagtatcgatggcaatctgctgagaattaactctgagagtggtggagcgaagggtgttggcattggtatttatgagaaagatggtagtacgccaattaatatgggggcgcttagcaaagggattccggtagtttcacccgcaactacacttgaatttaaggctaaatatgtggctacagaagcaactgtcacgcccggtacagtgaaagcttctacggactttacactagactacgagtaa

SEQ ID NO: 2021 - DNA, 741 bp, Xenorhabdus bovienii
  Coding sequence Name=Xb4151_4152.C431.gene92.dna; Position on contig =46799..47539bp; Strand=+
atgtctctcatttttagtttgtgtagggatattgttatgttaaaacgttttttgttcgggttgctattgtccctgccggttgtctttgccgcacccgtccatgccggaatagcgctcagtagtacccgggtgatctatgaagcatctcaacgtgaagcgactatttccgtaatcaacgacagtaaggagcatgtttaccttattcagtcttgggtagatacctttacaacaacgaccgaactatctgatcgcaaagcgccatttttagtgacaccacccttattccgtctggatggcgagcaagaaaaccgtctgcgaattatcctgacagatgactctttgcctcgggatcgtgaatctgtcttctggttgaacgttaaagcgattcctgcggtggaaaaaaacgatgcaaaccgcctgctgatatcggtgaaaaaccggataaagctcttttatcggccagccggactgacagaacaactggcggataatgcctatcaaaaattgactttttcccgccagaatgggcaattagtggtgcagaatccaaccccttttcatatctctttccacaacattacggtcgggaataatccagtaccggaagccggtatggtcgccccgttcagccgccgtcaatggcctttacccgcaggttccggtaataccgtgacttggtgggctatcaatgattttggcggcaccactgagccacagcatcaaacattatcatcctcgtaa

SEQ ID NO: 2022 - DNA, 2490 bp, Xenorhabdus bovienii
  Coding sequence Name=Xb4151_4152.C431.gene93.dna; Position on contig =47570..50059bp; Strand=+
atgagtttgattactccttctatccgtgcgcagttaatattgctgctgttggccgggttcctgcctgtcgctgggtatgccagtgactattttgatctcgatgctctggaaattcatgacccgtctgcgccgccgcctgatttgagctattttgcagagaaagggggtagtgcaccggggacataccatgttgatatccgtgttaatggccagaataaaggtgcacaggatatccagtttgtgctgggcgccgggagaaaacttcaacccgacttatcggttcaacaactggccgactggggagtcaatgttgcggctttcccggtcttgaactcaaaaatgcaggtcactgacctggctgacattatcccttatgccagcacctcattacagcttggtcaacaaacgctaattatcagtattcctcaggcggcgatgacggctgaagcgcgcggtgcgattgattcatcactttggcaacagggtgaatcggcgctatggatgaattacgattttaacggtgctgaaactcgcagtaagagcggctctaaaaccaacagtatctatatgaatctgcgtagtggattaaactgggacgcctggcgcttacggaattattctacttaccaccgagtcagtagcggtgagtcacgttgggaaaaccttaacacgtatcttcaacgtgatgttcatctgctaaaaagccagttggtgataggtgaaaccaatacacgtggagagctgtttagcggatttgctttccgcggtattaccctgatgtctgatgataatatgttaccggacagtcagcggggattcgccccgatagtgcggggaatagcggaaagcaatgcacaggttaccattcgtcagaacggattcatgatttatcaggcttatgttccgcccggggctttcgtgattgatgacctttatcctgcctcctcaggaggagacctgaatgtgactattcaggaagcggacggccgtgaacggcactttgttcagcccttttcgtcggttcctattatgttacgggaaggtgggttcaaatacagtctgacggcgggagaataccgcacttcgcacgaacagattcggcagccgctctttatgcagagtgaagtttattatggcctgccacatgccacaactgtgtatggcggtacgttattgtctccgaactatcaggcctatgtcgttggtgtcggatacagtcttggccgttggggttctttgtcttttgatatcacgcggtcacaggctgatattatcaatgaaggtcaacaacacggccgggtttaccggtcgcagtataccaaagacttcgagcagacggggactcgcttgtcgctgaccagttaccattactcttcaccacacttttatgattttcaggacgttaataaccgggctgcacatgatgagctgtcatatcaacgtaaacataaatttcagcttaatctgagtcaaaacttgtcggattatggcagcatctatgtttccggctatttgcaggatgattggggaagccgtagtacgacccggagtttaaatgtcgggtacagtgtgaattatgccgatatcaattataccctgaactacacccaaaatatgagttcaggtaactcaacagccgataaccaactggcattcaatatacaggttccgctcgaccgctggctgccgaacagttgggctacctatagtctcaatcataatcgccaaggagatatgaaccaatcagctggactgagtggtacggctctggatggcaatgttctgggttactctctacagcagcgttacggtaataacggtcagaattccagtgggaatattaatctcaactataaagcccgttatggggagctgtccggtggatataactataacaatagctcgcagcagattaactacggactcagggggggattggtcgctcatcgtcatggcataactttgtctcaatcattgggtgagacgattgtcttggtcaaaactcccggagcagcaggggttaaggttaacggctataacggggttgaaacggatggacgaggccatgcagtattgccctatgtcagtccttatcaccataaccgtattgctttgtcaccggattcttttggcgatggcgtggaaattgagtccaatatccagactgtcattccgacacagggagcgatggtcgtggctgatttccgaacacggatcggccaccgagtgctgtttactctgacccatctggataaaccgattccttttggcgcaatagctaccctgaatgaagaaaatacaatcagctttcttactgaaaatcagagcattgttggcaatggaggagaaatttatttcggtggtgtgccggagcgggggcagttatctgttcaatggggtaatggtcagtttgaacagtgtaaagcgcgttttattttgccaaaaagtgaagcggcggtgatttcgatgaaggcagattgtcagttatga

SEQ ID NO: 2023 - DNA, 1017 bp, Xenorhabdus bovienii
  Coding sequence Name=Xb4151_4152.C431.gene94.dna; Position on contig =50135..51151bp; Strand=+
atgaaggtattcgtttatccgtggttattgttagcctcggtgtttttttcctccggtaaggtttatgccgattgttccgggggcagtggaatcatatcgactgttgcggtgtccattccgcaacatatatcgagggatgaaatataccgtagcttaaattcccagtctcgggcaagtatggcgataacttgcacaaatatgccgataagagccactcacataacagtcggcataaaagcctatggggacgattcggggatgacttccatctcccgtaaaattttcaaactgggtgacagtggtattggatatgtcgtcattggcgtggatgatacgcacgatgagaaaccggtaacaacaaccgcggatcgtttttggggcgggaatgccagagagctatataccactgagataaggtctgatagcactatcaacctgaatgccgcactcagactcgaattttacaaaattggcccgataaagccgggtcgttattcccagtcagtagccgcagctattgtagcaccgcgcggatccagaatacccagtgtgactcaagaattccgattcaccacgggtatgataacgattaacgctccaacctgttccgtcgataacagcacaattcctgtaacattaggccggataacgacaatgcaattaccttatgtgggttcaacggcagcggaaacactatttaatatacctttgacctgtgaacccaaagccaacgtttttatgaccttagaggcaggtcgtcaaggggcttataatctgatgcaaggtattatcgagcttaaacgtgggcttaatgagagagccagggatggtgttggtgtgcagattttagatggtaaaacgaatagacccattcacctcggtgaaaaaaaatactatacaaccacaggaatgggcgggcctgtaaacatacctttaaaagcacgttactatcggtatggtgacgttagagcaggggttgccaatgcaacagcgacattcacaatgagttatgagtga

SEQ ID NO: 2024 - DNA, 138 bp, Xenorhabdus bovienii
  Coding sequence Name=Xb4151_4152.C431.gene95.dna; Position on contig =51224..51361bp; Strand=-
atggtgctgatgggcaagcccatcacaacacagcactgtctggtcacaagatcagtgtttgattttgagtggtgcgactttaagtcgtcatatgtacagacctctttatttatcagtgaaataaagggtctgttttag

SEQ ID NO: 2025 - DNA, 441 bp, Xenorhabdus bovienii
  Coding sequence Name=Xb4151_4152.C431.gene96.dna; Position on contig =51300..51740bp; Strand=-
atggaagaaattcaactcttgcttgagcagcaaaacgtacacttaaattcgctttcgaacactatggcagaagaacaacgcatattgagcgaaggctttattgaagcgaatcatttacatcgagtcaccgaacaaaagacattctttctctcggcactcgatcatgctgaacgaagacgccagcaattaaatgaaacgctgaaagtgagcgcaccctattctagtcatgaaatactggcgatattatgggatcaaatcagccaaactgttgaacgtatccgtgatctcaatgtacataatgggtttttactggatcagcatattgagttgaacagccaggcgattgctttcttgaaaagtcaccacagcccttctctttatggtgctgatgggcaagcccatcacaacacagcactgtctggtcacaagatcagtgtttga

SEQ ID NO: 2026 - DNA, 300 bp, Xenorhabdus bovienii
  Coding sequence Name=Xb4151_4152.C431.gene97.dna; Position on contig =51767..52066bp; Strand=-
atgagtattgaatgcactcaacctctactggctattgctgctgtgcagcagcgcaatgccaatgaaggtgcccagagcactcgcagaactgtggctgtcgcagaaaaaagcgccgatacgcaagttaagctgagcgaggcgcagaaaaagctcgttcagccaagtagccaagatattaatatccagaaagtacaacaattgaaagaagccattgcgaaaggaacgctgaccatggacagcggtaaaatcgctgatgctttgttcagagaagcccttgaaaacatggaatatgataaataa

SEQ ID NO: 2027 - DNA, 672 bp, Xenorhabdus bovienii
  Coding sequence Name=Xb4151_4152.C431.gene98.dna; Position on contig =52186..52857bp; Strand=-
atgcctgcattaaaatttatcgggtttattacctttttccttagcagttttttgcatagtactttggcattagcgggcaatttaccgcaatcaatcaataattatttcactcagcttcaccacaacgcggatcaaaaagtcaccgtgaaaattaaaacgcctgagcagcaatggccggtatgtgaatttcctgaaatacagccgtcactgagcaacagaaactggggtagtctgtccattcccgtcacctgtggccaacagcgccgttttattcaggtatacgtcggtgttacaggttcctatctgatgtctaaccgcgcaattcagcgtaatactgtgctgacagaaaaagattttcaggtaaaaacaggggctttggataagttgccaaatgacataatccgtaacagaaaggtcatacaaaatggtattgccattcgcaacatccctgccggacaattcatcactcgtaacatgatccgacgcccgtgggcgattcgcgccggacaaaatgtcgtcgtcatcgtagatgggcatcattttcaggtacgctacgaagggaaagcaattaacaacgccgcaagttttgataatatccgtgtccgcctggcttctggacaggtgattaccggagaaactcaggaaaatggcagtgtaaaaatgatgttataa

SEQ ID NO: 2028 - DNA, 417 bp, Xenorhabdus bovienii
  Coding sequence Name=Xb4151_4152.C431.gene99.dna; Position on contig =53096..53512bp; Strand=+
atgctcgataaattagatgctgcctttcattttcgacaagaagcgctggcactccgcaaccagcggcaggaaattctgtctgcaaatatcgctaatgcggatacccccggctatcaggcgcgtgatatcgattttgctgctcaactgaaacaagtaatggcagagggtcgtgtgacgggaaatggaatgaagctgcgtctggcttccgatcggcatatccccgctcagtctcagaatcgtttggaaatggatctgctctatcgggtgccttaccagacggcaatggatgggaataccgttgacatggatgtagaacgcagccatttcgcagataacagcctgaaatatcaggctgaacttacgatgacgaattcgcagcttaaaagcatgatgtcagttctacagtcacaaggataa

SEQ ID NO: 2029 - DNA, 513 bp, Xenorhabdus bovienii
  Coding sequence Name=Xb4151_4152.C431.gene100.dna; Position on contig= 53524..54036bp; Strand=-
ttgatatcaccacttttttgtggttgttgtttgttcagggtggcgagttcgcctaccgttgaattatctaatgagtcattgattgaagaggtaaccgccataatggaattcctgttactgacccagagtcaacgttttcaacatgatggatttggtggtgttaagcacttcaatgtttgcctgataactgcgggaagcagagatggtattgaccatttccccgacgacatccacatttggcatacggacataacctttttcatccgccagtggattgcccggccggtattcaaggcggaaaggagtgggatcatccacaacttcactgacacgcacgccaccgatctcctgccctgccggagccgcaacgcggaagacgacttgtttagcacggtaaggctcgccatcaggccctacaacgctatcggcattcgccatattgctggcgctgacgttcagtcgctgggactgagcagaaagtgcggagctagcaatatcaaaaatactgagtaa

SEQ ID NO: 2030 - DNA, 696 bp, Xenorhabdus bovienii
  Coding sequence Name=Xb4151_4152.C431.gene101.dna; Position on contig= 53936..54631bp; Strand=+
atggcggttacctcttcaatcaatgactcattagataattcaacggtaggcgaactcgccaccctgaacaaacaacaaccacaaaaaagtggtgatatcaaagataacttcttgaatttattggttgctcaacttaagaaccaagatcccaccaacccaatgcaaaacaatgaattgacgacacagcttgcgcagatcagcaccgttcagggtgttgaaaagctcaataaaacgctgggcgctgtggttgggcagatggaaggcaatcaggcgatgcaaacaacaatgctgattggccgaacggttatgatccctggcgataagattttagtcggttccggtgaagaaaacggtattagcacatcgccattcggtttcgaactgacccgacccgctgataacatcaaaattaccattagagataaagagggtgttgtcgttagggaagtggaggctgaaaaagtgaatgtcggtgtacataaagttcagtgggatggtaaagacgcagacggtaaggaagtgataaacggtgcctataatttcactgtttccgcaagctatcaagatcaggcgttggtgacacttccgctgacctctgctgaggttaacggcgtcacacggggtgaggatggcactaaattagatttagggctggcgggtacggtaaccatggaccaagtacgtcagattctttag

SEQ ID NO: 2031 - DNA, 1251 bp, Xenorhabdus bovienii
  Coding sequence Name=Xb4151_4152.C431.gene102.dna; Position on contig= 54647..55897bp; Strand=+
atggctttttcacaagcggtcagtggcttgaatgccgcagcaagtaacttagacgttatcggtaataatatcgcgaactcggcgacatttggctttaaatccagttcagccgcctttgcggatgtattcagcggttcagatgtggggctgggggtgaaagtttctggcatggttaagaactttaaggatggttcaaccaccactacaagccgtcagctggacatggcgatcactcagggcggttttttccgcatgctggattccaacggcagtactttctattcccgtaatggtcagttcaacatggactcagaccgtaacctgatcaacatgcaaggcatgaagttgaccggttatccggcggtacaaggggcaaatgggcctgaaattcaaaagggtgcggcaccggggccgatttcgattccaagggatatgctggatgccaaggcgacgacgaacgtcacgatgacggctaacctgaattcgatgaataagaaagtcgatattaacccatttaatccatcaaacaaagacagctttaactatagctctggtctctcggtatacgatagcctgggtaatgagcacaatatcaatgtgttctttgttaaaacgaacgacaatgagtgggatatttatgctcaagatacctctgtgccaggttcagatcaccaaaagctgaatgataagaaagtagtcgaaaaagaaggtgaaagtaaaagcgttctatttagtggtaatggcaagattataggtaataacaacgcatttgctttcgatatgcctgggttaaatggttccattggtgctccaatcaccatagatttcaacaacagcaaacagcagagcatttcacaggattctatctccaaccagcagcagaatggctatgccgcagggagttttactaactaccgcgtggatagtgatggcaaaattcatggtctctattctaaccagcaaacacaggtgttaggtcaggtcgtactggcaaacttctctaacccggaaggtttggctgcacagggtgataacgtttgggtagaaacaggtgcatccggtagcccaatagtaggaactgcgggatcaggtaactttggtaagctgatcagtggtgcactggaagcgtcaaacgtggacatgagccaggagctggtcaatatgatcgtcgcccagcgtaactatcaatccaacgctcagaccatcaagacacaggatcagatcctacaaacactggttagcatgcgttaa

SEQ ID NO: 2032 - DNA, 756 bp, Xenorhabdus bovienii
  Coding sequence Name=Xb4151_4152.C431.gene103.dna; Position on contig= 55919..56674bp; Strand=+
atggatcacgtcatttataccgcgatgggtgctgcgcgccaaacgctggaacatcaggccgtcacagccaacaatctggccaatgcttcgacaccgggtttcaaagcccagcttgccgcactgcgttctgtgcccattgaaggcgaaactctgccgacccgcacattgaccgttgcttccacccccggcatggatagccgtcaggggcccatgaattatacttcccgcccgttggacgtggctgtcggacaaggtggctttctggctgtccaactcgacgatgggacagaagcttatacccgcaacggtggtatccagatgtcaccagaagggcaattgatggtgcaggggcgtatgttgatgggcgaaaacgggccgatcgatgttccgccacaggctgaacttactattgcggcagatggtgccatttctgccttgattgccagcgatcctccgacactgctggggcagattggtaagctgaaaatcgttaaaccggaagcgggccaagtggtgcggggcgatgatggcctgtttcatttaacgccacaggcgcgggaacagcagggcaatgaactggcagccagcacggaagtaaaaatcatgccgggtgtactggagggcagtaatgtcaatccggtggaaagcatggtgaacatgattgccaatgcgcgtcgttttgaaatgcagatgaaagtcatacacagttccgatgagaatgcccaacgggctaaccaaattctcgccatgagctga

SEQ ID NO: 2033 - DNA, 783 bp, Xenorhabdus bovienii
  Coding sequence Name=Xb4151_4152.C431.gene104.dna; Position on contig= 56697..57479bp; Strand=+
atgatccgatctttatggattgccaaaactgggctggatgctcagcaaacaaatatggatgttattgccaacaacttggcaaacgtcagtaccaatggttttaaacgccagcgcgcggtttttgaagatttactctatcagaccgaacgccagcccggcgcgatgtcgtctgaacaaaccaatctgccatctggcttacagattggtacaggagttcgtccggtggcgacagagcggctgcacagtcagggtaacttggcacagaccaacaacagcaatgatgtggcaatcaaaggacagggatttttccagatccagatgcctgatggcacaaccggttatacccgtgatggttcatttcagaaggatcaaaacgggcaattggttactgcgggtggttttcaggttgtgcctgccatcatcattccagacaatgccaccaaaatgagcattgcccgtgatgggattgtgagtatcaacgtgcaggggcaaaacgcacctcagcaggttggtcaactgacgctgaccacttttattaacgaaagtggcctggaaagcatcggtgagaacttgtatctggaaaccaacagttccggtgtccctgtagaaaatgcaccgggaatcaatggggctggtctgctctatcagggctatgttgaaacgtccaatgtcaacgtggcggaagaactggtcaatatgattcaggttcagcgagcctacgaaatcaacagtaaagccgtatcgacttctgaccagatgctgcaaaaactgacccagttataa

SEQ ID NO: 2034 - DNA, 834 bp, Xenorhabdus bovienii
  Coding sequence Name=Xb4151_4152.C431.gene105.dna; Position on contig= 57530..58363bp; Strand=+
atgaaaggtataattattaatcaggatagtcggggaggaaattctccggctatttccgcgataaatttaagagcatctaagatggatacaatgcccgttgccgagaacaacgtagcttatgactctcccggtttacggaaaaaccggggatataagtggcgcatcagcatggctctggcggtactgtcactggcgggctgtgcctatatgccgcacaaaccgctggtgaaaggagcgacaaccgcaaaccccgccgaagcccctgctccaacaccaaatggttctatttttcaggtttcccagccggtttattacggttatcagccgttgtttgaagaccgccgtccccgcaatatcggtgatacgctgaccattattctgcaagaaaatgtcagtgccagcaaaaactcctcagccaacgccagtcgcagtggaaaaaccggtttcacggctgctctgaccccccgtttcttaaagggattgatgggcggcgacaaaacggatttgagtatggaaggcgatagtgaatttgggggcaaagggggagccaatgccaacaataccttcaggggcacgattaccgtgactgttgataggttgctggccaatggcaacttacatgctgtgggggaaaaacagatcgccatcaatcagggaacggaattcattcgcttctctggcgttgtgaacccgcgcaccattaccggcaccaatacggtgagctccaatcaagtagcagacgcccgcattgagtatgttggtgatggttatatcaacgaggcacagacaatgggttggttgcaacgtttctttatgaatatctcaccgttttaa

SEQ ID NO: 2035 - DNA, 1119 bp, Xenorhabdus bovienii
  Coding sequence Name=Xb4151_4152.C431.gene106.dna; Position on contig= 58379..59497bp; Strand=+
atggaaaaattagtcgccagcctttttacacttttactggcattatccagcatattcgtgtctggcaccgcttcggcagagcgcattcgtgatttggtcaccattgagggcgttagggataacgcattgattggctatggtttagtggtcgggctggatgggacgggcgatcagaccatgcaaactccttttaccacccaaagtctgagcaatatgttatcgcagttggggatcactgtgccgcccggtacgaatatgcagcttaaaaacgtggctgctgtgatggtgacagccaaactgcctccttttgcgcgttcagggcaaaatatcgatgttgtggtttcctcattgggtaatgccaagagtctgcggggaggaacattgctgatgacgcccctgaaagggattgataatcaagtgtatgcgctggcacagggtaatattctggtcggtggggcaggtgtcagtgccggtggtaacagtatcaaaattaatcagcttgcgggtgggcgtatttccaatggtgcggtgattgagcgggagttgccgacccagtttggtcagaaaggaacgctgaacctgcaactgaataatgatgattttagtctggccgagcaaatcagtgatgcagtcaatcgcctgcaaggaaaaggaacggcaacgccgctggattcccgcacggtacaattgcgtttaccgagagaaaacagtgaacaggtaaggttcctgtctcaaattcagaacctgaatattcgcgtggatgcgggtgatgccaaagtgattttcaattcccgcacgggatcggttgtgatgaaccgcaatgttacgctggatagctgcgccattgcacatggcagcctgtctgtcactgttgaacgtcagacggcggttaatcagcctaataccccattagcggggggcaacaccgtagtgacccgtaatacgggggtcggaattcaggaacagggcggtgcattgcaacaagttaatgccagtgccaatctcacacaggttgtccgtgcattgaatgtcctgggcgcgacaccgacagatttaatgtccattttgcaggcgatggaaacagcgggttgtttgcgggcgaaactggagatcatctga

SEQ ID NO: 2036 - DNA, 966 bp, Xenorhabdus bovienii
  Coding sequence Name=Xb4151_4152.C431.gene107.dna; Position on contig= 59497..60462bp; Strand=+
atgagtgattttttgacaacgcctactgcggcttacgacgtcaattcgctgcattcactgaaagctaaattgtcacaggaaccacaacaagggctacgtcaggtagcccaggaacttgaaggcgttttcgttcagatgatgctgaaaagtatgcgttcctcgttgccacaagatggcatattgagcagtgatcagacccgtttttatacgtcgatgtacgatcagcagattgcccaggatctttcccaaaaggggctgggttttgccgacatgatcgtcaagcaattttccaacgcgaacaacgttgccagcgaacaggccggaacggtaccgatgccgctggataaagaattcctgcaaacattgccgaagcaggcactggaacagtttatgcgccgtaccatgacggcgccgttttcttcggcggcttccaagggttccgtgcaatcgaagtcattgccagttagcagtactgactttgtttccatgctctccctgcctgcgcagatagcgagccagcaaagcggtatccctcatttgttgatcattgcacaggcggcgctggaatccggctggggacagcgggaaattctgacagaggaaggcaaaccgagccataacctgtttggcatcaaggccggcaagcattggaaaggggcggtcaccaacatcatgacaacggagtacattgagggtgaaccgaagaagatgcacgacagtttccgggtttatggctcttaccgggaagcaataacggattacgtcaaactgctgacggaaaatccgcgttacgctaaggtcgcgcaatcaacgacggcagagcagggcgcatattctttacagagtgcgggatatgccaccgacccgggctacgccaaaaaactggtgtcactgatccagcagttaaagagtaccggaaatcaaatggtaaaagcctataccgatgatttcgacaacctgttttaa

SEQ ID NO: 2037 - DNA, 183 bp, Xenorhabdus bovienii
  Coding sequence Name=Xb4151_4152.C431.gene108.dna; Position on contig= 60472..60654bp; Strand=-
atgttattacccactacacccatcgccacctgcgcagcattaataccactcatggcagtattcataagactattagacatgtgtagatccttttacgttttcgttatgcctccgtcatgggaggtaattcactgctacagttatcggcaatattctctgatccttgaacaaaaacggcgttaa

SEQ ID NO: 2038 - DNA, 1641 bp, Xenorhabdus bovienii
  Coding sequence Name=Xb4151_4152.C431.gene109.dna; Position on contig= 60575..62215bp; Strand=+
atgtctaatagtcttatgaatactgccatgagtggtattaatgctgcgcaggtggcgatgggtgtagtgggtaataacattgccaactccaagaatgtgggctataaccgacagacaaccgtgctgacacagaataacggaaccctgtcaccggcgggttttattggcaatggtgtggctgtcagttcgattaaccgcgaatatagcgagttcatcaaccagcaacatagctctgcacaaaccaaacatgctgctctgaccgcttacaaccagcaaatcaccaaaattaatgatctgttggccgataaggacaccagcctttctaattccatcgaagagtttttcaaaagtctgggtgcggctgaaagtaatgcggaagacagtgcggcaagaacgacggttctgggtaaagccgaaggattggtgagtcgattcaaagaagcggatgaatttctgcgtcagatagataacagcatcaattctcaaattgagcagaatgccagagaaatcaataaatacgccgaagaagttgccacgctgaacaatgaaattacgcgtatgcgcggtacgggtacgggcgaaccactggctttactggataaacgtgacgaagcggtcaacaaattaaaccagcttgttgacgtgaatgtaactcagcaggatgggggcgtttataacgtctcattcggtggtggcatgtcactggtatcgggcagtaaatcctatcggctggaagcgatctcatccagcactgacagcagtcgtatcacgctgggctataacaacggcaccgtgggaacgaaagaaattgacgagcgctttatctcacaaggcacattgggtggtgcattgcaggtacgcagggaagttgtagattcaagtcgcaatcaattgaaccaattggctctggtaatggctgatcagtttaatcaggtgcaaaacggcggttttgatctgaaaggcaagccgggtgtcgatttctttaacttcaccaagccggatgttatttccaacagcaataacaaaggaacggctgatattaaggtggaatatgcagataccaccaaagtgaaaaatagtgactataccctcaaatatgaaggcggagattggaaagtacagcgcgtttctgacaaggcagcggttcctgttaccaagaatggcaatgcgctggaatttgatggactgaaagttgaaatcgatgctgctcattctcaggatcacgatacctacacgctaaaaaccgtcagtaacgtagtggcaacactggaagtgaatctccaagattcttctcaactggcgactgcgggtgataaagatgccggcccaagtgataaccgcaacgcgaagaaatttcttgccttgcaggatcagcgtctgattgatggcaagtcttcttttgcgggggcttatgcgtcactggttagtcaagtggggagtaaggccaatgaagctcaggtcagtgtcgaaacacaggggcatatcgttgacaaactctatgcgacccgcgaatcgatttctggcgtcaatatggacgaagaatatggcgccatgcaacgcttgcagcagtactatctggcaaacgcccgtgtgatccagacagcggcgaccttgttcgatgctattttgggcattcgctaa

SEQ ID NO: 2039 - DNA, 963 bp, Xenorhabdus bovienii
  Coding sequence Name=Xb4151_4152.C431.gene110.dna; Position on contig= 62252..63214bp; Strand=+
gtgcgtgtaagtacgaatctattatacagtcaaaaaatggatgggattttgggcgcccaatccaaatggatgcgctatggtgagcaactgtccacggggaaacgggttattaacccgtcagatgatcccttagcggcttcacagagcatcatggtttctcagtctgaatcgaaaaaccagcagtttatgacagcgcgtatttttgccagaaattccatgtcagctcagttaagcatcacctcaaatatcgtttcggttgcgaccaatgtttttgagactttggtggcggcagcggatgagcagagtgatcaggatcgtgaatcctatgcgcagcagttggagggttttaaacaacaattgctgaacctcggtaataaaacggatggtaatggccgttatatctttgggggttacaaaaccgacgttccaccgttcaaagcggatgagtctgggaaaattcactataaaggcggacatgaagaaattacccagcaagttgatgataaccgctcgatgatcattgctcatacggggaagcaggtttttttatcgacaacaaccaatccgattaaagaacccggtggtggcactggagaggcagatgtttttgctaccctcgatctggcaatcaaggcgttgagaacgccatacagtacagccagtgagtcggaaaaaaatgatgctatggagctgatcaataaagccaaccgtggtatccgcaatagtctggacaacttttcttcggtagaagccgttctcggtcttcagcttcaggaactggaacaactggattcgctgggcagtgagcgcagcatatccaataaagtccgtacaggggaattggtggacgtggattgggcatcgtccatttccagctattatcagcagcaggctgccctgcaagcttcttataaagctttcactgacttaaaaggtttgtctctatttgagatgtatcgctaa

SEQ ID NO: 2040 - DNA, 144 bp, Xenorhabdus bovienii
  Coding sequence Name=Xb4151_4152.C431.gene111.dna; Position on contig= 63268..63411bp; Strand=+
atggggaaatgggtattggatgctctttggtcggtttattgcttgtccattggtgacgtattaatgcacttaatcttcctttggtacttcttctctcgcattcaacccgtaatcacgaatcatatacaggatcttaagcaataa

SEQ ID NO: 2041 - DNA, 147 bp, Xenorhabdus bovienii
  Coding sequence Name=Xb4151_4152.C431.gene112.dna; Position on contig= 63443..63589bp; Strand=-
atgcgtttcataaacgcacattggaaagcaatatgttgcaaagaaatgtcactgaagaattgcattaactggtgttttatagcgataatcgtcacaggcttcatccgtggttttgatatgagtttggcgacgattatcagatcataa

SEQ ID NO: 2042 - DNA, 786 bp, Xenorhabdus bovienii
  Coding sequence Name=Xb4151_4152.C431.gene113.dna; Position on contig= 63525..64310bp; Strand=+
atgcaattcttcagtgacatttctttgcaacatattgctttccaatgtgcgtttatgaaacgcatcagaaatatcgagccccacgtgttgatcctcagccttatcgctgcactgagcacgggtaaaatcacgtctattgcccagttacaccaaaaatttaatggcctgtgcccggataaaaagcaaccagtcagttaccgccccttttataaccagctccgtaaagcggcttttgtcgaatttgtcaaaatattggtcagatttgccatggcgcaatgggtggagaaacaggtctcctcaccccaaaagctcatgaaatttaaacaggttattctccaagatgggagttcgttcaaagtccattctgccctggccgatgtttttccctatcgtttcaggacaacgggggccgcggtggaatgtcacatgacaatgtccttgctgactcagtcaccggtaaaaatgaccgtgaccgcagataccgcccctgagcgggcttacctgcctgtaccggcgatgttacgtgaccaattattattggccgatgccggttatgtcgactttgcgtattttgagcaagtgtcactttccggtggttcgtttattgtcaggggaagcaagtcccttaatcctcagatagtggtggcccgcaatggtcaggggaaattattgcccaagctgctcaataagccgctgaaatccatcactcgccgaaccaaccgttccgaagggcagtgtcgcgttaacggcggcaagttagcaaaagtggtgttgccggttatttag

SEQ ID NO: 2043 - DNA, 603 bp, Xenorhabdus bovienii
  Coding sequence Name=Xb4151_4152.C431.gene114.dna; Position on contig= 64361..64963bp; Strand=+
atgttgatattgccctttgcgtatcatgtgaatcagttcgatgccggccaggagcgtctgtgcccggcgaaacgatttgaaccccagcatctgtcgtatccgacgtttgatattgcggtgatcttgctcaaccagattattcaggtatttattttgccggatttcaatcccctgctgaggcgatccttccgcattgaggagagtgagcgcggcagtattggccccacttttatcgatagtcacgacggcgggtctgccgtgctggcgtatcgctttacggaaaaaacgctgggcagccattgcatcgcggcgagcggtcagcaggaagtcaaccgtctgaccgtcggtatcgaccgcccggtaaaggtatttccactgacctttcactttgatatacgtttcatccattcgccaccgggagccaccgggagccaacgggctttttgcgaggtcggaaagccttgccgagcaggggcaccagacgtaacacccaacgatgtattgtggcatggtcgacctcaatgccgcgctctgccatcatctcttcgagattgcgcagactcaaggcataagcgaggtaccaacggacacattgggccatga

SEQ ID NO: 2044 - DNA, 234 bp, Xenorhabdus bovienii
  Coding sequence Name=Xb4151_4152.C431.gene115.dna; Position on contig= 64857..65090bp; Strand=+
atgtattgtggcatggtcgacctcaatgccgcgctctgccatcatctcttcgagattgcgcagactcaaggcataagcgaggtaccaacggacacattgggccatgatatcgacaggataatggaggcgtttaaacgcgtttcggatcagggacatcactctggactcgctcaaaaacaggggagcttacctgatgaccgcttaatgcgacagaaccgccagacgagtatgtag

SEQ ID NO: 2045 - DNA, 150 bp, Xenorhabdus bovienii
  Coding sequence Name=Xb4151_4152.C431.gene116.dna; Position on contig= 65090..65239bp; Strand=+
gtgagagcagttcctgttcccagatgttggtcggtgagtgcattgaacacctcccgtattttcagtaaaaaatgtcagggactatcatgccacaatggggcgtacggctgtagtactagggaggtttccacctctactgacaagtactga

SEQ ID NO: 2046 - DNA, 150 bp, Xenorhabdus bovienii
  Coding sequence Name=Xb4151_4152.C431.gene117.dna; Position on contig= 65184..65333bp; Strand=+
atggggcgtacggctgtagtactagggaggtttccacctctactgacaagtactgactcatttatccttccgaccaaatccgtgaggttttacctatccgaaccaaaccgtagaccttgggttgttcgcgtaatccaatttctgccatag

SEQ ID NO: 2047 - DNA, 24312 bp, Xenorhabdus bovienii
  Coding sequence Name=Xb4151_4152.C431.gene118.dna; Position on contig= 65277..89588bp; Strand=-
atgataaggaatgacatgaacctcgataatctgaaacgtgctgtgctaaaaaagaaaatcaaacaacaattgcaaactcagcaacagcagcgaccctccatcaagcaggttgatcggaatcttcctctgccattgtctttcgcccagcagcgactgtggttccttgctcaactcgatcccgccgccagtctggcctaccatattccggtagcgctgcgtctcaccggccaacttgaccgcccctccctgactaccgcactcgatcacctgatcgcccggcacgaaagcctgcgtacccgcttcgtattagtcgaaggtcagccctgccaacacatcgatcccgctgatatcggctttaccctgtcctgtcaggacctgcgtccgctggagccggcaatgcacaacaaccgtatcgccgaacttgccagccttgaggcacagatccccttcgattttacccaaggcccgctgatccgcggtcaactgctgcaactgacggaggaaacgcacgtgctgctgctcacccagcatcacatcatcgctgacggctggtctatcggtgtgctggtgcacgaactgggcaccctctaccgcgccgccctcgacggccacgacgatccgctaccgccgctgcccattcagtacgccgactacgccgtctggcagcgcaactggctacagggggatatcctcactgaacagcgtgacttctggtgtagccagcttcagggcgctccggccttgctggcactcccttccgaccggccacgtccgccggtgcaacgctatgccggcggccaaattcccttccagctcgatgcgaccttgctggcgtcgcttaaggaactcggacaacgccataacaccaccctgtttatgaccgtactgaccgcctggagtatcgttctcacccggctgagtggtcaggatgatattgtcatcggcactccggtcgctaaccgtccgcgccatgaacttgagaaccagatcggcttcttcgttaatactctggctctgcgcgtcaccccgggtgatacctcccgtgtgaccgacctgctcgcgcaggttcgtgaacgtgcacttgccgcctatgcccatcaggatctgcccttcgagcaggtggtggaagcgttgcagcccgaccgtagcctgagctacagtccggtctttcaagtcatgctgaccttaaacaataccccggctcaaaattgggcattaccgggtttacagctcacgcccgtcgaacaggtacgctatggtgcccacttcgacttgacgttatcactgaccgaaactgaaatgggtctgatcggtgatctggaatatgccgcggatctgttcgatcccgcgaccgttgagcgcatggtcagctatctggaaaatgtgctggcggcgatggccgccgatgcaacacaagtccttgcgaacctgccgatgctgccgttctccgagcgacaacaacttctggtggacttcaacgccacccgggcagacttcccgcagaacgccctgatccatcaactgttcgaagctcaggcggtacacaatcccgatgtaacagccgtggtatgcggggaacacacactcagctatgacgaactgaaccaccgcgccaatcgtcttgctcactatctgatcgcgctgggggtacgtccggacgatcgggtagcgatttgtctggaacgcagcccggatatgatagtgagcctgctcgctatccttaaggcaggcggtgcctatgtgccgctcgatccgacttatccggccgagcggctggcctatatgctcaatgacgcggcaccggtagctttgctcacccagacgacatggatcgacatgctgtccagcgctattcccaccgtggtgctcgatgccccggaatcgtctatgacgacacgatcggcctacaatccggagccacaagtgctggggctgacgtcacgccatctggcgtatgtgatctatacctcaggctcgaccggccagcccaaaggagtggcgatcacccaccgcaatacggtgaatttcctcacctgggcgcaacgaactttcagtccggaggaattggcacataccctttttgccacctcgcttaattttgatttagcggtgtacgaatgcttcgtgcctttgatcgctggcggtacggttcacctcgtcccagatgcgctgtcactgataaccaccgcacagccggtcagcctgatcaataccgtaccgtcagccatcgcacacttgattgaagccaaggcggtgcccatgaccgcccggacggtcaatctggccggtgaagcattaaaaccccacgtcattgagcatttgtttgccgatacatccgtacaggatgtgtgcaatctgtatggcccctctgagacgacgacctattcaacctggatacggatgaaccggacggagggctttgccagtcatatcggccgcccgatcgccaatacccggatctatattcttgatgcctacagtcagcccgttccgctcggtgtgaccggcgaaatccatatcgccggtgccggcgttgcccgtggctacctgaaccgccccgaactgactgctgagcgctttcttgccgatccgttctccgccgatccggatgcccgtatgtacaagaccggtgacctcggccgctggcgacccgacggcaatatcgactatctcggccgcaatgactttcaggtcaaactgcgcggcttccgcattgaactcggcgaaattgaggcgcaactgatgcaatgctccggcgtacgcgaagccgtggtgctggcgcgcgaagatcaaccgggtcacaagcgtctggtcgcctatctgcggcctcagaacagcgttgaactggtgcccgctgaactgcgtcagcagcttgcccggcaccttgccgagtatatgctgcccagtgcctttatgacgctcgatgctttcccgctcacccccaacggcaaactcgaccgtcaggcgctccctgtccccgacctgtctgctgtggtcgctcgcggctatgaagccccgctcggtgagatggaaactgctctggcgcaaatctggcaagatctgttgcagctggagcaggtcggccgtcacgaccacttctttgaactcggcggccactcgctgatgattgtcaatctgatcgaacggctacatggccttggttggcggctcgacgtccgcagcgtgttcgccactcccattctcactgaaatggcacaggctattcagggtgacactaacgccttcgtggtgccgcctaaccgtattcccgaagactgtaccgccctcacccccgacatgctgtctctggtctcgctgtctcaggctgaaattgatgctatcgtcgacgccatccccggtggggcaagtaatgtgcaggatatctatccgctggcgccgctacaggaaggtatcctgttccactatctgctacagacacaaggtgatgcttatctgttacagagcctgctcgcctttgacagccgagagcgtcttgatacttttctgaccgcgctgcaacaaattatcgaccgccacgatatcctgcgtactgccgtctgctggcagggattagcgcagccggttcaggtggtctggcgtcaggcaccgctgtgtgtcaatcgctttaccccgactacagcggacgatgttccggctcagttattgtctcacaccgatccacgccggcaccgtctcgacctgagccgtgcgccgctgttcgctggtgatatcgcccataatccggcacaggatgaatggctgctggcgctgcgcttccaccatctggtcagcgaccatatgacgctggagctgattttcgctgaggttgctcaggtgttacagggacaggccgggacactccccacagcgctgccctaccgcaactttgtcgcccagaccctgagtgtaccggccgcagtgcatgaggcctatttccgcgcccagcttgccgacgtcgacacaccgacagcaccgttcggggtgctcacaatgccgggcgataacgagcctgtcaccgaaaaccgtctttcgctcactcccgctctggcggaggccatccgtacccaatcccgccgtctgggggtcagcccgggtgtgctgttccatgtcgcctgggctcaggtgctggcacaaaccagcggccatgatgatgtggtcttcggctctgtattgctgggtcgcctgttaggggtcgctggcgctgatcgcatactggggatgtttatcaataccctgccggtacgagtctctctggccggccgcagtgtgcaggaggtggtgcaggccacctaccgcgatctgatgacactactggagcacgagcaggcacctttggcgctggcacaacgctgtagtggcgtaacgcagtcgatgccgctgttcagtaccctgcttaattaccgtcatagccaaaccagcacggcagacgcggttaacacgagctgggcaggtatgcacgtagtcgcagttgaagaacagagcaactatccgctcactttgtcggtggatgatctggggatcggtttccacctgacggctcaggccgtggccggaatcgatccggctcgcgtcaccgcctatctggttactgccatcagcggtctggtcgatgccctgattcgcgagccacaacgattgattcaggatgtaccgatcctgccaccttcagagcggcaacaactgctggtggagttcaacgccacccagacggacttcccacaggatgcgctaatccatcaactgttcgaggctcaggcagcacgcaaccccgacgctaccgctgtggtgtatgaagaccagatactcagctatggcgagctgaaccgccgtgccaatcgcctcgcccatcatttgattgcgctgggtgtgtgtccggacgatcgggtggcgatttgtgtcgaacgcagcccggagctggtggtcggcctgttcgctatcctcaaggcaggcggtgcctatgtaccactcgatccggcctatccggccgagcggctgacgtatatgctcgacgacgcagcaccggtagttttactcactcaaacgacgctgatcgacacgctgaccagtcccgttcccacgataatactcgacggccaagaaccgttcctgatgacgcaatcagctcacaatccggacgctcaggcgctggggctgacgtcacgccatctggcgtatatcatctacacttccggctccaccggattacccaagggggtgatggtcgagcatcgcggcctgagcaatctgatcgccactcagcaggacactctggcgatcaaacctgacagccgtatcctgcaatttgcctctaacagcttcgatgccggtatctgggaatgcggcatggcacttctggcgggtgccagcctccatcttgcccagcgaactcacctcctgcccggagctgccctgttgaatactctggagactcatgccattacccatgtgctgctgtcgccaacagcattggcggcactggattccgtacccgtaacactgcaaactctgatcgtaggcggtgaggcctgctcacccgcactggtcaaacgctgggctgaaggtcggcgtatggtcaatgcctatggaccgacggaaagtacggtctgtgcggctatttatctgtgcgataaccaagaagaaggcgctccgcctatcggccagccgattgctaatacccggatctatattctcgactcctacggtcagcccgttccgctcggtgtggccggcgaaatccatatcgcgggtgccggtattgcccgtggctacctgaaccgccccgaactgaccgccgaacgcttccttgccgatccgttctccgccgatccggatgcccgcatgtacaagaccggtgacctaggtcgctggcgacccgacggcaacatcgactatctcggccgcaatgactttcaggtcaaactgcgcggcttccgtatcgagcccggcgaaattgaagctcaattggtgcaatgctccggtgtacgtgaagccgtggtgctgacccgcgaagatgagccggaccacaagcgcctgatcgcctatctgctgccccagtctgatgttaagctggtgccggccgaactgcgtcagcagctttctcaacaccttgccgagtacatgctgcccagtgcttttgtgacgcttgatgctttcccgctcagccccaacggcaaactcgaccgtcaggcgctccccgcccctgatccgtctgcgatagtgacacgaggctatgaaactccggtcggtaaagtagaaatcacactgtcacagatctggcaagacctgctgagactagaacaggtcggccgtcacgaccacttctttgagctcggcggccattcgttgcttgccgttcagcttgtggcacgtgtgcgtcaggatctggcacgggaattgccactacaacagattttcgctcaccccctgctggcagagctagcccaaacgctgaccggtacgtcggcaaccactcaggtcgctatccccgccgccgatcacagccgaccgctaccattatctttcgcccagcaacggttgtggttccttggtcagctcgatcccgccgccagtctggcctaccatatcccgctagcgctgcgtctcaccggccagcttgaccgccatgccctgatcaccgcactcaatcgtctggttgtccggcaagagagcctgcgcacccgctttatcctgatcgacgggcaaccctgtttgcacattgatcccgccgatatcggctttaccctgtcctgtcaggatctgcgtcctctggagtctgcggcgcaaacccatcgtgttgccgaactcgccaaccttgaagcgcagacgcctttcgactttacccaaggcccgctgatccgcggtcaattgctgcaactggcggacgaggagcatgtgttgctgctcactcaacatcacatcatggctgacggctggtctatcagtgtgctggtgcacgaactgggtgccctctaccgagctgttctcgacggtcacagcgatctgttgccgccgctgcccattcagtacgccgattatgccgtctggcaacgcgactggctgcaaggaaccgttctcgctgagcagcgcgacttctggtgcgcccagctccgggacgctccgacctttttggaactccccaccgatcggccacgcccgtcggtacagacctatgccggcgatcgggttcctttccggcttgatgcgaccttactgacatcgcttaaggggctaggacagcgtcataacactaccttgtttatgaccgtgctgaccgcctggagcatcgtcctcgcccgactcagtggtcaggatgatattgttatcggcactccggtcgccaaccgtccgcaccgtgaacttgagaacctgatcggcttctttgtcaatactctggctctgcgcgtcacaccggatgatggcctccgtgtggccgatctgctcgcacaggttcgtgagcgggcgctcgccgcctatgcccatcaggatctgcccttcgagcaggtggtagaagccttacagcccgatcgcagcctgagctacagcccggtttttcaggtgatgctgaccttaaacaataccccgcctcaagatctgtcattgcccggcttacagctcacgccacttgagcaggtgcgccatagcgcccacttcgacctgacgttatcgctgaccgaaacggaggcgggtctggtcggtgagctggaatatgccaccgacctgttcgaccccgcgaccgttgagcgcatagtcggctatttaaagaatgtgctgacggagatggtggtcgatgcgacacaaactattgcggatctgccgatgctgtcagcctcggagcggcaacagttactgaccggcttcaatgccatccaagtagacttcccgcagagcaccttgatccatcagcggttcgagattcaggcggcacattctcccgatgccaccgccgtggtgtttgaggaccagacactcagctatggtgaactgaaccgccgcgccaatcgtctcgctcatcgcttgattacgctgggggtgcgtccggacgatcgggtggcaatttgcgtcgaacgcggtctggagctggtggtcggtttgctcgctattcttaaggcaggtggcgcctatgtgccgctcgatccggcttatccggccgagcggctggcttatatgctgcatgatgcgacaccagtagctttgctgacccagacaacacaggtcgacatgctgaccagctactcccctgctctcctgcccacaatcgtattcgatgctcaggatgcgtccctgatggcgcaaccggatcacaatccggatacacaggcgctggggctgacatcacgccatctggcgtatgtcatctacacttccggttccaccggattacccaagggagtgatggttgaacatgcccatgtcacccgcctgttagctgcaacccaagaacgtttccggtttgatagcaatgacgtgtggaccctgttccattcctttgctttcgatttctcggtgtgggaactctggggcgccttgtctcatggtggccggctgatcgtcgtaccgactgactgtacccgttcaccgcaggctttctatgcgctactgtgccgtgagcaagtcaccgtactgaatcaaacacccagtgcttttcgtccgttgatttctgcccagaatgccacaccgcattccctgcgctgcattatctttgggggggaggcgctggagttgcatacgcttgccccgtgggttacccgtaaccccacccgacagacccgtctggtcaatatgtacggcattaccgagatcaccgtacatgccacttatcgtgaactcacggaatccgacatcactctgggacgtggcagtttgatcggccagccgctacccgatttgcgggtatatatcctcaaccctcatggtcagcccgttcctctcggtgtgaccggcgaaatccatatcaccggtgctggtgtcgcccgtggttacctgaaccgtcctgaactgactgcggaacgcttccttgccgatccgttctcctccgatccggacgtccgtatgtataagaccggcgacctcggccgctggctccctgacggccatctcgagtatctcggccgcaatgactttcaggtcaaactgcgcggcttccgtattgagctcggtgagattgagtcccggctagtgcaatgtcacggtgtgcgtgaagcggtggtgctggcgcgcgaagacgaaccgggcaacaagcgtctggtcgcttacctgctgccccagaccgacgccgaactgatgccggctgaactgcgtcagcaactcgcccagcaccttgccgaatatatgttgcccagtgcctttgtgacgcttgacgctttcccgcttacccccaacggcaaactcgaccgtcaggcgcttcctgtccccgacgcgtccgccgtagtggtgcgcggctatgaagccccgctcggtgagatggaaactgctctggcgcaaatctggcaaaacttattggggctggaacaggtcggccgccacgaccatttctttgaactcggcggccactcgctgatgatcgtcagtctgatcgaagaactgcgcggcctcggctggcggcttgaggttcgcagcgtgttcgccgcccccgtcctcgccgaaatggcacagaccatccggagtgacaccgacgctttcgtggtgccgactaaccgtatccccgaaggctgtaccgcccttacgcccgacatgctgcctctggtcacactgtctcaggctgagattgatgccatcaccgacgtgatccccggaggggcaaccaatgtgcaggatatctatccgctggcgccgttacaggagggtatcctgttccatcacctgctacagacacaaggtgatgactatctgctacagagcctgctcgcctttgacagctgtgagcgtcttgatactttccttgccgccctgcaacaggtcatcgaccgccacgatatcctgcgtaccgccgcctgttggcagggattagtgcagccggttcaggtggtctggcgtcaggcaccgctgtgggtcaatcactttaccccagacacggcggacgatgttccggctcagctacgggctcacactgacccacgcttacaccgcctcgacctgagccgtgcgccgctgttcgccgccgatatcgcccatgatccggcacaggatgaatggctgctcgctctgcgtttccaccatctggtcagcgaccatatgacgctggagcttatttttgctgagattgccctgctgttacaggggcatgccgaaaagctgaccacggcactgccctaccgcaattttattgctcagaccctgagcataccgaccgcagttcatgaggcttacttccgcgatcaactcgccgacgtcgacgaaccaacggtgccgttcggtgtactcaaggtgcaggctgacggcgaacccgttaccgaagcccgtcttccgcttgtacctgctttagcagaggctatccgcgttcaggctcgtcgtctgggggtcagtccgggcgtactgttccatgtcgcctgggctcaggtactggcgcagaccagcggccgcgatgatgtggtctttggctccgtgctgctgggtcgtctgcaagggggcgcaggtgctgaccgaatactgggaatgttcatcaatactctgccagtgcgggtctctctggccgatcacagcgtacaggccgtagtacaggcgacctaccgcagtctgaccatgctattggagcacgagcaggcaccattggcgctggctcaacgctgtagcggcatggcgcagtcgataccgttgttcagtaccctgctcaattaccgtcataatcaggccggcaaggcagatacggctgagacgacttgggcaggtatgcgtattttaacaacagaggagcgaaccaactatccggtcaccctgtcagtcgatgatctgggaactggtttccatctgactgctcagactgtgacgggtatcgatccgacccgcgtcaccgcttatctggctacggcgatcagtggtctgatcgatgctttgacccacaatccgcaacagttgattcgagatgtgccgatcctgccaccggcagagcggcaacaactgctggtgaacttcaacgccacccagacgcacttcccacaaaacgccctgatccaccaactgttcgagtctcaggtggcatacaaacccgatgccaccgcagtggtgtttgaggatcagactctcagctatggtgaactgaactgccgcgccaaccaactggctcatcatctgatcgcgctgggtgtacgaccggacgatcgggtggcgatttgtctggaacgcagcttggagctggtagtcggcttacttgcgattcttaaggcaggcggcgcttatgtcccgctcgatccggcctatccggccgaacggttggcttatatgcttgatgacgcggcacccgtagtcttactcactcagacggcatgggttgacacgctggtcagccccgtgactacgtccgtacctataatagtactcgatgctcaggaaccggctgtggcagcacaaccgacccacaacccggagccgcagacactggggctgacgtcacgccatctggcatatgtgatctatacttcaggctccaccgggttgtccaaaggcgtcatggttgaacaccggaatgtccttcgtctcatcatcaataatggttttgccgatattggctccgatgactgtattgcccattgtgccaatattgcctttgacgcatcaacgtgggaaatctggtctgctctgctgaatggcgggcgtctgtatgtggttccaccctcagtgctgcttgatccggtacgtttctgcgattcgctgatcaaagggcaagtcactgccctttggctaacagccggcttgttcaatgagtatctcagcgatctcaaccccctgcttgggcgactacgctacctgctcatcggtggcgatgtactcgatcccagaaagattcaacgtgcacaattggctgagtctcagccagcacatctcatcaacggctatggtccgacagaaaccacgacgtttgccaccacctatcgtattgcatcccccgtcgatgttgctcactctattcccatcggccgtccgatcgccaatacccggatctatatccttgattgccacaaccagcccgtccccctcggtgtggccggcgaaatctatattgccggtgccggtgtcgcccgtggctacctgaaccgccccgaactgaccgccgagcgcttcgttcctgatacgttctccgccgatccagatgagcgtatgtataaaaccggcgacctcggccgctggcttttcgatggcaacatcgactatctcggccgcaatgattatcaggttaaactgcgtggcttccgtattgagcccggtgaggtagaggctcgtcttgtgcaatgtcacggggtacgcgaagcggtggttctggcacgtgaagacgaacctggctacaagcgtctggtcgcctatctgctgccccagaccggtgttgaactggttccggccgaactgcgtcagcaactttctcaacacctcgccgaatatatgctgcccagcgcttttatgacgctcgacgtcttcccgctcacccccaacggcaaactcgaccgtcagtcactccccgtccccgactcgtctgccgtggtgatacgcggctatgagccgccacagggaagaatagaaaccgctctggcccagatctggcaagacttactggggctggagcaggtcggccgtcatgaccacttctttgaactcggcggccattctctgcttgccgtccaactcgccgcgcgtgtacggcaagatctggcgcgggaattgccgctacaacaactctttgcccagcccatcctgacggatctggcccacgcactcaccggcgcttccgtgacaactcaggtcatcatccccgtggccgatcgcagccagttgcttccgctatccttcgcccagcaacggctatggttccttgggcagctcgatcccgctgccagtcaggcctaccatattccggcagctctgcgtcttactggctcactcaaccgtcacgcgctgaccaccgcactcgatcatctggttgcccggcaagagagtctgcgcacccgctttattctggtcgaaggccaaccctgccagcacatcgatcccgccgatagcggctttgcgctatcctgtcaggatctgcgcccgttagactcagcggtgcgtaacaaccgtgtcaccgagctcgctgcccttgaagcacagacacccttcgactttatccgggggccgctgatccgtggtcaattgctgcaattgacggacgaggagcatgtattgctgctcacccagcatcacatcatcgctgacggctggtccatcggtgtgctggtgcatgaacttgtcgccctctaccgtgccgcccttgacggccacagcgatccgctaccgccactgcccattcagtacgccgactatgccgtctggcagcgtaacgggttgcagggagccatcctcaccgaacagcacgacttctggagcagccagctccaaggcgccccggctttgctgacacttcccaccgatcggccacgcccacccgtacagagctatgccggtggccgggtgcctctccaccttgatgctacgttgctggcatcgcttaagggactcggacagcgccataacactaccttgtttatgaccgtattgaccgcctggggcatcgttcttgcccggctcagtggtcaggatgatatcgttgtcggcactccggtcgctaaccgccagcacagagaattcgagggtttgatcggcttctttgtcaatactctggccctgcgtgtcacaccgggtgatacgcctcgtgtgtccgatctgctcgcacaggttcgtgagcgagcactcgccgcctacgctcatcaggatctgcccttcgagcaagtggtagaagccttgcagcccgaccgcagcctgagctacagcccggtcttccaagtcatgctggctttaaataataccccgagccaagacttgtcgttacccggcctacagctcactcccgttgaacaggtgcgctatggtgctcactttgacctgatgttgtcgttgaccgaaactgaggcaggtctggtcggtgatctggaatatgccgccgacctgttcgaccccgcaaccgttgagcgcatggtcggctatttgactcatgtgctggtggcaatggcagccgacacgacacaaaccattgccagtctgccgatgttaccgcctgcggagcggcaacagctactggtgaacttcaacgccacccagacagacttgccgcaggacaccctgatccacccactgttcgaaactcaggcagcactgcatcccaccgataccgccgtggtgtacggggatcaggcgctcagctatgacgaattgaatcgccgcgccaatcagttggctcatcatctgatcaatctgggtgtacgcccggatgatcgggtagccatctgtgtcgaacgcagtctggagatggtggtcggtttgctcgctatccttaaggcaggcggagcctatgtgccgctcgatccggcctacccgaccgaacggctgacgtatatgcttgatgacgcggcacctgtggtattgcttacccagatggcgtgggtcgacacactgaacagcgccatacctacagtggtactcgatactcaagaaccgtttatggaatcacagccgacccacaatccagaagcgcagacgctgggtctgacatcacaccatctggcgtatgtgatctatacctcaggctcgaccggccagcccaagggggtgatgagcagccatcacgccctgtgtaaccggctgttgtggttcgtgcgcgacattgtgacaccgccactggtggcggcgctgaaaaccagcatcagcttcgtcgattcagtgaccgagacacttggtgtattactggccggtggcaaactggtggttttcgataaccatgaagtgaaagatcttacgcgcttcggcgaaggtttacgccgcgccgaggttaactacatggtggtggtgccttcactgctgaaactcctgatagaggggagtggcgattctctgaaatcgattaggacgttgatttgcagcggagaacgacttgcgcctgaactcgcgcggcaggtcgtaacggattacccttgtattcatctgctgaatttctacggttcgtccgaaatcaatggtgatgcgacctggtatgaatattctgctacggtcggcgtgccggatgtttcagtcatcggcagacccatcgccaatacccaaagctatatcctcgatccccacggccaacctgttcctctgggcgtcactggcgaaatccatatcgccggtgccggcgttgcccgcggctacctgaaccgccctgaactgactgccgaacgtttccttgccgatccgttctcctccgatccggacgctcgtatgtacaagaccggcgaccttggccgttggcttcccgacggccatatcgaatatctcggccgcaacgattttcaggtcaaactgcggggtttccgtatcgaactcggcgagatcgaagccaaattagtacaatgccacggcgtatgcgaagcggtggtgctggcgcgcgaagacgagccgggtcacaagcgtctggtcgcttatctgctgccccagaccggtgttgagttggttccggccgagttgcgtctgcaactctcccggcagctcgccgaatatatgctgccgagtgcctttatgacgcttaaggctttcccactcacccagaacggcaaacttgaccgtcaggcgcttcccgcacctgacccgtccgccgtggtgacacgtaattatgaagcgccagtaggagaggtagaaaatgctctcgcccagatctggcaaaacctgctggggctggaacgggtcggccgtcacgatcatttctttgaactcggtggacattcgctgatgatcgtcagtttgatcgggcggctgcgtggcttcggctggcggctcgacgtccgcagcgtatttgccgcccccgtccttgccgaactggcgcaaaccatcctgatacatcaggacgctgccgacgccttcgtggtgccgcctaaccgtatccccgcaggctgcactgccctcacgcccgatatgctggctctggtttcgctgtctcaggctgagattgatgttatcgtcagcatgatccccggcggagcgagcaatgtgcaggatatctatccgttggcgccgttgcaggaaggtattctgttccatcacctgctacagacacaaggcgatgcctatctgttacagaccctgcttgccttcgagacccgccagcatctcgatgcttttctggccgcgctgcaacaagtcatcgaccgccacgatatcctgcgtaccgccgcctgttggcaaggactgacagagccggttcaggtggtctggcgtcaggcaccgctgtgggtcaatcactttaccccaaccacagcagacgacgtcccggctcagttacgggctcatactgatccacaccagcaccgtctcgacctgaaccgcgcgccactgtttgccgccgacattgcccacgatccggcacaggatgagtggttgctggcgctgcgtttccatcatctggtcagcgaccaaatgacgctggcgctgatttttgccgaaattgccctgctgttgcagggacatgcccaaaaactacccgccgcgctgccctaccgagactttatcgcccagatcctgagcgtgccggacacagtgcatgaggcttacttcctctcccaactcgctgatgtcgacgaaccgacagcaccattcggtgtgctcaaagtgcagggcgacggtgagcctgtcaccgaagcccgtctcttgctcccccccaatttagctgaggctatccgcgctcaggctcgccgtctgggagtcagtccaagtgtgctgttccatctcgcctgggggcaagtgctggcacaaaccagcagccgcgacgatgtgatctttggctccgtgctgctgggtcgcctgcaaggaggcgcgggtgccgaccgagttctggggatgtttatcaatacgctgccgatgcggatctctctggccgattgcagcgtacaggaagcggttcaggccacctaccgcagcctcacaatgttgctagagcacgaacaggctccgttggcgctggcgcagcgctgtagtggtgtggctcaaccgatgccactgttcagtgccttgctcaattaccgtcatagtcaagctgacgaagccggcgcgcttgatacgatttgggcaggcatgcgcatcgtggcaaccgaagggcgaaccaactatccggttaccctctcggtggatgatcagggggtcggtttccgcctgactgcccagactgtgacgagtatcgatccggctcgcgtgaccacttatctggccaccgccctcagcggtttggtcaaggcgctggccagcgatccgcaacagcctatcctgcaagtgcccatcttgccggcatcagagcggcaacagttgctgaccggcttcaatgccatccaagtagacttcccgcagagcgccttgatccatcagcggttcgagactcaggcggcacattctcccgatgccaccgccgtggtgtttgagaaccagacactcagctatggtgaactgaaccgccgcgccaatcgtctcgctcatcgcttgattacgctgggggtgcgtccggacgatcgggtggcaatttgcgtcgaacgcggtccggagctggtggtcggtttgctcgctattcttaaggcaggcggcgcctatgtaccgctcgatccggcttatccggccgagcggctggcttacatgctgcatgatgcgacaccagtagctttgctgacccagacaacacaggtcgacatgctgaccagctacttccctgctctcctgcccacaatcgtattcgatgctcaggatgcgtccctgatggcgcaaccggatcacaatccggatacacaggcactggggctgacatcacgccatctggcgtatgtcatctacacctccggctccaccggattacccaagggggtgatggttgaacatgcccatgtcacccgcctgttagccgccacccaagaacgtttccggtttggtggcaatgatgtgtggaccctgtttcattcctttgctttcgatttctcggtgtgggaactctggggtgccttgtctcatggtggccggctgatcgttgtaccgactgactgtctccgttcaccgcaggctttctatgcactgctatgccgtgagcgagtcaccgtactgaatcaaacgcccagtgcttttcgcccgttgatttctgcccagaatgccacgccgcattccctgcgctgtattatcttcgggggggaagcgctggaattgcatacgcttgccccgtgggtcgcccgtaaccccacccgacagacccgtctggtcaatatgtacggcatcaccgagatcaccgtgcatgccacttatcgtgaactcacggaatccgacatcactctgggacgtggcagtttgatcggccagccgctacctgatctgcgggcatatatcctcggcacccacggccaacccgttcctctcggtgtgaccggcgaaatctatattaccggtgccggtgtcgcgcgtggctacctgaaccgtcctgaactgactgcggaacgtttccttgccgatccgttctcctccgatccggacgcccgtatgtataagaccggcgacctcggccgctggctccccgacggccatctcgagtatctcggccgcaatgactttcaggtcaaactgcgcggcttccgtatcgaacccggtgagatcgaaacccaattggtgcagtgccccggcgtacgggaagccgtagtgctggcacgcgaagacgagccgggacagaaacgtctggtcgcctatctgcggcctcaggacggcgttgaactggttcccgccgaactacatcaacagcttacccaacatcttgccgagtacatgctgcccagcgcttttatgacgctcgatgctttcccgctcacccccaacggcaaactcgaccgtcaggcgctccccgcgcccgatgcgtccgccgtggtgacgcgcggctatgaagccccggtcggtgaggtggaaaccgcactggcgcaaatctggcaaaatctgttgggactggaacggatcggccgtcacgaccatttctttgaactgggtggccattcgctgatgattgtcagtctgattgagcggctgcgtggccttggttggcagctcgacgttcgcagcgtgttctccgtgcctgtactcaccgatatggcgcaagctatcctgaagtcccagagtggtgccgacaccttcgtggtaccgcccaatcgcatccccgaagactgcaccgccctcacgcccgatatgctgcctctggtctcgctgtctcaggctgaaattgatgccatcgctgacgcgatccccggcggagtgacccatgtgcaggatatctatccgctcgcgccgctacaggaaggtatcctgttccatcacctgcttcagccgaacagagatccatacgttatatcgtcgttgttgagcgtcgaaaaccagacaaaactcgacgcattcattgcggcattacaagccgtcatcgatcggcatgatatcctgcgtacatctatccactggctcgggttatcccaacctgttcaagtggtacatcgacacgcaccattgccggtcaatgtcctgacattcgatgacgatagtgacgtggttgccagcatgcaagcgcgcatggcactgtcacatcagcacatggatttgtcccatgctcctctgatacgtttgcaagtcgccaccgaaccacattcagccaagttgtacgtcttgttccagttgcatcacatcatcgacgataacctctcactccggtgtttgctcgcagaaacgaccgctttcctgatgggacttggcgcggatttgcagccatccgttccttatcgtaactttgtcgcctacgcacgtcaggaaggtaaaactcaggaagcggaagccttcttccggacattcctggcagatatcgacgaggccaccgcaccttttggcctggcggatgttcaggggaatggcgaacataacgcggcggcacgaaaggttcttgatgttgaactctcacaagcaatccgtaaaacagcgcgccgcttcggcactaaccccgcaattttgttccacgcagcttgggcgctcgtcatcgcacgcacgagtggacgcgatgacattgtatttggcaccgtattgtcaggccgcatgtcgggagttgatgggagtgctcgcgctttaggcatgttcatcaataccctgcccttgagactgaagctaaaaggaagcagcgtggatgaactcgtcaaaatgacgaatgacgcctgtgccagcctgctgctctacgaacagaccccattgtcgcttgcacagcgttgcagtggactcggtggcatatccctgttcagtgccctgctcaatttccggcatggtaatgacaaaaatacccgtacacctagtctggatctgtttggtctggcaagtttagatagctgcgaacgtaccaattacccatttgaaatgtccattgacgatgatggtgaatattttgtgttatcagctcaaaccgtcaataacattgatcccaatagaataaatacctatctcacaagagcgatagagcaattgatatcaatattggttgaagcgccagacacgcctgcactggatttggacgtgttgcccgaagacgaacgccagcaactgctggtgaacttcaacgcgactcaggcggacttcccgcaggatgccctgatccaccaactgttcgaggttcaggcggcgtataaccccgatgccaccgccgtggtatgcggggagcaagcactcagctatggcgaactgaaccaccgcgccaatcgtctggctcatcatctgatcgcgctgggggtacgtccggacgatcgggtggcaatttgtctgacacgtagccctgagatggtggtcggcctgctcgctattctcaaggcgggcggtgcctatgtgccgctcgatccggcgtatccgactgaacgactggcgtatatgctcaatgacgcggcacccgtggccttactgacccagacggcatgggttaacatgctggtcagccccgtgcctacggtggtgctcgacgcccaagaaccggttatggcagcacaacccatccataatccggaaccgcagacgttggggctgacgtcacgccatctggcgtatgtgatctacacttccggttctaccggcctacccaaaggggtgacgatcgcccactgtaatacggtgaatttcctcatctgggcgcagcggactttcagcccagaggaattggcgaatacccttttcgctacttcgcttaattttgatttggcggtatacgaatgctttgcgcccctcgtctctggcggcacggttcatctcgtccctgatgcgttgtcactggtcactaccgaacaaccggtcagcctgatcaacactgtgccgtcggccatcgcacatttgatcgaagccaatgcgattcccctcactgcccggacggtcaatttggccggtgaagcattgaaaccacaggtcgttgagcatttatttgcccactcatccgtacagaatgtgtgcaatctgtatggtccctctgagacaacaacttattcaacctggatacggatgaaccggacggagggctttgtcagtcatatcggccgcccgatagctaacacacagatctatatcctcaacccacatggtcagcccgtgcctcttggtgtcgccggcgaaatccatatcgccggtgccggtgtggctcgcggttatctgaaccgacccgaactgaccaccgaacgcttcctcatcgatccgttctcctcggcaccagatgcccgtatgtacaagaccggcgacctcggccgctggctttctgacggcaatattgaatacctcggccgcaatgattttcaggtcaaactgcgcggcttccgtattgaactcggtgagatcgaggcgcaactgatgcaatgccacggcgtgcgcgaagcggtggtattggcgcgcgaagatgagccgagccagaaacgtctggtcgcctatgtacggcctcaggccagcgttgaactggttcccgccgagctgcgtcagcaactcgcccgacaccttgccgaatatatgctgcccagcgcctttatgacacttgacgctttcccgctcacccccaacggcaaacttgaccgtcaggcgctccctgcccctgattcgtccgccgtggtggcgcgtggctatcaagcgccagtcggcgcggcggaaaccaccttggcgcagatctggcaagacttattgggactggagcgggtcggccgtcacgatcatttctttgagcttggcggtcactcactgctcgctgtgcagttgctgaaccggatgcgggagcaagacatggcggttcctctgaccgtcttgttcgtgcatccgacattgagtgatctggcaatagctattggcgagcgttttgcccaatcaacgtctccgttcgatgcgaatcccgtgccgctaaacccaacaggcggcctgccacccttgttcctgatacacgagacttccggcgatccactggtctattcgccactggcagccttactgccatctgagcttcctgtctatgcattacaggctcttggtatccacacgctggagcatcctcctgcgtcgcttgaagcgctcgcggcctgccatattcaggctattcgtcgcgttcagccgcaaggcccctatcaccttgccggatggtcaattggtggtttgatcgcctatgagatggcgcaacaattcatgagctgcggcgaaacggtaggatttctcggtatgatcgattcctataattccataaatgggctacaaatctccaccgaccagccgatagacaaggaagcaaaacgaattgagataatcattgactcactgcgtgctcaaatcggcacgagtgacgagcaggtattagaagaactgcacgatctcagcgatgtgaaccaaattcttgaccgctgtattgaacaccaatggctgccggccagtatcacacgcgaggatatcctccttcgcctatacaccgccgagatcattacacaactgggtcaagactatatcgcgccaaaatcccccctgcccatccacctgtataccgcggatgaggcactcaacggggaaatttggcacggttggcgtaatatcgtcggcactgattcgacactccacgctatcggtggaacgcatttctccatcatgcgtcccccttcgctcaaccagatagtggattcactcaccgagcacttactgcccgctcctccctatgacccgcgcgttatcatccaaagcgggtctcggtcggttccgccgctattttgcatgcccggtgccggtgccagcgcctctagtcttctcgggctggcgctgtcgctcccacagcaacttccagtctacgccttgcagacacgcggtctgggactgactgacaaacacaattttccctatgtcagtgtcgaaggtgctgctcatgcctatatccagatcatccgtcaaacgcaacctcacggtccctatcacctgctgggtcattctttcggtggctggatcgcgtttgagatggccttgcaactgcaagcagaaggggaacaagtctccgaccttattctcgtcgataccgatgaacctgatccgcaaggcagtattcccaagtcagtcaaccgtaccgaaacgataatgaagctgattgagatctacaatatgatattggatcggcccctgccgctgacgaagccggattttgacgatctgactccgaatgaacagtttcaatacctgcttagtgctctggtaaacgcaggtctctttctggccaaaacaccaatatcactgctgcaaggtgtcgtccgcgtcatgcaggccaatctgaacacttgctatacacctcgtgcccgctatgagggtcttgttcatctgatcagcgcagaagagggagatgtggaggaaacaaaaacccgcgaagctctgtggagtacacacgccgctcaactcagcacgatgcatgtacccggtaatcacatgaccatgttgtccagcccgcagattgagcactttgttactgggctatggcagaaattggattacgcgaacaacccaaggtctacggtttggttcggatag

SEQ ID NO: 2048 - DNA, 6633 bp, Xenorhabdus bovienii
  Coding sequence Name=Xb4151_4152.C431.gene119.dna; Position on contig= 89585..96217bp; Strand=-
atgacaaggattaacatgaatctcgatgacctgaaacgggctgttctagagaagaaaattgaagaacaattgaaagcccgcggaggtcagcagcaacggccattgattgaacaggtaaatcgacatcagcctctgccgttgtccttcgcccagcagcggttgtggtttctcagccagctcgatcctgccgccagtctggcctatcacatgtcggtggtactgcgtctcacgggtcaacttaaccgcgatgccctgaccaccgcactcaatcatctggtcgtccggcatgagagcctgcgtacccgcttcgtgctggtcgaaggccagccctgccagcacatcgatcccaccgacgtcaattttgccttgtcctgtcaggatctgcgcccgctgaacccggcaatgcacacccgccgtatcgccgagctctctgccctcgaagcacagaccccctttgactttgtccgcggcccactgatccgcggtcaactgctgcaactgacagacgaatcacatatgttgctgcttacccagcaccacatcatcgccgacgcatggtccgtcggtgtactggtacatgaactgggcgctctctaccgcgccgccctcaacggccacagcgatcctttaccgccgctgcccattcagtacgccgactacgccgtctggcagcgtaacgggttacaggaaaccgtccttactgaacaacgtggcttctggtgtactcaacttcagggtgccccgaccttgctgacactccccaccgatcggccacgtccgtcggtgcaaacttatgtcggcgatcaggtctctttccagctcgattccaccttactggcatcgcttaaggaactcggacagcgccaccataccaccttgtttatgaccgtactgaccgcgtggagcatcgtcctcacccggctcagtggtcaggatgacattgtcatcggcactccggtcgctaaccgcccacaccaagaattagagggactgatcggtttcttcgtcaatactctggccctgcgcgtcacgccgggtgatgcgtttcgtgtgtccgatctgctcgcacagatccgtgagcgggcacttgcggcctatgcccatcaggatctgcccttcgaacaggtagtagaagcgctacaacccgaacgcagcctgagctacagcccgatatttcaggtgatgttgaccttaaacaacaccccggctcaagatctggcactaccgggtctacagctctctctggttgaacaggcgcgttatagcgcccatttcgatctgacgttatcactgaccgaaaccgaaaccggcctgactggtgatcttgaatatgcctcggatctgttcgatccaacgactgccgaacgtatgatagagtactttaagcaggtgctgacggcgatggccgccgatgcgacacaaactatcgcacgcctgccaatcctgccggcttcggagcggcaacagttgctgaacgatttcaatgccacccaagcggacttcccgcaagacgccttgatccaccaattattcgaagcccaagcagcacactcccctgatgccactgccgtggtgtttgaggatcagacactcagctatggcgaactgaaccgccgcgccaatcggctggcccatcatctgatcgccttaggtgtacgcccggacgatcgggtggcaatttgtatcgaacgcagcccggagctggtggtggggttactcgctattctcaaggccggcggcgcctatgtgccactcgatccggactatccggccgaacggctggcctatatgctcgatgacgcggcaccggtggccttactgagcctgacagcacaggttggtaaactggccagccccgtccccaccgtggtgctcgatgcccagaaactatccctgacggcacaaccgagccacaatccggacgctcaggcgctggggctgacatcacgccatctggcatatgtgatctacacctccggctccaccggattacccaagggggtgatggtcgagcaccgcaacgtcctgcgtctgatcatcaataatggttttgccgatattggtcccgatgattgtattgcccattgcgcaaacgtctcatttgatgcagccacctgggaggtgtggacgggtttagtgcatggcgcacgtatcctgttgatcccggaaaaaaccttattacaacctgattattttggtcagtgtttatcatcggaaggtgtcagtgcgcttttcctgacaaccgcgttgttcaatcaatacgcgagtttaatcgcgccatcattgtcgggtttacgttatgtccttttcggcggtgaacaggctgatatccgtcctgcgatccgccttagaaccgattacccgccacagcacctgctacatgtgtacgggccaacggaaaccaccacctttgccacggcctatgaaatcccactgactgaaagtgaatatggaaaaattcccatcggtcagccgattgccaacacccggatctatattctggatacccaagggcagcccgttcctctcggtgtcgcaggcgaaatctatattgccggtgccggtgttgcccgtggctatctgaaccgccccgaactgactgccgaatgtttcctcaccgatccattctccgccgatccggatgcccgtatgtacaagaccggcgacctcggccgctggctttctgacggcaatatcgagtatctcagccgcaatgactttcaggtcaaactgcgtggcttccgtattgagctgggcgagatcgaagcccgattggtgcaatgtcacggcgtacgcgaagccgtggttctcgtccgcgaagacgaactgagccacaagcgtctggtcgcttatctgcggcctctgggcggtgttgaactggtgccggccgaactgcgtcagcaactcgcccggcaccttgccgagtatatgctgcccagcgcctttatgacgctcgatgccttcccgctcacccccaatggcaaacttgaccgtcaggcgctccctgcccccgattcgtccgccgtagtggcgcgtggctataaagctccggtcggtgaggtagaagccgctttaacccagatctggcaagatttgttgggactgacgcaggtcggccgtcacgatcatttctttgaactcggcggccattcgctgatgatcgtcagtctgatcgagcggctacgcggcctcggctggcggcttgacgtccgcagcgtgttcgccgcccccgtgctggccgagatggcaaaaaccatactggcacatcaggacgacaccgacactttcgtggtaccacctaaccacattcccgaaggttgtacttccctcacccccgatatgctgtccctcatctcactgtctcaggccgagattgatagcctcatcagctccatccccggtggagccagtaatgtgcaggatatctatccactggcaccgttgcaggaaggcatcctgttccatcacctgatgcaggcacaaggtgatacttatctgttgcagagcctgattgccttcggcacccgcgagcgtctcgatactttcctgaccgccctgcaacaggtcatcgaccgtcacgatatcctgcgtaccgccgcctgctggcagggattatcgcagccggttcaggtggtctggcgtcaggcaccgctgtgtatcaatcgcttcaccccaactatggcggatgacgttccggctcagttattggctcacaccgatccgcgccggcatcgtctcgacctgaaccgtgcaccgctgttcgccgctgatatcgcccacgatccggcacagaatgaatggctgttggttctccgtttccaccatctggtcagcgaccatatgacgctggagcttatctttgccgaaattgcccaaatattgcagggacagactgagacactccccacagcgctgccttaccgcgactttatcgcccagaccctgaatgtaccggccgcagtacacgaagcctattttagcgcccaactcgccgacgtcgacgcccccacagcgccgttcggtatgctcacgataacggacgatagcgaatccatcgccgaagcccgtctcccgctcccccccgacctggcggaagccgtccgcacccgggcccgccgtctgggggtcagtccgagtgtgctgttccatgtggcttgggctcaggtactggcacaaaccagcggccgcgatgatgtggtctttggctccgtgctgctgggtcgtctgcaaggaagcgcgggcgccgaccgagtactgggcatgtttatcaataccctgccggtacgaatccctctggccagtcgcaacgtgcaggcagtggtacaggccacctatcacaatttaatgacgctgctggaacatgaacaggctccgttaacactggcacagcgctgtagtggcgtggctcagccgatgccgctgttcagtgccctgcttaattaccgtcacagccaaattggcgaagcagaggcggttgacacaacttgggcaggcatgcgcatcatcgcgacaaaggaacgaaccaactatccgctcaccctgtcggtggatgatctgggagccgatttctatctgaccgctcaggccgtggccgggatcgatccggctcgcgtaatcgcctatctggttaatgctatccgcggactggttgatgctctggctcacgatccacaacaattgattctggatgtgccgctcctgccaccggcagagcggcaacaactgctggtggacttcaacgccaccgagacggacttcccgcaggacgccctgatccaccagctattcgaggctcaggcagcgatccggccagccgcaacagccgtagtgtacgaagaccggacgatgagctatgacgaactgaaccgccgcgccaatcgactggctcatcatctgatcgctctgggcgtacggccggatgatcgggtggcaatttgtctggaacgctgtccggagctggtggtcggcctgctcgctatcctcaaggcgggcggcgcctatgtgccgctcgatccgacctatccggccgaccggttagtttatatgctcaatgacgcagcgccggtggctttactcactcaggcggcatggattgaccggctggacagccccgtgccggcggtagtactcgacacccaagagtcatctctggcggcgcagccagactacaacccggacgctcaggctctggggctgacgtcacgccatctggcgtatgtgatctacacctccggctccaccggattacccaaaggggtgatggtcgagcaccgcaatgtcctgcgcctgattatcaataatggttttgccgatattggccccgatgactgtattgcccattgcgccaatgtttcattcgatgcggctacctgggaagtgtggacgggtttagtgcacggcgcacgtatcctgctgatcccggaaaagaccctccttcaacccgactcttttgggcagcaattagcatcggaaagcgtcagtgcactcttcctgacaactgcattgttcaatcaatacgcgagtttgatcgcgccgtcattgtcgggtttacgttatgtcctttttggtggtgaacaggctgatatccgtcctgtgatcaatcttagagccgattaccctccacaacatctgctgcatgtgtacgggccaacagaaactaccaccttcgctacagcttatgaaatcccattcacgaaaggcgaatatggaaaaatccccatcggtcacccgattgccaatacccggatttatattctggatacccaaggccagcccgttcctcttggtgtcaccggcgaaatccatatcgccggtgccggggttgcccgtggctacctgaaccgtcccgaactgactgccgaatgtttcctcaccgatccctttgccgccgatccgggcacccgcatgtacaaaaccggcgacctcggccgctggcttcccgatggcaacattgaatacttcggccgcaatgactttcaggtcaaactgcgcggcttccgcattgaactcggcgagatcgaagcccgactggtgcaatgtcacggtgtgcgcgaagccgtggttctggtacgcgaggacgaaccggataacaagcgtctggtcgcttatctgcggccgctggacggtgttgaactggtgccggccgaactgcgtcagcagctcgcccaacaccttgccgagtatatgctgcccagcgcttttatggtgcttgatgctttcccgctcactcccaacggcaaacttaaccgtcaggcgctccccgccccggacgcatccgccgtggtagtacgcggctatgaagccccgctcggcgaggaggaaatcactctggctcagatctggcaagacctgttagggctggaacgggtcggtcgtcacgaccatttctttgaactcggcggtcactcgctgatggccgtgcaattgacaacgcgcatacaaaccgaatttctggtcgatatccccatcgcctcgttgtttctttcccccaaattggcggaacaggccaacatcattttgtcagcgcaaatggatgcaataggggaaaacgatattgaatcaatacaaaactcactggatttaatgtcaacagaagaactgatggcaattttaggcggagacagtaatcaatga

SEQ ID NO: 2049 - DNA, 10614 bp, Xenorhabdus bovienii
  Coding sequence Name=Xb4151_4152.C431.gene120.dna; Position on contig= 96214..106827bp; Strand=-
atgagccgggcggagggctttgtcagtcatatcggccgcccgattgccaacactcagatctatattctcgatggctacggtcagcccgttcccctcggtgtgaccggcgagatttatatcgccggcgccggcgtggcccgcggctacctgaaccgccccgaactgactgccgaacattttcttaccgatccgttctccgccgatccggatgcccgtatgtacaaaaccggcgacctcggccgctggcgctctgatggcaatctcgactacctcggccgcaatgactttcaggtcaaactgcgcggcttccgcattgagctgggcgaaatcgaggcgcaactgatgcaatgttacggcgtgcgcgaggcggtggtactggcacgcgaagacgaaccgggacagaagcgcctgattgcctatctgcggcctctggatggcgctgaactgcttcccgccgaactacgtcagcaactcgcccgacacctcgctgagtacatgctgcccagcgcctttgtgatgcttgaggccttcccgctgacccccaatggcaaactcgaccgtcaggcactccctgctcccgacctgtctgctgtggtggcacgcggctatgaagtcccgatcggtgaggcagaaactattcttgcgcaaatctggcaagacttactggggctggagcaaatcggccgtcacgaccatttctttgaactcggcggccattcgctgatgatcgtcagtctgatcgaacggctacgcggcttcggctggtggcttggcgtccgtagtgtgttcgccgcccccatcctcgccgaaatggcgcaggctgttcagggtgacgccagcgcctttgtgataccacccaaccgtattcccgaaaattgcactaccctcactcccgacatgctgtctctggtctcgctgtctcaggctgagatcaaggtcatcgtcgaagcaactcccggcggagcgggcaatgtgcaggatatctatccactggcaccgttgcaggaaggtattctgtttcatcacctgttgcagactcaaggggatacttatctgttgcagagcctgcttgcctttaacagccatgagcatctcgatacctttctggccgccctgcaacaggtcatcgaccgccacgatatcctgcgcaccgctgcctgctggcaaggtctggcgcagccggttcaggtggtctggcgtcaggcgccactttgtgtcaatcgcttcacgccagccacggaggatgatatcccggctcagttatcagcccacaccgatccgcgccggcaccgtctcgacctgagccgtgcgccgctgttcgccgctgatatcgcccacgatccggttcaggatgaatggctgctggcgctgcgcttccaccatctggtcagcgaccatatgacgctggaacacattttcgctgaaattgcccaaattcagcaggggcaggctgaatcgctgcccgccgcactgccctatcgcaactttatcgcccagaccctgagtgtgccggtcgcagcgcatgaggcctatttccgcgcccagcttgctgacgtcgatgcaccgacagcgccgttcggcgtactcacgatacggaacgatcgcgaatccatcaccgaagcccgtcttccgctcacttccactctggcagaggccatccgtgccgcagcccgtcgtctgggggtcagtccgggcgtgctgttccatgtggcctgggcgcaggtgctggcacagatcagtggtcgtgacgatgtggtctttggctctgtgctgctgggtcgccttcaaggaggcgcgggcgccgaccgaatactggggatgtttatcaatacgctgccggtgcgaatttctctggccggccgcagtgtgcaggcagtggtacagtccacctatcgcagtctgacaaccttgctggagcacgagcaggcaccattagcgctggcacagcgctgtagtggcatggcgcagtcgataccgctgttcagtactttgctcaattatcgtcacagccagaccagcgagtccgatgcggttgagacgagtcgggcaggtatgcgtattgtcgccacagaggagcgaaccaactatccgctcatcctgtcggtggatgatctgggagccggtttccatctgacggctcaggccgtggccggaatcgatccgacccgcgtcaccgcctatctggttaccgccatcagcggtctggtcgatgccctgattctcgacccgcaacgatggattcaggatgtaccgatcctgccaccttcagagcggcaacaactgttgatggatttcaacgcgactcagacagacttcccgcaggacgccctgatccatcaactgttcgaagttcaggcggcgcgttatcctgatgctatcgccgtggtgtttgaggatcagagactgagctatggtgaactgaaccgccgcgccaatcgtctggctcatcatctgatcgccctcggtgtacgcccggatgatcgggtggcgatttgtctggaacgcagcttagaactggtggtcggcctactcggtattctcaagtcaggtggtgcctacgtgccgctcgatccaacctatccggccgaacggctggcctatatgctcgatgacgcagcaccggtagccttactgacccaaacgacacaggccgatatgctggttcattccgtgcccacagtggtgcttgatggttcggaaccggcaatggcagtacaaccgacccacaatccggacgtgcaggcactgggtctgacatcacgtcatctggcgtatgtcatctacacttccggctccaccggattacccaagggagtgatggtcgagcaccgcaatgtcctgcgcctgattatcaataatggttttgccgatattggccccgatgactgtattgcccattgcgccaatgtttcattcgatgcagccacctgggaggtgtggacgggtttagtgcatggtgcacgtatcctgttgatcccggaaaaaaccttactacaacccgactattttggtcagtgcttagcatcggaaggcgtcagtgcgcttttcctgacaactgcgttgttcaatcaatacgcgagtttgatagcctcatcattgtcgggtttacgttatgtccttttcggcggtgaacagatcgatatccgtcctgcgatccaccttagagccgattatccgccacagcatctgctgcatgtgtatggaccaacagagaccaccaccttcgccaccgcctatgaaattccattcactgaaagcgaatggaagacaattcccatcggccagccgattgccaacacccggatctatattctggatacacaagggcagcctgttcctctcggtgtcgccggcgaaatccatatcgccggcgcaggtgttgcccgcggctacctgaaccgccccgaacttaccgccgagcgcttccttaccgatccgttctcttcagatcttgacgctcgtatgtacaagaccggcgacctcggctactggcgacccgacggcaacatcgaatacctcggccgcaatgatcttcaggttaaactgcgtggcttccgtatcgagctgggtgaaatcgaagcccggctggtgcaatgtcacggggtacgcgaggcggtggtgctggcgcgtgaagacgaaccgggtcacaagcgtctggtcgcctatctgctaccacaggccggcgttgaactggtgccggctgaactgcgtcagcaactcagccggcacatcgcagaatacatgctgcccagtgcctttatgatgctcgacgctttcccgctcactcccaacggcaaaatcgaccgtccggcattccccgtgcctgatcagtccgccatcgtgatgcgcggctatgccaacccgatcggcgaaacggaaaccgctctggcgcagatctggcaagacctgctggggctggagcaggtcgggcgtcacgaccatttctttgaactcggtggccattcgctgcttgccgtccagctggtggcacgcgtgcgccaagatctggcgcgggagttgccgctacagcaactgtttgacctgcccattctgacagatttggctcaggcactcagcggagcggcgacaaccactcaggtcgttattcccgccgccgatcgcaaccggccgctgccgttgtctttcgcccagcagcgactgtggtttctgggtcagctcgatccggccgccagtctggcttaccatatcccggtagcgctgcgcctcaccggccagcttgaccgccacgcgctgactactgcactcgaacgcttaattgcccggcatgaaagcctgcgcaccggctttgtcctaatcgagggtcaaccctgccagcatatcgctcccgccgacatcggctttgccctgctctatcaggatctgcgcccgctggagccggcgatgcacaccccccgtatcgccgaacttgccagccttgaggcacagacactctttgattttgctcagggctcacttatccgcggccaactgctgcaattgacggatgaagcgcatttgttgctgcttaccctgcatcatattatctctgacggctggtccatcggcgtactgatacacgaactgaacgccctctaccgcgccgctctcgacggccacgatgatcccctgccgccgctgtctctccagtacgccgactatgcggtctggcagcgagactggctgcaaggagccgctctcactgaacaacgcgacttctggtactcacagcttcaggacgccccggccttattgacacttcccaccgaccggccacgcccgtcagtacagacctatgccggcggacgggtatctttccagttcgatgctgccttgctggcgtcgctcaaagggttaggacaacgccataacactaccctgtttatgaccgtgctgaccgcctggggcatcgttctcgcccggctcagtggtcaggatgatattgttatcggcactccggtcgctaaccgcccgcaccgcgagcttgagaacctgatcggtttcttcgtcaataccttagccttacgcgtcacattcagtgacactacccgtgtagccgggttgcttgcgcaggttcgtgagtgcgcgctcgacgcttatgctcatcaggatctgccctttgagcaggtggtggaagcgttacaacccgaacgtaacctgagctacagcccggtcttccaagtcatgctggccttaaacaacaccccggctcaaaacctgatattgcccggtctccagcttgcatcaattgaacagacacaccatagcgcacactttgacctgacgttatcgctgactgaaaccgagtcgggtctggcgggtgatctggaatatgccgccgatttattcgactctgcgaccgttgagcgcatggtcggctatctggagaatgtactgacggcaatggcaagcgatgcgacccagaccattgccggtctgccgatgctgtcgaccccagaacggcaacagttgctggtggacttcaataccacccagacggacttcccgcaggacgcactgatccatcaactgttcgaggctcaggcggcgcagcgtcccgacgccaccgccgtggtgtttgaggatcaggtgctcagttatgacgaactgaaccgccgcgccaatcgtctggcgcaccacctgattaccttgggtgtacgtccggacgatcgggtggcaatttgtctggaacgcagtttggaattggtggtgggattactcgctatcctcaaggcaggcggcgcctatgtgccgctcgatccggcctacccgaccgagcgactggcgtatatgctcaatgatgctgcgccggtagccttactcactcaggcggcacaggtcggcacactagccagcaccgtgcctacagtcgtactcgatggccaagatgcgtccctgatggcgcaaccgactcataatccggacacgcaggcactggggctgacgtcacgtcatctggcctatgtgatctacacctccggctccaccggattacccaaaggggtgatggtcgagcaccggaatgtccttcgcctgattatcaataatggttttgctgatattggctccgatgactgtattgcccattgcgccaatattgcgtttgacgcatcaacatgggaaatctggtctgccctgctgaacgggggacgtttgcatgtggtttcaccctcagtgctgttcgatccggtacgattccgcgattcgctgatcaagggacaagttaccgccctctggttgacggtcggtttgttcaacgagtatctcagcgatatccagcccctgttcgggcaactacgctacctgctcatcggcggcgatgtacttgacccgcagaagatccggcgtacacagttgtctgagtttcagccggcacacctgatcaacggctatggtccaacggaaaccaccacatttgcggtaacctacaccattgcttctcccgtcgatgtgacccgttccattcctatcggccgtccgatcgctaacacccggatctatattctcgattcgctggggcaacccgttcccttcggcgtagccggcgagatccatattgccggtgccggcgttgcccgcggctacctgaaccgccctgaactgactgccgaacgctttcttgccgatccgttctcttccgatccggatgcccgcatgtacagaaccggcgacctcggccgctggcgccccgacggcaacatcgactatctcggccgcaatgattttcaggttaaactgcgcggcttccgtatcgaactcggcgaaattgagtcccgactcacgcaatgtcacggggtgcgcgaagcggtggtgttggcacacgaagacgagacaggccacaagcgtctggtcgcctatctgctgccacagaccggtattgaactggttcccgccgaactgcgtcagcaactcgcccaacaccttgccgagtacatgctgcccagtacttttatggtgcttgaggctttcccgctcaccctcaatggcaaacttgaccgtcaggcgctccccgcccctgacgcgtccgccgtggtcacacgcggttatgcagctccgaccggtgaaatagaaactgctctgacgcagatttggcaagacctgttgggattggcgcgggtcggccgtcacgatcatttctttgaactcggcggccattcgctgatgatcgtcagcctgatcgaacgactacgtgaccttggttggcgactcgatgtccgcaatgtgttcgctgcccccgtccttgccgaaatggcacaggctgttcagagcgacgctgacgcctttgtcgtaccgcctaaccgtattcctgagggctgcactgccctcacccccgacatgctgcccctgatctccctgtctcaggccgaaattgagtccatcgtcgggacaattcccggtggagcaagcaacgtgcaggatatctatccgctggcgccgttgcaggagggtatcctgtttcatcacctgctacaggcacaaggcgatacctatctgttgcagagtctgatcgctttcgacacgcgcgaacgcctcgatatcttcctggccgcgttgcaacaggtcatcgaccgccacgatatcctgcgtaccgctgcctgctggcaagatctcacacaaccggttcaggtggtctggcgtcaggcgccgctgtgtatcaatcgtttcaccccggctacggcggacgacattccggctcagttacgtgcccacactgatccacatctgcaccgtcttgatctgagccgcgcgccgctgttcgccgccgatatcgtccacgatccggcacagaatgaatggctgctggctctgcgcttccaccatctggtcagcgaccatatgacgctggaactgatttttgctgagattgcccaaattcagcaggggcacaccgagacgttgcctacggcactgccctaccgcaattttatcgcccagactctgaacgtgccgacgacagcacatgaggcttatttccgtacccagctcgctgacgttgaggcgccgacagcaccgttcggcgtactcgcgatgccgggcgatagccagcccgttgccgaagcccgtctctcgctcgctcccgatctggcggaggccatccgcgtccaggcccggcgtctgggggtcagtccgagcgtactgttccatgtcgcctgggctcaggtgctagcgcagaccagcggccgtgatgacgtggtctttggctccgtgctgctgggccggctacaaggggtcgcgggtgctgaccgaatactggggatgtttatcaataccctgcccatgcgggtttctctggccgaccgcagcgtgcaggaagtggttcaggccacctatctcagtctgacgacgctgctggagcatgagcaggcaccattagcactggcacaacgcagcagtggcgtagcccaaccgatgccgctgttcagtgctctgcttaattatcgtcatagccaaaccaacgaatccgaagcaattgacacgacttgggcgggcatgcgcatcgtcgcaatcgaagagcgaaccaactatccgctcactctgtcggtggatgatctggggctaggtttccatctgaccgcccagaccgtggccggaatcgatccggctcgcgtaactacttatctggccaccgccctcaacggtctggtcgatgccctgattcgcgacccgcaacagccaatcctgcaagtttccatcctgccagcctctgagcggcaacaaattgtggttgattttaacgccactcaggcagatttcccgcaggacgcgctgatccaccagctgttcgaaattcaggcggcgcacagccccgcggctaccgctgtggtatgcgggaaccagacgctcagttatgacgaactgaaccgccgcgccaatcgtctggctcatcacctgatcgctctgggactacggccggacgatcgggtggcaatttgtctggaacgcagcccggaaatagtggtcggactgctcgctatcctcaaggcgggcggtgcctatgtcccactcgacccggcttatccgaccgaacgactggcgtatatgatggatgacgccgcccctgtggccttgctgacccagacggtgtgggttgacaggctgatcagccccgtactcacagtggtgctcgacggccagaaatcggctatagcagcacagccagcccacaatccggagccacagaagctggggctgacgtcacaccatctggcgtatgtgatctacacttccggctctaccggactgcccaaaggggtggcgatcactcaccgcaatacggtgaatttcctcacctggacgcagcggactttcagcccggaggaattggcgcataccctttttgccacctcgcttaattttgatttagcggtgttcgaatgctttgcaccgctgctctccggcggcacagttcatctcgttccggatgtgctgtcactgatcaccaccgaacaaccggtcagcctgatcaatacggtgccgtcagctatcacacacttgatcgaagttaacgcggttcccatcaccgcccggacggtcaatctggccggcgaagcattgaaaccgcaggtcgttgagcatttgtttgcccgctcatccgtacaggacgtatgcaatctgtatggtccctctgagacaacgacttattcaacctggatacggatgaaccggacggagggctttatcagtcatatcggccgcccgatcgctaatacccggatctatattctcaactcccacagtcagcctgttcctcttggtgtggccggtgaaatccatatcgccggtgcgggtgttgcccgcggctaccttaaccggcctgaactgactgccgaacgtttcctcgccgatccgttctccgccgatccggatgcccgcatgtacaagaccggcgacctcggccgctggcgccccgacggcaacatcgactatctcggccgtaatgactttcaggttaaattacgtggcttccgcattgaactgggagaaatagaatctcaattgatgcaatgtcacggcgtgcgcgaagcaatcgttctgacgcgtgaagacgaaccgggtcataagcgtctggtcgcctatctgcggcctctggatggtgttgagctggttccggctgaactacgccaacggctcgcccagcatctcgccgagtatatgctgcccagcgcttttatgacgctcgacgccttcccgctgactcccaacggcaaactcgaccgtcaggcgctccctgcccccgacgcgtccgccgtggtgacgcacggctatgaatccccacagggaagaatagaaaccgctctggcgcagatctggcaagacctgctggagctggtacgcatcggccgtcacgaccacttctttgaactcggcggccactcactgatggtcgtgcaattgataacacgtataaaagccaaattcctggtcgatattcccctcacttcattgttcctttccccaaaattagcggaacaggccaacatcatcttttcagcgcaaatgagtgcggtaggggaaaacgatattgagtcgctacaaaactcgctggatttaatgtcaacagaagaattactggcaatgttaaacggggacaataaccgcggagacaataaccaatga

SEQ ID NO: 2050 - DNA, 18327 bp, Xenorhabdus bovienii
  Coding sequence Name=Xb4151_4152.C431.gene121.dna; Position on contig= 106824..125150bp; Strand=-
atgtcatgcaatcgtatcaacaaagatcagcttgcgtttgaaagttcctctgaatcctcctcttgcaaattttcgctcagctctacccaacaagttgtctggcttgaccaaattctccatcctgacagtcccagctacaatctcgcttcacttgtcgtcattgatggaaagctggatgaaacactgttagtgcgcgcctttgaagccattgtttatcgtcatgacgcattacgtttacgactcatcaatacccagaaactgccgcttcaggaacttatggacacgcttccggtatccgtgacaacccacgacttctcacatcatgccgacgcagaagcccaagccgcacaacacatacgcgctactttcatgcgtccgttcgagttatatggggagctatggcgctgcgaactgctgcaagtcagtgatacacgctggtactggcatttttgttgtcatcatctgatcggcgatgccacgagtttagggttaattcccgaagatcttgccaacacttatcgtcacttaatcagagaagaggcactaccagaaacccctccttcctatctcgattttattgccgaggatcgtgcctatctcgattcacaacgctatgtacacgaccggcaattctggttggaacgctatgtgaacttgcctccggcattgctccaaccgcctaatcccgatagaacggcagatcacggacaaaccgaaccggtgctttggcaattggataaggggcttttccagcgcatcgaagatactgtgaccgagcatgggttgtctgtcttgcacttcatgtatgccgttctggcttgctatttcgcccgtaccacccaggcggaggaaatcgtcatcggcattcctgtgcgcaaccgtaagaacgtcaggcaaaaacgcacgttgggcatgttctcgtcagtcattcccgtcggcataaccattacacctcatgacaccttccttgatgttatgcacaaagcggcaacagagttgcgtcattgctataaacgtcagcgcttaccaatcgcggagattaatcggcatatacaaatccagcagaaaacaggacgcgctcaactattcgacatcatgctgtcatttgagtcgtttcaggcgaacgctgacctgcccggtgccactatcaaatactcaaaaatacaacgtggaacaccgtttcctttttttatcgcgatctaccaatacacattcgctaacaatgaggatatcaatcagcccgttacgattgaattcaattactcaacccactacctaaactgcactgaagtgatggttctccaatcgcgtttagccatgttgatggaagccgctctcacttctcccgagacacagatccgaagcttacctgttttgccgccggcagagcgacagcaactgctggtgaacttcaacgctacccagacggacttgccgcaggatgggtttatccattcactgtttgaggctcaggctacacataatcccgacgccaccgccgtagtgtacgaagaccagacactcagttatgacgaacttaaccaccgcgccaatcgtctggctcatcacctcatcgcactgggagtacgtccggacgatcgggtggcgatttgtgttgaacgcagccttgagatggtggtgggcttactcggtatccttaaggccggcggcgcctatgtgccgctcgatccggcttatccggccgagcggctggcgtatatgctcaatgatgcggcacccgtggtcttactcacccagacggggctgaccagccacgtctctactcccgtacccaaaatcgtactcgatactcaggatgcgtccctgatggcgcaaccggatcataatccggatacacaggctctggggctgacgtcacgccatctggcgtatgtcatctacacctccggctccacggggctgcccaagggagtgggaatgcctctggcagcattgtcgaacttgttgcaatggcaccgtcaagatccttcacatctatccggaaccggtaaaacgctacagtttgccgcgcttggattcgatgtcgcttttcaggagatatttacgacgctgtgcgaaggcggatgtctggtcttgattaatgaagaaacacgtcgggatccgcaacaattcctccgcctgattcagcaaaaacagattgatagaatcttcctcccctacattgcactacaacatcttgccgaagcggccagtcacattgagggagatttttcttgcttagcccacatcattaccgccggtgaacaattacgtatcacgcctgctattcgccgctttctacaacgttccggatcatgccagttgcacaatcactatggcccgactgaaagccacgtggttacggcatatacgctggataagaatatggatcagtggccaacttttcctcccattggtcgcccgattgccaacacccaaatctatctcctcgacccgcagggtcaacccgtccccctcggcgttaccggcgaaatccatatcgccggcgctgatgttgcccgcggctacctgaaccgccctgaactgactgccgaacgtttccttgccgatcccttctctttcgatccggacgcccgtatgtacaagaccggcgatctcggccgctggctttctgacggcaatattgaatacctcggccgcaatgactttcaggtcaaactgcgcggcttccgtatcgaactcggtgagatcgaggcgcaactgatgcaatgccacggtgtgtgcgaagccatcgttctggcgcgcgaagacgagccggggcacaagcgactggtcgcttatctgcggcctcaggccggcgttgaactggttcccgccgagctgcgccagcaacttgcccggcaccttgccgaatatatgctgcccagcgcctttatgacacttgacgttttcccgctcacccccaatggcaaacttgaccgtcaggcgctccctgcgcccgactcgtccgccgtagtcacgcggggctatgctgcaccggtcggtgaaacagaaaccaccttggcgcagatctggcaagacttattgggactggagcgggtcggccgtcacgaccatttcttcgaactcggcggccattcgctgcttgctgttcagctcgccgcacgcgtacgtcaggatctggcgcgggaattgccgctacagcaactttttgccctgcctcttctggccgatttggctcaggcgctcagcgccgcttcggcaatcgctcaagtcatcatccccgccgccgatcgcaaccagccgctagcactgtccttcgctcagcagcgattgtggtttctcagtcaactcgatccggccgctagtctggcctatcatattccggtgacactacgccttaccggccaactcaacctccatgccctgagcacggcgctcgatcacctgatcgcccggcacgaaagcctgcgtacccgcttcgtactcgttgagggtcaaccctgccagcacattgatcccgccgatgtcggttttgccctgtcctgtcaggatctgcgcgcgctgaatccggtaatgcacactcaccgcattaccgagcttgctgatcttgaggcgcagacgccattcgattttactcagggtccgctgatccgcggtcaactattgcaactcgcggacgaaatgcatgtgttgttgctcacccagcatcacatcatctctgacggctggtctatcggggtgctggtgcacgaactgggcactctctaccacgccgtcctcgatggccacagcgatcccctgccgccgctgtccctccagtacgccgactatgcgctctggcagcgtgactggctgcaaggaaccgtccttacggaacagcgtgatttctggtgtgcacagctccagaatgccccggccttgctggcactccctaccgatcgaccacgcccatccatacagcgctacaccggcggccaagttcccttccggctcgacagcgccttattaacgtcgcttaaggcgctcggacaacgccacaacaccaccctgtttatgaccgtactgaccgcctggagcatcgtcctcacccggctgagtggtcaggatgacattgttatcggtacccccgtcgctaaccgccctcaccgcgagttagagggtatgatcggtttcttcgtcaataccctggccctgcgcgtgacaccgggtgatgcgccccgtgtggttgatctgctcgcgcaggttcgtgagcgcgcactcgccgcctatgcccatcaggatctgcccttcgagcaggtggtcgaagcgctacagcccgaacgcagtctcagctacagtccggtctttcaggtgatgctgtccctaaacaacacgccggctcaagaccagacattacccagtttgcaaatctctcaggtcgaacaggagagtcatagcgcgcactttgatctgatgctgttgctgaccgaaaccgaagcgggtctggtcgggggactggaatatgccaccgatctgttcgacaccacgaccgttgagcgtatggtcggctatttgcaacaggtgctggcagcaatggtagccgatgcgacacaaactctcgcatgtctgccaatgctgccagactcggaacggcaacagttgctggtggacttcaacgccacccaagtagacttcccgcaggatgccctgatccaccaactgttcgagactcaggcagcacacagtcccgatgccaccgccgtggtatgcggggagcaaatactcagctatggcgaactaaaccgccgcgccaatcgtctcgcccatcatctgatcgcactgggggtacggccggacgatcgggtagcgatttgtatgacacgcagtccggagatggtggtgggactgctcgcgatcctcaaggcgggcggtgcctatgtgccactcgatccggcctatccggccgaacggctggcctatatgctcgatgacgccgcaccggtagccttgctcacccagacagcgtgggttgatacgctgatcagccccgtccccacggtggtgctagacccccaggcatcgtttctggcggcacaatcgatccacaacccggaggcacaggcgctggggctgacgtcacaccatctggcgtatatgatctacacctccggctctaccggcctgcccaaaggggtagcgatcgcccaccgcaataccgtgaatttcctcacttgggcgcaacggactttcaatccggaggagttggcgcataccctgttcgccacctcacttaattttgacttggcggtgtacgaatgctttacgccactcgtctctggcggcacggttcatctcgttcctgatgcgctgtcactggtcaccaccgaacaacccgtcagcctgatcaataccgtgccgtcagccatcgcgcatttgattgaggctaacgcagttcctgcaaccgcccggacagtcaatctggccggtgaggcgttgaaaccgcacgtcgttgaacatttgtttacccgtacatccatacagaatgtgtgcaatctgtatggcccctctgagacgacgacctattcaacctggatacgaatgaaccggacggagggttttgttagtcatatcggccgcccgatcgccaatacccggatctatattctcgatacctacggtcagcccgttcctcttggcgtggccggcgaaattcatatcgccggtgccggcgtggctcgcggctacctgaaccgtcctgaactcacagccgagcgcttttttactgatccgttctccaccgatccggatgcccgtatgtacaagaccggcgacctcggccgctggcgtcccgacggcaatatcgagtatctcggccgcaatgattttcaggtcaaactgcgcggcttccgtattgaactcggtgagatcgaggcgcaactgatgcagtgtcgcggcgtacgcgaagccgtagtgctggcacgcgaagatgagccgggacagaaacgcctgattgcctatctgcggcctctggacggcgttgaactggttcccgccgaactacgtcagcagcttgctcagcatcttgccgagtacatgttgcccagcgcctttatgacactcgagtcctttccgctcacccccaatggcaaactcgaccgtcaggcactccctgctcccgacctgtctgctgtggtggcgcgcggctatgaagctccgatcggtgagacagaaactgcactggcgcagatctggcaaaacctgttggggctggagcgagtcggccgtcacgaccacttctttgaactcggcggccattccctgatgatcgtcggtctgatcgaacagctatacgaccttggttggcgactcgatgtccgcagtgtgtttgccaccccgattctcagcgggatggcacaggctgttcagggtgacgctgacgcctttgtcgtaccgcctaaccgtatccctgaaggctgtaccgcccttacccccgacatgctgtctctggtttcgctatctcaggccgagattgacgccatcgtcaaggtaactcccggcggtgcaagcaatgtgcaggatatctatccgctggcaccgttgcaggaaggtatcctgttccatcacctgttgcagactcagggcgatacctatttattgcagagcctgatcgcctttaacaaccgagaacatcttgatactttcctgtccgccttgcagcaggtcatcgaccgccacgatatcctgcgcacggctgcctgctggcaagatctggcgcagccggttcaggtggtctggcgtcaggcaccgctgtgtgtcaatcactttatcccggccacggctgacgatattccggctcagttatccgcgcacaccgatccgcgccggcaccgtctcgacctgagccgtgcaccgctgttcaccgccgacatcacccacgatccggcacaggatgaatggctgctggcgctgcgcttccaccatctggtcagcgaccatatgacgctggagctgattttcgcagagattgcccaaattcagcaggggcatgctgagtcgctgcccgccgccctgccctaccgcaactttgtcgcccagactctgagtgtaccggccgcaacccatgaggcctatttccgcacccagcttgccgacgttgacgcaccgactgcgccgttcggcgtactcacgatgccgggcgataacgaatccatcgccgaagcccatcttccgctcgaccccgctctggcagacgctatccatgctcaggctcgtcgtctgggtgtcagtccgggtgtgctgttccatgtggcctgggctcaggtactggcgcagaccagcggccgcgacgacgtggtctttggctccgtactgctgggtcgtttacaagggatcgcaggcgctgcccgaatattaggaatgtttatcaataccctgccggtgcgggtttctctggccggtcgcaacgtacaagaggtggtgcaggccacctaccgcagtctgacgacgctgctggaacacgaacaggcaccgttagcactggcgcaacgctgtagcaatgtgacccaaccgatgccgctgttcagtaccctgcttaattaccgtcacagccagaccagcggaactaacgcggttgagacgggtatgcgcatcgtcgctacagaggaacgaaccaactatccgctcaccctgtcggtcgatgatctgggaaccggtttccgtctgaccgcccagacggtggcgggaatcgatccgacccgcatcaccgcctatctcgccacggccatcaacggtctggttgatgctctggctcgtgatccacagcagttgatccggaatgtgccaatattaccgccgacagagcggcaacaattgctggtggcgttcaacgccactcagtcggatttcccgcaggacgcgctgatccaccaattattcgaatctcaggtggcgcaccatcccgatgcccccgccgtggtatttgaaggccaatcgctgagttatcacgaactgaaccatcgcgccaatcgtctggctcatcatttgatcgcgctgggtgtactcccggatgatcgggtggcaatttgtgtcgaacgcagtccggagctgttgatcggcttactcggtatcctcaaggcgggtggcgcctatgtgccgctcgatccaacctatccggccgaacggctggcctatatgcttgatgacgcagcacccgtggccttactcactcaggcggcatgggtcgatacactggacagccccgtccccaccgtggtactcgacgcccaagaatcggctatggcagcacaaccgacccacaacccggacgcgcaggcactggggctgacgtcacgccatctggcgtatgtgatctacacctccggctccaccgggctgcccaaaggcgttatggttgagcaccgcagtatcaatcggttggtcatcaacaatccttatgcagacatcagttcagacgactgtgttgcccattgtgccaatattgcttttgatgcatcaacatgggaaatctggtctgccctgctgaacggcgggcgtctgcatgtggtttcatcatcagcgctgctcgatccggtacgtttccgcgattcactggtcaaaggacaagtcaccgccctctggttaacagccggcttgtttaacgaatacctcggtgatcttgaacccctgttcggacaattgcgttacctgctcgtcggcggcgatgtactggatccacggaagatccggcgtacacagttggctgagtgtcagccggcacacctgatcaacggctatggcccaacggaaaccacgacgtttgccgcaacctatcgcataagctcacccgtcgatgtgaatcgtcccatccctatcggctgtccaatcgccaatacccaaatctacctcctcgatccgtatggtcagcccgttccccttggtgtcgccggtgaaattcatattgccggtgccggcgttgcccgcggctacctgaaccgccctgaactgactgccgagcgcttcctgaccgatcccttctcgtcagacccggacgcccgtatgtacaagaccggcgaccttgggcgctggctgcccgacggcaacctcgaataccttggccgcaatgattttcaggttaaactgcgcggcttccgtattgagctgggtgaaatcgaagcccggctggtgcaatgccacggcgtgcgtgaagccgtggtggtggctcgtgaagacgagccgggtcacaagcggctggtcgcctatctgctacctcagaccggcgttgaactggtgccggccgaactacgtcaacaacttgcccgacaccttgccgaatacatgcagcccagcgcctttatgacgctcgacactttcccgctgactcccaacggcaaactcgaccggcaggcgcttcctgcccccgacctgtccgctatagtgacacgcggctatgaagccccgatcggtgaaatagaaatcgcactggctcagatctggcaagacctgctgaaactggaacaagtcggccgtcatgatcacttctttgaactcggcggtcactcactgcttgccgtccagctcgccgcccgtgtacgccaacaattggcacggaagttgtcattacagcaactttttacccagcctctcctgacggatctggctaaaacgctcaccgacgcttcggcaatcgctcaagtcgttattcctgtcgccgatcgcagccagccgctagcgctgtctttcgcccagcagcggttgtggttcctcggtcagctcgatcccgccgccagcctggcctaccatattccgatggcactgcgcctcaccggctcgctcaaccacaacgctctgaccaccgcgctcaatcatctggttatccggcacgaaagcctgcgtacccgcttcgtattgatcgaaggccaaccctgccagcacatcgatcccgccgatatcggctttactctgtcttgccaagatctgcgcccgttggatctgacggcgcgggcgaatcgtgtcgccgagcttaccgccctcgaaacccagatccccttcgactttgtgcgggggtcgctcattcgtgggcaactgctgcaactgacggacgcggagcatgtgttgttgcttacccaacatcacatcaccgctgacggctggtccatcggtgtcctgatgcacgaactgggcgtcctctaccgcgccgccctcgacggccacgacgatcccctgccgccgctatctatccagtacgccgattatgccgtctggcagcgtgactggctgcaaggcgctgttctcactgaacagcgtgatttctggtacagccaactccagaacgccccgtccctgctgacactccccaccgaccggccacgcccgtcagtgcagcgctacgccggtaaccggatccccctccagcttaatgccgacttactggcatcgctcaaagagctcggacagcgccatcacactaccctgtttatgaccctgctgaccgcctggagtatcgttctctcccggttgagtggtcaggatgacattgtcatcggcacccccgtcgctaaccgccctcaccgcgagttagaggatatgatcggtttctttgtcaatactctggccctgcgtgttacgccgggtgatgcgtcccgggtggctgatctgctcgcacaggttcgtgaacgggcgcttgccgcctatgcccatcaggatctgcccttcgagcaggtggtggaagcgttgcagcccgaccgcagcctgagctacagtccggtcttccaagtgatgctggccttgaacaatactccgtcccaaaatctggcattatcgggtctgcaactcgctccggttgaacaggtgcgtcatagtgctcatttcgatctgacattatcgctgaccgaaactgaggccggtctggttggtgatctggaatattctaccgacctgttcgactctacgaccattgaacgcatagtcggttacttggaaaatgttctggcggcgatggctgccgatgcgacacaaactgttgcaggtctgtcgatgctgccggactcggagcggcaactgttgctgaccgatttcaatgctacccaagccgatttcccgcaggacgccctgatccaccaattattcgaagcccaagcggcacatgcccctgatgccactgccgtggtgtttgaggatcagacactcagctatagcgaactgaaccaccgtgccaatcggctggctcatcatctgatcacgctgggcgtgcggccggatgatcgggtggcgatttgtgtcgaacgcagcccggagctggtggttggcctgctcgctatcctcaaggccggtggcgcctatgtgccgctcgatccaacctatccggccgaacggctggcctatatgcttgatgatgccgcaccggtggctctgctgactcagaaggcacaggccgacacgctgatcagccccgtgcctataatcatgctcgacgcactcgcgtcatctctggcagtgcaaccgactcataatccggatactcagatactggggctaacgtcacgccatctggcgtatgtcatctacacctcaggctccaccgggcagcccaaaggcgtcatggtcgagcatcgcggcctgagcaacctgatcgctacgcaacaggacactctggcgatcaattccggcagccgtatcctgcaatttgcctcaaacagcttcgatgccggtatctgggaatgcggtatggcacttctggcgggtgccagcctccatcttgcccagcgaactcatcttctgcccggtgctgcactactggagacgctggagactcatgccattacccatgtactgctgtcgccgaccgcgttggcggcactggattcagtccctgtgacattgcagaccctgatcgtgggcggtgaggcctgctccccttcgctggtcaaacgctgggctaccagccggcgtatggtcaatgcctatggaccgacggaaagtacggtctgtgcggctatttatctgtgcgataaccaagaagaaggcgctccgcctatcggccggccgatcgccaacacccggatctatattctcgatacctacggtcaacccgtcccgcttggtgtggccggcgaaattcatatcgccggtgccggcactgcccggggctacctgaaccgacccgaactgacggccgaacgttttccggccgatcctttttcttccgatccgaatgcgcgcatgtacaaaaccggcgacctcggtcgttggcgccccgacggcaatctcgaatatcttggccgcaatgattttcaggtcaaactgcgcggcttccgcattgagctgggcgagatcgaggcacaactgatgcaatgtgagggtgtacgtgaggcagtagtgctggcacgcgaagacgagccgaaccatccgcgtctggtcgcttatgtgcagcctcagtccggtgctgaactgattcccgccgaactgcgtcagcaacttgcccgacaccttgccgaatacatgctgcccagtgcctttatgacgctcgacgctttcccgctcacccccaacggtaaacttgaccgtcaggcgctccccgctcccgatgcgtcctccgtggtcacacgcggctatgaagctccggtcggtgaggcggaaactatccttgcacaaatctggcaagacttactggggctggaacaggtcggccgtcacgaccatttctttgaactcggcggccattcgctgatgatcgtcagtctgatcgagcggctacgcggcttcggccggcgacttgaagtccgcagtgtgttcgccacccctgtccttgccgagatgacacaggctattcaggatgatgccgacgcctttgtggtaccacccaaccgtattcccgaaaattgcgccgccctcacccccgatatgctgtctctggtctcgctgtctcaggctgagattgaagctatcgtcgaagcaattcccggcggagcgggcaatgtgcaggatatctacccgctggcgccgttgcaggaaggcatcctgtaccatcacctgttgcagactcagggcgatacctatctgttgcagagcctgctcgcctttgacagccgcgtgcatctcgatacctttctggccgccctgcaacaagtcatcgaccgccacgatattctgcgcaccgctgcctgctggcagggattgacgaagccggttcaggtggtctggcgtcaggcgccgctgtgtgtcaatcacttgctcccggctacggcagacgacgtcccggctcagttatccgcgcacaccgatccgcgccggcaccgtctcgacctgagccgagcgccattattcgctgccgatatcgcccacgatccggcacaggatgaatggctgctggcgctgcgcttccaccatctggtcagcgaccatatgacgctggagctgattttcgctgaaattgcccaaatccagcaggggcaggccgaaacgctgcccgccgccctgccctaccgcaattttatcgcccagaccctgagcgtgccggccgcaacccatgaggcctatttccgcacccagcttgccgacgttgacgcaccgactgcaccgtttggtgtactcacgatgccggacgataatgaatccatcgccgaagcccgtcttccgctcccccccgctctggcagaggccatccgcgctcaggcgcgccgtctacgggtcagtccgggcgtactgttccatgtggcctgggctcaggtgctggcacagaccagcggccatgacaatgtggtttttggctctgtgctgctgggccgtctacagggggtcgcgggcgctgaccaaatattgggaatgtttatcaataccctgccggtgcgggtttctctggccggccgtagtgtgcaggaagtggtacaaaccacctatcgcaatctgacaaccttgctggagcacgagcaggcaccgctggcgctggcacagcgttgcagtggcgtagcgcaatcactgccactgttcagtaccttacttaattaccgtcacagccaaagccgcggggcagacgcagttgatatactccggacaggtatgcgtattgtcgctacaggagagcgaactaactacccgctcaccctgtcagtggatgatctgggaaccggtttccatctgaccgctcaggccgtaaccggaatcgtgccgtctcgcataaccgcttatctggttaccgccatcagcggtctggtcgatgccctgacccgagatccgcaacaattgatccgggatgtatccatcttaccgccgacagagcgacaacaactgctggtagagttcaacgccacccagacggatttcccacaggatgcactaatccaccaattattcgaggctcaggcggcgcacaatcctgacgccatcgccgtggtatttgaaggtcaatcgctgagttatcacgaactgaaccgccgcgctaaccgtctggctcattatctgattgcactgggggtgcgtccggatgatcgggtagcgatttgtgtcgaacgcagtctggatctggtcgtgggtctgttcggtattctcaaggcgggtggtgcttacgtgccgctcgatccggcttatccggccgagcgactggcgtatatgcttgacgacgcggcacccgtggccttgctgactcaaacagcattgaccgacacactggttagcgccatacccacaatcttactcgacggctcagaaccgctcctgatgacgcaaccgactcacaacccggacgctcagtcactgggtctgacgtcacgccatctggcgtatgtcatctacacctccggctccaccggattacccaagggggtgatggtcgagcatcgcggcctgagcaacctgatcactacgcaacaggatactctggcgatcaattccggcagccgtatcctgcaatttgcctcaaacagcttcgacgccggcatctgggaatgcggcatggcacttctggcaggagccagcctccatcttacccagcgaactcacctcctgcccggagctgccctgttgaatactctggagactcatgccattacccatgtgctgctgtcgccaacagcattggcggcactggattccgtacccgtaacactgcaaaccctgatcgtggggggggaggcctgctcaccttcactggtcaaacgctgggctaccggccggcgtatggtcaatgcctacggcccgacggaaagtacggtctgtgcagccatttatctgtgtgatagccgggaagaaggagccccgccgatcggccgtccgatcgccaacacccaaatctatctccttgatgatgacggccagcccgttcccctcggtgtcgccggcgaaatccatatcgccggtgccggcattgcccgtggctatctgaaccgccctgaactgaccgccgaacgctttcttgccgatcccttctctcccgatccggatgcccgtatgtacaagaccggcgacctcggccgctggcttcctgacggtaacatcgaataccttggccgcaatgattttcaggtcaaactgcgcggtttccgtattgaactgggtgaaatcgaagcccggctggtgcaatgccacggcgtgcgcgaagcggtagtgctggcgcgtgaagatgagctgagccacccacgcctgatcgcttacctgttacctcaaaccggcgttgaactggtgccggcggaactgcgtcaacagcttgctcagcacctcgccgagtatatgctgcccagcgcctttatggtgctcgacgctttcccgctcacccccaacggcaaacttaaccgtcaggcgctccctgcccctgacacgtccgccgtggtggcacgcggctatgaagccccgatcggtaaaatagaaatcgcgctggttcagatctggcaagacttactgggtctggagcgggtcggtcgtcacgaccatttctttgagctcggcggccattcgctgcttgccgtccaactggtggcacgcgtgcgtcaggatctggcgcgggagttactgctacagcaactgtttgacctgcctcttctggcggatttggctcaggcactcagcggaactttaacaaccgctcaggtcgtcattcccgcggccgatcgcaatcggccgctaccgttatctttcgcccagcagcggctctggttccttggtcagctcgatccggccgccagtctggcctaccatattccggtagccctgcgcctcaccggccaacttgaccgccacgcgctgaccacggcactcgatcgtctggtcgcccgacatgaaagcctgcgtacccgctttgtcctgatcgagggtcaaccctgccagcatatcgatcccgctgacatcggctttaccctgtcctatcaggatctgcgccgactggaacctgcggcacacaccaaccgtatagccgatctcattgcccgcgaagcgcaggcatcctttgactttattcagggaccattgattcgcggtcaactgctgcaattgacaggcgaagcgcatgtgttgctgcttactcagcatcatatcatctctgacggttggtccatcggggtgctggtgcatgaactgggcaccctctaccgcgccgttctcgacggccacgatgatcccctgccgccgctgtctctccagtacgccgactatgcggtctggcagcgcgactggctgcaagcaacggccctcactgagcagcgtaatttctggtgtacacaactccagaatatcccggccttgctggtactccccaccgaccggccacgtccaccggtgcagacctataccggcggccgggtatccttccagctcgataccaccttgctggcatcactcaaggggctaggacaacgtcatcacaccaccctgtttatgaccgtgctggctgcctggagtatcgttctctcccggttgagtggtcaggatgacattgtcatcggcacccccgtcgctaaccgtcctcaccgcgagttagaggatatgatcggtttctttgtcaatactctggccttgcgtgttacgctgggtgatacgccccgtgtggccgatctgcttgcacaagttcgtgaacgggcgcttgccgcctatgcccatcaggatttgccctttgagcaggtggtggaagcgctacaacccgaacgcagcctgagctacagcccggtctttcaggtgatgctggccttaaacaacatgccggctgaaaatctcgtgttgcccgatctgcaactctcttgggttgaacaggcacaccatagcgcccacttcgatctgacgttgtcgctgactgaaactgaggcgggtctggcgggtgatctggtctatgccgccgagctgttcgaccccgcgaccgttgagcgcatggtcggctatctggagaatgtgctggcggcgatggcggctgatgcaacgcaagctattacgagcctgccgatactgccggcatctgagcgacaacagttgctggtggacttcaacgccacccagacggacttcccgcaggacgctttgattcaccaattatttgaggttcgggcggcacacaatcccggcgcaacggccgtgatatgtggagagaaaacgctcagctatgacgaactgaaccgccgcgccaatcgtctggctcatcatctgcttgaccacggtgtgcgcccggacgatcgggtggcaatttgtctggaacgcagcccggatatggtggtgggactgctcgctatcctcaaggcaggcggcgcttatgtgccgctcgatccggcttatccggccgagcggctggcgtatatgctggatgacgccgcaccggtggtcttacttactcaggcggcacaggtcgccacactgggcagccccgtgcctacggtcgtactcgacgctcaggatgcgtccctaatggcgcaaccggatcataatccggacacacaggcactggggctgacgtcacgccaccttgcctatgtgatctatacctcaggctccaccggactgcccaaaggggtagcgatcactcaccgcaataccgtgaatttcctcacttgggcgcaacgggctttcagtccggaggagttggcacataccctttttgccacctcacttaattttgatttagcggtgtacgaatgctttacgccgctgctctctggcggcacagttcaccttacccccaatgtactgtcactgcttacggcagaacagtcggtcagcctgatcaacacggtgccgtcggccatcgcatacttgactgagtctgacgcgatccccatgaccacccggacggttaatctggccggcgaggccttgaaaccgcacatcattgagcacttgtttgcccgtaaatccatacagaatgtctgcaatctgtatggtccctctgagacgacgacctattcacctgtgtacggatga

SEQ ID NO: 2051 - DNA, 162 bp, Xenorhabdus bovienii
  Coding sequence Name=Xb4151_4152.C431.gene122.dna; Position on contig= 125218..125379bp; Strand=+
ttgaaaaatgagttatttcataagcagatactttatttttttaatcccacttataaaagagttagaattcatttatttttgataagtatcattaaaattactggtggtttggtcgtgatggattggatactgaggtatcattgctgtcagtatgtgtggtaa

SEQ ID NO: 2052 - DNA, 219 bp, Xenorhabdus bovienii
  Coding sequence Name=Xb4151_4152.C431.gene123.dna; Position on contig= 125532..125750bp; Strand=+
atggctaatttttataataagatcattatttattatttattatttattatttattatttattatttattatttattatttattatttattatttgttatttgttatttgttatttgttatttgttatttgttatttgttatttgttatttgttatttgttatttgttatttgttatttgttatttgttatttgttatttgttatttgcccttggtttaa

SEQ ID NO: 2053 - DNA, 105 bp, Xenorhabdus bovienii
  Coding sequence Name=Xb4151_4152.C431.gene124.dna; Position on contig= 125701..125805bp; Strand=+
ttgttatttgttatttgttatttgttatttgttatttgcccttggtttaatattttattcaacattttcaaagggaatttctttgtgttcatctacagttattaa

SEQ ID NO: 2054 - DNA, 816 bp, Xenorhabdus bovienii
  Coding sequence Name=Xb4151_4152.C431.gene125.dna; Position on contig= 126020..126835bp; Strand=+
atgtctgatattattgtaacccaaagtaataaagaaaaaatgtggtgggaagaagatgctggtttctttggggaactatataaagaagcggatgattcaacgcggactttttttggaggagaaaataatttagtacaaagaacaaataaagaggttgacggagttattaatttatgtggtcttaaatcagggcagtatcttatcgattgtccctgtggatatggaaggcacagtgttgctcttagagaaaagggtataaatgttatcggaatagatgtcaatgacgagcacttatctattgcacgtaggcatgccgaagtacataattcagatgtgattttcagaaaagatgatatgcgtacattcaaattggaaagacaagtggatgtgctaataaatatgttttattcttttggttttttttccgatgaagaaaatgttaatgccgcaaggaatttttatgatgcattgaaagagggcggtaaattccttatgcacacaatgataacagttcctgcattcggagatggtagaattccgttggaagaaaaaagaaaattgcaatcagggaggactttagtttcaaaacgaagattcaatcatataacaaaaagagaagaggggatatggtctttattaaacgaaaataatgaagaaatttctttgaggccatatgatgtgaggatttatactgatattgaattcaaagcgctttgtcttgaagctggattttctaaagtcgaattatatggggattgggatggttctccatacaatgacaattcgacttatttaattgtggttgctgaaaaataa

SEQ ID NO: 2055 - DNA, 162 bp, Xenorhabdus bovienii
  Coding sequence Name=Xb4151_4152.C431.gene126.dna; Position on contig= 126914..127075bp; Strand=-
ttgcgttcaggcaagaataaagtaactcaaacaaaagaaaaaagttacccccatagaacctgcattagaaaatattttttgaatttcattttcatatttctactgaatatttttcagataaaatatgataaaaaacatcatcaatgcagtaaaaaaccttaa

SEQ ID NO: 2056 - DNA, 99 bp, Xenorhabdus bovienii
  Coding sequence Name=Xb4151_4152.C431.gene127.dna; Position on contig= 127062..127160bp; Strand=+
ttgcctgaacgcaagttagttgttgtgatatcctcccgaggaagatcacctgactggaaagacgtttactcagcgtactcgagtaaaaagactgaatag

SEQ ID NO: 2057 - DNA, 255 bp, Xenorhabdus bovienii
  Coding sequence Name=Xb4151_4152.C431.gene128.dna; Position on contig= 127169..127423bp; Strand=-
atgttcaatctggcacaccaaacgccatacggttgtgccgggcgtgttgccactgtattgacgttgcacaccgacagaatgtgtgccttttttgataaagccggtttcatccacaatgagcatcctctgttcatcgcccaaatgctctgtcacatagccccgcaaaatatcgcgggcgacgtcgacattccagtgaacgcgctccagcagatgttgaatcccatcccattagttcttcggattttgaataactga

SEQ ID NO: 2058 - DNA, 255 bp, Xenorhabdus bovienii
  Coding sequence Name=Xb4151_4152.C431.gene129.dna; Position on contig= 127500..127754bp; Strand=-
atgatgagcaaaatagggatttatccgaaattttcataccctacttcaccatcatctaagtactacagccgtacattccattgtggcatgatagtctctgacattttgcgacagaaccacctaattgtgcatcgacgacaacctataccattgtcgaaaaagctcacctcacctcccagaattgcccttaagcggcggggaaatcgtagtttgactacatcatatgcagcaacagaaaaacgcgatttaaattaa

SEQ ID NO: 2059 - DNA, 225 bp, Xenorhabdus bovienii
  Coding sequence Name=Xb4151_4152.C431.gene130.dna; Position on contig= 127894..128118bp; Strand=-
atgaaaggctgctcatcagcacgcggttcagtggatggttcagcctgtgccccaaatgaaaccaagcaggccagaccgatagaatgcgtttttcgttttcccattttcgttatttcaccctgcgacccaaaaaatcaaacccgccccaacgccaatgcgcataaaatgggctgctcatgtttaatgcagtatatttttcaagcaaaaaatagtgccatgtcctga

SEQ ID NO: 2060 - DNA, 1539 bp, Xenorhabdus bovienii
  Coding sequence Name=Xb4151_4152.C431.gene131.dna; Position on contig= 128183..129721bp; Strand=+
ttgtcgtcaccattatcttcaccgttctctttggcgtttcctaaagaaaccccctgtttcctgatacagaaggtgaccgtctccggccgtgaagggcttccccattgggtgcctgtacagcgcttggccgatcttgccaaagatcactgcttgggcgtacggggcattaatcaagtaatgtcaaacctgcaaaaccgactgattgcccacggttgggtaaccacgcgagtcttagcacctgaacaggatttaagtcaaggcgaactgaaattgcgggttttaccgggaacggtgcggcatatccgttataccgatgattctgataaatacgcaacgctctatactgccatgccagcccgtgaaggaaagttactggatttgcgtgatattgaacaggggatggagaacctgcaacgtttacccaacgtccaggccagcatggaaatagtgccgggggaacagccgggagaaagtgacatcgtgattaagcgccagcagccccgtttctggcatatgggtgcctgggtcgataacagcggaactaaggccaccggacggacgcagggcgggctgatgttggcgctggataatccgacgtcactcagtgacttgttttatctctccatgacgcgtgatttggctttctccaatcgcaaaaactcgaccaattacagtgcacattattcagtgcccttgggctattcgcagtttgcgataacaggcagtagttacacctacgcacaaaccgtgccccagctcaatgaagaggcaaaatatcgcggccgtagccagagcctgaatgcgcagctaagccgggtattgcatcgcaatgcccgttccaaaacaaccctgacctatggaattaatctccgtcagacgcgtaatttcaccaaggatacggaaattgaaggccaaaagcgtcgcaccagtagctggaatttagggctcggccatcgccattatatcggtgcggcggtgctggataccggtattcgttaccagaaagggacccgctggtttggggcgctaccggcttatgaagagcggaatgaccgtgacagcgctgactatgcgacggcgcaatcggaaattatccagctttctgcttcgctcaacacgccctttacgctgggcgaccaacaatttcagcaccgtgtggagtatcagcgccagtggagtaataccccactgacgccacaagatcagttcagtatcggcaaccgctggagtgtgcgcggctttgatggcgaacggacgctgagtgcagataaaggctggacgttgcgtaataccttgtcatggcagacgccgttgcctgatcagcagttgtatctgggggcggattatggccgggtcgggggacggggggcggatatcatcatcggccgtacgttggcggggggcgttctcggcttcaggggtaatattcgtcccgctaatctttcatacgatgtttcggtgggtacgccgttctccaaaccggatggctttaaaactgacaacgctcacataggttttagcctgaactggcagtactga

SEQ ID NO: 2061 - DNA, 540 bp, Xenorhabdus bovienii
  Coding sequence Name=Xb4151_4152.C431.gene132.dna; Position on contig= 129734..130273bp; Strand=+
atgttgataggtcaatacgacgtgcgtgcccccctgattttaggcagtgaagagaatgaaaccgagatgctgggtgcagctacttggttgtggatgcattcccccctgcaccggaatgcaccgctgattgcgttatctacgcttttgctgccgatgattaaggcgggtcagtatgtcctggtgagtcatcacggccagccgattttctacctgagctgggcgctgtttaccgaagaaaccgaattacgttatctcacgaaacgacatgagcacaacagagatccgcagctacacggcggtgatcggctctggatactggactggattgccccgtttggccatagccgggaaatgagcagtctggtcaggcaagaactatttttacatcactgttatcgtgccctgtatcacaaagggactcagcggggcgcgcaggttatccgttttagagggaaaggcgtcagccgcgagcaggccgcgcactggtggaacacccatcccctcacacagtccttacccgaaagaggtttttcgcgatga

SEQ ID NO: 2062 - DNA, 1929 bp, Xenorhabdus bovienii
  Coding sequence Name=Xb4151_4152.C431.gene133.dna; Position on contig= 130270..132198bp; Strand=+
atgaacaaacattgttaccgagtgattttcaataaaacccgccagatgctgatggtggtttccgacctggcccgcagtcacacgccggggcaggcgcgtcgtggaatgcattcatgttcatcgcagactgccaacgtttcattgataccgctggtctgggggatctcactggcattgggactggtcagccaaacggcgcaggcaggcattgtggcggataataacgcccccggtacgcaacagccgaccgtgatttctgcggccaatggtgttcctcaagtcaatattcagacaccgaacagtgatggtgtttcccgcaaccagtacagtcagtttgatgtggagcagcggggcgcgatccttaataacagtggcgtgaatacccggactgatctgggtggtctgattacggctaacccctggctggctcagggggaagccaacattattttaaatgaagtcaacagccgtgatcccagccaactgaacggctttattgaagtggcgggaaaacgggcggatgtgattattgccaacccggcgggaattacctgtaacgggtgtggttttatcaatgccagtcaaacgacactggccgccggtcagacaatattggaaaacggccgtctgaaaggatttgaagtgggtgacggtaccctgaccgttgacggtaagggcctgaatgataccacgagtgattatacccgcctgattgcccgtgccgtcaatatcaatgccaaattgcacgcgcaggatttgactgtaacaaccggccgtaaccgcgtcgatgcacaaggtaacgtggaaaaagttcacgccaaggatactgaaaaacgggaattcagccttgatgtggcggcggttggcggaatgtatgccaataaaattaagctggtcggcaccgagcagggagtgggtgtccgtaatgccgggcagctgggtgcacaggccggtaacctgacgctcgatacacagggcaatctgactaatagcggtatgatgacgacttccgcagaggtggctatccagaatcaggggacgctaactaatcagggggatattaaagcgggtcagagtataaaaattcaaacccgtgatgcccttgaaaatcaagggcggatgctggcaggacggcacctcgatatccaaagtgcctcattagagaacaaggaaaagggcgtattagccgcaggcgttgacaaagacggtaaactgactcaacagggtaacttgacgatccacagtcgtggcgcactggctaatcaagggatgatggcggcttcggataatatgattatccagaataagagcggtttggccaatcagggacaaatactggcagggagcaataaacatggcaatctgacgctccacagtgagggtaaactcgacaacagcggtacgataaatgcttcagtggatgtctttcttcagaatcagggggagttagataacgttggggagattacttcaggtcgtgacgtcacgataaaggcacgtgatcatctcactaatcaagggaaaatatcagcaggacggaatcttgacatcacaagtgcctcgttaaacaaccagaaaaatggggtgctggcagcaggcattggccgtcatgataaattgactccgccgggcaatgtggtgctccgtagtgatggtcacctgattaatcggggggttatcaccgcgacaggcaatatcacactcccgactcatgataatttagttcagggcaatttagtcaaccagggagatattacggcggggcaggatatttcaatagaaaaccgtaatcatctcgacaatcagggacagatgctggccggacgtcaacttgatatccacagtgcctcattggaaaaccaacaaaagggaatactggcaaggcaatcgcatctaaatttgatgcgctttgcccagtactgtaagtag

SEQ ID NO: 2063 - DNA, 1122 bp, Xenorhabdus bovienii
  Coding sequence Name=Xb4151_4152.C431.gene134.dna; Position on contig= 132163..133284bp; Strand=-
atgtcctctgtcagccctttgttaccgcattttgcctcacttgaagatccccgagttcaacgaactcagttgcatagtttggaaaatatcctgactatcgccatctgcgctgtgatttgtggcgctgaaggttgggtcgaaattgaagagtttggcgaatctaaacaggatttctttacccaactgcttgatctcactaatggcatcccctctcacgatacctttggtcgtgtctttgctgcacttgatgcgcaggcttttgccgactgtttcacctcctggatatctacgctggcacaaggagttgatcaggatatcatcgctattgatggcaaaaccatgcgccggtcactcgataaagccaacggcaaggcggcaatccatctggtcagcgcctttgcctgtaccaatcgcttagttctgggacaagtgaaagtggagagtaaatccaatgaaatcaccgctattcctgagttacttcgacgattggttttgtctggaagtctggtgactatcgatgccatgggatgccagaaagcgattgctcatcaattacatgaagcgggcgcggattacgtactgagcctgaaagaaaatcatcccggcctgtataatgatgtcagccattatttcgattatgtctcatcccaaccggagcgcctgagcgaatatgaagacgtggatgccggacatggccgcattgagcgacgcacagtacaaatgacccatgttgattggttgccggaaaaggcgtgctggtgtggtttacacagcataatacgggtgatccgcgaacgctatgtaggaaatgaagtgagccgggagagctgttattttatcagcaccttacgtccgacagaggctcaacgggcagcgacagcgatccgcagtcactggcaaatagaaacgcaactccattggtgtctggatattgcttttaatgaagatcagcagcggatgcgggaaggcaatgcagccgccaatatggcattactcaataaaatcgcgttgaatttactgcgcttagctcccaccaaagcgggaattaaagcacgccgtaaacgggctggttgggatggtgaatatctacttacagtactgggcaaagcgcatcaaatttag

SEQ ID NO: 2064 - DNA, 7992 bp, Xenorhabdus bovienii
  Coding sequence Name=Xb4151_4152.C431.gene135.dna; Position on contig= 133452..141443bp; Strand=+
gtgatcaccgcttcggatgatgtaatcctccaaaatcagggggatttaaccaaccaaggggatatcaccgtaggtcaggacgtcacgatcaaaacccgtgatcactttgacaaccaaggccggatattggccgggcgtcatcttgacagccaaagtgcctcgttgcacagcgggacagacagtgtcctgtccgcaggcgttgataaatacggcaaactgacccaaaacggcaatctgacactgaaagcccgtgaagcagcacaactgtatggtcagaatctggcccatgacaatttatctgtcgacgcaaaaaatatcgcccttcagggcagccaaacggccgccggtaacctgcaactgacgtccggtacgcaattaaacttacaggacgcgaaagtccgtgcccgccaaaatctgacgttatctgcacccgaactgattgataaccaacgcggtgaattggaggcggaaacgctgtccctcaccagccgaaagctgaagaataatcagggtaagatcacccaaaccggacagttatcgttggtacttgatcatcacgccggcattgacaacaccgaaggggtgattgcgtccagcgggcaggatttgatgctcagggccagtactctcacgagtgaaaaaggcgtattgacccatgccggaacgggggtgatgtccattgatacgcaacagtttcagggtaagaaaagtcgcctgatctctgacggtgaacttaagctgacgggagggaattatcatttggttaagagccggacatccgcacagcagatcacggcgcatatccagtcacttgaccatcgcttgggtgacatgacccagcacggaaaacgttcactgacgctcgatgtccagcaagagctggataacggcagtggcaccattgctgccaacggcacggtggaaatcacggctgacagactgaataacaatacgctgacggaaaaccagcttaataacgataaagatcaacagaacaaaggggttttggataaagccgaactgaataaccagccgggtaaaatcattgccgctgaagacggtcatcttcaggtgaccgtgaaaaatccgctgaacaatcaggccgggcaattactggcctcgaaaagtctggtcgtttcggcctcagcgatagataaccggcaggggaagataacgtcttctggcggggatattaccctgacaaccgggcaactggacaatctctcgggcaaaatcgccggacagcaccatctgcaactgaacacacaaagtatcaacaacgaaaaaggtcacatgagtgcggatacggtggatatcaacacgcatcaacaagggctgaataataccgcagggctgattgtggctgagcgcaatatgatcctgcgtaccggcgaattactgaaccggcaggggtcggtacgcagcggacaggatctgaccctcaatacccacggcaatcagctggataaccgggacagtggcctgcaagggggcttgttcagtcagggcgcgatgcacctgaatactggctatctgaataaccagtccggtcatattgaaagccgcgaaagcctctctgtcaccgggaaaaatgttgccaaccaacaaggccagatactgggcggaaagggaacgcgcctcaccgtggccgatctgaacaacgatcagggtttgctgcaaagtggcggcaagctgacactcaaaacgacagccttgagtaaccgccagaatcgcgacaagcaaggtataaccagtaagcaggcactggaactggagacgggcaccctgaataacgaaaacggggtgattatctcggcggacagtctgcatattcaggttaatgccgccggcgtgaataaccaacaggggttactggcggcacacaccatgctcacgctggtcggtctgggactcagtaaccaatccggccgtattcaatcccatcaggctttatgggttgatacgcaagggcagacactcaataacaccggtggcgtgattgacagtcaggatgcgctggacgttcgcagcggcgatctgctcaaccagaacggcacactgcatggcaagtccgccgtgacattaacggccaaacatctggataaccggcatcagggcaagatcctgagtgaaaacggactggttattgaggcggatgacctctcgaatgaacagggccggatgctggcgctgggtgattttcaggcgaaggtcaaaaatcatattgataacaaggcgggattgatacgcagtgggggtgatctccgtttaaacgcgcagcacctcagcaaccaggcgacccgacaacaggataaaggcattgacggcagaaatatcgtggttacggcggagacactgcacaacaggcaggggcaactgaccgccactgaaaatgcggatttgacgctgtcttcaagactcgacaacacgcaggggctgttacaggccaaccagaaattgacagcacagggtcaaacactggcggtcacgaataccgggggggatatcaaaaccgggcaagcgctggggatggaagcggactcactgacgggggacggtaagctgcgttcgctgggcgatatgacgctgaccctgcttaaggactttacccataccggtgaaacgattgccaatggccgtctggtgctggatagccggggtgacatcatcaataacagcctgatcagtgcaggcactctggaaggccgtgcagccaatctgaccaacgaggtgaccgggaagattctggctaatcatcatcaatggaccattaaggacaacctcaacaacaccgggttgttagatggtgcacaaacctacctgaaagccgcccatttgaccaatcagggaaccggccgcatttacggtgatcatatcgcgattgaggcggtcagtctggataatctggctgaaaataataaatctgctgtgattgctgcccgtaatcgtcttgatatcggcacagatgaactcaataacaaaacccacagcctgatctacagtgacggtgatttatctattggtgggcagctcgacagccagcgacacgccagcggccaagggaaaaccctcaacaaccacagtgccagtattgaagccacgggcgatatgaggctggcgatggcgaacatcaataacctcaacgaccattttgagactgaactccggccaatctcgcaggaatccgttgaggaatatcaggtttgggggcaacgttataatgtcaaaaatcacaagatcactatcgacaatgatgaggttgatcacgcctgtattgataatatagggtgtgaggatgaatttcagatttataaatacacgagaacgacagaggaatcccgtgtaaaaacgactgatccggcaaaaattctggcagggaaaaacctaaccgttgataccacggtgctgacgaacgataaaagtcaggtggtagcgggaggattactgacggtgacgggcgggcaaatcaataatacggatgtacagggtgaacggcagactaccgataaggggcatatcgagtatttctggcgtatcaataaaaaaggcagtgatgatcagggttgggattcagacaaatatgaaccccctacggaaattcaggcgattaccctgaaacccagtaccgtacaggcacagcagaaccgtgtcgtgctgaagggtcagcgccctggtgcctatcagggcgctgacatacaaattacgccggtgaacaacggtcaaattgatgccggttttgccagtagtgaagccagcatccccgaaattgcccagaggccggggcagcgcctagaggtcgtgagccagcagcctgcggcaatcggtgaaaaaccgtcggtgatccgcacggaagtgccgaattaccgtttgccggacaacagtctgtttaaattgaacctgcctgcggaaataaagccacacccagcaaacagtcagttaaaaccgtatccggtacagggtaatgatctactcaagtcgcccccggataatcaccctccggcccccgacaatagcgtgttgattgaaaccgacccgcagtttacccagcttaaaaaatggctgggtacggattatatgcagcagtcgatgctgagtgatcataataacatgcataaacgtttgggtggcggtttctatgaacaacgcctgatacgtgagcagattatcaacctgacgggcaaacgctatctgccgggacaccagaatgatgaagagcagtttaagtcactgatgaatgcaggcctgcgtgcccggaaagcctttgatttggctccggggatcgcactcagtgcggaacagatgtcgacgctcactgaagacatggtgtggttggtcaatattccggtcacgttaccggatggccgtcaacaaaccgtactggtcccccaggtctatgtgcgcactcaggccggatcgctggatggcagtggtgcgttgttaagtggcagccaggttaatctgcaattgacgggggatttactcaatcaaggccgggttgtcggacaggatattcatgtgctggctgacaatatccgtaatcagggcagccatttgcaaggggatacattgtccttacaggcgcgaaccgatatggtccagcgcggcggcacggtcagggcgaaagatttcctggctattcaggcgggcaacaacattgatatcgccagtaccacgcgttctggcgaaaatcaggcaggcaatggccgtttcagctccacctatgtagataacgtggcgggtatttatgtgcaaggtgctgatggcaaactacaccttcaggcaggtaacgacatcagcctgtcagcggcgcaactcgctacgcaggggaaaaacagcgacatccggttggcggcggggcggaatattcagctcggttcggtcaaaacagcccgttatgaacatacggcaatcggcgatgaccaccgtattacccgcagccagtcggggggcgtgggttcgggggtcaatagtgccggacaaattcaggtagccgcagggcgtgatgtcaacgcgaaagcggctgaggtgacggcgggcagtgcactgcaagtcagtgccgggcgtgatgtcaatattctggccgatgagcaacagcagagccatgatgaatatcaccgggtggagggcagcaacagtctggtatcatcaaaaaccacgataactcagtatcagtttgaccataagcaggcactgagcagtaccctgagtggcgataccgtcaatgttcaggccggaaaagacatcaccgtagcgggcagcaacgtcgtggggacgcacgatatcacgatgagtgccggtgacaacctgaccgccaccacggccagggaaacccatcacgagactcaccgtaaagaagaaaaacaatcggggctgatgggcacgggggggataggttttaccgtgggggcggcggagtttaaacagtccaatgacagcgatgaggtgcggtataaaggcagcacggtgggcagcagtgggggaaacgtcaccctgacggccaaaaatcaggctatcttgcacggcagtgatgtgatggccggaaaagatatcgacattgaggcaaaagacgttgccattacggcggcgaaaaacagccatacctacctgagtaaaactgaacagaaacagtcgggctttacgctggggctgtccggcgcggtgggcagtgcgattgacacggcggtgaagaccgcgaatgaagccaaagaaacgaccggcgacagccggttgcaggcgctgaaaggcacgcaggcggtgctgtccggggcgcagggttatcaggcgtaccagctcagcgaggcgaattccgccaaagctgacgccatcaatcaggccgggggcgatgcgaaaaaaccgaatgacaccatcggtattcagctttcctatggcagtcagtccgcgaaatccgaaacccgccatgacgccagcgaatcgcagggcagcagcctgaacgccggacgggatattcgtatcacagcgaccggagataatgtgacggacagccgcggggatatccggattgagggcagtggcctgaaagccgggcgcgatgttgaactggacgcgaaacgggatgttgtgctgacgtcagcggaaaatacccagacgacgcggggtgaaaacagcagcaagggcggcagcgtgggtgtggggctgacggtgggtcagggcggctacgggattaaattctcggccagtgtcaatgcgggcaaaggccatgaaaaaggcgatggtgtcacccacagcgaaaccctgattgatgccggtaatcaggtgaacatcaaatcggggcaggacaccctgcttaaaggcgcgcaggtcagtggcgaaagcgtcacggcaaacatcggccgcaatctgcatctgcaaagtgagcaggacaaggatagctacgacagtaaacaggaaaacatcagcgcgggggccagcttcacctatggttccatgagtggttcagccagcgtcaatgccggccgtgacaaaatgcacagtcagtttgactcggtcaacgagcagacgggcatttttgccggtaaaggcgggtttgatgtcaaggtgggcgaacatacccaactggatggcgcggtgattgccagtaccgccgacaaagacaagaaccgtctggaaacaggcacactcggcttcagtgatattgagaacaaggcagaataccagactgaacaccagagtgtgggcatcagtaccggcggatcaatggggagccagatgggcaccaatatggcctccaatatgctggccggcacccacaagagtgacagtcaatcgtcaacgactcatgcggctgtgggtgacggtacgattattgtgcgtgatgcggataagcaaaaacaggctgtttcagacctgagccgtgataccgataacgccgccaatggtttgaatccgattttcgataaggaaaaagagcagcaacggctggcgcaggcgattgccaatatcggcacccaggtgttggatatctacaatacgcaggaggctatcactgcgacgaagaaagccaccgaaaaactgaaagaccggcaagagcagcaggcgctgaaacagcaggccgaagctcagttgaaagcggaagctgaacgtaaaaatgatagccgtccggttaccgaagcggacattgccgaccgggcgtataaaatcgcctatgacacggcgctgactaaacagggggcggcgattggcggcagccaacgtcaggcggttaccgcagtagtcacagcgcttcaggggctcgctggcggtgacatcaaagcggctattgccagcggtgccgcgccttatctggccaatgcagtgaaagtgctgacctacggcaataaaaagtatgggcaactgacagcagaagaaaaagcgaccaatctggtggcccatgcgattttgggtggcgtgattgctgagatgaaagggggctctgctatggcggcttcggcgatagccagtgcgctttacccagccaaaaatctgagtgaattgtcaccggatgagaaggaaaaagtcagtaacctgtctacactggcaggagggatagcggcagggctggcgacggattcaatggcaggtggtgttgccggtgcgcagaccgcgaagaacgcggtggagaataacttcttgggggatatctcacgcgacgcactggagaaaaaccgggaagcgctgggtgagaataaatacactgagaaacagttgcgtgaattgctggcacttgaggcccgtgaccaagttaacgatgacctgctgaaccagtaccggaaaaatcccgcgtccctgacgccagagcagcaacagctattccagcgggaattgcagcagtatgcctatgaaacaacccaactgtacggcgctgaaatggcggtgcagttggttacgttgttgttgaaagaaggggactcgccgcttattccgaacaaaggcttcccgtatgcgggtggctcggaggcgaagaatgcctgggcggatcgggaaaggcagcagtag

SEQ ID NO: 2065 - DNA, 861 bp, Xenorhabdus bovienii
  Coding sequence Name=Xb4151_4152.C431.gene136.dna; Position on contig= 141284..142144bp; Strand=-
atgtctttcaagtttgtgtctggatggaagacggttctgttgcttcgaaccgaaaaatttcttgataccctacggactttcccacctgaaaccctcatcgctatggaagcctgtgccacttctcatttttggggacggacgttgcagtctatgggctatcatgtccgaattgttcccacccagcatgtaaaagctttcagccatcatcaaaaaaacgatgccaataatgcgttggctatcggtgaaacggcctgccggcccggtctccattttgttcccatcaaaaccgtagaacagcaagatatcaaagcactgcgccgtgcccgtcagctcatggtggaacagcgtactgctattgctaatcaaatcagggcctttctcgctgagcagggaatcattgtgcctgtggggattcaaaaactccaacagcacctccctgatattctggaagaaggtgataatgctctgtcttgtgtgctgcgtcgtttattgcatacgctgtgggaagatctgcagaatttgaacgtcagcattcatgaaatggataacgaaattacggcactttcccgccagcaagcagggtatgggcacttgctgactattcccggtgttggtcccctgattgcggcggctttcgtgagtgacgtcaacgcatcccaatttactaatggccggcaggttgtcagcctagtatggtgtgactactgctgcctttcccgatccgcccaggcattcttcgcctccgagccacccgcatacgggaagcctttgttcggaataagcggcgagtccccttctttcaacaacaacgtaaccaactgcaccgccatttcagcgccgtacagttgggttgtttcatag

SEQ ID NO: 2066 - DNA, 108 bp, Xenorhabdus bovienii
  Coding sequence Name=Xb4151_4152.C431.gene137.dna; Position on contig= 142134..142241bp; Strand=+
ttgaaagacatttttagcgaggtcaatacccaccactttgatcgtactcataagatgttctcccgaaattcagtgcatcggataaaagatggcactattttccactga

SEQ ID NO: 2067 - DNA, 480 bp, Xenorhabdus bovienii
  Coding sequence Name=Xb4151_4152.C431.gene138.dna; Position on contig= 142228..142707bp; Strand=-
atggataaattagttgaacttttttgcgatgtcgacgatttttgtcgtattttcattcctcagtgggaacaacagtgtatcgagaacggacacagacaacgccgccgtcatgggcgcatgagtgtcagtgagatcatgaccattctgattttttttcatatgtcaaatcaccgtagttttaaaacattttatttgggactcatttggcaataccaccgcaacgattttccggttttactcagttacacccgttttatcgggatggctgcctctgttttagttcctctttgtagctatttgacccatctaaaaggaaaacccacaggactcgcttttatcgattctactcatctccgtgtttgccataatattcgtattccatgccataaagtttttgacggggtagcgaaacgggggaaaagtacgatgggtttacgatgggttgatgtgatggacgccccctttttcagtggaaaatag

SEQ ID NO: 2068 - DNA, 108 bp, Xenorhabdus bovienii
  Coding sequence Name=Xb4151_4152.C431.gene139.dna; Position on contig= 142781..142888bp; Strand=-
ttgcctttatttgtttcgttttgtccctgttcgtttttggttgtagctgactcgttcacttgccattgtgtacaaattgagtacataattcacctgaattctggataa

SEQ ID NO: 2069 - DNA, 99 bp, Xenorhabdus bovienii
  Coding sequence Name=Xb4151_4152.C431.gene140.dna; Position on contig= 142843..142941bp; Strand=-
ttgtttcgaactgtttgtatcttatctctttctgcctgttttaatcaagttttttgcctttatttgtttcgttttgtccctgttcgtttttggttgtag

SEQ ID NO: 2070 - DNA, 138 bp, Xenorhabdus bovienii
  Coding sequence Name=Xb4151_4152.C431.gene141.dna; Position on contig= 143118..143255bp; Strand=-
gtggcaataacggcaatagacatcaactttggccatacttcatccttaaaaagccggaagcatatcacagcaactaaccatttaatacatgaccctacccccgataatacccccgcaatggggtttattccagtttag

SEQ ID NO: 2071 - DNA, 171 bp, Xenorhabdus bovienii
  Coding sequence Name=Xb4151_4152.C431.gene142.dna; Position on contig= 143233..143403bp; Strand=+
atgtctattgccgttattgccacaaatcagaacaggtcaaaggacatgggaaaggaaatggcggacatcctcgttatcgctgttatagctgctgtaaggtctttcagttggcgtatacctatcaggcctgcaaacccggcgttaaagaacagattgtcgatatcgcgatga

SEQ ID NO: 2072 - DNA, 279 bp, Xenorhabdus bovienii; identical to SEQ ID NO: 890
  Coding sequence Name=Xb4151_4152.C431.gene143.dna; Position on contig= 143354..143632bp; Strand=-

SEQ ID NO: 2073 - DNA, 159 bp, Xenorhabdus bovienii
  Coding sequence Name=Xb4151_4152.C431.gene144.dna; Position on contig= 143756..143914bp; Strand=+
ttgactggaaaggcgtttactcagcgtatagagagaacgaatttaacgcatcgtacccgaatcaaaaggctgaatagaaaaaccattgggtattcaaaatcggaagaaatgcacgataaagtgataggaacctttattgaacgtgaacattatttttaa

SEQ ID NO: 2074 - DNA, 114 bp, Xenorhabdus bovienii
  Coding sequence Name=Xb4151_4152.C431.gene145.dna; Position on contig= 143931..144044bp; Strand=-
gtggcaataacggcaatagacatcaactttggccatacttcatccttaaaaagccggaagcatatcacagcaactaaccatttaatacatgaccaaagtagggtcatgtattaa

SEQ ID NO: 2075 - DNA, 375 bp, Xenorhabdus bovienii
  Coding sequence Name=Xb4151_4152.C431.gene146.dna; Position on contig= 144048..144422bp; Strand=-
atgagccactattcgcttcaggcggggttcccaagcataccaaagccagcgttggtttttcttattgccgacaaacgaccattgctcgtcgatttcacagacaatctggatgccacattccgcaaggggaagtgtcgttacgtttcggagtctgaggtttttaatgttttcatgacggtggcggtggcgactttcaggatccgagcggtgtcacgaattcccccgtttattcatcgcgatatcgacaatctgttctttaacgccgggtttgcaggcctgataggtatacgccaactgaaagaccttacagcagctataacagcgataacgaggatgtccgccatttcctttcccatgtcctttgacctgttctga

SEQ ID NO: 2076 - DNA, 159 bp, Xenorhabdus bovienii; identical to SEQ ID NO: 2073
  Coding sequence Name=Xb4151_4152.C431.gene147.dna; Position on contig= 144546..144704bp; Strand=+

SEQ ID NO: 2077 - DNA, 222 bp, Xenorhabdus bovienii
  Coding sequence Name=Xb4151_4152.C431.gene148.dna; Position on contig= 144713..144934bp; Strand=-
atgtctaaaattaataagctggataatattggtaaaaaatgctcatttaatcctgaccaatataagaagaagattgaggtggatgatgtagcacctgtaggttcttttccgtgggcagtgattcaagtgtatttgaataaaccagtgagacgtagcgactggaattctaatatataccttatacctaaatacgataattcaggtcatgtattaaatgattag

SEQ ID NO: 2078 - DNA, 678 bp, Xenorhabdus bovienii
  Coding sequence Name=Xb4151_4152.C431.gene149.dna; Position on contig= 145270..145947bp; Strand=-
atgacaaaatggtattcgcatgacttgcaatacgtacgctcgcagattatccccgcattgtttgatattgccggtgaaaccaaggggcaattggcggcatttgaagactctccactgacatgtacagatcactataagcgcaataaagcccgtattagggtaggaaatcactgggtcgtacaggataccgatccggttttttgtcttgaaacccgcatgagaaaacagcccaaaccgcctattaacccgataacatacagggggagttcgtggcggcgggcagtactggccatggataaacccaaactggcatgggtgctgtactgttatgcacattccctggattatcgctatcaggttgaaatatgcgaatatctctggggaggctttctggcagggcaaacaaaccgtcggttatcaatcaaagtcagcacgagattaaaaggattggtatggttggccgttcagcaacgtgccaaggggtgtcgttcagagaatttcttatcttataccagatcagaattggccagcttgactggggtgagtttatacaattggaaaaataattatgcggcacattggatagccttggtggagttatgcgaaaacatggatagagaagcactccaagatatcatcagattaagaattaaacaaaaatcagaccatgatctataa

SEQ ID NO: 2079 - DNA, 363 bp, Xenorhabdus bovienii
  Coding sequence Name=Xb4151_4152.C431.gene150.dna; Position on contig= 145947..146309bp; Strand=-
atgtcaaacactatcttaaagtcggttttcccaggttggtcagaggttgacgctgaaccgcccgccagctttatgcgtttgccaaaattacaacggtggcgcaatacccaatggctgcaatgggtgaaatcccagccctgtgcggcctgtcagcgtcctgccgatgatccccaccacattatcggtcatgggcagggcgggatgggtactaaggcgcatgatttgttttgtctgccactttgccgggaatgtcatgacgacctgcatcgggacaggctggcatgggaagaaaaacacggtagccaggtggatttattatttcgttttctggacagatcgctgggaataggggcaatcaaataa

SEQ ID NO: 2080 - DNA, 114 bp, Xenorhabdus bovienii
  Coding sequence Name=Xb4151_4152.C431.gene151.dna; Position on contig= 146260..146373bp; Strand=-
atgacgctcctcattttattccacatgagccattatcgtgattttaaaacgttttatattcagcatgtcaaacactatcttaaagtcggttttcccaggttggtcagaggttga

SEQ ID NO: 2081 - DNA, 120 bp, Xenorhabdus bovienii
  Coding sequence Name=Xb4151_4152.C431.gene152.dna; Position on contig= 146400..146519bp; Strand=-
atgacggggatacagggcatcaattcgttgcatagtacccgttcgtcactcttccatctgttcaagcgggatcggttgatcggaataactgtttatccaaccgccaaaatcactatctaa

SEQ ID NO: 2082 - DNA, 186 bp, Xenorhabdus bovienii
  Coding sequence Name=Xb4151_4152.C431.gene153.dna; Position on contig= 146587..146772bp; Strand=-
atgggtttttcattgttaccgataacattttcagaatggggacagttatatagccaaacgaccgaaatagtcattccttttatcgataatcaagcacctcccatgactcttatttgtatgccagtactcactttcgaaaatccaaactgtatctcatctcgctttatcccctgtcatttgaattga

SEQ ID NO: 2083 - DNA, 162 bp, Xenorhabdus bovienii
  Coding sequence Name=Xb4151_4152.C431.gene154.dna; Position on contig= 146699..146860bp; Strand=+
atgactatttcggtcgtttggctatataactgtccccattctgaaaatgttatcggtaacaatgaaaaacccattcaggggatgaataatatcgcaaagacgatgactttattgatattattccactgcataattttctctttaagtaaagataaagtatga

SEQ ID NO: 2084 - DNA, 147 bp, Xenorhabdus bovienii
  Coding sequence Name=Xb4151_4152.C431.gene155.dna; Position on contig= 146913..147059bp; Strand=-
ttggtggtgtcatttatttgttttcacttcaggtggtgtcatttagtcaccatcgcttttttggttaatctaattaggcattttattttattcataatttgcaaacaatcaagaaaacccatacaaaattatttaacaaaaaattaa

SEQ ID NO: 2085 - DNA, 423 bp, Xenorhabdus bovienii
  Coding sequence Name=Xb4151_4152.C431.gene156.dna; Position on contig= 147103..147525bp; Strand=-
ttggcggcaaataggtcctcattacaacgccagtcaggatattgtttaatgaaaaatgatctggatcttttgtcagcttaccagcggatccttagtttaagtgagcaaatgcttgatttagctaaaaatgaacagtgggatgaacttgttgatatggaaatcacttatctgaaggcggttgaagtggttaccctattatcagaaaattcagacgccccactttcattacagcaaaaattaacccaaattttacaaactgtcttggataatgaaaaagaaacgaagcgattgttgcaaaaacgattaagtgaacttagcgacctgattaaacaagaaagctgcaagcaactattacatgatacttatgggcagttccctgtcagtgactatgaaatggagttaacgactacagagccaaaataa

SEQ ID NO: 2086 - DNA, 411 bp, Xenorhabdus bovienii
  Coding sequence Name=Xb4151_4152.C431.gene157.dna; Position on contig= 147477..147887bp; Strand=-
atgtatcaacgttcggcaagccagttatacgctcaggtagatcttgagagcgaaattatgaatgcctctccctatcagttgattcagatattgttcaatggggcgcttagcgccctacgtcgtgcaattattctgatgcaacagggcaatatcccagagaaaggtttagctatttccaaggcaatcaatatcattgataatggtctcaaagagggattagatttcgaaaaaggcggagagattgctcagaatctgtttgctttatatgattatatgaatcgtcgtttactccatgctaattttcgcaatgatgagaaggccattaccgaagtgattgatttacttaccgagatttcagattcttggcggcaaataggtcctcattacaacgccagtcaggatattgtttaa

SEQ ID NO: 2087 - DNA, 1467 bp, Xenorhabdus bovienii
  Coding sequence Name=Xb4151_4152.C431.gene158.dna; Position on contig= 147900..149366bp; Strand=-
atggctagcatttcttcattaggagccggatccgggatggatttaggttctatactggataaacttcaggcagcagaaagaaaacgtttagaaccattagcacagcagcaaaccagctataaagccaaattaaccggttttggcacattaaaaggcagtttagagaaacttaaaagcgcatccgaagaactgaaaaaattcgataagctcaataccaccaaagtcagcgaagaccataaaacatttaccccaactacggattccaaggctagtccgggtaactatattattgaaatcaatcagcttgctaaggcacagtccctccaatcccctgcggtttccgatgtgaaattcccgcaaggagagaaactgggcgaagggaaaacccgcaccattgtcatcacccagccgggtgaagaaaagccgctgcgtatttccctgaaagatgatgaaacgtctctgattgaaatccgtgatgcgatcaataaacaggaaggcaacgttaatgccagcatcatcaaagcaaccgacaataaagacaataaagacaataaaggcgagaataaaaactacctgatcctgacgtcgaaaaaagcaggaatacagtccgtcatgacaatcaaagttgaaggtgatgacaaactgagtaagtggctgaattacacgtctggtagcgaaagtgtccctaaaagtggctccggtgcaatgacgcaaacagtggaagccgcagatgcaaaattaaaggtcaatggcattgagattgaacgtcagaccaatgagataaaagatgcgccggaaggcattactctgaatctgaaaaagctcacagaaaaagatgagtctggaaaaccaaaaccagaaacactggtggtttcccgtgatattgagccaacgaaagaagcgattaaaaagtgggttgaagcctataatggggtacagacgactttcgaatcactgaccaaattcaagcctgtagccaaaggtgaatccgcttccaaagacaatggcgccctgctcggtgacggcaccttaaaaagtattcaaagccaattgaggcaccagattttctcaccacaggatgttgctgatattgctaccctgaataaattgggtatcaaacaaaaattagacggcactctcgaaatcagcaacgaaaaactggaaaaaaacctgaaagagaaacctgccaacgttaaggctttcttcatgggtgatggtgaaaaaaccggtttcgcaacccaaacttataatatattaaagcaaacgctggatagtcacgaagggactatcgccacagcgaccgaaggcatcaacaagcgtctgaaaacacttgaaagacaagtggaacagaccaataaaaatattgatgcaacaatagaacgctataaacgtcaatttacagaactggataaacttgttaattcattgaagagcacaagttcatccctattccagcttttaagataa

SEQ ID NO: 2088 - DNA, 102 bp, Xenorhabdus bovienii
  Coding sequence Name=Xb4151_4152.C431.gene159.dna; Position on contig= 149438..149539bp; Strand=+
atgatttttttgatggacggaataattgacgagaacaggcgctgtttgggttatcggcaagaaaagtgcgaaaaaagaaaaaagtttttcaataaaaattaa

SEQ ID NO: 2089 - DNA, 1038 bp, Xenorhabdus bovienii
  Coding sequence Name=Xb4151_4152.C431.gene160.dna; Position on contig= 149578..150615bp; Strand=+
atgaacaccgtgagcgaaaaagctcaaactaattatatcgacttgattttaaaaaggaactctactatggcatcagttattaataccaactattcatctctgctggctcagaacaacttaagcaaatcccaaggtgttttaggtactgctattgagcgtctgtcctctggtttacgtattaacagcgcgaaggatgacgctgctggtcaagcgatcgctaaccgttttactgcgaacgttaaaggtctgactcaggctgcccgtaacgctaacgacggtatctctattgcccaaacgaccgaaggttctctgaacgaaatcaacaacaatctgcaacgtattcgtgaactggctgttcaggcccaaaacggcactaactctgaaagtgaccggaaatccattcaggaagaagtcactaagcgtctggatgaaatcaatcgtatttctgaacaaactcagtttaatggagtaaaagtattaagcaaagatactactctgaacattcaggttggtgctaacgatggtgaaaaaatcgctatcgacctgaagaaaattgataaggaaacattaaaactgggtgattttagcgttgaattacaaagaactagtgaggaaaaaacgaaaattacagaggctgaaggtaaagtaaaaaaggctgaagaggacgcgaaaaaagcaacaggtgctgcaaaaactgcggcagaagcaacgcttaaaacagagcaagcagctcttgaaaaagcaaaagaagcaggggcattaccagcagatacattggctaaattagatggcgctttgtctacagttgacagcctgcgcagctccctaggtgcagttcaaaaccgtctggaatccactgttaacaacctgaacaacacggttaacaacctgagtgcagcgaagagtcgtatcgaagacgctgactacgcaactgaagtttccaacatgagccgtggccagatcctgcaacaggcgggtacttctgttctggctcaggctaatcaggttccacaatctgttctgtctctgctgcgttaa

SEQ ID NO: 2090 - DNA, 252 bp, Xenorhabdus bovienii
  Coding sequence Name=Xb4151_4152.C431.gene161.dna; Position on contig= 150703..150954bp; Strand=-
atgcttcatggcgaactagtggtacatagcgcttccagaggctatttttgtccatcacgccttcggcggtatacaaatcgctcacaacaacagacacctttggataagagactggctaccattatccaatcacctaatcggtacaatcgtttgaacaatgaagtaaaagcgcttctttttcacctatgcgaaatttttttgtcgtccgcccaaatgcatcgtaagtttcagtctgtccctgacaaaggttaa

SEQ ID NO: 2091 - DNA, 693 bp, Xenorhabdus bovienii
  Coding sequence Name=Xb4151_4152.C431.gene162.dna; Position on contig= 150900..151592bp; Strand=+
atggacaaaaatagcctctggaagcgctatgtaccactagttcgccatgaagcattgaggctacaggtgaggctgcctgccagcgtggagcttgatgatctgcttcaggctggtggtataggcttactgaatgcggtggagcgttttgattccttgcagggaaccgcgtttaccacctatgcggtacagcgcatcagaggtgcaatgttggatgagttgaggagccgtgattgggctccgcgtagtgtgcggcgtaatgcacgtgaagtcacgcagaccatccgtaaacttgagcaagagttaggccgtccagctagtgagcaggaagttgctaaagaattaaagattaatctgatagaatatcggcaaatactgttagacacaaataacagtcaactgttttcttatgacgagtggcacgaaattcatggcgaaagctgtgagccggtaattgaggacgagcatgagacaaatcctctccaacaattgctggaaggtgatcttcgtcagcgggttatcgatgtcattgagtcgctgcctgaacgggaaaaaatggttctgacgctgtactatcaggaagaactgaatcttaaagagattggcgcagtacttaatgtgggagaatcccgcgtgagtcagcttcacagccaggcaataaaacggctgagggcgcgtttgaatccagaaaagtaa

SEQ ID NO: 2092 - DNA, 513 bp, Xenorhabdus bovienii
  Coding sequence Name=Xb4151_4152.C431.gene163.dna; Position on contig= 151649..152161bp; Strand=+
atgtctgttacaacacaaaagaaacggcctctcagccgttatatcaaggactataaacatagtcagactcattgtttgcactgtcataaaacccttgaccgtatttctctcgtttttaacggtcaggtaatcaacaaggaagctatctctgagatgactgaattagttgatgacaaaacatgggatgagttacagggtaaatttgtggcgctgtgccgcttctgtagcgaaatttattgcaatagccaaactgattatttcgacattatgtcatttaaacagtatctgtttgagcaaacagagatgagccatagcactgtgcgcgaatatgtggttcgtttgcggcgattggatgaattactaacatcaagcaattacccagcacaagagtttacgccggaaaaaattcaggaaaaactcagtgagaaattgtctcagtctgcttttagtaattacaatatcgcgctgcgtaaatatgagcaatatctgagctggcaacagaacgggtattga

SEQ ID NO: 2093 - DNA, 1089 bp, Xenorhabdus bovienii
  Coding sequence Name=Xb4151_4152.C431.gene164.dna; Position on contig= 152284..153372bp; Strand=-
atgccgaagcgaagggctggcattgagcgccatatccagaccatgcgcaccaaaggcaggccggtttatcaagcagtacataaaaatgaagccgatagtcaggaatcttcacaaggcacgtttgtcaaacccacgctgattgagctggaaaattttgatgaattaaagaaagaagttttcggccccgtactgcatgtagtgcgttttaaccgtaatgagctggataaactgctggaacaaatcaacgcttctggttacggattaacgctaggtgttcatacgcgcattgatgaaaccatcgcacaagtcacggccaacgctaaagtcggtaacttgtatgtcaaccgcaatatggtcggggctgtcgtcggtgtacagccatttggtggcgaaggtctgtcaggcaccgggccaaaagcgggtgggccgctttatctgtatcgtctgttatcacagcgtcccgtcaatgctgccagccagacactggaacgtcaggatgaggaatatcagcttgatgccagagcgcgtgtcgccctgcgctcccctttcaacaaattggctgaatgggtaacagcacaacataacgatgctttgagcaaattaattcagaaatacagcctgttagctcagggcggaaccattcgattactaccgggacctacaggggaacgcaatacttatacgctcttgccacgcggtgaagttttgtgtctggccgataatgagcaagatacgttggtacaattgtctgccgtgttgtctgtcggctgtcaggccatctgggagaaagacgatttgcatcagcaattactgcgtcaattgccggatgaggttcgccactcaattcgtctgatcaacgattggcaaaatgaagagacggaaatggaagccgttatttatcacggtgattgcgaccagctacgtcatgtctgcggtatcatcgctcaacgcaaagggccgattgtttcagtacagggttttgcccgtggtgaaacaaacctgctactggaacgtctattacatgaacgctcattaagtattaatactgccgccgcagggggtaatgccagtctaatgacaattgggtaa

SEQ ID NO: 2094 - DNA, 2919 bp, Xenorhabdus bovienii
  Coding sequence Name=Xb4151_4152.C431.gene165.dna; Position on contig= 153347..156265bp; Strand=-
atgggtagtaccactatgggcgtgaagctcgatgaagcaacgcgtaatcgtataaaatctgctgcacaacgaattgaacgcacaccacactggctgattaagcaagccatttttaattatcttgaacgcctggaaaatgaggaaaagatcccagaaatatcagtgtttcaggataacaaagaagaaaagatttccgaagaagaatcacagattgaggcgacttctcaaccatttttggattttgccgagcatattttgccccaatcggtgaaacgttctgcaattacttcagcgtatcgtctgcccgaaacgcaggcagttcccatgttgctgcaacgtgctcaattatcaggagaacaagccaaagcgacccacaaactcgcttactccatcgctgaaaaactacgccagcaaaaacatggcactggccgcgccggtttagttcaagggttactgcaagagttctccctttcttcacaggaaggcgttgcgctgatgtgtcttgccgaagccctgctgcgtattcccgacaaagcgacccgtgatgcgctgatccgtgacaaaatcagcaacggtaattggcattctcatcttggccaaagcccatctatgttcgtcaatgccgcaacttggggtctgttgttcacgggcaagctggtatctacccataatgaagccaaattatccaagtccttgaaccgcattatcagcaagagcggtgaaccattggtgcgcaaaggtgttgatatggcgatgcgcctgatgggagaacaatttgtcacaggtgaaaccatcgcccaagccctcgccaacgctcgcaagctggaagaaaaaggcttccgctattcatatgacatgctgggtgaagctgcgctgacagaagaagatgcacaggcatacatggtttcttatcaacaggcaatccacgccattggtaaggcatcgaacggccgcggcatttatgaaggaccgggcatctccattaagctgtcagccctgcatccacgttatagccgtgctcaatatgaacgcgtcatagatgagctttatccacgcctgctttctctgactttacaggcttgtcaatatgacatcggtatcaatatcgatgcagaagaagcagatcgtctggaaatctctctcgatttgctggaaaaattgtgttttgaaccaaaactggaaggctggaacggtatcggttttgttattcaggcttaccaaaagcgctgtccttttgtgattgacagcattatcgacctggcgcaacgcagccgccatcgcttgatgatccgtctggtgaaaggagcttattgggatagtgaaatcaaacgtgcccaaattgatggtctggaaggctacccggtgtatacccgcaaagtgtataccgacgtttcttacatcgcctgcgcccgtaaactgctttccgtccccaatctgatctatccacagtttgcgacccacaacgcgcatactctatctgcggtttaccatctggctggacagaattattatccgggacaatatgagttccagtgtctgcacggcatgggtgaaccgctgtatgagcaggttgtcggcaagattgccgatggcaggctcaaccgcccatgtcgcatttatgcgcctgtcgggacacatgaaacactattggcttatctggttcgccgcctgttggaaaatggcgccaatacttcgttcgttaatcgcattgcagatacctccctgccccttgatgaacttgttgctgatccggtgaaagtagttcaggaactcgcacaatctgaaggacaaattggtctgccacatccgaaaattccactaccacatgatttatacggcaagaaccgcgtcaattcctcggggctggatctgtcgaatgagcaccgtttggcttcactctccagcgcattactgagctcttcgatggaaacatggaacagcgagccgctgctgggtggtgattatgcacataccggcgaattgccgacagctaaatccgtcaataatcctgcgcggccttccgatatcgtgggctatgtccgtgaagcgactgagcaagaagtcagccacgctctggacgttgccatcgatgcaggtactatttggtttgcaactcccccctcagaacgcgccgcgattttggtgcgtgcagcggaattgatggaaaataacctgcaatccctgctcggcattttggttcgtgaatccggtaaaaccttcaacaatgccatcgctgaagtgcgtgaagccgttgactttctctattattacgcaaatcaagttcggcaggatttcgccaatgacacccatcgcccactagggccagtagtttgtatcagtccgtggaacttcccgatggcgattttcactggccaaatcgccgcagcattggcggcaggtaatagtgtcttggcaaaaccagcggaacagacgccattaattgccgctgttgcagtcaaaatgctgcatcaggcaggtatcccgcgtgatgtgctgcaattgctgcctggtcaaggggaaactgtcggggctttgctggttggtgatgagcgtgtgcggggcgtgatgtttacaggctccaccgaagttgccagcctgttgcagcgcaatattgccggccgtcttgatgcacaggggcgcccaacgccattgatcgccgagacgggcggactgaatgccatgattgtcgattcctcagcactgacggaacaagttgtcaccgatgtggtcgcgtcggcctttgacagtgcgggtcagcgttgttccgctctgcgtattctgtgcgtacaagacgatgtggcagaaagaacccttactatgctgaaaggagccatggctgagtgtcggatagcaaatcctgaacacttatcaacggatatcggcccggtgattgatgccgaagcgaagggctggcattga

SEQ ID NO: 2095 - DNA, 93 bp, Xenorhabdus bovienii
  Coding sequence Name=Xb4151_4152.C431.gene166.dna; Position on contig= 156428..156520bp; Strand=+
ttgatatttaatggtttttattgttgtaattatggaggtgtaactgattctttaatgaaaggtacaacttctgaagtgataaatgtgacttag

SEQ ID NO: 2096 - DNA, 210 bp, Xenorhabdus bovienii
  Coding sequence Name=Xb4151_4152.C431.gene167.dna; Position on contig= 156546..156755bp; Strand=-
atgttatctgtacttaaagccactcttgttcaacatgatatgttttcagtgcaatatatttgcagtacaaggcacttgcctaccaggttgcacctgaagatcatttcacctaaagcggcattaattttggtatgtataatttatgtttgtaattattttaaaatcactttctatcctagattagctaaaacatttttaacaactaattaa

SEQ ID NO: 2097 - DNA, 1485 bp, Xenorhabdus bovienii
  Coding sequence Name=Xb4151_4152.C431.gene168.dna; Position on contig= 156806..158290bp; Strand=+
atgacagtaaattcaccaatgctaataactttcattgtctacatttccgcgatgctggtgataggctacatggcttatcgttccaccaaaaattttgatgactatatattgggtgggcggcgattgggcagtgtggtaacagcattatctgctggcgcttctgatatgagtggctggttattgatggggttgccgggcttgatttttttatctggaatttcaggtggttggatagcaatcggctgtttgatgggcgcttatttgaactggctctgggttgccggtcgattgcgcgtgcatactgaggtgaataacaacgcgttaaccttaccggattatttcacccatcgttttgaagacagcagtaaaatcctgcgcatcatttcagcgttggttattcttgttttctttaccatttattgtgcatctggtgtcgttgcgggtggtctgttattcgagagcacttttggtatcagctatgaaaaagcaatatggcttggggcactggcgactattggctataccttcctcgggggttttttggcagtaagctggacggataccgttcaggcaactctgatgatttttgccctgattttggtacccgtactaattttgttcaatgttggtgggtttgagaatgctatcgcggttattgaagcaaaacataccttctatctggatatgttcaagggattaaatgctatcgccattatctcgctattgggatggggatttggttatttcggccagcctcacatccttgcgcgttttatggctgcggactctcacaaaaccattcacaaagcccgtcgtatcagtatgacgtggatgtttctgtgccttgctggaaccgtagctgttggtttctttggcattgcctattttgagctgtacccagagcaggcggctcccgtattacaaaagaacgaacgtatctttatcgagttaggtacgctgttgttcaatccgtggattaccggtatcttgctgtcggcagtattggcggcagtgatgagtactttgagctgccagttattggtttgttctagtgcgttgacggaagatctctataaagcctttgtgcgcactaaagccagtcagaatgagttggtatgggttggccgtttgatggtgttgctggtggctgcgattgcgattgttattgcaaccaatccgaacaataaagtgctggctctggcaagtaatgcatgggctgggtttggtgcggcatttggccctgtagtactgatttcggtactttggaaacggatgacgcgcaatggtgcattgatcggtatgctggtgggagcgattacggtattggtatggatgcagtacaaatggttcgggctgtatgaaattattccaggttttatctttgcttctattgccattattggtgttagcctgttagggaaagcgccaagtcaggcaactcaacagcgttttgatgaggcggaagcccattataaaactaaataa

SEQ ID NO: 2098 - DNA, 135 bp, Xenorhabdus bovienii
  Coding sequence Name=Xb4151_4152.C431.gene169.dna; Position on contig= 158350..158484bp; Strand=-
atggatagtaattcagatggctcagaacctccatcttatattcaagctacctttaattctgaaccaataccaataatccctctttctataagatacaattacagagccagtacttatgaaagaaccaatttataa

SEQ ID NO: 2099 - DNA, 102 bp, Xenorhabdus bovienii
  Coding sequence Name=Xb4151_4152.C431.gene170.dna; Position on contig= 158451..158552bp; Strand=+
atggaggttctgagccatctgaattactatccatttgatttaaacgtgctggacaatattgtctggtataaaaaatccataaaaataagacggatcaaataa

SEQ ID NO: 2100 - DNA, 105 bp, Xenorhabdus bovienii
  Coding sequence Name=Xb4151_4152.C431.gene171.dna; Position on contig= 158708..158812bp; Strand=+
ttgtcaggtttaatcacggatagtcaaaggatatcatcttgcgtcatgacaagtatgtacatatcagtgtacataaactacattaaaagctgtattgttttttga

SEQ ID NO: 2101 - DNA, 1236 bp, Xenorhabdus bovienii
  Coding sequence Name=Xb4151_4152.C431.gene172.dna; Position on contig= 158823..160058bp; Strand=+
atggcaattactgattcatggctgcgctctaccagtggcaagccccaagaaaaaatggttaccaaatcagacagagacggattatctattcgtgttactccgaaaggtaaagtgatttttcagttccggtatcgctgggatggaaaaggagatcgaattgacataggtacatatccagcgactagcctaaaagatgcgcgtgatgctgtgattttttaccgtggagaattagagcaacaccataaccctaaaatggttaagcgcgttcttcgcgagtccgtcttaaaggctgtgacagtggaaaggcttatccgagattggtgggaaacagcgatgaaaggagtgctagtgaaagcgaatgaaattttacgttcgttcgaattatatgtttttcccaaaatcggtaaattaccccatgatgaagtcactctccatatttggttagccttaattgaagatgttactaaacagcacccatcaattggggttcggatattgaataacaccaaaaatgcacatcggtgggctgtgcggagaggaatgactaaaatcacccctctatccgatgtattgatcagtgatttaggaagaaaaaaaaccaacaaagatgacagtacgttgagcgaagagagattaatagttctatttaaaattattgattcccctagttataatccacgtaatgcgttaataataaaactatgccttttatttggatgtcgtattggtgaattgctgaaagctaaagttaccgattttgactatgaaaaaaatatctggattatccctcccgaaaatcacaaaactggggctaaatcccaaaaacctattatcaggccaattgttctagaagccagggaattaattaaacaagcgaagacgctaaatcgcggaagcgaacatctatttatagtatccagtggtaaaccatttgcggaaggatcgcatcttcaaataattaattcactgaataaaaaaatgtctagttatttcgaacattataccccttggtcaatccacgacttgcgcaaaacaatgcgcacagggatttctgatctgacttcacctcatgtggccgagattatgctggggcacaaattaccgggagtatggcaggtgtacgataagcacacctacctgaatgagcagagagaagcatatgaacgctggtgggataagttgactaaaattgtttcccgccctcccagtcaagaatatcctgccgtagaaaattaa

SEQ ID NO: 2102 - DNA, 195 bp, Xenorhabdus bovienii
  unsure (1)..(195): unsure at all n locations
  Coding sequence Name=Xb4151_4152.C431.gene173.dna; Position on contig= 160006..160200bp; Strand=-
atgatgncggagtcaccntatatcaaaactcaggaactggcagctcgatacagtgtaaaaccacatactatcaggttgtggtgtggtaatgggaagcaaagaagaaaaggcttcccaaaacctaaatttttatccgaccagcttaattttctacggcaggatattcttgactgggagggcgggaaacaattttag

SEQ ID NO: 2103 - DNA, 198 bp, Xenorhabdus bovienii
  unsure (1)..(198): unsure at all n locations
  Coding sequence Name=Xb4151_4152.C431.gene174.dna; Position on contig= 160112..160309bp; Strand=-
attctaacaacgaagttaaacaacatattttttatgcgacatggaagaaaaggcgacactgcgggagtagcgaaaatggtttggagancggttatcagaaagnaggtgcatgatgncggagtcaccntatatcaaaactcaggaactggcagctcgatacagtgtaaaaccacatactatcaggttgtggtgtggtaa

SEQ ID NO: 2104 - DNA, 102 bp, Xenorhabdus bovienii
  Coding sequence Name=Xb4151_4152.C432.gene1.dna; Position on contig =186..287bp; Strand=-
atgatattgtggcgaagcactatccggggatgctggcagcgagatgaagagggcagggaggtaattccttacctgacccattacctgacccgattcgtataa

SEQ ID NO: 2105 - DNA, 834 bp, Xenorhabdus bovienii
  Coding sequence Name=Xb4151_4152.C432.gene2.dna; Position on contig =241..1074bp; Strand=-
atgcaaacagaacccgacgtgttaacagatcacaacgaacttatcctttcgaccaatatcgaacgtgtggtcactggccgcgatgccgcactgaaacagatagaacaacttattcagcagcttgatgccatttcacggctaacctcagaaattggcggtggcacagcgcaagattgggcgatgaagtccgtgcaccgctacgatagctggctgactgagaaggttgataaagcgatgcctgccgtcacccgcaatattgaccgcagtatctggtgcgatttgatgctgaagtccggcatgatggccttgatggatgcacaggctcgcgaccagtggcacaagaacctggaggagggcgaccttcctgccatcagcgaggcgaatatcctcagtacttttgagcagctacatctgaacaaaatggatgtctttgaacgtggcatcatcaacgtcttcaaaggcctgtcgtgggattacaaaaccaatagtccctgcaacttcggtaagaagatcatcatcaataatctggtaagtcacaatcgctggggatttagtctgaactggggttggcggcgggatcaactggcggacctggagcgaatgctgtttctgctggatggtaaaccgatacccgacaaccgtggcgatgtcactacacggttgatggagcatattcgggacaacccttcgaaggatgtctacgaagatggtttcttcagtatccgttattttcagaaaggaaccgcgcacatcacttttaagcggtgtgatctgacagaaaagatgaatgatattgtggcgaagcactatccggggatgctggcagcgagatga

SEQ ID NO: 2106 - DNA, 321 bp, Xenorhabdus bovienii
  Coding sequence Name=Xb4151_4152.C432.gene3.dna; Position on contig =1188..1508bp; Strand=-
atgcaaacctcaactgtaccggccacggtgccggtttcatcacgcctgtctcccgtccaagtgtggcaacaactgttaacgtatctactggaacaccattacggcctcacactcaacgacacgccattccacgatgattcagccatccaggaacatatcgaggcgggtatcactcttgctgatgcggtgaattttctcgtggaacgttatgaactggtacgcatcgaccgcaagggattcacctggcaggaacagacgccgttcctgaccgccgccgatattctcagagccaggcgagcaacgggcttaataaatacctga

SEQ ID NO: 2107 - DNA, 132 bp, Xenorhabdus bovienii
  Coding sequence Name=Xb4151_4152.C432.gene4.dna; Position on contig =1738..1869bp; Strand=-
atgtcgttatctgattctccccaatggggactgcaaagtgatattaccccccgctttggcgcaaggctggtacaggagggcaagcgtctgcattacctggctgacagggctggttttacgggggagctttag

SEQ ID NO: 2108 - DNA, 471 bp, Xenorhabdus bovienii
  Coding sequence Name=Xb4151_4152.C432.gene5.dna; Position on contig =1902..2372bp; Strand=-
atgtccgaaatcgcattatctcccgtttttccggttaacgaacaacgcattatccgtcgagccctgcgtctgctggagaaatatcagcgccagccgggagagtcgtttacctcaaccagcgtcactaaaacctggctgcagctgcaaatggcgggccttgagcgggaaatctttatcgtcctgtacctcgataaccagcatcgtttgctggagcgtgaaacgctgtttaccggcacgctcagccatacggaggtacatcctcgcgaagtggtcaaagcggctctacgccataacgccgctgcggtcattctggcccacaaccatccatccggcgaaatggagcccagccaggcagatcggcacatcacaaagcgggtagtgagtgcactggccttggtcgaagtgcgtgtgctggatcacctcgtggtaggggatgacgtgatgtcatttgcagagcgcggttggctgtag

SEQ ID NO: 2109 - DNA, 432 bp, Xenorhabdus bovienii
  Coding sequence Name=Xb4151_4152.C432.gene6.dna; Position on contig =2438..2869bp; Strand=-
ttgccaaaatggactgatttgcgggtgccgcataaaggcaatgtggtggagaaagtcattgaaggggcttacgaagtactggggatatttgaccgagtagaagagaagcgcgatgccatgcaatcgctaatgttatcgccgccagcacagcaggcgatggcgaaagcagcattaacctatcgctttggtgaagagcatcagccggtgacggaatcgcaaatcctatccccacgccgctggcaggatgaaagtaacgacctgtggaccacttatcagcgcattcaggaaaacctgattaaaggcggtctgtctggacgaaccaccaaaggcaaacgtgcccatacacgcgctgttaaaggtatcgacggtgatgtgaagcttaaccgtgctctgtgggtgatggctgagaatatgttgcagcttgcttcatga

SEQ ID NO: 2110 - DNA, 468 bp, Xenorhabdus bovienii
  Coding sequence Name=Xb4151_4152.C432.gene7.dna; Position on contig =2770..3237bp; Strand=-
atgacccgattagccagccgctttggtgcggttaatgttgtacgccgcgaccgcccattaactcacgacgaactggcgcattatgtgccgagtgtgttcagcgaagaaaagcatgaatcccgcagcgaccgatacacttacatcccaaccatcaccctgctagataacttgcaacgtgaaggtttccagcctttctttgcatgccagacccgagtacgtgaccagagcaaacgcgaacatacgaagcacatgttgcgcctgcggcgtgaaggacagattactggcaaacaagtaccggaaattattttgcttaacagtcatgacggctccagttcataccaaatgctgccggggctatttagatcggtttgccaaaatggactgatttgcgggtgccgcataaaggcaatgtggtggagaaagtcattgaaggggcttacgaagtactggggatatttgaccgagtag

SEQ ID NO: 2111 - DNA, 153 bp, Xenorhabdus bovienii
  Coding sequence Name=Xb4151_4152.C432.gene8.dna; Position on contig =3203..3355bp; Strand=-
ttgcagaaatatcgctggttaacatttcttataagtaaccatcccaccatcttacgggccatgcctcctttgggaagcatggcctcttcgtttttaatctccaaaaaaggaattaatcatgacccgattagccagccgctttggtgcggttaa

SEQ ID NO: 2112 - DNA, 459 bp, Xenorhabdus bovienii
  Coding sequence Name=Xb4151_4152.C432.gene9.dna; Position on contig =3334..3792bp; Strand=-
atgaaaagactatctatttttaccatattgttattccctattacctcttttgcggttcctaatatgtgggccagtggctttggtcagggcataactgaatacctgatcatcagcccggaaaatgtcgtttttaaccttaactgcaccatgaatccggatgagcagaatatcctacagcacaatgtactcatcgacctacctgacggtactcgcttggactcacgcgatgacaaaacaacaataacggttgtgaccgatgatcaacagttcccgttacctgcatcgctgggctggcgaaatggggataacgcctggattcagtttattgatgcccttggtcacgccgcaacgttcgatgtttatgttaatgataaaaaagtaggaagttttactcctggtattaagaatacagaaaaagagctggatgacctcagcggttgcagaaatatcgctggttaa

SEQ ID NO: 2113 - DNA, 474 bp, Xenorhabdus bovienii
  Coding sequence Name=Xb4151_4152.C432.gene10.dna; Position on contig =3817..4290bp; Strand=-
atgaaaaaaacaaagttattgttattaatatctgggatcgctgctggaataattacatcaaaattagcggaggcatccagcctttataaaggtgtattacctgccgcagtcaacaataaggatggcaacaggttttggtgcaatgcttatcagcaggtgagaaaaatgtgcaaagcaactgaaattgatgcgtcaggtgggtttatcttgatacgttctgcccctttaaaagattgcgaagctggtgtttggggatggatcaatcctggtgacaagaatatcctaactgattatattgcaacgggttataccattactgctgatgctaaacttaatgtgacagtcaaggaactgtgcagtcccggcatgaaagtaacctttagacctaatagtaaaagacctcaatttgatgacatggtcggaccgtataatggaaaagaagtcttccgttataaatggcctgactcaaaataa

SEQ ID NO: 2114 - DNA, 690 bp, Xenorhabdus bovienii
  Coding sequence Name=Xb4151_4152.C432.gene11.dna; Position on contig =4311..5000bp; Strand=-
atgactcaggctgaacgccgtcatgaccggcttgccgtcaggctgtcgttaattatcagccgcctggtggcgggtgaaactctggatttgcgaaagctggcaactgaatttggtgtgtcggttcgtaccctgcgccgggactttcgggaacgtctgatgtatctggatctggagtatcgcaaaggtcagtgtcgcttgctgtccggaggtcgacagagagagctggcggtgatgacgtttgctcgtcagtcgggtgttgaagcgctgtttcctgatatggacaaccatctggtcagttcacttctgagcgggccgggtgagtctccatgccttatttggaacggggattcactattgcaatcaccagacctcggcgtatttaccagactggtgagtgcagtttcggaacatcggagggtgacactactgggtaatggttgccgctgcacgggactcgctccctatcgtctggtattgcgtgaccgtgagtggtatctgaccggtgagcatcaggcccggatcgccgtgtttcctctggcggatatacgggctgtcacgcttaataaggacagttttgccccggatatggctgtgcgcgaaattctttctcgtcccgattttcttcaggcactaccacactttcagtgtatcgaagacgttatatcttcctttagtaccaacaatatttaa

SEQ ID NO: 2115 - DNA, 885 bp, Xenorhabdus bovienii
  Coding sequence Name=Xb4151_4152.C432.gene12.dna; Position on contig =5041..5925bp; Strand=-
atggataaattcgttgaacttttttgtgatgtcgacgatttttgtcgtattttcattccacagtgggaacaacagtgtatcgagaacggacacagacaacgccgccgttatgggcgcatgagtgtcagtgagatcatgaccattctgattttttttcatatgtcaaatcaccgtaatttcaaaacattttatttggggctcatttggcaataccaccgcaacgattttccggtcttactcagttacacccgttttatcgggatggcttcctctgttttagttcctctttgtagctatttgacccatctaaaaggaaaacccacaggactcgcttttatcgattctactcatctccgtgtttgccataatattcgtattccacgccataaagtttttgacggggtagcgaaacgggggaaaagtacgatgggctggttttacgggtttaagctgcatctgatagtcaatcatcaaggggaaattatggcagccaaactcacgccaggcaatgtggatgaccgcgagccagtgcatgaattagcaaaaggattaaccggttctctttacggagataaaggctatatcagccaatcccttgtggatactttagcggagacaggggtgacgttcatcaccaaaaagcggcataacatgaaagctaaagccctcagtgcatgggataatatgatgttatcaaagcgttttattatagaaacgattaatgaccaattaaaaaatatctctcaaatagagcactcacgccatcgtagtctacaagggctcatgttgactgttttgggcggactgattgcttattgcctgaaaaagaataaaccgtcactgaatattatccactcggaaaaggatgtcttagtgacggcttaa

SEQ ID NO: 2116 - DNA, 876 bp, Xenorhabdus bovienii
  Coding sequence Name=Xb4151_4152.C432.gene13.dna; Position on contig =6206..7081bp; Strand=-
atgaaaaaatcagaaggtctgcaggccatcgagaaaccgctggcttcactcccccatgccattggcaaacatattcttgaccatattcaaaagctcactcactacgaaccagtcatcgggatcatgggcaaaacaggcgcgggaaaatcatctctgtgtaatgcgcttttccagggggaggttacgcccatcagtgacgtccacgcctgcacccgtgacgtactgcgatttcgcctgagaaaaggtgaacatagcctgatactgatagacctccccggagtaggtgagagtgagcaacgggataaagaatatgaatctctatatcgcaatattctccccgagctggatctcatcttgtgggttatcaaagccgatgatcgggccttctctgtggatgaacgcttctaccggcgagtgatgactggctaccaacaacgggtactgtttgtcgttaatcaggttgacaaaatcgagccaagccatgagtggtatgtcaccggcaatgcaccatcaccgcaccagtgggtgaatattgaggccaggctggcatccattcgtcagttattttcaccactccatccggtgtgcgctgtctcagcgagaacagaatggaatctgccatcaatggtagaaacgatgatgtgctacctgccagaccgagccaccagcccattggcgacacaactgcacgggaggttatgcggtgaactggtaaaaaagcaggctcgtgagggctttggtaatgcgatcggggaggtgtttgattctgcggaagcggcatcatttattcccgtgccactaaaaacggttattcgtactatccgtgaggcagtggtatccgttgcccgtgccgtttgggactggtttttcttctga

SEQ ID NO: 2117 - DNA, 126 bp, Xenorhabdus bovienii
  Coding sequence Name=Xb4151_4152.C432.gene14.dna; Position on contig =7020..7145bp; Strand=+
atggcatgggggagtgaagccagcggtttctcgatggcctgcagaccttctgattttttcatgaaacgacctcagacagaaaaacaaaacccccgagccaggaaggcttcgggggtgattcgttag

SEQ ID NO: 2118 - DNA, 99 bp, Xenorhabdus bovienii
  Coding sequence Name=Xb4151_4152.C432.gene15.dna; Position on contig =7154..7252bp; Strand=+
gtgtctgagattattttaaatgtcggtatctctgaatcggtatccaggcgattgaaccgttattcttggttagttgcattagtagctggagcgagatga

SEQ ID NO: 2119 - DNA, 561 bp, Xenorhabdus bovienii
  Coding sequence Name=Xb4151_4152.C432.gene16.dna; Position on contig =7341..7901bp; Strand=+
atgagaaaatctgaggtttatatttcagtcgatgtcgaaacatcaggacctgtgcccggagtattcagcctcctttccatcggagcgtgtctggtacatcaggctgaagtagctatataccttgaattacaacctgacagtcccgagcacgatcctgaatctcttgctgtaaccgggttagatctaatgcaacttgaacaggacgggcttcccccttcagcagcaatgcatcaatttaaagtatggatagaaagcgtcattgatccgggacagaaagcgatttttgtggggctcaataccccttttgattggtcatttatcaattattacttctacaaatatgtcggaatcaatccttttggttttaccgcaatagatataaaagcatatttcatgggtgcctacggatacagctggtccgaaacaaaatcatcccatatgtcagccattctgaaaccttgcactaagccaaaccacaatgcgcttgaagatgctcgctttcaggccgaattgtttgccctaatgcttgccaggcaaaccggagatattcgctcaggttaa

SEQ ID NO: 2120 - DNA, 492 bp, Xenorhabdus bovienii
  Coding sequence Name=Xb4151_4152.C432.gene17.dna; Position on contig =7898..8389bp; Strand=-
atgagcggcccagtatggcactggatatggcctgggatagaaactgagctgatggtttcccggtcagtatccgatgtcttttccagctacagacagaataactcttctacagaaaaaggtgggcaactgttcgtcgaccccacttacccttccggcatgttgctgtcttttgcaactgttccccattatgccgatagagctggaaggacctggttggagctggatgctaaacgttgcagagaagagattgaaaacgcgaatgaccaaggcctacgtctggtaggctactggcatacacatccacaagttatcccgcagatttcttccactgatattttgagtttcgcacgctttgctcaacgttatgcccaagagctaccctaccccatagctgtcatagtggggacttcactttcaccagaaggcgttaaagcctggtctatcagagcgggaacctgtattgaagctttgaggataaatggcgcagattaa

SEQ ID NO: 2121 - DNA, 1776 bp, Xenorhabdus bovienii
  Coding sequence Name=Xb4151_4152.C432.gene18.dna; Position on contig =8386..10161bp; Strand=-
ttggctgaactaacagatactccacttcagcagggaatagccgctctgagggaaattctcggaaatggtgacacctcaggaatgctccagcccgccagtgtgcgggctggagaagctgcggcattttgctttcctttgccgattgattgcgcgggtgaagagcggaaactgtatattggttttcccaacaattttccttccgaatccctgcggctccacgttgagccttcgccctggcttctctggcctcacgccatggagtccgggttatgtcttcatggttttaaagaacgccctattacaggctcccctgcaagcattgttcgggacagtatttcacggctgacgagtatcctttcattgtcattgatgggaagtgatgctgagcggagaaaggctgaatttcagaacgaaattacatcatactggattcgacagcatggtaagtctttacaggaccttattctgctgggtcgtccaatagaggcttcagagctttttgctgttagcgatccgcgatatctcataccctccgggaaagaaaccgtctggttgtcgtctgacgtggaggctatcaagaagcacttcaaacgaatgaccgggcgaactgtaacagttcggtcacccatggcggcagggttctatataaaactggagagctaccctgatatcaaatttcccacaccaaagggtttgattgcatggttgctgcctcatatatccgagggcgacgcacaaaagttatctgactggtttgagaagagcagctcaatggtagcaaggtggatcatccttgaattacctgggaataatggatcaccagtttacacactgaacctctatgctcgtcggcataataccgatcgaggaccgaagcttggactcagggcttcacgccgtaagcctgtccgggcctcaggtgagttaccggaatgtattcgttcatccggcctgaatgtaattgaccgtgcagatatccattctcgtgacctaagtaatgaaataaaagggcttgaaactgcgcatgttgtttttgtcggagttggttctttgggtggggcagtggcgtcgcaactggtaagagctggtctgaagcaactgacgctgatcgatccagataatctcgaatcagcgaatttgggcagacatatacttggggctgatgatcttgggaaaccaaaggcgcaggcattacagtacaggctcactcgggatttaccgactattgatgtagccgcattcaatacttatgcacaatttattatggagttaaagccggagatttttgaaaaggcagatttaattattgtcactacagcagactgggaatcggaagttgcactgtggacaaaaaaagcagaaggtgcgacctggggtctattacagggatggagcgaaccacatactctggttggacatgccttaattgctcctcaaggggcacatgatggccgatacctgtttagcgataacggtgattttattcaccgttatacaaactggcctgagggcggtgttattccactcccggcatgtggggaaagttttattcccggtggttcggctgggatgactaatattgcggccatggtagcacaagcagccataagatttctgaacacgcatcagcatggccctgcgtgggtgaccagtctttaccgtcctcaggatgcagtgttgagtggcgggaaatatctaggaccagaacttcctgaaggaacaatcctgagtgttctggagcgaggctggcccgaatctgagaaaaataatatatga

SEQ ID NO: 2122 - DNA, 1248 bp, Xenorhabdus bovienii
  Coding sequence Name=Xb4151_4152.C432.gene19.dna; Position on contig =10154..11401bp; Strand=-
atgaacaatgaacaaacgaaacgtagcagctgggagtattttctccttcgcgcagcaagaaaaatctcgctatcagaacctcagtacgagaagatcaatggtcgttatgaccaattgcagagcatcctttctgcatctgacgatcctcttcttgctgaagctcatatttttcctcaggggtcaatgcggctaaaaacaactataaatccggtacccgatgctccagctgacttggggactatcgatgcggatgctattgtctggttgccacatgccaaaggcgtggatgcaggaagagtattaaacgcgatcgaaaagcgttttaaagagggaagccgggtacagggggatatccaacaacttcgtcgcggtgtaagaatcgtttacgccgatcaaaaccccggttttcatatcgatgtcaccccggcacgtgcctgcttctggaatgaacaggataacgggcttggcatgcttgaagttcccgatcgtgagctcggatggaaggcaagtagccccattccttattccgactggctccatcatgcttccagcctggaagttatgctcgaaagttatgttgcgcttaacaaaagttttgcgacagcggattctgctacccaggagcctctacccgagtatggagattatcagaaggaggatccgctgcgtgctagtattaaactgctgaaacgtcatcgcgatgaatgggctatccggacgaaaaatgaaaagaatcgcccaatatctgcagtaatcacaacgctggcaactcacgcgtatctggacgtggtgaaacaatctcaacagcggccttttacgcctctggaggctatcattgagattgtgcgcataatgccgcaatttattcgactcaacggccacgaatatatgatttgtaatccgcgagatagcggtgagaattttgctgagaagtggaatcgtccaggggaaggcccattttatcgtcgggctttctatgactggcatgaaaacgccagtcaagccgtgaatcttgggcttcagaattattcctccacagattccttcgccttggcagttaaggaaaattttggcatcgggcgtgcatttgttgatgagattaattcgcaggtcccagcaagttggacaatgccgggtcgagctgcgggggtaacccggaatgcagcctcaatgggcgcacttttcgggagtgcgacgggcagtagccggtctcaggtaaacgtgaaaccggtgggacgccttggctga

SEQ ID NO: 2123 - DNA, 1215 bp, Xenorhabdus bovienii
  Coding sequence Name=Xb4151_4152.C432.gene20.dna; Position on contig =11404..12618bp; Strand=-
ttgcacggcttgccgcaaaccgaagagttccggagggacagtgctttgaatactaaagaacaaacgagtacttctggcgggcgttttaatacaactgacgaagtgaaacgtattgtctggatccggaccgcaggccattgtgaactctgtggagtcgacctgactcatgattacagagttggtacaccaatgagatggggagaagttgcccatattttaccggcaagtcctaaagggccccgaggaaacgttgatcatagtggtgatcgagctctggcactcacaaatgatttcgccaacctaatgcttttgtgccctggttgccatgacaggattgatcgggacgaagacggctaccctgaaaatgatttaagcgggttgcatcaggcctgcctggagcgtatcaggctggcagcgtcttcgccgagagaaggtcgagctattcctgttattgtgcaaagccagcactttgccactaccaacaacattcctgtcggtgatttgctaatggtgatgtcttcagaggggttaaccgcttttgggcacccgattaacattatcttcccagcaccaggtcccaggggcagggatttatactactggcagaatgtgaaagatgacattcactataaactagctggtgagttggcacgccgtggtgggatgtatggagatttaccagcattagcggttattggcgtcgctgatattcctgcattaatgttactcgggcaagccattggcgatcgtacgaaacgttttcttttttcaatgagccgttcgcatggtctacgctggccggataaatcagctgagcctcctgatttcctgttttcttcggctcctgaagggaaaggcccattggctcttgttatttctatttctgccaagatcccgccgcgtgatgtcatgacagctatacctgatgtccgcattgctgagttcactattcctgaaccggggtatgcaatagtcagctgccgtgaggtgatccatgcctttcgtgatgagctacagaaacgcttaagccagcttgaagcaagcactgatgaagcaatccatgtttttgccgctattcctgcagctttagccatcgagttcggtgctttgttaacaacacagcatcaacatccgtatgtcatattcgaccgtgaaaacatgagtcagaaccagttcaggccaatgctgactattggtcattctcaggagctatag

SEQ ID NO: 2124 - DNA, 291 bp, Xenorhabdus bovienii; identical to SEQ ID NO: 155
  Coding sequence Name=Xb4151_4152.C432.gene21.dna; Position on contig =12762..13052bp; Strand=-

SEQ ID NO: 2125 - DNA, 279 bp, Xenorhabdus bovienii; identical to SEQ ID NO: 890
  Coding sequence Name=Xb4151_4152.C432.gene22.dna; Position on contig =13044..13322bp; Strand=+

SEQ ID NO: 2126 - DNA, 270 bp, Xenorhabdus bovienii
  Coding sequence Name=Xb4151_4152.C432.gene23.dna; Position on contig =13273..13542bp; Strand=-
atgaccacgccacgaatgggctactgccggtcatgtattaaatggttagttgctgtgatatgcttccggctttttaaggatgaagtatggccaaagttgatgtctattgccgttattgccacaaatcagaacaggtcaaaggacatgggaaaggaaatggcggacatcctcgttatcgctgttatagctgctgtaaggtctttcagttggcgtatacctatcaggcctgcaaacccggcgttaaagaacagattgtcgatatcgcgatga

SEQ ID NO: 2127 - DNA, 99 bp, Xenorhabdus bovienii
  Coding sequence Name=Xb4151_4152.C432.gene24.dna; Position on contig =13509..13607bp; Strand=+
atgaccggcagtagcccattcgtggcgtggtcatataccactccttgtgttgcacggagtgtcatttcaccggaggcaggcttgtcggctacgcaataa

SEQ ID NO: 2128 - DNA, 195 bp, Xenorhabdus bovienii
  Coding sequence Name=Xb4151_4152.C432.gene25.dna; Position on contig =13651..13845bp; Strand=+
atgacgttccgcagagtttttgtttttctggtgaaggactgtttgcagacagtccttcaccgtcccctcagaaataatccagccagaccaacaacttcacctgaacgaaccttcctgaactatcatgtcgatatgattactttctcgacagaatcgatcctatctcattgcttaaaacagtgcaacatgaaataa

SEQ ID NO: 2129 - DNA, 927 bp, Xenorhabdus bovienii
  Coding sequence Name=Xb4151_4152.C432.gene26.dna; Position on contig =13886..14812bp; Strand=+
atgacaaagtttcatgacgtttatctggaactgctggtcgacgcctattctcttccccaggcggaacgactggcgtacatagacctctgcattcgctaccttggcagcatttccagagctgaaattatggctgagttcaaggttgctcaggcagcagcatcaaaggaccttgctctttatcgagagttgaaaccagataactgcagcattgataccgcaaccaaaaggaccactatcctcgcggacagctatacccctttggtcaggatcggcgttcatacagcacttaacctgattcaatatggatttacgcgctccgaattaatgcaaaagcggcccatgctacctattgatgaagtggacccactctatcaaccggaacgtctcaaagaagaacaggtggctgcggtaacccgagcaataaaggaacggtgcgccattagatgctcatatggttcaaaaagcggagatcacagggaaaggatactgtttccatcagcattgtttgttgaccgtaagaactggtatttcagagcctacgatcgaaataacggagaaccgaatcgcagtggatttaaaaactttaagttttccaggctcttcaatgctcataaggaaccatccgtctcaccgactctggctgagaagacggacatagaatggaatgaagaaatcacttttattattgaatttaaaaagaatcttccaaaggaaacgattaatgaaatatcgcgtgagttttcaataaatggcagcgtgcattctgttacctgccgggcagctttagcctgctacgtgaagaccaactggaaaattgatttaaccaataatgaaaacaaccagtggctgtactttgatgtactgaatgctgaggcgttgtgggaagttcagtgtttagcaccattgtttgaacaaaaaaacagttaa

SEQ ID NO: 2130 - DNA, 165 bp, Xenorhabdus bovienii
  Coding sequence Name=Xb4151_4152.C432.gene27.dna; Position on contig =14842..15006bp; Strand=+
ttgcagccaccccttgatctttttcgggctgttcccatcttaactaacatgccattgttggcttatctcctgctcagtagctttgcaataaagctcatccatcacatccctctatcagtctcctgccggaaaatataccgcaagaatcagtactgttattcgtaa

SEQ ID NO: 2131 - DNA, 210 bp, Xenorhabdus bovienii
  Coding sequence Name=Xb4151_4152.C432.gene28.dna; Position on contig =14936..15145bp; Strand=-
atgttccggatggtcatgcgaagcaattttgaacgattctctgctgccatatatccctctaaattacaaacagataacagcctcattctaaacaagcgagccacctcaaaaggtgatgccgactataaatccgtatttattacgaataacagtactgattcttgcggtatattttccggcaggagactgatagagggatgtgatggatga

SEQ ID NO: 2132 - DNA, 1998 bp, Xenorhabdus bovienii
  Coding sequence Name=Xb4151_4152.C432.gene29.dna; Position on contig =15051..17048bp; Strand=+
ttgtttagaatgaggctgttatctgtttgtaatttagagggatatatggcagcagagaatcgttcaaaattgcttcgcatgaccatccggaacattggatgtatcgggaatgaaggcatcgatattgcacttgataacattgtttgtcttgtaggtaaaaacaacgctggtaaatcaacagtcttgcgagcatatgagttagctaagggtccaacagcatttgatgccagcagcgatcgacatcagcatgcctcagaggatgaacattcagaaattttgctcgaagttcacattcctgacggtattggtaatgtagatgcaaaatggaagcaagaaagagacggttttctcgtcgttaaaagccgttggcagtggaaagcacctgattttttgaaagtccgtacaacctgggatcctaccgctggagaacatggtgaaggggactgggcagaggacactaaagcaggcggcgctgattcagttttcaactcacgtctgccaagacctttgcgtataggatctctggatgatgcaggtaaaacagaagatgtgcttttgagttttgctctcgcccctttacaaaaagagcttgagaacgcgcggcttaatcccgaatcgtcattagcaaaagcgattgaaagtgtttccggaagtatcaacttgcttagtgaacagcatcaagaacattttaatggtattgcgggccgagtttccgaaggatttaaaggtatttttccggggctggatgttagtctgagcatcggtgccgcccctctggctcctaaagttgcggatctcatcaagaatggctccagtttaaaaatcactgacgggagggctaatacctctcttagccagcagggcacaggcgctcgccgcgcactattctggtcaatgttgcaagttcacaatgaacttaatcgcgacaaagaagtacgtgctgaattccgcaagcggcttgagaaagaagtaactgaacttgagaagaaactaaaaaagccgcctaaaaacgctgatttgaatgcccttaatgatgagcttattcaggttagagcccaactggatgcccatgatagtggtgctccaatccctgatagccctgatgatccagcttttcctggctatttactgttaattgatgaacccgagaatgcccttcatcccatggctgctcgtgcagcacagagacacctgtatcagttggctaagaatccagactggcaggtgattatgactacccactctccgtgttttatcaatccatttgaagatcacacaaccattgagaggcttgaacgcgataattctgaagaaaattcagcagttacaccaagaacttaccgctctgaccatatagcttttgagggggatgaaaaacagcgcttgcaggcattgcaacatatcgaacccagcttttcagaggtattcttcggttctcatccaattctcgttgaaggcgataccgaacatgcagcatttatgacctcgatcatcgagcgtgataatgcattgatggatcagattgcggtcatacgagccagagggaaggccatactagtaccgctaatcaaggtactgactcacttcaaaatccacttcagtcttgtccatgattcggattcacctaaccgctccgatggagttaaaaatggaatgtggactgaaaaccgaaaaatccatgaagcattgtgccaagccagaaacgcggggctaacagtccgccatcgagtcagtgtacctgacttcgaacgcttccttggtcaccgggaagcatacaaggataagccattgaatgcttacctgcagatcaagttggatgatgggttagcgaaacgggttcagaggctcatggattcccttctgaactctgatgagcattgctcctttgggaatgaaatcgatcacgatcgttatatggaaaagctactgggagttgtttctgggtgggctgaggcgaatggatatgcggaggatctgcgctttaagagccaaagataa

SEQ ID NO: 2133 - DNA, 120 bp, Xenorhabdus bovienii
  Coding sequence Name=Xb4151_4152.C432.gene30.dna; Position on contig =17099..17218bp; Strand=+
atggattacgtcagaaatgtggttactcacacagtagccacaattaccttgctcggtacttgtaagcaatctctagacatccctaacatgcactttagaatggtatcaattcaatcctaa

SEQ ID NO: 2134 - DNA, 2283 bp, Xenorhabdus bovienii
  Coding sequence Name=Xb4151_4152.C432.gene31.dna; Position on contig =17234..19516bp; Strand=+
atgcaatcaatccagttcgacctccacaaacttggatggaaggctttcgaggatctcgtatcatgtatcttgaaagagacctttgggcaaacatttcaagtattctctgacggcgttgatggcggccgcgacggggccttctatggcacttggtctggaactggtttcggcgatggcataagtaatagttttactacccaatgtaaacacactagcaaacaaggtatgaaactttcaaagggagttgttagtgatgaacttcctaagattgagcggcttgtgagtaaagggctagccgatgtgtaccttctattcactaattgttcagtttccgcagaaacagctgccgtgatggaagaggatatgcggaaagctggtgtaaagttcgcaaagatttatggggcagaatggataaaccacagcatatccttatacccaagccttaggcgcatggtaccccgaatatatggccttggtgacctttcccaaataattactaatcaggcatttcggcaagcgaaaagtgttctcgattcaattgctccagatcttgcatgtttcgtccccacagaggcataccgccgttgtgcacacgctctcagggattacggatttgtaatgctgataggtgaaccagcaagtggtaaaacgatgatagctaacttgttagcgctctcagcggctgatgagtggggactgcaaacgttgattttaagttcgccggaagatttggataggcaatggaacccagatgatccaggacaatttttttgggttgacgatgcttttggatctaatcattgcgactttaaccgagtccaggaatggaatcaaaggctccctaagttgaaagctgctatacacaagggagcgcgagtgattttcacttcgcgcagctatatcttccgtgcagctcagaatcgcttaaatacaaataaattcgagttattcagagatagtcgagtcacaattgaagtcgagaaactctccgatcctgaaaaagccatgatcctgtacaaccacttgaagcttgggaaacagactaaggcttttcgaagggcaataaagagttttctaccgtcagtagtatcagtacccaaatttcttccagaaattgctcggagattcgccaatccgcagttcacgaataagcttgtgcctaacgaagctgcagtcgttggttttttctcaaatcctacggggatcatggcagacattattggtgggcttgcacccgctgaaagagcggcattagcccttatattttcaaatggaggggagctaccaatcccacttcggtttgaaaaccctcagacaaccaatatcatcacgtccatgcaatcaaatcttggcgacgtaaaagcagcattgtcagcattggatgattcacttatcagaataagtaaaacacaagacgaacactactggaaattccgccacccaaccattcgcgatgctttcgcaactgatgtttcgggtaatccagaactcatcgatatctacctttcaggagtcacaaaggaaagattaatcgaggaaatcagttgtggggatatggggatcgaggggataaaactggttgtgccgcacagtatgttcaaaagtgttctgaacatcatcgatcccagtggtaacagagccctcatcagtaggccaatactcacttttttggcaagcagatgttcaattgaattcttggggctttatttcaatagcggcgaagcaaagacttatttgcttgatttaatcagctctgcgagaacatacgataatagcctgacaatactgagtaggctgaatgtaaatggtctactcggggatgacctcagaagaaaagcactggacaaactgagcgcccttgccgcaataaaccattcagattgtttcattgacgccgactttgtcggagttttactctcaaaagaagagaatgaagccaggctttctgtccaaaaagtcgagttctactctaacatgaatgaaataatccaagatatagaggactcttgggctacagacgatgatgtagacgaagcattttacgatgtcacacgccttttggagcgatttcgtgacgagaacaatgaattatactgtgaggatttttatgataaagatgaatggcaaaaatctgaacaatttactcgtgaaatcgaagccaaaaaaaacaggatgaagcagaagcaatccgaggctgtggattacgaagaattagaaacagaagaagcccagagtgcaaatttgtcatcaggtaggagtattttcgatgatgttgacgaatag

SEQ ID NO: 2135 - DNA, 165 bp, Xenorhabdus bovienii
  Coding sequence Name=Xb4151_4152.C432.gene32.dna; Position on contig =19481..19645bp; Strand=-
gtgctactagtgcggcctcgctttttaggcggaccggattatcacctgccgttatctatcgtttggcaagatttcgaagtgagcagctcgggtcaagccctctatctcactcgtgatggagctaagattctattcgtcaacatcatcgaaaatactcctacctga

SEQ ID NO: 2136 - DNA, 1056 bp, Xenorhabdus bovienii
  Coding sequence Name=Xb4151_4152.C432.gene33.dna; Position on contig =19835..20890bp; Strand=-
atgagtagcgtaatgatctggctatcccggctggagtcgacagcaaataagcaccgttttgcagccggtaaggccgtccgaacagttaaagccaatgcgattctggatgagatattagaaacacatagccaagaggctttgcgccaggatgttccaagtttattgagtcaggccgttacgcaactgcttgaaggggactggcgggctcagcctaagcataaagctagctggcatcgctactggcggggtatgagcctaccaaatacttttgtttacgaaggtgccatcgtccctacaaaaactgcatcagaaatagcctggcatccctggttggcggaacgtattacagggcaactgccactgccaatcaaggcacgtttacaacagttgaatacatatctctttcgccaaactaagggcgacaagccactctttccgggcttgctcggacaccgtgagcggtctctgcttatatttggtgatgaaaaagcactggattccatgccgcctgacggctggaagcatgtcacactgactttggctgatatgggcgcgtttcgacgtgctccgcctttaccgtatgagtcatcaggttgccgcgatcttccggctatcattgttgaaaactctgatgtgtattatcgactttgccaacttaatcgagttcagactcactggtcactggttatttatggcgcgggaaacaaagtgtcaggccaagcagagtgcgtgtcacaacttctcaaggtcgaacaggtaaaacaactgctctattttggcgatttggatgtggcgggcttaaaaatcgcccatcagctgtactgtaagctacttagtgattacgatatcagcctacaattggatcggtggctctatgatgaactgatcttaaattgctgggtgacgcctgaaggaaatgccaacagcgaacggttcgattttgagtcgctgtgtggttggatgccgcgctttgttttacgacaaatgaagatgctgctcgcgacccatcagcgtctgcctcaagagggagtggcatcgttgggtttggtcatatag

SEQ ID NO: 2137 - DNA, 4437 bp, Xenorhabdus bovienii
  Coding sequence Name=Xb4151_4152.C432.gene34.dna; Position on contig =20903..25339bp; Strand=-
atgtggctgattaaacgggtttatatagatggcgcaggccatgaagaagctttctacaaagacctcacgctggactatattggcctgtctcaagcagtcgatagtcctgctattgaacggcagcgctcgcccgtcaggaatgcgaaggtggtgaccagtacctatcaacagcttgttaatgggggtggcaagtcaacttacatcgcactactgttatcgatttttgagccctccgttagtgatttcacccaatacttggctaaccgtcggcaaagtgaataccactaccgcaattatttctataaagagctctctgttatcctggtagagatggtcaatgaatcaggccaaacgttattactggggcatgctcatcagcgcaatggggatgatgttgaccgcacgctgtttatttgtgatgcgcctgactccctgttgggggcgccatttgacgaagtcccttcttattcccgcgcggaacgcgattctgagctacgttcctacgctaatagcctgcacagcttcgaaagctggcttaatctcaaagcgggcggcgagggggggatgcactggcgcaaaacctccaggcagagtgaatggcgcacatttttgctggaacaacaaatcaacgttgatctcatcaaaacaatggtgactttcaactccgaagaaggtggcttgacccgttttattgaatacaaaactgagcatgatttccttggtgcgttctttgcttgcaccatgtctaaagatgcagctgagcggttgcgggaactggtagcgcatgaagttgaacgtcagggagagctggaaggtatccgtcgtaacgagtcatttctcaaggacgtgctggctaactggcagacgtttcttgaacccgccaaacaactggaaagcactcagacgcagctgcaactgttggatgacggtttccgcgaatcaatgcgcgatctcacagcctttattggggaagctcagattgaacagatacaactagaagaagacacgggaaacttgcaaaaatacattgaccagaagaggtttctgcttgaacagttgggcaagcgcagaacgctgcttgaatatgatttcgcgcagcatcagctcaacaaacaaaaaaccaaggtcgacgcacttaaagatgaagccgatgccaatcaacgtcaaattgatattactcgtactgctatagactacaaagcttatgcgaaggtgcgggatgcgtaccgtcaggcagacgaagatctgaaggtattccaaagtgaaacggaaaggccactgcaggtgatttttgagcgtactgctggtgaggccttgggcgtattagagtgggcaatcaacaggcatcgccagcaggaggcgaaacttgtggaagagcaagggcagataagcaaggaaagtaatgcccttagacagtcatacgacgagctacaaaagaagttgggcggcctggaggtgggtcgtgacagatataaaatagacaaacgccagggtgaattgcaacgggaaaaactttgtgaagttgggttgatccaaaagggagaaacgcctagtgttgctcaataccgactggaattaaccttacatgatgcgcagcagagtgaagagctggctaatactgatcattatcagaaagagcaggcgctggaagcgcagcagaatgtcgtgacaaatgcgttagttgagcaaagtaaggcgcagcagacgtgcactcaagcagatctaaatcaccagttggcaatggatagcgcgcagggcttagtaaaaacctatcaaacactaccagcgtcaacgcaacatgatcttgatgttgaggacataagttggcacaacgagcggtgcggattacagctcgagaaggtattgaatgcgaatgctcaaacgctgaatgaaatgaaacagcgcttactgcaagcacagcacgaactggaagagttaaaactgacggggcatgaactggtcactaagcagaacaatcaggcgcttgaagcgttctatgcggcgggcattgcacgggataagctctgggcatttccccactatctggcctctgtcttcctcgatgaggcggagagtatcgctgcagtgatcgatcatgatccaggccgctacctgagcctggtcgcacttgatgatgcaacttttgagttagtccacaaaatcagtgagaaattgccctggaagaaagcacctattgctattcatctgctggatgaagcacaggatctccgcagggaaacgcctgaattggtgcaggtcgtcctctcaaaccccgataaacacggttatagcaaggccgcttacaatgcccggttgcaagagttggaggacactgtagcgtcgcaggagaccagtgtgaaggctgtggaggacgcctttaatatactggaatctttcaggggtgactggcgtttgcattacgatcagtatggtaagcattgggcaagactagttgatcaccgcgagcaggctcgcttactgctggaaaatgctgatgtagcacttaagcaggcggagcattatgcgcaaacactgcgcgacgagaaggctgatgctctggcgcggttaaacagtgctcaacagcaaaaaattcaggccgaaaaagcacgtgataaactgaaccgttttgttgaaatggaatgggcgaagcgtgaaacggcgataatgaaactggaacagctagccgagcagattcagcgaagcgaggagactcttgttaacctgagggaggcgcaagagcggcagaaagagctcgcggataacaagagcgccgaacaaacctgtataagtatccagattagcgaatggaataatctatccaacgagccgttctattcagagattacggcgactgaaggtatggaaggacgaagccccaaagatgcccatgagaaggctgctcaggcgctcaaacaattactcgaagcagccaacggtgatcaggttaccgccctcaagaaacaacggaaagatgctgaacaggcacaacgttacgcctctgagcgtttgatagctcaacccatctacagtgcatatccggatgaggtaaaagcggaggctatcaatgagctagcggtaattaacaaccgcatcacacgccttaacgaacagcagaggcaattcacgcagaatctaattaactcgaaggtaactctgcaaaatttgtcccaaaattgcgcgaatgcccgcaacgcgcttgatgaggactttgtgtggaaagagaaacccgtcgaaatagaggcaatccaaacgtctttggctgaaatcgccaacagcctccatgaaactgaataccagctcaaactccaactggagaaaaaagcgctgctgttgaagaagatggaaaatgtgaaagaacgactacagaacgccaaaacagctcaggcgacgatccagtccataactccgagctctgcggcgggtctgcctagtaggattctgagtatcactgagtatgctgacgcgctgagtaagcaatgccaaatgtacgcaagcctaaaagaaacgcttaaacagcaaagtatacgtgtcgctacggtctggggacacttccgcaaaagaatcgaagaagagttggctaagggcccagatatccgagccagtcaggaatacttacgacagttggactcagtcgcaacttatcatgaagttttgggcgacttggacagggtcggtacagggatcacgcaggtattcgaagcggtgcaggacagcttggaacaattccagcgttcgattgaactgactgtcacccatctgactgcacatctggagggggcgataaaactcctcaagcgcgcgatgtcggtcaaaattcctgatgactgtcctgtactgcctggtcggcccattatcaaaatgactgaccggctccgtgatgtcacagctgatctcaggggttttgccagtggccgcttacagcagtggatagcccgagggcaggtaccccgtgcgccaaaccgggatgccttgacagcagatttggttcagtcggtatttggcgaaggagagctggaagtacgtctgctgaagacgaacgccagtcgtccacaatggactcctgtcacccggctcgaaggctcaggtgggcagcgcctcacatctgcctttttgctgtttgtgacagtcggcaaagtgcgtgaatacgatacgggtatttcaagtgcaggattcttactggccgacaacccgttgggcaaatcgaatgctgatgacttgatgcgaattcaaacccaaatggccagggcttataaaatccagctcatctacttgactggcatctcggatgaaaacgcccagtcgatgtttgataaccatctcttcctgaacaaagttcagaaactgaggcggcgcgatctggtaaccgttgataaagaacgccacgccctgtggtcggcttccctggttgctaagccaaagtccgaaccagtcttttaa

SEQ ID NO: 2138 - DNA, 897 bp, Xenorhabdus bovienii
  Coding sequence Name=Xb4151_4152.C432.gene35.dna; Position on contig =25342..26238bp; Strand=-
atgtccgacaacacgcatcaacaagctaaacgctacgccgagattgccacacaggcaattatgaactcactgggatacaaaatgggagatgagccgctccaacgcgcgctagacctgcaaggtgataccttgtttgctgaaattatccgtggcgtcgcggcaggcatgaaattgcggtaccttgggattcatgagtcgtacggggtgttactggcagcagatggccgaggcccatttgctccgtctttaggttggctgaacaagcgcctgctgccagaaataacgggggagcagttgagtaaagaacgcaaagagcagcgactgtttgcaggcttgactctgattgcgctgctggccgagctgtttccaattccggacacggttcgtgtcgaattcggtcagagtagtgccattaatgctgcctcggtagtggccaggctcaatgatgttgccgaccaggtaattgtacaacgcaaggccgagggcgacgataccgtcgacggtctactaacggtggccaggtttgtgcaggaagaacgcattcctcgcattcacgacgaaaaggtgggccgtgtctcgagtattcgctcacaaacagaaatggccacgcgctggatacagctgctgcaggaggaaggttttctggccgaagacagcagtctgtcgggtgagtccgactggtatccgactcaaaagctcaaacactatctgcgccataccggcatcgaagagacggtgcgttttgtgatgagcatcagtccagccacagaagatcggtcgttagatctagttgaaagcgatatcgctgcattagtaggcaccccaaggttccctccggtcaatgaacgacctgcccccactggaacctcagatacgcaacgcttgctggagatttaa

SEQ ID NO: 2139 - DNA, 1470 bp, Xenorhabdus bovienii
  Coding sequence Name=Xb4151_4152.C432.gene36.dna; Position on contig =26241..27710bp; Strand=-
atgtcgctagagtttttggagcaggctcgtaatgaatctatggcacgccgcgagctgactattcagtctcatgcattgctggtcgtgcggacgctggattcaatctatcgcaccctacagcgcaatccgtgggaaggcgtcgagcttgatgcgctggcggctattatgcatctctttgacgctatgctttattatgctgaccgcgagcgccaacccggtatgacgcggaaagaagcggagttatgcctggttgggcacctaaatgaagcttatccgggacaagaagcctcggcctacgcgcaggttgccagcaagatttttgcagcgattaaagaccctttccgtctccgttattacgatttcacgcaacgaacgcattccgaagaacagatagtccgtctggtccgctacgaccagctatccggctcagatgtaattctctggtcactgaccgatgaaggaatgctgttctataccctccgtttggatgaaacgccgattgagcgcgcggctattctggcctggcgcacgttaaaaaccatccgtcgcggtgagatcgacaaggccgtgcatcagattcagtcaactcagaggcaactggagcaatatctgattgggatgcggatgaaagtacgcgccgctcagtctggtgatttgagtgcatcctatgcgcgtgatattcgtccggtacttaatgactcatttgataagactggggaagtgctggagcatattcggaccacgatgtcggccattacggaaatgctcgttgatggacgctcagaattacaccccgataaattaaataagctgcgtaatgcgcaagagatttttgccgatgtctgcatatttactcagcgctatcaagactgcttacatgatgtgaacaaagattttgagcgagctcgcctgaaactcattattcccagagataacaccctttttcgtgaaacgctggaaaaaggtgcactcaaacccttgctgttacattcccccgacattgtcgaaaaggaaatagatgatctcatcacgcgcgtgctggctccccgaagtcaggatgatgatagacacatcctctttgaccttgaggcgctgctgaatctctatcttgatagatttgaacaagcgctgccacatgagatacaggaccctaccgaccagcccgtagctattgaaactaccctgcgtgggatccctgaatctgtcattaagaaatgcagtgattgggtgagtgaccggttgaagaatcgggggcatgtgagctttagagatgttttcgacgcctatgagtgcgacgaattgtccgaacaagaacaacaggtttgtttacttcatattggcagtgtggcggctaacagtgatcccacaatagaggtggagataagcggtgacgctatcgaaacagcgcggtggtgggctagcaatttaaaactgttaacggtagctcccgtacaccactttgaggagtag

SEQ ID NO: 2140 - DNA, 894 bp, Xenorhabdus bovienii
  Coding sequence Name=Xb4151_4152.C432.gene37.dna; Position on contig =27886..28779bp; Strand=+
atgtattactcaacgtttcttgagaaacacaaaacatccctcagccacgcacagtggttgcgtttgcgctatatcgagcgccagctactatgggagcgaaaagtcacttcacgcatgattgctgaagaatttggtgtctcagcgcagcaagcccgtaccgacgtacgaacctaccttgagatagcaccaggtaatgctttcgaacagggaggcggccgaaagggatattttcccagtgagacgtttgtgcctgttttactgggagacaacgacctaatatggcgtgcgacggctgagtttcaatcgccacaaacggctcacgcgcaggaaattccactcatacatcgcgcagtgcatagccgcacactggcaatttttttgtcagcgatcgagctgcggggccaagtgcaagtagtctatgcgtcaatggaaaaccctgaaggcacgtcccgtacactgacccctacgattattattaccgtcaatggccgtcagcatgtacgtgcctatgactgggacagttctacgtttaaggactttgttttggcgcgatttctgggcttaccggaactgattgtcccagctgcagccccaccgcgtgaagacacttcgtgggagatcgcgatccctgtacgttttattgtcaacccagctctaagcgaggcgcagcaggaagtgattgagcgagactacatactcgaaccacgtgagttcactattcgcgcaccgatgattttttatttgtgccccgagaacaatctgcctaaaaccgacgatgaatatgcacaggctacagatcccagtggtcaaggcccctttgtctatccaattcttgctgtgcatacccaaacaggtgagcctattcacaaataccgccatgcaggcgagagatag

SEQ ID NO: 2141 - DNA, 639 bp, Xenorhabdus bovienii
  Coding sequence Name=Xb4151_4152.C432.gene38.dna; Position on contig =28745..29383bp; Strand=-
atggccgctaatcttaccgagactgctatacgtggattgaagacaaaaagtactgcgtactacgtgtggagcaacagcgctcagcgtggcaccggcaggcttggtgttaaggttcagccttcaggcagtaaggttttttatttccgttattacgttgagaaagggaagaaagagaagttcatccagttgggcatctggcctgagatgaaactggtgatggccaatgagctggcgaaaaagtatggtgcctggcttattgaaggaaaagaaccgcaacaagagcttgagcaacaacgcctggccgagcagcacatcatgcagcttcatcgttcgcagggatcgtttaaagaactggttcacggttacgtcaataagatgaagctcgacaacaagcggacgtgggctgatgtattgaagcgcatggagcgagagtgctacaccgttattcctcgtgataccaaagcgacagcatccttaatgaaagtgtgcgagtacttcaagccaaccctaggagcgaagatcgaccagtattgcttccgctcagatctccaggccatcatccgcccagtaacagcgcatggcaataaattagcaaacagaagggctatctctcgcctgcatggcggtatttgtgaatag

SEQ ID NO: 2142 - DNA, 138 bp, Xenorhabdus bovienii
  Coding sequence Name=Xb4151_4152.C432.gene39.dna; Position on contig =29344..29481bp; Strand=-
ttgcctgatatcctcattgtatcatccttacctgacccgttacctgacccgaaattggcatcgggtcaggtaatgctcatccttataaaggtagatttatggccgctaatcttaccgagactgctatacgtggattga

SEQ ID NO: 2143 - DNA, 156 bp, Xenorhabdus bovienii
  Coding sequence Name=Xb4151_4152.C432.gene40.dna; Position on contig =29409..29564bp; Strand=-
ttgaaatgttcggatttggctttgtttgtatttttaattgtctataatcaatcagttatgatgttaattttgtttctttttggttgcctgatatcctcattgtatcatccttacctgacccgttacctgacccgaaattggcatcgggtcaggtaa

SEQ ID NO: 2144 - DNA, 93 bp, Xenorhabdus bovienii
  Coding sequence Name=Xb4151_4152.C432.gene41.dna; Position on contig =29672..29764bp; Strand=-
atggagggaaatatgagaacacttcattaccgtagcggtgttaatcggttatacctcacgctactgccagaaggtatcctatgggtatcctag

SEQ ID NO: 2145 - DNA, 621 bp, Xenorhabdus bovienii
  Coding sequence Name=Xb4151_4152.C432.gene42.dna; Position on contig =29894..30514bp; Strand=-
gtggcaagggccaacttttgtcagaggtgtcagattgtctacaatctgacacctcagcgatgggaaacccattcggcggggtggggagcgaaaggcgaacgtcagtatgactgggttcgggtaccgctctggcgtttacaactcagtgagaaagaacgggaatatggccattatctgctggttcgtcgcagccgggatgaaaaacaggaacgggcttactatatcgtgtatgcgcgcagagaccaggcggctctgaaaaccctggctcaggtggcaggttgccgctgggaaattgaatggggttttgaggaaacaaagggagaatgcggtctggatcattacgaagtgcggcaatggcacagttggtatcggcacatcaccttatcgctcctggcccatgcagtgctggcagttttgagaaaaaaaacgccgacggggctggtagccctcagtgtggcggaactgcgtaggctattgtcaaaattgatgaaaaaggccggagagaccgtcgaacaggttttacattggtcagactggcggcggcgacatcaatactccgcacaacaatgtcattatcagagccgggataacctgatgattacagagcacttacgactgtag

SEQ ID NO: 2146 - DNA, 195 bp, Xenorhabdus bovienii
  Coding sequence Name=Xb4151_4152.C432.gene43.dna; Position on contig =30466..30660bp; Strand=-
atgcgggaacgcgcattcgaggccgggatgccttgtcgctgggtgacggcagatgccgtttatggtcaggatcgccgcctgcgctgctggctggaatcccgatatcaaccgtttgtgctggcgatccccaaaaatgaaccgttgtggtggcaagggccaacttttgtcagaggtgtcagattgtctacaatctga

SEQ ID NO: 2147 - DNA, 588 bp, Xenorhabdus bovienii
  Coding sequence Name=Xb4151_4152.C432.gene44.dna; Position on contig =30615..31202bp; Strand=-
atgcacttaccgactcacgcctgggaacaggaactgctctcactccatactcgtctggctccgttgtttcaccatcccggcccacaacaacgcagcctcgcttatctccggggactgctcagtgacgttgagcgtaaaaatggctggcaactggcggaatggataggcgaacgtacgcctgatggggttcagcatctgctggagcgcgcccactgggatgttgatatcgcccgcgatattttgcgcgactatgtcacagagcatttgggggatgaacacggggtgctcattgtggatgaaaccggctttatcaaaaaaggcacgcattctgccggtgtgcaacgtcaatacagtggcaccgccggtcgcgtcgaaaacagtcaaataggcgtctttctctgttatgccggtcagggcggtcatgcctttattgaccgggcgttatacctgcccagacaatggacgatgatcggccccgctgtgaagctgccggcattcctgacgccgtcccctttgccactaaaccccaactcgcccggcagatgcgggaacgcgcattcgaggccgggatgccttgtcgctgggtga

SEQ ID NO: 2148 - DNA, 180 bp, Xenorhabdus bovienii
  Coding sequence Name=Xb4151_4152.C432.gene45.dna; Position on contig =31118..31297bp; Strand=+
gtgggccgggatggtgaaacaacggagccagacgagtatggagtgagagcagttcctgttcccaggcgtgagtcggtaagtgcattgaacacctccccgtatttcaggaaaaaatgtcaggcgttatcatgccacaatggggcgtacggctgtagtactaagttgattacgcaaacctag

SEQ ID NO: 2149 - DNA, 177 bp, Xenorhabdus bovienii
  Coding sequence Name=Xb4151_4152.C432.gene46.dna; Position on contig =31320..31496bp; Strand=-
gtgaccaaaaattttaaagttgcatatacagatactcaaggcaatcacactcattctgtatatataggttcccatcaccatactgtttcaggagtaacagcaaatacgggcaatggggagataatagatattaccaatggttatattatgttgatgggatggtgtaggttaaaataa

SEQ ID NO: 2150 - DNA, 144 bp, Xenorhabdus bovienii
  Coding sequence Name=Xb4151_4152.C432.gene47.dna; Position on contig =31422..31565bp; Strand=+
atgggaacctatatatacagaatgagtgtgattgccttgagtatctgtatatgcaactttaaaatttttggtcacgtattcatcccgttgtttctcacgtataatgagggtaaatacgtgagggatagtgatggcattagttga

SEQ ID NO: 2151 - DNA, 276 bp, Xenorhabdus bovienii; identical to SEQ ID NO: 1198
  Coding sequence Name=Xb4151_4152.C432.gene48.dna; Position on contig =31552..31827bp; Strand=+

SEQ ID NO: 2152 - DNA, 366 bp, Xenorhabdus bovienii
  Coding sequence Name=Xb4151_4152.C432.gene49.dna; Position on contig =31881..32246bp; Strand=+
atggggtcattcatcagtaacaaaaaacggcaacgctggctgtggtacgcgtgggagcctcgcttgaaacgtattgtcgctcacgcttttggcgctcgtagcaaacagacactcaggacgttgctggaaaagttatccgcttttgatgtggcattctggtgcaccgataatttcggggcatatgacatattggctgatgagaaacatatcaccggtaaactttatactcaacgtattgaacgagaaaatctgaacctgcgtaacaggctaaagcgactcaatcgcaagacgctgggttattctaagtcagttgaaatgcatgacaagatcattggcacattcatcgaacgtaagttctattattga

SEQ ID NO: 2153 - DNA, 222 bp, Xenorhabdus bovienii
  Coding sequence Name=Xb4151_4152.C432.gene50.dna; Position on contig =32240..32461bp; Strand=-
atggactatcaattcaaatcatatagtcagggtaacaagaaaaaatcattacctgtttactttattcttgtcccttttggcatctggatagcttacatgatttggtctataagtttaggccagagagttgtgatgttcgaatggttcccaaaatggaccatttctattacttttgccgcttttgtgggtcgtgtattcaacctgttgattggccatcaataa

SEQ ID NO: 2154 - DNA, 105 bp, Xenorhabdus bovienii
  Coding sequence Name=Xb4151_4152.C432.gene51.dna; Position on contig =32529..32633bp; Strand=-
atgaatgatgatatatacgcaattaacttgaagatgcaggttttagggtctggaaattatcagtcagccgagtcgccagttcctgtactttttctggcaatgtga

SEQ ID NO: 2155 - DNA, 1050 bp, Xenorhabdus bovienii
  Coding sequence Name=Xb4151_4152.C432.gene52.dna; Position on contig =32825..33874bp; Strand=+
atgattgcgcccatgaaaattaatctaacagatgcccaaaaagaagccctcgaattgatgcatgatacgactcgcgatggacgagtacgtgaccgcatcaaggccgtgcttttggcctcagaaggctggactgcccagatgattgctcaggctttgcggatctatgaaagtacggtgagccgccatctgaaagattacttctctgaggaaaaactcgcccctgaaaatgggggctctgaaagccgtttgtctgccgaacaaacaacagaattagttgagtatctgatggcaaatttgatgcacactaccgcacaaattgtggcctatgttcgggcacgatggcaggtgactttcactgtcgcaggaatgacgaaatggcttcaccgtcaaggtttcagctacaagaagccaatgggtgctccgcataaatttgatgcggataaacagcaacagtttattgaaacctacaacgcgctgaaagaagaatgtggccagaatgcgcctattttatttattgatgcggttcacccgaccctgtccacaaaattaagttatggctggatgaagagcgggcggaagcacgtcaaagtggttgaaaccacaggcagtcgtactcgactcaacatcatgggtgcccttaatttacaacggattgaagagactattgttcgtgaatatccgacgattaacgcgaaaaatgtcgtcctttttttcggctcaatccgggaaacctacccactttcgcaaaaaatccacattattctggatggtgcgggttatcaccgttccggagtcgtccaattttttgccgaggttttgaatattgagttgcactacctgccgccttacagccctaatctcaacccgattgagcgattatggaagtatgtgaatgagcaggtacgaaacaatgtctattttccggataccaaaacattccgtgaaacgctgtgccacttttttcatgtcacattgccagaaaaagcgaaagaactcaccactcggttgactgataacttccagattttaaaacccgcctcttcaagttaa

SEQ ID NO: 2156 - DNA, 195 bp, Xenorhabdus bovienii
  Coding sequence Name=Xb4151_4152.C432.gene53.dna; Position on contig =34069..34263bp; Strand=-
atgtcccttaacagccaccttcatattggaattacccatagccccatccggcaagttttcaccaatagcaggcagggtaaactcaatgccgttatgttgattaaaatggagaaaaaccgctttatcagtaaaaccatttcagtgaatggcactcaggggcggtttgtggttctgattttcaaggatgaagattga

SEQ ID NO: 2157 - DNA, 369 bp, Xenorhabdus bovienii
  Coding sequence Name=Xb4151_4152.C432.gene54.dna; Position on contig =34225..34593bp; Strand=+
atgggtaattccaatatgaaggtggctgttaagggacatgtggataaattaaacagtaaagatatttttgtcaccgaacagattggcatgtatttaaaagatacctatgattttgttggcgctaatgaacctttaggcatttggagtaaaaatggtatattagataaaattagttccgttgattatgccgctctttatgcgactggaagttggctggccttatggattaaatataatgggtatattcctgtaaataatgatagttttagaaaatggcagaaaaaacataatgaaggtagtgattttattgttttttctgatattttatggatgaacccgttaccacaatataaaactattcacctatga

SEQ ID NO: 2158 - DNA, 399 bp, Xenorhabdus bovienii
  Coding sequence Name=Xb4151_4152.C432.gene55.dna; Position on contig =34590..34988bp; Strand=+
atgaaaaataaatataaattcttttttagaaaaccatggctggttttgttttttatcattatttttataatatggatgttatttccatcaacattgttcttcggtaattggaataaatattttgaggataggggtgaagatggtcaatataccgcagtggtatataagaaattgccaatatctccatatgcaatgtggaagtatgtcattttgggagacaaatattttattgttttatatgataataaaaacagagatatctggaagagttctccttttacgtcaatatcatatggggcattttctgcctcatttagccttccaaccgctaataaagatgcttttatctatccaacaaatgatggatatgaagtcatctatgtaaataaattaaaataa

SEQ ID NO: 2159 - DNA, 291 bp, Xenorhabdus bovienii
  Coding sequence Name=Xb4151_4152.C432.gene56.dna; Position on contig =35164..35454bp; Strand=-
atgccgaagtacggtattcaggccaatccccatcactcgtgctgtcgcccgacatcccgttccattcatagccatatcgacgatttgcttatgggtaccaagacgacaagcggcataagtgaactccagttgccaggagtgacggcaggattggcaaagataacgttggtgaccagaacgcgagcacccattgcgatggatccctttcactgcggaacaagaggggcaagttacatcaatctttgccatttgaatgttttccaaatagacagactatacatgattcaataa

SEQ ID NO: 2160 - DNA, 324 bp, Xenorhabdus bovienii
  Coding sequence Name=Xb4151_4152.C432.gene57.dna; Position on contig =35400..35723bp; Strand=+
atgtcgggcgacagcacgagtgatggggattggcctgaataccgtacttcggcatttaaaaaactcaaacccaaatcggtaacagaagcgattaaacctggcactgaagtgattgtctgctgcgaaatggatgaacaatggtcttacgtaaagtcaaagaagccgcctcgttggctcttttatgcctacgacagaataagacgaaaagtgatcgcccatgtttttggtccaagaacaaaaaagacattaatgcgcctattcatatacaggctcttaagcattaagcctttcaaaacacgcatccaatgttttgtatttacatga

SEQ ID NO: 2161 - DNA, 1275 bp, Xenorhabdus bovienii
  Coding sequence Name=Xb4151_4152.C432.gene58.dna; Position on contig =35673..36947bp; Strand=-
atgaagcctgtgacgattatcgctataaaacaccagttaatgcaattcttcagtgacatttctttgcaacatattgccttccaatgtgcgtttatgaaacgcatcagaaatatcgagccccacgtgttgatcctcagccttatcgctgcactgagcacgggtaaaatcacgtctattgcccagttacaccaaaaatttaatggcctgtgcccggataaaaagcaaccagtcagttaccgccccttttataaccagctccgtaaagcggcttttgtcgaatttgtcaaaatattggtcagatttgccatggcgcaatgggtagagaaacaggtctcctcaccccaaaaactcatgaaatttaaacaggttattctccaggatgggagttcgttcaaagtccattctgccctggccgatgtttttccctatcgcttcaggacaacgggggccgcggtggaatgtcacatgacaatgtccttgctgactcagtcaccggtaaaaatgaccgtgaccgcagataccgcccctgagcgggcttacctgcctgtaccggcgatgttacgtgaccaattattattggccgatgccggttatgtcgactttgcgtattttgagcaagtgtcactttccggtggttcgtttattgtcaggggaagcaagtcccttaatcctcagatagtggtgacccgcaatggtcaggggaaattattgcccaagctgctcaataagccgctgaaatccatcactcgccgaaccaaccgttccgaagtgctggatctgatttgtcggcgtaatggctatgaatttcgcttaattcgtcgctggtttgccgaagaaaaacgcttttgtctctggttgagcaacttgtccgtggaagagtttacggctaatgacatcatggatatttatcgttgccgctggcaagtagaactgctgttcaaagagttaaaatcacacacaaactggcatcgatttgccacgagaaaagaaacgttagtcacgggcctcatttggctgagtttgctggctctgttgctcagacgttcgctggccagcagattattccccgccgtttcattgctcaaagcagcccaaaatacggaagtctggctgtggcccataatcgaaaacctactccaacgggcgtggtcggaaaccggtttttggctggaaaaagcccaagcgtatttatgtcagaatgcgttcaaaacaccacaaagaaaatcatgtaaatacaaaacattggatgcgtgttttgaaaggcttaatgcttaa

SEQ ID NO: 2162 - DNA, 276 bp, Xenorhabdus bovienii
  Coding sequence Name=Xb4151_4152.C432.gene59.dna; Position on contig =37045..37320bp; Strand=+
gtgcgcctattagctttactggcacctttcaacattattatttatatgacagatggctggaaaagttacgaaaaagcactcgcagggaaacgccatgtggccagcaagcgttatacccaacgcatagagaggcataacctgaatcttcgtcaacatttggcaagactgactcgcaaaacattgtctttttcaaaatccatagaaataatgggatggacgccccattcaagcggcatcagtgtgccaaaatggaagtgtattaacacagttatttaa

SEQ ID NO: 2163 - DNA, 276 bp, Xenorhabdus bovienii
  Coding sequence Name=Xb4151_4152.C432.gene60.dna; Position on contig =37283..37558bp; Strand=+
gtgtgccaaaatggaagtgtattaacacagttatttaataacgggagcgtccaccatgaagatgacaacggttggtatcgatctggcaaaaatgtctttcagatccacggcgttgatgcacaagggaaaacggtgctcaaaaaacagctaccacgcgcgaaaatgctgacgtttttcgtcaaccttcccccctgccttattggtatggaagcctgtggtggggcgcattattgggcacgcaagctgcgaagttttggtcacgacacgcatctttga

SEQ ID NO: 2164 - DNA, 141 bp, Xenorhabdus bovienii
  Coding sequence Name=Xb4151_4152.C432.gene61.dna; Position on contig =37500..37640bp; Strand=+
gtggggcgcattattgggcacgcaagctgcgaagttttggtcacgacacgcatctttgacttacggcattcaaccaagattgatacggttggtaaggtcgcaacggctatcggacatcaattaacggtgtccattgaataa

SEQ ID NO: 2165 - DNA, 783 bp, Xenorhabdus bovienii
  Coding sequence Name=Xb4151_4152.C432.gene62.dna; Position on contig =37705..38487bp; Strand=-
ttgttaaccgcctgtggcgttgatgttccggcaaaggggaagcatggcgcttgcccgatatgcggaggcactgaccgttttcactttatagatgataaccatcatggcgactggcattgtcgccagtgcgatcagcccaatcacggggatggtctggatttagtggcaagagctaaaggtatcactattctgaccgccgctaagcaggttgctgatgtattggcaattccattccctgaacccaaaccagttaaagagcagccccgaacagtgaaacccattgcagaacggatcgcggagctggtggcaaaatcgataaggggagaatctccgtatttggcgagaaaggggctgcaatgccccaatcagcggctattacagaattctctattgctggtaactcagacactggacggcactatcacgggcgctcagaccatcaaaccgaatggtgaaaagcgccttgtctcgggtacacagaagaaaggaagctttattctggcatctgaaattatcggaacgccggacaccatcatcattaccgaaggctacgcgaccgcgttgactgtcagccagttacatcatgatggcacggtactgtctgccattgatgaaagcaatttactgaatgttgccgaattggtcagaactcagtggcctgaatcgaaaattatccttgcggctgataatgactggcataagcaaggggaaaaggacaaaagcggaaaactgaaaaagaacgtgggcaaaattgcagctgataaactaacagagttactctaa

SEQ ID NO: 2166 - DNA, 114 bp, Xenorhabdus bovienii
  Coding sequence Name=Xb4151_4152.C432.gene63.dna; Position on contig =38491..38604bp; Strand=-
atgtgttatttgctctctgattgttgccgatacatcataattactaggtcgcctttcgtagctatcttcatagtctggccgtcctgtatctggtcaagttcaaatgcgtcataa

SEQ ID NO: 2167 - DNA, 1122 bp, Xenorhabdus bovienii
  Coding sequence Name=Xb4151_4152.C432.gene64.dna; Position on contig =38715..39836bp; Strand=+
atgtcctctgtcagccctttgttacagcattttgcctcacttgaagatccccgagttcaacgaactcagttgcatagtttggaaaatatcctgactatcgccatctgcgctgtgatttgtggcgctgaaggttgggtcgaaattgaagagtttggcgaatctaaacaggatttctttacccaactgcttgctctcactaatggcatcccctctcacgatacctttggtcgtgtctttgctgcacttgatgcgcaggcttttgccgactgtttcacctcctggatatctacgctggcacaaggagttgatcaggatatcatcgctattgatggcaaaaccatgcgccggtcactcgataaagccaacggcaaggcggcaatccatctggtcagcgcctttgcctgtaccaatcgcttagttctgggacaagtgaaagtggagagtaaatccaatgaaatcaccgctattcctaagttacttcgacgattggttttgtctggaagtctggtgactatcgatgccatgggatgccagaaagcgattgctcatcaattacatgaagcgggcgcggattacgtactgagcctgaaagaaaatcatcccggcctgtataatgatgtcagccattatttcgattatgtctcatcccaaccggagcgcctgagcgaatatgaagacgtggatgccggacatggccgcattgagcgacgcacagtacaaatgacccatgttgattggttgccggaaaaggcgtgctggtgtggtttacacagcataatacgggtgatccgcgaacgctatgtaggaaatgaagtgagccgggagagctgttattttatcagcactttacgtccgacagaggctcaacgggcagcgacagcgatccgcagtcactggcaaatagaaacgcaactccattggtgtctggatattgcttttaatgaagatcagcagcgaatgcgggaaggcaatgcagccgccaatatggcattactcaataaaatcgcgttgaatttactgcgcttagctcccaccaaagcgggaattaaagcacgccgtaaacgggctggttgggatggtgaatatctacttacagtactgggcaaagcgcatcaaatttag

SEQ ID NO: 2168 - DNA, 114 bp, Xenorhabdus bovienii
  Coding sequence Name=Xb4151_4152.C432.gene65.dna; Position on contig =39790..39903bp; Strand=+
atggtgaatatctacttacagtactgggcaaagcgcatcaaatttagatgcgattgccttgggtggcaggagccatcctgtctcctgtttgattgttattataaacagtattga

SEQ ID NO: 2169 - DNA, 246 bp, Xenorhabdus bovienii
  Coding sequence Name=Xb4151_4152.C432.gene66.dna; Position on contig =39910..40155bp; Strand=-
ttgttcagtattattcgcttgttgttgggtggagatgggtttattagatttactcgtctttgtgataataacgttgtaaaagatgtggagaatgattatgaaaaaatatcttcttctttgcctagtagcaggcacgactcttttagcttcaatgcagacttatgcttctttctgcttacctttggctctgtcacccctattatatgcagagtgtacagctacttgtcttttgttaaattcggataa

SEQ ID NO: 2170 - DNA, 255 bp, Xenorhabdus bovienii
  Coding sequence Name=Xb4151_4152.C432.gene67.dna; Position on contig =40225..40479bp; Strand=+
atgccatcagttaacacgggtggcatttttgtatctgcatttcaccgcgcaccgcagcgcaattctaacgtcgagcctttatttaggaatgaacctttgaggaatcagctaaaactgatgctactctacatacagcggctaacacatcaaacggggcgactggctgaatgggtaaaaaatcagcttcaaaaaaacactcttgtgtggttgcttgtgcactcgcgaacaagttcgctcggattgcttgggcaataa

SEQ ID NO: 2171 - DNA, 96 bp, Xenorhabdus bovienii
  Coding sequence Name=Xb4151_4152.C432.gene68.dna; Position on contig =40587..40682bp; Strand=+
atgactgaacggcctgacggcctggtgataaacctaacaaaaaaaatggctcatagaagccgggcggttaatgagatggtccccaccaccctgtga

SEQ ID NO: 2172 - DNA, 1041 bp, Xenorhabdus bovienii; identical to SEQ ID NO: 1042
  Coding sequence Name=Xb4151_4152.C432.gene69.dna; Position on contig =40688..41728bp; Strand=+

SEQ ID NO: 2173 - DNA, 207 bp, Xenorhabdus bovienii; identical to SEQ ID NO: 1041
  Coding sequence Name=Xb4151_4152.C432.gene70.dna; Position on contig =41754..41960bp; Strand=-

SEQ ID NO: 2174 - DNA, 168 bp, Xenorhabdus bovienii
  Coding sequence Name=Xb4151_4152.C432.gene71.dna; Position on contig =41964..42131bp; Strand=-
gtggcgtacgggctttgtacaatgcctgtagacaatctttttcatagaagcgtcgctcaaacgcattgtagtgcccgagcaaatcatctctgtctcgccagccagcctggacggaaatatccgtacaaaatctatggtccccaccttttttgcaacactgatttttga

SEQ ID NO: 2175 - DNA, 816 bp, Xenorhabdus bovienii
  Coding sequence Name=Xb4151_4152.C432.gene72.dna; Position on contig =42050..42865bp; Strand=+
ttgctcgggcactacaatgcgtttgagcgacgcttctatgaaaaagattgtctacaggcattgtacaaagcccgtacgccacgctgggaggatacctgtaatgtcatcctgcttgacgagatgaatctgtcacggcctgagcaatattttgcggagtttttgtccgcgctggaaaaaaacaatgcagatgaacgtttgattagcctctctgagacggcgttgccaaacgcaccgcagatgctgcgggaagggcgcaaaatcctcgtgccgggcaacgtgtggtttattggtaccgctaaccatgatgaaaccacgaatgaatttgctgataagacctacgatcgtgcgcacgtgatgacattaccaaaacaggatagtcaatttaagatcaagccaatggggaaaaggcattactcctttagttcactgcgcaaagcatttgaggcggcgcgccagaaacacaaaggcgaagtgacggaactactccaggcgctaactcgcgatagctttaccgattgccttgaccgcgagtttaatcttggctggggcaaccgttttgaaaagcaggcgctggattttattcccgttatgctggcaagtggtgcaatgaaaggtatcgcgctggatcatttgctttcaacacgcgtgatgcgctcaggtaaagtcacggggcgctataacgtgagtgttgatgccgtcaaggcactgaaaggggcgctggagtctttctggagtagagaaaaactggtaggtgagccggtcaaatcgctggaatttctgaatgccgatatccgacgcatggagggacggaactga

SEQ ID NO: 2176 - DNA, 1818 bp, Xenorhabdus bovienii
  Coding sequence Name=Xb4151_4152.C432.gene73.dna; Position on contig =42865..44682bp; Strand=+
atgtggctggatcggctaacgggtgaaacaatatctcagctgccatcacagattgaagcgggtcgttatcagcttgcggtctcgtctttggtcttcaacagccacaccacggacttttctggtgtgctggttagcgatggcggcgagcgttgccagttgggagatgaggtccggacatttgtcatgccgcgacaggttaagtccaataaatccgccttacttttcagggcggtagaaaccatctatccggacatgatgccttcgtcagcgttgatttcgcctctcatgcctggggcgatcattgaccagcaaagccagcttctgccatttgaacagaacttgctcgaggtggtgaagaaagggcatctgcaccaaatttcacagcggccgcgtttggatgttcattacgaagacgaagtcgcggatatcgcccgcgcacgacgtcttgcgaaaggtgcgctggtgcatctggcctcgcattcagagtgctggcagcggcagacactcaatggcgtcattccccggaaggtactggcgcgttttagccatgacgattacgacatttatgaaaatcgcgtttatgcgcgcctgctcgataaggcagaacgtcatttgcgcacccggctatcgacccttctaagcctgcaggtcacactggagcaggctctggaattttaccaaacggagggtactcatcaccttctggcctatgaggtttgtcagctctggggaatgacatttaatgaggataagacaaatcaggcgttggttcacctgaatgaaactgtggacacccttcacatgttacataaaaccctctctggtttgcaacaaacggggttgtacacactggttaaccgcaatgcacaggtcacggggatactgcatccaacaaatattcttggacatgacccgcattaccggcatttgactatgctttgggaacttctcgatagcacaaccgtggagaaaaccacgccacaggaacgtttccggcataatcagtatctggtggaagcttattcgcgttatgcaggtctggtattaaggcatgcgctttacccttatctgcagggcgaaagcgaaggtttgtgggcaggtaaaacattgcaactcgcacaaaaggggctggaatggcatttgatttgccggacagagaagggtaattcagcaggtaatacattgcttattctggttccgtggctcactgacctggcggagcccattaacgagacgaaactgacctctgagcgatttgttgcatggccgtctcaggatttggcgctatcaccctcaggctacgtggataactggatcgcgctttcgccgtcagacatgtactgtgtcgaacgttttggcctgcttattaatcgaaccctttaccggcaggttctgaaatccttcgctagaccaatcactaaaattccgacgaaagcgctagccgtggcggaaaaaattgcacatatccacgttgaacatcaatcacattgcctgacggtgcaaggtgaagtggcggatatcgatttggaaaaattaaagcgcacattgaaagaagcgaacgcacatgaaaaagcctctgatgtcgtgcagcgttgtcgggagattttgtttctgcaaagctgcccggtttgtcagcacaaaacaactattgctttccagcctcctggtggttttaagacgatctgtggcaagtgtggtacagagcgttatctaaggcagaaagaggaagggttgtttttggagcaaacaggcaccaaaggtgtgcaaacaagcaattttatgactctgggaaaacgaagtttctccatgcagatttaa

SEQ ID NO: 2177 - DNA, 279 bp, Xenorhabdus bovienii
  Coding sequence Name=Xb4151_4152.C432.gene74.dna; Position on contig =44767..45045bp; Strand=+
atgacatcaattcactctgctcgcacaataagaatgagatttaaaatatggaattacatggtcatttgttgtatgtggatattacttagatatgcggtattggttgcgttttttgcatgtacgcggatatctttgcttgccgatgccttatcgactggcttggctgaagaaacgtacgcatgggggaatccaggcgctatcaaaaatattgtggcgcaggccagagacttaatcgtaaccattaccgatgagcaattaatctgggagcaggtatactga

SEQ ID NO: 2178 - DNA, 327 bp, Xenorhabdus bovienii
  Coding sequence Name=Xb4151_4152.C432.gene75.dna; Position on contig =45008..45334bp; Strand=-
ttgtttgattttgtacaactagggttattaggtggattgaatgggtttggaaagtattatgccaggtcgatagaaaatgagggcacacgtgaccttctggttctaggaaaattactaaccttaatcgagccacagatattgagacatatcaaagaagatgttgcgcgtgattggccgcaacagcaaaatatagctgaaagtatacaacaggaagatataggaatgtttcttgtattagtgagattaccgagggagactgacggacaaattaccgagagatgttgtcgtttcagtatacctgctcccagattaattgctcatcggtaa

SEQ ID NO: 2179 - DNA, 162 bp, Xenorhabdus bovienii
  Coding sequence Name=Xb4151_4152.C432.gene76.dna; Position on contig =45364..45525bp; Strand=-
atgaaaaaacggcaaaaatcgtcgacatcgcagaaaatttcaactaagttgtccatagcctattcccctaggaactgtgttaggcgttcaccaaaactttgctcccggaacaggcttctcgtcaatttcttatccagaattcgggttaataaggtattatga

SEQ ID NO: 2180 - DNA, 390 bp, Xenorhabdus bovienii
  Coding sequence Name=Xb4151_4152.C432.gene77.dna; Position on contig =45470..45859bp; Strand=+
atggacaacttagttgaaattttctgcgatgtcgacgatttttgccgttttttcattcctcagtgggagcggttttgtctcgataacgggtaccgttttcgttgtcggcaaggtcacatgtatctcagtgaaatcatgacgattttgatcctctttcatatgtcacattatcgtgactttaaagccttttatttgaaattcctttgggtctatcaccacaaagattttcccaccttgctcagctatacccgttttgtcagtgttgcgccttccgttatggtatcgctaagcagctacctgagccgttcatataatcatgctacctaccttgatgaaaagaaggcaatgatgcaagaatggtctgctaatcttgatgagtggtctggatag

SEQ ID NO: 2181 - DNA, 1620 bp, Xenorhabdus bovienii
  Coding sequence Name=Xb4151_4152.C432.gene78.dna; Position on contig =45943..47562bp; Strand=+
atgcggacagtacggatgctttttgaatatgcccttaatgattcaaacacaatagttcacgtagattcagtgccaaacggaaagcgctgtaactgtgtttgtaagcactgtggtgataccctcattgcaaggaacaatggaaagatcgtcacacaccacttctctcatactacaaaggaagaaagccgtgactgtcggatgacgcagttacatatagcgatgcaactacatttttcttcgctatctgaaattactcttccaacaaatgagataaccatcgacgaaacagatattgttgttttcgacctaacaactgaagttaaaaaatcagtactcgaatataggatcgggccctacctggcagacgtatatcttgcgacagatactggctatgtagctattgaagtctgcgttactcacaaatgtgatgaggataaagaacggtattacattgaccaacaaattgattcaattgagtactactttcctcttgctaaaggtaatagcatctctgaatggatttatctagtaagaaataatctcgtcgagtacaaatggatttatcactcagaacttgaaattaagaaaatcgagtattttaaacagatagaagaagagaaaaggaataaaaaggcagaaaaaagaaacagtgctttaacatcgcttcgtaacgccatatctagcaaaagaattcacttacccaatatacataaagagatggagcatatttatgcaggacaatcttacaaagaaagactgttgatctattccaaaagggatgtaacttgtgacaaggttttactttgccatgaatcaagtgactattcggtaatagaaggatatatagacaatcgcgtgatatcgattatctattcttttaccgaagagatacctactctaaattatcaagatgacagaagtatagtttgttgtcattattcaaatgaatcgaatacatcgacgtggacttgggttaagcatccatcattaaccaagaaatttgataaaataaagttacaattcagatctgattgcaagcatatctatcataaaagagtaaggtcagtatatctaaaggatgaggtgaccaagttcgcatccgaatacttagataaccgtcaagcttactttaatcgggactatcagaaatggagaagatggatgattaataaagagttatttatacctagccaaaataaaaaaaatccttcattccctgacatcttgaagaagagagagtatcgcatgctctggccattccaagcatgggatataatagtgttatgtaatctagcagaaatggtggatgcttaccctgttagccagaagatatattaccacgatttatttattgaactcgtaggaaaatatgatttatcagaacaatatcgatacctatcgaaagagtttaaagatttaaatacctctactactacctttgattcacttattgatgaagatagaataattcaaaatgtattatctacctttgactcacttattgctgaagatagaatgattcaagatgcattatctccctttgccaagatgagtatcatttctgttagcaaggatcacttaataagaaaaggttctcttatattagcactagtaatttag

SEQ ID NO: 2182 - DNA, 213 bp, Xenorhabdus bovienii
  Coding sequence Name=Xb4151_4152.C432.gene79.dna; Position on contig =47638..47850bp; Strand=-
ttgacgaccagttcgcaaattacttattcgattccaacaaaaactaaaaatagtgcgagaaaacgttggcaggcaggtttgagcgaggagcagactgatctgcttatagtcagcaatggttatcagcatcagaacgaaaggataattaatagtaatgcttctcaatcaataggggacagatcagcttggcagcgagagcagccctgtccctag

SEQ ID NO: 2183 - DNA, 501 bp, Xenorhabdus bovienii
  Coding sequence Name=Xb4151_4152.C432.gene80.dna; Position on contig =47898..48398bp; Strand=-
atgcttattgttgctctgctttcgatccttcccggaatggggtacgtgaaattgggccaggccgttgtgacgaagagatttcggcatttttcagggataatcatcctgaccatgatcctactcatcagtatgtatgtcccctcgttcattcctgtactcatcgataaatcgctgtctgccgctggcgtggcagactggcatatccggcgctatcagatagatgaaagcagaatgccgatggcactctttacgcgttctgagtggaaggttagtccactggtggctggcaaaagttttacggttgaaggaattctgatttattcccttaataacgttaaacttctgtgtccggccacgatcaaaaatgactatctgaatatgcttcactttgttccctgggacaaagactatgataaaaagcagggggaagtattaaagaaacatgcggcccgatgccagtcttttattcagggaggtgttgcccgaatcgtagaagagtga

SEQ ID NO: 2184 - DNA, 216 bp, Xenorhabdus bovienii
  Coding sequence Name=Xb4151_4152.C432.gene81.dna; Position on contig =48312..48527bp; Strand=+
atgccgaaatctcttcgtcacaacggcctggcccaatttcacgtaccccattccgggaaggatcgaaagcagagcaacaataagcatcgatatacccgtttcatcagtgtcgcaccttccgttttagtggcactatgtagttatctgaattccttatccagaattcagataccgtctcagtcattaaactgcaagcggtatttctgcgttaaataa

SEQ ID NO: 2185 - DNA, 129 bp, Xenorhabdus bovienii
  Coding sequence Name=Xb4151_4152.C432.gene82.dna; Position on contig =48495..48623bp; Strand=-
ttgcacgtacggttcttaggaggacggcacttggtaacaggtgtcgtctatccgacattgtgtgttagtgccgatggcgtgatgaaatcaggcacattatttaacgcagaaataccgcttgcagtttaa

SEQ ID NO: 2186 - DNA, 1095 bp, Xenorhabdus bovienii
  Coding sequence Name=Xb4151_4152.C432.gene83.dna; Position on contig =48679..49773bp; Strand=-
atgatagatagaacacagcaagcgttgcatcttcttgctttggatccaatctctgagacaatagctgatccgaacagttacggttttcgacctaaccgcagcacggcagacgcgattgcacaatgcttcaaatgcttgtgtcaaaaacgttctgcccgatgggttttggaagaggatctcaaagcctgcttcgataagatcgggtatcaatggctaattgaaaatattcaaatagacaaacggatgctgaagcagtggcttggatcggattttatcgataagggattgttttatcgaacagcggaaggaacaccgcaaggcggtattatctctccgacgctcatgctactgacgttggctggcttggaaaagcgtgttaaagaagtggcacgtaaaacggacgatagaataaactccatcgaatacgccgataacttcgtgatgacaggggcatcagaagatgtcttgttgaatgaagtcaagccacagctcattgattttctgagagaaagaggtttgacactctccgaagagaaaacgcatatcactcatatcaatgatggctttgattttcttgggtttaatcttagaaagtacagaggcaagctcctcataaaactgagtaaaagtaacgtgctattatttttgagtcacctgcgcgaactcattaagagacacgcaacgactccagtaaacgatctcatcaaaatgttgaatcccaaactgagaggatgggcgaattattatcgccattgcgtggcaaagcgaaccttcggctatccaggtcatcaactcttctggttgttatggcgatgggcggtcagacgtcatccaactaaatccaaagattgggtacgtcgaaaatactacatgaaccgtcaaggagaatggcaatttcatggttggcagaaaatagccaatatggacggccattttaatctggttcaaatagctcaaacgccgataaaaaggcatgtgaagattaggagtgtagcaacgctattcgatcctcaataccaaacctatttggctaagagtaaatcgaaaaaggaaagtcgtcactcttggcacgatcctgctctgactgcaatgtag

SEQ ID NO: 2187 - DNA, 315 bp, Xenorhabdus bovienii
  Coding sequence Name=Xb4151_4152.C432.gene84.dna; Position on contig =49838..50152bp; Strand=-
atgatggcttctacagaagtgagtgcctctcctaacggcacacagtggcaatccattgactggaaagcgattgagtcgcatgtgttaaagcttcaaatgcgcattgcaaaagcaacccgagagggtgaacacggcaaggcgaaagcgttgcagtgggtactcacgcactcgatattagcaaaacttcttgctgttaagcgagtgtctcaaaacaaaggcagtcacacactaggaattgacggcatcatttggaacacagatgctcgtcgcatggctgcggcaaatcaattgaagtcggaaaggctatcaagttaa

SEQ ID NO: 2188 - DNA, 210 bp, Xenorhabdus bovienii
  Coding sequence Name=Xb4151_4152.C432.gene85.dna; Position on contig =50072..50281bp; Strand=+
atgcgactcaatcgctttccagtcaatggattgccactgtgtgccgttaggagaggcactcacttctgtagaagccatcatttgcgtttctccttaaataaagttcttcaaatcatcttgcaatgggagacccgccagaagtcggctcgctttcgcgccagatatcaatctgtatccgcctcattacaacgcggccttcgctttttctag

SEQ ID NO: 2189 - DNA, 156 bp, Xenorhabdus bovienii
  Coding sequence Name=Xb4151_4152.C432.gene86.dna; Position on contig =50386..50541bp; Strand=+
atgcccactctagtacggagagtttatcgatcacgaaagagtactgcccaacttctttccaactctcgttgccattttggccacagcgtattaaccacttccgctgtttctcatataacgtaccttacatggattcacctatgttcatcatactga

SEQ ID NO: 2190 - DNA, 225 bp, Xenorhabdus bovienii
  Coding sequence Name=Xb4151_4152.C432.gene87.dna; Position on contig =50454..50678bp; Strand=+
ttgccattttggccacagcgtattaaccacttccgctgtttctcatataacgtaccttacatggattcacctatgttcatcatactgacaccctggcgcttacccgatctgtggttatcaggaagaacctcctctcacgattcgattcccattcagccttgtggccgaatttcgttacattgtcagatccgctgctttattcagaatcccagggtcacctggtga

SEQ ID NO: 2191 - DNA, 159 bp, Xenorhabdus bovienii
  Coding sequence Name=Xb4151_4152.C432.gene88.dna; Position on contig =50715..50873bp; Strand=-
atgggtaattcatttcccgggacaaaaaataatgtcaggaacacgatggccttttgggttaatcggggggtaggctgtcaatgctcatttcacgcggtgacccgttctggccgcttggtctataactcatttatgcccgtgcgacctgaagtcgtatga

SEQ ID NO: 2192 - DNA, 186 bp, Xenorhabdus bovienii
  Coding sequence Name=Xb4151_4152.C432.gene89.dna; Position on contig =50879..51064bp; Strand=-
ttgagattaagaaaccttcatcgtcatcagactgacgatatctgcttccaaaggtgcgcagatgtaccacacggttgtgtactcccttgcaggttacaggagtgttattgtcgctgcccgaaggtgatccttacaagcgaccggatcatcgataagtctgactacgctaataaacggaaatcataa

SEQ ID NO: 2193 - DNA, 207 bp, Xenorhabdus bovienii
  Coding sequence Name=Xb4151_4152.C432.gene90.dna; Position on contig =50995..51201bp; Strand=+
gtggtacatctgcgcacctttggaagcagatatcgtcagtctgatgacgatgaaggtttcttaatctcaaccatcatggccaacaggccagtcacccaacggggaacacgtttcctattgggtcaggtgttccccgttgttttatcaggagaataccatgcaacaaaatacaaccccggcaacggcacacactgtgcccgcgtctga

SEQ ID NO: 2194 - DNA, 435 bp, Xenorhabdus bovienii
  Coding sequence Name=Xb4151_4152.C432.gene91.dna; Position on contig =51152..51586bp; Strand=+
atgcaacaaaatacaaccccggcaacggcacacactgtgcccgcgtctgaacactccccttttgctgaaatttttccacaaaccagttcactggaattgatgctgctggaacacacgttcattaaagccgccgccgtgctgtgtgacgatgaccggtgtgatcagtgggagtaccggaaagtgtcagacaacatcgcctatgtcgtgccggcacggtcggattcatctgttgtcaacgtcaataccacgggctttaaaggcgaggtctccgccgatgccttcgggctgatggtgaccctgagcgtgttgggttatctggcggccctgatgaagctggacgggtacgctgaacggttttgcgacctgcgtgaatatgcgctgcaacatcctcaggctcagtgtatccgggcggctttaggcttaaaggatgcatag

SEQ ID NO: 2195 - DNA, 462 bp, Xenorhabdus bovienii
  Coding sequence Name=Xb4151_4152.C432.gene92.dna; Position on contig =51599..52060bp; Strand=+
atgccaaataatgaactgattatgctggacagtcttgcgctgtcggtcgtgtttcccgacaaaaccccgctggaacggttgtttctggggttcctgctggcgaataccgcatcaacgttatgcggcgattatcagcctgaacagtggacaagccgacaggtgtctgaatcgctgacttatatggtgccgacacgggcggaaacgtattccgtttacctgccggatacgcagctgacggtcacgctttcagccgatgccttcgggctggcggtcacggccatcgtatcagcccgtatcgcggtgctggagaccccgaatgaggaggtgtaccggttctgcgcattgcaggagtatgcacaacagcatccggaaagcggcctgataacatcgatcatgacactgaaacccagagaggacgttatcagtccgtcacttatccctgacaaaaataatcatcactga

SEQ ID NO: 2196 - DNA, 156 bp, Xenorhabdus bovienii
  Coding sequence Name=Xb4151_4152.C432.gene93.dna; Position on contig =52066..52221bp; Strand=-
gtgccggcctcatccggtgccggtaaaaaaatgggattcatggtgttgttccttgatttcacgttaaataaagaaaacacccgcccgataccgggaaggtgttttcgcttccccggtcaggcgctgaagaaaagcgttaacagcctcatgggctga

SEQ ID NO: 2197 - DNA, 555 bp, Xenorhabdus bovienii
  Coding sequence Name=Xb4151_4152.C432.gene94.dna; Position on contig =52181..52735bp; Strand=+
atgaatcccatttttttaccggcaccggatgaggccggcaccacattacgtgaagagctgtttaccgctcaggtcaccggcctgaggcaacacccgaaagcacttcaatcattgcagccggaaaccctgatggtgtgcgaagccgccaccgtcgcggaagtggtgcagcggctgaaggtgatccatctactgggtgactggccggtgccggagaggttatctgctcaggtttcggggactttttttccgctgaccgtcatgatttttgacgcacaggacagaaaagtgctcggtggccggtttgatgaagagattatctgggcgcagccggtcacactgacgtcagaacgcctgtcattggaacagcaacagcagcggttatgtcaggcagcgatgcttgagcagagctggcagaatactccgacggcgcgtgcgttgtggcacaaggcacatttattgtcactgcacatggtttcatcccgttatcagcagtgcagtgaagtgcaggatattctccggcacggcgtatctgtcagtattccggaggccgcgtga

SEQ ID NO: 2198 - DNA, 297 bp, Xenorhabdus bovienii
  Coding sequence Name=Xb4151_4152.C432.gene95.dna; Position on contig =52735..53031bp; Strand=+
atgaccactacacgtttaaccgtttggcaggtgattgcggcggctttgctgaaacggcattttggcttgaatctgactgacacggtattgtgtgaaaccggtacggtggcagcactgatagcccgcggtgtccggccttcagaagccattaacgaactggtggataaatacgacttaatccggctgaacacgcaggttatcctgcgcagtacgccttatctggatatccacgatgagctgacggttatttttgacagtggtctggctgacaggctattcaggcagaccggacagtaa

SEQ ID NO: 2199 - DNA, 924 bp, Xenorhabdus bovienii
  Coding sequence Name=Xb4151_4152.C432.gene96.dna; Position on contig =53124..54047bp; Strand=+
atggcagaatggtgcactaatcaactggaaatcaccggcaaatccgtctgtctcgatgtaatgcagcagtgggtctgcggggaagaagtcccccgttaccgtcaggcggtgttacaaagcctgcggttatttctggcgggttgtgcgggaatactgaaaccgaccaaaccacaaacctacactccgtacccggcgctggtgcgcggcacggcggtgccaacggcgcagcatctggcctttgagcagtggttgttgttgttacagaataatgtgccgctgaataatgacaatatcaaacgcattgataacctgtaccggcagtccggtctcagcctgatgtcctgggacaaggtgccggaagcggcgcgtgatattatcgcccgtctgctgacccgccagtataccgactggttcggcatggtgggctggtctgacacacccgatatcggggcatgctgggataagctgaatgcgtacccgcaggcggcacagccctgcgatatgctgatgatgatgtcaacgaatctggcgactgaaatcaacggtaacagcaccctgctgaaaggcattgccacgacagcgcagttttacgaagagcaatacgggctggaatggccgtttggtcaccatgtccgctgggagcgccgcaatgtcagcagcttaaccgtgcgctttgattccccctgggcaccgccttcacccgaactgatgggcgagctgtccgcgatgtttgactgtgaaatccgccactggtacagcgatgcgtcaggccagctcaaaggctacgattgctatgaccagggcgagcacgtggacagcggctacgggcagtcaggacgggaaaaccggccggcactctatctggtcaccggtgagcaggcggaaacggcactggctctgccggctatcgcggtcgggcaatag

SEQ ID NO: 2200 - DNA, 621 bp, Xenorhabdus bovienii
  Coding sequence Name=Xb4151_4152.C432.gene97.dna; Position on contig =54083..54703bp; Strand=-
ttgaatatacgccatcacggccgccagcgggtcaatatcaatcgcataaacccacagactgcacaacggatcgtgccccagctcccgcagcacttcagcggcggccaaagttatacagccagcaccacagcacggctcgcacaaggtgacaaacggttgtgtctgcaacagcccggcggcatcctgcaactgcatctgtgccatcattctggccacactccagggggtaaagaactgctgaagatccttatcacccagttccagccgcataaacacactacccagaaaatcaccgggttcctgcgccagtccgagcaccacatgcgaaaacaattgtacgatccggtcaacatcggcccgctcgtacttgttaatggttttcagataatactgctccagctcctcactgaaacagtgtttattgtggatcgctgccatagcacaattgcaaaaatcccggaagacctgataacgggtatgataacgggccgtttgcttaaacagcgaaataaattctttctgatgatcggttcgggaggccattgcgtgttttccttgctgaacaaaaagcgaaaaaaggaaaacacaccccgaaaagggaatagttcccctttcggttga

SEQ ID NO: 2201 - DNA, 252 bp, Xenorhabdus bovienii
  Coding sequence Name=Xb4151_4152.C432.gene98.dna; Position on contig =54596..54847bp; Strand=+
ttggccgccgctgaagtgctgcgggagctggggcacgatccgttgtgcagtctgtgggtttatgcgattgatattgacccgctggcggccgtgatggcgtatattcaattatccctgaccggtattccggccgccgtcaccatcggcaatgccctgcatgatggtggtgacaagcgaacccgttatacgcccgcgcattatctgggcaactggtctcagcgtttgcgggaggcggagcttatcgccgcctga

SEQ ID NO: 2202 - DNA, 123 bp, Xenorhabdus bovienii
  Coding sequence Name=Xb4151_4152.C432.gene99.dna; Position on contig =54966..55088bp; Strand=+
atgaaccgggtcagtttaattttcatttccgaaaaaagagttgttccttgtttccggcagggattgaccgacactgagccaaatctgaaccgaaagaggaaaagtgatgtttcagcgttttaa

SEQ ID NO: 2203 - DNA, 894 bp, Xenorhabdus bovienii
  Coding sequence Name=Xb4151_4152.C432.gene100.dna; Position on contig= 55072..55965bp; Strand=+
atgtttcagcgttttaaatcccgttttacccgccagaaactcccgcaacccaaatcacgcccaccggaagacagtcggtttttttttcaaccccaatcggctgacgaattgttagcaacgcccctgcgccgtcaatatctccaacaattatggcaaaacagtgcgctccctgaaggattgtatcagcgcttttatcttgcgccggtgaagcaattgctgggtaatgtccagcaggtgccggcaaccccgaagggggaatggtcagcgtcggggggatttgctgatctgacgctggcatttaccacctgtgctgtacggctggcaaaagggcatatgctgcctccgggggtaccgccggaaacccaggccgtgcaaagtctgctgtggcaggcggtggtattctgggtcgcgttgttttatcacctgccgctgttgcggcaactggaaggggaactggaagacgggtatcactggcaaccgggtgtctgtgtgcctgacaaaccctttcgtttccgctttcgcactcctgaaaacacgccttcgatcccccaggaagcgttgctggcggcctgtctgttaccggaaaaggccatgatgtggctggtttcggtaccggaagtctggcactgcctgatgcagcatcttaatggccgtccgtccactgtgccgctgattgatgcgctgcttcaggaagcggccggattggttcattcaccgcgggtgaagccgtctgtttcacccgcagtggcagacacggcttgtgtgtctgaaacgggagcaacaacggctccggaaacaacaccgatcccgcccgccagtgaaatgaacagttcgtccccgttcacggctgacgatacccggacactgctgtcattatttcaatcaactgattga

SEQ ID NO: 2204 - DNA, 150 bp, Xenorhabdus bovienii
  Coding sequence Name=Xb4151_4152.C432.gene101.dna; Position on contig= 55913..56062bp; Strand=-
gtgactgtcagtgacaatacttctttctcccgtcccgatcgtttgatcagttttgagtcaggatggttattttttccgtcaggttgccgtcaagaaatcaatcagttgattgaaataatgacagcagtgtccgggtatcgtcagccgtga

SEQ ID NO: 2205 - DNA, 141 bp, Xenorhabdus bovienii
  Coding sequence Name=Xb4151_4152.C432.gene102.dna; Position on contig= 56059..56199bp; Strand=-
atgtttctgctgtgtacaacatcttctttttccctcaattatcacgccttcatgcggtttcctgttcagaagcccccttcaggtgcccaaaatacccataactatttaaattatttattgttaaatgatgaagttaggtga

SEQ ID NO: 2206 - DNA, 1029 bp, Xenorhabdus bovienii
  Coding sequence Name=Xb4151_4152.C432.gene103.dna; Position on contig= 56178..57206bp; Strand=+
atgttgtacacagcagaaacattcagttgggaagcgttattagacgagtactttttttcacatatcctgagaccggataccgagtggagttaccggaaggtcgtacggggttttatccggtttatgggggaagcggcctcaccggcgcaggtcactcaccgggatgtgctccggtggcggcgtcatcttctgctggagaaaaaacagtcgagccatacctggaacaataaggtggcgcatctgcgggccatttttaattttggcatggagcaaaaactgttgcctcataccgagaacccgtttaataacgcggtggtgaaaaaagagaagaaaaagaaaaaaattctgagtgaatcgcagataaaccgcattaatctgctgatggggaaatttgcggaagacgaaagaactcaggtcgcaccaaagggagggcgttgtgccctgtatccgacctggtactggtcaacggtgctggcgacattgcgttttacggggatgcggcagaatcagttgctgcacctgcggttgcgggatatcaacctggaagggaactccattgaactgggtctggcaggcagcaagaaccactgtgaatgggaggtgccgattgttcatcccctgaaaccccggctggcacacttaattgaacgggcaaccgccgccggggctgaagctggcgatccgatttttgacctcagccggttgagtgtgccgcatccaagccggctttcccgttacaaatacgatattaaccgggaaaaacaacagctccggtctttcttccggcggttgtccagagagtgtgactttgccgtctcccctcaccggtttcgtcatactgtggcttcaacgctgatgaaagcgccggatcgcaatctgccgctggtgaaaagattgctggggcatcgtaatgtcgcgaccacgatggagtacattgatctcgatatggaagtaacggggaaaacactggagcgggaactggggttgtacaccgaccgtgctgatgaaagtggcggtgagagtgaataa

SEQ ID NO: 2207 - DNA, 123 bp, Xenorhabdus bovienii
  Coding sequence Name=Xb4151_4152.C432.gene104.dna; Position on contig= 57245..57367bp; Strand=-
atgatttcagtaattgattctgatgtcaagtcagtgaaaacttcacgggatgcaggatcagtaatattcctttttcataccatcaatattgatgcagggcagctcgcacaaaccacctcctaa

SEQ ID NO: 2208 - DNA, 198 bp, Xenorhabdus bovienii
  Coding sequence Name=Xb4151_4152.C432.gene105.dna; Position on contig= 57339..57536bp; Strand=+
ttgacatcagaatcaattactgaaatcattaccttcaacaagaaaggggtaactgttaaaacagctacccttcaatcttgtctaaacttttttaaacaccacaatagtgtgcaaattgtcattcaacatcttattaactattgtttgtttttcgcgcctttgtcaggaaatttaacaacctctgacaaacccgcataa

SEQ ID NO: 2209 - DNA, 573 bp, Xenorhabdus bovienii
  Coding sequence Name=Xb4151_4152.C432.gene106.dna; Position on contig= 57747..58319bp; Strand=-
gtgcaacgtgaatatgttcttagtcatgccctgactttacttgagcagcatggcctgtcatcaacattggagacgcttttaactcccctgaaagttgatatcaatcaaataaagcatttctggcctgatcgcgaagccttgctctacgattgcctgcgccatcacggtcagcagattgaaatctggcagcgccagatcctgctagatgaggttttgagccctgagcaaaaattactggcacgttacgacaccctcaaggaaaaagtacagaaacagcgttatccgggttgtctgttcattgcagcttgcagtgtcttccctgatacagagcatccgatccaccaattggcagagctacaaaaacaaaattcttttcattataccgtagagttattacagcaacttgagatcgaaaacagtgaacgggttgccaaacaaatggaactgatccttgagggatgcctcagcaaactattagtaaaaagagaacttgaagatgtaataacggcaaaattgctggcacaggatattctgaccattgcaaaatgccgaaaaaatggcgcattcagttaa

SEQ ID NO: 2210 - DNA, 1752 bp, Xenorhabdus bovienii
  Coding sequence Name=Xb4151_4152.C432.gene107.dna; Position on contig= 58338..60089bp; Strand=-
atgatgaaacgtattctcatattgtttctgctgttgggtggtatagctatttctcctgtcaaggccaatgcgctgtttgagcagccgggacaaaatcgctatcttcctgtagcccaagcattcgtgtttgattttcaacagaaaggcaacgaacttacactaaactgggatatcaaacccggttattacctttatcaaaagcagttcattatcactccgataaaagcaacgttgggtcatctcaatttctccgaatcggtagatcacgaagatgagttttttggcaagactaaggttcattttggttcagcacagattaacgcccctatcctttctgcctccaatgactccaatttgcaagtcacgtaccaaggttgtgcagaagccggattctgctatgctccagagacaataactgtgccattgtcagccattattgcctcggctccttcagccaatgaagccgcaaaacaacctgacataacgacatctcagaaggcatcattgccgcaggaagaatcccctcccaacgtacctgacgtgccattttcaccattatgggcattgctgattgggattggcattgcctttacaccttgcgttctgccaatgtatccgttgatttccggtattattctaggacagcggcgacccgatagcttaaaacgcattttctggttggcaatgagttacgtacagggaatggcgctcacttataccgtgttgggattgatcgttgccgccgccggattgcagtttcaggctgcattgcagaacccttacattctggtggggctatcaattctgtttattttgctggccttgtccatgtttgggatgtactcattacagctcccttcttctgtacagactcgtttagttgactggagcaaccaacaaaaaagcggctcttacattggcgtattcgtcatgggaatcctggcggggctgatcgcctccccctgtactaccgctcccctcagtgccattttactttatatcgcccaaagcggtaataccctgcttggcgggctgaccctttacctctatgctcttggcatgggcctgccacttattgccgtcacgctattcggtcacaaactcctgccccgcagaggcccgtggatgcagtacgttaaagaagccttcggattcattattctggcgctccctgtattcctattggagcgtgtacttggtgatacgtggggcataagactatggagtttgctggcaatcgctttccttggctgggctttcgcattgaccttaaacagcaaaaaaggctggctacgcaccctgcaactcatcttactggtgctgacactcatcgcctcccgccccatacaggattgggtatggggaaattcagctacgacacaacagcaaccatcgttgaagtttcagcaagtcagtaactggcaggaactaagccagatcctagccaagaaccgtcatcaactcatcatgctggatctttatgcagattggtgtgtagcgtgtaaggaatttgaaaaatacaccttccccgatccacaagtgcaggcgcaattgagtcaattcctcgtattgcaggcaaatgtcacggagaacggttcaaaacagaaagaattactggataaattgaaggtattggggcttcccactatcttgttttttgatgctcatggaaaagagctacccgattcacgagtcagtggtttcatggatgcaggacgctttagccgccatttacagcatctacaaaaataa

SEQ ID NO: 2211 - DNA, 96 bp, Xenorhabdus bovienii
  Coding sequence Name=Xb4151_4152.C432.gene108.dna; Position on contig= 60086..60181bp; Strand=-
atgagtttcatcagttatagttctaactcagatatcatgctaactctggcaaattttatgaaccaagatacagacaggtcaaagattatcttatga

SEQ ID NO: 2212 - DNA, 1302 bp, Xenorhabdus bovienii
  Coding sequence Name=Xb4151_4152.C432.gene109.dna; Position on contig= 60303..61604bp; Strand=-
atgctagccgtagaattagttatcgttctgctggccatttttttgggagcacgactagggggaatcggaattggatttgcaggaggacttggtgttttaatattggccacaattggaatcaagccgggaaacattccatttgacgttatttcaatcattatgggagtcatcgccgctatttctgtcatgcaagtggctggggggctagattatctagttcaacaaacagaaaaactactgcgcagaaatccaaaatacatcactatcctcgcacccatcgtcacttattgcttgacgctattggcgggaacaggaaatatctctctggcaacacaacctgtcattgccgaagtcgcaaaagagcaaggcattaaaccatgccgaccgctatcaaccgctgtcgtagccgcacaaattggactgacttcctcgccaatctccgcagccgtagtttatatgtcttctgtcatggaagggcaaggtgtcagctatattcagatgttgatggtcattattccctcatcgtttgctgcaattattttgatgtcattcattgtctcatggttttttgattccaaactgtctgacgatcctgtctaccaaaaacgccttgcagatggcctaattgagctacgcggcagtcataaagttgatatcaagccaaaagctaaactctctgtactgctgtttctgttaggggtagttgggatcgttatttatgcgattattaacagtccaagccttggtttagttgaaaaaccactggtaaataccaccagcgcgattctgattatcatgttaagcatcgccaccctcacaacggttatctgctcagtgaataccgatgctattttaaattcaagcacctttaaagccggtatgagcgcgtgtatctgtattatgggtgtcgcatggttaggagatacatttgttcaagctaacatggattggattaaagaaaccgcgggtagtttgattcatgcccaaccgtggctgctggctgttatattcttcttctgctctgctctgctctattcgcaagcagcaaccgcgaaggctctgatgcccatggtactggcgctgcatgtcacaccactgacggctctcgcctctttccctgcggtttctggcctatttattctgccaacttatccgactctggttgcggctgtgcagatggatgataccggcaccactcgtattgggcgttttgtattcaaccacccattcttcattccgggtaccattgctgttgcattagccgtgacattcggtttcctagttggtggtatgatcctgtaa

SEQ ID NO: 2213 - DNA, 111 bp, Xenorhabdus bovienii
  Coding sequence Name=Xb4151_4152.C432.gene110.dna; Position on contig= 61622..61732bp; Strand=-
atgaaatacaatatttttagtgatcaattcattcactcagtgggttcgaatgccttttattttcatcaacaatacaaaaatttaacaataaattttcacaacattaaataa

SEQ ID NO: 2214 - DNA, 144 bp, Xenorhabdus bovienii
  Coding sequence Name=Xb4151_4152.C432.gene111.dna; Position on contig= 61722..61865bp; Strand=+
ttgtatttcattaagtcatcatcaaaacgttttactttatatactggatatttttctttattaagtaatttaataaagattacatcattatactttgttttaacacaaacttttcacgtttttataagtgtaaattatatttaa

SEQ ID NO: 2215 - DNA, 117 bp, Xenorhabdus bovienii
  Coding sequence Name=Xb4151_4152.C432.gene112.dna; Position on contig= 62042..62158bp; Strand=+
atgttatcaaatggcaagagatatgaagtatttttgatggttataattaggtatagagcctgtaaattaaattgtgtatttaccttatctttgctcatcaagaatgttgtgctttaa

SEQ ID NO: 2216 - DNA, 570 bp, Xenorhabdus bovienii
  Coding sequence Name=Xb4151_4152.C432.gene113.dna; Position on contig= 62291..62860bp; Strand=+
atgactactttagaagaactttattgctgcgtcgatgatttctgccaaaaatttagccctctctggcatcaacaacttatcgagaatggattatgtcaacgtaggcgctcctttttcctttctctcagcgaggttatgacgctcctcattttatttcatatgagccattaccggaattttaaatgcttttatctcgagcatgtcatcctttatctgcacaaggaattcccgggattagtcagttatacccgtatgcttacgttgaaaaaaagagcacttatttccctgcacacattcctgtcatcacgtaaaagccaaaccgcaggcattgcgtttattgactcaagcaaaactggctggttttatggttttaaacttcattggcttattgatgattacggggcgcttttagcggttaaattgacgcccggtaatacggatgatcgtcaatcggttaagacactattgaatggggtaatcggacatgtatatggcatcaaaggttatctttcacaggcactgtgtgatgagcttaccgcagaagggaatagaacattcaagacaccgtag

SEQ ID NO: 2217 - DNA, 201 bp, Xenorhabdus bovienii
  Coding sequence Name=Xb4151_4152.C432.gene114.dna; Position on contig= 62775..62975bp; Strand=+
atgtatatggcatcaaaggttatctttcacaggcactgtgtgatgagcttaccgcagaagggaatagaacattcaagacaccgtagtgtactcggttttttgctcgaagtggtgtcaggattaatggcttacacttttcagccgaaaaaaccgagcctgaatttacggagttctgaacgggctcttcttaaacgaagctga

SEQ ID NO: 2218 - DNA, 552 bp, Xenorhabdus bovienii
  Coding sequence Name=Xb4151_4152.C432.gene115.dna; Position on contig= 63137..63688bp; Strand=-
atgagtgtgttgcaggaaaacatcatcagaggcacagtttatgtcttgactgacaatattgataccgatcagatcctgacggctgaatacctcaaggtaaacccctcaacaccggaaggatacgctcaactagcttcattagcgatgtgtggattaccggaaggatctctgccctttattgatgaagaacagggcaaagcaaagtacccgattattgtggcaggacagaactttggttgtggttcttcgcgtgaacatgcggtcgctgcattgggcgcttcaggtgtgaaagcggttttagcacagtcttatgcacgtatctttttccgtaattgcgtttctaccggagagctgttgcccgttgctgcacaggaacgcttgtgtgacaaattagtcactggcgatcgtattgagattgatattgaaaaccagacagtaactttgctggaaaatagtgaaaaatatcccaccgatccggttggcgaactggcgaatattgtcgcggcgggtggattattctcttatgcccggatgacaggcaggataaaataa

SEQ ID NO: 2219 - DNA, 1299 bp, Xenorhabdus bovienii
  Coding sequence Name=Xb4151_4152.C432.gene116.dna; Position on contig= 63685..64983bp; Strand=-
atgagccaaactatgacacaaaagattctcgcacgagcgagtggccgtgagcaggtcacaccaggtgaagtggtttgggcgaaagtggacatcctgatgtctcatgatccctgcacaccgggagtcgccagtgtatttaaaaaagagttcggccaagatgccagaatatgggacccgactcgctttattcttatccccgaccattttgtctattctgctgacccgcaggccaatcaaaacattcgcgtaatgcgcgaatttgccgccgagcagaacatcaaatatttttatgatgtgggaacaccaaactataaaggggtctgccatattggtctggcggaaggagggcatactcgccccggtgaagtcctgttgggaaccgattctcataccgttacggcgggggcttttggcgcgttcgccattggactgggcattaccgatgctgcctatgcgttaggtacaggggaaattcccctcaaagttccgacttctatcaaagtgaattttaccggaaccaagcccccgcacgtgttggccaaggatatgattctggcggtattgtcagagttaacggttgatggcgcaacttatgaagctatcgaatttggcggtaatgtcattgatgaattatctgtagaagaacgcatgaccatttgcaatatggtggttgagtgtggagccaagaatggcattatggtgcctaatcaggccacccttgattatctggctgagagaaaccaccttccctttgagattgtttatccggatgaggatgcagaatacagccgggtgttaaacatcgatgtttccgatatgcagccgatgattgccaaacctcattcaccggataatgtcgttccgattgagaaaatagccaacgttgctatttctcaggcttatatcggctcctgtaccggcggtaaactggaagattttattgcggccgctcgtgtcattaagggtaataaagtctccattcctacttatgctgtccctgctaccaaagaggtttttcataagacaatcaccacccagattgatggtgtttctgtttatcagatcttaactgatgccggagtgacactttcctcggaatcaggatgtgcggcttgctgtggtggcccgccggatacctttggccgagtgaatgatccgatatcggtcatctctacaaccaatcgtaattttgtcgggcgaatggggcataaacgcgccaatatctatctggcatcaccttactcggtagctgccgcagccattacaggacgtattactaatccgggggagtttttatga

SEQ ID NO: 2220 - DNA, 129 bp, Xenorhabdus bovienii
  Coding sequence Name=Xb4151_4152.C432.gene117.dna; Position on contig= 65072..65200bp; Strand=+
ttgagcgcactgtttctctactggaacagttgttcttctgaggggaaattcctgcgcttttattctgacaccatttttgccgcgcagtttaatgcctggttaaaataccacctttatctgattgagtaa

SEQ ID NO: 2221 - DNA, 102 bp, Xenorhabdus bovienii
  Coding sequence Name=Xb4151_4152.C432.gene118.dna; Position on contig= 65160..65261bp; Strand=-
atgatttacttgggggaatctccgcctaacatatcacagatgttatggagaaaggccaatattactcaatcagataaaggtggtattttaaccaggcattaa

SEQ ID NO: 2222 - DNA, 921 bp, Xenorhabdus bovienii
  Coding sequence Name=Xb4151_4152.C432.gene119.dna; Position on contig= 65273..66193bp; Strand=+
atgaataatatcgaaaatcttacttcgatggtgatctttgcccgcgtagtagaaacactgagttttactgaagctgcgaaatcattaaggctgtctaaatcttcggtcagtcgtgagatcgcacagctagaagtaagattgggtactcagctactcaatcgcaccacgcgcaaaattcaagtgacggaagtcggactgagctattaccaatactgttcccgtattcttaatgaagccaaaagcgccgagcgttttatccgcaactttcatgacgagccgatgggaaacctgcgcctgattgctccggtatcctttggcagtcagtgtatcgtccctgccctgaataactttatcgccagaaacattcatgtcagcgttgatctggaactgaccgacagaaccatcaatatgacagatgataactacgatattgcaattattgtgggacgagaaactccggatcatccacttgttatgcccctgattgatatcacttgggggctttacgctacaccagattatatgagtcagtttccgccgatagaaaagcccgaagacctgccccgctacgattatctgctgttccgtggccctgcccatacgatttccctgccgttccgtaaggagaggcaaaagctcgatattgaagttcgcagccgttttcgcatcaataacagcgtggcgttgatgagttcggcgctgtccggtgcaggcattgcttacctgccggattacatcgcccacgaatctgtagcagaaggcaaacttgtccggctactgccgggatggcacatggatatttatcaaacctggatgatgtttaaatcagaaaacacactttctgcacgtgtgcagctatttgccgacgctttgcagcagaaactacagggtgatctcggggacagcaaaagggaagaatag

SEQ ID NO: 2223 - DNA, 780 bp, Xenorhabdus bovienii
  Coding sequence Name=Xb4151_4152.C432.gene120.dna; Position on contig= 66249..67028bp; Strand=-
atgagcaataaaaaaattgaatggaataatggattacagcaggaagcggtagagatcctttccaacgagggtggaatgatcgtctgcccgaccaaagtgggctacattattatgacttctgacgcacaaggtctggagcgtaaattcgaagccaagcagcgtaatcgcaacaaacccggcgttgtgttatgtggatctctcgaacagttgaaagaattggctcagcttaacccggaaatcgaagagctgtatcaaaaacattgggatgcagatgtgttgctgggctgcatcctgccgtggaaagaagacgctgtcgcccgtattcctgatgatggttctaaggcgctgatgatggatggccgtggcaccagttgtttcgtgattaaattcggtaaaccgggcgaaattctggcaaaagccctgtgggaaaactacggcaaattctcttttgccagctcggctaacccatctggtaaaggtaaccgtggcttggtggagtgtatcggtgagcgcattgaagaacgtgctgacttgattattgatgccaaccactacgttaaatctatccagccaaacgaaacagagcagacccgctatgaacagggagtaatgatttcaatggtggatgacaacggggcattggtgccgatgcagaatggtcagcgcgatatcaccccgtgtccggtattgatccgtaagggactggatgtgcataagatcatggtgatgatgtctgatatcttcacaacctgggactaccgtcacggtaactattactga

SEQ ID NO: 2224 - DNA, 927 bp, Xenorhabdus bovienii
  Coding sequence Name=Xb4151_4152.C432.gene121.dna; Position on contig= 67267..68193bp; Strand=-
atgagtattagctccttagggaaccaaattgataactctttggtttcaaatgccttcggtttcctgcgctttccgctgaatttccagccttattccagtgatgcagaatgggtgattaccggtgtgccttttgatatggcaacatctgggcgtgccggcagccgtcatgggccagccgctattcgtcaggtatcgactaatctggcgtgggaaagctgtcgctggccgtgggacttcagcttgcgcaaacgcctgaatgtggtggattgcggtgatctggtctttaacttcggtgatgctcaggacatgagcgacaagttgcaggcacatgctgaaaaagtgctggcatcgggtaagaaaatgctgtctttcggcggtgatcattttgtcactttgccattactgcgcgcccatgctaaacatttcggcaaaatggcactgattcattttgatgctcatacggacacctatccgaatggcagcaagtttgatcatggtacgatgttttatcatgcacctaacgaagggctaatagatcctcatcgttcggtgcaaatcggtattcgcaccgaacacgatactgacaatggttttactgtattggatgcggcacaggtcaacgatcgtagcgttgatgctgttgttgaacaaatcaaaaacgttgtcggtgatctgccaatttacctgacattcgatattgattgccttgatcctgcttttgcgcccggtacagggacgccagtgattggcgggttgacgtctgatcgtgcactgaaaatcctgcgtggtctgcaacccctgaatatcgtcggcatggatgtggtggaagtggctcctgcctatgatcagtctgaaatcaccgctctggcagcagcgacgattggattggaattgctgtatttgcaggcgtcgaaaaaagcagtttag

SEQ ID NO: 2225 - DNA, 126 bp, Xenorhabdus bovienii
  Coding sequence Name=Xb4151_4152.C432.gene122.dna; Position on contig= 68296..68421bp; Strand=-
atgtttaatactatagaatcagtcgctgaatcagggcgatctgggtgctttttttgtttgtctatggatgtgtacacatttgcggctttttttgtttgtgatttatgtttaattaattgtttttaa

SEQ ID NO: 2226 - DNA, 123 bp, Xenorhabdus bovienii
  Coding sequence Name=Xb4151_4152.C432.gene123.dna; Position on contig= 68451..68573bp; Strand=-
gtgggtagaaacagtgacgttgaatcccgagcgagaaaaacggtctgcttaaattcattaatggtgccaactatgttgacaattaccgttttaggtggctatcggtcatggcactcgatgtga

SEQ ID NO: 2227 - DNA, 321 bp, Xenorhabdus bovienii
  Coding sequence Name=Xb4151_4152.C432.gene124.dna; Position on contig= 68584..68904bp; Strand=-
ttgtcaccagccggaatatgccagcttacgccatcacacagccgcccacgagtcagcaatgataatgcctatgcagaatcgctgttccgaacgctgaaatatgtgccggcgtggccggaaagcggcttcaatgctctgacacaagtgcgtgtctggggggataattttaccgactggtataacgaggaacaccgtcatagcgggataaattatgtgacaccgggtcaacggcacagaggtgaagacaaagtgattttaaaacagcgggatgccgttttcaagctaagctcacacacccgtaacgcgggtcgcgccgcataa

SEQ ID NO: 2228 - DNA, 192 bp, Xenorhabdus bovienii
  Coding sequence Name=Xb4151_4152.C432.gene125.dna; Position on contig= 68846..69037bp; Strand=+
ttgctgactcgtgggcggctgtgtgatggcgtaagctggcatattccggctggtgacaaacggccaatatctgttgctcttcttctggggttgatcggtttgccgacttgggccggacagccaacggccgccggtcttccggactcttttgccagcgccgctaggtgcgcaggctcaaagggatctctttaa

SEQ ID NO: 2229 - DNA, 198 bp, Xenorhabdus bovienii
  Coding sequence Name=Xb4151_4152.C432.gene126.dna; Position on contig= 68994..69191bp; Strand=+
ttgccagcgccgctaggtgcgcaggctcaaagggatctctttaagcgcgaccgtcaaccgggcacccgcctcggccgccttgctcaccgcatccctactcgctttcgaaaatccagactgtatcccatctcgctttatcccctgtcatttgaattgagatattcatgccatattaatatgatttacatatggaattaa

SEQ ID NO: 2230 - DNA, 138 bp, Xenorhabdus bovienii
  Coding sequence Name=Xb4151_4152.C432.gene127.dna; Position on contig= 69224..69361bp; Strand=+
atggtaataattcccattttcatttatggttgcgttatgtgtccttacttctggataaaatgtactctttccctttattcaaataggttgaatgaaagttttgggtattcccatgccagaattctatttacgctctga

SEQ ID NO: 2231 - DNA, 1047 bp, Xenorhabdus bovienii
  Coding sequence Name=Xb4151_4152.C432.gene128.dna; Position on contig= 69380..70426bp; Strand=+
atgcagtgcaaatttactttttcctattaccgattaatcaccgttctttttgcttttatcgcactaattcttaccagtggctgtgataaaaaatcgacagaaattaaagccggacatccccaaccttctggggaaaccaccagcatggcgggctggccacgaaccttcgaaacagtaaaaggtcctctcacattaacacagccacctaagcgtattgtctctaccagtgtgacgctcagtggcactttgctggctatcaatgcccctttaatcgcttcaggcgcaaccggtccaaataccgatgtggctgatagccgaggattttttattcaatgggccaaagtcgcttatgaacgaggtgtaaagcttctctatatcagtgaacccaatgccgaagctgttgcggctatggtgccagatctgattgttatttcagcgacgggaggggattcagccatgaagctgtatgaacaactctcaaccattgcacccatactggttattgattatggcgataagagctggcaacagcttgccctgcaacttgggcaaataatcgggcatgaagctgatgccggggaaatcatcgcgcgctttgagcaacgtttgcagaaagtgaaacaagatatcaccttacccccgaatcccgtttctgcatttgtctattatgctgacgggagaggtgtcaatctttggacgccatcatctgcgcaagggcaattattgcatcaactaggttttacactcgccacattaccgaccaacctgaaaacagaaaccagtatgggcaaacgtgaagatatcattcagctttctgctgaagggttagcagatggtttaaacggccaatcttttatgctattcgctaccaatgacagcacaattcaagttgtgagtgctaacccttttttacagcacctgcctgctgtcagtacccaacgcctctatgcgatggggccggatacttttcgcttagactattacagtgcaaacaatatgcttgatcgcattgaacactatttctcaaatcaagaattaaaaaattag

SEQ ID NO: 2232 - DNA, 1266 bp, Xenorhabdus bovienii
  Coding sequence Name=Xb4151_4152.C432.gene129.dna; Position on contig= 70460..71725bp; Strand=-
atggctaagtcatcaatcctgctggacttcagtttacttaaaaataatgcacatttccgcgctatctttatcgcccgtatgctatctgtttttgcattaggaatgctgacagtgggcgtcccagttcaaatgcagtttctgaccggttctaccttgcaggtggggatcgtggtggcattggatgggatcggcatgtttatcggattgatgctgggcggaatactggccgaccgctatgacaggcgtaaattgattctgtttgcccgtggcacttgtggcttgggttttgttgcattgagttttaatgcgtttttggattccccttcactgtttgtcctctatttcctttccgtctgggatgggttctttggcgctttaggcatgaccgctttaatggcggcgatcccaaacttagtcggccgggaaaatctggcggcggcgggtgccttgagtatgatcacggttcgtattggtgccattctttctcccgcactaggtgggcttattatcgttgccagcggacctggctggaactttgccattgccgcagcagggactttggctacactgatcccgctggtgaggttgccaaagatgaagccacagtcaacccggcaagagcatccactccgagcgttagtgagtggtgtacaatttgtctgtcagcataaaatcgtaggcagtgtgatattagtcggtatgttgatcagcatggcgggggcagttcgcatccttttccctgcattatctcaagaggtttatcaccaaggtccttccgcgacaggtttaatgtattcagccgttcctctgggtgccatgctaggagcatttaccagtggctggataggacggagcgcccggcccggtcttctgctcattatttttgcgttgggctctttccttgcattatccctgctcggtctcatgacgcatattgtcccggcattactcgcattggtgtgttatggctacctgaatgcttttgcttccttattacagtttacactcatccagagtcatacacctgatcacctattggggcgggtgaatagttttgtcacagcacaggatgttactggtgattccttgggagcgttgggattgggcgtcatgggacgtctgttatctcctctcataacggcgctttcgtttggttcttttgcggcaattacctgtctattgcttgcagcactggtaaaacctctgcgccattctactctgcataataatgccgcatcattagagggcggtgcctctgaaaagtga

SEQ ID NO: 2233 - DNA, 123 bp, Xenorhabdus bovienii
  Coding sequence Name=Xb4151_4152.C432.gene130.dna; Position on contig= 71797..71919bp; Strand=+
atgtttccagaaaaagctgtgctagcatatcgaccgttaatgataatggcaatacaaatgattatcacaatcaataacgaatggagcctttccggttatgcctgctgccccaatgcatcgtga

SEQ ID NO: 2234 - DNA, 1047 bp, Xenorhabdus bovienii
  Coding sequence Name=Xb4151_4152.C432.gene131.dna; Position on contig= 71894..72940bp; Strand=+
atgcctgctgccccaatgcatcgtgagataacctcttcaaaacccttgtctcaatttcatacttatcgcacccgtcggttaacaggtcccataatctgtttattactcctcattattttttctatagcgagtctgttattaggcagtaaatatattgcccctgagaccgtctggcatagtttaaccggtgagctgcataacaatgagagcatcattattctcgaatcgcgcctgcctcgtacccttgtcggtattttggtcggcatggcattaggtggtgcgggggcattaattcaggcattgacacgtaaccctctggcagacccgggtatattgggcgtcaacgcaggagccagctttgccatcgtagtggcaatcacattatttggcttaagcagtgttatggcaaaagttagcgtggcctgtctgggcgcttttcttgccagcctggcggtatggttaatcagtatgcagtctggtgataaatccaatcctgttcgtttaacactgtcaggagtcgcgattagcgccctgttaaccggaataactaccaatattgccctgctcaatccttcaactttcgatcaattacgcatctggcaggcgggtacgctggatatccgatccttacaggtcactctccttgttgctccgttcattcttatcggctgtgcgctcaccttattgatttcaaggccactcaatacgttgagtatgggggaagaaatcgcaataacgttaggcgtaaaaattctctgggtaaaagtttcagccatcatagccattatgctgttatgtggaacggcaactgcattggctggcccgatcgggtttgtcggattgatgatcccacatatcgcgcgttggtggtgtggcccagaccaacgctggatcattctgcattcattactcatggctccggtgttattgcttagtgcagatatcgtcgggcgtttactggttgccggtgagttgcgcgtatcaatcgtcacggcctttattggcgcgcccgtgctgatctggcaggtacgcaagcgtaaatactga

SEQ ID NO: 2235 - DNA, 1032 bp, Xenorhabdus bovienii
  Coding sequence Name=Xb4151_4152.C432.gene132.dna; Position on contig= 72957..73988bp; Strand=+
atgtcgaaaatgttgcaagtcgggcatccagaagggtggataaatggccgaatttcccttcgggttttactggtgaatactttccagctatttttaattatgttattagcgctgttcgctgtttattacggaacgctgaaactttccttctggcaaatctgtcaggcttttcaaggtgaaggtgatcccggcattattgctgtcgtcacgcaatggcgagcgcctcgtgttgctattgcgctggtggtcggagccgcactggcgataagtggcgctatctttcagtctgtcatccgcaatcctttgggcagccccgatattatgggattcagtaccggcgcatggactggcgtactgattactctgatttttctaaatggcggttattatcaaatgactctgggtgcgctgatcggcggctcattaaccgctgtcttaatttatttactcgcctggcgtcagggtatccacggttttcgcctgattattgtggggattgctatcagtgccatgctgacagcggtcaatacttggcttatcgtaacgggttcgctggaacatgttatgagtgcggcactttggggtaacggttcgcttaacggcattacctggcaaaaagcggcctcagctctgtttgtcattcctttgcttactttcggcgcttttgctttggcaaagtcgctgaaaataatggaaatgggggatgataaagccagcgccttgggctgtaatgttgaaactaaccgtatgcagcttattctctatggcatactgctgactgctgtcgtgacggcaacgacaggcccgatatcctttatttcccttgctgcaccgcaaattgcccgaagattaacaggtacaagctatgttcccctgttttctgctgccatgacaggtgccttgctattgttaactgctgatttagttgcgcagcatactttttcaaatgtgcagctacctgtgggtgctgtcaccgtcagtattggtggtatctaccttatttggcttcttattcgggaagctcgccaataa

SEQ ID NO: 2236 - DNA, 804 bp, Xenorhabdus bovienii
  Coding sequence Name=Xb4151_4152.C432.gene133.dna; Position on contig= 74025..74828bp; Strand=+
atgacatatcgcctcagcgcttcacatttgacattaggctatgaacgaaaaattattgctgaagatttaagtatcagtattccggataaacagttcagcgtaattattggcccgaatgcctgcggtaaatctacgttactgcgtgcgctttgtcgtttactgaagccccatcacggtcatattttgctggatggaaaagatattcaacaaataccgactaaggcattggcacgtcagttaggtttactgccccagcaagcgatagtgccggaaaatatcacggtttccgaactagtcgcccgtggccgctatccccatcaaagcctgctgcgccaatggagtctggatgataaaactgctgtggctcaggcgatgaaagccacagggattgcaccattagctgaacgctatgttgatgagttatccggagggcagaagcagcgtgcctgggtagctatggtattagcccagcaaactcccttgctgtttcttgatgaacccacaacatggctcgatattgctcatcaaattgacctgctggatcttttcctgcaacttaatcaggaaagcagccacacccttgttgcagtgctgcatgatattaatcaggcatgccgctatgcggatcatttaatcgtcatgcaggcagggcagattgttacacagggtaagcctcaggatattatcagcacagaactgatcaaatcggtgtttggcttatcttgtgttgttattgaagatccggtttcccatacccccctgattattccctgcggccgctaccactcggtaaaaggcatttaa

SEQ ID NO: 2237 - DNA, 8595 bp, Xenorhabdus bovienii
  Coding sequence Name=Xb4151_4152.C432.gene134.dna; Position on contig= 74908..83502bp; Strand=-
gtgtctagtagattacaagaggttggggttgaaacaataaatttgacgctaccactggttgctgcccagccagggatttggatagccgatcaactcgctgacccacgcaacatattcaccattgcacattatattgaaattaaaggggcattagaccagccattatttgatgccgctatttgtcagggattgtctgaagcggatacgatccatgcccggtatttcctgaatgaagatggaataccagtacaacagatcccgctttgctgtgacccacagcaggtcattgcccctgaatggattgatttttccagagagccggccggacaggccgaaatagcatcacagacattgatgcaggaggatctctcggctgaattaccggcagatggagaacgtgcgctgtaccgacaggtggtgatgaagattgataagcaacctgaacgctggttctggtatcaacgctttcatcatctcatgctggatggtttcagttttgatgcactgactcgtcggattattcagatttataacgccctgaaagctgagcatccgcccgctgagacccctttctgttcctttactcaggtggtggaggaatatcaggattggcaaagttcaccggcaaaagcaaaggctgcggcattctggcaagaatatacccgtgagccgggtgcctgtgtctctctttcagttgaagatattgccgcttcggagaacacctcgcctttatattatcactgccattttccggcaactcagctgacttcattaatggcagaggattcactacgccaatttcaacctgctgaaattgctatggctgcactcggcatctacttctaccgcatgtgcggagaaaagcatctctctattggttttccgtttatgcggcgtttgggatcagccgcgctttgctctaccggccctgtggttaacctgctaccgttacaaatcaaactgcaagacagcatgacactggccgatgtcgtgaaggcttttgtagcagaaataaaacaagtccgccgccaccagcgttatgatgccgaacagctacgctgccatttggggttatcgggaagcagcaatctgctctatggccctgtttttaactataaaatatataacgagacgctgaaattagacggcaaaccaattacgactcatacactcgccacggggccagtggatgatctggaatttgaattgaattttcaggatgacgttcttcatctgaccttcattgccaatcggacaaaatatagcgaacagactttacactggcacagtgagcgcatccgttatctattagatcaactgctcattcagccgaaacaaccgattgcttttataccgatgattcccccacaggaacaacagcgtcttgatgaatggtcccgcgggccatgcgtaacaccgccatcagatagggtttctgtgcttgatttcttcttatctcaagtgaaacagcaaccagataccttagctgtccgttgtggtgatcaacaacttagctatcatcaattaatggcaaaaagcatgcagcttgcgcgtctattgctggcgcaaggtattggtgccgaggatgtggtcgcgataggtgtaccccgctcaatagattcggttgtcgcgattctgggggtattagccagtggcgcggcttacatgccactggatctcgattatccgcgggaacgcttacaattaatgagcgatgatgctcagccggtactgttgataacctgcattaatacactgccacaaatgcctgatataccgaaggtaatatgtctggatgatcatcagatacaggagcggtgtaccagtctgtcttcccttcctgtcacagatgaagaaaggcgtgaaacgctgcggggcgagcaccttgcttacatcatctatacctctggttccacgggcaaacccaaaggggtgatgagtacacatggcgggttgttgaatttgctggcttcccatgctgcacggctgtttgggccagtgattgacaattttcatcttcagcatcaacggcgtatgcgcgccggtcacacagcctctttctcatttgattcgtcctgggagccgctgttctgcatgatgttaggcagcgagctttatatctttgatgaagagttacggcgagatgcgtggggtgtggtacagcaaatgaatcaactgcctgttgacctcatggatattaccccatcgtttttgactcagcttattgacagcggtttgctggaagaaggcaaccaccagccagcgtttattatgattggtggtgaagcggcgacgccgcgattgtgggagctgttgaagcaatacccgcaaatgaatatccataattactatggcccatcagaatataccatcgacacgctgggagccgatattcaggtcgctgatcagcctgttattgggcggcccgttgccaatactgatgtttggcttctggatagccatctgcaacctgtgccggttggtgccgtgggggaactttacctttccgggccaggcattgcccgcggttatctgcgccgtcctgatttaaccgcggcgcgttttgtcgccaaccccttcaagaatggtgaggtgatgtatcgtagtggcgatctgatgcgttggcggcctgatgggcagctctcatttgttggccgagtggatcaccaaattaaagtacgtggttttcgcgttgagttaggagaggtagagaatgcattagctgctttacctgaagtcagctcggccgtagtcattgcagaacccatgggagtcacatatcggctgattggctattgctcggttcctgataataaactgcgagccttagcggatatttctgcacgattgctggctgaactggcaaaacagctacctgattatatggtgcctgctttattggtgattttggaagagttgccattaacagtcaatggcaaggtggatcgcaaggcactgcccaaaccgcagcaacagcatttttctatagggcggcaagctgaaaatgaaaaggaaaaatatatttgtgaggcgtttgcaaccttattaggaatagttcaggtcagtgcagatgatgatttctttgtgctcggaggcgacagtatctctgcaatggcactgggaacacaattgcgtcgtgttggctggcagcttcgtccgcgcgatattttcagtgaacggacaccggcgcgtatggcgctgaaaatgtctccggtcgctattggcaaaagaacctctagcgccaataagatatctaagccagtacaaatcggcgagatcgatcacttacctattttgcattggtttgcagaatctcatggcatcaatacccgtttcgcccacggtgtattcatccgcgtaccggctgaattacggccagaacatttatcatctgcccttctcgcgttgagccagacccacccggtacttcatgctgttacccgcaataatcgccttatcatcggtgaaaaacctgtactggcagacggatcgtattacagcgttatacaaaatagtggtcatatagaaacgagtgcagaacaggctttccacgaggcggtgatgcgcctgaatccggccacgggtcatttattccatgcctgtttactgcaacaagatgaagagactcagggattagtatgggttattcatcatctggcaacggatggtgtgtcatggcgggtactactggatgaactgcaacaggcgatagagactgccatagcgggtaaagcaatcactttgccaccggaagagtacacattgtatgactggaaccttcagctaggccaaaatttagtaaaccgtgccggagagctgtctttctggcaggccatgcttgacgaaaaaattcccctgttaggaaaacgcccgttggatgcgcatcgggatcggcaagtcgctgtccgtgagcaacgcacactattaaccggcaaacagaccacggcattactgggagtgttgccgcagcagtaccatgccaacatcgaagagatgttgttaacgatattggctatggcctgtaaccggcactttggtgtcagcaaattccgtttccaattagagtcgcatggtcgtatggagttagaggatgacgttgatttagcccgaaccgtgggctggttaacggcggaatatcccgtggtgctggcgttgccacaggcagaacaccaatccacaaaaatcgctgacgaaaacccttcaaaaatcgtacgggcagtgaaaagcgctctgcgtacaatacccgatcgtggcataggttatggcctgctgcgttatctggatcaaactggccgacaagtattagcccaacaggatacgccggagatcttatttaactatttggggcgctttgctgcgactgataacttatgggcgccacagcgcactgaaaacctgttccgtgatacttttgctgtttatcaagatccgcaaatgtcccccaatcatagcttggaaatcaacctgtttgttgatgaacagggaagcattccgcagttagcgattaactggcaatgggtagatggtatcttcagcgaacaagacatctctgaattacagcgcggcatggaatgggctaccgactgcctaatcaattttgcccgacagcagccacggcaggcggctgcgacgctggttgccgcagaaattgttttaccgagacttgaagaaagtgatctgacgcaactgactgaacgttatgggcctttggctacggtgttaccgctgttaccattgcaacaggggctactctttcacgctcagacagcaacagataagggtaattataattcactcacccgcctttccctgcatgggtcattagatcgggttaaactacaccgggcactatctgccctgatccgccaccatcctcagcttgccgcacgttttgatactgagcaaagtgcttctcctctacaactgatcccccttttatcagaggatagcgatatttggccgcttgatttttatcagctccctgaattacctgagcaggaagaagaagcagcattattagaactggaaaggacggaactggcgcgcgatcttttccaccagcctcaagccatgctacatgctttactggtatgccacggtgaaggttcacgttatacattattgttgaatattcaccatcttgtcgtagatggctggtcaacacctatcttgatacaagatcttttaaccttgctgaatcaaggtgaacaggcgttatctgtgcccagagtcagttatcaagagatcgtacatcaattggcggcacaagaaacggcagtggcacgccaatgctggcaagatgtgttgaagggcgttcaaccgaccaaactgttcagtgatcaaccccataacggcaaagtgaaagagcttgatatcgcgctcgaacctgaaatggaacaggcactcttcagcttatgtcagcaacgtggtttgacactcaatacgctgatgcaggggatctggtctgtgctgctcagtatacacagtggttcatccgatgtggttttcggttcccccgtgtctgggcgatttggccagattgaagggttagaccagcatgttgggctgttcagcaacacgctgccggttcgaatgacgctggatatcacgttacctctcttgcctcagttagaacaattgcaggcacaacagatccaattgattgaacacgacaatatcggtctgggtgaaattcaacatattgcggggacaagtacgctttttgataccttattggtagtggaaaattatccagaaaccgatactgaatcagattgcactcaaacgatcatttgtcagcggattaataaccgtggttacacgcactatcccttaaccttgctggttctgccgggtaagcggctacgcttattaatggaataccgggagtgtgtcaaacaacctgaattattggctcaacgcattcttctcctgattcagcaactgcttgagcaacccgatacggctctgcaagattgggttttacaatcacctgacgaggctgcattgattaccaaagtgaatcggacgcaccatgaaatcccttctggtacactccatcagtttgtgattgaacaggctgaaaaaacgcctgatgatttagcgttactggataaccagcatcatctgacttatcggcaaatgcgtgctcagacccgtctattagttgatcgtttaattgaagccggagttcagcccggtgatattgttggggttgctttaccccgttcagtaagactcagcctggcattacaggcgatactggaagcaggagcggcctggttacccctcgataccggttatcctgatgatcgtttggcgatgatgctggaggatgctcaaccacggttagtcattacagaaagtaaacttcaagcgcgttttgctcatcaggctcctttgctggtattcgatcaattggcggatgaaaatcagcagccggtgcatcccgcagcgtgggtgacgccacagcacacggcttatatcatttacacctcgggttcaaccggacggccaaaaggtgtgatggtcagccatcaatccattgtgaaccgcctgttatggatgcaggatgcttacccgcttacgcaggatgatgtggttttgcagaaaacaccatgcagcttcgatgtttctgtctgggagtttttctggccactgatgaccggtgctaaactcgtgatggcaccgcctgaagtgcatcgcgatccagaagcgctaatgcagcttattgatgactatgcagtaactacgctgcactttgttccatccatgttggcgacgttgattgactcattggcatcacgtcagcaaagtgctttattctgtcatagcctgcgtcaggtgttttgcagtggtgaagcgttatcctgtgaactggctcgccgctatcagacattcatctcggcacctttacataatctctatggtccaacggaagcggcagtcgatgtcacatggcagccggcttatggtgaggcattagatcactgtacaggctcaggcgtgcctattggccgaccggtatggaatacccaattgcgtattttggacgcttggctgcgtccggttcctgttggtgtagcgggtgatctctatctctgcggtattcaattggcgaccggctacctgaaccgggctgatttgacggccagccgttttgtggctgatcctttcgcctgtggcgagcgcatgtatcgaactggcgatattgcctgctggttgccgaatggtgaagtggaatatcttggacgcagtgacgatcagttaaaaatacggggtcagcgtattgagctgggagaaattgaacaggttctactggaacagtccggcatcgctcaggctgcggttgctgcgtgtgaattaggcaaaacagccaacaccgttagtgatgcagatgcccgtcagttagttgcctggttaattcctcaacccgatgtttcactggatacagaggcgttacatcaagcccttacccggcgattgcctgcttatatgctgccggtcagttatgtgcttcaggatagtttcccattaagcgccaatgggaaattgaatcgcaaggcacttcctatgccacagaaactcactaccggacgcttgcctgtggcaggtatggaaagccaaatggcagccctttttgctgaaattctggattgcgacaccgtttgggctgatgatgatttctttgcgctgggtggtcactcactattagctatgcgcttggccgcagaaatacgccgccgttttaatcggtctatttctattggtcacatcatggttgctcgcagcgtcgagaaactgagtgcattactgtctgatgagaatgagcaagattccgcagaaaaccggggtctgggagaagtgttcccgctgagagacggacacggttccgcgctattctgcctgcaccctgcatctggctttgcctggcaatatagtgggctgctgcgttatttaaaaggcgactggccgatcattggactacagtcacctcgcccgctgggagtgattgccgactctgataaccttgaagatatgtgtacacaccatttagcgacattacggcagatccagccacatggcccttattacctactcggttattcgttaggcggaatgctggctcaaggcatggctgcacgcttgcgccaagagggagagaaagttgctttcctcggattattggatacttatccaccggaaggccaagactggacggtcttaagtgaagaagaagccaaagaagaagctgcgcgtgaacaggccgaatttatggccgccacagaagatgaacgtgatccgctgttacgtgctgaaaagcaggctatgttcgccgatattgtggctaactataaggattctgttcgtatcctttcatcagcttccaatcaaaaatatgatggcgaagccattctgttttcagcaacccgcacattgcctgctgatatggatgttgctgcgacatgggcgccttggatacgacaattaagcatctatcggcaagattgtgaacatgctgatattctttctccagcatcactgaaacagttagggccattgctcaatacgttgttgaaaacgcatcgcgattga

SEQ ID NO: 2238 - DNA, 237 bp, Xenorhabdus bovienii
  Coding sequence Name=Xb4151_4152.C432.gene135.dna; Position on contig= 83495..83731bp; Strand=-
atgtctcaggaacaaaaaaacccttttgatgatgataacgcgactttctttgtgctgatcaacgctcaacagcaatacagcctctggcctgcttttgcggaacagccggctggctgggaacaggttgccgggccagattcgcggtcaacatgtattacatacatagaagaacattgggtagatatgcgccctgcccggttgcgtgacttattagttaaaggaagtacacgtgtctag

SEQ ID NO: 2239 - DNA, 1350 bp, Xenorhabdus bovienii
  Coding sequence Name=Xb4151_4152.C432.gene136.dna; Position on contig= 83770..85119bp; Strand=-
atgccagataggggcattaatggaacaactcgatggggcaattattttgaagaggataagggaatgaaattagcatttcagccatccggtacgataagtaatttattatcagcatcttattctggcagtgaattatggtgggagcatattgcagctttagggactccgttagtggaagcaaggccggatcatcaggttcaactcacgtttttctggcgagatccggccggaaatgaacggaattcagatattcgccgagtttttattgatatcaacggcatcaccgatcaccacagtccacagccacaaagtctgcaacgattgcccgaaagtgacatttggtattggtctgtcactattgatgatgactggagaggaagttacagcctgatccctgtcactcatgcccatctgccccctgatttttacggcgacacccagcagcgtaaccaacagcaacgcgaatggtggtgttcactctttcctctgtctattcccgatcctctgaatttacaaggctgtcatcgtaatgggctcggaatgtctttatcggccgctcatatgccccatgctcctgagcaatcagcctgggcatcaatcgggagaaatagtctcgctcagccggatacacaacaacctgttctgttgaattggcagagtcatcgccttggtaatcagcggcgtatctggctttacgctacgggagaggaaacggagagaccacgcccgctggtcattcttctggatgggcaaaactgggcagaaagaacccctgttttttctgccttagaagccgctaccgaacagcaacacataccgggagctgtctggctactcattgatgtgattgatatgtcccgacgggaacaggaattaccctgcaaccgagatttctggctggcggttcaggatgaacttttaccgcttgccgcacagcatgccacgttcagcgattcccccgacaatacggttgtcgccggccaaagttatggtgggctggccgcactttatgcagcactgcattggccgcaacgctttggctgtgtactcactcaatccggttctttctggtggccttacagcaaaatgatgaagtcatctgagcgtcaaaccggttggctgacacagcaggttattgagcaaaaagttaccccatcctcattgaaaatctttcaggaggcgggttcccgcgaagatgatatcgaaggtgttaaccagcaaatgtatgaagcattgaaaaatgccggatatcacgtgagttatcgtgtttttaatggcggacatgattctttgtgctggcgtggcgggttgattgacggccttagctggttactgtctgaaaacgcataa

SEQ ID NO: 2240 - DNA, 102 bp, Xenorhabdus bovienii
  Coding sequence Name=Xb4151_4152.C432.gene137.dna; Position on contig= 85215..85316bp; Strand=+
atgaatgaagtttatcggtttatggaattaataagatcgtcgcagaggaaaataggactggaatcctcttatagaaacttagggaaaataagagacatatga

SEQ ID NO: 2241 - DNA, 2199 bp, Xenorhabdus bovienii
  Coding sequence Name=Xb4151_4152.C432.gene138.dna; Position on contig= 85371..87569bp; Strand=+
atggtaatgcccacgaaaaaaacgctaaaaaataaaacaaccaaaaatcacaataataaagtaccgttaatattaacttctgtattatttttatctcctcactccgcaatagccgttgaaacggctaatgagaaagacaccatcatagtcaccgcatcaacacagggtggctccagcggcttcgttgaatcagaaagttctgcgggtacgaaaagcactgcaccactgataaaaacacctcaggcgattacggtagtgaaccgtgctcaaatagaggctcagggcgcaacaacagtggctgatgccctgaattattccagtggtgtggtcactaactatcgtggtgcttccaaccgtagtgatgaagtcattacacgtggtttccgttacgcgcccaaatttcttgatggactgagctatggtttaaacggccagggggctacggcaggtcagatcgatccttggcttttggagcgtgtggaactcgttcatgggccagcatccgtgctatacggccaggtcagccccggtgggttggttagcatgaccagcaaaaggccgactgcacaacctatacataaagtgcagatgaaagccggtaatcagcgtcttggtgagtttgcctttgattttggcggggcagtacatgacgacattccccttttctatcgcttgaatggaattctcagtactcaacagcaattcgtcaaagactataaaaaggaacgtattgcaattgctccggcgctgacatggataccgaacagtgacacgacctttacgctgctgactagttatcaatacgatcctaaaatgggattccgtaacttctaccctaaagtcgggactgtcacgcctatccccaatgtgggctatatgccctatgatatgaatctcagtgagccttcttttaatcaggccagacgggagcagacttctatcggctatattcttgagcacgatattaatgatattttctccttccaacaaaccttacgttactcaagctcagatgaacgcactaaactgtttgtttatacaaaagatgtcaccagttccatcattgggcgtcgcccgcagcgtgaacacaataaagcgcaggaatttggcatagataatcaactgaaagctctgttttcaacggctaacattgagcataacattatcagtggaatagattacaagtggggagacaggcacaataaaacatggaatgataaaaacccgggcagagaaccccaatatcgttttgactggtcaaatcccactaggaacattcacattgatgagaaaaacctctcacttgactcaaatgataaaaagaaacttcatcagttaggtatctatttacaggatcaactcaattgggaaaactggaatttagttctttcagggcgttatgactggactgaagtcaagcagcaagatctcatcaagcacacattaaaaaaacagaatgacagtgcgtttacaggacgagcgggtttactgtatgcctttgataacggtatttcgccttatatcagctacagcacctcttttgaacccaatctggatacaggtgcaccaggtgcaccggaattcaaaccaacaatgggtgaacagaccgaaataggcattaaattccagcccaaagaccatgataccttgctgacgctttctctgtttgatatcacgcagaaaaacgtgacaacccgtgatccggttacccgcattagcgagcagattggcaagattggttcaaaaggcgcggaagccgaaattcattctaaaattaccccagaaatcaatctgatggcgtcgtatacctataccgataccaagacgaaaagtgatagaaaccctgctcgtgtcggtaaaagagtgccagcggttcctgaacatgcggcttctgtatggggtagctatagtttcaaacaatccgtactggaagggcttacgctgggtactggcgtgcgttacctcggtaccacttccggtgattttacagaaaaattcaatgtaccgtcctacactctctacgatctgatggcaaaatatgatcttggtgaagcgtcacctcagctaaaaggtgccagtgtacaactgaacgtgaataacctgaccgacaaacgttatgtcgcttcgtgctcgaatgacggagcctgcttctatggcagcggtcgcagcattttcgccactgtagcgtatagctggtaa

SEQ ID NO: 2242 - DNA, 120 bp, Xenorhabdus bovienii
  Coding sequence Name=Xb4151_4152.C432.gene139.dna; Position on contig= 87659..87778bp; Strand=-
atgcggaattcagttgctaaattaggcacggttttttcctatattttattgactgttattttattttttctgcctgttacggttcgaattagaaaaacgtattacacctgtgttgtataa

SEQ ID NO: 2243 - DNA, 1185 bp, Xenorhabdus bovienii
  Coding sequence Name=Xb4151_4152.C432.gene140.dna; Position on contig= 87750..88934bp; Strand=+
gtgcctaatttagcaactgaattccgcatatcccaattgcaggatttttgttgtgatgattttgtgttcctgtcatctaataaaagtctacatgcacacggatgctttaccaaaataaccacgccagtcggtgataatacagatactgactgccaattacatcgcgatatacctgagcttttccgtcaggctaaaaataaaggtattgaaaaccccattatagtgggtgcgattccatttgataaacgccagccttctgctctgtttattccggaagattactcttggctagagcgtgaggcattatctttttcatctgtttcttccggccccaaattacagcagataaattcattgccggataaagacgaattctgccagatggtgactcatggcgttgatgcaattcatcatggtttgctcgataaagttgtcctttcccgcctgctgaacatcaaatttgaccaacagcctgatgctacgcagttatttatgcggttgaatcaacaaaacccttatagctataacttccatgttccacttggcaacagcacccttatcggtgccagcccggagttactactgtgtaaacaggggagtaccattatctctcagcctctggcgggttcttcacgcagaggcagcaacgtcatgcaagacaatgagttgcgtcaatcgctattgcgttcagcgaaagatcagcatgaacatcaattagtgattaccgcaatgagaaaagcattagctgaacgttgtacagaattagctattcctgagataccttcgttactcagcacccccttgctttggcatctcgcgacagaaattcgtggtgaattagccgataaacagatagatgccctctcgatcgcttgcttgctgcatccaactccggcgctgtgtggtgctcccagacagcaggccgcgacgctgatttctgaattggaaccgttcaaacgcgactattttggcggtattgtcggttggtgtgatgccagaggtaatggcgaatgggtcgtgacgattcgctgtggtgaagtgtttgaaaaccatattcggctctttgcaggagcagggattgtcgctgactcgaaacccagtgccgaatggcatgaaacagatgtgaaatttggcacgatgctacaggcgctgggattgtcttacgataaggaacgttgtttatga

SEQ ID NO: 2244 - DNA, 531 bp, Xenorhabdus bovienii
  Coding sequence Name=Xb4151_4152.C432.gene141.dna; Position on contig= 88931..89461bp; Strand=+
atgaatattgaattcactcactggcctgagaaattagcgcaacactatcgccaatgtggttattggcttgacttaccgctgagcgacatactcagccgccaagtcgccaatgaaaatatcgcccttattgctgacaaacatcagtatagttaccaccagctcaagagtctggaattattacaattacaggtggggggtgcacggttgagtgaatcatcagccagaagaataccttccgagcttggctgccgcttacagcaggtatttggcatggcagaagggctggtgaactacacacggctggatgacgatgaacaaaccattttcacgacccaaggccgcccaatcagcgcagatgatgaagtatggatagcggataaacaaggcaactctctgccacacggtgtcaccggcaggttaatgacccgtggcccattacacagcacaccctatttcaagtcggagaaacccaatgagcatccccaaactaaacgattatcttctgcctgctgttcaggaattacctgttaa

SEQ ID NO: 2245 - DNA, 888 bp, Xenorhabdus bovienii
  Coding sequence Name=Xb4151_4152.C432.gene142.dna; Position on contig= 89403..90290bp; Strand=+
atgagcatccccaaactaaacgattatcttctgcctgctgttcaggaattacctgttaataaggtgaattgggcatttgatagcaaacgggcggctttgctcatccatgacatgcagaattattttctcaatttttggcaacctgatagtcagctagtgacgcaagtcatcgataatattgcccgcctgaaaatacagtgtcagaaacttggcatacctgttttttataccgcgcagcccgaccaccagagcgatgctgaccggggcttgcttaatgatatgtggggggcagggctgaataaacatcctgaacagcaaagtatcactgacgcattaacacccgaaagtgatgacacgttattagtcaagtggcgctatagtgcttttcaacgttctgatttggaacagttactgaaaaatagcgaacgggaccaattaattatttgtggtatttatgctcatatcggctgtatgacaaccgccactgatgcctttatgcgtgatataaaacctttcttcgttgcagacgcactggcagatttcagccgcgaagaacatatgatgtctctgcgttatgtcgcaggacgtagtggccgtgtactgacgacggcaacattgctcaatgaaatgtcactttcttctctaggggagaagaaatgggatcgggaacaccttcgtgctgaaattttaccgttattagacgatgactgtggcgacattgatgatcatgaaaatttacttgattacggcctcgattcggtacgaatcatgtcgttgataacgcgctggaataatcagggtcatcagctagatttcatcacgctggttaaaacaccaaccttatcgaactggcttacgctgttgactgataaacgggaggtcaaataa

SEQ ID NO: 2246 - DNA, 132 bp, Xenorhabdus bovienii
  Coding sequence Name=Xb4151_4152.C432.gene143.dna; Position on contig= 90243..90374bp; Strand=-
gtggctggcaatttgataacctattccacgcccagcccccgtgatccagacatttttaccgctgaaatcaagaaaaagcgctcattatttgacctcccgtttatcagtcaacagcgtaagccagttcgataa

SEQ ID NO: 2247 - DNA, 108 bp, Xenorhabdus bovienii
  Coding sequence Name=Xb4151_4152.C432.gene144.dna; Position on contig= 90496..90603bp; Strand=+
gtgattaatcttcatacggcatttgattattttttcaatcctaagcgggcagcccagcccgctcccccatatttaaattcaagcatgggaagcgatccagttacctag

SEQ ID NO: 2248 - DNA, 687 bp, Xenorhabdus bovienii
  Coding sequence Name=Xb4151_4152.C432.gene145.dna; Position on contig= 90886..91572bp; Strand=+
atgacaaaaagagctgatataaaaaatgaaagattggtttacacagaaaaattagggtggttagacttagggcatgctaacggtgatgatgctaggaagctaatgatttctctttatttgggggataatactactgaggaatcgcattttattgttagatatgtccaatatatggggaggggacgaaactatgggacatctataaaaacaagatggagagttaagagaggtttatctttgcatgatacgaagagagttgctcttactatcatgatgtatacaactcattcatttgaatcgtaccaagattcctttccttttacttggttttcggatagtggttatagcggtgaggatttaatttctaatttatttggtttttatcaggctgttaatgatattaattatttgcctcaagtaggggtagtaagtaaggatgaggcatttaaacggtgggattactatgggcctataggaaaatataaaaataaaacttttaaaccgctcttatttcctgatcctgaaaaatacccaaacaatgcaagaccttatcatgcttcactacctagttttttaaacactataatacctataagtgacataaaaactagtcaagatgtaatgcttattgaagatgcaagctggattaatgtaggtaaagaatatgctgggatttcggttgagtaa

SEQ ID NO: 2249 - DNA, 423 bp, Xenorhabdus bovienii
  Coding sequence Name=Xb4151_4152.C432.gene146.dna; Position on contig= 91550..91972bp; Strand=+
atgctgggatttcggttgagtaattttatacgtatatgtatcgttatatctgttttaattgtgggtgttcttttttttattgcttcattagcaaatgtaaatttgtcatatacaaaaagaaacttcatttactatcatacatttacctttgatgaaattaaaaatataccattagtttcaaatgattacatcatatactatgactctcctgatggctcacaaataatgactaatgaaattgttttttcaaatgtaaacttgattcgtaaaaaggagctaatagaatatgttgagaatatgggatttaaaaaatattttgataaatattggaatgaagatagttggcgaaaagataatgtacgaataagtataaaacaaaatgataccgaacgtaccattttgtttttagttgagataagttaa

SEQ ID NO: 2250 - DNA, 480 bp, Xenorhabdus bovienii
  Coding sequence Name=Xb4151_4152.C432.gene147.dna; Position on contig= 91969..92448bp; Strand=-
gtggccaatattatttacatgactataaatggtaaaaagcaaggtcttatatctgccggatgctcaacttatgattccataggaaataaatatcaagaagagcacaaagataaaatacttatttatgctgtagaccatgatataagtagagagcaaaatgtaaatcaccagcctattgtaataacaaaaccaattgataaatcatctccactattaggagttgcaatatcaagcaatgagagtttaaattgtgaaattgatatatatagaaacagttcatcaggtgggctagaaaaattttattcaatgaagttaacaaacgcaaccataaaaaacatatctatacattaccctaactcgctaaatcacaatgatatgcaaccatatgaatgtataacaatttcatatgatagcataacttggacacaccatactgctggaacatctggttacagcataagagaagataatgtattttaa

SEQ ID NO: 2251 - DNA, 120 bp, Xenorhabdus bovienii
  Coding sequence Name=Xb4151_4152.C432.gene148.dna; Position on contig= 92551..92670bp; Strand=-
ttgcacaacagggttttattggcctttgggtttgaaggcagaggcttgcatttagggcttttagtacgcccctatggggtgaaattaatgccgccttctatgaaagcagatttttactaa

SEQ ID NO: 2252 - DNA, 1050 bp, Xenorhabdus bovienii; identical to SEQ ID NO: 483
  Coding sequence Name=Xb4151_4152.C432.gene149.dna; Position on contig= 92746..93795bp; Strand=+

SEQ ID NO: 2253 - DNA, 177 bp, Xenorhabdus bovienii
  Coding sequence Name=Xb4151_4152.C432.gene150.dna; Position on contig= 93792..93968bp; Strand=-
atgcacaactttcatggctacaacaatgcaagaaaaagaaggcatgagcgcagaaaagagcaacaagaagcgtataacaaggatgaagccataaatatggcattaaagactgctctccatcctgaagaaattacaataccaacacgaccaatattatcactaaatatacgcaattaa

SEQ ID NO: 2254 - DNA, 630 bp, Xenorhabdus bovienii
  Coding sequence Name=Xb4151_4152.C432.gene151.dna; Position on contig= 94310..94939bp; Strand=-
atgagtcttgcagatagagtcaagaacagaaggtttgagttaaagttaactcaagcggaggcggctatgattgctggcattagtcagcaatcttgggccgtcattgaagatgggaaaactctgaggccacggaatataataagcatagccaaggccctgaaatgcgatgctgaatggctaatgacaggtggtgatttccagcccctttgtgatgtaaacattcgaaaagtgccgttaataagttacgtacaggcagggaagatagcgagaggctttcctatgcgcggctacgatgacttaaaacacattataaccgatatgaattggtcagaacgcgcatttgcattgcgtatagacggggactcaatggaacccgattttaaggctggtgatattgttgttatcgatccagaagttactcccaatcccggagagttcgtagtagcagcaagctatgaacgggaggcaacatttaaaaaatacaggccaataactataaatattgatggaacacagcactttgaactcatcccattaaataatgattatcctattttagataatcagcggataaaaatcaccattataggaacaatggttgaacatcgaatttaccgtagaaaacgataa

SEQ ID NO: 2255 - DNA, 126 bp, Xenorhabdus bovienii
  Coding sequence Name=Xb4151_4152.C432.gene152.dna; Position on contig= 94954..95079bp; Strand=-
ttggtttttaatcgcttggatatagtttccatccttgcaaatctcctttatacaaatttgattgtatttaataacacattatactgtttgtcaaatacagtttttgttgtaagaatcctactttaa

SEQ ID NO: 2256 - DNA, 201 bp, Xenorhabdus bovienii
  Coding sequence Name=Xb4151_4152.C432.gene153.dna; Position on contig= 95048..95248bp; Strand=+
atggaaactatatccaagcgattaaaaaccaaacgacatgagctgaatatgactcaagctcaattagctgaactatctggaacaaggcaacaatcaattcagcgaattgaagctgggatcactaaacgccctagatttattttagaaatttctaaagccttagattgcgatccattatggcttcaatacggctcaaaataa

SEQ ID NO: 2257 - DNA, 147 bp, Xenorhabdus bovienii
  Coding sequence Name=Xb4151_4152.C432.gene154.dna; Position on contig= 95336..95482bp; Strand=-
ttgaataaattcggcatcacccgactggtaaacgtcgggcattattacgttgtggattggatgtatattcacgattggaattggcctttctacgtgccgaacggacgtgttcgatacgcaaaaattacgaagttaaattttgtttga

SEQ ID NO: 2258 - DNA, 312 bp, Xenorhabdus bovienii
  Coding sequence Name=Xb4151_4152.C432.gene155.dna; Position on contig= 95441..95752bp; Strand=+
atgcccgacgtttaccagtcgggtgatgccgaatttattcaaaagattctatccgcgatgaaaccaaccatgcgggagtatgcgagagataaatacgcctacgtctacaaactgcggcgggatgaagatccagtgtcatttcgccgggataacaccggggctaaggccgctaacacatggctcaggctgtatttcaaaaagcattacagatcgatgcaaggttatacagaagcgccgttgttagccccgaaagcacagccagaggacaagcccaattcaggagttgtttcagggcaaggagccagccagtag

SEQ ID NO: 2259 - DNA, 303 bp, Xenorhabdus bovienii
  Coding sequence Name=Xb4151_4152.C432.gene156.dna; Position on contig= 95617..95919bp; Strand=+
atggctcaggctgtatttcaaaaagcattacagatcgatgcaaggttatacagaagcgccgttgttagccccgaaagcacagccagaggacaagcccaattcaggagttgtttcagggcaaggagccagccagtagcaccgaaaatggctgtgtcttctggctgtggaacggagcttaggggatcactagggctgagtatgaaaaaacagccaagtgagaatgattatcaaagtggggaaaagccaaaaaactggcagtcacgaaaagtactaaatatgtacccccctattttttttggataa

SEQ ID NO: 2260 - DNA, 831 bp, Xenorhabdus bovienii
  Coding sequence Name=Xb4151_4152.C432.gene157.dna; Position on contig= 95926..96756bp; Strand=+
atgaatctcattaaaaaagcagaaaaaattattgcaagacgcaagcaattgatcgcttggaaaccagcaaaagccgttgccgcactggtgaaaatcggaatgagcgagagcgaagcaaaggagtttgtgaataaaaactcaccggaaaggaagccacacaagccacacaaaccacacaacagccacgcaaaacccgtgaatctggaagcattgagcactcactacatcgtggttggtgattacgatttgctaggcctgaaacatcaggatgcactgattgccgctatccgaaacggcaaagggaagagttcatggcgtgatgaatcaatggcggtaaccctgttcggattagtcaaagcgtatccgatcatcaccacagccgaagtaaacaaattcctcaaccgtggcgcattcatcgacagcattccactgttcattgacggggagatgataggaggtgaagcgatgccgtcagcagataacgacagcgtgaaagacgtttttcgtgcggttaagcaactgaaaaaaatcactgaacacttagcggatactggcgcattaactctcaataaataccttgatcgcgtaccgactgacgaagacgtcaagcgcgccgttggcattgtcgcaccggcaataacaaacccgcacttccataaaatcgattatgcgcgccagtacagcaatatgcctgcacacgagcacgccgaagacagcaagcggattatcaatgagtggaaaaacgaactgaaaatcaaaggaggcaagaaaccgaacagcaaaactttggcgagtacgactgattcggatcttgcggaggaggcgaaataa

SEQ ID NO: 2261 - DNA, 201 bp, Xenorhabdus bovienii
  Coding sequence Name=Xb4151_4152.C432.gene158.dna; Position on contig= 96756..96956bp; Strand=+
atgaacacttcatctcaaaaagattatggcactaataccgacttattcgcaactttatgtggatctcagcaacttgttgatgttgccatcaccctgattcgggaaggccggaatcttgaagcagagagcatattgcgcagagcgaatgttgtttctgtatccgccatcgagaatcataaagccgctttattgggcaaataa

SEQ ID NO: 2262 - DNA, 1080 bp, Xenorhabdus bovienii
  Coding sequence Name=Xb4151_4152.C432.gene159.dna; Position on contig= 96968..98047bp; Strand=+
atgctaaccattacccccaactttgcacaggaacgcgctttaaacatgctgcgtcaggactggaagcgcttcaattcttttatggtgtatgccccgacaggcgcaggtaaaaccggattatctgccttcatcacagacggttttatatccaaggggatgaaggtcatgatgatctgcccgttcaccgtcctgatcaaccagactgcccagcgctttattgagtatggcttgccggaggatgaaatcgcctatatctggcgtgaccaccccaatcaagacccgtcaaagctgattcagattgcgtcggctgacacgctgatccgccgtgactttcccgaagacattaacttgctggtgattgatgaagcgcacctgaaacgcaaaaagatactgacagagattacgcggttgacctctgaaacagattgcaaggttatcggattatccggcacacctttctcgccgttcctcggtcactattatcagaagctgataaagcccaccacgataaaagagttaatccagcgtggcgacctgagtccttacgagttttacgctcccaccaagcccgatttaagcaaggtgaagtctgcccgcaatgacgactacggcagcgattacaaggaagacgagatagccgaaatcatgtgcggggctgatctggtcggggatgtggtcagtagctggctcaagctgggcgaaaatcagcctactatctgcttctgtgtcaatgtcagccacgccaactttatcacggtcgaattcaatcgcgccggggtgaatgctgaaatcatgacggccaacacgccccacgatgaacgggatttgatcatccatcggtttgagcagggtgcaacaaaaatcatcgtcaatattggcgttctcgtggcaggttttgacagtgatgtccgctgcattatctacgcccgtcccaccaagtcggaaatccgttggttgcagtcaatcggcagatcgctgcgtccagtcgataacttttcaaaactgtataccgaatacctttccaaaagaagcagcttacttgcaggcagggaaatcaaggaggctaatcatggaatttaa

SEQ ID NO: 2263 - DNA, 810 bp, Xenorhabdus bovienii
  Coding sequence Name=Xb4151_4152.C432.gene160.dna; Position on contig= 97818..98627bp; Strand=+
gtgcaacaaaaatcatcgtcaatattggcgttctcgtggcaggttttgacagtgatgtccgctgcattatctacgcccgtcccaccaagtcggaaatccgttggttgcagtcaatcggcagatcgctgcgtccagtcgataacttttcaaaactgtataccgaatacctttccaaaagaagcagcttacttgcaggcagggaaatcaaggaggctaatcatggaatttaaaaaagccttctcgtggcgttctgatgacatgcccgaaaccactgaggccgttgtgtatgtatccagatgcggctcggtggttaaagcgggtagttatcgtctttggaacaaaaagaatcagtcctattcagttcggaaggagcggatataccgacaatcaaccaacagaggcaaggatgcgaaatcaaaaaacacccgttacggtaaatatcagcatgtttgcattagggatcgctcgtatcaggtacatcgcttagttgcattggcttggataccgaaccccgacaataaacctcaggttaatcataccaatggaatgaagtcggacaatcgtgtcgaaaatcttgagtgggtcactaatttagaaaacaggcgtcactcaggagagaagttattcagaaatatacctcatggtgagcaggtaggaacagccaagttaactgctaaagacgtcattgaaataagagaaaggttaaaaactccctataaggggctttgccgtgacttagccgctgagtttggtgttgtcgcatcaactattacatggattaaacaaggtgaggtctggaaacatgtttag

SEQ ID NO: 2264 - DNA, 840 bp, Xenorhabdus bovienii
  Coding sequence Name=Xb4151_4152.C432.gene161.dna; Position on contig= 98572..99411bp; Strand=+
ttgtcgcatcaactattacatggattaaacaaggtgaggtctggaaacatgtttagagtcttgttcaaaacggcctgtaaagatgatatcgagcatgtacgcgacatcatcatgaaccttcaccaagataatggtgacactattattgtttctgacaatgacttaccagcagacattgttatcaatgtacccaaagttcagaagaaagcggccatcattctggatcactccggctctgtgcaccgtctcggctaccccgatgatatcgaatacgacgaactgcccagcaagaatgacggcatgaaatccagttccagctaccgtgagcaggagaagcgggagaagttaccgaaagaatgctcctcctgtcattacatgaagccagcaggggtctatgtctgccccaagtgtggctttaagccattggtgggtgaaaacattgatgtcgataccagccgcaccatccagaaactcagtaagaaagagcgtatctacacccaagccgaaaagcaaagtttctactcgcagttgaagtattaccagaaccagcgcgcctcacagggtaagaccatcagtgacggttgggtatccaacacctttaaagacaagttcgacgtttggcctcgcggtctccatgacaccccacaagagatgacccccgaagtcagtaatttcatcaagcacaaacaaattgccttcgcgaaatcccgcaagaaagcggaacaggtgcaaccgcccagcaacgagcagcaggaaatgcgtcttgaggttgctcaccaaaaagtgcgcgatatccgtgaaaaattaggcagatcatcacatcagggagacaggctgtga

SEQ ID NO: 2265 - DNA, 981 bp, Xenorhabdus bovienii
  Coding sequence Name=Xb4151_4152.C432.gene162.dna; Position on contig= 99408..100388bp; Strand=+
gtgaacagaataaatacgaccgatgccgttattggccactggcctaaagttttcgaatactacggtttaccgcccgtgacaggcaagaagcactttaaaggaaagtgtccgatatgtaagcagataggcaagtttcgcattgatgatcgtgacggacgcggaacattcatctgtacctgcaatgccggggacggctgggcactgctcaggttgacgcagaaaaaagaatttaaggtgctggcggatgagattgatcagctattgggtattcagcgcgataaggtcacacccaaacctaaagcaagcacggttgcagataaccgccaaaagataatcaccctttactcacgcatgccggaactgaaaggcacctcagcggaaaaataccttcaaagccgggagatttacagccatcaccccattgagcaaatccgcttctgtgaaaagcagccgacctataaaggggattatcaggcgatgtgggcattagcgacagactcacgcggtcaattgtgttacctgcaccgaacctatctggacggggatcggaaagcgcctttagatgtgaccaagaagatgatgtcgctacaggaagccagttatctggcgcacgccgaatcggtggctatcaggatgtcgcctgtggattcaacgctgggcatcgctgagggcatcgagacggcactgtcctgcaagcaactttatggtgtgaatacgtgggcagtgctgaatacggcattaatgaagcgctttaaggctccccgtggcgttaagcatttaatcatttttacagatatggactggaacgccgcaggccatgctgccgcgatggagtgcgcacataaaaatttattgagtcataacgaggtagaaaaggtcagtgttcgctggcctgaccgtgacgattttaacgacatgctccagaacgcggacgaagtccggcagttggtatttatgaaaaaacagcgggagacagcataa

SEQ ID NO: 2266 - DNA, 420 bp, Xenorhabdus bovienii
  Coding sequence Name=Xb4151_4152.C432.gene163.dna; Position on contig= 100388..100807bp; Strand=+
atgcgtgatattcagatggtattagagcgctggggggcgtgggcggctgataacagagaggatgttaactggccgtctattgcggcggggtttaaagggctgatccccagtaaaatcaaatctcgggtgcagtgttgcgatgatgacgcaatcattatttccaactgcatggcaaagttgaaccaaaaaaatagcgatgcgcatgatttactgttcgactattacgtattcggtaaaacgttcatgcaattagcacgtgatcataattgttctgatgggcacatcgggaagaagttacaaaaatctgaggggatgattgagggaatgctgatgatgttagatattccattggagatggataaatgcgtccaaaaagaaccaataaatattaaccagcatcagttgtgtagtattttctga

SEQ ID NO: 2267 - DNA, 195 bp, Xenorhabdus bovienii
  Coding sequence Name=Xb4151_4152.C432.gene164.dna; Position on contig= 100925..101119bp; Strand=-
atgaacacgaacgcatacaccctgattggacgcgctatctgtcagttattggatgacaacacaccgatttataaaacgactatcggcgaggcgatgtcggatatttttaacgccgaatatcgcggcgtctatgatgaacgatgcgaaacattcaatgacgcgctgaaattactgatgaataaaaatgaaaattga

SEQ ID NO: 2268 - DNA, 279 bp, Xenorhabdus bovienii
  Coding sequence Name=Xb4151_4152.C432.gene165.dna; Position on contig= 101477..101755bp; Strand=+
atgaggaaattaaccatgtacgcattaaagctaatcacagaaagaaacggtcgttcagtagaagagtcatggatcttgggagacatgtatcgtctggagtttttcccgaaagatgtcgctgataatgttattgcccgtgtcgagcatagccagaacggcaatctgattaatcacgacatcaaaaaaacagaccaagcctacattaccactctgacgggtgacactgttcgcacggtctgtcgaggccgaagtggacttgtagctggttccatacagtaa

SEQ ID NO: 2269 - DNA, 114 bp, Xenorhabdus bovienii; identical to SEQ ID NO: 1265
  Coding sequence Name=Xb4151_4152.C432.gene166.dna; Position on contig= 101776..101889bp; Strand=+

SEQ ID NO: 2270 - DNA, 156 bp, Xenorhabdus bovienii; identical to SEQ ID NO: 1266
  Coding sequence Name=Xb4151_4152.C432.gene167.dna; Position on contig= 101893..102048bp; Strand=+

SEQ ID NO: 2271 - DNA, 237 bp, Xenorhabdus bovienii; identical to SEQ ID NO: 1267
  Coding sequence Name=Xb4151_4152.C432.gene168.dna; Position on contig= 102023..102259bp; Strand=-

SEQ ID NO: 2272 - DNA, 333 bp, Xenorhabdus bovienii
  Coding sequence Name=Xb4151_4152.C432.gene169.dna; Position on contig= 102409..102741bp; Strand=+
atggggtggaatatgaagatgaaagaaaatcctgatgtatgggctgagctgctcaatggcctgcaaaattcgtggccgcagatatccggctctgttttggcaatagctatctgttatggccgcctgatttatgacggcgtggaacgcaagaaccgttgggtcgaagcgctgctctgtggtgccttgtcatggagcgtgtccagtggcttagagatgtttggcgttcccagtagtttcgcgccggcaatcgggggtgtcattggttttattggcgttgaaaaaatacgtgagtttgctatccgtgccatcaataaacggttgggagataaataa

SEQ ID NO: 2273 - DNA, 402 bp, Xenorhabdus bovienii
  Coding sequence Name=Xb4151_4152.C432.gene170.dna; Position on contig= 102741..103142bp; Strand=+
atgaccagaggcattcgtaataacaatcccggcaacattgaccacaactcagcgaataagtggcagggtcaattgcctcacgacccgaagattgaatctcggttttgtcggtttgaatcaccagagtatggtattcgggcactgatgaagctgttgtgcaattaccacaaaaaaggctatcagaccgtcgcgaagatgatagaccgctgggcacccactaacgaaaataacacttcggcttatatcaatggtgtggccaaggcgttaggtgtcgatcctcatcaggtgatgactgtcgataaagtgacgttgattggattggccaagtccatcatccggcacgagaacggcaagcaaccgtattcagaggcaacgtttgagaaagcgtttgagcttttatga

SEQ ID NO: 2274 - DNA, 468 bp, Xenorhabdus bovienii
  Coding sequence Name=Xb4151_4152.C432.gene171.dna; Position on contig= 103139..103606bp; Strand=+
atgaagtggaaagttaaagctgtttcagtggtagtcggtatcgttctgattggttcggctgcatattccatctattcagtgtatgtggaaaatggacggctcacagatgagaaaaagtcactgactactcagctatcagagaaaaacgccatcatcaccaaccagcaagcacgaatccaaaaccttgcagagctggagaccaaacacattcaggaactcgacaatgccaaatctgaaattgatactcttcgggctgatgttgccgctggccgtcgcaagttgcgcatcaaagccatctgtccctccgtgcctaacaccgttgcctccagcagcatgggcgatgcaaccaccgtcgaactctctggagaaactggatcaactgttctcgatatccgagaaagcatcatcaacgacctcgcaaaattaagatatttgcaggattacataaaaacggagtgttcccgatga

SEQ ID NO: 2275 - DNA, 225 bp, Xenorhabdus bovienii
  Coding sequence Name=Xb4151_4152.C432.gene172.dna; Position on contig= 103603..103827bp; Strand=+
atgagtatgacattaggacaaaaattggtaggtattagctttaacccaggcggtaatattctggttgatgcggtaaaacagaatgccgctgacacaattgatttaattcaagacagcatgcagaaagcgacatcagaagaagcgctgatgattcacaacgaagcggtgcgtcgcattatggacgcccagatgtgggcagtaaaagcgatcacgtggaaagactga

SEQ ID NO: 2276 - DNA, 177 bp, Xenorhabdus bovienii
  Coding sequence Name=Xb4151_4152.C432.gene173.dna; Position on contig= 103755..103931bp; Strand=-
atgattttctttaatacttatctgaatctgccccttcgccttctggacaaaatcataccacatcaccccagtctcatttgctctggggtggctgtttatttatgtcagtctttccacgtgatcgcttttactgcccacatctgggcgtccataatgcgacgcaccgcttcgttgtga

SEQ ID NO: 2277 - DNA, 843 bp, Xenorhabdus bovienii
  Coding sequence Name=Xb4151_4152.C432.gene174.dna; Position on contig= 103918..104760bp; Strand=-
atgtatacctgccccatttgccttcaaaagttttggaagccagctaagttagagaggcatatgcgagcccatacaggagagaagccttttcagtgtgatatttgcgaatacacgagtcctcgggaggacaacttaaaaaggcatatgcgagcccatataggagagaagccttttcagtgtgatatttgcgaatacacgagtactcggaaggacaacttaaaaagtcatctgagccgcatgcataatatgaaccgcgagtataatactccgattcctgtccaaaactatcaacccagcacttctggtttgaatacgcagccccctaacacattcacatcttcgctaaaacaaagaggtgcatcaccatctaatgtcgataacagcgcaacttttgctcgtatgcgtcaaagtatgcaagaaccagatagacgacaaagagccccgcacctcatacctgctgcacaatctggtggtcctgttagggagctaactccttcgacatcacaacatcctaccccatatcagcaaccggctactcaagaaagattttcaacattacgctctctattagaaaatagcccttccccgcccgaaccatctggtttgaatgtacgacaaagaagtgtatctccttatccttatgaacgagcgccactatctatacaaccaccgggtgctccgaggccacaaactccactgtcaccaccttcagtgcgcacaacttcaccaatagggcatccagttcgatcgcgatcggttagccctaccgcagaattcctgagaagaaattcttcgtctgaggcattaccccggttagatatagatgatgatgattttctttaa

SEQ ID NO: 2278 - DNA, 114 bp, Xenorhabdus bovienii
  Coding sequence Name=Xb4151_4152.C432.gene175.dna; Position on contig= 104709..104822bp; Strand=-
ttgttattgaggaaagatgggggtatggattattgcaaatatattatttattggaggttcttatgtatacctgccccatttgccttcaaaagttttggaagccagctaagttag

SEQ ID NO: 2279 - DNA, 120 bp, Xenorhabdus bovienii
  Coding sequence Name=Xb4151_4152.C432.gene176.dna; Position on contig= 104858..104977bp; Strand=-
gtgttagggtactctgtgtcatgttctgttctccaaaaagaaaaaccaccagcgttaactgatggcatggggtattcctttaaccactcaagggaatgggtaaaggaatattggctttag

SEQ ID NO: 2280 - DNA, 354 bp, Xenorhabdus bovienii
  Coding sequence Name=Xb4151_4152.C432.gene177.dna; Position on contig= 104956..105309bp; Strand=+
atgacacagagtaccctaacacataccttcatcattgatttcaagtgtgacactgacacactgaaccaacttaaatcacagttgaaaaatattgctgaacaagtgggtcgcattaacggtcgtcgctatgacgcaggtataacactggcagtagatacaggtgctaaggctcgaattgctgccgatagcttcaaggtcttcgatgtaaccggaaaggtttacatgaaagaggcggtcataccccaagcggtaataaaggataacgacgatcacctccgtcagataatccgtgaagagatacgccagttcgtcacccgtgagagacgaggcggcggtctgttctacaagaggtaa

SEQ ID NO: 2281 - DNA, 333 bp, Xenorhabdus bovienii
  Coding sequence Name=Xb4151_4152.C432.gene178.dna; Position on contig= 105314..105646bp; Strand=+
atgtcccaaatctacaacagcaaatggagtaaggcacggctggcgttcttgcaacaacatcccttatgtgtgatgtgccgtcagcagggcaagttagccccggctactgtggtcgatcatatcgtcccgcataaacttaaggatgcgattaatgccaatgatagcgaggccattaaaatcgcacggcgtttgttctggggtaaggcgaactggcagtcactgtgcgcctcacatcacaactcgactaagcaacgtattgagaagtgcaatcgagagattggctgcgatatcaacggcatcccgatagatgatcattcacactggaataaatga

SEQ ID NO: 2282 - DNA, 168 bp, Xenorhabdus bovienii
  Coding sequence Name=Xb4151_4152.C432.gene179.dna; Position on contig= 105621..105788bp; Strand=+
atgatcattcacactggaataaatgacggaataaaatttatatcaaccggaatgaaaacaaatgcaatgactttatgcgtaatgataactagggtgattataaagttccatccagaaagtattagaccgccgctatccctcaacgatatcgctaacgcagttttttaa

SEQ ID NO: 2283 - DNA, 474 bp, Xenorhabdus bovienii
  Coding sequence Name=Xb4151_4152.C432.gene180.dna; Position on contig= 105842..106315bp; Strand=+
atgacaaaacgcacgcgttcagacagcctcaaaggcaagatgcaggcgattgtcaacgcatttcaggacaccctcgaaccgccggcgcacgcaggcttaatgccggaagccatcgacttttacaatgacaacattcgcacaaaagcgctcaatctctggacaccttccgacctgattgaagtggtcagtctggcgaataaccaatatgccctgatggaagtcagtcactacctgcgcaagctggagtcggattactccgagacccgtgacgaaaaggcgatcaaggaaaaccgcaagtacaaactcgaattaacccgcgtgattattgcccagcgctccggtctgcaaatccattcacgcgccaccaatggcgaaagccgtgaccagcgcaacaagaatcaaaacgatgccgacgcccgcgccttgctgggcgaagttgaggacgatggcttgctggcgtcgccctggcactaa

SEQ ID NO: 2284 - DNA, 1527 bp, Xenorhabdus bovienii
  Coding sequence Name=Xb4151_4152.C432.gene181.dna; Position on contig= 106325..107851bp; Strand=+
atggtcagtcaattatcgcgcggtgagaaggtcatcgcgtttatcgagcgttattgcattgtgccagaaggggtgctgctggggcagcccatgcggttagaggcgttccagaaacaatttatccgggatatctacgacaatccccacggcacgcgcaccgcgtacttatcgattgcccgcaagaatggcaaaacgggattgattgccggcattctgttggcccatctggtcggcactgaggcggtgcagaattcccaaatcgtaagcggtgccatgagccgggaacaggcggccattgtgtttaatctggcggtgaagatgattaacctgaacccccggttgcagcagcttattcacattatccccagcagcaagcggctgatcggcaaaccctgcaatgttgaatacaaggcactgtccgccgatggtaaaacgacacacgggctgtcaccggtgctggcgatactggatgaagtcgggcaggtgaaaggggcgcaaaacgattttatcgacgctatcacgacctcgcagggggcgcatgaaaacccgctgttggtcgctatcagtacgcaggcacccacggatgccgatttactcagtatctggctggatgatgcggcaaactccaacgaccccaaaatcgtttcacacgtttacacggcaccgatggatttagccattaccgatccggcggcatggcgggcggctaacccggcgctggataccttccgatcactgaaagatattgaggaacacgccaaacgtgccgcgcggatgccgtcacaagaaaacagcttccgtaacctgatgctgaatcagcgggtatcactggtgtcgccgttcatttcccgcaatacatggatggaatgcgccggggaactggagcctatcgtcggcaaatgttacgccgggctggatttgtcggcagccaaagatctcacggcactggtgattatcggcaaatcggcgtcgggtaaatggaatgttcacccgttcttctggacaccggacaagacgctgctggatcgggcgaaaactgaccgcgtgccttacgacgtatggaaaaaacaaggctttttgcgcaccacgccgggggcgaccgtggactatgagtatattgcaaaagaactcgctgacattgtggaaaacttcgacattgaaatactccactttgatcgttggcggatagagatatttaagaaggaagtcaggcgggctggcttgtccctgaaaatggccgaatttggacagggctataaggacatgtcccccgccatggataaaacagaacagctattactggaagggcaggtaaaccacgctaatcatcccgtgttaaccatgtgtgccgcgaatgcggtggttgagcgggatgcggccggcaaccggaaactcgcgaaagacaaatccacggggcgcatggatggcatggtggcgctggtgatggcagcaggtgcattaaacaatgcgaaaggttcatcggggctggatgcgttcctccagaacccaatcatggtgggggtataa

SEQ ID NO: 2285 - DNA, 1224 bp, Xenorhabdus bovienii
  Coding sequence Name=Xb4151_4152.C432.gene182.dna; Position on contig= 107897..109120bp; Strand=+
atgggggttcccattggtttactggatgggagtttctggcaggaatggacagggatgagcagcagcggcaaaacggtcagtgcggacagcgccctgcaattatccacggtgtgggcctgcgtccggttgctgagtgaaaccgtatcaacgctgccgctcaagctgtacaaatcccatgatgacggctcccgtgaactggcgaaaaaccatccggtttaccccattctgtgcaaccgccctaatctggagatgacccaatcccggtttatgttaacggtggtcgccagtctctgtttgcgcggcaacgcctttatcgaaaagaagttcatcggtcataaactggtggcgctgatcccactgctgccgcaaaacatgaacattaaacgcttgccgggcggtgatattgaatacacctacgccgacaatagcggggaacatcagggcaggcgtcgggttatccccgtcaaaaacatgatgcacattcgtgggttcggtatcgacgggttgagcggattgatcccggtgaaaaccgggcgtgatgtgattggcgcggcgttatccacagatgaggcggcggccaaagttttcgaaaacggactgcaaagctctggctttatttctgcgtctgcaaataccgatttaaccgaagagcaaattaacggcattcggcaacacattcaggcgttcgtggggtcaaaaaacgccgggaaaatgatggtgctgccgggggatttgacgtaccagaacatcacgatgaacccggaggcggcacagttgttacaaagtcgcgcctacaatgtggaagaaatttgccgctggtttcgggtgccaccggtgatggtgggacacgccacaaaacaatccagctgggcatcgtcactggaggggatgaacatgcagttcctgacccacacgctcaggccgttgctggtcaatatcgagcaggaaatcgcgcggtgtctgctggattctgacagcgattattacgctgaattcaacgtggaggggctgctgcgtgcagacagcagagggcgggcttcgtactacgccacggcattacaaaatgcatggatgagccgcaacgaggtcaggcgcaaagagaatttaccgccaattgagggcggggacgttttcaccgtacagctgaacctgacaccgatagatctgttaggggaggaggtggagaaaaaattaccgccagaggataacaaccatgaagattaa

SEQ ID NO: 2286 - DNA, 852 bp, Xenorhabdus bovienii
  Coding sequence Name=Xb4151_4152.C432.gene183.dna; Position on contig= 109110..109961bp; Strand=+
atgaagattaaacacatgcctgtcgcaccggagggcaggccatttaacgcgaccgttaacgatatccgaccgctggcgctcgacaaatggaatggggggatcagagcgacgagtacggataacaccctctctattctcgatgtgattggtgagagtttttgggacgagggcgtcacggccaaacggatagcgggcgcattacgggcaatgggtgatcaggacgtcattgtcaatattaacagtccgggtggggatgtgtttgagggtatcgccatttacaacctgttgcgcaaccatagcgggcaggtcacggttaacgtgctggggctggccgcatccgccgcctcagtgattgcgatggccggggatgaaattaacatgggacgcggggcgttcctgatgatccataacgcctggacctgttgttgcggcaataaaaatgaactggttgcggtcgctgaggcactcaggccgtttgatgattcattgattgatatctatgccgcacgcaccggtatcgacaaggccagtattgcccaaatgatggacgatgaaacgtttatcaaccacaccgaggccatcgcgcagggatttgctgacgggttgttaaccgccgacgtgattgacgacggcaacgacagcccgcaagccgccttgcgcaaactggatgccctgctggctaaatcccatgtcccccgcgcagagcgcagaaaactgttcaatgcgttaaacgggcgcacgccgggcgctgcgtctcacaatcacggtatgccgggcgctaccgatatcaatattgacactttagccgaactggaaaagacgataaacgcctttgcaccggcacacccataa

SEQ ID NO: 2287 - DNA, 1212 bp, Xenorhabdus bovienii
  Coding sequence Name=Xb4151_4152.C432.gene184.dna; Position on contig= 109974..111185bp; Strand=+
atgtctgataccaatgaattactgaaaaacctgtctgccaaaatcgaagcggctaacagccagttcaatgccaaagccgaagaagccctgaatgaagcgaagaaagtcggcggactgtccacggaaaccaaggcggcggtggacaagatggcggcggaactgaatacgctgcgtgaagcggagaaatccatcaaggcggaattaggcgagctgcaacagcatgttgcacaaatgcccctgcacaatgcagtgcaggttgtgcagacgctgggccagcaggtgatttctgctgaactgatgaaagaggtgagcggcaatatttctgccaaccgccgcatttccgtgccggtacaagcggccttgacaaccccgcaagtgcctgaccgggtgatcgagccgcaccgtctgccggaaattgacgtgaaacccaaacatcgcctgtttatccgcgatttgattgccggcgggacaaccacgtctaacgcgattttctgggtgcagcaaactgggtttaccaataaagccgctgccgtaccggaaggtaccgcgaagccctacagtgatattcagtttgcgacgcaaatcactccggtagccacgctggcgcacatgttcaaggcctccaagcaggtactggacgatttcggacagttgaaatccctgattgacagcgaaatgcgctacggcttgaaatttgttgaagaacaacaaatcctgttcggtgacggggcgaacggcaatatcaagggcattgtgccgcaggccagcaagtacaaagcggaaatcaaggtcgacaaggcgaccgcgattgacgatatccgtctggcgatgttgcaggcgcagttagccctgctgccgccgtcggccatcgtgacccactttgtggactgggcgacggtggaattaatcaaggacagtctcggccgttacctgctatccaacccccaaggctatacctcgccgacgttgtggggactgccggttattgccacggatgtggcggcgttccgcggtaagtttctggtgggcgcgttcgattctgctgcccagatttttgaccgtgaacaggtgaacgtcgtgatttccagcgaaaacgaggacgatttcggcaaaaacatgatctccattcgttgtgaagagcgtctggcgctggcagtcaaacgcccggaagctttcatttacggtgacttcaccgcaacggccaaaggttaa

SEQ ID NO: 2288 - DNA, 321 bp, Xenorhabdus bovienii
  Coding sequence Name=Xb4151_4152.C432.gene185.dna; Position on contig= 111234..111554bp; Strand=+
atgatacctctcccaacaatcaaagatcattgccggatagactcaccccatgatgatgacctgctccggcaatatgaaaacgccgccctgcaatatgccctgaattataccgacagaaaaaccctgcatgtgccggaagccggggtgatcccgccggagtctcaggcgctgatattggatgaggcggttattcaggccattttactgctgatcggtcactggtatgagaaccgcacggccgtggttgtggggcagtcagtggccaccctgccatttgccgtgaaagccctgctgcaaccctataaacgctactgtctgtga

SEQ ID NO: 2289 - DNA, 321 bp, Xenorhabdus bovienii
  Coding sequence Name=Xb4151_4152.C432.gene186.dna; Position on contig= 111563..111883bp; Strand=+
atgaatattggccgattgcgtcaccgcatcgacattcagggtatccgcacccgccgaagtccatctggtggcgttgtcaacgaacgctacaccgtggcgacggtctgggcggaagcgaaatttatcagcggccgcgagttggtggcggccaagacggtgctgtctgaaagcctcgtccggttctggatacgttaccgtgctgatatcgataccaccatggctgttgtctttcagggcaaaacctacgcgattcaggcggcgatgccggacaacaaattaaccttgttggaattactctgtcaggagggtgtaaagcaatga

SEQ ID NO: 2290 - DNA, 444 bp, Xenorhabdus bovienii
  Coding sequence Name=Xb4151_4152.C432.gene187.dna; Position on contig= 111880..112323bp; Strand=+
atgacgaccgtggatttttcagcacttaaagacctgtcgcaggatttggcgttactcagcaaagccgagagcgacaaggtgttacgccgtggcacctatgccggggcgaaagtcctgcgcgatgagacccgcagccgcgcccccaaacgcaccggtaagctcaaaaagaacattatggcgactaaccgtaaaaagcagcgtgacggctcagtgtcttcaggtgtttatgtgcggggatcgaatcaatccggcaccaacagcgaccccaaaatgaagaaaaacgacccccgcaacgcctactactggcgctttctggaaaaaggcacctcaaagatggccccgaagccgttcattgatccggcctttgaatccaaatcagatgccgccgccgatgcggtatttaatgcggcgttgaaagccattgatgaggtactggcaaaatga

SEQ ID NO: 2291 - DNA, 336 bp, Xenorhabdus bovienii
  Coding sequence Name=Xb4151_4152.C432.gene188.dna; Position on contig= 112320..112655bp; Strand=+
atgacagacggcgatttgtttacattgttagatccggtactgcccggtcgggtgtttccctatttaatcccgcaaaccgaaagaaaaaccgcggcgccgtggtgcgtattttccacctacagtatctacaccgatgtactgagcggccagtcggtcaaaatgacgcgggttcagattgatgcctacgcgcccgggctggacgacgccgaccggatttgtggcgacgccttcagtgccatcaaaacattgcaaccttttgaagtagaacgtgagaacagttacgaaaatgacacggggctgtatcgcgcgaccgtcgaatttaaaatctattcctaa

SEQ ID NO: 2292 - DNA, 133 bp, Xenorhabdus bovienii
  unsure (1)..(133): unsure at all n locations
  Coding sequence Name=Xb4151_4152.C432.gene189.dna; Position on contig= 112606..112738bp; Strand=+
atgacacggggctgtatcgcgcgaccgtcgaatttaaaatctattcctaatcccggagataataggctaagtataaaaaacatgggtaagagtgcgaatngccccagtgcnnccaaacactacnntgcccccc

SEQ ID NO: 2293 - DNA, 192 bp, Xenorhabdus bovienii
  Coding sequence Name=Xb4151_4152.C433.gene1.dna; Position on contig =550..741bp; Strand=-
atgtctggcagtgccctactctcacatggggagaccccacactaccatcggcgctacggcgtttcactgctgagttcggcatgggatcaggtgggaccaccgcgctatggccgccagacaaattctgtgttcaatcccgaacaagctgctgtttttcatttgaaactgcgtctctctctcaccaaaacacct

SEQ ID NO: 2294 - DNA, 930 bp, Xenorhabdus bovienii
  Coding sequence Name=Xb4151_4152.C433.gene2.dna; Position on contig =974..1903bp; Strand=+
atgccaattcgtgtaccggatgaattacctgcggtgaatattctccgtaatgaaaacatctttgttatgacttcaacacgagcgaatattcaggatattcgccctttgaaagtgctgttacttaacctgatgccgaagaagatagaaacagaaaatcactttatcaggttattatctaattcaccgttacaggttgatattcaattgttgcgtattgatagtcgccaatgtaaaaatactccagaggaacatttggataacttttattgtgattttgagtctataaaagatcaaaatttcgatgggttaattgtaacaggcgctcctttggggttggttgaatttgaagatgtcacttattgggccgaaattgaaaaaattgttaattgggctaaaaatcacgttacttcaacgctctttgtttgttgggctgttcaagctgccttaaatattctttataacctgcctaaatatacgagaacgactaaattatccggtgtttactcccatataaccttagatccttttgcgttattgaccagagggtttgatgaatcctttttggcacctcactcacgttttgcggattttccagagacagtgatccgtgagcataccgacctagatattttggcttgttcagaagacgctggcgcttatttgtttgccagtaaagacaaaaggttggtatttgtgacaggtcaccctgaatatggagttgatacattagcgacagagtactggcgtgatctggctgcggggttagaacccgcgctaccggtcaattacttcctgaataatgatcctgaaaataaaccagttgcatcttggcgtagtcacggccacttattgtttttaaattggcttaattactatgtctaccaaattacgccatacgatctgacgtatatgaatcctactttagattga

SEQ ID NO: 2295 - DNA, 108 bp, Xenorhabdus bovienii
  Coding sequence Name=Xb4151_4152.C433.gene3.dna; Position on contig =1852..1959bp; Strand=-
atgagaaatggctcgcttcagctaattctcatttttatttttatttttttacaaattcaatctaaagtaggattcatatacgtcagatcgtatggcgtaatttggtag

SEQ ID NO: 2296 - DNA, 1599 bp, Xenorhabdus bovienii
  Coding sequence Name=Xb4151_4152.C433.gene4.dna; Position on contig =2211..3809bp; Strand=+
atgacacagcaagcattaacaactgatttaacctttacaaagctttttggtgaagctgaaaatcagatattactacctgaatctataggttttatagaagatctagttgttgagttttctgacaggcgtaaaaaattattggaagagagaattcactggcagaaaaaaatagatgatggaatattacctgattttatttcggaaacaatttccattagggaaagtgactggaaagttcagggaattcctgacgatcttaaagatcgccgtgttgaaatcacgggtccagtagaacgtaagatggtgattaacgctttgaattcaaatgttaaagttttcatggcggattttgaagattcactgtctccttcatgggataaagtcattagtgggcaaattaatctaagggacgcagttaacggtacgatctcatataccagtgagcaaggtaagcgttatgaattgaaatctgaaccggcagttctggttgcacgggtcagagggctgcatctgtcagaaaaacacgttctttacaagaaggaaccgatctcgggtggtctatttgactttgcactttacttctatctaaatcataaaaatctgctggcaaatggcagcggcccctatttttatttgcctaaaattcagagctaccacgaagctcaatggtggagcgatgttttcagttttacggaagagcgcttcaacctaccaaaaggtacaatcaaagcgaccgttctgattgaaacactgtctgctgtattccagatggatgaaatcctctaccacctgcgtcaccacattgttgggctgaactgtgggcgctgggattacattttcagttatatcaagacactgaaaaaccattctgatcgtgttttgcctgatcgccagtcggtcacgatgacacaacctttcctgagtgcctattctcgcttgctgattaaaacttgccataaacgtggtgcatttgcgatggggggaatgtcggcattcataccaagcaaagatattgaacaaaaccagtggattatggacaaggtcagggctgacaaagaactggaagctaagaacggtcacgatggcacatggatagcgcatcctgggcttgcagatattgcgatgacagtcttcaacaccaccttaggagagcggccgaaccaattggcagtttcccgtgaagaagacgaaacgatcacagcggaacaattgcttgaaccttgcttgggagagagaacggaagaaggattgagagcgaatattcgtgtcgctgtgcagtatatagaagcatggatttcaggtaatgggtgtgtaccgatttatggtttgatggaagatgccgctactgcggaaatatctcgcacatctatttggcaatggatccgccatgaaaaattactttccaacggtaaaaaagtcacaaaagagctgttcaggcaaatgctgaaagaagaactgggcattattaaacaagaagttggagagatgaatttcaaccaagggcgatttatggaggcttctaatctaatggaacggattactacacaggatgagctaatcgatttcctgactttgccgggttatcaattactcgattaa

SEQ ID NO: 2297 - DNA, 1308 bp, Xenorhabdus bovienii
  Coding sequence Name=Xb4151_4152.C433.gene5.dna; Position on contig =3858..5165bp; Strand=+
atgaacaattcccgaacacaacagatcgctcaattggaacaagaatggaaacactcacgttgggaaggtattactcgcccatacagtgctgaagacgtggttaaattgcgtggttccgttaatccagaacacactttagcgcagatgggagcgaaaaagttgtgggaactgttacatggaaaatcaaagaaaggttatgtgaacgcacttggcgccctgactggcggtcaggcacttcagcaagcgaaggcgggcattgaagcagtttatctttctggttggcaggttgctgcggatgcaaatactgcctccagcatgtaccccgatcaatcactttatccagtggattctgtacctaatgtcattaaacgcatcaataacagtttccgccgtgcagatcagatccaatgggcaaatggtatcgacccggacagtcaggaatacaccgactatttcctgccgattgtcgcggatgctgaagcagggtttggtggtgtgctgaatgcatttgaactgatgaaagcgatgattgaggctggtgcagcggctgttcattttgaagatcaattggcggcggtgaaaaaatgtggtcacatggggggtaaggtactcgtaccgactcaagaagcgattcagaaactggtggctgctcgtctggctgctgatgtatccggagtttcaaccttgttagtcgcacgcactgatgccgacgcagcagacttgctgacttctgattgtgatccttatgacagcgaattcattactggcaagcgaactgctgaaggtttcttctgtacccgagctggtatcgatcaggctatcagccgtgggttggcttatgccccatatgccgacgttgtttggtgcgaaacttctacgccggatcttgaggctgctcgccgttttgcggaagccattcatgcggaatacccaggcaaattgctggcatacaactgctctccatccttcaactggaaaaagaatctggacgacaaaaccattgcgagctttcaagagcagctgtctgccatgggatataaattccaatttattacattggctggtatccacagcatgtggtttaacatgtttgatttggcttatgactacgcccgtggtgaaggtatgaaacattatgtcgaaaaagttcagggacctgaattcgcagctcttgagcgtggttatactttctcttcacatcaacaggaagttgggacagggtattttgataaagtgacaacgattattcagggaggaacgtcttctgttaccgcacttacgggctcgacagaagaacagcaattttag

SEQ ID NO: 2298 - DNA, 132 bp, Xenorhabdus bovienii
  Coding sequence Name=Xb4151_4152.C433.gene6.dna; Position on contig =5134..5265bp; Strand=-
atgcgcaagatctatttccatcatcgccaccttatccgacgcgtaaaggggaattcctcacagaatcccccacctgataatatcaatgagcctgataaatctaaaattgctgttcttctgtcgagcccgtaa

SEQ ID NO: 2299 - DNA, 1725 bp, Xenorhabdus bovienii
  Coding sequence Name=Xb4151_4152.C433.gene7.dna; Position on contig =5242..6966bp; Strand=+
atgatggaaatagatcttgcgcatttaattgcacaaaccattttgcagggattcgatgcgcaatatggtcgatttctggaagtgacttcaggcgcacagcaacgttttgagcaggcggattggcatgcagtacagcgagccatgaaaaagcgaatcaacctgtatgaccatcatgttggcttggtcgtggaacagctgaaatgcattcacggtacactgcaatatgacgaagattacatagctaaagctaaagccgtttatacccgtttgttgccggactatcctcgttttgagattgcggaaagtttttttaattcagtctattgccgtttgtttcaacacagtaacttaaagccagaaaatctatttattttttcttcccagcccgcctgtcgttttcgtcatatttcacgtccattgtcgcgggatttttcccctaacagtaatattgcgtcaatgttgcgaacgatattaaatgatgtgccattgcgtcttaaatgggaagatttggatcgagatattgattacatcatgcaatatttacagaaaacattttctgaatatgatttattacatgcgacatttcagattgctaatgaactattttaccgtaataaagcggcgtggctggtgggaaaaatcaggctgggcaccacggtttatccatttttattacccatccaccataacgaatccggcagcatctttattgatacctgcctgacgtgccgcaatgacgccagtattgtttttggtttcgcacgttcttactttatggtttacgcccctttgccggcagcattagttgagtggctgcgtgaaatcctgccgacaaaatcaacggccgaattatacatggcgattggttgccaaaaacatggcaagacagaatactatcgtgaatatctgatgtttattaacgcatctcaagaacagttctcgattgctccaggcgtgaaaggcatggtaatgcttgtcttcgcttctccttcatttgatcgtgtatttaaagtcatcaaagataaatttgctcctcagaaagaagtctctcaagaacgtgttcaggagtgttaccgtctggtcaaagagcatgatcgtgtgggaagaatggccgatacgcaggaatttgagaactttgtcattgagaagcgtcatatcagtcaggaattaatggaagaattgcaaaaagaaatcccggcaaaactcgaggatctgggtgataaggttctgataaaacacctctatatggaacggaaaatgatcccgttgaatatttatatggaacaggtagacgaagtgcagttgaaagatgtgatagaagaatacgggaacgctattaaacaattggccgcagcaaatatatttccgggtgatatgctgtttaaaaactttggtgttacgcgtcatgggcgggtgattttctacgactatgatgaaatctgttatatgactgaagtgaattttcggaatatccctccaccacgttatccggaagatgaactggcaagtgaaccttggtacagcgttgctgccaacgatgtttttccagaagagtttcggcattttttatgtggtgacaaccttgtccggcgttactttgcagaaagtcatagtgacttattcgaagcggattactggtcggcattacaagagcgcattaaaaatgggcatgtggaggatgtctttgcctatcgacgcaaacagaggttcagtcagcgtaattaa

SEQ ID NO: 2300 - DNA, 561 bp, Xenorhabdus bovienii
  Coding sequence Name=Xb4151_4152.C433.gene8.dna; Position on contig =7227..7787bp; Strand=+
atggctaatgtcattttatacggcgatatccttcacattaaaaataggtacgccgatggtagttatcttgatgtttatgggcagtctacatcactgggagaaaaatataatgttgtcacttctgtttcaccgaatcgtgatacaggctcgggttcatggcagattttatctgcggaaagcaaaagtttaggaacggaaatttacagtggtgataccgtatttctagtgaatctctatcgaaacaatggaggatatttgagagtgagtggctatgcaccttctcctgaactctataatgtttataccgcagatagacccgtaaacgccctcgatacggcaatatggcatatttttacagatacggctaatgaatttgatggcaaaatccgtgagggaaatgtcattcgtctgcttaacaattttaataatgtacatggtggtttccttgatacctgttggttggcaaaccaatctggtgctgtttataaggtgtatacttcactgctgtcagatcgggggaatggcacgggtacatggatattatcaaaagcaatcaattaa

SEQ ID NO: 2301 - DNA, 642 bp, Xenorhabdus bovienii
  Coding sequence Name=Xb4151_4152.C433.gene9.dna; Position on contig =7788..8429bp; Strand=-
atgaataattggaaaacaaccgcagaaaatatcctgaccgatggccctctcgtccctattattgtgatcaatgagattgaacacgcggttccattggcaaaagcactgattgccggcgggatacgtgtactggaagtcaccttaaggaccgaatgcgcactggaggccatccgtcttattgccaaagaagtgcctgaagcaattattggcgcaggtacagtcattaatcctgaacaattggctacggtcaccgaagcaggcgctcagtttgccatcagcccaggattaactgacccgttattaaaagccgcaactacaggctcaattccattgattccggggatctctacggtttcagaattaatgcttggtatgagttatgggataaattgcttcaaattttttccagcagaagcgaatggcggcgtgaaagcgctaaaagccattgcaggcccattccctcaagttcgtttctacccaagcggtggtatttcatccgacaattaccgcgattatctggctctaaatagtgttctgagtattggtggttcatggctggtgcctagcaatgcactgaaaaaaggtgattatgcccagattaccgagctggcacatgctgtaattgccggagccaaagcgtaa

SEQ ID NO: 2302 - DNA, 831 bp, Xenorhabdus bovienii
  Coding sequence Name=Xb4151_4152.C433.gene10.dna; Position on contig =8584..9414bp; Strand=-
atgagtacagccgttgccaacaagcgtaccaaaagaaccaaaataacggcaaatagtaccgctacaagcggtcaggttcagtccttaagccgagggcttacacttttggaatatatttccgattcacaagtgggtgttgccttaaccgatctggctatacaagctggtttgcctaactccaccactcatcgccttttgactacgttacagcagcatggttttgtccgtcaggtaggcgatttaggattatgggttatcgcttcacatacctttgttgtcggtagcagttttctgcaaagtcgtaatttgatggtgttggttcacccaatattacgtcaattaatggaagattccggtgaaaccgtcaaccttgccatcctgaatcttgatgaatatgaagccgttattgttgatcaggtgcaatgtaatgcgctgatgcggatgtctgcccccattggcggcaagctgccgatgcatgcttccggcgcaggcaaagcgttgctttctacactacctgaacaaaaacgcctccaattactccataagaaaggtcttcatacctatacccagcatacttacaccaccgcagcggctctgaaagaaaatcttgaacaaatccgcaagcaaggcttttcgctcgatgatgaagaacatgctcttgggttacgctgcattgccgcctgtatttacgatgaacatcatgaagcgtttgccgccatttccatttccggttcaatttcacgaatctctgacgatcgagtcactgaactaggcgcactcgtgatgcgggctgcaaaagagatcagtagagaatatggcggtattaagtaa

SEQ ID NO: 2303 - DNA, 120 bp, Xenorhabdus bovienii
  Coding sequence Name=Xb4151_4152.C433.gene11.dna; Position on contig =9468..9587bp; Strand=+
atggaatttattttcgttttcttattatggatgataacgagggggaaaacacatccgatgagtggaaccactctgagatatccaatttatctacatcaggctgaggacggatcatcttga

SEQ ID NO: 2304 - DNA, 1374 bp, Xenorhabdus bovienii
  Coding sequence Name=Xb4151_4152.C433.gene12.dna; Position on contig =9721..11094bp; Strand=-
atgtgtgctgtttcatctacttacccacagtatgttgtcgcaaaattcggcggtaccagtgtggcagactttgatgccatgaatcactgtgccgatattattctggcaaacgcagatgtccgcgtagtcgttttgtccgcttctgcgggggtgactaatttgctggtcgcattggcgacgggctgtgataacgataaacgtaaaaagtgcctgaaacagatccgtgacattcaatatgcgattattgaccgattaaatgacgtgaatgtgatatgtgaagaaattgatcgcctgctggaaaatatcgagatgttgtcagaagccgcatcattggcaacctctgaggcgttaactgatgaattggtcagccacggtgaagtgatgtccacattgctattcgtagaattactgcgtcaacgcaatgtaaatgcagagtggtttgatatccgcagggtcatgcgaacgaatgatcacttcggacgagcagaaccagactcccttcaactccatatatcggcggttgagctccttcagcctcgtttgaataatacagttgttatcacacaaggttttatcggcagagaagaaaaaggccgcacaactacactgggacgtggtggcagtgattataccgccgccttactcggcgaagcgctgaatttacagcgtgttgatatttggacggatgttcccggcatctataccactgatccccgtgttgcaccaacagccaagcgcatcgataaaattgcatttgatgaggcagcagagatggcgacatttggtgctaagatcctccacccagctacgttgctacctgccattcgttgcggtattcctgtttttgttggatcaagtaaagatccacaggccggcggcacactggtttgtgacaaaaccgaaaacccgcccctgtttcgtgcactggcattacgccgcaaacagacgttattaaccttgcacagcctaaaaatgttacatgcaaggggctttctggcggaagtttttacgctgcttttacgccataacatttcagtagatttgattaccacctcagaagtcagtgtcgccctaacgctggatacaactggctctaccagcaccaatggcagtctgctgactaatgctctgctgaccgaactttctacattatgtcgtgtagaagttgaagaagatctggcgctggtggcaattatcggtaatgagctttcacaggctaaagggttggggaaagaaatttttggcacactggaatcttttaatatccggatgatcagctatggcgcaagcagccacaatgtatgtttgctcgttcccggtcaagatgcggaatcagtcattcagaaactgcatcagaatttgtttaaggtgtga

SEQ ID NO: 2305 - DNA, 1647 bp, Xenorhabdus bovienii
  Coding sequence Name=Xb4151_4152.C433.gene13.dna; Position on contig =11360..13006bp; Strand=+
atgaaaaacatcaaccctagccagaccgaagcttggaaagcattgcatcagcattttgagcaattgaaaaacgtccacttgcgggatttgtttgaacaggacaaagcgcggtttacggcattctccgctacgtttgacgagcagattttggtggattattccaaaaatcgtattaccgctgaaacactgacaaaattacagacactggcgaaagaaacggatctgtccggagctatccgcagtatgttctccggtgaaaaaatcaactgtactgaagatcgtgctgtgctgcacattgccctgcgtaaccgcagcaataccccgattaatgtggatggggaagatgtgatgccgcaagtcaatgcggtgctggcaaaaatgaagtcattcagtgaacgcatcatcagcggagaatggaaagggtataccggtcaagccattactgacgttgtcaatattggtattggtggttccgatctcggcccttatatggtctctgaagcactgaaagcgtataaaaatcacctcaatatgcactttgtttccaatgtggatggaacccatatcgcagaaacgttgcaaacattgaacccagaaacgacgctgttcctgattgcttccaagactttcaccacccaggaaactatgaccaatgcgtattctgcccgcaattggttcctgcaaaatgcggagattgaggctcatgttgccaagcattttgcggcactttcgaccaatgagcaggaagtcagtaaattcggtatcgatccactgaatatgtttgaattctgggattgggtcggtggccgttattcactgtggtctgcgattggtttatccattgcactttccattggctatgagaatttcgaacagttgctgagtggcgctcatgctatggataaacacttcgagcagacttctcctgatcagaacattccgatcctgctggcgctgatcggcatctggtacaacaatttctttggtgcagaaactgaagcgattctgccttatgatcaatatatgcatcgttttgccgcttattttcaacagggcaacatggaatcgaatggcaaatgtattgataggaatggcagcccggtagattaccaaactgggccgattatctggggcgagccgggcaccaatggtcagcatgctttttatcagcttatccatcagggaaccaaactgatcccatgtgattttattgcgcccgcaatcagccataatccgctcagtgatcatcacagcaaactactgtccaacttctttgcgcaaactgaagcactggcttttggtaaaaatcgcgaacaggtggaagcggaatttgttgcagccggaaaaaatgcacaggacgtggcgaatgtcgtgccattcaaagtttttgaaggcaaccgtccgactaactccattctattacgcgaaattacaccattcagtttgggcgcattgattgccatgtatgaacataaaatctttgcccaaggcgctattctgaatattttctcatttgatcaatggggcgtagaactcggtaaacagttggcgaaccgtatcctgccagaattgcacgatgatgaagcgataaatagccatgatagttcaaccaatggcctgattaatcgtttcaaaacatggcgctaa

SEQ ID NO: 2306 - DNA, 141 bp, Xenorhabdus bovienii
  Coding sequence Name=Xb4151_4152.C433.gene14.dna; Position on contig =13161..13301bp; Strand=+
atgaagatttacataaattgttatcaactttttattttattcacttgcaacgtgatatcctcactccccattcgttgtgctgtcggggaaaatgatgtgccccgcaatgggaaaatgacatggcagatgacacaatattaa

SEQ ID NO: 2307 - DNA, 528 bp, Xenorhabdus bovienii
  Coding sequence Name=Xb4151_4152.C433.gene15.dna; Position on contig =13280..13807bp; Strand=+
atggcagatgacacaatattaactcctgcacctatccgctggttttcggcagatgattctaatattcctgaagatattttagattggcttatggaagtcggttcaatgacgcgccgttttgaagaacattgtcagcaggtatcagttgtaccttttcgggaatgctttattacagcagcagaattaggagatgaaagtgagcacttacctaaaagtgaaaggtattggttgcgtgaaattgtcttgtatggagataacattccgtggctgctgggacgtactgtgatccctgaggaaactctgactggcacggataagtggctggtcgatgtaggaacagttccacttggccgatatctttttaatggtaataatttgactcgggattatattcaaataggccagcaagggcagcactgggcgcggcgttctttattgagactatcaggcaaatccttgttactcacagaggtttttctgccggaatcacctgtatataagatgaataaaatcaaagggggaaaatag

SEQ ID NO: 2308 - DNA, 855 bp, Xenorhabdus bovienii
  Coding sequence Name=Xb4151_4152.C433.gene16.dna; Position on contig =13821..14675bp; Strand=+
atgacgcagaataaatggctcgcctattgccgtttaatgcgtatcaataaacccattggcgtattattattattatggccaacatattgggcattgtggatcgcagcaaaaggtatgccagatttgtacatcttgttagtttttactattggggtgtataccatgcgtgctgcgggatgttgcattaatgatttcgcagatagaaaatttgatgggcatgtagaacggacaaaatctcgtccacttcccagtggggatgttagcgaaaaagaaagcaagatcttgtttgttacactggggctgatctctttcgcactggttttgacgctgaacaaaatgacgattgccttatctttcattggattggcactggcatgggtttatccttttgtcaaacgagtcagtaacttgccacagattgtattgggggcagcctatggttggtcaattccaatggcttttgccgcagtaagtgagtccttaccattagaatgctggttgttatttttggttaacataatatggtcagtaatttatgacacacagtatgcgatggttgatcgtgatgatgacctgaaaatcggtgtaaagtcgacggccgtgctttttgggcgttttgataaactgattctgggtattttgcagtttattatgctcggtattctggtatcggttggttgcatagtgaatttaggtgggatgtactactggacgttattactagcgggttcgctcttcatttatcagcagaaattgatttctgggcgaaaaaaggctctctgctttcaagcatttatgaacaataactacgtcggttttatcttattcctcggtattcttttcagctatgtttaa

SEQ ID NO: 2309 - DNA, 2469 bp, Xenorhabdus bovienii
  Coding sequence Name=Xb4151_4152.C433.gene17.dna; Position on contig =14727..17195bp; Strand=-
atgtcaagttggcgtaaaatatattataaattattgaattttccactgaaattcttagtaaaaagtaagcttatccccacggatcccattgcagaactgatccttgatacgacacggcctattttatatgtgctgccgtatcactcaaaaacagacttattgaccctgcgtcaacaatgcctggcgcaagatctgccagatccattgaatcctttggaaatgggtgacaccctacttccaagctatgtctttattgatgacggcccacgagtgttccgttgctatgcacctaaacatgaatccgtgaagatttttcattcttatctggatctgcatcgcaataatcccgatttggatattcagatggtgcctgtttctgtgatgttcggccgctcccctggacgcgaagggcaggaaggaaatacagcgccacagctgcgtttactaaacggtgtgcaaaagttttttgcaattttgtggctgggacgggatagttttgtgcgtttttccacacctgtttcattactcagcatggccaatgatcatggcacagatgatatcattgccaataaacttgcccgcgttgcacggatacactattcccggcagcgtttggctgcggtagggccacgtttgcccgccaggcaggatctgttcaacaagctgctggcatccaaagccattgagaaagccattgccgatgagacacgtagcaaaaaaatctcacctgaaaaggcgaagcaaaacgctatcaatatgttggaggagattgcagcagatttctcttctgaaaccgtacgtttgaccgatcgtatcttgagatggacgtggaaccgtttgtatcagggcattaatgtccataacgccgagcgggttcgccaactggcgcaggatggtcatgaactggtttatgtcccatgccatcgcagccatatggattatctcctgctctcatatgtgctttatcaccaagggctggttccaccacacattgctgctggcatcaatcttaatttctggccggcaggctcgatattccgccgccttggtgcattctttatccgccggacttttaaaggaaacaagctctattcgacgatattccgtgaatatctgggtgagttgttttcccgtggttattctgttgagtacttcgtcgaaggtgggcgttcccgtaccggccgtctgctcgatccgaaaaccggcaccctttcgatgacattacaggcgatgctgcgtggagattcccgtccaatcaccatcgtgccaatttatgttggttatgaacatgtaatggaagtcgcaacttatgctaaagagttacgcggtgcaaccaaggaaaaagaaggcttttttcagatgatccgtgggctgcgtaaactgcgtaatctgggacaaggttatgtaaactttggcgaacccattcctctgacacaataccttaaccatcatgttcccgactggcgtgattccatcgatccgatagacgcccagcgcccgacatggttaacgccgactgtcagcaaactcgctggcaatattatggtcaacatcaataatgccgcagcagcaaatgccatcaatttatgcactacagccttgttgtcatcacgtcagcgagcacttactcgcgagcagctgattgagcaattgaactgttatctgcaattactgtgcaatgttccttacgctgacgatgtgactgtgccgaacaaaacagctgaagaattgctggatcatgccttgctgatgaataagtttgaggtcgaaaaagacagtcttggggatatcattatcctgcctcgtgaaagcgcggtattgatgacttattatcgcaacaatatccagcacttgctgatcctgccatctttgattaccagtattgtgatgcatcatcgccgcattagccgcagcgaactactcagtcaggttgagctggtttacccgctgctcaaacaagaacttttcatgcggtatagtaaggaatctctacctgaagtggtcaacacactgattgatgaattggtgcgtcaatgccttatctgcaacaaagaacaggatatgctcgttctgaaccctgagcgcattcgtccaatgcaattgctggcagcaggtatccgtgaaactctgcaacgctatgccattacgctttctttattgaatgccactcctgaaatcagccgtggcgtgctggaaaaagagagccggatgctggcacagcgtctgtcggtactgcatggaatcaatgccccagagttctttgacaaggccgtgtttgccagctcagtcaatacgctgcgcgaggaaggttatattcatgataatagtgatataagcacgaccagcgctcaaaaactctatcaaatgttgagtgaattaatgtcccctgagatccgtctgacaattgaaagtgccagtatgccaccagagcagaatgatactgaacagacaaacaaagaccaacattaa

SEQ ID NO: 2310 - DNA, 372 bp, Xenorhabdus bovienii
  Coding sequence Name=Xb4151_4152.C433.gene18.dna; Position on contig =17334..17705bp; Strand=+
atggaaaatcaatcaacaggtttgattcgtatcattaaagcggcagggtactcggcgaaaggtattagggctgcgtggcaaaatgaagcggcatttcggcaggaagtcattgtcgccatattagcaattatccttgcattttcccttgattttggcatgtccgagaggcttttgctcatcggttcagtcatgctggtggtcattgtggaaatccttaacagcgccattgaggcggtagttgatcgcattggcagtgaatatcatgaattatcgggcagggcgaaagacatgggatcagctgcagtatttctgacaataattctggcgttgtttatctggggaatgatcctttggtcgtattttatgcactga

SEQ ID NO: 2311 - DNA, 96 bp, Xenorhabdus bovienii
  Coding sequence Name=Xb4151_4152.C433.gene19.dna; Position on contig =17712..17807bp; Strand=+
atgattttcgtcaatacacgttatttagcggcttttatgggctggcaggttcccaattcgaatttacctgtatatactcacaggcggactgtataa

SEQ ID NO: 2312 - DNA, 615 bp, Xenorhabdus bovienii
  Coding sequence Name=Xb4151_4152.C433.gene20.dna; Position on contig =17824..18438bp; Strand=+
atgaaagcattaactgccagacagcagcaagtttataacttggtgcgtgaccatatttcgcaaacgggtatgccaccaacacgtgctgaaatcgcagcacgtcttggttttcgttcacctaacgcggcagaagagcatttaaaagcattggcgcgtaaaggggtgatagagattatctctggtgcatccagaggtctccgtttgcttcttgaagaagaaggggcagcgggattaccgctgatcggtcgtgttgctgctggcgaaccattgctggctcaggaacatatcgagagtcattacaaagttgatcctgcattattcaaaccaaatgctgattttctgttgcgtgtcagcggaatgtccatgaaggacatcggcattatggatggggatttacttgctgtgcataaaacacaggatgttcataatggccaaatcattgtggcgcgaattgaagatgaagtgacagtcaaacgtttcaaacaagtaggaaacaaaattgagctgattgctgaaaacccagaattcgagcctatcgttgtggatttatgtgagcagagttttaccattgaaggattggcagttggtattattcgtaacggggattggatctga

SEQ ID NO: 2313 - DNA, 180 bp, Xenorhabdus bovienii
  Coding sequence Name=Xb4151_4152.C433.gene21.dna; Position on contig =18370..18549bp; Strand=-
atggccgataaacacatttattttcaagcttccgtaaaacttttattgaacgggtactacgaaaaaaatgaccgccccagaatggcaaagtgcaattatccgcttttacaatcagatccaatccccgttacgaataataccaactgccaatccttcaatggtaaaactctgctcacataa

SEQ ID NO: 2314 - DNA, 534 bp, Xenorhabdus bovienii
  Coding sequence Name=Xb4151_4152.C433.gene22.dna; Position on contig =18583..19116bp; Strand=-
atgctgagtgtgaaaggtgtaatgaaaactatcaatccaaaaaagttactgacacaggctgagacaatctgcctgtcacgaggagttcgtttaacacctcaacgacttgaaattctgcgtttaatttcaacgcagccaagcgcaataagcgcttatgatttattggatctgctacgtgaagtcgagccacaggcaaaaccgccaacggtctatcgtgggctggaatttttgcttgaacagggttttgtccacaaaatagaatccacaaatagttatgtgatttgccatcattttgaggaacccagccatacgtcagccatgtttatctgtgagaattgtggttccgttaccgaacgggatgccaagaatattgaatccgctattcagcagttagttcaaggagtggggtttcatttacgtcacagcgtgattgaagtccacggtttgtgttccccttgccatgaaatcgattcctgtacagaacgcgatacatgtcagcataatcacaaaactgaagagaataaaaagaaataa

SEQ ID NO: 2315 - DNA, 111 bp, Xenorhabdus bovienii
  Coding sequence Name=Xb4151_4152.C433.gene23.dna; Position on contig =19141..19251bp; Strand=+
atgtttttcagtctggaagtgggatccaagcagacggttacggtgctgatggctaaacgagtcggtgaaaaggtgattaactatcctgatgttatgtcatactttgtttaa

SEQ ID NO: 2316 - DNA, 213 bp, Xenorhabdus bovienii
  Coding sequence Name=Xb4151_4152.C433.gene24.dna; Position on contig =19248..19460bp; Strand=-
atgatggctggaatccctttaaaggcattttcactaaataacaattgccttaatttcccttacaaaatagcggtttcttttaagaaactgctattatctccatacatgccttttttctaccgccaaagaattaaaattttgttttcagcatattttatcgttcttatcaacggattaatttttatttttatcctgaatagccaccaccattaa

SEQ ID NO: 2317 - DNA, 276 bp, Xenorhabdus bovienii
  Coding sequence Name=Xb4151_4152.C433.gene25.dna; Position on contig =19420..19695bp; Strand=-
atgaactttattgcattatttttcggaattttctattacctaatcattggattatggaaaaaaggattaactttattaggccttaacattgctgtattttcaatcatagtaattttctcaataatatcaggtattgatatatcagatagtattttaaatgtaatgggaggagctttttctctcttaaatgggtatctagcaaattatgcttattatctaaaagaaataaaaggcgatgatggctggaatccctttaaaggcattttcactaaataa

SEQ ID NO: 2318 - DNA, 189 bp, Xenorhabdus bovienii
  Coding sequence Name=Xb4151_4152.C433.gene26.dna; Position on contig =19694..19882bp; Strand=+
atgtttattttaatacgttttaaaaaaggtgtttttctaaatgcttctctatgctcttgtgtagatggagctcaatttttttcaaaaaacttaaaacgttcttgccatttttcagaatatttagatatgtccattgagttcccttatttattatcattatattttttaagtttaataactattttttaa

SEQ ID NO: 2319 - DNA, 147 bp, Xenorhabdus bovienii
  Coding sequence Name=Xb4151_4152.C433.gene27.dna; Position on contig =20101..20247bp; Strand=-
atggtctactatagcacagagaagttccagagggcggacaggaatccatacaagctaaacaaaaaaactcattcaaacagtaaggagtactctatgaatatcatgacatataaagtttatgccgccaaaattgaatacagcgattaa

SEQ ID NO: 2320 - DNA, 195 bp, Xenorhabdus bovienii
  Coding sequence Name=Xb4151_4152.C433.gene28.dna; Position on contig =20190..20384bp; Strand=-
atgtttagttgtatcagtattttcaatttttttattttgctgcatttttgtactttcaaggcgatattttcattctctgaatcccttgccgctccctcatttataaggaagctgatacagagaatagggggaaatttatggtctactatagcacagagaagttccagagggcggacaggaatccatacaagctaa

SEQ ID NO: 2321 - DNA, 117 bp, Xenorhabdus bovienii
  Coding sequence Name=Xb4151_4152.C433.gene29.dna; Position on contig =20340..20456bp; Strand=+
atgcagcaaaataaaaaaattgaaaatactgatacaactaaacatgtgagcaaaaaagaggctgaattctctctcaaccgtttctccgttgcccccatgttagattggatttactaa

SEQ ID NO: 2322 - DNA, 264 bp, Xenorhabdus bovienii
  Coding sequence Name=Xb4151_4152.C433.gene30.dna; Position on contig =20547..20810bp; Strand=-
atgaatacagcctttttgttaatggcagagtttgagacttcacaaattccgctgtcagatatagcggaaagatatttcaagatgagtcccggaacagccgaacgcaaggcaaacgaaggaaagctgggtatccctacatataagttaaacgacagccagaagtcaccgagaatcgttcatgtgaatgatcttgctgcatacattgataaacaaagagagcaagcctcaaaagaactggagaggatacagtttaaaagaaaatga

SEQ ID NO: 2323 - DNA, 318 bp, Xenorhabdus bovienii
  Coding sequence Name=Xb4151_4152.C433.gene31.dna; Position on contig =20816..21133bp; Strand=-
atgatcaataactcattccacctgactcaaatcatcgcctcggtctggggcgatccttctgatatcaccgatgcaatctggcaggcaggataccgtaagccagaacggggagaaaaggaaattgccgcactcactatagacattatggaaggagtgcccgacatagtgccctacaacttaagaccaaaaaatttggacgacattcttagttgggaactgaacgacatcatatttgatgcgacatggagtgataaggtgacacctgcgggagtggctaaaataattctggagaacggctatcagaaaggaggggaatag

SEQ ID NO: 2324 - DNA, 594 bp, Xenorhabdus bovienii
  Coding sequence Name=Xb4151_4152.C433.gene32.dna; Position on contig =21130..21723bp; Strand=-
atgaaaggcaaattacttcctgtggttgttggtgttgaaattccccttgatgaattcgggcgctacaacctgaacacattacataaggccagtggagagggtgaagaaaaagcaccaaacagatggctgagaaccaagtacgcaaaagagcttattgcagaattggaggctaagttactgaaaagtattcaaacgccagatttggcgcttgctcaaaaagcagtcgattctgctcacggcggcacatcgccgggcacttacgcccatgagttgatagcggtttcttacgcgggatggattcgaccggatttccagcttgatgtgaaccaggcatttatcgatttcaaatcgggaaattcaggtatcggcattaatgccctgccgtctctcgatcacatggttggacgatttgatgaattacgccaccagctagcaaaagatgagaagaacgaagctgagttgctttctgtgtgcagccaaatcatgaacgctcgcaaaaagaccaaaggtaagcgccataagatgattagtgcactgaaagaggcgggacaaatggctatctttgatgatgaaaacagcggagaagagtcatga

SEQ ID NO: 2325 - DNA, 204 bp, Xenorhabdus bovienii
  Coding sequence Name=Xb4151_4152.C433.gene33.dna; Position on contig =21723..21926bp; Strand=-
atggcagacattaacgatgtgcttgttaaggccacgttccacatcgacgacggcagggatcatacggatcagattatccaccgcctcagacagaacttttacattcatgagggcgattgccctcccttgccaccagcgccaaaagtggcagaagtgaaattaacaccggtgaagaaagcgggtaataagcgaggtaaagaataa

SEQ ID NO: 2326 - DNA, 228 bp, Xenorhabdus bovienii
  Coding sequence Name=Xb4151_4152.C433.gene34.dna; Position on contig =21937..22164bp; Strand=-
atgaaaatcgaatatcaggacaagggcagcacagcgcaaatagtcatttccagtttcattacagaacgccgaaaacacaaccgttgtgttgatgctgccctgttagccacacctgttcgggcttcttcttccagtgtgtttttcagaagaacggttatcacaggcaaatccaatcacatgatgcgcgcttacaaaatcctttgcaaggaggcggacagtgacagataa

SEQ ID NO: 2327 - DNA, 594 bp, Xenorhabdus bovienii
  Coding sequence Name=Xb4151_4152.C433.gene35.dna; Position on contig =22161..22754bp; Strand=-
atgatcattgcttctgatttgttgcgcgccgctttggtctgtgtggccaaaggcgaagatgcggaaaaacgcccccagttatcgggggtgcacattacccgaaaacatcttgaggcaactaacggtcatgcattggtacgcatggaactcacagagaacgtcattaactttgatgatgatactgacgtcgatctgattatccggttctgtggcgacattccagaacaggcttgctttaccgacatccagttaggggacgaaccaaaagcctttcatttgggggaagatgaagtggcctttagccttactcgtctggagataattaatggacgcttccctgatttagacaaagccatcccgaccgagaaacagaatgtgatcccgtactttggtgctaagtatctggcctacccatatttgatgtttggtaggggcgcggtactcatggaaccctcgggcatggaagccgcttgtcgattccggtttggcgctttcacaaacaagctttacggcaaccctgtttttatcgttctgccactttataaagacgctttcgaagctgccgagcaaagggtaagagagttgaagctatga

SEQ ID NO: 2328 - DNA, 330 bp, Xenorhabdus bovienii
  Coding sequence Name=Xb4151_4152.C433.gene36.dna; Position on contig =22751..23080bp; Strand=-
atgttaagtcatggcctgccgaatcatggctggctgtatacggtattgatctcaaaaaattgtttggcaagaagtgaggtgatgaaaatggaacagacaaaacacattgtgacctatttaggtgattacccctgcggacatcgccacacgctgcgaatttatacggaggctcatgatgcattggacgctatcgaaaaatcacaggcggtatttaccgatgatcgcctgatatcaaccaaccataccctcttctctgttatgccggaagaattcaatgaaaataccattgctggcatagatctgtgcccaaacgcggaggtgaaatcatga

SEQ ID NO: 2329 - DNA, 789 bp, Xenorhabdus bovienii
  Coding sequence Name=Xb4151_4152.C433.gene37.dna; Position on contig =23004..23792bp; Strand=-
atgagcaagaaaaacgaattagtcactatagattcaaacaagctgccagtgatcgaatggcaaggcgttcgtgttgtcaccactgaaacattagcggctgggtatggtgctagtacaaaaaacattcaagacaatctcttgaacaacaagtcacggtttattgatggcgtccattatttcaagcttgaaggggatgaattacgtcagtttaagaaggtacccgataacatcgggttggttagtaaacatacaagtcagcagattctatggactgaaaaaggcgctgcccgtatgtcgaaaatcgttgataccgatgaagcatggtctttctttgaaaaaatggagtcagcttactttcaccaacaaaagccagcaaccaatccccctgccttgcccggtgattacattgcagctctggaagcattgctgacaactgaaaaagaaaaggtcgtcattactcaagaacgtgatgaagctcgccgcaccaaatcacagatcagtcgcagtcgtgaggctcaggctctcggcaaactcggtgctgccacccgcaaatgcagagaactggaagaacgtctgggcgaaagcaccaagcacgcaacgattacagcggtacagaacgccacagaaaaaaaataccagtatgccccactccgtaaatggtgccgtgaaaacgacatcgaagttgtgaaggttcccgacacccgatacggacatgttaagtcatggcctgccgaatcatggctggctgtatacggtattgatctcaaaaaattgtttggcaagaagtga

SEQ ID NO: 2330 - DNA, 492 bp, Xenorhabdus bovienii
  Coding sequence Name=Xb4151_4152.C433.gene38.dna; Position on contig =23803..24294bp; Strand=-
atgagcaatgcagaaatgacaccaaaagaagttatcgaatatttaaaagaaaataacaaaggttgcccagcttgtcttttagatgaagaaagagcgataaccaactacccgccattaactgatgcggaaaaaatggaatgcgcagagtacatggtgaaaagacaaagaacccttattgctaaggaatatttagtttcatgctacgaacggttcggtttaaacaccaatgggaactttatatttattcacgaaaacggcggcgttgaattagatgccgaagttattgaaacgctgcttattcaccaaatcgaaaaaacgattctggggttcagacccgatgagagatatatcgctttgtggagtttctatttcaacatcgagaagagcgagaaagaaaataactccacatggatgcgtgattttatcgatggcgtatttatcaacggcatcaagttattcgtcgctgaaccggcatcattaactgaacattaa

SEQ ID NO: 2331 - DNA, 189 bp, Xenorhabdus bovienii
  Coding sequence Name=Xb4151_4152.C433.gene39.dna; Position on contig =24294..24482bp; Strand=-
atgactgaatatgaacaggcaacagaatcagcgcagagtttagaactaaaaggcttattccgtcgtgctgctgataaatggggtgaggcactttcattatcccgtaataaaaagcaagaacaggaatgtatcaagaataatttacgatgtgttcgagaagcaaaaataactattagggaggggttgtga

SEQ ID NO: 2332 - DNA, 237 bp, Xenorhabdus bovienii
  Coding sequence Name=Xb4151_4152.C433.gene40.dna; Position on contig =24475..24711bp; Strand=-
atgaaaaatgaaacttatttagattttgctgaaacagccatccagaaagagaaagaagaaaagtatgaccttgccgccacatattggaaaagagctaaatatttagccgctgatcttaagcatcgactatgggctcaatataatcaagaaaataacgaagaaagacatctattacatcacagtcacatcacagtattaagcaggtacatgaataaacaggcggcgaataatgactga

SEQ ID NO: 2333 - DNA, 339 bp, Xenorhabdus bovienii
  Coding sequence Name=Xb4151_4152.C433.gene41.dna; Position on contig =24708..25046bp; Strand=-
atgacacaattaacgttgcttgaaagaaagcgaaaggcatttatacatgccaaattggacacattacaaaagaagcacagttctcactctgtaatagtcaaagtggcagaaattaattaccgactggatttagacgaagatgtattaaatatagcgttaattagtctctttgagaaaaacgtaattttaagtttaaaaggcaaacttatagcagaggacgctctcgtaaattcatatgacagcttttataccaagaacggagatctaaccgcagagggtaatgagtttatgaaagagcttctaaaaatcattgcacaaaaaatggaactgatgaaatga

SEQ ID NO: 2334 - DNA, 405 bp, Xenorhabdus bovienii
  Coding sequence Name=Xb4151_4152.C433.gene42.dna; Position on contig =25126..25530bp; Strand=-
atgaaaatacttaaacccattgaaactgcaaccaaccaagatatccaaattgaaacgcgtgaagtctatgtcgtttgcggtgctagcaaggcttatctgagtgagaaaggtgcactgaataaactggcttatgttcgggcgcaagagcagtttaatgcagaagacaggccaagtaacttccctgcccaagaggtcattcaggaagacggtacttctgcattacgtcaaggtgaaatgcgccctgagtttatggaacgacatgctcaggtattggaagaactgaaagctgatgttagacaggtaagagaaattgctcgacttaaaaaggaatgcaagaaagcaaaagagaaactcctaacagtcttggatgatttagaaaacgcagaaaataaatacaaaaattaa

SEQ ID NO: 2335 - DNA, 309 bp, Xenorhabdus bovienii
  Coding sequence Name=Xb4151_4152.C433.gene43.dna; Position on contig =25559..25867bp; Strand=-
atgaataatatcttctatcatacccgtgtcaataatgaacgattagaaaagatgagtgatagcgatttacagttattagcatcatcaagcgaagatgtcatttattcgataacaagtggaatgaaatctattgctaatttagctaacgcggctgttaatagtgaagaatattcccaagatgatgcaatgactgaccttgatagattatcccgattgttttctgtattgactcttattatcgaagctgagcatgaaaatcacgtcaatgcaaccgatgaaataagaaagagaaagaaatttagtaaataa

SEQ ID NO: 2336 - DNA, 375 bp, Xenorhabdus bovienii
  Coding sequence Name=Xb4151_4152.C433.gene44.dna; Position on contig =25864..26238bp; Strand=-
atgatgaacaataaactacaagcagccgtcgagattgcagaagaaattgaagcctcaatatttcccgtagtgactgcaattcaaaatgaagccgaaccggatacttatttaatgtgtcgtggtgtacatcgtcaaacttgtgatttagcccaacggttaagggatataaataaagaatatatcatgtcaggtaatcaggcattcgatgaattggaaggcgttgcgagtgaaatagaaaacctaagaacatatatttctttattagttgatacggataaaagtctatccggtgcagaattacttagtattgcattggttgcgatctttcatataggtaaagaaatagcacgagtacgaggagtggaatactcatga

SEQ ID NO: 2337 - DNA, 204 bp, Xenorhabdus bovienii
  Coding sequence Name=Xb4151_4152.C433.gene45.dna; Position on contig =26225..26428bp; Strand=-
atgataaataggccaacccacacagaaacattaacaactcaaaactcattaaaacttgcagaacggttacaaacttatttatttacctggtcagcatcagaaaaaaataaagatacagtacatttaattgaaatggccatagataccacaaataaaatcattgataacttaattaaatcaaccgaggtcaatgatgaacaataa

SEQ ID NO: 2338 - DNA, 744 bp, Xenorhabdus bovienii
  Coding sequence Name=Xb4151_4152.C433.gene46.dna; Position on contig =26675..27418bp; Strand=-
atggaaactaaagacataagacgcaataatttgcgcaccctgatgacacaacatgtgcgtcaagggacatcaaaaacagcattcgcagagttgatagggatcccacccagtcagctcagtcagctaacgagcgataacgcggtaagaaacataggagacattattgctaggcgcatagaggtgaatttagaactaccaattggttggttagatatccctcagcaactcattgataaccgtgataatagtcacaaagaaagaaacaatgaaaactatcacttgcaaaacatttcacataaagttactgatctttcatacaggattgaacagctcgatgtggaatttagttgcggaggtggtagattgaatagcgattatcccgatatagttcgctcaattgaggttgatcctgaatatgcaaaacggatgtttggttgtagaccatcaacatcattaaagctaacaactgctctaggtgacagtatgctgggaacgattaatcccggtgaattggtcgtcttagatataacggttagtcgttttatgagtgatggtatttatgcatttacatacggggatgggatgcacattaaacgactccaacttttgaaagacaggatagttgttattagtgataatcaaatttatgacagatgggagattgattctgaaaatgaatcaaaattccacatacatggatttgttgttggtaaatggaggatggattatgcacgcttggggtaa

SEQ ID NO: 2339 - DNA, 135 bp, Xenorhabdus bovienii
  Coding sequence Name=Xb4151_4152.C433.gene47.dna; Position on contig =27365..27499bp; Strand=+
atgttgtgtcatcagggtgcgcaaattattgcgtcttatgtctttagtttccatatcacgataatcacattaattagcaatttgataaatatgcatgatgataaaaaatcttgcaagtttttatcaaaaagataa

SEQ ID NO: 2340 - DNA, 237 bp, Xenorhabdus bovienii
  Coding sequence Name=Xb4151_4152.C433.gene48.dna; Position on contig =27536..27772bp; Strand=+
atgaaaaatgatctacatcgctggaaaaaggaagcggataaagatgattggaacaatctcgctcaagttgttgggacaagcgtcggttatctaaatttgattgcgggtggatttcgtagagcctcgccgagcatggctagccgtattgaggatggaactaagaaattcaatagattaagcccagtgaaaaaagaaaatttaatttttatggattcaccaaagaaaaatgtttcctga

SEQ ID NO: 2341 - DNA, 282 bp, Xenorhabdus bovienii
  Coding sequence Name=Xb4151_4152.C433.gene49.dna; Position on contig =27762..28043bp; Strand=+
atgtttcctgatttcaccaaggtcaccatgccatcgcatttctaccctgacgatggcacatggatacaagaaacactggcgaagctgagagccagcacccgagcaaagatcaccgcgaagtactcagaagtgtatcaagcagcatgggatgaggagtcagtgtcataccggaaggacaacgcagcacgacgggcagcaaatatcaggctcagagagtttgtcactaagtatgagagagccgctcaaggttacacagcacagccgttaacagtaaatcaataa

SEQ ID NO: 2342 - DNA, 405 bp, Xenorhabdus bovienii
  Coding sequence Name=Xb4151_4152.C433.gene50.dna; Position on contig =28065..28469bp; Strand=+
atgtttagatgtttagatggctatatctgctttctggggaagaggggaaaactttctaggggggggttggggggggtgatctttgaaaggggtgttagggaaggcacagccaagaggaagaactcagatcttaatgtagatcactgtaggggttacaaaatgggacaggtggctagacgtctaaacgagaataagaaaagggcttgtcctctggcagtggaaattattcaagtgagggtatcaatgttgactgagaaggaaagtgtaagagggtgcaagaaaccgaacagagaaactttggcgagtagaactgattcggatcttgcagtcggcaacggagagttacctgtgcaaaagtattgcacggttactataaaaaataaacagggggtgacgtcatgctag

SEQ ID NO: 2343 - DNA, 1632 bp, Xenorhabdus bovienii
  Coding sequence Name=Xb4151_4152.C433.gene51.dna; Position on contig =28463..30094bp; Strand=+
atgctagaaatcacccctaacttcgcacaggaaagagggttaaatcttttaagggctgactggaaaaagtacagcagctttcttgtgtatgctcccacaggagcagggaaaaccgccctgtcagcattcattgttgacggttttgtctcaaaaaacaaaaaagtcatgatgatctgcccgttcaccgtcctgatcaaccagactgcccagcgctttattgagtatggcttgccggagaatgaaatcgcctatatctggcgtgaccaccccaatcaagacccgtcaaagctgattcagattgcgtcggctgacacgctgatccgccgtgactttcccgaagacattaacttgctggtgattgatgaagcgcacctgaaacgcaaaaagatactgacagagattacgcggttgacctctgaaacagattgtaaggtggtgggattatccggcacacctttctcgccgttcctcggtcactattatcagaagctgataaagcccaccacgataaaagagttaatccagcgtggcgacctgagtccttacgagttttacgcccccaccaagcccgatttaagcaaggtgaagtctgcccgcagtgacgactacggcagcgattacaaggaagacgagatagccgaaatcatgtgcggggctgatctggtcggggatgtggtcagtagctggctcaagctgggcgaaaatcagcctactatctgcttctgtgtcaatgtcagccacgccaactttatcacggtcgaattcaatcgcgctggagtgaatgctgagatcatgaccgccaacacgccccatgatgaacgggatttgatcatccatcggtttgagcagggtgcaacgaaaatcatcgtcaatatcggcgttctcgtggcaggttttgacagtgatgtccgctgcattatctacgcccgtcccaccaagtcggaaatccgttggttgcagtcaatcggcagaggcctgcgtactgccaggggtaaagaccgatgcatcattctggatcactccggctctgtccaccgtctcggctaccccgatgatatcgaatacgacgaactgcccagcaagaatgacggcatgaaatccagttccagctaccgggagcaggaaaagcgggagaagttaccgaaagaatgctcctcctgtcattacatgaagccagcaggggtctatgtctgccccaagtgtggctttaagccattggtgggtgaaaacattgatgtcgataccagtcgcaccatccagaaactcagcaagaaagagcgtatctacacacaggccgaaaagcaaagtttctactcgcagttgaagtattaccagaaccagcgcgcctcacagggtaagaccatcagtgacggttgggtatccaacacctttaaagacaagttcgacgtttggcctcgcggtctccatgacaccccacaagagatgacccccgaagtcagtaatttcatcaagcacaaacaaattgccttcgcgaagtcccgcaagaaagcggaacaggtgcaaccatccagcaacgagcagcaggaaatgcgtcttgaggttgcccgtcagaaggtcagtgatatccgtgaaaaattaggcagatcatcacatcagggagacaggctgtga

SEQ ID NO: 2344 - DNA, 981 bp, Xenorhabdus bovienii
  Coding sequence Name=Xb4151_4152.C433.gene52.dna; Position on contig =30091..31071bp; Strand=+
gtgaacagaataaatacgaccgatgccgttattggccactggcctaaagttttcgaatactacggtttaccgcccgtgacaggcaagaagcactttaaaggaaagtgtccgatatgtaagcagataggcaagtttcgcattgatgatcgtgacggacgcggaacattcatctgtacctgcaatgccggggacggctgggcactgctcaggttgacgcagaaaaaagaatttaaggtgctggcggatgagattgatcagctattgggtatccagcgcgataaggtcacacccaaacctaaagcaagcacggttgcagataaccgccaaaagataatcaccctttactcacgcatgccggaactgaaaggcacctcagcggaaaaataccttcaaagccgggagatttacagccatcacccccttgagcaaatccgcttctgtgaaaagcagccgacctgccaagggaattatcaggcgatgtgggcattggcgacagactcacgcggtcaattgtgttacctgcaccgaacctatctggacggggatcggaaagcgcctttagatgtgaccaagaagatgatgtctttacaggaagacaactatctcaaatatgctgaatcggtggccattcggatgttccctgtggcttccacgctgggcatcgctgagggcatcgagacggcactgtcctgtaagcaggtttatggggtgaatacgtggtcaacgatgaatgccggacacatggagaagtttctcactccccggggcgttaagcatttaatcatcttcactgacatggactggagcgccacaggtcatgccgctgcgatgaaatgcgcgcacaagaatttactggcgaataacgacttagacaaggtcagtgtccggtggcctgattttggggattttaacgacctgctccagaacggggatcaggccagagaattgacatttatgaaaaagcagcgggagacagcataa

SEQ ID NO: 2345 - DNA, 855 bp, Xenorhabdus bovienii
  Coding sequence Name=Xb4151_4152.C433.gene53.dna; Position on contig =31071..31925bp; Strand=+
atgatggacaacacagcacacaaaacccttttcactatccctgagcctcgttacagcacggcgctggcgaccgtaaaaccattacctgttcagcggaagatcaccggcaataaacaggtggatgcttacctgtgggtactggaggttatcaagaccaatgaacccgcccaccttgaggccgccgaggaaggcttgaagaagctgaaaatcacccccaaggcagcccagcagaaatattctgactacctgatgaaatcgggtgcacatccttttcagatagcctttggcaccctgagtatggataacccgcaaggttatataaacagcgcgaaggagcaaatcaaaaaggccagtcaggtgagggctgcttttgctagctatgaagccacactggaactgaccgaaccggagaaattaatgctggtgggggagctggcagacatttatgaacctttctactactggaatgaaacagaacgggcggaagggtgtatgcacggtgatcgcatttgtgaaacggataaattgcgtcaggcgacggcgaaagggtttgctgaacaactccccgaaccgcacaccttgtctgatgttgttcgtgagttcctttattgggactggttatatcagatgcgtaatgtcgcggccgaagaacttaatccgggcggatacggtgatagtgataggtatcacatctatgacagacaagattatcttgaagggaagctggtcactatccaagccgtaaaccgtcaggaggctatcgacgtttgtaagtgggtgctggaagaagaacggttccatgatcgtaagttgacggacaggattattcttaatctggtgggggagacagcataa

SEQ ID NO: 2346 - DNA, 780 bp, Xenorhabdus bovienii
  Coding sequence Name=Xb4151_4152.C433.gene54.dna; Position on contig =31928..32707bp; Strand=+
atgaaactcgaatcagcattaaaacactttcacccgaaaacaccgacgttcagtgatgcgtcaaccagtaccgcaccggacagaatgaaagggatggataccgcagcggctttggggatggcgggatcacaagccaagttcggcatggcggcgttttttgccaagaacgaggtcagtgaagaagacaagttcagtacggtagaagaactgacccgatacgcaaggcgaactgttcctaagctgatatccaaagcagcagggaataaactggggccctgtctggttatcttatcgaagatggcgtttgaagattatgcccgttcagcggcgtctacttgtcagtgttcggaatgtcgcgggaaagggcttatctacggcataaaagaagttgaaaaacatcccggcattattcgtgcggacggtgaagtgattatggcgccgtggattgaaaaagagcaagtgggtgaactttgccagaagtgcaatggtaagggtacgctgtcaagtcgttgtcgctgcaaggggcgcggtgtcgtagtcgatgaggaaaagaccgccttgcagggcgtaccggttgataagatttgcccccgatgctcaggtcggggttacagcagagtgccatcatcagtggcttatacggcaatcaaggcctatttacccgagcttaacgaaagaacatggcggcggaactggaaacccttttatagggtgctggtggataagtgctattcggaagagaagcgtgccgaagctgcattcaatgaggtgacaaaataa

SEQ ID NO: 2347 - DNA, 279 bp, Xenorhabdus bovienii
  Coding sequence Name=Xb4151_4152.C433.gene55.dna; Position on contig =32937..33215bp; Strand=+
atgaggaaattaaccatgtacgcattaaagctaatcacagaaagaaacggtcgttcagtagaagagtcatggatcttgggagacatgtaccgtctggagtttttcccgaaagatgtcgctgataatgttattgcccgtgtcgagcatagccagaacggcaatctgattaatcacgacatcaaaaaaacagaccaagcctacattaccactctgacgggtgacactgttcgcacggtctgtcgaggccgaagtggacttgtagctggccccatacagtaa

SEQ ID NO: 2348 - DNA, 213 bp, Xenorhabdus bovienii
  Coding sequence Name=Xb4151_4152.C433.gene56.dna; Position on contig =33139..33351bp; Strand=-
ttgccatttgtagcatcaggcttacaaaccaagtatgccgaccgcaataggagatacggaggtacgggaagtgattgcggcggcaaattaggtaataagcaatatcgagcgcccagagatagacgctctgtattggttactgtatggggccagctacaagtccacttcggcctcgacagaccgtgcgaacagtgtcacccgtcagagtggtaa

SEQ ID NO: 2349 - DNA, 168 bp, Xenorhabdus bovienii
  Coding sequence Name=Xb4151_4152.C433.gene57.dna; Position on contig =33421..33588bp; Strand=+
atgaaagtatcaatagaacttaatggcgaaacggtctggtatcgtgatgaagaaaaaggtgagggaatggcttcaactggatacataaaggacggtacacagcaaaaaatcattaccgcccttgaagctgcgttatttcaggctaaagctgaatatttatgcgtttag

SEQ ID NO: 2350 - DNA, 339 bp, Xenorhabdus bovienii
  Coding sequence Name=Xb4151_4152.C433.gene58.dna; Position on contig =33577..33915bp; Strand=-
atgttgttagatcagccaaagattaatcaactggagggatggctgatgacctcttacctaaaggaaggtgaaatgtcttacattcacagccgagagtatctaaaagatggcaatgtcgtgtctgtccagtgtagccatcagataaacgtattggttatggatgacaaccaatacagtaactacaggaatggacgacaatatcgctattatgggggtttttataaacaatttcctgccaatattattccccctcactctggttattggaatgttgttttagctatgccgcctggatatagtgccaatattaagcacactatcagtgtactaaacgcataa

SEQ ID NO: 2351 - DNA, 345 bp, Xenorhabdus bovienii
  Coding sequence Name=Xb4151_4152.C433.gene59.dna; Position on contig =33994..34338bp; Strand=+
atggggtggaatatgaagatgaaagagaatcctgatgtatgggtacacctcggagagtggctcatatcggtaagagagcaaggcatctgggcaactcttgccggaacgatggcattttttcgcggtcgctataacggtggcggctgggtaaaggtttcaatcgacgcctttatgtgtgccatgttcgcgtggttcattcgtgacgtattaaatttcatgggtctgaatcctgacctggcctacatcggcagtgtggtgattggctacttggggacagactttattggtcaattgctgcgtaagtcggcagagaaaagagcgggggtcagcaatgacaacgaataa

SEQ ID NO: 2352 - DNA, 471 bp, Xenorhabdus bovienii
  Coding sequence Name=Xb4151_4152.C433.gene60.dna; Position on contig =34253..34723bp; Strand=+
ttggctacttggggacagactttattggtcaattgctgcgtaagtcggcagagaaaagagcgggggtcagcaatgacaacgaataacttcaagttaagccaacgcagtgaaaataaccttaagggcattcatcctgacttggtggcagttgttcgtcgtgcgctggcattatctccggtcgatttcaccgtgattgaaggcctcagaacgcttgagcgccaaacgcaactggttgctgaaaagaaaagccggacaatgaactcccgccatttgaccggccatgcggtcgacctgcttccggtgggggctgactggaatgattatacctgttggcttccggtattgaatgcgatgcgtcaggcgggtgaagaacgggggatcaaactgcggtttggcattacttggacgaacaatcccaatgataagccggctaaatttctggatgcgccccatattgagatactggcatga

SEQ ID NO: 2353 - DNA, 381 bp, Xenorhabdus bovienii
  Coding sequence Name=Xb4151_4152.C433.gene61.dna; Position on contig =34720..35100bp; Strand=+
atgaaatttaacagccagcacttcaccctcggcgctctggtggttgtctccggtctgctctggttcttttacagtgagtatcagcaaaaggctcaagattatagcgagctggacacgaagtataagcatcaacaagtcatgaccgccaatacctttcagactgtcaggatattcaatgatatctcacgaattaatagcgaaagccggagccggtcagccgtggattctgagcagactaaagcggccatcaaagcggttgttgtcagtcatgattgtgccaatcgccttgtgcctgatggggctgttatccggttgcagcagcatacaaaccgaatacgttccggtgccaccgatacccattccggcacatctgctcgctga

SEQ ID NO: 2354 - DNA, 261 bp, Xenorhabdus bovienii
  Coding sequence Name=Xb4151_4152.C433.gene62.dna; Position on contig =34988..35248bp; Strand=+
atgattgtgccaatcgccttgtgcctgatggggctgttatccggttgcagcagcatacaaaccgaatacgttccggtgccaccgatacccattccggcacatctgctcgctgactgtctgcctccggccatatccgacaaaatgacatggagtgacagtctgctgctgaatgagcagttactgacggtcattgagcagtgcaatctggataaacaggcgatacgggaaatagaagagagcaagccaccccagagcaaatga

SEQ ID NO: 2355 - DNA, 156 bp, Xenorhabdus bovienii
  Coding sequence Name=Xb4151_4152.C433.gene63.dna; Position on contig =35175..35330bp; Strand=-
ttgaacaggtataaggataacaaatctgattactcagagtctcaccgacactatgccccaatacactcctgccaccccagaatcatttgctctggggtggcttgctctcttctatttcccgtatcgcctgtttatccagattgcactgctcaatga

SEQ ID NO: 2356 - DNA, 429 bp, Xenorhabdus bovienii
  Coding sequence Name=Xb4151_4152.C433.gene64.dna; Position on contig =35337..35765bp; Strand=-
atgttgtttttgttggaggtggttatgccgataaacccacgagatccatttagaaccagttatccccttgtgagaagcagacgagctttccatgcccaagtgggcactacgcattcacagactcattttctcggtgctgatattcttgacgtatatttagagtacttaattgtatgcagattcttaagtgcagatagtaccggagttttaaccattaaagcgaggtttctcgacttgacttatgaaccttatattaatttaccaaatgtagaaaaatatctattcctgcttggatttactcccactctcgcaactagcggagttaaatatacacagacacgttactcaaaggttcagagcttacccgattatgaaaaaaacgttttacccgcaataaaacaattgtgggctgcgaatcccccatattga

SEQ ID NO: 2357 - DNA, 168 bp, Xenorhabdus bovienii
  Coding sequence Name=Xb4151_4152.C433.gene65.dna; Position on contig =35897..36064bp; Strand=+
atgccatcagttaacgctggtggcttttttgtatctgcatttcactgcgtcgggttatcgccgtctgcctgtattagccatgacatgttccctttgcatcgagcgtacaggtcagaatcaaaaataatcaatgccccagacagtcattatcagcaacatccgctgtag

SEQ ID NO: 2358 - DNA, 189 bp, Xenorhabdus bovienii; identical to SEQ ID NO: 1278
  Coding sequence Name=Xb4151_4152.C433.gene66.dna; Position on contig =36027..36215bp; Strand=+

SEQ ID NO: 2359 - DNA, 366 bp, Xenorhabdus bovienii; identical to SEQ ID NO: 1279
  Coding sequence Name=Xb4151_4152.C433.gene67.dna; Position on contig =36196..36561bp; Strand=+

SEQ ID NO: 2360 - DNA, 105 bp, Xenorhabdus bovienii; identical to SEQ ID NO: 1280
  Coding sequence Name=Xb4151_4152.C433.gene68.dna; Position on contig =36572..36676bp; Strand=-

SEQ ID NO: 2361 - DNA, 360 bp, Xenorhabdus bovienii
  Coding sequence Name=Xb4151_4152.C433.gene69.dna; Position on contig =36649..37008bp; Strand=+
atgacacaaagtacaggcacggcaacatatgacatcactgttggtatcaaatatgacactgacacactgaaccagcttgagacacaactaaagcgtatcgctgaacaagtggatcgcattaatggtcgtcgctatgacgcagatatgaaactgtcagtagatacaggtgctaaggctggaattgctgccgatagcttcaaggtcttcgatgtagccggaaaggtttacatgaaagaggcggtcataccccaagcggtaataaaggataacgacgatcacctccgtcagataatccgtgaagagatacgccagttcgtcacccgtgagagtgaacgaggcggattgttctccaaatggtga

SEQ ID NO: 2362 - DNA, 351 bp, Xenorhabdus bovienii
  Coding sequence Name=Xb4151_4152.C433.gene70.dna; Position on contig =37013..37363bp; Strand=+
atgccgccaagaataccgagagcctgccgcaagcagggttgccccaagaccaccactgaccgaagtggctactgcaacgatcaccttcacaccggctgggagaaccaccagcaaggcaagagccgacatgaacgcggctatggcagcaagtgggacaagctcagagccaccatcaaggccagagataaacacttatgccaacagtgcttacgcaatggacgggcagtgacaggtgtgactgttgaccacatcaagcccaaggcacacggtggcacggatgcgttaacaaatctggttctattatgctggtcttgccatagggcgaagaccgcgacggagcgattacgatga

SEQ ID NO: 2363 - DNA, 204 bp, Xenorhabdus bovienii
  Coding sequence Name=Xb4151_4152.C433.gene71.dna; Position on contig =37360..37563bp; Strand=+
atgagtgagaaacaagtgaaactgtcacgcctgtataagggtggtcacttcaagggttatgccctgagtgtggatggcatgttgctgtcgaaccagcagcaggtcgtgattgaaactaactctgagggtgttcaccccacactgaacgtaaccttcacggtaactgatgagatggcgggtgagggggtcgacatttatatttga

SEQ ID NO: 2364 - DNA, 294 bp, Xenorhabdus bovienii
  Coding sequence Name=Xb4151_4152.C433.gene72.dna; Position on contig =37572..37865bp; Strand=+
ttgcatcatatcaagtgcaatggtcatggtgactgctaccctgagatgattttaattccgtcagtaacaatatcatcagtcatggtcacgcaaggggaggggcgggtcaaatccctgccactctcgccccaagggaccgccgccttacctcttttcacatcgccgcgaaatgcaaacctttttttggggtgccccaactgcgccattttacaggagaaatcacatggcaggacgaccgccaaccccgacccacctgcgtctggtgagggggaacccatcaaaacggccgattaa

SEQ ID NO: 2365 - DNA, 516 bp, Xenorhabdus bovienii
  Coding sequence Name=Xb4151_4152.C433.gene73.dna; Position on contig =37741..38256bp; Strand=+
atgcaaacctttttttggggtgccccaactgcgccattttacaggagaaatcacatggcaggacgaccgccaaccccgacccacctgcgtctggtgagggggaacccatcaaaacggccgattaacgccaatgaaccgatgccgggaaaaggggtaccccatgtccccaaacatttcgggaaaatgggcaggtactggcacgagcggatcgccggggaactggataaagtcggcgtgctgaccagccttgatgccaaagcccttgaattgctgattgaagcctacgtcgaatacagaacgcactgtgaaacactggagacagaaggctacacataccgaaccgatcagggattaattaaagctcaccctgcggcaggcatgaaagccgatgcgtggaaacgtattcacgccatgctgagtgcgttcggcatgtcgccctccagtcgatccaaggtcaacatcaccggagaagacaaagccgatcccctgactgagtttttacaaatgagggactga

SEQ ID NO: 2366 - DNA, 1737 bp, Xenorhabdus bovienii
  Coding sequence Name=Xb4151_4152.C433.gene74.dna; Position on contig =38259..39995bp; Strand=+
atggcaaaagtggctgaaggtattcgctacgcggaacgcgttgtggcgggtgagattgtgtccggcgagctggtgacactggcttgtcagcgttttctggatgatctggcgcacggtgaagaacgggggatcagctttagcgaaccccgcgcccagcatatcctgaacttttataaatttgtcccccatgtcaagggggcactggcaggccagcccattgaactgatggactggcatgtttttattctgattaatatcttcggttttgtccgtccgctgattgatgaacagaccggcgaaattgtcctgcgcaatgatggcagtggccgcccggtgatggtgcgccgttatcgtaccgcctataacgaagtcgcccgtaaaaatgccaaatcgaccttatcctcgggcatcgggttgtacatgaccggggcggacagcgagggcggggcggaagtctattcggcggccacgacccgtgatcaggcgcggattgtatttgaggacgcgaagaacatgatcaaacaggccagacccacactcgggcggctgtttgcgttcaataagctggcgatttatcaggagcagtcggcgtccaagtttgagccactgtccagtgacgccaacaaccttgacggcctcaatatccattgcggcattgtcgatgagctgcatgcccacaagacccgcgatgtgtgggacgtactggaaaccgccaccggtgcccggctgcaatcattgctgttcggcatcaccacggcaggcttcaacaaggaaggcatctgttacgagctgcgtgactacgccgtcaaggtgctgcgcggtcaggtggatgatgacaccttcttcggcattatctacaccctcgacaaagaggacgatccctttgatgaaacggtctggcaaaaggccaatccggggctggggatctgcaagcgctgggatgacctgcggcggctggcgaaaaaagccagagagcaggtgtctgcccggcataacttcttcaccaaacacatgaacctgtgggtcaccgccgaatcggcgtggatggacatgctcaaatgggacgacagcgaaccgcttgccccgccgcatgagctgaaaacttacccgatgtgggtcggggtggatttggcgaacaagatagatatctgtgccgccgtcaaggtctggcagggtaataacgggcatgtgcatgccgactttaaattctggctgccggaagaccggattgaacgctgctcccgccagatggccgaactctaccgtaagtggggagagatgggcgccctgaccctgacggacggtgaagtcgtcgatcacacccagataaaggaagaattgcagcactgggtcgccggggagaacctgaaagaaatcggctttgacccgtggagtgccacccagttcagccgggcactggccgaagaagggttgccgctgattgaggtctcccagacagtccgcaatttgtcggaagccatgaaatcgctggaagcgctggtctacagtggccagttccaccataacggtcacccggtcatgaactggatgatgagcaacgtcaccgccaaacctgacaagaacgacaacattttcccgaacaaatccacaccggaagccaagatagacggccccgttgccctgtttaccgccataagccgcttgctggtgaacgggggcgagcaaccggaaagcctgtccgatgtactgatggcccggggtttacgcgccctctga

SEQ ID NO: 2367 - DNA, 177 bp, Xenorhabdus bovienii
  Coding sequence Name=Xb4151_4152.C433.gene75.dna; Position on contig =40005..40181bp; Strand=+
atgaaaatattaatctttgttgccctgctggttggactggcaggcggcggcctgttgtcttacggggcgtggctgctgctgccggcggcgggatttatggtcgccggcgtattgtgtctgggctggtcttatctggtctcccgcatgttgggtcataaacccggtaagggggcctga

SEQ ID NO: 2368 - DNA, 1239 bp, Xenorhabdus bovienii
  Coding sequence Name=Xb4151_4152.C433.gene76.dna; Position on contig =40181..41419bp; Strand=+
atgttctttcccggactgtttcgaaaatccgccgacccgatgacctcacgggaactcagtgaactgatcggcctgtcgtatgacacctacaccggacggcgggtcagcccccggatggccatgcagcttaccgccgtttttagctgcgtgcgggtactggcggaatcggtcggcatgctgccctgttcgctgtatgaacaactggcgcgggggaacaaacgggcgacccgcgaacggctgaacaccctgctgtcggtaaaacccaacaactacatgacgccccaggaattctgggagctgctgattgcctgtctgtgtctgcgcggcaacttctacgcctacaaagtcaaggcgctcggcgaagtggtggaactcctgccccttgagccgggcagcgttgtacccaaactgaacagtgactggttgccggaatatcaggtcaccttcccgaacggggatagccggacactgacccaggatgagatctggcatgtgcgtatcttcacactggatggcctgatcggattaagcccgattgcctatgcgcggcaggcgattggactcgggctggccaccgaagagcacggctcccggctgttcggtaacggtgccgtgaccagtggcgtactgcaaacggatcagtcattgaccgatgacgcctttgaccgcctgaaagcggattttgaatcccgccatcagggactggtcaacgcccataaaccaatgatccttgagatggggctgcaatggaaacagattagcctgtccgccgaagacgcccagtttctggaaacccgcaaatttcagcttgaggagatttgccgcatcttccgtgttcccctgcatatggtgcagaacaccgaccgggcgacctttaataacattgaaaatctggggatcggtttcattaattattcactggtgccatacctgacccgtatcgagcagcggattaatgccggactggtgaaagggactaagcaagggcagttttatgccaagttcaacaccggggcgctgctgcgcggggacatgaaatcccgctttgaggcgtacacccggggcattaactgggggatttactcgccgaacgaatgccgggaactggaagaactgaacccgcgtgaaggcggggatatctacctgaccccgatgaacatgaccactgatcccgattcaccccccaaacccaagacggagactgaatcccatgccgatgatgaccaaaaaacggcttga

SEQ ID NO: 2369 - DNA, 660 bp, Xenorhabdus bovienii
  Coding sequence Name=Xb4151_4152.C433.gene77.dna; Position on contig =41391..42050bp; Strand=+
atgccgatgatgaccaaaaaacggcttgatgtccccctgaaaatcaaatcggtcagcgactccggcgagttcgaaggctacggttcggtgttcggggtgaaagacagttatgacgatattgtgttacccggtgcctttgaaaactcgctgaagcagtggggcgaaaaaggcggcttacccgcgttgctctggcagcaccggatggacgaacccatcggtatctataccgagatgaaagaagatgaggtcgggctgtacctgaaagggcggttgctgattgacgacgatccgctggcgaaacgggcgcatgcccacctgaaagcggggtcactgtccggcctgtcgattggctacctcctgaaagaatgggaatacgaccggacgaaagaggcctttttactgaaagaactcgatttatgggaagtgagtctggtgacctttccggccaatgacgaagcccgggtcagtgaggtgaaatcggcctttgcccggggtgacattcccgccccaaaaagtattgaacgggtcctgcgcgacgtcggactctcccgctcccaggccaaggcatttatggctgaggggtacggcgcgttgtctctgcgtgacgctgaaacggacgtgtccattttgaatgcattaaaaacccttacttttgaataa

SEQ ID NO: 2370 - DNA, 1212 bp, Xenorhabdus bovienii
  Coding sequence Name=Xb4151_4152.C433.gene78.dna; Position on contig =42065..43276bp; Strand=+
atggcagttgaattgaaagacgttgaacagatcgcgcaggaaatcaaggggcgctttgacgagttcaaagagaagaatgataaacgctttgacgcgattgaggccgaaaaaggcaaactggcggggcaggttgacaccctgaacggcaagctgtctgaactggatagcctgaaaaccgcactggaagaagaactggcgggactgaaacgcccggcaggcggcagcaataacaaggccgcgtctgagcacaaaaccgcctttacccagtttatccgcaagggtaaggatgacgggctggccgaactggagcagaaagccatgcagaccgtcagtgatcccgagggcggttatgccgttcccgaagagctggatcgtaatatcatcagcgccctgaaagatgaagtggtgatgcgggcagaatgcagcgtggtgtccgtcggtaatcccaactttaagcggctggtcaatcagggtggcaccaacagtggctgggtcggcgaaaccgatgaacgcccggaaacgaaaacaccgaagctgacgcccatcgaaccgacctggggtgagatttacggtaatcccgccgccacccagaccatgctggacgatgccttctttgatgtggaggccttcatcacggcggagctggcacaggaatttgccgagcaggaagaagacgcctttacccacggcgacggggtcaagaagccgaagggattactggcctacggcagtgacgcgcagaccgacaaagagcgcaagtggggcaccttgcagcacctgctgctgaaaaagccgaccgaagtgacggcggacgaaatcatgcagctgatctacaccctacgcaagccgtaccgcaacggggcaaagttcatgatgaacaacaagatgctgttcaccgtgcgcaccctgaaagacagtcagggcaattatctgtggcaaccgggtctgcaactggggcaaccctctgcgttgctgggctacggcattgcggaaaatgagcagtttgccgatgtgggcgcggacgccgtgccggtggcgttcggtaacttcaagcgttgctacaccattctggatcgcatgggcgtacgcatattgcgtgacccgtacacccacaagccgttcatccacttttacaccaccaagcgcgtggggtctttgctggtggacagcaacgcggtgaaactgctgaaagcgggtggcggtaaatcataa

SEQ ID NO: 2371 - DNA, 306 bp, Xenorhabdus bovienii
  Coding sequence Name=Xb4151_4152.C433.gene79.dna; Position on contig =43322..43627bp; Strand=+
atgcccttacccaccattgaagaactgcggttgcagtgcaagatagatgagacgcaggacgatgacctgttactgaattatcttgccagtgccagagagaaggccgagaactacctgaaccgtaaactctatgaagacagggtgccggacgatgatcttgacggcattctgatcaccccgttaattaagctggccttaatgctggcagtggggttctggtatgaacaccgtgaacctaatgtattagccagtggatttaaagagctgcttaacgactaccggatcagacccatgagggggaaataa

SEQ ID NO: 2372 - DNA, 321 bp, Xenorhabdus bovienii
  Coding sequence Name=Xb4151_4152.C433.gene80.dna; Position on contig =43627..43947bp; Strand=+
atgaatatcggccgattgcgccaccgcatcacgattcagggtatccgcacccgacagacgtcttcgggcggcgttgtcaacgaacgctacaccgtggcaacggtgtgggcggaggcgaaatttatcagcggccgcgaggtggtggcggccaaggcagtgttatctgaaagtgttgtccggttctgggtgcgttaccgcgctgatatcgacaccaccatggctatcattttccggggcaaaacttacgccattcaggcagtgatgccggacaataaattaaccctgttggaattactctgtcaggagggcgtaaaacaatga

SEQ ID NO: 2373 - DNA, 444 bp, Xenorhabdus bovienii
  Coding sequence Name=Xb4151_4152.C433.gene81.dna; Position on contig =43944..44387bp; Strand=+
atgaccaccgtggatctttcagcactcaaagacctgtcgcgggatttggagctgctcagcaaggctgagaacgacaaagtactacgtaaaggcatgtatgccggggcgaaagtgctgcgcgatgagacccgcagccgtgcccccaaacgcaccggtaaactcaaaaagaacattatggcggttaaccgcaaaaaacagcgggacggctccatctcttcgggcgtttatgtgcggggatcgaatcaatccggcaccaacagcgaccccaaaatgaagaaaaacgacccccgcaacgcctactactggcgctttctggaaaaaggcacctcaaggatggccccgaagccgttcattgatccggcctttgaatccaaatcagatgccgccgccgacgcggtatttaatgcggcgttgaaagccattgatgaggtactggcaaaatga

SEQ ID NO: 2374 - DNA, 336 bp, Xenorhabdus bovienii
  Coding sequence Name=Xb4151_4152.C433.gene82.dna; Position on contig =44384..44719bp; Strand=+
atgacagacggcgatttgtttacattgttagttccggtactgcccggccgggtgtttccctatttaatcccgcaaaccgaaagaaaaaccgcggcgccgtggtgcgtattttccacctacagtatctacaccgatgtactgagcggccagtcggtcaaaatgacgcgggttcagattgatgcctacgcgcccgggctggacgacgccgaccggatttgtggcgacgccttcagtgccatcaaaacattgcaaccttttgaagtagaacgtgagaacagttacgaaaatgacacggggctgtatcgcgcgaccgtcgaatttaaaatctattcctaa

SEQ ID NO: 2375 - DNA, 531 bp, Xenorhabdus bovienii
  Coding sequence Name=Xb4151_4152.C433.gene83.dna; Position on contig =44670..45200bp; Strand=+
atgacacggggctgtatcgcgcgaccgtcgaatttaaaatctattcctaatcccggagataatatggctaagtatgaaaaaacactggcgacctcgctgtcggtttctgctgaggcagccaatgacgcaaccagcaccctgataaaatgggtggcaattgacacttccgtcaaagaaatcaactacaccggcggtcaaaaaagtgacattgaggtcactacgctcggttcccgtgaacaggagatgattaacggactggcggccccggctgaaattaccctctccgggcactggacggccgacgaggaagggcaggacattttgcgcctcgcctacagcaccgaccaagcctatgccttccgtgtccagttccccagcggcaatggctataccttcttggctgaggtcaggcaggaatcatggcaggctgccgccaatggcatcgtcagcgcctccttcaccttgcgcatgaaaggccgcccgacaccgctggcgaaaaaactgcaaaccaacacacaggaaggacaataa

SEQ ID NO: 2376 - DNA, 492 bp, Xenorhabdus bovienii
  Coding sequence Name=Xb4151_4152.C433.gene84.dna; Position on contig =45089..45580bp; Strand=+
atggcaggctgccgccaatggcatcgtcagcgcctccttcaccttgcgcatgaaaggccgcccgacaccgctggcgaaaaaactgcaaaccaacacacaggaaggacaataatcatgaatattcgtcaactggcattaaccccgaaactgggctttcgcaccaaaacggtaaccgtgactgagtgggataacgccaccgtcaccctgcgtgaaccgtcagctggggcatggatccgctggaatgaagtgacctcgccaacagacaaagaaggaacactctccacggcagaaaaggtgctgcgcaatacccgtgccgatgtcgtgctgtttatcgatgtgctgtgcgatgaacacggtgaaccggtctttactccggacgatatggaggccgtgatggatatctacgcccccgtgcattcccgcctgttacatcaggcactcagtctggtgaccaccggtgatgaagccgaaaaaaagtccgatctccattaa

SEQ ID NO: 2377 - DNA, 267 bp, Xenorhabdus bovienii
  Coding sequence Name=Xb4151_4152.C433.gene85.dna; Position on contig =45589..45855bp; Strand=+
atgctgacgctggccctgcgcctcggtaaaaccctgtccgaattgcagggcgggttaagtgccagcgaactgatgctgtggctggcctacgaccgtgaaaaccccctcagcgaccgtcggggtgacattcaggccgcgcaaattgcctccgcggtttatcagtcacagggtgtcaaagtcgggctgagcgaggcgctgctgcaatggggtaatcccgatgaggaaagcggcgacgacttcgaaaacttctttgctaatctcacatag

SEQ ID NO: 2378 - DNA, 3375 bp, Xenorhabdus bovienii
  Coding sequence Name=Xb4151_4152.C433.gene86.dna; Position on contig =45864..49238bp; Strand=+
gtggcaaaactgcgtgaactgattatcaaaatctcggccaattccagctcgtatcaggcggaaattgcccgggctgcccggctgggagaaaattaccaccgggtgatggaaaatggcaaccggggtgcggcggcggcggcgcgtggcagccgtgccgccctgcgtgacctgaacagccagctggtttcagtgaaagactctgccgtcgggatggcgggcgcgtttgccggcatcttcgccaccagtaaactgattgaaaccgccgacaaatggacaaacctcaattcccgcttgaaactggcgacggcgtccagtatcgatttagccaatagccagcggttattgatggagatgagtcaaaaaaccggaacatcattcgaggccaatgccacggtctttgcccgtgcggctgccccgatgcgggcactccaatatgcctcacaagacattgttaatatgacggaagcgctatcgacggggttgagaatatcaggcgcgaatgcttcagaatccagttcggtgctggtccaattttcacaagccatgtcgtccggtgtcctgcggggtgaagaatttaacgcgatggcggagaacggcagtcgaatcattcaggcactggctgacggtatgggcgtcgccagaacccaattaaaaggcatggcgaacgacggcctgttgacgatggataaagtcattcccgctttactgagccaactggagaaactgaaagcagaaggcctttcaatgggggcgacggttgaaaaatccctgatgcgcgtacaaaacgccttcatggaatggatcggtggggcgaatgaagccacgggtactacccgcgttctcgccggggtactggatgacctgtctaaaaatattaacgacgtcgctgcggcgggcgcagtggcagtcggtctgttcggggcgcgggcgctgggtaacagggtatcagcgattggggcatcaacctctgcgttgatccagaattcccgcgccgaaattaataacgcggatcaagcttaccgtaattctcaggttcaggttgcctcagcgagagccagcgcttatcaggcacaacaaaacgttatcgccgcgcgttcacgcctgcttcagacgacaaacacacagaccttcgccgccgcagaagcgagactgaaccggacactggtcgcagaagcggcagcgcaggccagagtgacacaaagcatcaatgcaagagccgccgcacaagcgcgactcaatgcggtcacctcgctcggttcaagaatgggcggtgcactgctcggcgctgtcggtggactgccggggatactgattatggccgccggtgcagcctacctgctgtaccaaaaccaaaagcaggccaaagaagaagcccgggcgcacgcgaaagaggcgacaaaaatcaaggaagaactgagcaagatggatcctgttcaactcagggacaccaagaatcagttaaaagaagatcttgccgtggctaaagaggatgtggaaaagttcaggaaggagatgaataaaaaccaaatcagcctcaatcttttcatgaaggataaaagcaacggtaaaaatactgacatcaagatcaccgagttcagcactaaactttcagaaagccgttcggcgtatgaagctgccctgaaaacggtcggtgaaatcacgtctgccctcacgagtctgggtgaccaacaaacaatcaatggggagaaagagaaaaggttcatcacagcgattaacgaaatgcgcaaaaccggcaatgtgacgctggcgctgcaaaatcaaaagctggagcttactgtcagtcttctggaacggatcaaaaacttagggattgatgtgtcgggtatccatgttcccgtgccggtagtgaaattcgagccaaacgacaaaataaagtcgttactgaaagaccaggaaagggaaattgatctttctaaaaggaagggattagataaagtcaggcgtgaggcgtattacaaagccgttgatggggggttgaatccggatgataggcaacaaaagccctatgtgaatcaggtcattaataacgcggctcaggtataccaaaatgccgaagccctacgtaagcaggacgaagccgcccgaaaagctcaaagcgaggcagaaagtgccacacggaaagccgccaaaaccgcagaagattacacgaataaagtggccgaactgaatacgcaactggccaccgaagcgatccgctataaagagggcaatgctgccgccgagctattcgccaattctcaaaataacgtcagtaagtttactcaggaacagaacaaccacctgaaccagcttaacaagcgactggaggaaaccaagcagcgttatcaggacttacaggctgctatcgaagcggatccattccgtaatgttgctaaaagaacccaagaagcgacagagcaactggagcggcagaagaacaatggtcaaattgagtcacccgccgaatacacctatcgaaaaggggatatctggaaagacgaggttagaggcaatgcggacgccagacagcagtatgccgtttccgccagagataacttacggggcgaagttgacccaatacaggatctggaaaaccaacttgaacgcaaaaaggcgctttatcagtcctatgctgacgcaactgttatcagtgaacagcgtaagaatgaactaattgcggccgccgaaacggaaaacaacacgaaacgcattgaagcggcgaaacagttatttgctgcccaaagtacctatcacgcaatcgcagtcaacctgtttgatactgtcagcgaacgcatgggcaacatgattacggggctgctaaccggaactaaatcgctcaaagaaggcatttctgaaatgttcgcttcaatggcacagagcgtcgttcagagtttaatgaaaattgctgcgaataaggcatttgaaatgctggcctcttcattcggtggcggtgcgggtggggcgttcaacggcttcatgtctacgttcgtcaagaatgccaaaggcggtgtttataattctcccagcctgagtagctacagcggtcagatagtcaatagtccgacattgtttgcgtttgcgaaaggggcgggactgatgggtgaagcggggccggaagccatcatgccgctgacccgtagtgccgatggctctctgggtgtgcgtgctatttccccaaagggcttgggtgatcaagggggcaccaatatcaatgtctacatcacggacgggaaaactgaaagttcatcatcgaaaggcgataatgacgccttcgggcgtcgttttgctcaggctgttgctcaggtctactacgctgaacgcgaccgggatttgcggcagggtggtgccatcaacaaagcgataagggcgaaataa

SEQ ID NO: 2379 - DNA, 333 bp, Xenorhabdus bovienii
  Coding sequence Name=Xb4151_4152.C433.gene87.dna; Position on contig =49238..49570bp; Strand=+
atggaaatattcacatggctgccgcgcgtgaatgccagttccaatgttgaatttgctatccgaaaagcgaaattcggtgacggttatgaacaggtctctggtgcggggattaaccccaagtcgatgagatggacattggattttgtcggtaatgaaaaacacattactgagattatcgcctttcttgaccggcatgaagggcataagtcatttatctggacgcccccgctggcgagcaaggggctgtttcggtgcgagagctataagtatcaggccattgattacaaaacctatgccctgtcaactgaattcattgaggcgcacgcgccatag

SEQ ID NO: 2380 - DNA, 750 bp, Xenorhabdus bovienii
  Coding sequence Name=Xb4151_4152.C433.gene88.dna; Position on contig =49580..50329bp; Strand=+
atgtttactgctgacgtacaaaagctggacgccggaaataccgtccggctctacgagattgacgggacaaaattcggtgccgatgtgcttcgttttcatgcgtatggtatgcctgtgacgcccgaagaaattgacaccgccgaggagacaggtagtcagccgcagccgaagtccctttggtggcaggggcaggaatataaaccgtggcctgttcagatagagggactggacatgtccacggatggacaggctgcccgccctcgcttatctgttgcgaatattgagggaacggtcaccgcgctatgtctgcaatttgatgacatggtacaagcgaaagtcgctatccatgatacatttgttcattatctggatgcgaaaaatttcccgcagggtaaccctaccgctgatccgcaacaagagcggcagctcatgttttacatcaacagaaaaacatctgaaaccgataagactgtggtttttgaattagccagcccggcgtcactggatggcctgattattcccacccggcaaattcacggcgtatgcacatggtgtgcccgtggctggtatcggacagggaaaggttgcgactacgccggaacaaactattttgatattgacaacaacccgaccgatgatccgagcaaagaccgatgccccggcaccgtcattgcgtgtaagttgcgttacggtgaagataatgagctatcatttggtgggtttccggcctcgtcccttatcaggagatag

SEQ ID NO: 2381 - DNA, 708 bp, Xenorhabdus bovienii
  Coding sequence Name=Xb4151_4152.C433.gene89.dna; Position on contig =50332..51039bp; Strand=+
atgaatgataagacattaacggccatatttgaacacgctaaacagatgcatcccaatgaatgttgtggggtgattgcccagaaaagccgcgtagaaaaatactttccctgcaaaaatttagcccctaatcccgccgaacaattccagctagaccccggtgattatttagccgcatcaatctggggaactattaccggtattgttcatagtcacccggacgcaactactatgcccagtgatttagatgaggcacaatgtgattttactgaattgccgtggcacattgtgagctacccagagggtgatttcaggacaatctatccgcgcggtgaattgccgctactcggtcgcccgtttgtgttgggtgtctatgattgctatggtctcattatgagctattaccgccaacaatgcggtgttgaactgaatgactatcgggttaattatcattggtgggagcaaggtgaaaacctttacatagagaattttgagaatgccggttttgttgaagtcacaggcgacccgcagacgggcgatgtaatcattatgcaggttcaagcggatgtgcccaatcatgccggtgttttgttagagggtaatttattactccatcacctctacggacagttaagccagaaagtgccttatggggggtattggaaagacagaactgtgaaaacgctgcgttataatcaattgaataaataa

SEQ ID NO: 2382 - DNA, 363 bp, Xenorhabdus bovienii
  Coding sequence Name=Xb4151_4152.C433.gene90.dna; Position on contig =51133..51495bp; Strand=+
atgatctgtggattattactctcagcgtgcaagcctacagaaaaagatttcattaatataggtgaatctcttgttagagatagtctaaatgatccagacagtgcgaaatttgattcattctatcactcatcagataagatatttactccgatcggccgtccatcaggtgaactagatggttatgtttgtgggagagttaatactaaaaacacatacggtgggtacacaggtggaaaaccatattatgtacatattgaaactaaagatggaaagctaaagaagcatggacctatagttatagtaagtgatgatgaccaaaacaatttattaaattttagattagtgtgtcccaaaggtggttga

SEQ ID NO: 2383 - DNA, 639 bp, Xenorhabdus bovienii
  Coding sequence Name=Xb4151_4152.C433.gene91.dna; Position on contig =51617..52255bp; Strand=+
atggcttatacagatccccctttacgcacaatccacttacacggcgtccttgctaccaagttcggcgcgacatttgactatgccgtcagagatgccccccatgctatccgggctatgagtaggctggttgcaggttttgaggcattcatgatccatgctcaccagcagggttttactttttcggtcattgtgggtggcagaagttaccacaaaggcgaactggacatgaccaagggtaatggtgatatccatatactgcctgtcatcaccggcagcaaacgcggtggattgtttcaaacgattttaggggtagcgctgattgcggttgcatggtggaatccattgggctgggctgcctcgaccgcattgtttgtcggggcgtcaggggcatcaatggcaatgggcggcgtttctcaaatgctggcacctcagccgccgaggctggggatgcgggaatcccccgacaataaacccagttatgctttcggtggtgccgtcaataccatcgcacaagggaaccctgtgcctcttctgtatggttcgcgcgagataggcggggcgattatctcagcgggtgtttacaccgaagaccagtatcagactgagcaaatagaaaaccaacgcaaacacagccgctaa

SEQ ID NO: 2384 - DNA, 1041 bp, Xenorhabdus bovienii; identical to SEQ ID NO: 1042
  Coding sequence Name=Xb4151_4152.C433.gene92.dna; Position on contig =52296..53336bp; Strand=+

SEQ ID NO: 2385 - DNA, 207 bp, Xenorhabdus bovienii; identical to SEQ ID NO: 1041
  Coding sequence Name=Xb4151_4152.C433.gene93.dna; Position on contig =53362..53568bp; Strand=-

SEQ ID NO: 2386 - DNA, 117 bp, Xenorhabdus bovienii; identical to SEQ ID NO: 1293
  Coding sequence Name=Xb4151_4152.C433.gene94.dna; Position on contig =53579..53695bp; Strand=-

SEQ ID NO: 2387 - DNA, 261 bp, Xenorhabdus bovienii
  Coding sequence Name=Xb4151_4152.C433.gene95.dna; Position on contig =53723..53983bp; Strand=+
gtggggaccatagattttttatcacatgttactttttttaaagaaagtgacacgctgagcgaagttaactctggtgaaagtgactattacgccaaatattacaagccggaacctattaatttatttgggatttatctaaccataatggagaaagagcctatttttgtggttttatatgataaagaggataaatatatatacgcaattaacttgaagatgcgggttttaaaatctggaagttatcagtcaaccgagtggtga

SEQ ID NO: 2388 - DNA, 1050 bp, Xenorhabdus bovienii; identical to SEQ ID NO: 483
  Coding sequence Name=Xb4151_4152.C433.gene96.dna; Position on contig =53928..54977bp; Strand=-

SEQ ID NO: 2389 - DNA, 120 bp, Xenorhabdus bovienii
  Coding sequence Name=Xb4151_4152.C433.gene97.dna; Position on contig =54990..55109bp; Strand=+
atgaaaaatcaagcatcttcaatgacgacgggtatatttatatttttgatattaaatagtttttacccatctatctttttatatttatatttatatttatatttatatttatatttataa

SEQ ID NO: 2390 - DNA, 123 bp, Xenorhabdus bovienii
  Coding sequence Name=Xb4151_4152.C433.gene98.dna; Position on contig =55223..55345bp; Strand=+
atgcaactaaccatgaatatagatgcttggttttgtgacttcatagaggtgatgaagatgaaatggcggagaggaaagaaaataccgccagttcttaaagaaatggcggtgggaacacgttaa

SEQ ID NO: 2391 - DNA, 540 bp, Xenorhabdus bovienii
  Coding sequence Name=Xb4151_4152.C433.gene99.dna; Position on contig =55342..55881bp; Strand=-
atggtaaagcagcctgaagattggcttgacaattatcctgctgaagaggaagacgatgagataatctgggtcagtaaaagtgaaattaagcgagattctgaagcactgaaaaagctgggaatggagctggttgaactgagtaaaaacgcactggaacgcattccgctggatgacgacctgctggcagccattgagttggcacagagaatcaagcgtgaaggccgtcgccgccagttgcagttaattggcaaaatgttgcgttcccgcgatccggaaccgattactattgcactggataaactgaataaccgtcacaaccagcaggtagtgctgttccacaagctggaagaattacgtgacaaactgctcgaagattcagatggcgctctggcagaagtggttgcattatatccacatctggatcgccagcaactgcggacgatggttcgcaacgccaaaaaagagaaggcggctaataagccaccaaaatcctaccgtcagattttccagtatctgaaagatctgtctgaatcagcttaa

SEQ ID NO: 2392 - DNA, 132 bp, Xenorhabdus bovienii
  Coding sequence Name=Xb4151_4152.C433.gene100.dna; Position on contig= 55875..56006bp; Strand=-
atgccgagtggtaatcaggcaattttcccagttacaatacacaatattaggatgttaacacccaccggacgattggtcatgttccaaaatgcaccttatccggcctttttggaaggaaaaaaattatggtaa

SEQ ID NO: 2393 - DNA, 1344 bp, Xenorhabdus bovienii
  Coding sequence Name=Xb4151_4152.C433.gene101.dna; Position on contig= 56080..57423bp; Strand=+
atgatagtcactaatcaatatatcgcagaacagcgcaagcaattggaagatgcggtctcccacgctctcgaattagcgaagaccggttctgatgctgcggaagtcgcggtcaataaaacgacggggattagcgtcagcacccgtttcagtgaagtcgaaaatgttgagtttaacagcgatggtgcgctggggatcactgtttatcatcagcagcgcaaaggcagcgcttcttcaaccgatctcagcccagaggcaatagcccgcaccgtgcaggccgcgattgatatcgcccgctatacatcacctgatccttatgcaggcccggcggataaagatctactggcattcgcagcgccggatttggatctcttccacccggctgatttggatacggatatcgccattgagttggctgcccgtgctgaacaagcctcattgcaggcagatcaacgtatcaccaataccgaaggcggcagttttagcagccattatggtatccggatatttggcaatagtcacggtatgctgcaaagctactgctcaagccgccattctctgtctagctgtgtgattgctgaacaagatggcaatatggaacgtgattatgcttataccgtcagccgccgttttgatgaattgcaatcaccggaatgggttgggcaggagtgtgctcgccgtactctttctcgtctgggcgcacgtaagttaccgaccatgaaagcacctgtcattttctctgcggaagtggccacaggactgttcggtcacctggtcggggcgatcagcggcagcagcatttatcgcaaatcttctttcctgctggatagcttgggcaagcagattttaccttcgtggctgacgattgaagagcagccgcatttgctcagaggtctggcttcaacaccttttgacagtgaaggggtacgtactgcaccgcgtgatattatcaaagagggtgtgttgcagacgtggctgctgacttcctattcagcccgtaaactgggcatggtgaatacggggcatgcaggtggtattcataactggcgcattgcgggtcaaggacaggattttgcagctttgttgcgtgaaatgggaacggggctgattgttactgaactgatggggcaaggtgtcagtgcggttaccggcgattattctcgtggtgcatccggtttctgggttgaaaatggcgagatccagtatccagtcagtgaaatcaccattgcaggcaatttgaaagatatgtgggcgaatatggtgaccgtcggtgatgatatcgaaacacgcagtaatattcagtgtggttcggtattgctgccggaaatgagtatcgccggtcaatag

SEQ ID NO: 2394 - DNA, 96 bp, Xenorhabdus bovienii
  Coding sequence Name=Xb4151_4152.C433.gene102.dna; Position on contig= 57378..57473bp; Strand=+
gtgtggttcggtattgctgccggaaatgagtatcgccggtcaatagggatactcaatcaacaacagccagtttggattttactggactggctgtga

SEQ ID NO: 2395 - DNA, 411 bp, Xenorhabdus bovienii
  Coding sequence Name=Xb4151_4152.C433.gene103.dna; Position on contig= 57475..57885bp; Strand=-
atgaaaaaaccaaaaattattattaacgaactcgatgcggaacgtttagatttgctgttggaacaacccgcctttgccaatacccacattgcagaggcgctgaattcggagttggatcgagctgaaattgtgcctccggtcgaaattccgccggatgttgtcacaatgaacagtgaaattcgttttattgatttgggcagcaatgaagagcgtgtacgcactcttgtgtatccagcgtctctacaggatagtaccaagcacctgtctgtcatggcacctttaggggctgctcttttgggcctgcgggtgaatgatgagataacctggcaactaccaaacagtgaaaaaacccggatcaaagtattagaaattatttatcagcccgaagccgcaggtgaatatcatcgctag

SEQ ID NO: 2396 - DNA, 210 bp, Xenorhabdus bovienii
  Coding sequence Name=Xb4151_4152.C433.gene104.dna; Position on contig= 57797..58006bp; Strand=+
atgtgggtattggcaaaggcgggttgttccaacagcaaatctaaacgttccgcatcgagttcgttaataataatttttggttttttcataccacgctccaaattaggctcaatacaaaataacaccccgcatcacaaggaggggggtgttattttcaaagtaataaaattgatattaggctgttctgacgtgaaaataaagagatcatga

SEQ ID NO: 2397 - DNA, 126 bp, Xenorhabdus bovienii
  Coding sequence Name=Xb4151_4152.C433.gene105.dna; Position on contig= 58027..58152bp; Strand=-
ttgttgaattctcttccatctggggagaaaccaacccaaggatcaccattacaggcgcataatccacggctcaaaatgatatcgggctgttcttccattttgtgtggattagccctgttccattaa

SEQ ID NO: 2398 - DNA, 1233 bp, Xenorhabdus bovienii
  Coding sequence Name=Xb4151_4152.C433.gene106.dna; Position on contig= 58091..59323bp; Strand=-
atgcgttttaataaaactacactggcatttcttcttggcgtgaccctgtgccaaggcactgctcaagccgcccctacgctttctttagacaatactcaggcagaacacgttgcggctaccaacaacgcttgggttgaaatcaacacgacgactttcgaaaataatatccacacactgcaaagtaaactgacgaaagacaccaaagtgtgtgtagttctgaaaggtgatgcctacggtcatggtatcgatttactgatgccatctgtcatcaagacaggcatgccttgtgtaggaattaccagcaatgaagaagctcgcatcgtgcgtgaaagcggcttcaaagggcaattgatgcgcatccgtgcagcggctgtgactgaaattgagagtacgctgggctatgacatggaagaaatggtcggcgatctagaacatgctaaaactattgatgctcttgccaaaaaacacggcaaagcaatccgtgtccatttagttctgaacacgggtcgcatgagccgtaacgggctggaaatgaaaactgagcagggtaaacaagaagcgctgaaaattgctcaattgcctaacctgaagctggtcggcatgatgagccattatgccctcaaagatctggatgcgatccgcgaaggcgtgaacgatttcaaagaacaaacggcttggttgatcaaaaccgccaatctgaaaagaaacgagatcattctgcacgcttcgagctcttatgcgtcaattcgcgtacctgaagcacaattcgacatggtgcgtgtcggcagtgcactgtacggcatcctgaaccctgaatatccagaattcaagccgctgattcaggtaaaaacccgcgttgcttctgttaaaccctatcctaaaggtaatggtgtcagctacgacaacacctacatcctgaaacgtgattccaaactggctaacctgccgataggtttctctgacggtttcagttccagtctgtccaacaaagcgtttgttctgatcaacggtcaccgcgcacctgttgtcggcctcgtttccatgaataccgtcatggtcgatgtaactgatttgcctgatgtgaagagcggtgatgaagtggtcattttcggtaaacaaggcaaagaagaaattacccaatctgacattcaaaaatggggcggaatgcatattgttgaattctcttccatctggggagaaaccaacccaaggatcaccattacaggcgcataa

SEQ ID NO: 2399 - DNA, 132 bp, Xenorhabdus bovienii
  Coding sequence Name=Xb4151_4152.C433.gene107.dna; Position on contig= 59281..59412bp; Strand=-
atgaaattaattaataaaaaatttatcattacggggtatttacacacggatcattttttcagttcaaatattaaaccggagattacttcatgcgttttaataaaactacactggcatttcttcttggcgtga

SEQ ID NO: 2400 - DNA, 273 bp, Xenorhabdus bovienii
  Coding sequence Name=Xb4151_4152.C433.gene108.dna; Position on contig= 59763..60035bp; Strand=-
atgacagtcaaaaagcagcttgaaattaaaaatcggcttggtatgcatgcccgacctgcaatgaaattgcatgaccttgtgcagcagtttcaatcgcaggtcattctgcgcaacagcagcaatattcaagccgaagcccacagtgtgattgccatgcttatgctggattccgaacaaggcagttacattgaagttgaggcgaccgggtcggatgagcagcaggcactggccgccattattgagttatttaatgccggatttgatgaagaataa

SEQ ID NO: 2401 - DNA, 852 bp, Xenorhabdus bovienii
  Coding sequence Name=Xb4151_4152.C433.gene109.dna; Position on contig= 60053..60904bp; Strand=-
atggtgctgatgatagtcagcggtcgttccggctccggtaaatccgttgccctgcgtgcgctggaagatatgggattctattgtgtcgataacctgccggtggtcttactgccggaactggcaggcacattagctgaacgcggtatttcagcggcggtcagcatagacgtgagaaatatgccggagtcgccagaaattttcgaagaagctctgacgaaactgccggacacgttctcgccacaattactgtttcttgatgcggatcgcaacaccctgatccgccgctacagtgacacacgtcgcctgcatccactatcaagcaaaaatctgtcgctggaaagcgctattgatcaagaaagtgacctgctggaacccctgcgttcacgggcagatttgatcatcgacacctctgaaatgtccgtgcatgaattggcagaaatgctcagaacgcgtctactgggcaaacgcgaacgcgaactgacgatggtgtttgagtctttcggctttaagcatggtattccgattgatgccgattatgttttcgatgtgcgtttcctgccaaacccacactgggatcctaaactgcggccaatgaccggtttagatcgccctgtggctgcctttttggatcgccacacagaagtacacaattttatttaccagacccgcagctatcttgaactctggctgccgatgctcgaaaccaataaccgcagctatctcaccgtggcaattggttgtacggggggtaaacaccgttccgtctacgtcgctgaacaattagcggactacttccgttcccgtggcaaaaacgtgcaatcacgtcaccgcacactggaaaaacgtaaataa

SEQ ID NO: 2402 - DNA, 468 bp, Xenorhabdus bovienii
  Coding sequence Name=Xb4151_4152.C433.gene110.dna; Position on contig= 60985..61452bp; Strand=-
atgaacaacgaaacagatttaccactaagttcggtactttcgcccgaatgtacacgcaacaacgtaccttgttcgagtaaaaagcgcgccttagagattatcagtgaactggcatcaaaacagcttggattaccggaaaatgccgtattcgaggctattctttcccgcgaaaaagtgggcaccacaggtatcggcaacgggattgccattcctcacggcaaactggataaagagtgttcacataatgccgttggcgtgtttctgaatctggaacagcctattgccttcgatgccatcgataatcaacctgttgacttgctgtttgctttattggtgccgtctgaccagtgtcagacccatttacattcactatcattgattgcaaagcgtcttgcagataagaatctctgccgccgtctgcgttcagcacaaagtgacgaagagctatataaaatcataactgaataa

SEQ ID NO: 2403 - DNA, 93 bp, Xenorhabdus bovienii
  Coding sequence Name=Xb4151_4152.C433.gene111.dna; Position on contig= 61484..61576bp; Strand=+
atgcctgactggaggcatccggtattgatgcactgtttatacctttcacctgaatctattgggtatgtaagtagaacagtgatgagtttatga

SEQ ID NO: 2404 - DNA, 288 bp, Xenorhabdus bovienii
  Coding sequence Name=Xb4151_4152.C433.gene112.dna; Position on contig= 61599..61886bp; Strand=-
atgcaactcaatgtcacaggccacaatattgaaatcactgatgcattacgcaacattgtgaatacaaaatacggcaaactggatcaatatttcgataaaattaacctcattcaggtcatactccgagtggagaaagtgcagaaaatcgctgaagccacggtgtatgtcaatggaggtgagttgcatgcaagctcagagcatgaagacatgtatgcggcgattgatgcactggcagataagctggcacgtcaattgaccaaacacaaaagtaagttgagacaacattaa

SEQ ID NO: 2405 - DNA, 1440 bp, Xenorhabdus bovienii
  Coding sequence Name=Xb4151_4152.C433.gene113.dna; Position on contig= 61910..63349bp; Strand=-
atgaagcaaagtttgcaactcaggctcagtcagcaactggcgatgacgccacaactccagcaagctatccgtttgttgcaactttctacgcttgaacttcaacaagagatccagcaggctttggaagctaacccactgcttgaacaggatgatcctcatgaggaaatcgacagtcaggaatctcctgatgcggtaactgaggtgatggatacccgcgaagcgcttgaacagaagaatataccggaagaactgccattggatgccagttgggatgaaatttacacggctggcactccttcggggacaaacagcgattacagtgctgaggattttcccgtttatcagggtgaaaccactcagacactgcaagactatctgatgtggcaggcagggttgacaccgtttactgaaacggattctgccatcgccacctccatcattgatgcgattgatgattcaggctatctgacagtttcaatcgaagagatccttgccagcattggcgataatgagctgacgctagaagaagtggaaatcgtactcaaacgcatacagcatttcgatccgattggtatcgccgcccgcgatttgcgtgaatgcctgcttattcaactttcgatgctgccgacaaaaacaccttatctgaacgaagccaaactggttgtcagcaaataccttgagctattgggcaatcgagactttcgtaatgtgttacgtcagagcaaattaaaggaaaatgccctgaaagaagccatcgatattattcaatcattggaacccaaacccggattagtggtcaatgcaggtgaatccgagtatgttattcctgatgtgcttgctcataaagagaatgaaagctggcaagtcaaactgaataccgatagcatcccccgtctgcgcatcaatcaacactacgcagcattggggcaacaggcccatagtgaaagcgacagtctgttcattcgcaataatctgcaagaggccaaatggctgataaaaagcctcgaaagccgtaatgacacgttattgaaagttgccagttgcattgttgaacggcaacaagatttttttgaatatggtgcagagcacatgaaaccgctagtactggcagatatcgcctatcaggttgaaatgcacgaatccaccatttcccgtgtgacaacacagaaatatctgtatagcccacggggcatttttgaattgaaatattttttctccagccatgtcaataccgatagcggaggtgaagcctcttctactgcgatacgggcactggtgaaaaaattggtcgcggcagaaaacccggccaagccactgagtgacagcaaattgaccagcattctggccgaacagggcattcaagtcgcgcgtcgaactgtcgcaaaatatagagagtcgttatccatcccgccttcaaaccaacgcaaaaaactggtttga

SEQ ID NO: 2406 - DNA, 108 bp, Xenorhabdus bovienii
  Coding sequence Name=Xb4151_4152.C433.gene114.dna; Position on contig= 63354..63461bp; Strand=-
atgagcaggtcaaacgcgtttatctgggtgagggtttccgtctttaatcctgattctgtcaggcgtcattcaggagaaattccagagaaattcaggagaaagtggtaa

SEQ ID NO: 2407 - DNA, 726 bp, Xenorhabdus bovienii
  Coding sequence Name=Xb4151_4152.C433.gene115.dna; Position on contig= 63415..64140bp; Strand=-
atggcaattttaaacgcagaaaatctggcaaaggcttataagggtcgcagggtcgttgaggacgtcagtctgaccgtcaaatcaggcgaaatcgtgggtttgcttggccccaatggggcaggtaaaaccacgaccttctacatggtggtcggcattgtgccacgtgatactggcaccattactattgatgatgaagacatcagcctgctgcctctgcatgaacgcgcccgccggggaataggctatttgccacaagaaccttccattttccgtcgtctgagcgtatttgacaatttgatggcagtcttggagatccgcaaggatatcacgcaagagcaacgaaaagagcgggcagaagaattaatggaagagtttcatatttcccatctgcgtgacaatctgggacagtcactttccggtggtgaacgccgtcgtgtggaaattgcccgtgctctggccgccaacccgaaattcattctgctggatgaaccttttgctggcgtcgatcccatctccgtactcgatatcaaaaagatcattcaacatctgcgggactatgggctgggagttctgattacagaccacaatgtccgtgaaacactggatgtctgcgaacgcgcctatatcgtcagccaaggccagttgattgcccacggctcaccggaagatattctcaacaatgagcaggtcaaacgcgtttatctgggtgagggtttccgtctttaa

SEQ ID NO: 2408 - DNA, 546 bp, Xenorhabdus bovienii
  Coding sequence Name=Xb4151_4152.C433.gene116.dna; Position on contig= 64147..64692bp; Strand=-
atgagatcccaaatgaacaacctaatccgtaataccgttattgccagtaccctgtttgcagtcagcctgcccgtactggcattgaaagaagatacgaaacagcccattacccttaattctgacaggcaatctttggatttaacggggaacgtagccacatttacggataatgtcagcgtaaaacaaggctcaatcgacattcatgcggataaagtcgtcgtcactcgcccagaaggggatgcgaaaaaaacggttattgaagcctacggtaatccggcgactttctatcagttacaagatgacggcaaacccatcaaagggcatgcctcaaaaatgcgctatgagatggataaagagctgatgacgctgacaggtaatgcctatcttgaacaactcgacagtaacatcaaaggcgataaaatcacctatctggtgccaacacagcaaatggaagcctttagtgataaaggtaaacgtgttactaccgtcctgttgccttcccagctacaggaaaaaggcatcagtgttaacaacaagagtaaataa

SEQ ID NO: 2409 - DNA, 699 bp, Xenorhabdus bovienii
  Coding sequence Name=Xb4151_4152.C433.gene117.dna; Position on contig= 64661..65359bp; Strand=-
ttgcaggtggccgtggtgcagtcagggagctttgtgatttggtacttttcgctcagaataagctggaaggtgccaaagggttatcaatataagactaaaattgaaaagagaatgagcagaattcaatcctggctgatcggaacactggcattgatcgcgcttgcgctgattggctggaatttatccaatttaaacgaaaacgcctcatcaccaattgtggatgatgggtatcccacttatcaaacacaggaagccacttcttttgtctatgatcccgagggcaagctggcttacaaactggtggcagatgatgtacagaactatacggaaagcaaactgacttggtttactaaacccatattgacaacctttgcctccaatagcacttccgaaacaccgacatggacagtacgcgcaaataaagcaaagctgaccaacgataaaatgctctatctgtacggcgatgtccagctggatagcctgaccgatgcctcacaactgcaacggatcacaacagaaaatgcgaccgtcaatctggtgtctcaagatatcttatccgacgaccaagtcactctgattggtgtcggcctgaaatctgttggcatgaaaatgcgtggcaatctgcgaaacaaaactgctgaattgattgaaaaggtgacgactcactatgagatcccaaatgaacaacctaatccgtaa

SEQ ID NO: 2410 - DNA, 564 bp, Xenorhabdus bovienii
  Coding sequence Name=Xb4151_4152.C433.gene118.dna; Position on contig= 65268..65831bp; Strand=-
atgagtcagaaaacgtatctggacacctgttatggcccggtcaacgaagaaattatcgaaagagccagtaaaatccgtctactgatttgtgatgttgatggtgtgatgtcagatggcctgatatatatgggcaaccagggtgaagaactgaaagcctttaacgttcgtgatggttacggcatccgttgtctgattacctcaggcattgaagtcgccatcattactggccgtaaagctaagttgctggaagatcgcgcagaaacactgggtattacacatctttaccaaggacagagcgataaggttttggcgtatcaggaactgttagataaactaacgttacagccagaacaggtcgcttatattggtgatgatcttatcgactggcctgtaatggcacaagttgggttatctgttgcggtttctgatgcccatccactgctgctgccaagagcagattatgtgactcagattgcaggtggccgtggtgcagtcagggagctttgtgatttggtacttttcgctcagaataagctggaaggtgccaaagggttatcaatataa

SEQ ID NO: 2411 - DNA, 987 bp, Xenorhabdus bovienii
  Coding sequence Name=Xb4151_4152.C433.gene119.dna; Position on contig= 65933..66919bp; Strand=-
atgacgtgggaagtagaaatgtctaagatagattttcaacaatcaggtaaaaaagtattacaggtcgaactcgacggattggcagaactggaacaatatattaatgaagatttcagccgagcctgtgagttgatgtttggttgtgaaggaaaaatcattgtcatggggatgggaaaatccggtcatattggacgaaaaattgccgccacatttgccagtactggcacgccctctttctttgtccaccccggtgaagccagccacggtgatctcggtatggtgacatcaaaagacatcgtgctgacaatctccaattccggtgaatccaatgaaatcgttgccttgatccccgtcctcaaacggcaaaaagttccgcttatctgtatgacaaacaacccaaacagtagcatggggaaagctgccgatatccatctgtgcatcaaaacaccacaggaagcctgcccgcttggattagcgcccaccactagcacgacagcaacacttgttatgggagatgctctggccgttgcgctcttacaagctcgaggttttaccgctgaagactttgccctttcccatccgggtggcacgctgggacgcaaacttctgttactgaccagtgacttaatgaccatcggtgatgatattccccgtgttccttataccgcgacactacgtgaagccttggttgaaatcacccgcaagaaactgggaatgaccgtcatctgcgatgacgatatgcagatcaaaggaattttcactgacggggatttgcgccgtgttttcgatatgggaatcgatttaaaccatgcaaacatctctgatgttatgactatcggcggtgtccgcatcaagccccatacactggccgttgatgccctgaacctgatgcagtcacgccacatcacgtccttgctggtcactgacggtgacaaattgctcggcgtactgcatatgcacgacctcttacaggcgggtgtagtataa

SEQ ID NO: 2412 - DNA, 978 bp, Xenorhabdus bovienii
  Coding sequence Name=Xb4151_4152.C433.gene120.dna; Position on contig= 66926..67903bp; Strand=-
atgtttctgactattgctctgttcattaccgggttgattttactggtgtatggatctgatagattagtatatggtgctgcggtttttgcccgctcactgaaaatacccccctatatcgtcggattgacagttatgggaatcggcacttcactgccagagttgatggtatctatcacagcagctcaagatgggctaccgaacatagctgtaggcaatgccattggttccaatattaccaatctgctactgattactggcgctgcgtcactcattcgaccgatcacagtgaaatcagatatcctgaggcgggaattgccgctgatgttgctgattactgcatttgtaggctatattctggcagacagctacctgaaccgcctggacggtatcgtcctgttacttaccgccttgttttttatcgtcataatgatcaaaatgacaacagtttcccaagatgatggtctagacagctatatgcaggaacgagatgcagaattacctgtcgaaggcaacaaaggcatcgcacttctctgggttgttttaggattgattatcctccccatttctacccgcatggtgattgacaatgcggctgtgattgcacgtatttatagcatcagtgagctgattattggcctgacaattctggcggtaggcaccagcctgcctgaactggctacttcaattgctgcggccattaaaggcgagaatgatatggcgatgggcaatatcatcggctcaaatgttttcaacatcactctggtattgggtatccccggtatactttcacccggcgttatttcacctcaggccttttcccgggacttctgggtcatgatggctgccagtgtgttattcacgatattctgtctggggagaaagcatcgattgaaccgattaaacggcatcctgttactgggctgttttatcgcttattttttcgtactttttgtttctaattattacggtactgattaa

SEQ ID NO: 2413 - DNA, 804 bp, Xenorhabdus bovienii
  Coding sequence Name=Xb4151_4152.C433.gene121.dna; Position on contig= 68135..68938bp; Strand=+
atgagtcaacaaacagcaaatcttattgagatctgcggcatgtatttcactcgtggtcaacgcccgattttttctgatattaatctgaccgttccaaaaggaaaagtgactgccatcatggggccttcaggcatagggaaaaccaccttgctacgcctgattggtgggcagatccgccctgaacgcggcgagatctggtttgatggcgataatattccggcattgtcccgccaacgtctctatgctgcccgtaagaaaatgagcatgttatttcagtcaggtgcgctgtttacggatctgaatgtctttgacaatgtcgcctttcctttgcgtgagcatacccaattgcccgaagcgttgattcacactacggtgatgatgaaactggaggctgttgggctgcgtggtgctgcgcacttgatgccatcggaattgtctggcggtatggctaggcgcgctgcattggcgagagcgatagcactcgatcccgatctcattatgttcgatgaaccttttgttggtcaggatcccattacgatgggcattctcgtcaaattaattgatgagcttaaccatgcgctcggtgtcacctgtgttgtagtttcccacgatgtacctgaagtattgagtattgctgattatgcttacattgtggctgagaagacggtcattgcagaaggtacaccggagcagttaagaatgaatcaggatcatcgggtacggcaattccttgatggcattgctgatgggccagtgcctttccgtttccctgcgggggattacaaaactgagttattaggataa

SEQ ID NO: 2414 - DNA, 789 bp, Xenorhabdus bovienii
  Coding sequence Name=Xb4151_4152.C433.gene122.dna; Position on contig= 68943..69731bp; Strand=+
atgttgatgttaacacgggcactggctgcgctgggtaaacgtgcgatcgaggttgcagcctcattcggccgtgccggctttatgcttttcagtgcaatcattggtaagccagaactcgccaaacaatggaaattattatgtcagcagctgtatagcgtcggtgttcagtcactgctgattatcgtggtttccggcttgtttatcggtatggttctgagtttacagggctatctggttttaacgacattcagtgctgagggcagtctgggcatgatggtggctctgtcactgttgcgtgaattggggccagtcgtcacggcactgttgtttgcgggtcgggcgggttcagcgttgaccgcagaaattggtttgatgaaagccacagagcagatttccagcttggaaatgatggcgattgatccgctgcgtcgggtaattgctccgcgtttttgggctggttttatcagtatgcctttactgtcgctgatctttgtcgcggttggaatcatcggaggcgcgatagtgggcgtggattggaaaggcattgatgccggctttttctggtcttcgatgcaatcggcggtggattggcaaaaagacttgctcaactgttttcttaagagcgtagcttttgccattacggtcacatggattgcattgttcaatggttatgacgctatccctacatcagaagggatcagcagggcgacgacgcgtacagtagttcatgcgtctttggcagtattgggtttggattttgtgctgacagcactgatgtttgggaactaa

SEQ ID NO: 2415 - DNA, 507 bp, Xenorhabdus bovienii
  Coding sequence Name=Xb4151_4152.C433.gene123.dna; Position on contig= 69736..70242bp; Strand=+
atgcaaaacaagaaaaatgaaatttgggttgggtgttttgtcttgattgcactggctgcaatcgtctttttatgtttgaaagtagctgatgttcggtcatttggcagccagacaacctatcgcgtatctgcggcatttgacaatattggtggactgaaagtgcgttcaccagtaaaaattggtggagttgtgattggtcgtgtagagcgaatctggctcgatcacaaaacctatactccacaggttgaactggaacttttcactcaatacgacaatattccaagtaccagctcgctttctattcggacatcaggactattgggcgagcaatatgttgcaatgaatgtgggtttttatgaccctgatatgggggtatccatgttgaaagggggagatcgtattgaggataccaagtctgcaatggtacttgaagatttgatcggtcagttcttatataaaagcggtgacagtggtcaggcgaaatctgattcggcacctgcacattaa

SEQ ID NO: 2416 - DNA, 630 bp, Xenorhabdus bovienii
  Coding sequence Name=Xb4151_4152.C433.gene124.dna; Position on contig= 70276..70905bp; Strand=+
atgtttaagcgattacttatggttgcgctgctggtggttgcaccattggccagcgcagttgatcaaaccaacccttatgcattgatgaaagatgcagcagaaaaaactttcacccgtttgaagaatgatcagcctcaaattcaggcaaacccagaagttctgcgtcagattgtgcgtgaagaattattgccttatgtgcaggtaaaatacgcaggggcactggttcttggaacttactacgggcaggctacgcctgaacagcgcgaagcctatttcaaggcttttgaatcttatttagagcaggcatatggtcaggctctggcgatgtatcatggccagaactaccagattgcgccagaacagccattagagggcaagacgatagtggctatccgggtcactattactgatgaaaatggtcagccgcctgttcgcttggattttcagtggcgtaaaaatagcaaaacaggttactggcaggcttatgacatgattgcggaaggcgtaagcatgatcacgaccaagcagaatgaatgggcagatatcctgcgccagaaagggattgatgctctgacagaacagttgaaaatcagtgcgaaaacgccaatcactttagaaaagaaaaagtga

SEQ ID NO: 2417 - DNA, 336 bp, Xenorhabdus bovienii
  Coding sequence Name=Xb4151_4152.C433.gene125.dna; Position on contig= 70907..71242bp; Strand=+
atggaaaaccgggaaataagccaatcgtctgatgacggaaagataagttgggaacaaacgggaagtacactatttcttcacggtacactggatcgtgacagtttacttccgctttggcagcaaaaaggcagcgttatggctgagatcgaaaatattgatgtttctcggcttgagcatgtggattccacagggctggcgttgtttgtccacttaaaaggagacatgcagcaacgtggcaaacgattaacattttctggcataagtgaacgtctagagacattgatagcactttatggcttgcaaagtctcattgctgctgacacgccagatatgtaa

SEQ ID NO: 2418 - DNA, 150 bp, Xenorhabdus bovienii
  Coding sequence Name=Xb4151_4152.C433.gene126.dna; Position on contig= 71177..71326bp; Strand=-
atggaaaccagacgactcttaaaccaagaaaaacgcccttgtaagaggatgacttacaagggcgataattatgggaaaagggaattacatatctggcgtgtcagcagcaatgagactttgcaagccataaagtgctatcaatgtctctag

SEQ ID NO: 2419 - DNA, 255 bp, Xenorhabdus bovienii
  Coding sequence Name=Xb4151_4152.C433.gene127.dna; Position on contig= 71374..71628bp; Strand=+
atggatactgatgaaattaaagaagtgctgatgaaagcattggcacttgatgacgttatcgttagcggtgatggcagccatttccaagtcattgccgttggcgagctttttgatgacttaagccgtgtcaaacaacagcaggctgtttacgcccctctgatggaatacattgctgataatcgcattcatgccgtgtcgatcaagacttatacacctgcaaagtggcagcgtgaccgcaaacttcaggggttttga

SEQ ID NO: 2420 - DNA, 1269 bp, Xenorhabdus bovienii
  Coding sequence Name=Xb4151_4152.C433.gene128.dna; Position on contig= 71676..72944bp; Strand=+
atgaagatggataaatttcgagtgaaagggcctacctgcttatcgggtgaggttactatttccggagcaaaaaatgctgcattacccattctgttcgcagcgctgctggcggaagagccagttgaattacagaatgtacctgaattaaaagatattgataccaccatcaaactactcaaccgtttgggaaccaaagtaaaacgcaatggttctgtttttgttgatgccagtaacgttaacgaatactgcgcgccttatgaactggtcaaaacgatgcgggcttccatttgggccttggggccgctggtcgcacgtttcggtcaagggcaggtatcactgccgggtggctgtgccattggtgctcgccctgttgatctgcacatttctggtctggaacagctcggtgcaaaaattgttctcagtgaaggctacgtcaaggcttccgtcgatggtcgcttgaaaggcgccagcattgtcatggataaagtcagtgtgggtgcgaccgtcaccatcatgaccgcagcgacactggcggaagggacaaccatcattgaaaacgcagctcgtgagcctgaaatcgaagatactgccgattttctgaatacactgggagcgaaaattaccggagcaggcaccgatcgcattgtgattgaaggggtagagcgtctgggaggtggtgtttatcgtgtgctgcctgatcgtatcgaaacaggaactttccttgtcgctggtgccatttcccgtggcaaggtgatttgccgtaataccaagccgaatacattggatgccgttttatccaaactgcgtgaagctggggcagacattcaggtgggagatgattggattagccttgatatgcacggcaagcgaccaaaggcggttacattccgcaccgccccgcatccgggctttccgacagatatgcaggcccagttcagcttgttgaatatggttgccgaaggtgtcggcatgatcactgaaactatctttgaaaatcgcttcatgcacattccagagttgattcgcatgggtgcgcgtgcagaaatcgagagtaatacggtagtttgtcacggtgttgaaaatttatctggcgctcaggttatggcgactgatttgcgtgcctctgcgagtttggtattggctggctgtattgctgaaggcaccacggtagttgatcgtatttatcatattgaccgaggctacgagcatatcgaagataaactacgtggtttaggtgcgaatatcgagcgtattaagtcgactgattaa

SEQ ID NO: 2421 - DNA, 150 bp, Xenorhabdus bovienii
  Coding sequence Name=Xb4151_4152.C433.gene129.dna; Position on contig= 72910..73059bp; Strand=+
gtgcgaatatcgagcgtattaagtcgactgattaaactgaattcatatcatccttcgcccagtctgggcgaaggattgaataagcgaaaagcagcggagttatcggctatactcttcatcttgcaagctgccgcagacgttaaatactaa

SEQ ID NO: 2422 - DNA, 1059 bp, Xenorhabdus bovienii
  Coding sequence Name=Xb4151_4152.C433.gene130.dna; Position on contig= 73065..74123bp; Strand=-
atgctgatcaagttattgcgctccatatcgataggattgctcattgctgcaatcttattggttaccataccttcactacgtcccaatgggttaaaacatctcctgagtgatagcagccgcaacgacaaaccatacagtttcaatcaaggagttcgtcgagcagctcctgctgttgtcaatatctacagcagtaatctgggtagtttttctcatgaaggccgggaacttcttcccttgggttctggcgttatcatgaatgaacagggctatatcctcactaacaaacatgtcatcaatgaagccgactctattattgttgcattacaagatggacgattctatgaggcgctgctggctggctcggatgctccaaccgatctggcggttttaaaggtcaatggtaaaaatctcccagtaatcccgataaatcccaatcgagttgcccatgtgggagatatcgtgctggcaatcggcaatccttacaatttaggacaaaccatcactcaaggtattatcagtgcgacagggcgtgttagcctaagccctacacgtcgccagaattttctgcaaacagatgcctcaattaatcagggaagttccggcggtgcactggtcaatacgctgggggaattagtcgggattaatacgctgacgtttgataagtcagaatttggtgtcacgcctgaaggcttgggatttgccattcccactgagcttgccacaaaaatcatgcataaactcatccgtgatgggcgggtcatcaggggatatattggtatcactgtccaagatttgccccgtattcgctcgtcagacagcaacataaaccaaatgccggggttgcgggtttttgaagttgcaccgagaagcccggctcaaaaagtggggatcaaagtgggagatatcattactaatttcaatcaccaacctgcgatttctccgacagagacgatggatcaagtcactgacattcgccctggcagtatggttcccatcactgtgctgcgtgatggtcaatccctcaccttcaaggttatggttgaagaatttgacggctga

SEQ ID NO: 2423 - DNA, 99 bp, Xenorhabdus bovienii
  Coding sequence Name=Xb4151_4152.C433.gene131.dna; Position on contig= 74169..74267bp; Strand=-
gtgacgataatatctacttgttattgcgtaattaaccaattgaatataaaaacgcgttctagtattactaacagacacagcataagctgtgtctgttag

SEQ ID NO: 2424 - DNA, 1458 bp, Xenorhabdus bovienii
  Coding sequence Name=Xb4151_4152.C433.gene132.dna; Position on contig= 74233..75690bp; Strand=-
atgaaatttcctgacaggataggtcttttaagtacgatttccctttctggcttaggtattaagagaacgtattcaatgaaaagaaaaaacacattgctcagtgcacttgcgatcagtattggattatctttggcttcagctccaatggtaggtaacgcagctttacctgccgcagtggcttctcaggaattaccgagcctcgcgccaatgctggaaaaagttcttccttccgtagtgactgtgcatgtctcgggcacagaagttcaaaatcagcagcagcttcagttaccagaagactttcaatttttctttggaccaggttttcctccacaggagcaaagaagccgtccattcaaaggattaggctctggggttattatcaatgccaataaagggtatgtgctgaccaataaccatgttattgagaaagccaataaaattcgggttcaattaaacgatggccgtgaatattccgcaaaactcatcgggcgtgacccacagactgacatcgcacttttacagctgcaagatgccaagaacctgacagccattaaattcgctgattctgatcaactgcgtgtaggggattattccgtcgccatcggcaacccattcgggctggggcaaaccgtaacatcggggattatctctgcccttggccgcagtggcctgaatctggaaggtttggaaaatttcatccagaccgatgcttccatcaaccgtggtaactcagggggagcattgatcaacctgaaaggggaattgatcggcattaacactgcgatcctcgctcccggcggcggtaacatcggcatcggttttgccatcccaagtaacatggccagcaacctcgcagatcagctcattgcccacggtgaagtcaaacgcggccttctcggtatcaagggaaccgaaatgacagcagatgtcgccaaggcactcaacgttgatactcaacaaggggcattcgtcagcgaagtcattcctaaatcagcggcggctaaagctgacatcaagccaggggatgtgctggtctccgttgacggcaaaaaaatcaccagctttgctgaattgcgtgcgaaggttggtacaaccgctcccggtaaagcaatcaaaatcggccttctgcgtaaaggaaggccaatggaagtgatcgtaacactagaaaataatgtagcccaagaaactaaggctgaaaacttgagcgttgccctgcaaggtgccattctgagcaacagtacagtgaaaaacacgcaaggtgtgaaagtagataaaattacccagaattcacctgccgcaatgtctggcttacagaatgatgattttattgtaggcgccaataacgagcgaattcggaatatcaacgagctgcgtaaactgcttgaggcaaaaccgcctgttattgccctgaacattttacgtggtgacgataatatctacttgttattgcgtaattaa

SEQ ID NO: 2425 - DNA, 132 bp, Xenorhabdus bovienii
  Coding sequence Name=Xb4151_4152.C433.gene133.dna; Position on contig= 75696..75827bp; Strand=+
ttgggaattacgcttattgggataggttttaagcataattgtttcgatgctgttatgactctcaattattcagcaaagttcactaacaatgttgttttaccgtgtttctttacaggtatttacgtgaattaa

SEQ ID NO: 2426 - DNA, 465 bp, Xenorhabdus bovienii
  Coding sequence Name=Xb4151_4152.C433.gene134.dna; Position on contig= 75904..76368bp; Strand=-
atggtattgagacatagtggaacactattgccgaacactgaagttaataaaggggttgccatgacttgggaatatgcactgattggattaattattggttttatcgttggcgcactggctgtccgctttggcagttcgagactgcgtcagcaaaatgcagcacaggccgaactggagaagaatcgggcagagttggaagagtatcgtaaggagctggtcagccattttgctcacagtgctgaattacttgataatatggcacgcgattatcgccagctgtatcagcacatggccaaaagttccaacgaactgatgccaaacatgccaatacaggataatcccttcaattatcgcctgactgaatctgaagtcggtaaaagtaaaatcacctccagtatgcctccacgggactattctgagggagcatccggcctattccgcccgattcaagataaaaaacagtaa

SEQ ID NO: 2427 - DNA, 132 bp, Xenorhabdus bovienii
  Coding sequence Name=Xb4151_4152.C433.gene135.dna; Position on contig= 76428..76559bp; Strand=+
atgccacttgatgtgtcaattttatacaaatttgcgatgatacgccgtgaattattggcggaattgagagaggatatggaaaaaagtatgaaagatgggaacaaatataacgaactcagacagaaaagatga

SEQ ID NO: 2428 - DNA, 1128 bp, Xenorhabdus bovienii
  Coding sequence Name=Xb4151_4152.C433.gene136.dna; Position on contig= 76624..77751bp; Strand=+
atgtcaccgattataccttcgtctctctatcaatctgcactgtcagaaggccagtaccaacctgatgaagtgcagcgtaataccgttgcccgcctggatatcattcatcacgatcttggtcatcgctctccggagcaggctttaccttcaagtggactgaaaagcctattgggcaggttatttggcggcttatcaacagagcagccgcgaccgattcaggggctttatatgtggggcggcgtcggacgtggaaaaacatggttgatggatatgtttttccagagcctgccaactgaccgaaaactgcgtctccattttcatcgttttatgttgcgggtacatgaagaattaaccgctttgcaggggcacgaaaatcccttggatgtgatagcggatggttttaaggcgcaaactgatgtgctctgtttcgatgagttttttgtttcggacattacagatgccatgatcctcggtaccttgctggaagctctgtttaagcgaggaattaccttggtggcaacatcaaatattccacccgatgaattgtaccgaaatggcttgcagcgcgcgcggttcctgccagccattgagcaaattaaaaaatactgcgatgtgatgaatgtggatgcgggtatcgattatcggttgcgcacgctgactcaggcacatctttatctcacgcccttgtcggaagataaccgacaggaaatgcatcgcatgtttcagcgtctggcaggacggaaaggagagccgaatccggtattggagattaaccatcgcagtatgcctgccatcagcagtgttgacggggtgctggccatcactttcaaaaccttgtgtgaagatccccgcagtccgttggattacattgcgttgtcgaagctttatcattctgtcctgctgcatgatacgccagctatgactgcattggatgaaagcgcagcccggcgttttcttgcattggtggatgaattctatgaacgccatgtaaaactcatcatcaatgctgaagcgccgatggagcagatttatcaaggggaattactgacatttgaatatcggcgttgtctgtcccgcttgcaggagatgcaaagtgaggaatatttaaaacttcctcatttgccctga

SEQ ID NO: 2429 - DNA, 174 bp, Xenorhabdus bovienii
  Coding sequence Name=Xb4151_4152.C433.gene137.dna; Position on contig= 77913..78086bp; Strand=-
ttgccatctgcgtcaacaacataccagtcgcgttttacggtttctggtttagctgtaaaagttttcattaaagcttacccaattataagttacacgttggtgaacactcgatgttcagaaactgtttttgaggttcacacgacttttgtccagcaaacctaccccttcgaatag

SEQ ID NO: 2430 - DNA, 429 bp, Xenorhabdus bovienii
  Coding sequence Name=Xb4151_4152.C433.gene138.dna; Position on contig= 78019..78447bp; Strand=+
atgaaaacttttacagctaaaccagaaaccgtaaaacgcgactggtatgttgttgacgcagatggcaaaactttaggccgtcttgcaactgaaatcgctagtcgcctgcgcggcaagcataaagcggaatatactccgcacgttgatactggtgattacatcattattgttaacgccgaaaaagttgctgtaactggcaacaaacgtgctgacaaaatctactatcaccacactggccacatcggtggtatcaagcaagcgacctttgaagagatgattgcccgccgtcctgagcgtgtcattgaaatcgcggttaaaggcatgctgccaaaagggccactgggtcgtgcaatgtaccgtaaactgaaagtttacgcgggcagcgagcacaaccacgcggcacagcaaccacaagttctggacatttaa

SEQ ID NO: 2431 - DNA, 393 bp, Xenorhabdus bovienii
  Coding sequence Name=Xb4151_4152.C433.gene139.dna; Position on contig= 78463..78855bp; Strand=+
atggctgaaaatcaatactacggcactggtcgccgcaaaagctcctccgctcgtgtctttattaagccaggtagcggtaacatcgtaatcaaccaacgcagcctcgaagtttacttcggtcgtgaaactgcacgcatggttgttcgtcagccactggagttggttgacatgttaggcaaactggatctgtacatcactgttaaaggtggtggtatttctggtcaggcaggcgcaatccgtcacggtatcacccgtgcactgatggcttatgacgagactctgcgttctgatcttcgcaaagctggcttcgttactcgcgatgctcgtgaagttgaacgtaaaaaagtgggtttgcgcaaagcacgtcgtcgtccacagttctccaaacgttaa

SEQ ID NO: 2432 - DNA, 261 bp, Xenorhabdus bovienii
  Coding sequence Name=Xb4151_4152.C433.gene140.dna; Position on contig= 78731..78991bp; Strand=+
atgacgagactctgcgttctgatcttcgcaaagctggcttcgttactcgcgatgctcgtgaagttgaacgtaaaaaagtgggtttgcgcaaagcacgtcgtcgtccacagttctccaaacgttaatttgttgccacggctgtggcgatgggttaaagttgaaacccgtcatttatatggcgggtttttttatcatctgattttcctttctttggtgaatagccttttttcccaaaaaatagcgtattacagaaataaataa

SEQ ID NO: 2433 - DNA, 279 bp, Xenorhabdus bovienii
  Coding sequence Name=Xb4151_4152.C433.gene141.dna; Position on contig= 79013..79291bp; Strand=-
atggctaaaaatgtcggtcgagccggaaaacagagtcattaccgaacgtttgttggcagcgacagccatgaaaacctccaagtttatctaaacaaaggaacgaacagcccttcagtgaaaaacggctattctcgctcatattctcatcctgtttcgcacttattatccgagggtatattgaaacccctgccaaatcaggctcattcatggataaggcaaaaaattattactagtctaccagattttgcacattttgtggggaagtacattgagaattaa

SEQ ID NO: 2434 - DNA, 642 bp, Xenorhabdus bovienii
  Coding sequence Name=Xb4151_4152.C433.gene142.dna; Position on contig= 79223..79864bp; Strand=+
atggctgtcgctgccaacaaacgttcggtaatgactctgttttccggctcgaccgacatttttagccatcaagtgcgaattgtgctggcggaaaaaggggtcagcgttgagattgaacacgttgaagcaggtaatttgcctcaggatttgattgatctgaatccttatcagacggttcctactctcgttgatcgtgaattgactctgtatgattctcgcatcattatggaatatctggatgagcgttttccccatccaccactcatgcctgtatatccggttgcacgtggtagcagccgtttgatgatgcatagaattgaaaaaaactggtattccctgatgtataaaattcagggaggaaatactcaggaagctaatgctgcacggaaacagcttgcagaagaattattggccatggcgcctgttttcagagatatgcctttcttcatgagtgaagagttcagtctggtggattgctacctttcgcctctgctgtggcgtttacctgtattaggtgtagagttatctgggccaggtgcaaaagatatccagatttatatgcagcgtgtatttgaacgtgacgcatttttggcttcactgacggaagcagaacgtgaaatgcgtttaccatcacggagctaa

SEQ ID NO: 2435 - DNA, 483 bp, Xenorhabdus bovienii
  Coding sequence Name=Xb4151_4152.C433.gene143.dna; Position on contig= 79868..80350bp; Strand=+
atggagatgattcaaatgtctccccgtcgtccttatttattgcgggcgcattatgaatggctgctggataatgaaatgactccgcatcttgtcgtggatgtcaccctgtatggggtgaatgtcccgatggaatatgcgaacgatgggcaaatcatcctgaatatttcgccgagggctgttggcaatctggaattgactaacgatgaagttcggttcaacgcccgttttggtggtgtagcgcgtcaagtctctgttccaatggcggcagtgattgcggtttatggtcgtgaaaatggcgcaggaatgatgtttgagccagaatctgcctatcaggcgggctccacaccagaagattctgatgttcctgtagcggataatctggtgcttatcagtgacgctaagattgctcgtgataatgactcatcggatgacgaacctccccaacctccaaagggtcgtccaactttgcgtgttgtaaaataa

SEQ ID NO: 2436 - DNA, 501 bp, Xenorhabdus bovienii
  Coding sequence Name=Xb4151_4152.C433.gene144.dna; Position on contig= 80466..80966bp; Strand=-
atgcgcttactcacacagatattcttattctctttcatatctttaataatgagctcaccctcaattgctcatttatcgacacaagcggaaatcctgcaacaagtgcgggaaagaggtgtaaatgccgttgttgcggaattaggagaaagtggaaaaagggatgaagtcgcctataacattacaacaggtgaaagtcagtggctgagagttgcatttacgttatcccccaatatgcattccgaattttcgaaacaactccttcgctctttatcttttgccttaattaataaccccgtagaagtcttatcgctgtcgaaaaaatataattcattctcatcagatcagatctgcgatataccgtcaactttaaaaggcttgggcgaaaggacaagttttattgaaaagctgtctaacagcctgaatgcagccaaaaaatcgaattccggaaaaaataaggaaaatatagaaaattgcctgtggagactagatcaaactttatag

SEQ ID NO: 2437 - DNA, 120 bp, Xenorhabdus bovienii
  Coding sequence Name=Xb4151_4152.C433.gene145.dna; Position on contig= 80929..81048bp; Strand=+
atgaaagagaataagaatatctgtgtgagtaagcgcatctatttattccagtcattgtcaatgaatagttattacttaattaactattatttaatttttgtttggatatcgtttaactaa

SEQ ID NO: 2438 - DNA, 111 bp, Xenorhabdus bovienii
  Coding sequence Name=Xb4151_4152.C433.gene146.dna; Position on contig= 81049..81159bp; Strand=-
atgcgactactcttataccctaaaggtaaatattcagatttaatctactgtgttaatacagcaaaaaatcttattcctcttatcaaagagaagacggtttttttagtgtaa

SEQ ID NO: 2439 - DNA, 198 bp, Xenorhabdus bovienii
  Coding sequence Name=Xb4151_4152.C433.gene147.dna; Position on contig= 81137..81334bp; Strand=-
ttgcggaaggtagaaaggcggcatccggtattctcgactatctcgaggtttaatccctattcactgtttcttcaattacttctccggtcttttgaccggagaaaatttcaaaaattcagagacaagttcacttttatcactttttactcccacattagttgtatttttttgctttatgcgactactcttataccctaa

SEQ ID NO: 2440 - DNA, 1566 bp, Xenorhabdus bovienii
  Coding sequence Name=Xb4151_4152.C433.gene148.dna; Position on contig= 81282..82847bp; Strand=-
atggcgaaagcatactggaaagctggtcacaatgggtcaataaattcgcgctggttaaacctaagtccagtgatgtcagtgcattgttgggacaccgcagccgttcttccgcagaattgcgggttcaagcgcagtaaggagttaaaaatgagtcagaacgtttatcaatttatcgacttacagcgtgtcgatcctccgaaaaagccgttgaaaatccgcaaaatagaatttgtggaaatttatgaacctttttctgaaatgcaggttgaggcacaggcagatcgctgcctttcatgtgggaatccctattgtgagtggaaatgccctgtgcacaactatattccgaactggctgaaactcgcgaatgaaggccggattattgaagcggcggaactctcccaccggacgaatagcctgccagaagtctgcggacgagtctgtccgcaagatcgcctgtgtgaaggtgcctgtacgctgaatgatgactttggtgctgttaccatcggcaatattgaacgttacattaacgacaccgccattgcgatgggctggaagccggatatgtcagacgtgatcccgacaggcaaacgtgtggcagtgattggagccggccctgcggggctggcctgtgcagatgtcctaacccgcaacggcgtacaagcggtagtttacgatcgccaccctgaaattggcggcttgctcacgtttggcattcctgctttcaaactggaaaaagacgtgatgatccgccgccgtgaaattttctccgacatgggtatcgaattccgcttaaacacggaaataggcaaagacattacgcttgctgaactcaccgagcaatttgatgctgtatttctgggcgtgggtacttatcagtctattcatggcggacttgaaaacgaaggtgctgacggagtctatgatgccctgcccttcttaattgccaatacccgtcatttaatgggctaccccgctttaccggaacaaccttatgttgatatgaaaggtcagcgtgttctggtactcggaggcggtgatacagcaatggattgcctgcgcacttctgttcgccaaggcgcaacccatgttatctgtgcttatcggcgggatgaaggcaatatgccaggttctcgtcgagaagtgaaaaatgccaaggaagaaggtgtggattttcagtttaaccttcagccgctcagtattgagatcaatagcgcaggtcaagtttgcggcgtcaaagtcgcgaaaacacaacttggcgaaatggatgaaaaaggccgccgtcgagctgaaatcattcagggctccgaatttcggatcgaaaccgatgctgttatcacggcgtttggtttcaaacctcacaacctgcactggctgaatgcgcatcagatcaatctcgatcagcagggacgtattgttgctcctgaagccagcaacctgcccttccaaaccagtaatcctaaaatattcgcaggcggggacgctgttcgtggttctgatttagtggttactgcgattgcggaaggtagaaaggcggcatccggtattctcgactatctcgaggtttaa

SEQ ID NO: 2441 - DNA, 4458 bp, Xenorhabdus bovienii
  Coding sequence Name=Xb4151_4152.C433.gene149.dna; Position on contig= 82711..87168bp; Strand=-
atgttgtatgataaatcgcaggaaaaagataactgtggctttggattaattgcgcatattgaaggggagcaaagccacaaggttgtgcgcacggccatacatgcgctggctcggatgcagcatcgcggcgcaattctggcagatggcaaaacgggtgatggctgcggcttattaatgcaaaagccagatcggtttttccagatgatcgccagcgatcagtcatggcggctcgccaaaaactacgctgtcggcatgctgtttttaagtcaggatgccaaaattgcccaatcatgtcgtgacattgtcgaacaagaattacaaaacgaaaccttgtccattgtgggttggcgggaagtccctatcaaccgcgatattttaggcgggattgccctgtcaagcctccctcgtattgagcagatttttatcaatgccccggccggatggcggccgcaagatctggagcgccggttgttcattgcccgacgccgtatagagaagcgcatcactaatgacgacttttatgtttgcagcctgtccaatctcgtcacgatttacaaaggactgtgcatggcggctgatttaccgcgcttctacctcgatttggcggatttgcggatggaatcctctatctgtttatttcaccaaagattttcaaccaatacggttcctcgctggccgctggcacaaccgtttcgctatctcgcccacaacggggaaatcaataccatcaccggcaatcgcgaatgggcaagagcaagggcctataaattccggacaccactgatccccgacttacaaactgccgcgcctttcatcaatgaaaccggctcagattccagttcactggacaatatgctggaattgttcctcaatggtggtatggatttaattcgggcaatgcgtctgctggttccccctgcatggcaaaataatcctgatatggatgatgatctgcgggcattcttcgacttcaactccatgcacatggagccgtgggatgggcctgctggcatcgtgatttccgatggacgctacgcagcctgtaatttggatcgcaacggcctgcgccccgcccgttatgtgattaccaaagataagctgatcacttgtgcttccgaagtgggcatttgggactaccaacctgatgaagtcgtagaaaaaggacgcgttggccctggtgagttaatggtaattgacacctatgaaggccgcattctccattccgctgaaaccgataatgatttgaaaatccgccatccttacaaagagtggctggacaaaaatgtcaaacaattgaccccatttgagaaactgccggaagatcaaatcggtcagcgtgatttagatgatcggatgctggcgacttatcacaaacaatttgcctacagtaatgaagagctggatcaaattatccgtgtgctcggtgagaatggacaggaagccactggctcaatgggggatgatactccgtttgcggtgctttccagccgtccacgtgtcatttatgactattttcggcagcaatttgcccaagttaccaatcctcccatcgatccactgcgtgaagctcatgtcatgtcgctggcgacccgtattgggcgggaaatgaacgtcttttgtgaagcagaaggtcaggcacatcggctgagttttgagtcccctgtactgctctattctgattttgtgcaactcacgacacagcaagaaccctactatcacgctgaaatactggatttgacgtttaatccacaagaaagcagcctcaaaagtgctgtcacaacgttatgcaaacaagctgaagaactgatccgcaacggagcggtattgctggttctgtctgaccgaaatatttcaccagaaaaattgcctattcccgcccccatggctgtcggagctatccagcactgtctggttgagaaaagcctccgctgtgatgctaacctgatcgtagaaaccgccagcgcccgcgatccacaccattttgccgtactattgggctttggtgccactgcggtttatccctatctggcgtatgaatcactgggaaaaatggtggacgatggcacgatcaacacgccatatatccgcgttatgctgaactatcgcaacggcatcaataaagggctatataagattatgtccaaaatgggcatttccactatttcctcttatcgttgctctaaattattcgaagccgtcggcctgcattccgatgtgacagatctgtgttttaacggcgttgtcagccgtattgaaggggcagatttcaacgattttgaacaagatctgcgtaatctatccaaacgggcgtggttacatcgccatacccttgagctggggggattgctgaaatatgcctatgatggggaatatcacgcttataaccccgatgtcatcaatacattgcaggcggctgttcacagtggcaaatacagtgattatcagaaatattcccagctagtgaacggccgccccgccacgacgctgcgagatttgctcgctatttcttctaaagcagagcccatcgccattgaggaagtccaaccagccgaatccctgttcaaacgttttgacacggctgccatgtcaattggtgccctaagccctgaagcccatgaagcactggctgaggcgatgaatacgctgggcggtttttccaattccggtgaaggaggggaagatcctgcgcgttatggcacgaagaaagtgtcccgcattaaacaagtcgcttccggacgtttcggggtaactcccgcgtatctgagcagtgctgatgtgatccaaataaaagttgcccaaggagcaaaaccaggggaaggcggccagttgccgggggataaggtgacgccttatatcgccagactgcgctattccgtaccgggggtgacactgatttcaccgccgccgcatcacgatatttattctatcgaagatttggctcagttaattttcgaccttaagcaggtcaatccgaaagcactaatttcagtcaaactggtttcagaaccgggcgtaggaactattgccacaggtgtggcaaaagcctatgcggatttgatcaccattgccggttatgacggaggaacaggcgcaagtccgctgtcatcagtgaaatatgccggctgtccgtgggaactgggtctggtagaaacgcaacaggcgttagtcgccaatggactacgccataaagtccgccttcaggttgatggcggattgaaaacaggtgtggatatcattaaggccgccattttaggtgcggaaagtttcggcttcggcacggggccaatggttgccctcgggtgtaaatatctgcggatctgccatctgaataactgtgctactggcgtggcaacgcaagatgaaaaattgcgtaagtctcactatcatggcctgcctgagcgcgtgatcaattatttccgtttcattgcgcaggagacacgtgagctcatggcgcaactgggcatacgggaattaacggatctgattggccggacagacttacttcagatattggaaggcatttctgccaaacaaagtaagctcaaccttgagccgctgctggaaaccgcacaaccccacgaaggcaaggatctgcattgtactgaagataacccgtcatttgatcagggtattttgaataaaaatatcatcaagcaggctatgccttatgtgaaaaattcacagagtaaaaaactttattttgatatccaaaatactgatcgttccgtcggagcctcactgtcaggtgaaatcgcggcgttgcatggtgatcagggtctggcagccgatcccataaagttacacttcacaggcacagccgggcaaagttttggcgtctggaatgcgggtggcgtcgaattgacattaactggcgatgccaatgattacgtcggaaagggcatggcgggaggtcaaattgtcattcgacctccggttggttctgcattcagaagtaacgaagcgaccatcatcggtaatacctgtctttatggtgcaacaggcggaaaattgtttgccgccggaaatgcaggcgagcgctttgccgtacgcaactccggtgctatcacggttatcgaaggcatcggtgataatggctgtgaatatatgaccggtgggatcgtctgtgttctgggcaacacaggggtgaattttggcgctggcatgactggcggattcgcttacgttcttgatgaatttgatgatttccgcaaacgagtcaacccagaattggtcgaagtactctcaatagataccttggccattcacaaagaacacttgcgtggattgatcaccgaacacgtccgattgacgggctcccagcatggcgaaagcatactggaaagctggtcacaatgggtcaataaattcgcgctggttaaacctaagtccagtgatgtcagtgcattgttgggacaccgcagccgttcttccgcagaattgcgggttcaagcgcagtaa

SEQ ID NO: 2442 - DNA, 156 bp, Xenorhabdus bovienii
  Coding sequence Name=Xb4151_4152.C433.gene150.dna; Position on contig= 87311..87466bp; Strand=+
atgttatgtcactgcataaagacactgcataaatatgagtcggagaattatccgacaggtgattttcagtggattcccaacttagcgagaaaaatagagcaggtcaaatcgtgccagatcgcgttttttgcaacgaaaataataatatttatttga

SEQ ID NO: 2443 - DNA, 2337 bp, Xenorhabdus bovienii
  Coding sequence Name=Xb4151_4152.C433.gene151.dna; Position on contig= 87825..90161bp; Strand=+
atgaagcggatcaggagatttgcccagtattatgtcgatttgatgatgaaattaggactggtgcgtttttcgttactgctagcatctgttctcattatccttgcgatggtgatacagatagcaatcactttacattggcgtggagaagtacaacgaactgatttaattggctccatcttttttggtttattgatcacgccttgggcggtttattttctttccatcgtggtggagcaacttgaagaatcccgccagcgtttatccagtctggtcgcaaaactggaggaaatgcgccagcgtgatgccaaattgaacctgcaacttaaagaaaatattactcaattaaatcatgaaatcaatgacagagaaaaagcagaaaaaacgcatctggtattgttggataaattaaagtcggaaatggaacatcgtgaaaaaacccagagtgcacttgagcagcaatcgattctgctacgttcatttcttgatgcttctcccgacttggtttattaccgcaatgaaaacaatgaattttccggttgtaaccgtgcgatggaactgctgacaggcaaaagtgaaaaacaacttatcggcctgacaccgacagaggtttacgataaagaagtcgccagtaaggtgatggaaaccgatgaaaaagtgtttcgtcacaatgtatcgttgacttacgaacagtggttggtttatcccgatggacgtaaggcctgttttgaactcagaaaagttcctttttatgatcgcgttggcaaaaggcacggtctgatggggtttgggcgcgatataacggaacgtaagcgctatcaggacgcattggagaatgccagtcgggataagacgacctttatctcaacgattagccatgagcttcgtacgcctttgaatggcattgttggtttgagtcgcatcttgatggacactgatctgacgccagaacagtgtaactatctgaaaacgatccatgtcagcgctatcactcttggcaatattttcaatgatattattgaattggataaaattgagcgccgtaaaacccagcttgataaccagcagattgacttcacgggctttatggctgatttggaaaacctgtcagggctactggcacagccgaaaggcattcggtttgtactagaaccaaaattaccattgccagctaaaatcttaactgatggcacccgcttgcggcaaatcttgtggaatctgatcggcaatgccgtgaaatttactcagaaaggtgagattcgggttcgcatctggcgtgaagaaggtgaacggctgttatttgaagtcaccgattccggaattggcattccttctagtgagttggaaaaaattttcgccatgtattatcaggtaacagacagtgcgggtgggcgtccggcaaccggaaccggtatcgggcttgccgtctctaaacgtcttgcccaaagcatggggggagatattgtcgtggaaagcaccgtggatcaaggttcctgttttacattgtctattgttgcccctgctgttgatgaaaaatcagaaggacaggaagaaagcgaattgccattgcctgcactcaacatcctgttggttgaagatattgaactgaacgtcattgttgcccgctccgttctggagaaattgggaaatagtgtcgatgttgccatgaatggccatgacgcattgatgatgtttgatcctgatgaatatgacttagtgttacttgatattcagttgccggatatgactgggctggatattgcccatcaattacaccagcgctatccaagccagtcacttcctccgttggttgcgttgactgccaatgtgttgaaggataaaagagaatatcttgatgtgggaatggatgatgtgctcagtaagccgctttctgtcaaggaattaaccgccgtgatggagaaattctggggtaaggcgtctgagcctgaacagacattacaggagacaaaggttgtgaagaagaacgaagatttacttgatacagagttgctcaatcaatatatcgacttggtcgggccaaaaatgattgctgataacctgaaaatttttgaaaccatgatgccaagttaccttgccttgttggattcaaacatgaccgcgagggatcagaaagggatcaccgaggaggctcataaaatcaagggagcggcgggttctgttggattacgtcacttacagcaattggcacagcagattcaatcacctgatttacctgcatggtgggataacgttcaagaatgggtggatgagctaaaattggaatggagaagtgatacagaaacattgagaaactggttaactgacgctacaaaaaaataa

SEQ ID NO: 2444 - DNA, 186 bp, Xenorhabdus bovienii
  Coding sequence Name=Xb4151_4152.C433.gene152.dna; Position on contig= 90138..90323bp; Strand=-
atgaatcttgtaacaaaaaatcttatctttgctatgttggtacctgtattcagtacggaagagttttttaactactcgcgccgaaaacaaattttagataagcgggtagacaagtttccctggtgttggcgcagtattcgcgcaccccaacttcggttggggttatttttttgtagcgtcagttaa

SEQ ID NO: 2445 - DNA, 654 bp, Xenorhabdus bovienii
  Coding sequence Name=Xb4151_4152.C433.gene153.dna; Position on contig= 90398..91051bp; Strand=+
atgaaatgcgttgcagttatattaagtggatgcggagtctatgacggaagtgaaattcacgaatcagtcctgactatgctctctttaagtcgcttgggtgccaaagtgtcttttttttcgcctgatgaagtacaacatcatgtaattaatcaccttaatggaaaggaggaaaaagaaactcgtcacacaatgcaggagtctgctcgaataacacgaggaaatatccagcctttatctcaggttgatattaataccttggatgcgctgatcattcctggtggttttggcgtcgctaagaatttatgtaatttcgcatttaaaggatcagaatgtgaaataaataaagatttattaagtatagtgcgttctatgcatcagcagggtaaacctatgggattcatgtgcattgcacccgttatggtagctaaaatattaggcaggccgataaaagtaaccatcggtaatgacccagaaactgcggcacaaatagaagcaatgggaggaattcacattgagtgcccagttgatgacattgtcattgattttaaaaacaaaattgtaactactccagcctatatgcttgctgaatctctatctcaggctgaacaaggaattgataaattggttcgcaaaatattggaaatgattgagtaa

SEQ ID NO: 2446 - DNA, 717 bp, Xenorhabdus bovienii
  Coding sequence Name=Xb4151_4152.C433.gene154.dna; Position on contig= 91056..91772bp; Strand=+
atgaaaaatcctttttcaatattgtggttctggttgaagaaaattgcggtagcgatcacaattctgtggttcgttactgtaattttgttttcgtttctgccggtgccgttttctatggtaatggcagagcgtcaaattagtgccttaatgtcaattaatttatcttatgtttcccgttcctcatgggtagatcagaatcaaatttcaccttatatgacattagccgtcattgcggccgaagatcaaaattttccaaaacattggggattagattttgaggctatcaaaacggcgatggcacataataaaaaatttcagaagcggatacggggtgcttccactattacccagcaaaccgccaaaaatttgtttttgtgggaaggtcgcagttgggtgagaaagggattggaagcaggaatggccattgttttggaattattatggtcaaagaaacgtattttgacggtctatctcaatattgccgaatttggtcatggcatttttggtgtggaagaagcggcatggcattattttggtaaatcggccagccgtttaactgcctctgaagcggcattactggcagcggtgttacccaacccttatcgttataaagttgatgcgccctcagcttatttgttgcagcgtcagcagtggattttgcagcaaatgcgacagctagggggagaaagttatctgaaacaaaataaattgcgatag

SEQ ID NO: 2447 - DNA, 576 bp, Xenorhabdus bovienii
  Coding sequence Name=Xb4151_4152.C433.gene155.dna; Position on contig= 91851..92426bp; Strand=-
atgcggctattttctctattaatagtattttgcagtgcaatgttattgcagggatgtattggtgccgccgtcgtgggttctgccgcgattgcgacaaaagcgggtagtgacccccggtcaattggtcaacaggttgacgatggcacgctggaagcccgcgtcagcaatgccatcagcaaagatccgcaaattaaggcacaagcccgcataattgtgactgtttatcagggtagagtgctgctaacgggacagagcccggatctgcaactggctgatcgggcaaaacagctcgcctcaaaggttgaaggcactgaagtggtatataacgaagtccgtcaaggtaatcctgttgacctgggtacggcctctgtagacacttggctgacaaccaaagtacgttccaagattttagccagtgattcagtgaagtcatcgaatatcaaggtcgttactgaaaatggtgaagtctttttgtttggtattgtcaccagacaggaaggtgcagatgctgcgaagataaccagtgaaaccagcggtgttaagcgcgtaacaacggcattcacttatctcaattga

SEQ ID NO: 2448 - DNA, 498 bp, Xenorhabdus bovienii
  Coding sequence Name=Xb4151_4152.C433.gene156.dna; Position on contig= 92438..92935bp; Strand=-
atgatgatggttcaatcactgctgaatggcaacaaaatcctttgctgtggcaatggcggctctgccgcgacagcacagcgttttgccgccagtatgataaaccgatttgagacagagcggccaagcctgccagctctgtctctgaatgctgataacgtggtgatcacttccatcgccaacagtaaacagccagacgaaatctatgccaaacaggtcagagcgctgggacatgctggagacgttctgcttgccatctctacgcacggaaacagccgggatatcatcaaggcggtggaagcggctgtcacgcgcgatatgacgattgtcgcactgaccggttatgatggtggtgaactagcaggcttactgggaccacaggatgtagaaatccgcatcccttcgcatcacagtatcagaattcaagaagttcacatgctgacaattaactgtctgtgcgacttaatcgataatacgttatttcctcatcaggatgactaa

SEQ ID NO: 2449 - DNA, 147 bp, Xenorhabdus bovienii
  Coding sequence Name=Xb4151_4152.C433.gene157.dna; Position on contig= 93157..93303bp; Strand=-
atgccattgctacaattacccagagcaagtgcagaaaaatattgcatacagcttctgtctggctgtatcaacgcaacgagtgtctggagacggcctcgtgtcgctttgatatttgtgcaattacaggtcagaaatttgaatggctga

SEQ ID NO: 2450 - DNA, 519 bp, Xenorhabdus bovienii
  Coding sequence Name=Xb4151_4152.C433.gene158.dna; Position on contig= 93233..93751bp; Strand=+
ttgatacagccagacagaagctgtatgcaatatttttctgcacttgctctgggtaattgtagcaatggcatcaccatatgttgcgttctggcggaaacgaacctcgacaaatacccatgtctgtttatcacgcataatcagatcaatttccccaccccgaattttcacattctccgcaacaaagacaagcccctgttgttgcagaaactgtttaacctgctgctcgtaatggcgtccctgcgcatagcgattgatgcttggttttttcatcctgaaatgaccattagtgttacttatggcattaattgtactgcgttactgctgtcagcgcttttattaacggtgctgtcaacagtggcatcaatattattggctgcattattctcgataatgatgcggccattgttaaactgcatccacgctagatggcgtaatattgtacaatcatttgtaacggaaagctctcccgacgcccccttcatatggaacccagtgccttgctgtagctgtgtaaactga

SEQ ID NO: 2451 - DNA, 1848 bp, Xenorhabdus bovienii
  Coding sequence Name=Xb4151_4152.C433.gene159.dna; Position on contig= 93526..95373bp; Strand=-
atgaccgatttaaaattgagcatctttgaaaaaaacatcactggatacagtatgcttccctcaatttttgtgcgtttcaaaactggtttagtctgcacagcgctgctgtcgactatgattattgcagggtgtaccacgccagaacagcaagggcaaccaccttctaagccacaagacaagatcagcgcagagattaaccgctatcagtccattattgatgcagctcataatcaaccgtctctggatgttatccgcgcttatattgcgctggaaacacataccgcagacgacgctgctcaccagaaaaacattgatgatacatggcaggtactgacgcatctttccccacaacagttgggcgaactggtgattaatgccaatgagtatacgcttcagggctggcttgacctactcaatgcctatcacgtcaataaacaagatctagataagctacgtactgccatcactgactggcgtacccgctatccagataaccctgctatccgtagtttgcccacttcgctgcaacaaatgctgctcaagccaaaggacagccatgccattatcgggctattcctccccctgagcggtcaggcaaaagtgttcggtgaggcaatccgtcaaggcttccttgatgcacaaaaaggactgccacagccaactttgcctgtaaatgctaccgtatcagcgccagaagcaggggtagcagcaaatacgactgaaaccgcactgtcatcttctccagtctcggcaatttcaaacactattgctgctgtccccgtcaacgatcagccggtgaaagtctatgataccaacagccaaccactcaccaacctgctggcacaagctgaacaagatggtattacgctggttgttggaccattgctgaaaccgagtgtggaacaattggtacaaattaatacgctattgaacattctcgccctcaacgaactggacgtttcacaatcgcggcctaatatctgctatttctccctgtctcctgaaaatgaggcgcaaaatgcggctttacatctctggcagcaacaaaaacgcaatccattaatattagtgccacgtaacgagctaggtaatcggataactaaagccttcgcagaagaatggcagaaattgggcggtaatgtggctttgcaacagactttcggaacactgggtgaaatgaagcaatccatcaatcggggtattggcattcgtttatctggtacgcccattccagtcagtgcttacctgccggatgcgggggaatcaccgctcaaaacgaacggagcggtgatcgccacaagcgcccctacaaattctgccagtggtgccgtcgatgccgtttacattgcagcgacaacggatgaactgactctcatcaagccaatgatcgatatggcaatcagttcccgtaagaaacccgcgctctatgctaattcacgcagtaataaggcgggtgtcgggccggatttccgtctggaaatggacggcatgcagtttagtgacattccattgctgacaggcgtcaatttgccattaatgcaacaagccgccagtaaatttgccaatgactattccctgatgcgtctctatgctatgggcatagatgcatggtcactggctaatcagtttacacagctacagcaaggcactgggttccatatgaagggggcgtcgggagagctttccgttacaaatgattgtacaatattacgccatctagcgtggatgcagtttaacaatggccgcatcattatcgagaataatgcagccaataatattgatgccactgttgacagcaccgttaataaaagcgctgacagcagtaacgcagtacaattaatgccataa

SEQ ID NO: 2452 - DNA, 873 bp, Xenorhabdus bovienii
  Coding sequence Name=Xb4151_4152.C433.gene160.dna; Position on contig= 95386..96258bp; Strand=+
atgaatcaaaccaatcgagcagtggttacgacatccacgctatatgttgtgccaacccctatcggaaaccttggggatatcactcagcgcgcacttgaagttcttaaacatgtcgatctgattgcagccgaagatacgcgacacactggcctattgcttcaacattttgccattaatgcgcgcatgttcgcacttcatgatcataatgaacagcagaaggcagatcaaatacttgcgaaattagagcaaggtttgagcattgctctcgtgtctgatgcaggaacaccattaatcaacgatccgggctatcatgttgtccgccgttgtcgtgaagcgggcattaatgtggttccactaccaggtccctgtgcagcgatcaccgcgttgtctgctgccggattgccttctgatcgtttttgctacgaaggttttctgccggcaaaaagtaagggacgccgggatacactgcgcgatttggcgcaggagccgcgaacgctgatcttctatgaatcgacacatcgtctgttggacagtttagaagatattgtggaagtgtggggcgctgatcgttatgtcgtgttggcacgggagctgaccaaaacgtgggaatccattaagggtatgcctgtgggtgagcttttggcatggatcagagaagatgaaacccgtcgccggggagaaatggtactgattgttgaaggctatcgtaaaccggcggaagattgcctgccgccagaagccctacgaacactggaactactacaaaaagaactgcccttgaagaaggcggcggcattgacggcggagattcatggtgtaaagaaaaacgcactgtatcgccatgcccttgagcaaatcgaagaaggtgcgtga

SEQ ID NO: 2453 - DNA, 219 bp, Xenorhabdus bovienii
  Coding sequence Name=Xb4151_4152.C433.gene161.dna; Position on contig= 96310..96528bp; Strand=-
ttgccagccgcgcggtgcgctcttaccgcaccctttcacccttacctgatcccacccttatttttgcaaacaaaagtaggccatcggcggtttgctctctgttgcactagtcgtaggctttcaccccccagacgttatctggcaccctgccctgtggagcccggactttcctcccctttacatctcccgaaggagagcggtaaagcagcgactgtctag

SEQ ID NO: 2454 - DNA, 270 bp, Xenorhabdus bovienii
  Coding sequence Name=Xb4151_4152.C433.gene162.dna; Position on contig= 96419..96688bp; Strand=-
gtggagttgaccgataagccgggttctgtcgtggacaatcattcatctaggccagaacttgcgcgctggctcaagcaacctacccgggttcagtacgggccgtaccatgtgaacctctatttggtcttgctccgggtggagtttaccgtgccacggactgttgccagccgcgcggtgcgctcttaccgcaccctttcacccttacctgatcccacccttatttttgcaaacaaaagtaggccatcggcggtttgctctctgttgcactag

SEQ ID NO: 2455 - DNA, 153 bp, Xenorhabdus bovienii
  Coding sequence Name=Xb4151_4152.C433.gene163.dna; Position on contig= 96651..96803bp; Strand=+
ttgtccacgacagaacccggcttatcggtcaactccaccagattcagccctatagagctttggctttatagggcttattctttttctgggcagatgaaaaacgtgctgtcagagtatgagaatcagccacccaaatcgattagcagcccctga

SEQ ID NO: 2456 - DNA, 702 bp, Xenorhabdus bovienii
  Coding sequence Name=Xb4151_4152.C433.gene164.dna; Position on contig= 96773..97474bp; Strand=-
atgataataactagaacagcaaatcaatgcggtaaagccgattatggctggctcaaagcgcgctatactttttcattcggccactatttcgacccaaaatttttgaactatggcgcattgcgcgtccttaatcaggaagtccttgcgcctaaggctgaatttcagccaaaagcgtatccccacgtcgatattctgaatattatcctgcaaggcgaagcccaataccgggatagtgagggaagtcatattcatgcacgccaaggagactgcctgctgttttccgcccgtcaggacattcgctacagtgaacataatatcagcgatgaaatcccgctgacacgcatgcaactctggctcaatgcctgtccggaacaggagccgctaccgttgcaacgcacagtactgccaaaccgaccattaacattactggcctctccctcgtcagaaaacaagagcatgttcctgcgccaacaggtatgggtaagttatctggtgatcaagaccagcgatatacaaactctgcctttgcggggaaaaaatgcttatctgcaatccatccgtggcaatgcaaaaatcagcggcagcaatcatgccaacgtggaaatcaaatgtggggatggggtatttattcaggaagaattgctgctaaaactgcgggcagacacaccatttcaggggctgctaatcgatttgggtggctga

SEQ ID NO: 2457 - DNA, 897 bp, Xenorhabdus bovienii
  Coding sequence Name=Xb4151_4152.C433.gene165.dna; Position on contig= 97632..98528bp; Strand=+
atgggtaaagaacgggcgcttacattagaatccctgcgcgttatggatgcgatcgaccgacggggaagttttgcggcagcagcggatgaattggggcgtgtgccttctgcattaagctataccatgcaaaaattggaagaagagctggatgttgtattgttcgatcgatcgggtcatcgcacgaaatttaccaatgttggccggatgttgctggagcggggacggttattgctggaagccgcagataagctcacggcagatgcagaagcccttgcccgtggatgggaaactcacctgactatcgtctgtgaagcgttgtttcccgttgtatcgctgttcccccttgtggataaactggcgaaaaaatcgaatacacagttctcattaatgacggaagtgctggcaggggcttgggaacggctggaaacagggtatgcggatattgttatcgcaccagatatccatttcaggccctctgcggaaatcaattcacgtacactttattccatcaataacgtctatgttgccagtgtggatcatcctatccaccatgaacccgaacctttatctgatgccacgcgggtcaagtaccgtggaatagcagtcgctgatacagcaagggagcgccctgtgctgacagtgaaattattggataaacaagcacggttaaccgtcagtacgttagaggataagcgtcgtgcacttttggcgggtttaggggtagcaacgatgccatacccgatggtagagcaggacattgccgaaaaacgactacgggttattggttcggaatacagccatgaaaccaacatcattatggcatggcggcgcgatagtatgggcgaggccaagtcgtggtgcctgcgtgaaatacccaaactgtttatgaagcaataa

SEQ ID NO: 2458 - DNA, 492 bp, Xenorhabdus bovienii
  Coding sequence Name=Xb4151_4152.C433.gene166.dna; Position on contig= 98614..99105bp; Strand=-
atgattaacaaattgtgttttttagctcatgagttggtcattaaaaatataaacagaccttttattatcattgccttctgtatcttggagatgttcatgaaaaaatttgaagatagtagcctgttggcggctcgcattttaatatcaaccctgttcattatcgcaggatatgggaagctgggtgatgcttatgcggggacacagcagttcatggaggcaatgaaagttccgggaattttactgccactcactatcttacttgaactgggtggtggccttgccgtattgttcggtctgctgacgcgtaccactgcggtatttacgtttattttctgtattctgacagcacttctgttccacagcgatttttcagatggcatgaaccaaacaatgttcttgaaaaatatggccatcggtgcaggttatctactattggcgatgatggggcctggaaaattcagtattgaccgcgcactgaataaaaactggtaa

SEQ ID NO: 2459 - DNA, 207 bp, Xenorhabdus bovienii
  Coding sequence Name=Xb4151_4152.C433.gene167.dna; Position on contig= 99214..99420bp; Strand=+
ttgaaagagaataagaaaaagacgagagatgaaaatagcattagcgctcgttcaggtttctgcgtggacactatcgtgaatttgaccacccgaaagctcaaaatgaacagagaatgctcgttctcatccggtaaagaatgctttccaaggtcaaacggtgttcaggtttgtctaaacccatccggtgtgttgcatcaatgcagatag

SEQ ID NO: 2460 - DNA, 123 bp, Xenorhabdus bovienii
  Coding sequence Name=Xb4151_4152.C433.gene168.dna; Position on contig= 99398..99520bp; Strand=+
gtgtgttgcatcaatgcagatagcttattccaatggagatcggttaacatagctcgcggcatgatggtgagggctggttgttttttggcgaaagtaattatactaaatcatcacgctgcctaa

SEQ ID NO: 2461 - DNA, 93 bp, Xenorhabdus bovienii
  Coding sequence Name=Xb4151_4152.C433.gene169.dna; Position on contig= 99475..99567bp; Strand=+
ttgttttttggcgaaagtaattatactaaatcatcacgctgcctaataatcccttgcaaaacgtcaacacgccctattatattgttaatgtaa

SEQ ID NO: 2462 - DNA, 174 bp, Xenorhabdus bovienii
  Coding sequence Name=Xb4151_4152.C433.gene170.dna; Position on contig= 99605..99778bp; Strand=+
atgagttgggtttatgctctggaaaatgaatcttgtttttttgaacataaaccttcaattaaaatctcttttctgtcctctcttcgaaagataattacaatggttcttcactttccgcaatcggcctgtccccgaggctttttaaggcctgtaatttctccggcggagtactga

SEQ ID NO: 2463 - DNA, 1182 bp, Xenorhabdus bovienii
  Coding sequence Name=Xb4151_4152.C433.gene171.dna; Position on contig= 99887..101068bp; Strand=+
atgaaagatttcccaatgatgaaaaaatttgtaatcaataccttggcctttgccacaatagcaacctctccgttttatgcctcagcacaaaaaacactgacggcgcaacaggttgaaaaaattgtcaatgatacgcttacgccgctgctcgaaaaacaggatattcccggtatggctgtcgctgtgatttatgatggaaagccgcaattttttaactacggcgtggcggatataaaaactcaacgcccgataacggaaaataccctgtttgaactaggttcggtcagcaagacctttaccgggatcgccgggggatatgccatgcaaaccgatattctaaatcttaatgatccggtgacggcgtacagtcctgagctaacgggcagtcagtggcgggatgttaaaatgctgcatctggcgacgtacactgcggggggacttcctcttcagctcccggattcggtcacggatcagaagtcattgtggcagtactaccagcaatggaagccactgtcggcacctgggatgatacgcaattactccaatgccagtattggcttattcggtgcgctggctgtaaataaaagccagttgacatttgaaacctatatgacgaagtatgttttcctgcctttaaaactgacgcatacttttataaccgtccctgaatctatgcagtcagattacgcgtggggatataagaatggtcaaccggttcgcgtcacaccgggcatgttgagtgcagaagcctacggggtaaaatctaccacgcaagatatggtgaaatatatgcaggccaatatggctccggacagcctgcctgccgataacgataagttaaagaaggctatcctcgcggctcagtctcgttattaccaagtgggaaacatgttccagggattgggatgggaaatgcataactggcctatcaatccgcagagggtgattgccgacagcaacaatgacatcgctttacaaccgcgtgaggttgaggcactgataccgccacgctctgccgtaccggcatcctgggtgcataagaccggcggtaccgatggctttggagcttatattgctttcatcccggaggagaaaattggcattgtaatgttggctaacaagaactatccaaatcctgtccgcgtggaagctgcgtatcatattcttaaggcattgcgttaa

SEQ ID NO: 2464 - DNA, 309 bp, Xenorhabdus bovienii
  Coding sequence Name=Xb4151_4152.C433.gene172.dna; Position on contig= 101262..101570bp; Strand=-
atgaccatcatgaataagtcacggtgccaacagcgagaatggcgaaaacagcagttattactggaaatacagcagcaacggcactcactttcagagtgtacccaacactggcttgatatcactcagccttatgacagaggttggcaaaccctatctgccttcaagccttatgtcgccattggctcgggtatcgcactgatctatgggatatgccatcccatgaagttttatcgcgggtcacgccgtatggttagccttttgggatttattagggggattaagtcggttttatcggtcgcaataacctaa

SEQ ID NO: 2465 - DNA, 402 bp, Xenorhabdus bovienii
  Coding sequence Name=Xb4151_4152.C433.gene173.dna; Position on contig= 101554..101955bp; Strand=-
atgatccaatcaccccgttcacaaggccccggcaaagggatctttgatactttacgacgagtggcagcgattgttgttagcatggttgaaacccgtatccggctcatagccgttgagttggaagaaaatacggccacgctggtgcagttgctgctgctgattgggttcacgctattacttgcgacctttggcctgatgtgcctgttaatattgatattctgggtcattgatcctgtttatcgagcaacggcaatggctattaccgcaggcattctgctgattcttgccgtatttggtgcaatatggacgatcaggaaaagcagaaagctgatttttttcaattcaacccgtgaacagctaaaaatagatcgcaaaatgctggaggatgaccatcatgaataa

SEQ ID NO: 2466 - DNA, 306 bp, Xenorhabdus bovienii
  Coding sequence Name=Xb4151_4152.C433.gene174.dna; Position on contig= 101957..102262bp; Strand=-
atgtcgcagaagaaaaactctgaagatttacgtactgaattgcaatcccttgcggatacgctggaagaagttctcaatagttccggtgacaaatccaaggctgaattggaaaaactacgtagtaaagcagaaaaaacgttgaaagatgcgcgagtcacgctcagtgatgccagcgataagttggtcgatcaaacaaaggaaatggcaggtcgtgcggataattatgttcgtgacaatccgtggacaggtgtaggaatcggtgcagcagttggtgttgtgttaggtattctactggcaaaacgctga

SEQ ID NO: 2467 - DNA, 171 bp, Xenorhabdus bovienii
  Coding sequence Name=Xb4151_4152.C433.gene175.dna; Position on contig= 102419..102589bp; Strand=+
ttgaggaggaaatttaccggaagttcaataccctgtggtatgttttggctcgataccacagggaaaagccagcctttgtattggcagaagaaaaattatcacgacaggatattactgaggaggatggttagcacgtctcttacgccagatgaccgtcagactgccaattaa

SEQ ID NO: 2468 - DNA, 669 bp, Xenorhabdus bovienii
  Coding sequence Name=Xb4151_4152.C433.gene176.dna; Position on contig= 102530..103198bp; Strand=-
atggaaattgtaacagacttgatttatgcactttggcaccaagattatgaaacactggctaacccatcattagtatgggcaatctacatcctgctatttacgatcctgtttctggaaaatgggatattgcctgcggcttttttaccgggcgatagcctgttgatattagttggcgttttgatcgcaaaagatgccatgagcttccccgcgacgatattcattctcaccgccggagcaagccttggttgctgggtgggttatcttcagggacggtggcttggtaataccaaattggttcaaggctggctgtcacatcttcccactcattattaccaacgtgcgcacaatctgttccaccgccacggtttatctgcactgctgatcggtcgtttccttgcatttgtcagaaccctgctgccaacactggcaggaattgctgggctgaaaaacggacgtttccagattttcaactggttaagtgggttcctgtgggtcatcatattaactactttaggttattttcttggcaaaagtccgcttttccgtcaatacgaagaatatgtgatgaattttctcgttctgttaccactgggtttgctactcattggcttaattggcagtctgacggtcatctggcgtaagagacgtgctaaccatcctcctcagtaa

SEQ ID NO: 2469 - DNA, 123 bp, Xenorhabdus bovienii
  Coding sequence Name=Xb4151_4152.C433.gene177.dna; Position on contig= 103157..103279bp; Strand=+
ttggtgccaaagtgcataaatcaagtctgttacaatttccatcaaatgttcctaaaacgcggattaaggattacatcttacttttatggtgtatttctggtgcattcctgttgggtactttga

SEQ ID NO: 2470 - DNA, 156 bp, Xenorhabdus bovienii
  Coding sequence Name=Xb4151_4152.C433.gene178.dna; Position on contig= 103560..103715bp; Strand=+
atggctgcaatcagaatattgccattccgatcacacaaatgtaagcaatttgttatcaaatattgtgttgtctgtatatttcaattaattattcgttttagtttttttcatttccctatactggggaagcaaacacaaaaacaacaggctcattga

SEQ ID NO: 2471 - DNA, 1245 bp, Xenorhabdus bovienii
  Coding sequence Name=Xb4151_4152.C433.gene179.dna; Position on contig= 103742..104986bp; Strand=+
atggaaaaacgacaaaaaggctttgtgcaatatattgtacagggaagccttgtcactcaaattattattggattaattgcagggatattattggcatggctgctaccttctacggctcaatcggctgatttgcttggctctctcttcgtaagtgctcttaaagctgttgcccctgtgttggtctggatattggtgatgtcctcgattgcaaaccataaaaaaggacaaaaaaccagtattcgcccgatcttgatcctttatctgcttggaacattcggtgcagcggtcgtggcggttatcggcagtacgttgtttccgtcaacgctgatactggtgactactgatgccaaaatttcaccgccagacaatatcgttgaagttattagaggaattttgcttaacatcgttgttaacccgattgatgcgatattaaaaggcaattatgttggcattctggcatggtcaattggtttaggtattgctttacgtcatgccaaagaatcgaccaaatctctggttcaggatctggctgaggctgttacgcagcttgtgcgtgttgtgattcgtctggcacccatcgggatctttggtctggtggcttcaactattgccacaaccggcttcgaagcactgcttggctatgttcgactgctggctgttctgcttggctgtatgattatcgttgccttagtgattaatccgctgattgtttactggacaattcgccgcaacccttatccgttggtttttgcctgcctgcgtgaaagtggtgtgacagcattctttacccgtagttctgcggctaacattcccgttaatatggcaatgtgtcgccgtatgaatctgaatgaggatacctattcagtttctatcccattgggggcaaccatcaatatggcgggtgcagcggttacgatcacggtgctgacgctggccgcagtcaatacactggatatgacggttggcctgccaactgctattttgctgagtgtggtttctgtgattggtgcgtgtggatcatcgggagtggcgggtggctctttgttgttgatcccactagcgtgcagcatattcggtatttccaatgaaatcgccatgcaagttgttgcggttggtttcattatcggtgtgttgcaggattctgccgaaactggcctgaattcttccactgacgtgctgtttaccgctgcggcttgtcaggcagaagatgcccgtcttaatgcggatcagttggctcaacgttaa

SEQ ID NO: 2472 - DNA, 2034 bp, Xenorhabdus bovienii
  Coding sequence Name=Xb4151_4152.C433.gene180.dna; Position on contig= 105070..107103bp; Strand=-
atggagaatgcaatgagcaattaccctcacctgctggccccgctggatttgggctttaccaccctgaaaaaccgtgttttgatggggtcaatgcataccgggcttgaagaacatcccgatggtgcccgacgactggcgcggttctatgcagaacgggcggctggcggtgtagcattgattgtaaccggcggtatcgccccaaacggacagggtgttgttacagccggtgcaagtattctgaataatgaagataccctgtctcatcatcaagtcatcacggatgccgtacatcaggcgggcgggaagatagccctgcaaatcttgcatacaggacgttacagctaccagaaaaaccttgttgctccttctgccattcaagcaccgattaatccttttaagccccgtgaaatgtctgaggaagatatccagcagacgatcagagatttcgcacgttgcgcccggctcgcacaacaggccggatatgatggtgtcgaaatcatgggttcagagggctatctcatcaatcagtttctggtcgcccgcactaatcaccggcaggataagtggggaggaaacttcgaaaatcgtatgcgttttgccgtggaaattgttaaagctgcccgcgccatcacaggagaacagtttattattatctatcgtctctccatgctggatttagtggaagaaggttctgactggcaagagatcgaacaactggcgaaggaaattgaaaaagccggcgcgtccatcatcaatacggggatcggctggcatgaagctcgcattccaactatcgcaacaatggtgccgagagccggcttcagttgggtaactcaaaaactaatgggaaaagtcagcattccgttgattactaccaatcgtatcaatgatccccatgtagctgaacagacactcagtgaaggctgtgccgatatggtttccatggcgcgccctttcctcgctgacgctgaatttgttttaaaagccgagcaaaaccgcgctgacgaaatcaatacgtgtattggctgcaaccaagcctgtctggacagaatatttgtcgggaagttgacttcgtgcctggtcaatccacgcgcctgccatgaaactgaattcatcgcagagccagtgaaggaacctaaaactatcgcagtgattggcgccggcccagcggggttgtcctttgctgtcacggcggccagccaagggcatcatgtcacgctatttgaacgtgacaataagattggcgggcaatttaatatcgccaaacagatccccggcaaagaagagttttacgaaacgctgcgctattttgatcgccaattggcattaaacggtgttgaggtaaagctcaatcacaccgcaacagccggtcagcttgcgtcgtttgatgagatcgtcattgccacgggcatcatcccacggacgccagatattgatggcatcaaccatgaaaaagtgctgacttaccttgatgtattgaaacataaatgcaatgtagggccacgtgtcgccattatcggtgcagggggtattggcttcgatacggcagaatacctgagccaaaatgggcaaagcaccagcttgagtagtcatgcgtttagccaagaatggggcatcgatcaaactctctcccatcgtggtggattacagccagaaggggcacaaatggaacgttctccacgaaaaatttatctgctgcaacgtaagaattcgaaagtcggagaaggtttgggaaaaaccaccgggtgggttcaccgcgccagcctgttgatgcggggtatcacgatgctgaacagcgtacagtacctgaagattgatgatcaggggctgcatatcagtcgcaacggtgaacagcaatgtctcgaagtggacaatgtgattatctgcgcagggcaggagccattgaaagatctttatcagccgctgcaaacgatggggaagaatgtgcatgtgattggtggtgccgatgtcgcggtagagctagatgcccgcagagcaattgatcagggagccagattggcgcttaagatttag

SEQ ID NO: 2473 - DNA, 117 bp, Xenorhabdus bovienii
  Coding sequence Name=Xb4151_4152.C433.gene181.dna; Position on contig= 107088..107204bp; Strand=-
atggttccaatcaggctggaaccgtctaaatttgatctcaatctcatccgaccacttagtcatactgaaaacaataatacttttaagtcaccaaatattcgatggagaatgcaatga

SEQ ID NO: 2474 - DNA, 120 bp, Xenorhabdus bovienii
  Coding sequence Name=Xb4151_4152.C433.gene182.dna; Position on contig= 107313..107432bp; Strand=-
atgacccattcggttattttcttcatgctcactccaatattctcgatttcatccaagcagcctatacagagggatcaactccatccatacgccataaagattaaaatatcatcggcataa

SEQ ID NO: 2475 - DNA, 597 bp, Xenorhabdus bovienii
  Coding sequence Name=Xb4151_4152.C433.gene183.dna; Position on contig= 107407..108003bp; Strand=+
atgaagaaaataaccgaatgggtcatattatctggaaagttcgttactctggtgcctttggaacataacaggcatgatgaatttgtgcgggctattgaagaggggcaattgcatcagctgtggtataccaatattcctgaacccgctaatgtgaaggctgatatcgaacgccgtttggcgttgcatgaacagggcagtatgttgccttttactgtgattgataaccaaaccggtgtggcagttggcatgaccacctatatgaatattgatgccaaaactcccagactggagattggctcaacatggtatgcacgttctgcccagagaacgcctatcaatacagaagctaaatatctactgctggaatatgcgtttgaacaacttggcggtgttgccgtggaatttcgtacccattttctgaatcaccaaagccgcagagctatcgagcgtctgggtgcaaaactggatggtattctgcgcagtcacttgcgtgcaaaggatggttcaataagagacacttgtgtatacagcatgcttgccagcgagtggcctgccattaaaactcatcttttatggctaatggcaaagccacgctaa

SEQ ID NO: 2476 - DNA, 936 bp, Xenorhabdus bovienii
  Coding sequence Name=Xb4151_4152.C433.gene184.dna; Position on contig= 108036..108971bp; Strand=-
atgaattatctacaacaacctgcttcttcaggtatgaagctgtttgctgatcttgtcggaaagcgtgttacccccggtgaatactggcattcttccagttatcgaactaaattcgctctgcgcagcatttttacgcctatttctacacttaagcttttaaataaaattgctaagacaccgctttataaggatattttaaaaaagcaacccagcttgccctgcaaattgcatcgtccatatttgagcatcaatttcaagcgtaaacagattgtttgtgcacttaatgaacattataagatattatttgaacaattagagccggctgttatcaacaaaatatttgatactcatgcttatttgctggcaacggttcagggtaaaaatgaatcattcatgatatatattgattcattggataatcttaataaagaaggtgagctttcgttatatattaccacaacagaaaatgtcattctggcgaaatgcgcattcactttattgacgattaagggtaagcaaacattattcattggtgtattacaaggccctgctaaaatggatagttctctggatattatccgccatgccaccaaagaatgttatggattatttcctaaacgtttgttgattgaatccatctgccgttttgcctctcatgcgaattgtgagcagatcttggcggtcagcaatgagacacatatttatcgcagtatccgctattggcataaaaagaaagataagatggtggccgattataacgccttctgggaatccctgaatggtatcaggaaggaaaataatgatttccatctgccatcagccatagaaaggaaatccctggaagaaatcgccagcaagaaacgcgccgaatatcgccgccgttaccaactgctggacgagctggataaccatatcaaagcagccctgactgattaa

SEQ ID NO: 2477 - DNA, 435 bp, Xenorhabdus bovienii
  Coding sequence Name=Xb4151_4152.C433.gene185.dna; Position on contig= 109364..109798bp; Strand=-
atgtatttaaagcaagccactgaaacggatttcgcgattcttatccagatttgggaagcctctgtgcgtgctacccatgattttctgcctgaaactataattgaagatctacgtccccttatcttgaatgattacttacccaatttaatcatctataaggttgtaaatgatcaacatatcatcgaaggatttgtggcagtcgatcaacaacgagtagaaatgctatttatttcaccacaggcacgaggtcaagggatcggcaagatgctgctggcatttgcaatgactgaattgcagatcaacgaactggatgtaaacgaacagaatgaacaaggtgttggcttctataagcatatggggtttcaggtttttgcccgttcagcagtcgatgggcaagggaatccatttccactattgcatatgaaactcgcttaa

SEQ ID NO: 2478 - DNA, 1152 bp, Xenorhabdus bovienii
  Coding sequence Name=Xb4151_4152.C433.gene186.dna; Position on contig= 109834..110985bp; Strand=-
gtgaaactgctgcgcaacaatgacagtgcatttgtacctgtcgcaggcttgacggtatttgcgattgcttctggttacttaatgagtttaattccgttatcgatggcaagtttcagcatcgatacgggttatgccagctggttggccagcgcttattacgtaggtttattaataggctcaactatgattgaacctgttattgccaaaataggccaccgcttttcatttattagttttttgctgcttttagccacgacggttgttgttttgcctttttttccgactaaagagatctggctggttattcgctgcgtggcggggatcgccgttgcagggatttttgtcgtggtagagtcttggttgttaatgggtgatagccctaaagaacgggccaaacgtctgagtttttacatgacttccctctatggtggtacaacactgggtcagctggctattggctttatagggactcagggtatagtgcctttcattgtggtgctggctctgctattgctagccatcctgccgccattacttataagccaagggcaacctcccgctctccagcatcagagcttatcgctgaaaaaaattgcccaattcagcaaaccagcgatagtcggttgtattacgtcaggggttgtcatggggacgatttacggtctgatgcctttatcgttaagccaaagccacttcgatggtgagcaggttggtgtattaatggccgcgactattttgggcggaatggtgattcagcccattgtcagtagactgtctgtcatagtgagcaaaacgctgttactggcaatggtttcactactcggcgtgtttgcgatgggaatgatctacctttctgaaaattatattgtaatgatcgtggcattggggcttctgggaatgtcttcctttgcactctatccgatcgccatcacgctggcctgcgataatctggattcatcctgcattgtggctgcaactcaagtgatgctgttaagttacagtatcggctcctccattggccccctgggcgcagggaattttatgctgcaacacaatggattaatgaatttctttttcattgtcttactggccactgctatttatatgctactggcgagcctgcgccgtaaagaccatattttggcaaactag

SEQ ID NO: 2479 - DNA, 222 bp, Xenorhabdus bovienii
  Coding sequence Name=Xb4151_4152.C433.gene187.dna; Position on contig= 110877..111098bp; Strand=+
ttgccatcgataacggaattaaactcattaagtaaccagaagcaatcgcaaataccgtcaagcctgcgacaggtacaaatgcactgtcattgttgcgcagcagtttcactactgtcgtctccacataaaaaatcagctagatatgcgctgcttctcatcaaaattttgccgaatggcggtaacgatatatgccagggattgggatatatcttggtgatttaa

SEQ ID NO: 2480 - DNA, 108 bp, Xenorhabdus bovienii
  Coding sequence Name=Xb4151_4152.C433.gene188.dna; Position on contig= 111095..111202bp; Strand=-
atgaatcttttcattcatgagtatcagtttttctcattgtatctctccggagtaaagggctatagtccgcagcgctcaaggttattgagcgacttatctactgcttaa

SEQ ID NO: 2481 - DNA, 108 bp, Xenorhabdus bovienii
  Coding sequence Name=Xb4151_4152.C434.gene1.dna; Position on contig =1..108bp; Strand=+
cctgctccggtcggaccgctctttaacaatttaatcagacaatctgtgtgggcactcacaagacagtatcgacagcatcgcaagatgccgaaaactttaaagtcttaa

SEQ ID NO: 2482 - DNA, 132 bp, Xenorhabdus bovienii
  Coding sequence Name=Xb4151_4152.C434.gene2.dna; Position on contig =1847..1978bp; Strand=-
gtgttatcaccggcctgtcagacaactgtgcagaccgtttccccgcccgccgtttcaacgcagataacaccgctgcatccgcaccgggtcaccctggaaagggccaggagtcaacgtgtctggtaggcctga

SEQ ID NO: 2483 - DNA, 138 bp, Xenorhabdus bovienii
  Coding sequence Name=Xb4151_4152.C434.gene3.dna; Position on contig =2071..2208bp; Strand=-
gtgtcttcgggtgtgcgttttgagagactcaccagtcccgtccatgacggcactgattgtttcaaattttcagcttgttccagattgttaaagagcaaaaatttcacaacacacgggtgttttccccatgggttctga

SEQ ID NO: 2484 - DNA, 135 bp, Xenorhabdus bovienii
  Coding sequence Name=Xb4151_4152.C434.gene4.dna; Position on contig =2253..2387bp; Strand=-
atgaattcaggccaggatagtgcaacggattgcactgggtttccccattcgggtatcgccggttattgcggttcatatcaccttaccggcgcttatcgcagattagcacgcccttcatcgcctctgactgcctag

SEQ ID NO: 2485 - DNA, 192 bp, Xenorhabdus bovienii; identical to SEQ ID NO: 153
  Coding sequence Name=Xb4151_4152.C434.gene5.dna; Position on contig =5145..5336bp; Strand=-

SEQ ID NO: 2486 - DNA, 93 bp, Xenorhabdus bovienii
  Coding sequence Name=Xb4151_4152.C434.gene6.dna; Position on contig =5600..5692bp; Strand=-
ttgggatttttctacaagcagacaatggacacggaggaggtaagttacaagcaagaaaaaacccagctaaatttagctgggctattaatctga

SEQ ID NO: 2487 - DNA, 849 bp, Xenorhabdus bovienii
  Coding sequence Name=Xb4151_4152.C434.gene7.dna; Position on contig =5713..6561bp; Strand=-
ttggagatacatgtggacactgaattactgaaaacctttttggaagtcagtaagactcgtcactttggtcgggcagctgaatcactctatctaacacaatccgctgttagctttcggatccgccaattagaaaatcagctgggtaccaatttatttacacggcatcgcaataatattcgcctgacagccgcaggggaacgccttgtgccctatgcagaatcactaatgaatacttggcagttagcaaagaaagaaatcagttatgtctcacagcatacagaactctctatcggtgctacggcgtccttatgggagggctacctgatatcttggctgagtactttttatcagcatcatcaagggatgagaattgaatctcgagtttctacacgccaaattctggtcaaacaactacactcccgtgaattagatctcttaatcacgacagaaccgcccaaaatggatgaattccaaagtcaattgatcggtaatatccaactcgttttatcgacaacgcaacataatcttaaacaaggcatagaaaattacatcaagttggagtggggagctgattttcaccagcaagagcaacagatcttaaaaaatgactatccgccgatcattacaaccacatcagcacatattgcccgagaattactaaatagcgtaaatgctgcagcttttctgcctgtgcattggcaggaagactatcctaaactggtaacttcacccaataaagaactaatcaaacgtccattatatgcggtatggttgcaaaacagcgatcaacaaacatttattcagcagttattaaaaattcctgtcgaaaaagcgcctataacaggctaa

SEQ ID NO: 2488 - DNA, 366 bp, Xenorhabdus bovienii
  Coding sequence Name=Xb4151_4152.C434.gene8.dna; Position on contig =6639..7004bp; Strand=+
atgacagtagagttaggagtgtgtcagatggctgaaagcttcatcacgactaatcgtttttttgataatagaaattatccacgcggattttcccgtcatggtgatttcaccatcaaagaggcccaattgctagaacgttatggccatgcgttcaatgaattggatcttggtaaacgtgaacctcaaacagaagaagaaaaactgtttgttgccgtttgccgaggtgagcgtgcccctgcaacgacagaggaaaaagtatggataaagtatttggcaaaaatcagccgtccaaaacgttttcatactctttccggcggaaaaccgcagatagattctgcggaggactataccgatactgatgattaa

SEQ ID NO: 2489 - DNA, 1527 bp, Xenorhabdus bovienii
  Coding sequence Name=Xb4151_4152.C434.gene9.dna; Position on contig =7061..8587bp; Strand=-
atgacactcgccgtcatttatactcgggcaacaataggcgttgattcccccattgtcacgatagaagcacatatcagtaatggcctgcccggcttaacgcttgttggtctacctgaaactaccgtcaaggaagcgagagatcgggtcagaagcgcgttgctcaacagcggttttacttatccaccaaaaaggatcaccgttaatctggcacctgccgatctccctaaagaggggggaagatatgatttacctatcgccatcgcgattttggcagcatcagaacagataccgacagataagctgcataattatgaatttttaggggagttagcactatctggcgaaatacgccgagtcatgggtgccatccccgccgcactgagtgcgaaaagaacaggaagacaattgattttgtccatagaaaatcaagctgaactggctatcttatcccagaatgaaacattagtggccaatcacttacttcaagtctgccacttcctgcgaggagaaaccgccattttatcctccccgcctcccattacgttacaggccgacccccttgttttagatatacgggatattatcgggcaagagcaagccaagcgtgcactggaaattactgccgctgggggccataatcttcttctacttggccctcccggcacaggcaaaactatgctggctagccgattgtgtggcttactaccgcccttaactcacttagaggctctagacgtcgctgcaatcaatagcctgacgggtaactcggttaatccccaaaagtggcatacacgcccatttagagcgcctcatcacagttcatcaatggcggctctcgttggtggaggttcaattcctaaaccaggggaaatttcacttgcgcataatggtatattatttttggatgaattgcctgaattcagccgaagcgccctagatgcgctacgtgagccattagaatccggcgaaatagttatatcccgtgcaagagcgaaagtctgtttccctgctcaagtccaactgattgctgccatgaacccaagcccaacgggatatcatcaaggattgcacaatcgcagtagcccacagcaaatattacgctatctctccaaattatcaggtccttttttagatcgttttgacctctcaattgaagttcccttacttccttcaggtatcttaagccagtcatcagaaaaacatggcgaaagtagctatgaagtcaaaaaacgggtacaaattgccagaaaagtgcaaatagaacgatgtggacatgtgaatgcttatctcaatcgcaaacaaactgacagcgcttgtaaactaaaaatggaagattcaatttttctggaagatacgctactgaaattaggcttatctgtccgtgcctggcaccgaatactcaaagtttcacgcacgattgcagacctgaaagaacaaaaaagaatagaaagaccagatattatggaagcactcagctaccggagcatggataggttacttattcaactacagaaacaagcagggtaa

SEQ ID NO: 2490 - DNA, 102 bp, Xenorhabdus bovienii
  Coding sequence Name=Xb4151_4152.C434.gene10.dna; Position on contig =8616..8717bp; Strand=-
atggtcaatgaatttcaaaataccaataacagtaaatatatttacgagtctcttcgcaaaataacaacaaaatactttttattattttttatcaattcatga

SEQ ID NO: 2491 - DNA, 96 bp, Xenorhabdus bovienii
  Coding sequence Name=Xb4151_4152.C434.gene11.dna; Position on contig =8700..8795bp; Strand=+
ttgaaattcattgaccatttggtttttctaattaatattttgttatatattaataatttaatgtttttgggtgctttttataaagagagtgaatga

SEQ ID NO: 2492 - DNA, 129 bp, Xenorhabdus bovienii
  Coding sequence Name=Xb4151_4152.C434.gene12.dna; Position on contig =8873..9001bp; Strand=-
ttgctatcagaaaaaattgccatctgcatatttaataaaattattaatacaaaaataataaaaattcgacttaatcatctttttataggaagtaacatccaagcagatattttttatctatgcccatga

SEQ ID NO: 2493 - DNA, 192 bp, Xenorhabdus bovienii
  Coding sequence Name=Xb4151_4152.C434.gene13.dna; Position on contig =9195..9386bp; Strand=-
ttgtatttagcttgtaaatggcttgctgtgatgttgttttgttatgcgtttctacgtgtcaaaaaaaacccccgcgcctttcggtgcgggggtttttgtgaaatctggctatttttctgtttaagccttccttcgtccaagtgcagccccgcacggtgggataataatcaccaccacgctcacgataattag

SEQ ID NO: 2494 - DNA, 1647 bp, Xenorhabdus bovienii
  Coding sequence Name=Xb4151_4152.C434.gene14.dna; Position on contig =9400..11046bp; Strand=+
atgaacggggcgcaatgggttgtacaagcattacgaacacagggaattgaaaaggtttttggttatcctggtggagcaatcatgccgatttatgatgcgctgtatgacgggggaattgaacacttgttatgtcgtcatgaacagggagcggtgatggcagcaatcggctatgcaagggcgaatggtaaacctggggtttgcatcgcgacatcagggccgggggcaacaaacttaatcaccggattggcggatgcgctgctggattctgttccagttgtggctatcaccggtcaggtgagttctgaattgattggcactgatgcctttcaggaaatcgatatgttggggctttcccttgcttgtacaaaacacagttttctggtcgattctctggataaattaccccagatcatagccgaagcctttactatagcaacaagtggccgccccggccctgtactgattgatttaccgaaagatattcagttagctcaaagcgatttagcaccttacctgatgcctgttgtgtccgaatctttcccccctgaacaagaactggaacaggctcgtcacatgatgctcatggcccaaaaacccattttgtatgtaggtggtggtattggcatggctgatgcagtacctgaactgcggcgttttgttaccgaaacgggattacccgttgtttccacgctgaaaggcttgggagctgcggatgccgagcataaatattatttagggatgttggggatgcatggcacaaaggctgccaatcttgccgttcaatcctgtgatttattgattgctgctggagcccgttttgatgatcgtgtgacagggaaattaaatacttttgcccctcatgccaaagtgatccatgtagatatcgatcctgttgaattcaataaattacgtcaggcacatgtttcattaccggggaatttaaaaacattgttgccccacttacagcaacctttatcgattgaatcctggcaacaggaaatcaaacgcttaaaaagcgaacatacatggcattatgactatcaaggcgtaagtatttatgcgccatcactattaaaacaggtatctgaacgcaagccatccaacgcgataatcacaactgacgttgggcaacatcagatgtggacagcgcagcacatgacatttgataggccggcaaatttcattacttccagtggattaggcacgatgggttttggcattccagcggctattggcgcccagatggctcgtccggaagatatggtgctctgcatatccggtgatggttctttcatgatgaatgtacaggagttaggtaccatcaaacgtaagcagttgccaatcaagattattttattggataaccagcgtctgggcatggttcggcagtggcaagaactgttttttgacaaacgctatagcgaaacgatcttaaacgataatcctgattttattgccttggcaaaagcttttgatattcctggtcaacaaattactgacaaaacccaaatcgatgcagcgctggatgctttgttcagcagcgaaggtccgtatttattacatgtatccattgacgaattagagaatgtctggccattggttccaccaggctcaagcaatgcaaccatgttggagaagtcattatga

SEQ ID NO: 2495 - DNA, 258 bp, Xenorhabdus bovienii
  Coding sequence Name=Xb4151_4152.C434.gene15.dna; Position on contig =11043..11300bp; Strand=+
atgatgcagcatcaacttgctattcaggcacggttttgccctgagattttggaacgaattctgagagttacccgtcatcgtggatttcagatatgtgctttgaatatggatcatacaacagatagtgataatgtaagcattgaactcacagtcgccagccaacgctctgtaaatttacttttttctcaactgatgaaattagtcgacgttgctggtgttgagatccgacacaaagaatcacaatttataagcgcataa

SEQ ID NO: 2496 - DNA, 930 bp, Xenorhabdus bovienii
  Coding sequence Name=Xb4151_4152.C434.gene16.dna; Position on contig =11325..12254bp; Strand=+
atgacaaagcaagctgattatatttggttcaacggtgaaatggttccttgggctgatgcgaaagtccacgttatgtctcacgccctgcattacggaacttccgtatttgagggcgttcgttgctataactctcacaaagggcccgttgtttttcgtcatcgtgaacatatgcggcgtttgcatgactcagccaagatttaccgtatgcccgtgagccagagcgttgatgaattaatggaagcctgtcgtgaaacacttcgtaaaaataaattagtcagcgcttacattcgcccattggtttttatcggtgatgttggaatgggggtcaatcctccagacggttataagacagatatcattattgcggcttttccgtggggggcttatttaggcgaagaagcgctggatcagggtattgatgcgatggtttcttcatggaatcgtgtggcagcaaatacgatcccaacaggggcaaaagcgggtggtaactatctttcttctctgctggtgggcagtgaagcacgacgccacggctatcaggaaggtattgcactggatgttcatggctatatttcagaaggtgcgggagaaaacctgtttgaagtgaaagatggggtactgtttacgcctccatttgcgtcatcagcactgccggggattacccgtgatgccattatcaaactggcacaggatctgggtctggaagtgcgtgaacaaatacttacccgtgaatcgctttatttagctgatgaagtattcatgacggggacagcggcagaaattacgccggttcgtagtgttgatggcattcaggtgggtattggtaaatgtgggccaatcactaaaaaaatccagaatgccttctttggcttatttgatggtacgacagaagataaatggggctggctggacgccgttaatcctgaataa

SEQ ID NO: 2497 - DNA, 1851 bp, Xenorhabdus bovienii
  Coding sequence Name=Xb4151_4152.C434.gene17.dna; Position on contig =12339..14189bp; Strand=+
atgcctaaataccgttctgccacgacaactcatggccgtaatatggcgggagcacgagctttatggcgtgcgacgggtatgaccgatgaggattttggaaaacctattattgcggttgtgaactcatttactcagttcgtgcccgggcatgttcacctgagagatttaggaaaactagtagcagaacagattgaggcatcaggaggcgtcgcgaaagagttcaacacgattgcagttgatgatggtattgcgatggggcatggcggaatgctctattctttgccttcgcgtgagttgattgctgattctgtggaatatatggtcaatgcccactgtgcggatgcgatggtgtgtatctccaactgtgacaaaatcacaccgggcatgttgatggcatcaatgcgcctgaatatcccggttatttttgtttctggcggcccgatggaagccggtaaaacccgcctgtctgatcagatcatcaaactggatctgattgatgcgatgattcagggagctaatcccaatgtcagtgatgaagaaagcaatcagatagaacgttcagcttgtccgacatgtggttcctgctcaggcatgtttacggctaactccatgaattgtctgactgaggcattggggctttcgcagccgggtaatggttcactgcttgccactcatgcggatcgcaaggagttgtttttaaatgcgggcaaacgcatcgtcgaactgaccaaacgctattatgagcaaaatgatgatagcgctttacctcgtaatatcgcgaccaaagctgcctttgaaaatgcgatgatactggatattgcgatgggcgggtcgaccaacacggtactgcatctgctggcggcggcgcaggaaggtgacgttgatttcactatggcggacattgatcgtttgtctcgtctagtacctcatttgtgtaaagtggcaccaagcacccagaaatatcatatggaagacgtacatcgtgcagggggagtcatcgggatcctcggtgaactggatcgtgcggagcttttgaatcgtgatgtgaaaaatgttttggggctggatctgccgcaaacgttagctcagtacgacatcatgctgacacaggatgaaggtgttaagagcatgtattctgcggggccagcaggtattcgaaccactaaagccttttcgcaggattgccgttggccgtcattggacacagatcgtaaggaagggtgtatccgtgaacgcactcatgcttatagccaagatggtggtttggcagtgctgtctggtaacgttgcggctaatggctgtatcgtaaaaaccgctggggtggatgaaggaagcctgacttttcgtggcccagcgaaggtttatgaaagccaggatgatgcagtagaggcgattctgggaggcaaagtcgttgcgggtgatgttgtggttatccgctatgaaggcccgaaaggcggtcccggtatgcaggaaatgctctatccaaccacctatttgaaatcgatgggactgggcaaaagctgtgctcttatcactgatggtcgtttttcaggcggaacatctgggttgtcgattgggcatgcttcccctgaagcggctagtggtggcgtgattgggttggtttatgatggagatatcatcgacattgatattccgaaccgtaaaatccatctggatgttaacgaaacagaactggccgtacgtacacaggctgaactatctcgtggagatcaggcatggacacctaaatcccgtgatcgtcaggtttcttttgccttgcgtgcttatgctttactggcgaccagtgccgataaaggcgctgtacgcgataaagcaaaattagggggctga

SEQ ID NO: 2498 - DNA, 1548 bp, Xenorhabdus bovienii
  Coding sequence Name=Xb4151_4152.C434.gene18.dna; Position on contig =14192..15739bp; Strand=+
gtggcagtttatcctcttaatgctgagccaaagggagcggaatacctcaaagccgccttgagtgcaccggtttatgatgtcgctcaggttaccccgctgcaagaaatggaaaaaatctctgcccgtttagcaaataccattttagttaaacgggaagatcgtcagttagtacacagtttcaaattgcgcggtgcatacacgatgattgcgggtttgactgaggagcagaaagcgaaaggcgtgattaccgcttctgcgggcaatcatgcacagggtgtggcactttctgccagcaaagtgggcaccagagccatcattgtcatgccgattgccacggcagacatcaaagttgatgcagtccgcagttttggcggtgaagtcctgttatacggtgctaattttgatgaagctaaagccaaagccatctcgatggcaaaagagcgcggctatacttttgtaccaccgtttgatcaccctgccgtgatcgcggggcaggcaacactggcaatggaacttttacagcaggacgtccaccttgatcgcatttttgtgccggttggtggtggcggtttgattgcgggtgtcgcagtgctgatcaaacaacttgtaccggaaatgaaagtcatcggagtggaaaccgaagattctgcgtgtctgaaagcggcactggaagcagggtgtccggttgacttaccgagagtggggctgtttgcggaaggtgttgcagtcaagcgtatcggtgatgaaacattccgtttatgccaactgtatgtcgatgatgtcattacggtggatagtgatgccatctgtgccgccatgaaagatatttttgaggatgtcagggcaattgccgaaccttccggtgctctggctctggcgggtttgaagaaatacgtacagcagcatcagattcagggagaaaggctggcacatattctctcaggtgccaacgtgaattttcatggcctgcgttacgtctctgaacgctgcgagctgggagagcagcgtgaagcactactggctgtcacaatacctgagcaaaaaggaagtttcctgaatttttgccagacgctgggaacacgtgttgtgacagaatttagttaccgttattcagatgcgactaaccctgctgaagcctgcatttttgttggcgtacggctgaatcgaggcaatgcagaacgtcttgaaatcatcaatgagttgaaagcatcgggttatcaggtcgctgactttaccgatgatgaaatggcaaaactgcatgttcgttacatgatcggtggccgtcctgccaagccattacaggaacggctatacagtttcgaatttcctgaatcgccgggcgctttattaaagtttttgcagacactgggaacacattggaatatcacactattccattaccgcagccatgggatggattacggtcgcgtattggctgcctttgaactttcaggtgcggaagtacgttttgatcgccatcttgaggatttgggttatgaataccatgatgaaacgaataatccttcttttaacctattgttgaaataa

SEQ ID NO: 2499 - DNA, 102 bp, Xenorhabdus bovienii
  Coding sequence Name=Xb4151_4152.C434.gene19.dna; Position on contig =15746..15847bp; Strand=+
ttgatcatcggcttaaaaaatagcaccttggcaggtgctattttcagaataaagaattgttcacaacatcccccaaaatgctttaaccaatggttcctgtaa

SEQ ID NO: 2500 - DNA, 882 bp, Xenorhabdus bovienii
  Coding sequence Name=Xb4151_4152.C434.gene20.dna; Position on contig =15806..16687bp; Strand=-
atggatatacgtgatttaaaactgtttttacatcttgcagaaagttgtcactttggacgcacggccaaagctatacatgtcagtccatccacactttcacgccaaatccaacgacttgaagaactattaggacatccgttatttctgcgggataaccggacagtcaagctcactttcgcaggtgaacagctaaaacaatttgcccaacagacgctcctgcaatatcagcagttacgccattcattaaatcaccagagtccctcattgagcggtgaattacgtctgttctgttcagttacggcggcttatagccatctcccgcaggtgctggataaattccgggcagagcaccccttggtagaaataaaactaacaacgggagatgccgctgatgccgtcgataggatccaatctgatcaggctgatttaggcattgcaggcaaaccggagaaactgccccataatgtcagctttaccaaaataggtgaaatccctttggtattgattgccccttccctgccttgtgccgtgagaacacttgccacacaggaacaacctgactggaatgccattccttttattctgccggaacatgggccttcacgtacacgcatcgaactttggtttcgccggaatagcatccctaatcctttgatttacgccaccgtttcaggccatgaagccattgtttcgatggttgcgttaggttgcggtatcgcgctgatcccggcggttgtcgtcgaaaatagcccagaacctgtacgcaatcgtgtgtccctgttagagaatattgcgctggtcgaaccgtttgagttaggcgtctgtacgctgagtaagcgcttacaggaaccattggttaaagcattttgggggatgttgtga

SEQ ID NO: 2501 - DNA, 1479 bp, Xenorhabdus bovienii
  Coding sequence Name=Xb4151_4152.C434.gene21.dna; Position on contig =16831..18309bp; Strand=+
atggctaattattttgatacgttgaacctgcgccagcaattagcgcagttaggcaaatgtcgttttatggcgcgggaagaatttgctgacgaagcaggatatttaaaaggcaagaaagtagtcattgtcggctgtggtgcgcaaggacttaatcagggtctaaacatgcgtgattctggtttgaatattgcctatgcattgcgtcaagaagcgattgaagaaaagcgcgcatcatggcgtaaggcaacggaaaacggcttcaaggtcggcacctatgaggagttgatcccacaggccgatttggtcattaacctaacaccagacaaacagcattctacggtggttcaggcagttcagcctttgatgaaagaaggtgctgcactgggatattctcacggtttcaatatcgtggaagtgggtgagctggttcgtaaagacatcaccgtcgtgatggttgcgcctaaatgcccgggtacggaagttcgtgaagaatataaacgtggtttcggtgtccctactttgattgcggtgcatccggaaaacgatgtgaaaggtgaaggcatggccatcgcgaaagcatgggctgccgcaacgggggctcatcgcgctggtgtactggaatcttctttcgtggctgaagtaaaatcggacttaatgggtgaacagaccattttatgcggtatgttacaggcgggttctctgctttgttatgacaagctggtggcagagggaacagagccgggttatgccggtaagctgattcaatttggctgggaaaccatcacggaagccctgaagcaaggcggcataacattgatgatggatcgcctgtccaactcagcaaaactgcgtgcttatgccctttccgaacagttgaaggttattttagcaccgttgttccagaaacatatggatgacatcatttctggaacgttttcttctactatgatggcagactgggcaaatgacgataaaaacctgctgacttggcgtgcagaaacaggccagacaccattcgaaaactacccggatcacagcggcaatatcagcgagcaggaatactttgatcatggcgtgctgatgatagcgatggtcaaagctggggtggagctggcgtttgaaactatggtggatgccggcattattgaggaatcagcctattatgaatcgctgcatgaactgccattgattgcgaataccattgctcgtaagcgtctgtatgaaatgaatgtggtgatttctgatacggcggaatatggtaattacctgttctctcacgttgcggttccactactgaaagaaaaatttatggctaccttgcaggcaggggacatgggtaaacccgtggcagacggcagtatcgataatgcccaattacgtgatgttaacgaagcgattcgtcaccatccgattgagactattggccgtactctgcgtggttatatgaccgatatgcaacgcattgcagtgggtggataa

SEQ ID NO: 2502 - DNA, 108 bp, Xenorhabdus bovienii
  Coding sequence Name=Xb4151_4152.C434.gene22.dna; Position on contig =18337..18444bp; Strand=+
atgaacctccataaaataacgcccgatgagattctatcaggcgttgttttttatgggaatttacaggctaagctgttgtttcagatcatcgattgcctgacgctgtaa

SEQ ID NO: 2503 - DNA, 1116 bp, Xenorhabdus bovienii
  Coding sequence Name=Xb4151_4152.C434.gene23.dna; Position on contig =18397..19512bp; Strand=-
atgctacgtaaaactggctttttctttgatgaactctgtttctggcacaatatgggttccatgcataccttcatatttcccgtaggtggatggatacagccgccgtgcggggcaggacatgccgaatcaccagaaaccaaacgcagaatgaaaagcttaatggatgtttccggtttaagtcactcattagagctaatgagtgccgagcctattgatgaagcaacgttaaggctcgttcacacagaatcttatttacagcgctttaagtatctgagcgataacggcggcggtacattggggtctgaagcatcactgggtgcaggcagttatgaaattgccaaactgtccgcagggctaacctatgcagcagtaaaagccgtcttgcaaggtgaattggataatgcctacagcctttctcgtccccccggccatcattgcctacccgatcaagccatgggcttctgtttcctcgccaatatttctcttgcgattgaaaaagcaaaagaacaactgggccttggccgggtagccgtcgtcgactgggatgtgcaccacggtaatggaacacaacatatcttttggcaacgggatgatgtactgacaatttcactgcatcaggatcgctgctatccggcaggttacagcggcgaaagcgatatcggcgaaggtccgggtgaagggttcaatatcaatattccactgatggctggtgcgggtcatgacagctacatgtatgccatggatcaaattgtcatgccggcactgcgacgttaccagcctgagctgattatcattgcctgtggctatgatgccaatggctttgatccgctggcacggatgcagctgcatagtgacagtttccgtgagatgacgcgtaaaatgcagcagatagcggatgagttctgtcatggcaaactggtgatggtacacgaaggcggttattccgaagcctatgtgcctttctgtggtttggccgtaatggaagaattgtctggcgttcgcactgaagtcattgatccggctcttgccatactcgaattgcagcaaccgagagcaccttttgaaactttacagcgtcaggcaatcgatgatctgaaacaacagcttagcctgtaa

SEQ ID NO: 2504 - DNA, 93 bp, Xenorhabdus bovienii
  Coding sequence Name=Xb4151_4152.C434.gene24.dna; Position on contig =19897..19989bp; Strand=-
atgactatattattaagaaaaaataaacttttacgatattctatttacattaatattatccctctccttaatactaataaacaccaaccttaa

SEQ ID NO: 2505 - DNA, 2031 bp, Xenorhabdus bovienii
  Coding sequence Name=Xb4151_4152.C434.gene25.dna; Position on contig =20313..22343bp; Strand=+
atgcgattaaatcctagtcaacaacaagcggttgaatttgtcacagggccttgtctggttctggcaggtgcaggctccggcaagaccagagtaatcaccaataaaattgcccacctgatccgtgcctgtggttatcaggcacgtcatattgccgcagtgactttcaccaacaaagcggcacgggaaatgaaagaacgtgtcgcgcagactttggggcgcaaggaaaccagagggctgatgatttcgactttccatactctgggtctggaaatcatcaagcgtgaatacaaagcgctgggtatgaagagtaacttttcgctgttcgatgatcaggatcagagggtactgctgaaagatctgacggcggatttgctggaagaagataaggatctattgcaaaaactgaactccagtatttccaactggaaaaatgatctgatgtcacccgagcaggtgattagacaggctcgttcggcgcaggagcatcaatttgcggagtgttatcgccgttatgatctgcatttgaacagttgcaacgttctcgacttcgatgacttgattaccaaaccgacgttgctgttaatgcagaatgaagaggttcgggaacgctggcaaaataaaattcgttatctgctggtggatgaatatcaggataccaacaccagtcagtatcaattggtgaaactattagtgggcaatcgggcacgttttaccgtagtgggtgatgatgaccaatccatctattcatggcgtggtgcgcgcccacaaaacttgatcctgctgaatgaggattttcctcagttgaacgtgatcaaactggaacagaattatcgttcatcagggcggatattgaaggccgcgaatattctgattgctaataatccccatgtatttgagaaaaaactgttttcagaactgggctatggtgatccgctcagggtgatcgaagcaaataatgaagatcatgaagcagagcgagtcgtgggagagttgctcgctcatcactttattaataaaaccgaatataaagattacgccattctatatagaggcaatcatcagtctcgtatttttgaaaaaatgctgatgcaaaaccgtattccttatcgcatttctgggggaacttcattcttttcccgccctgaaataaaggatttactctcttatctgcgggtgttgactaatcccgacgatgacagtgcatttctacggatcgtcaataccccacgtcgagaaatcggcgcgatgacaatccagaaattgggcgagtgggcaaatcagcgtaacaaaagcttgtatcacgccagttttgatctcggtctggagcagagtctgacaggtcgcgggctggctgcgctacagcactttacccactggatggatgaaatttcccgccaggccgagcgtgagccattgctggcagtgcgggatttgctgcgcggtatggactatgaaagctggctgtatgaaacgtcacctagcccaaaagcggctgaaatgcggatgaaaaacgtcaatcagctttttacttggatgagtgaaatgtttgaaggggatgacctgaatgaaccgatgacgctgtcgcaagttgtggcgcgttttaccctgcgagacatgctggaacgtggggaagacgatgaggaattggatcaggttcagctgatgacattgcatgcatccaaggggttagagttcccttatgtttttctggtgggtatggaagaaggtttgttgccgcatcaaagcagcattgatgaaaataatatcgacgaagagcgacgtctggcttatgtcgggatcacccgagcgcggcgggagctattttttaccctcagcaaagagcgtcgtcagtatggtgagctgattcggcctgaaccgagccgatttttgctggagttgccgcaggatgatttgcactggccgagaggcaaaaagatgatcagtgcagaagatcgaatgaagcaagggcaatcgcgtcttgctgatatcaaatcccgtttggggcttggtcagaaaaacagcgataaataa

SEQ ID NO: 2506 - DNA, 1509 bp, Xenorhabdus bovienii
  Coding sequence Name=Xb4151_4152.C434.gene26.dna; Position on contig =22391..23899bp; Strand=-
atgctgagttcttcttcgctctatgccgctatcgatttaggctcaaacagttttcacatgctggttgtccgtgaagtatctggtagcattcaagtggtcacccgtatcaagcgcaaggtcaggctggccactgggttggataaaaataaccatttatcacaacaggcaatggagcggggatggcagtgccttcgcctattttccgaatatttgcaggatatccctgcctcgcagatccgcgttgtcgctacggcaacattgcgattggctgtaaattcggctgattttgtcgggaaagcctctgaaatattgggcaatccagtcaaaatcatcagtggtgaagaagaagctcggctgatttatcaaggtgttgcccacacgacaggtgggtctgaaaagcgtcttgtggtggatattggtggtggcagtacagaattggttacaggcaccggagcaaaagccaatcagttgttcagccttgaagtgggttgtgtcacctggctggaacgctacttcaatgatcgcagcctgacagaagaaaactttgcacaggcagaatccgctgcccatcatattctcgcccctatcaccacgaccctgcttaagcagggttggcagatttgtgttggtgcctccggtacagtgcaggcgttgcaggaaatcatgatcgcacagggaatggatgaacttatcaccctgccgaagctacaacagcttaaatacaaggcgattgagtgcggcaagctggaagagcttgaaatcgacgggctgacattggaacgggcattagttttccctagcgggctggcaattttaattgccatctttcaggcactgaacatagaaagcatgatccttgcgggaggtgcactgcgtgaggggctggtttatgggatgctggatttccccattgagcaggatatccgtacaagaaccctgtgcaatattcaacatcgttttcaactggatattgaacaagctctgcgtgtcaaacaactggccgaacatttttgtcagcaggtcgccacggtatggaatctggatgcccgatgtcgcgagttgttgaccagcgcctgtctacttcatgaaatcggcttatgtgtcgattttcgccaaggcccggctcattcagcgtatctcatcagtcatttggatcttcccggttatactcccgcccaaaaaagattactggcaacgctgttgaacaatcaaagcggccctatagatctggcctcactcagtcagcaaaatgccttgccaccgttacaggcacagcaattatgccgcttgttacgtctggctattatttttgccagccgtcggcaagatgatactttgccggccttgcggctgcgggttgaaaatgagacgctcaccatcaccctgccctatcagtggcaaatgcagcatccactcagggctgaagccttacatcaggaaatccagtggcaaagttatattcagtggacattgttccttgaagagcagaataactcccatctcggataa

SEQ ID NO: 2507 - DNA, 1284 bp, Xenorhabdus bovienii
  Coding sequence Name=Xb4151_4152.C434.gene27.dna; Position on contig =23908..25191bp; Strand=-
atgagcaaaacacatttgacagaaaagaagttttccgacttcgcattgcaccccaaggtcattgaagcccttgataaaaagggcttttccaactgcacgccaatacaggcgctaactttgccttttactgtcgaaggccgagatgttgcggggcaggcacaaaccggaacgggcaagacgctggcatttctgacgtctacttttcattatttactgacccatcctgctgcggcagatcacaaaaccaatcagccaagggcgctgattatggcccccacccgcgaattagccgtccagatttactctgacgcggaggagttggcagaagccacgggactgaaaatggggcttgcctacggtggcgacggctatgataagcagcttaaggttctggaatctggcgtcgatatcgtgattggcacaacaggtcgtttaatcgattacaccaaacaaggatatgtcaatcttaatgctgttcaggttgtggtactggatgaagccgatcgcatgtacgatttgggctttatcaaagatatccgctggctgttccgccggatgcctgttgccgctcagcgaatgaatctgctgttttccgctaccctgtcttatcgagtgcgtgaactcgcctttgaacagatgaatagtcctgaatatgtggaagtggaacccttacagaaaacggggcatcgcattcaggaagagctgttttatccttccaatgaagaaaagatgcgtctgttacagaccctgctggaagaagagtggccagatcgctgcatcatttttgccaataccaaacaccgctgcgaagatatctgggcccatctggctgccgatgggcatcgtgttggtctgctgacgggtgatgttgcgcagaaaaaacgtctgcgtattttggaagaattcagtctgggaaatctggatattctggtcgccactgatgttgctgcccgcggtctgcatattccttttgtaacccatgtatttaactatgatctgccggacgactgtgaagattacgtccaccgcattggccgtacgggtcgcgcaggagaaagcgggcattcaatcagtctggcatgtgaagaatacgctctgaatttaacgtcgatcgaagagtatatccagcatcagatccctgtaagcaaatataacagtgatgcactgctgatggatttacctgtacccaagcgccgtaaccgcgctcgttcaggagggcacccacggcgcaccaatatgtcgcgccgtggaaatccgactcgcaaccgtaaacatccaggctga

SEQ ID NO: 2508 - DNA, 396 bp, Xenorhabdus bovienii
  Coding sequence Name=Xb4151_4152.C434.gene28.dna; Position on contig =25258..25653bp; Strand=+
atgttggttaatgtacactgggaccgtaaaaaattttactttggagcaaaaataatgaacgagaagattataagtgatcgtatcatccatttggctgatgcggattttgatgcaaaaaaattaaatgtaaaaggcgcagttctcatcgaattctgggctgaatggtgtggtccctgtaaaatgattgcccctattttagacgaagtttccgaagaatacgcaggcaaactgacagttgccaaactgaacgttgatgatcacgaacaaacaccaaaagctcatggtattcgcggtattccaacactgatgttgtttaaagatggtgaaaaggtcgcaacgcaagtaggggctttgtcaaaaacgcaactgaaagcgtttttagactcacatatctaa

SEQ ID NO: 2509 - DNA, 234 bp, Xenorhabdus bovienii
  Coding sequence Name=Xb4151_4152.C434.gene29.dna; Position on contig =25745..25978bp; Strand=-
atgcttaacatagagacgctgtcagcaccaagctatataccgaatgattcccgtatatatgctctcaaatactttgccaaatgcgatatgccatcagatacttcagatgaaccagagataacagatttatcagacactacagattgtttagtatgtaacatgcttaatgtcaattctttatatagattgaagaatccactgatgcaatgcttcatacaagcacatgactgctaa

SEQ ID NO: 2510 - DNA, 150 bp, Xenorhabdus bovienii
  Coding sequence Name=Xb4151_4152.C434.gene30.dna; Position on contig =26112..26261bp; Strand=+
ttgaaattaaccacgtttcgttactattatctcagccgtgttttgacagtttgtcagccttattttgaaatcaatctgagtacttcaaactattgccttgtaatattagttaatatgttaaaaggttttattcgtttctggtacaaataa

SEQ ID NO: 2511 - DNA, 237 bp, Xenorhabdus bovienii
  Coding sequence Name=Xb4151_4152.C434.gene31.dna; Position on contig =26201..26437bp; Strand=-
atgtcttgtttgcgcatacgagccaggttttccagccccatattttcgccgagagtaatcaactcagataccggcgtattctttaattcggtaagattcataatggtgggttctttaactcggggtatatctcgaactatgaacgtgaatggtatggcagcgttatcggtgcctgtttatttgtaccagaaacgaataaaaccttttaacatattaactaatattacaaggcaatag

SEQ ID NO: 2512 - DNA, 1260 bp, Xenorhabdus bovienii
  Coding sequence Name=Xb4151_4152.C434.gene32.dna; Position on contig =26337..27596bp; Strand=+
atgaatcttaccgaattaaagaatacgccggtatctgagttgattactctcggcgaaaatatggggctggaaaacctggctcgtatgcgcaaacaagacattattttttctattctcaaacagcatgcgaagagtggagaagatattttcggagatggggtactggagatattgcaggatggatttggtttcctccgttccggagacagctcctaccttgcaggtcccgatgatatctacgtttctcctagccaaatccgtcgttttaacctccgtactggtgataccatttcaggtaaaattcgcccaccaaaagaaggtgaacgctattttgccctgttgaaagttaacgaagttaactttgacaagcctgaaaacgcccgtaataaaatcctgtttgagaacctgactccacttcatgccaacaatcgtctgcgcatggagcgtggcaatggttctactgaagatttgactgcacgtgttctggatttggcagcacctattggccgtgggcagcgtggcctgattgttgctccgccaaaagcaggtaaaaccatgctgctgcaaaacattgcggctaacattgccaacaactacccagactgcgtcttgatggttctgctgatcgatgagcgtccagaagaagtcactgaaatgcagcgtctggtaaaaggtgaagtgattgcttcaacctttgatgaacctgcttctcgtcacgtacaagtggctgaaatggttatcgaaaaagcaaaacgtctggttgagcacaaaaaagacgttattatcctgctggattccattacccgtctggctcgtgcgtataacactgtagttcctgcttccggtaaggtactgaccggtggtgtggatgctaatgcactgcatcgtccaaagcgtttctttggtgcggctcgtaacgttgaagaaggtggtagcctgaccattatcgcaactgcgctggttgatacgggttccaagatggacgaagttatttacgaagaatttaaaggtacaggtaacatggaactgcacctgtcccgtaagatcgctgaaaaacgcgtcttccctgccattgattacaaccgctctggtacacgtaaagaagaattgctcactacgcaggatgaactgcaaaaaatgtggatcttgcgtaagatcatccatccgatgggcgaagctgatgcgatggaattccttatcaacaagctggctatgacaaaaacaaacgaagaattcttcgactttatgaaacgttcatag

SEQ ID NO: 2513 - DNA, 159 bp, Xenorhabdus bovienii
  Coding sequence Name=Xb4151_4152.C434.gene33.dna; Position on contig =27720..27878bp; Strand=+
gtgttttctgggcgcaatcatttacaaatgcttaggaaaccattattagtcatgctctacagcttacattatctatttgctttatttttatacatagacagaatgtcttctttattaacagggaacttatggatttggtgtcgaatggaacatccataa

SEQ ID NO: 2514 - DNA, 120 bp, Xenorhabdus bovienii
  Coding sequence Name=Xb4151_4152.C434.gene34.dna; Position on contig =27846..27965bp; Strand=-
atgcaaaaaatttcgacactcatactgggaatattcacaataacaactctctgtaaaataatgatggatcatctattattcattgacttatggatgttccattcgacaccaaatccataa

SEQ ID NO: 2515 - DNA, 1074 bp, Xenorhabdus bovienii
  Coding sequence Name=Xb4151_4152.C434.gene35.dna; Position on contig =27943..29016bp; Strand=+
atgagtgtcgaaattttttgcatatttatattttcatccgtgtttctgtttgtggcacgcaaggtggcaaaaattatcggccttgttgataagccgaattaccgcaagcgccaccatggattaatccctctggtaggtggtatctctgtcttttttggcgttttttttgcttttgctataacaaaagaatttatacctcataaatggttatatctggcttgtgcgggaatattggtttttatcggcgcgttagatgaccgttttgatattagtgtgaaaattcgggcagcaattcaggcactggttggcatcagcatgatgtattttgctgatctcaaaattgaaagtttgggcagcgcttttggttcatgggaaatgacactgggtccattcagctacgttgttactttgtttgctgtctgggctgccattaacgcctttaacatggttgatgggattgatggcttgttgggtggtctgtccagtgtttctttcggggcattgggaattttgctatatgtaaacggtaatacggcactggcgttttggtgttttgcgtttatcgcgggaatattaccttatatttttctcaatctggggctactcgggaaacgtttcaaagtttttatgggagatgcgggaagcactctgatcggctttaccattatctggttgctgactgaaacaactcagggcgaacacagttcgattaatccagtgactgcattgtggattatcgcgatcccattaatggatatggttgccattatgtatcgccgactacgcaagggtatgagtccgttttcgcccgatcgccagcatattcaccacttgatcatgcgtgcgggtttcacttcccgtcaggcatttatcttaattaccgtggccgctgctttattggcatcgatagggatcattggtgaacacctgagttttgtgcctgagtgggttatgttggcattgtttttgcttgcatttatgttgtatggctattgcatcaaacgagcatggcgggtagcccgttttattaaacggtgcaagcgtcgtatgcgccgggcagtcagccatcactaa

SEQ ID NO: 2516 - DNA, 1128 bp, Xenorhabdus bovienii
  Coding sequence Name=Xb4151_4152.C434.gene36.dna; Position on contig =28977..30104bp; Strand=+
gtgcaagcgtcgtatgcgccgggcagtcagccatcactaaaaacatttggcttatcaaagaggttttgggcagtgataaactcagaaacgaaatctaagcaggatcaatctgttatagagcatgagttggatattcgtgcactgtgtcatgctctgtggcgcggaaagatatggattatcgcactggcaatgattttcgctgccgttgctttaggtgcgtcgtacctgatgcagcagaaatggagcgcaaccgctattgtggatttaccgacgaccaatgatctggggagttactattcacaacaacaatttttgcgcaatctggatactcacatcaatgcctctccagaggtacaactgccgactatttcagatggtgcatacaaggaattcatcacacaggtggtggcgtatgatacccgccgcgaattctggcttcagtctaattattacaaacagtacagagaaggtaatgagaaagcagatgcggtattgctggaagagttaattaatacgattcaagtggtacggcgtgatgataaaaaattaccgaatgaagtcataaaattgacggcagaaacggcagtgaatgctaatcagtttctgcgagagtatatggcgtttgccaatcaacgtgcgagtactcacctgaacaatgagattaaaggtgcgtgggcaacccgtatccagtcgatgaaagcgctggtcaaacgtcaggaaatggtcgccaaggcgatgtacaatcgcaaactgaatgtcttacagcaatcattgaaaatagctgaaaaacaaggcatcaaccgtaatcaaacagacattcccattgaagaattacctgaatcccagatgtttatgatgggggcgccattactgcaatcacaaattgaaaccttggaagccactgggcctaattacagcattgattatgatcaaaacatagcgatgttggctacattgaatgttggcccgactctgcaaaatactttccagacctaccgttacctcagaacccctgaggtgcctgtcaaccgagacagtccccgccgtgtattcatgatgattatgtggggagctattggtctgttggtcggagctggagtcgcgctgacaaggcgttcgcacacataa

SEQ ID NO: 2517 - DNA, 261 bp, Xenorhabdus bovienii
  Coding sequence Name=Xb4151_4152.C434.gene37.dna; Position on contig =30123..30383bp; Strand=-
atgctgtgcagtcacacacacttttgcgtcaaaggcagcatccttggccaatgcgtgtaccaaaggagccattttgatagcttccggccgagtaccaaacacagtcaacactttcacagtggctctcttattttgtcaatcattactgatgcttccagaaaagggcgcttttttaccgccatttctatccctgcttccgatatatgtgtatgtagcatacagaccatcggaaatagtcattattttgtattccccgaataa

SEQ ID NO: 2518 - DNA, 1131 bp, Xenorhabdus bovienii
  Coding sequence Name=Xb4151_4152.C434.gene38.dna; Position on contig =30267..31397bp; Strand=+
gtgaaagtgttgactgtgtttggtactcggccggaagctatcaaaatggctcctttggtacacgcattggccaaggatgctgcctttgacgcaaaagtgtgtgtgactgcacagcatcgggagatgttggatcaggtactgcatttgtttgatatcacgccagattttgacctcaatattatgaaaaaagggcaggatcttacggatatcacgtgtcgtatccttgaaggcatgaagccagtattagaagagttcaaaccagatgtagtgttggtgcatggtgataccgcgaccacaatggcgaccagcttggccgctttctatcagcgcattccggtaggccatgttgaagctggcttgagaactggtgatctttactccccgtggccggaggaggccaaccgtaaaatcgcaggtcatctggcgatgtatcattttgcgccgacagaaaactctcaaaataatctcctgaaagagtccattagcgaaaactctatttttgtgacaggtaatacggttattgacgctctgctgtgggtacgtgatcgcattgtgagtgatgacgcgctgagtggccaacttgctaagctttacccctttattgacccgaataaaaaaatgattctggtgacaggccaccgccgtgagagctttggtggcggatttgagcgtatttgtgaagcgttggcacaggtagccagagcacaccctgaagttcaggtcgtttatcctgttcacttgaacccgaatgtcagcgagcctgttaaacgcattctgcatgacatggataacgttattctcattaatccacaggactatctgccatttgtctacttaatgaatcatgcctatatgattctgacagactctggtgggattcaggaagaagccccttctttagggaaacccgttctggttatgcgtgacaccacggagcggccagaagccgtcgatgcgggtacagtgcggctggtgggaacaaaaacgcagaccatcgttgaggaagtcacgcgcctattaacggatgacatcgcttatcagcaaatgagccgcgctcataacccttatggtgatggtcaggcttgccagcgaattcttgaagcattgaggaaaaatcaggtgacattatga

SEQ ID NO: 2519 - DNA, 1263 bp, Xenorhabdus bovienii
  Coding sequence Name=Xb4151_4152.C434.gene39.dna; Position on contig =31394..32656bp; Strand=+
atgagctttgaaacaatttctgtgatcggccttggttatatcggcttgccaactgctgcggcattcgcttcccgcaaaaaaaacgtcatcggtgtggatgtcaaccaacatgcggtagagacaattaaccgtggcgcgattcatattgttgaacctgatctggacaaagtggtgaaaaccgctgttgaaggcggttacctgaaggccgtgacttgtccgcaggctgcggatgctttcctgattgcagtaccaacgccgtttaagggcgagcatgagccagacatggcctatgtgcgttctgcggcagaatcgatagcgccagttttgaaaaaaggggatttgatcattttggaatccacttctcccgttggtgcaaccgaacagatggcagaatggctggcagcggcacgtcctgagctatcattcccacagcaggcaggcgaaaatgcagacattgatatcgcgtactgtcctgagcgtgttctaccgggtcaagtcatggtggaattgatcaagaacgatcgtgtagtgggtggcatgacattaaaatcgtcccgcagggcgagcgagctgtacaaaattttccttgaaggcgaatgcgttgtcactaatgccaaaacggcagaaatgtgcaaattgactgaaaacagtttccgtgatgtcaatattgcctttgccaacgaactttccctgatctgttccgaacaggggattaatgtctgggaactcatcagtctggcaaaccgtcatccacgcgtcaatatcctgcaaccaggccctggcgtaggcgggcactgtatcgcggtagatccgtggtttatcgtgtcccagaacccggcacaatctcgcttgattcataccgcgcgtctggtgaatgacggcaagccgctttgggtggttgatcaagtgaaagccgcagtagcgggctgtctggtggagagcggcaagcgggcggatgaaatcaaaatcgcctgttttggtctggcttttaaaccgaacattgatgacttacgggaaagccccgctgttcatatcacgaagatggtggcacagtggcatgttggtcaaactgtggcggttgagccgaatgttcatgaattgccgaattcgctgaaagagagtgtggaattaatcgatatgcaacaagcattgaatgaagccgacgttgttttgatgctggtggatcacagccagttcaaggcaattgccggcagagaaataaaacaaaaatgggttgttgatacaaaaggagtttggcgttga

SEQ ID NO: 2520 - DNA, 1077 bp, Xenorhabdus bovienii
  Coding sequence Name=Xb4151_4152.C434.gene40.dna; Position on contig =32647..33723bp; Strand=+
ttggcgttgaaacgtattctgattacgggtggtgcgggtttcattggttctgctgttgttcgccatattatcaatcataccgaagacagcgttgttgttgttgatagtttgacttatgcgggtaatcttgagtcactggcatcggtggttgatcatccgcgttatgcctttgagcaggttgatatctgccagcgtgatgcattggatcgtgtatttcagcagtaccagccggatgccgtcatgcaccttgcggccgaaagtcatgtggatcgctccattgatgggcctgccgcctttatcgaaaccaatattatgggtacctatgtcttgctggaagcatcccgcgcattctggcagcaactggatcaggaaaaacaggctgcattccgtttccatcacatttcaaccgatgaagtgtatggtgatttgcatggcgatgagggttttttcacagaaactacaccttatgcaccgagtagcccttattccgcgtcaaaagcatccagtgatcatttagtcagagcctggcgtcgtacttatggcttaccgaccgtgatcaccaactgttcgaataactatggcccttatcactttccggaaaaactgatccctctgatcatcttgaatgcattggcaggaaagccattgcctgtctatggcaagggagagcagatccgtgactggttgtatgtggaagaccacgcgcgcgctctgcatctcgtggctaccacggcagaaccgggtgaaaattataacattggtgggcataacgagcgcagaaacattgatgttgtagagactatctgtgaactgctggaagagctgcgtcctgtcaaacccgcaggtattgtctgttaccgtgacctgattacccatgtggcggatcgtccggggcatgatatgcgttatgccattgatgcggcgaaaattgagcgcgaattgggttggactcctcaggaaaccttcgaatctggtattcgcaagactgtgcaatggtatctggagaatgagaattggtggcgtcgggttcaggacggttcttatgcgggtgaacgtcttggtctggcgaatgaataa

SEQ ID NO: 2521 - DNA, 882 bp, Xenorhabdus bovienii
  Coding sequence Name=Xb4151_4152.C434.gene41.dna; Position on contig =33742..34623bp; Strand=+
atgaaaggaattatactcgcgggaggctccggcactcgtctgtatccaataacacgcggcgtctcaaagcagttattgcccatttatgataagccgatgatctactatccactgtcggtcttaatgctggcagggatccgcgatatcctgattatttccacgtcggaagacttgcctgctttcaaacgcttattgggcaatggcgaacagtttggtattcgcctgagctatgcagtgcaaccttctcctgatggcttggcacaggcatttatcattggtgaagaattcattggcaatgatgcctgctgtctggtgctcggagataatatctactttggtcaggcgtttagtccgaaactgcaaagtgtcgttgcccgtcagactggagcaacggtattcggttaccaagtgatggatcctgaacggtttggtgtcgtggagtttgatgagcaataccgcgtcctttcgattgaagaaaaacccgcccggccgaaatcaaactgggcagtcaccgggctttatttctacgacaacaaagtggtggatttagccaaacaagtgaagccttctgcccgtggcgagctggaaatcaccagcattaaccaaatgtatctggaacgcggcgaattgaacgttgaactattggggcgcgggtttgcgtggctggataccggcacccatgacagcctgattgaggccagtacttttgtgcagaccgtcgaaaaacggcagggattcaaaatcgcctgcctggaagagatcgcatggcgtcacggctggttggatgatgaacagttaaaagccgcggctgccgagttggcaaaaacgggctacggcaaatacctgatggacttgctccatgtctattcacgccaatattga

SEQ ID NO: 2522 - DNA, 729 bp, Xenorhabdus bovienii
  Coding sequence Name=Xb4151_4152.C434.gene42.dna; Position on contig =34601..35329bp; Strand=+
atgtctattcacgccaatattgaaccactggcatgggatagccaatttttcggtttgtccactgcccgtttgaatttttcaccgcaggcgtcagtgctgacgacagctcagttagatgagtatgcactggtacaggcgaaagtccctgcccggcagacggatatcattgacggattatctgctttgggcttttcactggtggaaggtgaggcggattttttgctgccggtggattctggcgcgatgagttacagaaatgcaaccggaattcagtcggaacaagcgctgatttctgcaacatcgcaggatatacctgtattgacggcagccgcagccagtgtattcaaggccagccgctttcgggtgccttggtatcagcctgatgatagcggtcggttttacgcggcttgggttgaaaaagccgttttgggtacttttgaccatgaatgcttgctcgtcaacgatgagtgcggtcaaattatcggctttgtcaccctgagagatatcggtagccatgaagcccgtattggcttactggcagcccttccgggcaattatcaccggggcattggtaaaaaattaatgtcggcggcgcagcggtggtgtgaaaaccaccagatacagcggctgagagtggcaacacaaatcagcaacatcactgccttgcgtctttatacacgtagtggtgcaacaattgaaagcaccgcatattggttatacagaggatga

SEQ ID NO: 2523 - DNA, 1131 bp, Xenorhabdus bovienii
  Coding sequence Name=Xb4151_4152.C434.gene43.dna; Position on contig =35331..36461bp; Strand=+
atgattccatttaataaaccaccagtagtcggcacggaactggaatatatgcaacaggcgatgggcagtggcaaattatgcggcgatggtcacttcactaaacgctgtgaagagtggatggaacagcattttaactgtctgaaggtgctgctgacaccatcttgtacagcggcattggaaatggcggccattttgctgaatatccagccgggtgatgaaatcatcatgccgagctacacctttgtttcgacctccaacgcctttgtcctgcgtggtgcaaccatcgttttcgtggatatccgcacagacacgatgaatatggatgaaaccaagattgaagctgccattacagaccaaacccgtgccattgtgccagtgcattatgcgggtgttgcctgtgaaatggataccatcatggcgctggcggaaaaatataacctgtatgtggtggaagatgcagcccaaggcgtgatgtccacctataaaggccgcgcactcggtactattggccatatcggttgtttcagttttcacgaaaccaagaactactcttccggcggtgaagggggggcgatattaatcaacgatgaatcaatgatcccccgggctgaaatcattcgtgaaaaagggactaaccgtagccaattcttccgtggacaggtggataaatacacgtggcgcgatattggctccagctatttgctgtctgatttgcaagctgcatacctttgggggcagctggaaattgctgagaatatcaaccagcgtcgcttatccctgtgggataactattatcaggcattgcagccattcgcagaagcggggcatctgaccttgcccgttgtgccggagggtctggaacataatgctcatatgttctatatcaaactaaaggatgtcgaggagcgcggcgcattcaaccgctatatgcaagaagcaaatattctgaccgtgttccattacgtagcattacatacgagcccggcgggtgaaaaatgtggccgtttccatggagaagatcgctttacgaccagcgacagtgagcggttggtgcgtttgccaatgttttataacattactgatgaagagcagcaggtagttatcaaccgtatcaaggaattttttgcctga

SEQ ID NO: 2524 - DNA, 1251 bp, Xenorhabdus bovienii
  Coding sequence Name=Xb4151_4152.C434.gene44.dna; Position on contig =36463..37713bp; Strand=+
atgtcacttgctaaagcttctgtatggacggcgggttccacactaatcaaaatcggtgtggggctgctggtcattaaacttctggcggtgtccttcggcccagcgggtgttgggcaggcgggcaactttcgccaattgattaccgtactgggcgtgctgtctggtgcggggatttttaacggtgtcaccaaatacgtggcggaacaccatcagcagccggaaaaacttagggcgatactgggtacttcgtcttcgattattctggggttttccaccctgttggccgttatttttctcttgttcactgacgccatcagtatcggcctgtttggtcacaataattacaaaacagttgtgcaggcgcttgcattgatccaaatgggcattgcttacgccaactattttctgtccattctgaaaggtttcagggatgctcagggcaacgcactgtcgattattctgggtagcctgacaggaatgattgcctatggcctctgttattggctgggaggctatgaaggcgcactagcgggtttggctttggtgccggctttggtggttctgccggcagggttgatgatcctgcgcagtaaagtgattacgttttcagcattaaagcccatgtgggatcgtgtgattgccagccatctgggaaaatttacgctgatggcgctactgacgtccattacgctgccagtggcttatatcatgatgcgaaatctgatggcagagcgttatagctgggaggaggtcggaatttggcagggggtgagcagcatttcggatgcctatttgcagtttatcaccgcctctttcaccgtctatttgttgccgacactctcccgattggagagtaagcaagaaattactggcgaaatcgtcaaagcactgaagtttgtgttacccgccgttgctgcagccagcttttcagtttggctgttgcgtgattttgtgatctggcttctgttttcagataaattcaccgcgatgcgggatctattcgcatggcagctggtgggcgacgttttgaaagttggcgcttatgtttttggttatctggtgatagcgaaagcggcgctgcgtttttatgtactgactgaaatcagtcaatttctgctgctggccggcttttctcattggctgatacctgaaaatggagcactaggggcggcgcagtcatacatggcaacttacattatttatttcatcctttgttgtagcgtatttattatttatcgcaggcgagcatga

SEQ ID NO: 2525 - DNA, 1080 bp, Xenorhabdus bovienii
  Coding sequence Name=Xb4151_4152.C434.gene45.dna; Position on contig =37710..38789bp; Strand=+
atgacaatcctaattcacgtcttgggatcggatattccacatcacaatcaaacggtattgcgtttctttaatgacgtcttggctcaggaaatgatttttccagctaaaccgtgttttatggtggtgtccaaagaccacacatggctatctaattacccggccttggcgatcacggtttatggcagcaaagctgctttggcgcgtgctgtgatagagaaagcgcaggcagacagaaagacccgtttctttttccacggccagttcaatgcggctttgtggctggctttatgggttggcaaaatcaaacgccatcaattctggtggcacgcttggggggctgacttatatgaagactcccgccagctaaaattccgtttgttctatcagcttcgtcgtttggcacagaagcgggtggggcaggtttttgccacgcgtggtgatctccagtattttagccagtccaatcccaatgtaccgtcaacactgctctattttccaacgcgtatggagccatcactgatcgtaacggaaaaactatgctcgccagaagggatcaccattctgctgggtaattccggtgatcaatctaaccgccacattgaagcgttaaacaagattcaccgtcaatttggcaatgaggcgagagtgattatgccaatgggctatcccggcaataatcgggcttatgtccaaaacgtggagcaaaccgcattgtcgctgtttcgggcggaaaacgtccatattttgaaaaataaaatggcttttgacgactatctgtcattgctgcgtcaatgcgatttgggctatttcattttcaatcgccagcagggggtcggaaccctttgcctgttaattcaatttggtattccgtttgtcttgagccgtcagaacccattctggcacgatctgacagaacagcagatccccgtactgtttgatggagatgaactgaataaacactgggtgcaggaagcacagcgtcaaatgctgtccctcgataaaaaggcgattgccttttttgatcccaatttcattgaagggtggaaagccgccctatcggctgcattgggagagtattaa

SEQ ID NO: 2526 - DNA, 1419 bp, Xenorhabdus bovienii
  Coding sequence Name=Xb4151_4152.C434.gene46.dna; Position on contig =38789..40207bp; Strand=+
atgactttggcgcaattcagcgggttatttgttgtttacgtgatctcgctgttctttatcctaaccctgacatatcaagagttccagcgcgtacgctttaacttcaatatctttttttcactgctttatttgctgacattctattttggctttccgttgacctgtatgttggtgttccattttgaggtgcagatagtccctgtagacgcattgttgtacgcgatgctggcttctggctgtttttatgctatttattatgtcagttataaaacacgtctccgttataagacgccagcctgtaaaactgcctcgtctagcacaccatcttcggtcgtgtctcgtcggccgctgttcaccatgaatcgggtggaaactaacctgacgtggctgttgttggccagcattgctatcttcacagttggctcgttctttatgcaaaacggctttttgctgtttaagctacagtcgtatagccagatattttccaatcaagtttccggtgtggcactcaagcggtttttctacttttttattccggccatgctggtggtgtttttcctgaaaccgactaaaacccgctggttgtgctttttggtggcgacagtcgggtttggtatcctgacttatgtgatagttgggggaacacgggctaacattattctggcttttgcgttattcctgtttattggaattgtccgtggctggatcactttgtggatgctacttttggcgggtgttatcgggatcgtcggcatgttctggctggcattgaaacgttatgggctggatgtgagtggttcggaagcattttatactttcctgtaccttacgagggataccttttctccgtgggaaaacctcgctttgctgctggataattacggcaaaattgattttcagggactggcgccgattgcccgtgatttctatgtttttattccaagttgggtgtggccggacagacctaatctgatattgaatactgcaaactactttacgtgggatgtgctggataatcactctggtctggcgatctctccaaccttgataggctcattggtagtgatgggcggcgtattctttattccctttggcgcgattgttgtcggattgattatcaaatggtttgactgggtctatgaagcggggaaacaggaatctaatcgctataaggcggcaattttgcaggctttctgttttggggcgatttttaatattattgtcctcgctcgtgaaggaatggattcttttgtttctcgggtggtgtttttttgtctcgtctttggcctgtgtctggtggtcgcaaaattgctgtattggctgtttgaaagcgtggggttggttcgaaaatttgtcatcagcaatatgcctgcgtcgcagaaaatatccgttattgcggatgttaaggaagaaaaatga

SEQ ID NO: 2527 - DNA, 738 bp, Xenorhabdus bovienii
  Coding sequence Name=Xb4151_4152.C434.gene47.dna; Position on contig =40204..40941bp; Strand=+
atgacactgaataacattccaaaataccgtatccgtggcctcagtctctggggctttcgtggaatgtcgcatttcctcgatcacctttttcaggatgggcaggtaaaaacaggcacattggttgcgattaacgcagaaaaagtccttactgcggaaaaagacaatgtgttgaacatattgctggatgaggctgaatacttatatgccgatggcattagtatcgtgcgtgctattcgccgtaaatatcccggtgcgcaggtgtcccgcattgcgggagcagatttatgggaagctttgatggaacgcgcaggccgggaaggtacgccggtatttctggtgggtggaaaacctgatgttctggcgcagacagaaaacaaactacgtagtcagtggagtgttaatattgttggcagtcaggatggttattttacccaggaagggcgtgatgcggtgtttgagcgtatccatgccagtggtgctgccattgttacggtagcaatggggtcgcctaaacaggaaattttcatgcgtgattgccgtaaagtgtattctgacgcactgtatatgggcatagggggaacgtatgatgtctttaccggacatgtcaaacgtgcaccgaaaatttggcaaaatttgggattggagtggctttatcgtctgttatcgcagccaagccgcatccggaggcaaatcaagctattgaaatttctgggctattattacggtggtaagctgtaa

SEQ ID NO: 2528 - DNA, 165 bp, Xenorhabdus bovienii
  Coding sequence Name=Xb4151_4152.C434.gene48.dna; Position on contig =40958..41122bp; Strand=-
ttgtccatcagtgaaataaaaaattataaaatcgagtcaaagcctgtttcattatgcatagtgaatagcagacaaaatggatgtatggaatggaagaaattagcgaggcaggtcaaacccacgatatccatcctaatcactgatgttgatacagtgggtcaataa

SEQ ID NO: 2529 - DNA, 99 bp, Xenorhabdus bovienii
  Coding sequence Name=Xb4151_4152.C434.gene49.dna; Position on contig =41104..41202bp; Strand=-
atgatgtctctatttgcaagcagaaaattacaggaattgataatcaatcattgtaaaaaaggcagggatcaaaacacgttttgtccatcagtgaaataa

SEQ ID NO: 2530 - DNA, 1380 bp, Xenorhabdus bovienii
  Coding sequence Name=Xb4151_4152.C434.gene50.dna; Position on contig =41223..42602bp; Strand=+
atgagtgattcaaaacaaagcctgcaaaggggacttgaggcacgtcatattgagctgattgcgctaggtggcacaatcggcgttggactgttcatgggttctgccagcacgttgaaatgggcgggaccttcggttctgttggcttacatcatcgctgggatttttgtttttttcatcatgcgttcgatgggggaaatgctgttccttgaacccgtcactggctcattcgctgcgtttggacataagtacctcagtccttattggggatgtctgacggcttggggctactggtttatgtgggtttcagtgggaatttcagaaatcaccgctgtgggggtctatgcagaattctggttccccgatctgccccaatgggtttctgcattggttgctgtcgggttggttgctctagcgaacttggcggccgtgcgtttgtatggggagctggaattctggtttgccatgatcaaagtgaccacgattatcgtcatgatcctgattggtatcggtttgatctttttcggactgggtaatgactggcagcctattggcttggataatttgaccgcacatggcggctttttctcgggtggctggaaagggttcttgtttgccctctgtatcgtggtggcctcgtatcagggagtggaactggttggcattacagcaggggaagctaaaaacccacaggtcacacttaaaaaggctattaacaatattctgtggcgtattctgatcttttatgtcggtgcgatttttattgttgtgaccctgtttccgtggacagaagctggtacgcatggcagcccgtttgttatggttttttccaaagtagggattgcttctgccgcagctgtcattaacttcgtggtgctgactgctgcgctttcgggatgtaacagcggcatgtatagtggtggccgaatgctgtatgccttggcgaagaatcgccagttaccggcttcattgctgaaattgtcaaaaaatggcgtacctgtgagatgtattgcgatcaccattggttgcctgattgcaggttccagcctgaactacctgatcccgaatccacagtcggtattcgtttacgtttatagtgccagcgtattgcccggtatggtaccgtggtttgtcattctggtaagccagttgcgtttccgccagcagaatcaggaagcattaaaacagcatcggtttaaatcgctccttttcccttatgtcaattacctgactctggtatttctgagttgtgttctgatagggatggcaattaatccggatacgcgtttttcactgatggtaggtggcgcatttttactacttgtgtcactggcttattggctggggaaatttatttgcgacaaacgcaaaatagttcgttag

SEQ ID NO: 2531 - DNA, 96 bp, Xenorhabdus bovienii
  Coding sequence Name=Xb4151_4152.C434.gene51.dna; Position on contig =42665..42760bp; Strand=+
ttgaagtgtaatcaaacaaatcttttccttaaaaaaagcactggacagttcgacattaaatccgtactatcctccaccgcaacggcgttaagcgcc

SEQ ID NO: 2532 - DNA, 120 bp, Xenorhabdus bovienii
  Coding sequence Name=Xb4151_4152.C434.gene52.dna; Position on contig =43223..43342bp; Strand=-
atgacaaaaagaaatgaagggctttttgatagttgggaaataacggttaggaatagcatttctaccagaaatgcaaaaagaaaaagccctgctatatgcagggctttctcagaatctggt

SEQ ID NO: 2533 - DNA, 171 bp, Xenorhabdus bovienii
  Coding sequence Name=Xb4151_4152.C434.gene53.dna; Position on contig =43704..43874bp; Strand=-
gtgcatcatgcaaatctcaggatacaagcaaaaaaaaacacctatcaaaaaagacaggtgtataaatacaatcaggtctacagacggatagtgcctcactcaacgttgtgtccggttggtgatgaaaagactaaatgcttattcatctataacgtggaccataggcactga

SEQ ID NO: 2534 - DNA, 1206 bp, Xenorhabdus bovienii
  Coding sequence Name=Xb4151_4152.C434.gene54.dna; Position on contig =43953..45158bp; Strand=-
atgctgaaagtattattgctgttcattatcctcatcgtaggcgttgtgctcggccctgtgttgtccgggcatcagggatacgttttgatccaaacagacaatcacaatatcaccaccagcgtcactgcgatggtgattatgtttgttctgttacaattcttgctgattttaatcggttggtgttaccgcaggttaaaacgtaccagtacgttcacccatagttggctctttggcggatacaagcgcagccgggcacgtttacagaccaaacaggctctgctcaaattggccgaaggggacttcaagcaggttgaacatttgatgacccgtaatgctgaccatgcggaaagccccgtcgtcaactatttactggccgcagaagccgcccagcagcgtggcgattaccaccgaactatccagtatattgaacgtgccgcagaagtcgccgataaagatcagttacctgtcgatattacccgagtccgtatccaactggcacaaggcgaagttcatgccgcccgtaatggtgtggataagctgctgaaccacgcaccgcgccatcctgaagtactgcgactggcggagcaggcttatacacagtcaggagcctaccaatccctcattgatatcctgccctctctgataaaggttggtttgtgtgatgaagaacatattcatcaattgcgccagcaagcctacatcgggttgatgaatcagatcatggcagaaaaaggcagtaccggattgaaggcatggtggaaagatcaaaaccgcaaactccgcaatgatatcgtgctgcaagtcgccatggccgaacatctgattgagtgtaatgatcacgacactgcacagcagattgtcctcaatgggttgaaacagcaatatgacgaacgcctgctactgttaattccacacttaaaggcagatgagaccgaagccttacaaaaatcactggcatatttattaaagcggcatggagcgacaccattgctgaacagtacacttggacaggtagccttacaccacagtcagtgggctgaggctgaaaccgcattcaaggcggctcttgtacagcgtcctgatgcccatgattatgcttggcttgccgatgcgttagataaacagcataagcgtgaagaagcagctcagacacgtagtaaaggctttatgctgactctgaagcgtgagagtgatgcagaagaataa

SEQ ID NO: 2535 - DNA, 1197 bp, Xenorhabdus bovienii
  Coding sequence Name=Xb4151_4152.C434.gene55.dna; Position on contig =45161..46357bp; Strand=-
atgtccattatgacggaacaaaagcaatccactgatgcggttgaaacaaaacaccctcagcaacctgaaacggctccccataaacccaaacgttgtgggtgggtgggaaatacactctcagttgccattatgttggctatcggtgcaggtggcgtttacctttaccatcatggcaagcaacaaaatgcagtattaacagccgaaaaccttgctcttcagcagcaggttgcctctctcgtacaacaacagtctggcgacaaacaagattttgctacccagtttcagaagctagagagtgacttgcaacaagccaaactgcaaaataaacaaacagacagccgtatggtggagcttcagacccgcatatcagagatttcaaatacggatctcgaaaactggcgcctgacacaagcaaattatctcgtgaagatggctggccgcaaaatatggaccgagcaagacacgaccactgcaatcgcactgctgaaagacgccgaccaaagccttgccgagatggatgatcccagcctgctacacgtccgccaagccattatggaagatatcaatactctctctaaaatcaatcagcttgatttagatggcattattcttactctgaaccgcttatccaatcagatcgataatttacggctggaagataatggagaacaagaagcgccaatggatgaaggcgatacaggaattagtgcctcactctctgactggcgtaaaaatctgagtaagagctgggacagctttatggagaatttcattactatcaaacgtcgtgacagttccgcagtaccattattggcgccgaaccaagacgtttatctgcgcgaaaacatccgctccaggctgctggtggcagcacaagcagttccccgtcaccagaatgaagtctataaacaatcattggaagccgtttcaagttgggtgaggtcttatttcgatacagcgtcctcagatacaaaaacctttttgcaggatattgattcgctggcgcagaaaccactttccattgaactccctgaacacctgagcagtcagccaatactggcagacctaatgcgcaagcgtatctacaacttaccgcatcagtcggacactcaagttcagcctcaatcagaagttcaacctcaaccgaagcccgcagaaacatctggtcaggcagcaacacctgttcaggagggttga

SEQ ID NO: 2536 - DNA, 741 bp, Xenorhabdus bovienii
  Coding sequence Name=Xb4151_4152.C434.gene56.dna; Position on contig =46369..47109bp; Strand=-
atgagcattttgatcacccgcccagatcccgcaggagagcagttggccaagcgactgagggctatgggaaaaatagccttcagtgcgccactcattacgatttatcccgggggcgatttgccgttgctgtcacagaaactccaacggctgtcggcgggtgatttagtcttcctgttgtcaaaaaacgctgttcactacgctaatgaacagcttctgcaagaaggcctatcatggcctgataagctatcctattatggtatcggcaaatcaacttccctgatgtttcatcaaaaaaccgggttggagatcctctggcctgaacagggtgaaacgagtgaagacctactgcaactccccattttacaacgggtgaatgataaaaagattttattgctgcggggtaatggggggcgtgaagttattgcttcgacattaataaatcggggagggaaagtcgattattgtgagtgttattcacgccagcctatcaaatatcatgtcgctgatttcagtcgccattggcaacaatatggtataaaaaccctcgttgtgaccagtggcgaaatgctgcaactattatataacttagccacagatgatgatggcaaagcgtggttattgagttgctacttgattgtggtcagcgaacgccttgccaatattgcccagacactgggttggcagacgataaaagtagccaagagtgcagataatgacgccttaatgcaggcactagaataa

SEQ ID NO: 2537 - DNA, 936 bp, Xenorhabdus bovienii
  Coding sequence Name=Xb4151_4152.C434.gene57.dna; Position on contig =47106..48041bp; Strand=-
atgaaaatcattcgtatcgcgacccgccaaagcccgttggctatgtggcaagcccaatatgtccaaaagcaactggaacagtttcatccagaactgaaagtggagctgattccaatggtgacacgcggagatgtgatcctcgatactccactggcaaaggtgggtggtaaggggttatttgtaaaagagctggagttggcactgctcgaaaatcgggctgatattgccgtccattctatgaaagatgtccctgtggaatttcctgacggcttggggttggtcacaatttgcgaacggggtgatccaagggatgcctttgtttcagtaaaatatacctcgcttgatgaactgcccattggcagtatcgtcggtacatccagtttacgccgccaatgccagcttcgtcagttacgtcctgatttggtggttcgtgacctgcgaggcaatgtaggtacccgtctgggcaagcttgataacggcgattatgatgccattatccttgcagctgcgggtcttaagagattagggttggaagatcgcattcgtatgccattggaaccggagttactccttcccgcagtcggtcagggtgccgtcggtattgagtgccgccttgatgataagcaaacccgtgagttacttgctcccttgaaccatacaggaacagaaatctgcgttctggcagaacgcgccatgaatacccaccttgagggtggctgtcaggtacccattggcagctatgctatctggcagggaaacaatatctggctgcgcgcacttgtcggagctcccgatggcagtataactgttcgtggtgaaaaaaccgtatcaccagaagaggctcgtcgcgcgggggtggaattggcagaagaattattggaaaaaggtgcgcgccagattctggctgacgtctaccagaggaatcctcctgaatga

SEQ ID NO: 2538 - DNA, 93 bp, Xenorhabdus bovienii
  Coding sequence Name=Xb4151_4152.C434.gene58.dna; Position on contig =48044..48136bp; Strand=-
atgttaaaactgactctatcttctcgcaatttagcggctcaaaagcccctaaataccgttattaatacgattatccaatataattatcaatga

SEQ ID NO: 2539 - DNA, 117 bp, Xenorhabdus bovienii
  Coding sequence Name=Xb4151_4152.C434.gene59.dna; Position on contig =48501..48617bp; Strand=-
atgacttttaaaaatttttacaaaattattgtcggaaacgtgatcaatttaacaccttgcagtcgaagcgtaaagtacgcaataccacctttccgccctctccgcaatagacgataa

SEQ ID NO: 2540 - DNA, 2601 bp, Xenorhabdus bovienii
  Coding sequence Name=Xb4151_4152.C434.gene60.dna; Position on contig =48686..51286bp; Strand=+
ttgtatctctatattgaaacattgaagcagcgactggatgcaattaaccagcttaagttagagcgcgcgaccagctcaatgagtcccgtttttaagcaggtctataatttaattccggtattattgcattatcatcatccaatgatgcccggttatatcaaaagcaacgttcctcatggcgtttgtttcttcacgcctgatgaatctcagcaattttggattaatgatctggcatgtcagtctgctgatattttgtcactcgctcccaacggtgagctgccgattacgggtatttactcgatgggcagcacctcttctatagggcaaagctgttcttctgacctggatatctggatctgtcatcaatcctggctggatcataatgaaaaagcgttactggaacagaaatgcactctgatagaacagtgggcggggtcgctgggtattgaggtgacattttttctggttgatgaaaatcgctttcgtcataatgcctgtggcagcctgaacggggaagactgcggaacaacccagcacatccttctgctggatgaattttatcgcacagcggtctgcatggcaggtaaacgtttgctgtggatgatggttccggtggaagaagaggggcagtatgacgaatatgtgctgtctctttatgcccaaggtgttttgacgccaaacgagtggctggatctgggcggattgagtgaactgtcagcagaagaatattttggggcaagcctgtggcagctctacaagagtgttgactctccttataaagcagttttgaaaagtctgctgctggaggcctactcatgggaatatccgaacggaaaattgctgtcaatggagatgaagcaacatttccatgatggttctattgtttccttcggtcttgattcttatagcatgatgcttgagcgtgtaacccgttatctcaccgcaacgaacgatttcacacgtctggatctagcgcgtcgttgtttttacctgaaagtttgcgaaaagatgctggaaagccacgaggataaaggctgtacaggatggcgtcatcaggtcatgtcgcagctggcgcatgagtggggttgggatgccggcaaattggcaatgctggataaccgtaattcatggaaaatcgggctagtgcgtgatgctcataatgaattactggataccatgatgatgagttatcgcaatttgatccgctttgcccggcgtaacaatttaagtgtgagtgccagcccacaggatatcggtgtactgacccgtaaattgtatgcagcatttgaagctttgcccggtaaagtcactctggtgaatccacaaatttcaccggatctgacagaacaggatctgacgttcatctatgttccgcccgggcgtgtaaaccgtagcggctggtatctttacaatcacgcgcccacgatagaatcgatcatcggccaccagccactggaatataaccgctatttaaataaattggtggcgtggacctattttaacggcctgctgactaaaaaatctcgtatccatattcatcacgggaagtcgcaatgtgaccggaataatctgtgtgatttggtgaacgatatcgctacccattttccaatccgcctgcctgcgccgacgccgaaagcgttatatagcccctgtgagattcgtcatctggcgattattgttaatttggaaaaagatcccactacggatttttccaatcggatcgtgcattttgatttcagaaagctggatgttttcagttttggtgaattgcagcaatgtctggtggggagcatcgacctgctttaccgtaactcgtggaatgaagtgaggacattgcatttcagtggcgaacaatccatgctggaagcgctgaaaaccatactgggcaaaatgcatcaggatgcggcaccacccgctgaggttgatgtgttctgctatagcgagcatttgcgtggattgatccgaactcgcgtccagcagttagtttcagaatgtatagagttgcgtctgtgtagtaaccgtcaggatcccaatcgctttaaggcgttacgcatttcaggccagacatggggtttgttttttgaacggttaaacgtttcggtacagaaattagaaaatgctgtggaattctatggcgcgatttccaatactaaattgcacggcctgcccgttaagatagataacaaagaaaagcatttacctcccgtgatcgatgggtttgcctgtgaaggaattattcaatttttcttcgaagatattgaaaaaagtcaggggttcaatatttatattcttgatgagtcaaatcgggtagaaatttattcccattgtgagggcagcaaagaagaactagtctgtgacgtcagccgtttttattcttcctcgcatgatcgttttacttatggctcgagttttatcaacttcaacttaccacagttctatcaaatcatcaggaaaggtgagcgtactcatgtctctccatttatagatggagtgtttccaccggataatacgaaacttaatgatacagcgtacagtgttgatgtacttctggatgattcgtgtaggtcacatgatccttgtcattcgttgtatccctattga

SEQ ID NO: 2541 - DNA, 111 bp, Xenorhabdus bovienii
  Coding sequence Name=Xb4151_4152.C434.gene61.dna; Position on contig =51517..51627bp; Strand=+
ttgttgtattttatattttatattttatattattgcaattggttttatggtgatctacagcgattaggtttatggaaggtaataaaaatgccgtatttcaatacggcataa

SEQ ID NO: 2542 - DNA, 147 bp, Xenorhabdus bovienii
  Coding sequence Name=Xb4151_4152.C434.gene62.dna; Position on contig =51586..51732bp; Strand=-
gtggtaacgattttctatccatgctggaacagtcgatcacagaacagagtggcgaatcatttcagttttagaatttgttttgctactacgcagataatttaccgcttatgccgtattgaaatacggcatttttattaccttccataa

SEQ ID NO: 2543 - DNA, 324 bp, Xenorhabdus bovienii
  Coding sequence Name=Xb4151_4152.C434.gene63.dna; Position on contig =51662..51985bp; Strand=-
atgaacatgaacgatagcgaatttcatcaattggccgatcaattgatgcagcgtattgaagagcaactagataactacgatggcgatgccgatattgactgtgaaacaaacggcggcgtaatgacgctaactttcgaaaacggcagcaaaatcattatcaaccgccaggaaccctttcatcaaatctggttggcaaccaaaagtggtggctaccactttgattatcaggaaaatcgatggatttgtgaccgtagtggtaacgattttctatccatgctggaacagtcgatcacagaacagagtggcgaatcatttcagttttag

SEQ ID NO: 2544 - DNA, 96 bp, Xenorhabdus bovienii
  Coding sequence Name=Xb4151_4152.C434.gene64.dna; Position on contig =51944..52039bp; Strand=+
ttgatcggccaattgatgaaattcgctatcgttcatgttcatttcctatttgcttttcagggtctaactgcgattatagagagtattgacgcatga

SEQ ID NO: 2545 - DNA, 180 bp, Xenorhabdus bovienii
  Coding sequence Name=Xb4151_4152.C434.gene65.dna; Position on contig =52062..52241bp; Strand=+
atgaaaaaacaattccgttggtcactggctatcataacattacttgcggtttctggttgtggcttgaaaggtcctctttatttcccgccggcagagccgactgtgacacaggctcccgcagatcaggaaaataaagcacagccagaacacaatacacaatcggatactcaacaaaaatag

SEQ ID NO: 2546 - DNA, 906 bp, Xenorhabdus bovienii
  Coding sequence Name=Xb4151_4152.C434.gene66.dna; Position on contig =52454..53359bp; Strand=-
atgacagatgcgctttctctggcgatccatgtgccattccatcagggagacacattcacgcaccggatgaggaacgcgtatcttatcgactctattggcattgcggataaaaaactcaggattattcagcaaataatccactaccgcctgatcattcagccaattttccaagtgcagtggatcgtcatttttacccattttccaatgccccatatttcaataatgactcagataaaactgaatccatcacaaatgaatcgtaccttcataaacgtgagttgcaggccctatcatatagagtggcttgcccggcccgtcccagcaaatttgcaggaaaccacccggcagatcaacgcgaacctgactattcagcagatcttgctggataccgacggcgacggctgcacatgcaccgctgccacaagcccgtgtctctcctgcaccacgttcaaagacacgcaatcgaatatgactacgattcatgatctgcatgaaaccaatattcgcccgctcaggaaaacggtcatgattttccaatactggccccaaaatctccacttctgcggtgtcgacatcttcaacctgtatcacacaatgaggatttcccatcgacacgacaccgcagagcacggtgcgttcaatggcacggataatataggttttctccgccttaatggcacgaaaaggaacatgctgtggttcaaagtccggttctcccatattgacacagacctgatcatcattggtgatgctcagtaccatccggcctgtttgcgtactgaccttaatatcacgcttattggtcaatcctttcaagcgaacaaaacgggcaaagcagcgcgctccgttgccacactgggaaacttcactaccatcagcattaaaaatgcgatagtgaaagtctaa

SEQ ID NO: 2547 - DNA, 705 bp, Xenorhabdus bovienii
  Coding sequence Name=Xb4151_4152.C434.gene67.dna; Position on contig =53162..53866bp; Strand=+
atgggtaaaaatgacgatccactgcacttggaaaattggctgaatgatcaggcggtagtggattatttgctgaataatcctgagttttttatccgcaatgccaatagagtcgataagatacgcgttcctcatccggtgcgtgaatgtgtctccctgatggaatggcacatggatcgccagagaaagcgcatctgtcatctggaagacgatttgttacatttggtggagcaggcgaaacagaatgaaatactgttttgccgtctgctgcaattactcgctgatctctccgctgccaaaagtttgcaggactttctttcccgcttgagttcatggtcgaaaacctttgggttgagtaatagttatgttcggttattcagtgataaatggcgtcttggtgcgccgctgaatgcgccggagctggctatctcgcgtcatatttttgagcctgtccgcattcagcgatttggtgacagtaaccattatcttggcacactgtatggtccagaaattttactgctgataccacaggctcgctatgtaggttcagtcgctatctcccttttgggttcacggggggagctgggcatggtgattttcaacagccgcaataaacagcactatcatgaaggtgtgggaaccgatctacttgatcatctggcgaaattgctaccggaattattgtcccgctgggtagaacgagtatga

SEQ ID NO: 2548 - DNA, 915 bp, Xenorhabdus bovienii
  Coding sequence Name=Xb4151_4152.C434.gene68.dna; Position on contig =53863..54777bp; Strand=+
atgactcagccgcttgacttgctgcttgaaccagtagaaacctttttgcattatctgcgggttgagcgtcgtttaagcccattgacgatcactaactaccgtcgtcatttggtggttctggcatctatgtcactggatatggggatacatgagtggcaggcacttgatccggctaaagtcagaatgtttgcttcccgcagccgtcgggcggggttgcagtctgccagcctggctctgcgtctttcttctctgcgtactttccttgattggatggtaatacagggggaactggatgccaatcctgccaaagccgttagtgcaccgcgtaaaaagcgccatttgcccaaaaacatggatgtggacgaagtcaatcagttactcaatatcaacctgaatgatccattgtccgttcgtgaccggacgatgatggaagtgatgtatggtgcaggtttgcgtttgtcagaactggttggcctggattgccggcatctggagctggcaagtggtgaagtctgggtgcagggtaagggcagtaaagaacgtaaagtacccgtgggtcgcatagcactggaatggctccagcgctggcttgaaatgcgggaattgtttgagccggaagataatgccgttttcatttctaccaaaagcggaaaacggatctctgcccgtaatgtacaaaaacgatttgaacagtggggcgttcgccaaggggtcaacagccatatccatccccataaactacgccactcttttgccacgcatattctggaatccagtggtgatctccgtgcagtgcaggagttgctgggtcatgcgaatttatcgacgacccagatctatacccatctggatttccagcatctggccaaagtctatgatgtggcccatcccagagccaaacgaggaaaatcataa

SEQ ID NO: 2549 - DNA, 717 bp, Xenorhabdus bovienii
  Coding sequence Name=Xb4151_4152.C434.gene69.dna; Position on contig =54777..55493bp; Strand=+
atgcgtttttatcggcctctcgcgccgtttgctgcgatgacattcgatctggatgatacgctttacgataatcatccagtaatcgataaaaccgaaaaagaagtgttgtgttttatcaggcagtacgatgtcaagttcaatcattttgagagagaagatctgtatgtgtaccgtcaggcggttcttgagtcggagcctgaaatttaccatgacgtgacatcttggcgccgccagtcagtagaattgatgttcagccaccacggtttcaatcgtgaggagaccctgcgtggtgcggatgaacttatgtcctgctttacttattggcgtaatcagatcatcgtgccggaatccacctataatactttatctgtactggcgaaaaaaattccgttggtggcgatcactaatgggaatgccgaacctgctgcgtgcgggcttgaaccttattttgagtttgtcctcaaagcgggggtggacgggcgggctaaaccttacccagatatgtatcatctggcggctgaacggctgaacctgccaataagccagatcctgcatgttggcgacaatctgaaaactgatgtggaaggtgctctgtgcagtggcatgcaggcctgctggattaacctcgaaaatagaaacctgatgcaggagcccgaagggcgccgggttccacatgttgagatttctgatttggcttctttgatcgcactgatataa

SEQ ID NO: 2550 - DNA, 105 bp, Xenorhabdus bovienii
  Coding sequence Name=Xb4151_4152.C434.gene70.dna; Position on contig =55496..55600bp; Strand=-
ttgtttatcattcaggctttcgagcagataagaaacgtccataattaccatcaattgagaacagtcacttttgtcactgttttttttatacagatcacaatatga

SEQ ID NO: 2551 - DNA, 2175 bp, Xenorhabdus bovienii
  Coding sequence Name=Xb4151_4152.C434.gene71.dna; Position on contig =55550..57724bp; Strand=+
atggtaattatggacgtttcttatctgctcgaaagcctgaatgataaacaacgcgaagctgttacggcatcgcgtaccaatatgctggtgctggctggggctggcagtggtaaaacgcgcgtgctggttcaccggatcgcctggttactgtcagttgaaaatgcgtcacctttttccatcatggcagtgacttttaccaataagtcagcggctgaaatgcgccaccggattgaaaacctgattggcaccagccaagggggaatgtggatcggaacattccatagtctggctcatcgcctgctgcgttttcatcaccttgacgccaatctgccgcaagatttccagatcctcgatagtgaagatcagcacagactgatcaagcgtattatcaaggcgatgaatctggatgacaaacagtggccagcccgtcagggcatgtggtacatcaacggtaaaaaagatgaaggactgcgccctcagcatatcgaaatctacggcaatccggtagaaacgacatggatgaaaatttaccaagcctatcaggaagcgtgtgaccgcgccggattggtagattttgccgaattactgctgcgtgctcatgaattgtggctgaacaaaccgcagatcctgcaacattatcgtgagcgtttcactaatcttatggtggatgaatttcaggacaccaacagtattcaatatgcttggatccgcctgctggcaggagatagcggcaaggtgatgattgtcggtgatgatgatcagtcgatttacggctggcgtggggcgcaggtggaaaatatccagcgttttctcagggattttcccgccgcagaaaccattcgtctggaacagaattatcgttccaccagcaatatcctcaaagcggctaacgctctgattgctaataacaacgaccgattgggtaagagtctgtggacagaaggcggggaaggtgaaccgattgcactttactgtgctttcaatgaactggatgagtcacgttatgtggtcagccgtatcaagcattggttggataacggcggtgcactgaaagagtgtgcgatcctgtatcgcagtaatgcccagtcccgtgtgttggaagaggcgttattgcaggtttctatgccttaccgcatttatggcggccagcgcttctttgaacgtcaggaaatcaaggatgcgttgtcttacctacgtttagtatcgaaccgttatgatgattccgctttcgagcgtgtggtcaatacgccgacgcggggtatcggggatagaacgctcgatgttgtgcgtcaagtggcgcgtgatcagcagaaaacgctatgggaaagctgtctgctgctgcttcagcaaaaagtgttggcggggcgtgctgcatctgcattgcagcgttttattgaattaattgacgcgttggaaacggaaacgcaggagatgccgctgcacgtacaaaccgaccgcattatccgtgactccggcctgtgggcgatgtatcagcaggaaaaaggcgaaaaagcacaggcgcgtatcgaaaaccttgaagaactggttactgcaacccgccagttcagttttaaggatgaagatgaagacttgatgccattgcaggcctttttgtcccatgcggcactcgaagcgggggaagggcaggcggatgtttatcaggatgccgtacagttgatgaccctgcactctgcgaaaggtttggaatttccgcaggtcttcatcgtcggtatggaagagggaatgttccccagccaaatgtctcttgacgaaggcgggcgattggaagaagaacgtcgtttggcctacgtgggcgtgacaagggcgatgcaaaaactgacactgacttatgccgaaacccgtcgtttatatggcaaggcagtgtatcatcgcccgtctcgttttgtcggggaactgccgacggaatgtgttgctgaagttcgtctgcgggcaaccgtatcacgtccggtcagccataagcagctgggaacacctatcagtgccggcgacagtggttacgcacttggtcagcgtgtacatcatccgaaatttggtgaaggaacgattatcaatatcgaaggcagtggggaacattgccgcctgcaaatcgcgtttcaaggtgaaggtatcaagtggctggttgctgcttatgccagacttgaaacaggccaataa

SEQ ID NO: 2552 - DNA, 951 bp, Xenorhabdus bovienii
  Coding sequence Name=Xb4151_4152.C434.gene72.dna; Position on contig =57816..58766bp; Strand=+
atgctgaacgcatttaaattagagaataatcgcctgctccgtcttgagcttgaaaacggtgatcagttatctgactctatgtgggtagatttagtggggctgggagatgaagatcgtctccgtgttcagaatgaactggggcaagtactggcaacccgcactgaattggatgatattgaggcatcggcacgcttttttgaagatgaagatggtctgcacgtccactcattcttctactttgaagatgccgaagatcatgctggtaactcgacagtggcatttaccatccgtgacagtcgtctctacacactgcgagagcgtgaacttcctgcatttcgattataccgaatgcgcgcccgcaaccagactatggttgacgggaatgcctatgagctactgttggatttgttcgaaactaagatcgaacagttggcagatgtgattgaaaatatttacagcgtactggaatccctgagtcgagttatcatggaaggcaagcagggggatgaatttgactcagcgctttcaaaccttgccgagcaggaagatatcggctggaaagtccgtctgtgtctgatggatagccagcgcgcgctcaacttcctcgtgcgtcgcgcccgcctgcccgctaatcagcttgaacaggcccgcgaaatcctgcgagatatcgaatctctgttgccgcataacgaatccctgttccagaaagtcaactttctgatgcaggcggctatgggtttcatcaatatcgaacagagccgcattatcaaaatcttctcggttgtttccgtcgtattcctgccgccaacgctggtggcttccagttacggtatgaacttcgaatttatgccggaattacactggacatttggttaccctgcggccattggtgtgatgattgccgcgggattagcaccttacctttatttcaagcggaaaaactggctgtaa

SEQ ID NO: 2553 - DNA, 891 bp, Xenorhabdus bovienii
  Coding sequence Name=Xb4151_4152.C434.gene73.dna; Position on contig =58804..59694bp; Strand=-
atgactgaccaacagactgccaaaggcgttctatatgccttgggcgcttatcttatctgggggctggctcccatctacttcaagaccatacaacaggtaccgcccgatgaaatcgtgtcgcaccgtgttatatggtctgtgttctttatggtgctactgctaacgctgacacgccactggcgtaaagtgtgggtcgttgcccgtcaaccgaaaaaactgctactgttaggtatcaccgctttcactattgccagtaattggcttgtctatatctgggcagtcaataatgggcatctgctggaagcaagcctcgggtattttatcaatccactggttaacgtgctgttcggcatgatatttcttggcgagcgtttccgccggatgcaatgggttgcggtagggctggccttcaccggcgtattaattcagttatggcaatttggctctgtacccgtggttggactgtacttggcgatgacatttgccgtttatgggctgatccgtaaaaaattgggcgttgatgcccaaaccggcatgatgattgaaactgtctgggtatttccggtcgcgatggtctatcttctctgttttaccagcagcccaaccagcaatatgctagataacacgctatcactgaacatgctgttgattgccgcgggtatcattaccactgttccgctactgtttttcaccgcagccgctgctcatctgcgtttatccacactgggatttttccagtatcttggtccaacgctgatgtttttgctggcaacgctggtttatggtgaacaaattggtccggagcgcctgatcacgtttggttttatctgggctgcattgatcctgtttacgctggatgctctgtacacccagcaccgcttgcgcaagtag

SEQ ID NO: 2554 - DNA, 132 bp, Xenorhabdus bovienii
  Coding sequence Name=Xb4151_4152.C434.gene74.dna; Position on contig =59687..59818bp; Strand=-
gtggcaaaattttattcatccctcacagcattaaccccttgtaaatcattcatcccagtgacacattgtatgagtgctaacaattcacaagctcttctgattttattttacattcaaggatattatgactga

SEQ ID NO: 2555 - DNA, 93 bp, Xenorhabdus bovienii
  Coding sequence Name=Xb4151_4152.C434.gene75.dna; Position on contig =59846..59938bp; Strand=+
ttgtatttattaaaaaataattcactatatttatacaatctaactcatttttcatctcaaagtttgtgtgttcagaagtggattaaaaaatga

SEQ ID NO: 2556 - DNA, 177 bp, Xenorhabdus bovienii
  Coding sequence Name=Xb4151_4152.C434.gene76.dna; Position on contig =60202..60378bp; Strand=+
atggcaaagattgatgtgacctgcccatcttgttgtgcagttaaagggggtcaccgtaatgggcgctctcgctctggtcatcaacgttatctttgccagtcctgccgtcattcctggcaacgggaattcactgatgcgtctgatggcgctactggcatgaaatgcaaattattttga

SEQ ID NO: 2557 - DNA, 1167 bp, Xenorhabdus bovienii
  Coding sequence Name=Xb4151_4152.C434.gene77.dna; Position on contig =60461..61627bp; Strand=+
atgaaaaaaattatttttttagctataggtatgtttgctctagggtttgatgcgtatattatagcagggcttgtaccggggatcagtgaaacctatcaaaaaagcgcctctcaaatcggacaatctgtaagtatatttactttatgttatgcaatatcagccccactatttgcatctcttttagcaggaaaacctataaaaaaggttctattaaccgctatagtaatttttggacttgcaaacgcattaacggctctttccccaaatttttctgtattcttgatatccagagcgattgcaggtgttggtgctggtttgttttcaccattagctgtagccggctcgactctgttggttcctatagacaaaaaaggaagagcacttggcctaacaataggtggaatgagcatgggaactgtgttaggtgttcctataggtctttatatcgccgaccaatttaattggcaatctgcaatgtggtttgtcgttattctgagttttattgctgcgttaagtattctaaaatttctaccacacgttccagtcacagcaccacctgcaataacagaaagaatcgcaatgtttttggataaaagggtcacaatcactgtactaataacattttttgcaagtattgcaagtttaggcttatacacctatttatctccattattacaagacattaatgattcaaataatttaacaatgtatttatgggcttggggtctggggggattatttggaagtttatcgattggatatataattgactactttaagaagccaaaaattttaatggcatttatattaattattttaatgatttctgtcatgtgtattccgataatgattaatctatcatttataaaatatttaccgttctttatatggggtgctatgggatgggcatcaggggcacctcagcaacatattttattatcttatcaacctaaacacggaagtgctgccatagctctcaatagttcgattaactacctaggaagctcggtaggagcgataataggtggagtagttatatctctgggaatgggaactatggttttaatctatttcgcggtattttctatggtaatttcattaggtcttcaattttatagtatgaaaagcaatgattttaaaataattaatactgaatccagccaataa

SEQ ID NO: 2558 - DNA, 240 bp, Xenorhabdus bovienii
  Coding sequence Name=Xb4151_4152.C434.gene78.dna; Position on contig =61660..61899bp; Strand=+
gtgccatttaaaatgagaaaattcacgtatggtgattttatcaaaacacgcggaatatttagattgttttataataaaataaatgactttatttttctcctctgggagtcaataaaaagtatcacccaaccaaatacgtcgccattgcgctggcgatatgcacctgccgctcattgtgcagttcaattctggcaactgatactttgttgccactacggacgatattgctgctggcggtga

SEQ ID NO: 2559 - DNA, 486 bp, Xenorhabdus bovienii
  Coding sequence Name=Xb4151_4152.C434.gene79.dna; Position on contig =61781..62266bp; Strand=-
atggaaacaatacagcgatcaacccagccattaacacaggaagaagcccgtaagattattggtgatttatttgtttatcacatgccattcaaccaattgctgggattcgaattactccgctttgatcacgactatgcagagcttcaatttcgcaatcaagataagctggtcggcaacatggcccagaaaatcctgcacggtggcgtgattgcctcaatattggatgttgccggtggcctgatttgcgcaggcaacgctctgacggcaatggaaaccatcacgatagcagaaatggaaaaacgcctgccgaccatcggaactattgatttgcgtattgattatctgcgtccgggacgcggtgaagtgttcaccgccagcagcaatatcgtccgtagtggcaacaaagtatcagttgccagaattgaactgcacaatgagcggcaggtgcatatcgccagcgcaatggcgacgtatttggttgggtga

SEQ ID NO: 2560 - DNA, 132 bp, Xenorhabdus bovienii
  Coding sequence Name=Xb4151_4152.C434.gene80.dna; Position on contig =62319..62450bp; Strand=+
atggttaataatttgttaagtttatgcttttataactcatcttaccagtttgcgaagcacctcgaaaaacaatttattgaaggaaaacttactacagaaaatcaccattcagtgtgtagaataaacaggtga

SEQ ID NO: 2561 - DNA, 138 bp, Xenorhabdus bovienii
  Coding sequence Name=Xb4151_4152.C434.gene81.dna; Position on contig =62420..62557bp; Strand=-
atggtgtcgatgccaaaacggatcttcccgaaatcatcatcgatcatggattctccatatccactgaaatcactgggtataaaaacggctatcccaaaactaaaacgtcacctgtttattctacacactgaatggtga

SEQ ID NO: 2562 - DNA, 117 bp, Xenorhabdus bovienii
  Coding sequence Name=Xb4151_4152.C434.gene82.dna; Position on contig =62574..62690bp; Strand=-
atgacttctgcggtagacacgccttccctcaatcatttaaaaaaaacaggcagtaaaaaatacagacgcgattcaggtgcctgtacatactatgctatctcactgttgaaacaatga

SEQ ID NO: 2563 - DNA, 1839 bp, Xenorhabdus bovienii
  Coding sequence Name=Xb4151_4152.C434.gene83.dna; Position on contig =62659..64497bp; Strand=+
ttgagggaaggcgtgtctaccgcagaagtcatcagcacggcatcgctggctgaacaagtattacgaaaaacattcggatatcagcaatttcgtcccggacagcagcaggttattgatgctgttctcgatgggcgtgattgtctggtcgtcatgccaaccggtggcggtaagtcgctgtgttaccagatccctgccctgatcaacaatgggctgacgttggtggtttcgccattgatctcgctgatgaaagatcaggttgatcaactgagggcgaacggcgtagaagcggaatgtttgaactcaacccaaaaccgtgagcagcaggttgatatcattcaacgctgccgtcaaggaagcatcaagcttctctatatcgcgcctgagcggctggtaacagataattttctcgatcaattgcatgattggcaccctgtgctgctggctgttgatgaagcacactgtatttctcaatgggggcatgacttccggccagaatatcgcgcgctggggcaatttcgccgacgctttcctgaacttccatttattgcactgacagcaacggcggacaaaacaacccgtcaggacattactcgcctgctggaactgcacgatccgcttatccacctcagcagttttgatcgccccaacatccgctatacattggttgagaaatataaacctctcgatcaactatggtcatttgtgcgtggtcagcagggaaaaagtgggatcatttactgcaacagtcgaactaaagtggaagaaaccgctgaacgcctgcaaaagcgggggctgagtgttgccccttaccatgctgggctggataacaatcaacgggcatgggtgcaggacgctttccagcgtgacgatttgcaggtcgttgtggcaaccgtcgcttttggtatggggatcaacaaacctaacgtacgttttgtggtgcattttgatattccgcgcaatatcgaatcctattatcaggaaacaggcagggcggggagagacggcctaccggcggaagcgatactgtttttcgatccggcggatatggcatggttgcgtcgttgcctggaagaaaaaccggcaggtgagcaacaggatattgaacggcacaaattgaatgccatgggcgcatttgcggaagcccagacttgccgtcggctggtactactcaactattttggtgaaagccagcagacatcatgcggcaactgcgatatttgccttgatccaccaaaacgttacgatggtctgatggatgcgcaaaaagcgctttcctgtatctaccgcgttggacaacgttttggtattggctatattgtagaagtattgcgtggtgcaaataaccaacgcattcgtgattttggccatgacaaattgcccatttacggtatcggtaaagaacagagtcaggaacattggatgagtgtcctgcgtcagcttgttcatctgggattgattagccaaaatatagccaattattcggcgttacaattaacagaagcggcacggcctgttttgcggggagaagcgtctttacaacttgcggtaccacgtatccaaagcctgaaaagccggaatcagcaaaacaaatcatacagtggcaattatgatcgtaagttatttgccaaattgcgcaaattgcgtaaatccattgctgacgaaaataacattccaccttttgtcgttttcaatgacgttacgctgattgaaatggcagaacaatgcccgataacacctaatgagctcctgctgattaatggtgttgggcagcgtaaactggagcgttttggcgatgttttcatggcgctcatccgtgatcattttgaaggttttgaataa

SEQ ID NO: 2564 - DNA, 1011 bp, Xenorhabdus bovienii
  Coding sequence Name=Xb4151_4152.C434.gene84.dna; Position on contig =64525..65535bp; Strand=+
atggcgcctgagatattgaaagcaagctggttaaaccgcgaacctcagttctctgcgtttacgaatggactattactggatttctggaaaaccagagacgaacgggaatttatgggtgttgatgatatccctattcgttatgtctctttccgttctctccatcacgataaaacgttgttgatcctgccgggccgcagtgaaagctatgtgaaatatcctgaaatagcctacgatttttaccacttgggctacgacatttttattattgatcaccgtgggcaggggcgttcagggcgaatgcttgatgatccccaaaaaggccacgttgaaaaatttgatcactatgtggatgatctagccaaatttgttgaattggaaattaccccgcgtcagtctcacggttattatgcgttggctcattcaatgggagccgcgatcctcagccgttttctattacggcaagaacttgtacgtcaagagcctgattttcgggcggtagctctgtgtgcaccgatgtttggcatcaacttaccgatgccgcgctggttggcaaattttctggtcaatcaggctgaaccttatcctaaaaggcgtaacagctacgcggtatcaacagggcagtggcgtccgttgccctatcttatcaacctgttaacccacagttatgcacgttatcagcgctatttacgctattatgccgattatcctgaattgcgcctcggagggccgacttaccactggatgcgtgaaagtatgcaaatgggagacgaactgattgaaaatgcaggggtaattcagactccgcttattgttttaaaagcgagtgaagataagatcgttaataatcgggagttactggcattttgtgaatctcgacaaaaagccggaacaggaaaagcaggaagaaaacctctggtcatccaaggggcacatcacgaaatcctgttcgaaaaagatgcattgcgggcgcaggctcttaatgcaatttgtgatttttttgaccagcactga

SEQ ID NO: 2565 - DNA, 801 bp, Xenorhabdus bovienii
  Coding sequence Name=Xb4151_4152.C434.gene85.dna; Position on contig =65557..66357bp; Strand=+
atgtatcatgttgttgcttcagacttggatggcacattattgtctcctgaccacaaattaacgccgtataccaaagaaacgctgaatttactgatgaataaagggattcactttatttttgcgacaggccgtcatcatattgatgtagggcagatccgcgatggtttgggcattgatgcttatatgattacctctaacggggcgagggtgcataatactcagggaaaattggtattcagccataatctggcgcctgagattgctcttgatttgtgcttaatggagttcgataaccctaataccctcaccaattattaccgtaatgatgattggttcattaaccgtgaaagccctgaacagaatgagttttttcaggaatctgtttttcagtatcagatttttccgcgtgataatttccccacggatggcgtgtgcaaggtctattacgttagtgaagatcatgactatttggaacagttggaagaaactattaaagcgcgttggggagatagcgttaatgtcagcttttcactgaggaattgtctggaagtgatggcgggtggtgtatctaaaggccatgcgctggaacaagtctgtcaggccatcggatatcaattgagtgactgcattgtttttggtgacggcatgaatgatcaagaaatgttatctgtggcgggtaaaggctgtattatgcagggcgcacaccaacgcctgaaagacatcttgcctgaaatggaagtgattggcgctaatgctgatgatgccgtttcatactatttgcggaacatgtatcaagtctga

SEQ ID NO: 2566 - DNA, 117 bp, Xenorhabdus bovienii
  Coding sequence Name=Xb4151_4152.C434.gene86.dna; Position on contig =66305..66421bp; Strand=-
atggccagaaaaaaacagcaccccatcaggtgctgctctcaatcaacattccgaaccattaccatcagacttgatacatgttccgcaaatagtatgaaacggcatcatcagcattag

SEQ ID NO: 2567 - DNA, 150 bp, Xenorhabdus bovienii
  Coding sequence Name=Xb4151_4152.C434.gene87.dna; Position on contig =66750..66899bp; Strand=-
atgcttaaaatcggaacaaaagccagtaaaaaccaccaaccggagcgattagtatcatggagacgacggatcaccactgcaagtgaaggaataaaaatcactggcgacgttttatcatctggactcaggatacaatggagtatgagctaa

SEQ ID NO: 2568 - DNA, 156 bp, Xenorhabdus bovienii
  Coding sequence Name=Xb4151_4152.C434.gene88.dna; Position on contig =66823..66978bp; Strand=+
gtggtgatccgtcgtctccatgatactaatcgctccggttggtggtttttactggcttttgttccgattttaagcatcgcgttattggtattcttctgcttggaaggatctaaaggaaataacgattttggagcagatcctaaaggaatgctttaa

SEQ ID NO: 2569 - DNA, 102 bp, Xenorhabdus bovienii
  Coding sequence Name=Xb4151_4152.C434.gene89.dna; Position on contig =67057..67158bp; Strand=+
ttgctaaacgtagttttctcgctcaataaatgtccctatcactttgtcatgcatctcttccgatttagagtagccgattgtttttctattcagcctttttag

SEQ ID NO: 2570 - DNA, 201 bp, Xenorhabdus bovienii
  Coding sequence Name=Xb4151_4152.C434.gene90.dna; Position on contig =67188..67388bp; Strand=-
atggctaaagttgacgttcactatcgttattgtcacaaaccagaagacgtaaaaggacatggaaaaggaaatgaagggtattcccgttatcgcttctgtccccccttaacattcggttccactgcacggatgattatgctgtttatcattgccctctggaagaaaaccatcttgttggaaagatgtttacccaacgaatag

SEQ ID NO: 2571 - DNA, 144 bp, Xenorhabdus bovienii
  Coding sequence Name=Xb4151_4152.C434.gene91.dna; Position on contig =67387..67530bp; Strand=+
atgtttcaccataaaaaggctggagttatcacaacaactaaccattcaatacatgaccccatttccctcctatcagttgtagcctcagttgaattttcaggatcaaatcaagatctgtgtataaaattttgggtaagtccctaa

SEQ ID NO: 2572 - DNA, 282 bp, Xenorhabdus bovienii
  Coding sequence Name=Xb4151_4152.C434.gene92.dna; Position on contig =67551..67832bp; Strand=+
atgatatcgaagactatagttttatctgcattgatcgttttcagtatgagtgctgcctatgcaagccaagagaagacgggatgtgaaataaagaaaaaaacactggagaaacaacttaaatacgcacaggcagatggagataaacgcctgattgcaggattgacgcgcactttagaaagtataaaggccacttgtgagctggaaaaacgcttaaaatatccacaacacaacccagagccgacaaaagatagacttaaaaaagtgcagaccaagaagaaatag

SEQ ID NO: 2573 - DNA, 537 bp, Xenorhabdus bovienii
  Coding sequence Name=Xb4151_4152.C434.gene93.dna; Position on contig =67877..68413bp; Strand=-
atgatgtttgtccatgttgccaacaagaatattattatcatatttgcgttaatattgggaatttccattgtatttttatcttttaataacagcaggttgagtcttattggttatgttgataaacattgtcagaagaatacggcctgtttgatcgatgtgaataaaatcacgtcttttgattgggataaaatgtatatcatcgataaaggaatgggtcgtgaggatattgaatatatcatcggtgcagcatttacggggaaagccagtcttttttataaaattatctttgttaaaaatcagaaggtgatttattcggatgaatattacccccatgcagagtcttacgagaagaaatttcttaaacccgattttaattatccttatgatgtaacaggaaatgattttatctattatgcgatttccagagataactcgatcctttcggtggaaattgaaaataagccatttatgggcgataaagtttattacaaaatctccccttctaatgcacagcaagtcaggggaagaagcttgtag

SEQ ID NO: 2574 - DNA, 93 bp, Xenorhabdus bovienii
  Coding sequence Name=Xb4151_4152.C434.gene94.dna; Position on contig =68399..68491bp; Strand=+
atggacaaacatcattcccccttcataatcaaatttgatatgagaaaacggtttttagaattttacccttggcaatcaactcattactattaa

SEQ ID NO: 2575 - DNA, 147 bp, Xenorhabdus bovienii
  Coding sequence Name=Xb4151_4152.C434.gene95.dna; Position on contig =68638..68784bp; Strand=+
ttgctacattacttacaagcaactgttttacaattgctatttaatcttttaagtgcaacttacaagataaaaaattcaaccccctttttgttcttcctgcatttaaagaacactatcatcggtgctctatacagcgaaaaagtatag

SEQ ID NO: 2576 - DNA, 249 bp, Xenorhabdus bovienii
  Coding sequence Name=Xb4151_4152.C434.gene96.dna; Position on contig =68859..69107bp; Strand=-
ttgtgtttgggggcttgtcagggcaatgatttttcgtataatgcgctccccgtaccgatgaagaatttcaacagtacggcataccgaaagtattacaccaaaagtaccatacatcgatatgtaagcgggaatagctcagttggtagagcacgaccttgccaaggtcggggtcgcgagttcgagtctcgtttcccgctccaattcttattatgtaaacctccacgcaagtctgctttcctttcacattag

SEQ ID NO: 2577 - DNA, 120 bp, Xenorhabdus bovienii
  Coding sequence Name=Xb4151_4152.C434.gene97.dna; Position on contig =69137..69256bp; Strand=-
ttgctgagttggtttactaccgcgagcactttatccagaaataaaaagtgtgtttggtgcacgaggtttacgataattaatctctggattgatgatgaaacagatttcttgctgatttaa

SEQ ID NO: 2578 - DNA, 546 bp, Xenorhabdus bovienii
  Coding sequence Name=Xb4151_4152.C434.gene98.dna; Position on contig =69213..69758bp; Strand=-
atgtcaaaaagtgagaacaatcttatctggatagatttagagatgaccggtttggagccagagcgcgatcgcataattgaaatcgcgaccattgtcaccgactcggaactgaatatccttgcggaagggccggttattgcggtgtatcagcctgatgaacaactggcattgatggatgactggaacgtgcggacgcatactgcaagtgggctggttgagcgagtgaaacaaagtcagtttggtgatgcggaagcagaaaaagcgacgattgcttttctggagcagtgggttcctgcgggaaaatctcctatttgcgggaatagtgtgggtcaagatcgccgttttttgttccgttatatgccagagttggagaaatattttcattaccgctatctggatgtcagtacgctcaaagaattggctcgccgctggaagcctgaaatgttgtcgggattcagcaagaaaaatactcatcaggcattggacgacattcgggaatcaattgctgagttggtttactaccgcgagcactttatccagaaataa

SEQ ID NO: 2579 - DNA, 1071 bp, Xenorhabdus bovienii
  Coding sequence Name=Xb4151_4152.C434.gene99.dna; Position on contig =69870..70940bp; Strand=+
gtggctaagaataaactctccaaagggcaacaacgccgtgtgcaggccaatcaccagcgcaggctgaaacagccgctcaacaaggctggcactcataaaccagaaatggatgacagcctgtttggcgagccacaggaaggactggttatcagccgattcgggcagcatgccgatattgaagccgcagatgcgtccatacagcgctgcaatattcgcaggacaattcgttcactggtcacgggtgatcgtgtcgtatggcgacccacattacagctccaaactgatgtcaaggtcaatgggatcgtggaagctgtgcatgaacgcacctccgtccttactcgccctgattactacgatggcattaaacccattgcagccaatatcaaccaaatcatgattgtttccgccatcttgcccgaactttcgctgaatattatcgatcgttatctggttgcgtgtgaaacacttaatattgagcctctgatcgtgctcaataaaatcgatctgttggatgccgaaagccgtgcatgggtcaacagtgtcatggatatttaccgccacattggctatcgcgtactggaagtttccagccataccggagaaggcgtatccgagctggtttcccagctggtggataaaatcagcatctttgcggggcaatctggggttggaaaatccagcttgctgaataccctgttaccagacaatgaaaaagatattctggtcaatgaagtatcggataactccggcctgggtcagcatacaaccacaaccgcacgcctgtatcacttcccacagggaggcgacgttatcgactctccgggcgtccgtgaatttggattatggcatttaacgccagaacaggtaacacaaggtttcattgaattccgtgaatacattggcgaatgcaaattccgtgattgcaaacatcagactgatcccggatgtgccttgaatgcagcactggagcagggagcaattgcagaagagcgtttcgaaaattaccatcgaattttagaaagtatggcgcaggtcaaaccacgaagaaatttcacggatggccaaaaataa

SEQ ID NO: 2580 - DNA, 987 bp, Xenorhabdus bovienii
  Coding sequence Name=Xb4151_4152.C434.gene100.dna; Position on contig= 70980..71966bp; Strand=+
atggcgggtacaatagtagacttttgcccaatttgcctatcaaaaatccaagaggttgatgtgctggataatattaaaattaaattgcaatatttactgccaaaacaatgtattactaatttggcaggctggttcgccaataaaaaggcgggctggttgacacagtttgcaattcaatctttcgccaaagtctataaagtagatatgaatgaagccgaaaattcttcattcacagcttactcaacattcaatgaattttttgttcgcccattaaaagagggcattcgtcccatcgtcaatgaagctcaccagttggcgctgccagcagacggaaccatcagccagctcgggatgatccgtgacgatcaaattattcaggctaaaggtcactactataccgtagaagctctgctggccggccagcatcaacttgctgaacagttccgcaatggccatttcgtcacaacttacttatcacccaaagattatcaccgtgtccatatgccgtgtgacggcgtactgcaagagatgatctatgttccaggcgagctgttctcagtcaatccattgaccgcagcaaatgtccctaatctgtttgcacgtaatgagcgggtcatctgcctgtttgatacagctttcgggccaatggtacagattctggttggtgcaactattgtcggcagtatcgaaaccgtctggagcggctgtgtcacccccccgcgtgaaggcatcatcaagcgttgggcttacccagcagcaggtcaggaaggcgcgatttctctcaagaaaggagaagaaatggggcgtttcaaactgggttcaacggtgatcaacctgtttgcacccaatcagattcaatttgccaataatttatacagcggctcacaaaccctgatgggtgacctgttggcacagtctgttacggcaaatgaagagcaggcagcaaatgcagatgatgaatctataaacaaagatatcatcagctaa

SEQ ID NO: 2581 - DNA, 3345 bp, Xenorhabdus bovienii
  Coding sequence Name=Xb4151_4152.C434.gene101.dna; Position on contig= 71993..75337bp; Strand=+
gtgcgcctgattatcagtttacttttcagcctgtttcttgcgaatccggctttcgcttcgatagcacagttggatgaaacccaactgaaacaagagctaaaacaggttggaggcagtaaaaatccacaggatgctgaaatcgcacaggcacttcaaggggcaataaactggcttaacgatgctaagtccaccgatgaacgcagccagacataccaacaaactattgatgattttcccaagatcatcaaagaattgcgtcagaaaactcttactgaaagtgatattgtcccttccattccggccaatcagtctatcggcgagttagagcagcagactctccagaccagtagccagttgttggagcaagagcgtcagctacagcaggaacaggataagatccgggaaatcagtgattcaatgaacctgttgccccaacagcaggttgaagcgaggcgtctgctggcggtggcaacttcccgcctccaatccttgggtacgcctccgacaccgctgaccgaagcacagctgaaactcgctcaagccgaagtcagtgcccgcaaagcggtcactaatgaactggagatgtcacagctttctgctaataatcggcaggaaattgcccgcatgcgggcagatttatttaaaaaacgttatcaacgtctggatctcaaactccagcaattacgcaaccaattaaacattcaacgccagcaaaaagcagaatcggctcttgaacataccgaaatgctggcagagcaggcgggcggaaaactaccgcagtttttgttggatgagctccatcaaaaccgccagctgtcacaactgctcagtcaacaaacccaacgcatggaggccattggctcacagcaacgcaaagctgctaacgatattctgcaagtacgccgaacactcaataccatccgtgaacaggcggaatggctgagtgattcaaccgcacttggtgaagcattaagaactcaattaacccgcatccctgatgtgccgaaataccagcaacttgaccgaaatattgtggaattgcgggtcgaaagactgaaatatgaggaaatgcaggagcgctcccaacaggaaaatggtcaggcattgccttcatctcaaagcctgacatcagggcagaagcaggtctatgaatctcttatccgtaccagaaaagagttattgaattccctgctttcaggttatgacaatgaaatattggaactcacgaaactcaaagtcgcaaccaaccagttaaatgaagctttaaaagagataaaggatgccacccatcgatacctgttctgggtcacggatgtcaatcctatttcactagactatccgttgcttgtcgttcaggctctgacacggctgctctctctggatacgttatctcagctaggggtcgcaattcacgttatgctgaccaccaaagataccctgctctatttactgggtacgctattgctggtgattttcagtatcagctcacatcgtcaatatcatgcgttccttgagcgttccagcaaccgtattggcaaagtcacacaagatcatttctcccttaccctgcgtaccgttttctggtctattgtcgctgcattacccctgccgatactttggtcagccattggttatgggctgcaaaatgcatggcagtacccgatggctaccgcgattgggctcggtgtcagtgagacaacgccagtcctgtgggttttcatgctcagtgcggcatttgccaatccgaatggtctgttcatctcccacttccgctggcctgaagaacgcataaaacgggcaatgcgtttttatcgtctgtctattttcttgatcgtgcctctcatgatggcattgatcacattcaataattatagtgagcgcgaatttgccgcgacactcggcagactgtgtttcctgatgctgtgcgtttccctgagtctggtgaccagcagcttaaaacgcgccggagtaccgctgtatatggacaaacacggcgcgggcgaaaatatcatcaactctgttctgtggtggatactgctatctgccccgatcttggccgctcttgcggctatactcggctatctgcaaacttcacaggcgctgctggggcgtttagaaacctctgtcgccatctggttatccctgctggttatctaccatattattcgtcgttggatgctgatccagcggcgaaaactcgcctttgagcgggcaaaacaacgccgtgcagagatcttggctcaacgcgctaaaagcgaagaagagacggctaatattaatagcagcgtggaaggctccattgaagttgaagaacccgtgatcgatctggatgccatcagcgcccaatctttggggctggtgcgctcgatcctgacgatgattgcgttggtttcactgattctgctgtggtcagaattacattctgctttctcttttctggagaatatccggttgtgggacgtcagcacgacggtcaacggggtcaataccatccagccaattaccatgggatcagttctgattgcgatcttagttatcgtcatcaccacgcagcttgtccgcaacctacccgcgctactggaacttgccctgttgcagcatcttgaactcacaccaggcacaggttacgccatcacgacactaaccaaatacggccttacattgattggtgggattgtgggtttctcactggttggtattgaatggtcaaagcttcaatggctgattgctgcgatgggtgtgggtctgggttttgggttacaggaaatttttgccaatattatctctggcctgattatcttgtttgaaaaacccatccggattggcgataccgtcactatccgtaatttgactggcagcatcacgaagatcaatacgcgggcaacaacgctgtcagactgggacagaaaagaaattattgttcccaacaaagcatttattaccgagcaattcatcaactggtcactgtctgacacgatcactcgtatcgtcttaacaatcccagtgccggctgaaactgattccgcagaagcgactgacatattaatgaccgcatccagacggtcaccattaattcttgataacccgatgccagaagtgtatctggttgatttacaaaacggtattcaaatttacgaattgcgcgcttacgcagcggagatggggcatcgtatgcccgcccgccatgaagtgcatcaatatattttgcaggagttccacaaacatggcattaccttgccattcccgccatttcaggcacgtgttgatatcttcggacaagaaatccgcagtgccacaaccaatatttcgggtcgcaatccaccgcgtaaaccgggagaactataa

SEQ ID NO: 2582 - DNA, 1206 bp, Xenorhabdus bovienii
  Coding sequence Name=Xb4151_4152.C434.gene102.dna; Position on contig= 75350..76555bp; Strand=+
atgatgaggcgtataccttttcagataagtggattactggctttaaatggcgtttcgatcttgggaaacgccattacagatattgccattccgtggctgattctagaaatatcaggcagcccactgctggtcgcagccgtgatgtctgccaaaatagtgccgttgatattatccattttctttagcgcacaactagtagataaatacggagccttccgtatttcagtcttatctgatttggtgaacttcctgagcgtcttgctgatacccgtattttatacaatggatatcatgcacttttacctgttagccattctgcttatattctcgacaattttagattctccgggacgtttagcaaaagacgtaatgctggcaaaggagattaaacagaataaaagtgaacatgagttgatcaatggaatcaacagtaccattgaaaatatttgtgacctcactggacctgtattgggttcattgattattgccctgttcggtacaatcaacgccctatacttcgatgcagtcagttttttagtggttgcgctggggctgattattctgaagaaacactttgtcaccaatatcaatgaagttactgagattccttctctgccacaccactatttcctcgaagcactcaaatacgttaagtcagaaaaggaactgttttctattcttatcctgagttcagtggtcaattttgtcatcgctccattcctgatcgtttatttaccttatgtgaataaagtcgagtttaattccgtcgtcagccttggtgtttccatgacctgctttggcttaggcacaacgttttcttccttactgtacggtatttacggcaaacattttgccaacaaccatattatcctttctggctacagtctgtttgtactgtgtttgataaccctaagcctgctcagtgggcaatatattctttttgcccagctatttgctatcggctgttgcattggttttaccgcacctgttgaagtcactttaattcagcgccaagtgccagagaatctgtttagccggataataacgctgttttcttctacgcgctttcttgccgtgcctgtcgggtacgtctgttttggtactctgctgggatccagccttaccaaacaaacaccgttaattatggcaacaatagtattgggtggtttattggcttatctggctatgcatggaagggtgaaatga

SEQ ID NO: 2583 - DNA, 342 bp, Xenorhabdus bovienii
  Coding sequence Name=Xb4151_4152.C434.gene103.dna; Position on contig= 76552..76893bp; Strand=+
atgaagacaactctttttcaaattgacaaactattacaacaccatgtgtctttacccttataccgccaaatataccagcgttttattcaggcgattaatcagggcatattgagacctgaacaacgtgttccgtctattcgtacgttatccagtgaactgcaagtttcacgcagtacagtggaatctgcctatacgctattactgaacgaaggctatctagagtcccgagggcaggcaggtacgattgtgtccccaaagcttgcggacagagtattacagcctcctgaaacacttatatcatcgtctatcgatgtgactaggtcgtgtcccttaattatataa

SEQ ID NO: 2584 - DNA, 957 bp, Xenorhabdus bovienii; identical to SEQ ID NO: 1679
  Coding sequence Name=Xb4151_4152.C434.gene104.dna; Position on contig= 76976..77932bp; Strand=-

SEQ ID NO: 2585 - DNA, 141 bp, Xenorhabdus bovienii
  Coding sequence Name=Xb4151_4152.C434.gene105.dna; Position on contig= 77925..78065bp; Strand=-
atgcagtcagataaccatcaagggattaagcccgttaatgagctttcgacgcatgattgtgacttttcttcgagaaacccgaacagttgcttgaaacacaattcgtatttgcaagaatgggagccgaagaaccatgactaa

SEQ ID NO: 2586 - DNA, 150 bp, Xenorhabdus bovienii
  Coding sequence Name=Xb4151_4152.C434.gene106.dna; Position on contig= 78071..78220bp; Strand=-
atgtttgccgagatcgataccgataattgcaacagtgttcatgataatggcctctttaaaaagaatcactctgtcagcatactcctacagggtgagggtgaccatcttgtatctttaatctggtttattatggttaagttagattggtaa

SEQ ID NO: 2587 - DNA, 1008 bp, Xenorhabdus bovienii
  Coding sequence Name=Xb4151_4152.C434.gene107.dna; Position on contig= 78179..79186bp; Strand=+
atgaacactgttgcaattatcggtatcgatctcggcaaacattcatttcacgttcattgtcaggataaacacggcaaagccattctccgtaagaaattcacgcgaaacaaattatttgaattcttaggttcaacaccatcgacgtgtattgtgatggaagcgtgtgcaggagctcattttatggcaagaaaaatgagtgctctcggccatgaagcgaagctgatttcccctcaatttgtccgcccttttgttaaaagtaataaaaatgattttattgatgcagaggccatctgtgaagccgcatccagaccttctatgcgatttgttcagcccagaccagaagctcaacaggcgatgagagcgttacatcgagtcagggagtcactgattaaagataaagtaaaaaccaccaatcaaatgcatgcttttctacttgaatttggggtcagtatgcctaaagggattgccattataagaaggctttcgggtgtattagcagagaatgaactccccccatacttagttcagttattgatgcgtttacatgcccactatctttacttggttgagcaaattactgagcttgaaaatgaacttactcaagagctttttcgtgatgatactagtcaaaggctaatgactattccggggataggaccgataactgccagtgttttatcgtctcaattaggtgatggcaagcaatatgctaaaagtcgggattttgcctcatcaacagggttggttcctcggcaatacagtacaggaggaaagaataccctgatggggatcagtaaacgaggagataaaaatttacggcgtttattggtgcaatgtgcccgagtctacatacagcggctaacacatcaaacggggcgactggctgaatgggtaaaaaatcagcttcaaaaaaaacactcttgtgtggttgcttgtgcactcgcgaataagttcgctcggattgcttgggcaataacgacccaacgaactgagtttaatccatcctga

SEQ ID NO: 2588 - DNA, 144 bp, Xenorhabdus bovienii
  Coding sequence Name=Xb4151_4152.C434.gene108.dna; Position on contig= 79308..79451bp; Strand=+
atggctcatagaagccgggcggtttttaaaggagtatcaggcgcggaactcattgaggcgcgggcatccttgcccatattgacgccggatagatttaagcaagcccatcataaatcaaaatcagtgttgcaaaaaagagggtga

SEQ ID NO: 2589 - DNA, 144 bp, Xenorhabdus bovienii
  Coding sequence Name=Xb4151_4152.C434.gene109.dna; Position on contig= 79524..79667bp; Strand=-
ttgccaatacctttcgttcctccggaaataaacgcaattttgtcctttaagttaaacatggtcgtttccctttatatgagtggatacagtatttttgttacaaacaatataatttttcaatatatttttaataatccaaactga

SEQ ID NO: 2590 - DNA, 750 bp, Xenorhabdus bovienii
  Coding sequence Name=Xb4151_4152.C434.gene110.dna; Position on contig= 79609..80358bp; Strand=+
atgtttaacttaaaggacaaaattgcgtttatttccggaggaacgaaaggtattggcaagggtattgctcaggtatttaagcgagcgggtgccattaccattatttccggtactaacagggcaagaggcgaggcgattgcaaaagagctggatattgattttattcctcttgatgtgacggatcaggcggcatgcaaaaatgtgattgatgagattgtcgaaaaatatggcaggcttgatattctgtgctccaatgctggtatttttccgcaacattatcttaaagacatgactgctgaagattgggatttagtgaatactgtcaacctcaaaggaacatttttattggttcaggctgcattgaatgttatggagaagcaacattatggccgggtcgtgcttacatcatcggtgacaggggagatgacaggtattccgggttacagccattatggtgccagtaaggcgggtcagttgggatttatgcgcagtgcggcgctggaatatgcaggtcagggtatcaccattaatgccattatgccgggtatgattatgacagaaggcttaaaggcatttggtgaagattatctacagcatgttcaatctacaacgccgatgcgcgttttagggttgccggaagatatcggctatacggcctgttttcttgcctccgacgaagcaaaatatattaccggacaggcgattgtggttgatggcgggcagatactgccagaagtgcagggtgcttaa

SEQ ID NO: 2591 - DNA, 141 bp, Xenorhabdus bovienii
  Coding sequence Name=Xb4151_4152.C434.gene111.dna; Position on contig= 80297..80437bp; Strand=-
ttgggtgattatcttatctttttcttctgccttacggcaatggtggaaaagaaaaaacggtttttatcacatcaaggtcttaagcaccctgcacttctggcagtatctgcccgccatcaaccacaatcgcctgtccggtaa

SEQ ID NO: 2592 - DNA, 681 bp, Xenorhabdus bovienii
  Coding sequence Name=Xb4151_4152.C434.gene112.dna; Position on contig= 80505..81185bp; Strand=+
atgtcactgaactatgaacgtaacccgcttccgctaccaaacggacacaataaagtgttattgcactcgtgctgtgctccctgttccggggaggtgatggaggctatgctggcttcaggaattgatttcacgatatttttctataatccgaatattcatcccctaaaagaatatgaattgcgcaaagatgaaaatattcgttttgcggagcagatggggatcccctttattgatgctgattatgatcgtgataactggtttgaacgtgcgaaaggcatggaaaatgaacctgaacgcggtattcgttgtaccatgtgttttgatatgcgtttcgagcggacagctctttatgcttatgaacatggttttcctgttattagtagctcgctgggtatttcacgctggaaaaacatgcaacaaattaatgaatgtggcgtccgtgcagcttcccattaccccgacttaacctactgggaatataattggcgtaagggcggcggttcttcccgcatgatagaaatcagcaaacgtgaggagttttatcagcaggaatattgtggctgtgtttattccctgcgggataccaaccgacatcgtttatcgaccggacgggaaagaataaaattgggtacagtattctatcaagcggaaagtgataaaaaagatcacgaatcaaattga

SEQ ID NO: 2593 - DNA, 198 bp, Xenorhabdus bovienii
  Coding sequence Name=Xb4151_4152.C434.gene113.dna; Position on contig= 81157..81354bp; Strand=+
gtgataaaaaagatcacgaatcaaattgacgttcaaggttatactctctattcattgttagtacacacacctgccagttattgctatgtgactgacaggtgttttttatgttattattttattttattttattttattttattttattttattttattttattttattttattttattttattttattttatttttaa

SEQ ID NO: 2594 - DNA, 123 bp, Xenorhabdus bovienii
  Coding sequence Name=Xb4151_4152.C434.gene114.dna; Position on contig= 81340..81462bp; Strand=-
ttgaattattgcactatatcattcttttctatgaaaaataaaccaattgtattattaatgaatataatgtcaatcctgtgtcatttgaattcatcactgagttattatttaaaaataaaataa

SEQ ID NO: 2595 - DNA, 993 bp, Xenorhabdus bovienii
  Coding sequence Name=Xb4151_4152.C434.gene115.dna; Position on contig= 81598..82590bp; Strand=+
atgaagaaattttgtcgttggattaaaatactgcctattatctctgtttttttgcttattgcgtgtgatgaagagaattacagttttaagttacgtaaagataattatgcagaggctcatactaaatttaaaaccaatattgttgatgaaagttttatcggagatggaaaacccgctactccaccaaaggatatcttttcattggtgtattatcctgctgatgatggtgatatggctgcgtttctcagtgctccaccgttaaataatgacaaaaaatatcccgcagtgatttggttgatagggggatacggtggtattggcaatagtgattttttctggtctgaacagcccgaggataatgatcaatcagcctctgcattccggcgtgatgggttggtattgatgatacccagttttcgtggtgaaaatgttaatcctgggcgctatgagatgttttacggtgaattacgtgatatagaatcagccagacaatatcttgcgaagttgccgtatgtcgatcaaaatcgtatttatttggcgggacacagtacgggtggaactcgggcattattggccagcgagtatagcaaaggattcagggctgttttctcattggggggaattcctgatttgcgtttacgtctagaatatgggtcagttccggtggctgtaccatttgaccaaaataatccagaggaatttgaacttcgttctccacgtacttttctgagttctatcaaatcccccactttctattttgaaggagagaaaagttattgggatgaatttgatgaaataaaacaaattgtagaggataaaggtataccattgcatatctacgctattcaaggcggggatcattttaatattattttacctttaaccaagatgattgcagaaaaaatcttgagtgatacaggcgagaaaacgaacattcaatttgatgaacaggatattctgaagattcaatatcaccttccgctgactgattaa

SEQ ID NO: 2596 - DNA, 111 bp, Xenorhabdus bovienii
  Coding sequence Name=Xb4151_4152.C434.gene116.dna; Position on contig= 82600..82710bp; Strand=+
ttgactatacctatagtaaataaatttatatatgtaatatcacggtttgaaaatataaaagtcaaaaaaaaaggcctgcatagacaggccaaaggatacggtgaagcataa

SEQ ID NO: 2597 - DNA, 108 bp, Xenorhabdus bovienii
  Coding sequence Name=Xb4151_4152.C434.gene117.dna; Position on contig= 82828..82935bp; Strand=+
ttgatcgaacaaatagaaaaacgcagatttttccagttggatgagggacttacggcttttcagtttgatctaaaatatctttacataaacctggaaagccttgattaa

SEQ ID NO: 2598 - DNA, 816 bp, Xenorhabdus bovienii
  Coding sequence Name=Xb4151_4152.C434.gene118.dna; Position on contig= 82982..83797bp; Strand=-
atgaaaaggacgacaggcttaaaccagaagagtatttgtactcatctattgaccatacctgatttcaataccctcgaacataaacaaagagggctgtatgttttactcgatggagaaatgatatggaaagattgcaccaatacttactatatcacatcgaatgaaatcctttttacccatccggggagctacgtagccaaaaccaatacagaaaactgtcaggtattatggctacccttacaaatggagtttctgcgcagttttttaaaacgtttcggatcgttactgagtaaaattgaacgacataattttccggcccgtaggcttattcccttcagtcagttccccctattgacggaaagtatccgtgggctggccaatctgctggctcatgattaccctcctgccctgattcagctcagggttgaagaattactattattgctttctcttagcaaacagggcgcattactgatgtcggtattgcgacagttgagtaaccgtcaggtagaacgcctgcaaacatttatggacgcacattatctcaaggaatggcggctcaatgactttgcccgcgagttcggtatgggattaacttcattcaaggaactttttaacagcgtctatggtacatcgccacgcgcctggatcagtgaacagcgtattctttatgcgcatcaattgatactgaacagtgaaatgagcatcgccgatatctcattggaatctggtttttccagccagtcctattttacccaaagttatcgtcggcgttttggttgtacccccaatcgcgccagatatggtaaagattag

SEQ ID NO: 2599 - DNA, 165 bp, Xenorhabdus bovienii
  Coding sequence Name=Xb4151_4152.C434.gene119.dna; Position on contig= 83807..83971bp; Strand=-
atgctatttcgatatctatcaatactgtttcacttcgcactcaatgctatcagcataattcgagagccaaatgaaaggcttttccaacatctattaattaataaaataaataaatacaccatgcactcatcacaaaaaatgattactcatgatacggaagattag

SEQ ID NO: 2600 - DNA, 108 bp, Xenorhabdus bovienii
  Coding sequence Name=Xb4151_4152.C434.gene120.dna; Position on contig= 83996..84103bp; Strand=+
ttgtattatatctctaaattaatatttgtgttaggtttcagtgttaaaatttgcgctataaatttatttttatgttttttaaaggtattaaagcaagtttatttatga

SEQ ID NO: 2601 - DNA, 105 bp, Xenorhabdus bovienii
  Coding sequence Name=Xb4151_4152.C434.gene121.dna; Position on contig= 84105..84209bp; Strand=+
ttgtttattttttatctcatggtctttaatgcttttataattcacttgctggagagctgttcattactgtcatttaggtggttttatacttttaatcctatttaa

SEQ ID NO: 2602 - DNA, 96 bp, Xenorhabdus bovienii
  Coding sequence Name=Xb4151_4152.C434.gene122.dna; Position on contig= 84219..84314bp; Strand=+
atgacaatttttatcatcaaaaatatgtcagttaatatgtgtaattatttgattttaaaaattaattataaattatttgctctattgggcaggtaa

SEQ ID NO: 2603 - DNA, 102 bp, Xenorhabdus bovienii
  Coding sequence Name=Xb4151_4152.C434.gene123.dna; Position on contig= 84326..84427bp; Strand=-
ttgttaactttcttttcaatgccaccgtgcaattggctggctaaatttaaaaataatctatctatatcactcgcttactctatttacttgttatacaaatag

SEQ ID NO: 2604 - DNA, 96 bp, Xenorhabdus bovienii
  Coding sequence Name=Xb4151_4152.C434.gene124.dna; Position on contig= 84596..84691bp; Strand=-
atgattaacaatatggcaaccgaaattaaatatcacgattcaaactctgtaattatatccccccccataaaagctaaggataacaatctgatataa

SEQ ID NO: 2605 - DNA, 108 bp, Xenorhabdus bovienii
  Coding sequence Name=Xb4151_4152.C434.gene125.dna; Position on contig= 84693..84800bp; Strand=-
ttgaataaaaaaacagataaattaataatattgcaacaatataaacaaaatactaataatttaatatcatgtctggtatgtggaaaacatttcagatcagttgactga

SEQ ID NO: 2606 - DNA, 93 bp, Xenorhabdus bovienii
  Coding sequence Name=Xb4151_4152.C434.gene126.dna; Position on contig= 84824..84916bp; Strand=+
atggattttttattctgggaatatgggataattaaacgaaaattcagaacgttaaacttaagtagtaacgttatccgtgtaatagcgctataa

SEQ ID NO: 2607 - DNA, 666 bp, Xenorhabdus bovienii
  Coding sequence Name=Xb4151_4152.C434.gene127.dna; Position on contig= 85072..85737bp; Strand=+
atggaaaggtatcgtttttcagataacgcttttttatacagtgtatggctcctttgggggggtgccttagggctatatttgtatggcgctcatctcggttgtgccataacagcaattatatcttttctagccttggtactttactttacaaatatgaaactgagaataaatgctatgtttggaaaaaaaactgaggcaccagttgccaatcctgttacgccaatcatttctacacagcctgaagataaaaaaaacctcagtgttgaaacgcgttccaatacgattattgcgaaaaattcggtatttaaaggcgatattgagatggaaggcgatattcaggtctggggaaaagtcgttggtaatattcgcgtaaaaggtggtgctattcgtgtcatgcatgccggaaaagttgaaggtgagcttaatgcgccagaaattattattgatggccatgttgacggtacgtgctgtgcggaaacgctggatatcctggagcacggcgaactacgtggtatcagccgttgtggaagtatgtcaatccggcgtggcggtttatttgtcggtcagtctgaacaggtcgaaaacaagaaaaagccggatattgagcgggttgtttccatcaaagagaatccggcagataaagcgaaagccaaaaatagtgcttaa

SEQ ID NO: 2608 - DNA, 96 bp, Xenorhabdus bovienii
  Coding sequence Name=Xb4151_4152.C434.gene128.dna; Position on contig= 85691..85786bp; Strand=-
atgatacacattttccggcggctatggcatggatttttattatccaatattaagcactatttttggctttcgctttatctgccggattctctttga

SEQ ID NO: 2609 - DNA, 543 bp, Xenorhabdus bovienii
  Coding sequence Name=Xb4151_4152.C434.gene129.dna; Position on contig= 85849..86391bp; Strand=+
atgattatcaaactggaaacagaaagattgctactccgtggctggaaagaagaagatcgtgagcctttctttcgcttaaatagcgatcctgaagtgatggaatttttctttaatacactgaatgaagagcaaaataatattcttgttgataatttgatccgtaagtttgaaacgcagggtggctggggattatgggcagttgagcgaaaacaggatggtgcattcatcggcatgattgggctaaatattcccagtgaagagtcaccctgttatccctgtgtcgaaattggctggcggcttgataaacctttttggggcaaaggttatacatgtgaagcggctcgcaggatttttgatttcgcgtttacagacgcggggttggacgaagttgtggcattcacttccgtacttaattaccgctcagaaagtgtgatgaaaaaactgggcatgatcagagatgaaaaaacatttctacatcctttggtgccggaaggtcaccgattgagagaacatgttctgtatcggatccggcgttcaagttga

SEQ ID NO: 2610 - DNA, 114 bp, Xenorhabdus bovienii
  Coding sequence Name=Xb4151_4152.C434.gene130.dna; Position on contig= 86343..86456bp; Strand=-
atggtttccatcaaggttatcctgcctgtcgggataaccttgataatgtttactctatcatgccatcaacttgaacgccggatccgatacagaacatgttctctcaatcggtga

SEQ ID NO: 2611 - DNA, 591 bp, Xenorhabdus bovienii
  Coding sequence Name=Xb4151_4152.C434.gene131.dna; Position on contig= 86473..87063bp; Strand=-
atgggggctgatagtgggggaagacccgctattgagcgtcttgtccgcgcgtatggatttaaatcacgccaagccctgagtgaccatttgggcgtttccaaaagcacaatggcaaaccgctatcttcgtgatagctttccagcggattggatcatccagtgtaatctcgaaactggcgcttcactgctgtggttaagcacaggtcagggagaaatgttttcggatggagagagtggtaaaacagaacggctggaagatatcatcgcgccatcaattcctcgtataaagttatcgggaggtaaactgaacgaggctaatccagtgatcctggacagcgaattgatttccaaagagcttaacaacccgttggttgttgatgatggcgtgacatggtatctgcttgatgctcagggagacaatattcaggatggcttatggctggtggatatcgaaggtatgcacagtattaaaaggatcgccaaaattcctgtcagtaaaatccgtgtcagcgatgatgacgtcacttttgactgttcagtcagcgacattcaattcatcggccgcgtggttctggtgatatccagacaataa

SEQ ID NO: 2612 - DNA, 939 bp, Xenorhabdus bovienii
  Coding sequence Name=Xb4151_4152.C435.gene1.dna; Position on contig =3..941bp; Strand=+
aaagacgcgcataaattttttcgcaaaatagtgttggctactgcgctaatgacaggggtaaattactctgcgcaggccgatgttgtcacatctatccgtccgctgggttttattgttgccgctattgctgatggtgtaacagacactcaggtattgctgcctgacggtgcgtctccacatgattatgcgttaagaccttccgatatccgtaagattaatcaggccgatttggttatttggatcggtccggatatggaaacatttctggcgaagccgataaccaaaattgcgcagaacaaacagttggcgcttgctcaattatccaccattaaaccattgctattgaaaaacaatgaagatgaaaatgatttagaagaatcgagtcagcctaaacatgacgctgatcacgaacatcaccatcacggtgaatataatatgcatatctggctttctccggagattgcgaagcaggtggctcaggcaatttatattcaacttgttgagcagtatccgcaacaaaagcagcaattagaagtaaacctacgtaaattcaatggacagcttgtacaaactgacaaaaatattgctagtattctaaaacctgtgcgagggaagggatatttcgtttttcatgacgcttacggttattttgaaaaacattacaagttggccccattaggtgtgttcacggttaatcctgagatacagcccggcgcacagaaattacattatatacgaacacaattagttgagcagaaagccacatgtatttttgctgaacctcaattcaggccagccgttattcacacagtagcaaaaggtactgatgtacgtacgggaacactagacccattgggaagtggcatagtattaaataaagacagctatatgaaatttataactcagttgtctgaacaatacgcgagctgcctgaattag

SEQ ID NO: 2613 - DNA, 1272 bp, Xenorhabdus bovienii
  Coding sequence Name=Xb4151_4152.C435.gene2.dna; Position on contig =1004..2275bp; Strand=+
ttgccgagaccacacaagctaatgcttggttctctgacgttagtcaccttagctgtcgcagtgtggcggccagttgcttaccatgaacaagaagaaagaacaggcagtattattctgagtaccccaaataatatctcagatgcgaccgacgattcgataggcgatatcgatgagcagctccctgatgaaggaattggagatgaagagggtggttcggatacaactgtaaattatcctcaccaatatgttgtctccgatggggataccttaagttctattttgacccagtttgggattgattcatctgatgtggctttattggccaatcagtataagtcattgcgcgatttaaacattgggcagtcattatcatggacaatcgatgataatggtaatttaaaaacgttaacatggggtatatcacgacgtgaaacccgtatttatacccgtgaaggtgatgtctttaaagaaacaagtgcatttcagaaaggggagtggaaaaatacgattgtcaagggcaagataaatggcagtttttctggtagtgctctttccgctggattaaccagtggtgaagcaagagatatcacaaaagcgctgcaatggcagatagattttcgtaaattgcgtaagggcgatcgcttttctgtgctgatgtcccgtgaaatgctggatggaaaaagtgagcagagccagttaatgggcgttcgtttgcatagtggcggaaatgattattatgctttccgtgcagatgatggccgcttttatgatggcaatgcgtctggtctggaacgtggcttcctgcgttttccgactatgaaacaattcagattatcttcttcttttaatccgcaccgtttaaatcctgttactgggaggattactgcacataaaggtgtggattttgccatgcctgtggggacacctgttctggctgtaggggatggggaagttattgtctctaagtttgatggtgccgcaggtaattttattgccattcggcatggtcgccagtataccactcgatacatgcacttaagaaaattgctggtgaaaccaggccagaaagtgaagcgtggtgaacgtattgccctgtcaggtaatacagggcgctcaactggcccacatttacactttgaattctggaataaccagcagccagtaaatccacttacggctaaattgcctcgctctggcggattaaacggtaaagagcgctcggaatttatagctaaagtcaggggtatcaagcctcaattattgctggattga

SEQ ID NO: 2614 - DNA, 168 bp, Xenorhabdus bovienii
  Coding sequence Name=Xb4151_4152.C435.gene3.dna; Position on contig =2285..2452bp; Strand=-
atgaaacgttgggacatatcccagtttactatctgtatctttctctttattcatgagctaactctgatggttccaaaacaagctttcaatacacaagcttccaacaaaaataatataaaagcggatgatatcaatcatccgcttttatgtctgttaataatcgagtga

SEQ ID NO: 2615 - DNA, 969 bp, Xenorhabdus bovienii
  Coding sequence Name=Xb4151_4152.C435.gene4.dna; Position on contig =2399..3367bp; Strand=+
atgaataaagagaaagatacagatagtaaactgggatatgtcccaacgtttcatctatcctatttgcatcctcgttattgggggctttggactggtgtgggaatattggctggattggcttatgttccggtaaaatggcgtgatccactgttagccaagatgggtatttgggcgggcaagaaagcgaaaagtgctcgtcggagggcgaaaatcaacctggtttattgctttcctgagctacaggaacagcaacgtgaagcgttgattgataaaatgtttgcaaccgcgcctcagtcttttgtcatgctggcggagctttgtctaaagggagctgaatcaacgcttcagcgcacccggtggcatggtgaagaaatacttcactcgttaaaagcacaaagtaagaatgtcattttactggttccccatggttgggctattgatattccagctatgttgttggctgcgcgtgatcaaaaagtggcgggcatgtttcatcatcagagcaatcccgttgctgactatttatggaataaagttcggactcattttggcggccgcctgcattcccgtgaggcggggatcaaaccgtttattgcgtctatccgtcaggggcacttgggctattatctgcccgatcaggatcatggcgaagaacacagtgaattcgtcgatttttttgctacttacaaggcgacattacccgcgattgggcgcttgatgaaagtcagtcgggcagccgttgtgccattatttcctgtttataattgccagactcatcagttggatatctatatccgtccaccgatggatgatattgaagggcaggatgacacttatattgcccgtcgcatgaatcaggagctggaggagttggtgcgtcctaatcctgaacagtatacgtggatactgaaactgcttaaaacacggaaagcaggggatatagagccttataaaaggaaagatctctga

SEQ ID NO: 2616 - DNA, 1443 bp, Xenorhabdus bovienii
  Coding sequence Name=Xb4151_4152.C435.gene5.dna; Position on contig =3424..4866bp; Strand=-
atgtccagacggctcagaagaacgaaaatcgtcactacgctaggccctgcaacggatcgtgacggcaatttagagaaagtcatcagtgcgggtgccaacgttgtccgccttaatttctctcatggcactgcggaagatcatgttcaacgtgctaataaagtgcgggaaatcgcagcccgtttgggctaccacgtggctatcctcggcgatctccaagggcctaaaatacgcgtatccacttttaaggaaggcaaaattttcctgaatattggagataaattcctactggatgccaatcttggtaagggagagggagataaagaaaaagttggtatcgactataagggattgccgtctgatgttacaaccggtgatactctgttactggatgatggacgcgttcaattgagagtcctggatgttcagggcatgaaagttttcacggaagttactgtaggtggtccactttccaacaacaaaggcatcaataaacaaggtggcggtttgtcggctgaagcgctgacagaaaaagacaaacaagatatcattacagcagcaaaaattggggttgattaccttgcggtttctttcccccgctcaggtgaagatctgaattatgcccgtcgccttgcccgtgatgcaggttgtgaaacccaaattgtcgcaaaagttgaacgtgcggaagctgtcagcagtgacgatattatcgatgaaatcattttagcatctgatgtggtcatggtcgcccgtggtgatttgggcgttgagattggtgatcctgagctagttggtgtccagaaaaagctaattcgccgtgcccgtcaactgaatcgtgtcgtaattaccgccactcaaatgatggaatccatgatcactaaccctatgccaacgcgggcagaagtgatggatgttgccaatgcagtgcttgatggcactgatgccgttatgctttcagccgaaactgccgcgggtcaatatcctgcggaaactgttgcagcaatggcgcaagtttgtctgggcgcagaaaaaatgccaagcattaatgtgtccaaacatcgattagatattacattcgacagcattgaagaggccatttcaatgtcagccatgtatgctgccaatcatctgaaaggtgtcaaggcgatcattgccatgacggaatcaggtcgcacagcacgcatgatgtcacgcatcagttccggtctgcctatattctccatgtcacgccatgaatccaccctgaaccgcaccgctctctaccgtggtgttacaccggtttattgcagcacccacactgatgggatctccgccgcaaacgaagccgtcaatcgcctgcgcgataagggttatctgacttctggtgatgtggtgctggttactcagggcgatcagatggaaacgattggtagtaccaatacctgtcgagtgcttgaagtagagtaa

SEQ ID NO: 2617 - DNA, 111 bp, Xenorhabdus bovienii
  Coding sequence Name=Xb4151_4152.C435.gene6.dna; Position on contig =4931..5041bp; Strand=+
ttgattatcaaccccgtaataagaatgatactgacgggaggagactttccattatgctaccagcctagagggctgataaatagtgaacaaaaacacagtctatttttctga

SEQ ID NO: 2618 - DNA, 885 bp, Xenorhabdus bovienii
  Coding sequence Name=Xb4151_4152.C435.gene7.dna; Position on contig =5043..5927bp; Strand=-
atgaaatcgttaaaaccaaaggttgaactgcgtcttatgaatacactggaacgtctccaaaatagccttgatattttgagtaagtcagaaaaaaaggttgcgcaggtcatccttgattcaccacatactgccatccattcaagtattgctaccttagctaagatggcgaatgtcagtgaacctacagttaatcgtttttgtcgtcgcctgaacacgaaaggattcccggattttaaactacatctggcacagagcctggcgaatggtacgccttacgtaaatcgtaatgtggaggaaagtgacagcgtcacgtcttataccagcaaaattttcgaatcggtgatggcaaatctagaaacggttaaaagtaatctggatattacggccattaaccgtgcggttgatctgctgactcaggcaagaaaaatctcttttttcggattgggcgcatcagccgcagtcgctcatgatgccatgaacaaatttttccgctttaatatccctatcacctattttgacgatattgtcatgcagcgaatgagctgcattaacagtgccgaaggggatgttgtagttctaatttctcatacaggacgaaccaaaaatctggtagaaatcgccagattagcccgtgaaaatgacgcaactgttatcgccatcacttcaacgggctcaccgctggcacacgaagcaaccctgtctattctgctggatgtccccgaagacacggatatttatatgccaatggtttccagaattgctcaacttaccattattgatgtactggcaacgggttttacattacgccgaggctcaaaattcagggataacttgaagagagtcaaagaagcgttacgcaattctcggtttgataagtatgagtaa

SEQ ID NO: 2619 - DNA, 135 bp, Xenorhabdus bovienii
  Coding sequence Name=Xb4151_4152.C435.gene8.dna; Position on contig =6218..6352bp; Strand=-
gtgctaagtctcctttcgccccaaaaatcaccaaatcacaagcctgagctacggatgtcaccgccatgttgcatctcctcaattacgggatattgtaatttttttacagaactcgcgggtaatgtactcttttga

SEQ ID NO: 2620 - DNA, 1476 bp, Xenorhabdus bovienii
  Coding sequence Name=Xb4151_4152.C435.gene9.dna; Position on contig =6286..7761bp; Strand=+
atggcggtgacatccgtagctcaggcttgtgatttggtgatttttggggcgaaaggagacttagcacgccggaaattaatgccttccctttaccagttggaaaaagcgggttatatccatccagacacccgaattatcggagttggtcgtgctgactgggataaaaaagcctacacaaaggtggttgaggaagcgttggcaacgtttatgtctgaaaaacttgatccagaattgtggaaaaaattcagttcacgtctggagttttgtaatttagatgtcaatgaaacggaacatttcacccgactggcgaaaatactcaagcaggacagcctgccagctattcattatttcgccatgccgccaaatacctttggctccgtgtgtcatgggttaggggctgcgggattgaataaagagcctaatcgcgtagtgatggaaaaaccactggggacagatcttgcatcttccagagcgattaatgatgaagtggcaaaatatttcaatgaaagccaaatctaccgcattgaccattatttaggtaaagaaaccgtactgaacctattagcgctgcgttttgccaattcactgtttgccaataattgggatcatcgtacgattgatcatgtgcaaattactgttgctgaagaagtgggtatcgaagggcgctgggggtattttgaccaggccggacagatgcgcgacatgatccagaaccatctgctgcaaatcctgaccatgattgccatgtctccaccatctgatttaaccgcagaccgcatccgtgacgagaaagttaaaatactgcgttcattgcgtcgcattgatcagaccaatgtgcgggaaaaaaccgttcgtgggcaatataccgcaggcttcgtgcatgggaagaaagtaccgggttatctggaagaagagggtgcgaataaaatcagtaaaactgaaacctttgtatcgattcgcgttgatattgatgattggcgttggtcaggtgttcctttctacctaagaacaggtaagcgcttaccggctaaatgctctgaagttgtcgtctattttaaagagccttcattgaatttatttgccaattcttatcagcaattgccacagaacaaactgacgatccgtttgcaacctgatgaaggtattgatattgaagtcctgaataaagcaccagggctggagcataagcatcgtttgcagactacaaaacttgacctgagtttctctcaaacattcaatcagacacatcttgcagatgcttatgagagattactgctggaagccatgcgtggtattcaggcgttgtttgtccgccgtgatgaagtagaagaagcatggaaatgggttgattccatcatggacgcttgggaagcagataacgaaccaccgaagccttatcaagcaggaacttgggggccagtggcttccattgctatgattacccgggatgggcgctcgtggaatgagtttgagtaa

SEQ ID NO: 2621 - DNA, 105 bp, Xenorhabdus bovienii
  Coding sequence Name=Xb4151_4152.C435.gene10.dna; Position on contig =7966..8070bp; Strand=+
ttgctttctattttaggctatgttagaaatatacccacaattaacaccactaatatggagattcgtagtatatcatacagtgatcatcgtgtgatgaaagaataa

SEQ ID NO: 2622 - DNA, 117 bp, Xenorhabdus bovienii
  Coding sequence Name=Xb4151_4152.C435.gene11.dna; Position on contig =8077..8193bp; Strand=+
atgaatagcgccaaaagcgtcacaattcaatacagcagtaaaattcaacgcagtacacatgttctttttctctccgctatcttatctagcgaacactactggtgcggtgcactttag

SEQ ID NO: 2623 - DNA, 165 bp, Xenorhabdus bovienii
  Coding sequence Name=Xb4151_4152.C435.gene12.dna; Position on contig =8250..8414bp; Strand=-
ttgtttcatggacagagtaccaatcacttctgtcataatcgccagtgcaagaaatatccaataaatcatttttttctcctgaacatactgtatgtagcatgccaagacaccaaaccattaataccaataagattatttaaaaacgtgatatcagaatcagcctga

SEQ ID NO: 2624 - DNA, 351 bp, Xenorhabdus bovienii
  Coding sequence Name=Xb4151_4152.C435.gene13.dna; Position on contig =8346..8696bp; Strand=+
atgatttattggatatttcttgcactggcgattatgacagaagtgattggtactctgtccatgaaacaagccagtgtttcaggtgattttaccggcatgattgtgatgtattccatgatcacaacttcttatattttgctggccattgccgtgaaaaaggtcgctttgggcgtggcttatgccctatgggaagggtttggtatcctgtttattacagcctttagcgtattgtggttcaatgaatcactgtcacctatgaaaatcggtggattggctctgttgatagcaggaattgcactgattaaatccggtacaaaaaaagcctctaatcctcaactgaaggaggcataa

SEQ ID NO: 2625 - DNA, 333 bp, Xenorhabdus bovienii
  Coding sequence Name=Xb4151_4152.C435.gene14.dna; Position on contig =8698..9030bp; Strand=+
atgttaacaccatttgaatggtggcatgccgctttccttgttttggcggttctgctggaaattgtggcgaatattttactgaaactgtccaacggttttcagcgcttctggataggggttttatcgctgatggctgttttggcagcattcagcgcactggctcaggcagtaaaaggtattgaactttccatcgcttacgcgatttggggcgcattcgggattattgccacggttgcagcaggttggattatgtttaatcaaagactgaatttcaaaggttggggtggcattgtattgctattgattggcatggttatgattaaaatgtcttaa

SEQ ID NO: 2626 - DNA, 345 bp, Xenorhabdus bovienii
  Coding sequence Name=Xb4151_4152.C435.gene15.dna; Position on contig =9131..9475bp; Strand=-
atgactattgaacgcattgatccagatacccgctggtcagaagcgatcattcacaatgacactatctattatactagcgtgccagaaaatctggatggggatattactgaacaaactgccaatacactagctgcgattgatatcatgttacagcgtctgggttcagataaaagcaagatcatagatgcgacgatttttctggcaaataaagccgactttgctggcatgaatgcggcgtgggatgcatgggttgttgcaggaagctcacctgtacgctgcactgttcaggctgaactgatgaatccaaaatacaaagtggaaatcaagattatcgcagctttataa

SEQ ID NO: 2627 - DNA, 1917 bp, Xenorhabdus bovienii
  Coding sequence Name=Xb4151_4152.C435.gene16.dna; Position on contig =9578..11494bp; Strand=+
gtgtcagacgattttgcgaaaaatggcgtacttgccaaggcgatacaaggtttcaacccccgtgatgcacagcgggaaatggcttcatccattaccgctgcaataaaaaaacagcggcaattagtggtggaagcgggaacgggaacgggtaagacttttgcctatctggtgccagcactacgttcaggcaaaaaagtaattatttccacaggttccaaggcgttacaggatcagctttataaccgtgacctgcccactgtcgctgatgcattgaagtttacgggtaggatggccttattgaaagggcgctcaaattatctatgccttgagcgtcttgaacagcaatcatttggcagttctcagcttgagccggaaatgctggcagaagtggtcaggctgagaagttggtcgtctcagacagaagatggcgatatcagtacttgccaccaaatcgcagaagacagcattgtctggccattggtaacaagtactaatgacaattgcctcggtagtgattgtccacgctatcaggaatgtttcgtactgaaagcccgccgcaaagcgatggaatcggatattgttgtcgttaaccatcatctgtttatggcggacatggtggtgaaagataccggatttggcgaattaatccctcgtgcagatgtagtcattttcgatgaggcacaccagcttcccgatattgccagccaatattttggccagcaattgagtagtcgccaactgatggatttatcacgagatatcattatggcctaccgtactgaagtacgggatcaggctcaattgcagaaaagtgcggatcgtctcagtcaaagtacgcaggatttccgtctgtccttgggagataacagttatcggggcaatctccgtgaagccttgcagcagccacagatacagcggatgctggtacggttggatgatgcactggaactctgttatgacgtaatgaagctctctctggggcgctcggccatgttggatgctgcttttgaacgggcaacgatctatcgtaatcgtcttaaaaggctgatcgacgttgttgtacccaattatagttattggttcgaaagttatggacggcattttttgctggcactaacacccctatccgtatccgataaattcagtgacatgatccgtgaacaatccggttgctggattttcacgtccgcaaccttatctgtcaatgaacagcttgaccacttcacggcacgcttggggttaaaacaagcacagacgttgctcctgcccagccccttcgattatcagcgccagatgttactgtgtgttccgcgccatttaccatcaccaaaccagaatggcggggcaaaatggctggcacgtatgctgaaaccattaattgaaagcaataaggggcgttgtttttttctttgtacttcccatcagatggtgcgcggtctggcggaggaattccgtgctaacctgacattgcccgtgttggtgcaaggagaaacaagtaaaggacagctgttgtcccagtttatttctgcgggtaatgcgctactggtggcgacgggtagtttttgggagggtgtggatgttcgtggtgatgcattgtcctgtgtcattattgataaactgccgttcaccgcgccggatgatccgctgctcaaggcacggattgaagattgccagcttaaaggcggggatgcctttagtgaagtccagattcctgatgcagtgctcagcctgaaacaaggtgtaggacgcctgattcgtgatattgatgattatggcgtggttattatttgtgataatcgtttagtaatgcgcccatatggtgaaatttttcttaacagcttaccgcctgcccgccgtacacgtgatttatcgaaagcggtggaattccttaaatcacgtccaatagagtcagagtaa

SEQ ID NO: 2628 - DNA, 696 bp, Xenorhabdus bovienii
  Coding sequence Name=Xb4151_4152.C435.gene17.dna; Position on contig =11559..12254bp; Strand=+
atgtccacgcggattttagctattgatactgcaactgaagcttgttctgttgcactttggaacgaaagtgtcattgaggcacagtttgaaatttccccccgggaacatactcaacgcattttaccgatggttcaggcggtattgtctcagggcaatttgagcctgcaacagttggatgcgctggcgtttggtcgagggcctggcagttttactggcgtgcggattggtattggcgttgctcagggtctggcgttgggagctgaattgccgatgctgggtgtttcatcccttaaaacgatggcgcagggggtatttcgcctgaaaggcgtgcaaaatgttctggttgctatcgacgcccgtatgggagaagtttattgggggcaatatacccgtaatttacaaggtgagtggcagggtgatgaaaccgaggcagttttgaagcctgaacaggcattggccattatgaatgccttaactggggtttgggcaattgccggaacaggatgggaagcttatcctcaattattggattctcatttagatttggtaaaaagtgacattactttaccccatgcggaagatatgcttccactggctgttcagatgtggaaagcaggagaagcaacggcagttgaacatgccgaacccacttatctgcgcaatgaagtgacatggaagaaattaccaggtcgttaa

SEQ ID NO: 2629 - DNA, 588 bp, Xenorhabdus bovienii
  Coding sequence Name=Xb4151_4152.C435.gene18.dna; Position on contig =12361..12948bp; Strand=+
atggaggagcttatgcttaaggggacgcactatcgagccatgctgcaagtggttgcattggcgggagcaatgatacttacaggttgtgtatcagttcctgatgcaataaaaggaacgaccaaaacacccgtagaaaatctgctttctgtcaaagatacacctgaactatatattgggcatgaagggcgttttggtggaaaggtattgagtgttttaaatgaaaaagacagaactcggctagaaattttggctttaccactggcaagtaatgcggctccgcttttgaataaaccgtctcttgggcgagtttatgcctatgtgaatggttttttggaaccgaatgattttaaagatcagtatgtgacagtggtgggttcgattacagatctggaaaaaggaatggtggggaatagtccgtataattatgtcgtgatgagtgtcgtcggttttaaacgctggtatgaatctgaacgtgttaatctaccacctgttggtaactctgttttctggaactattatggttccccttattttccagacctgagccagatggcgagcatgaaggacgctttgtcggaaaggcattga

SEQ ID NO: 2630 - DNA, 99 bp, Xenorhabdus bovienii
  Coding sequence Name=Xb4151_4152.C435.gene19.dna; Position on contig =13056..13154bp; Strand=+
gtggcgaggccatcctcaaggtttcatatctttgtttactattatcttcctaataattatactttattggtttattctgcttataactatttagaataa

SEQ ID NO: 2631 - DNA, 1698 bp, Xenorhabdus bovienii
  Coding sequence Name=Xb4151_4152.C435.gene20.dna; Position on contig =13447..15144bp; Strand=+
ttggaaaaagtttggttaaaacattatccggcagatgttccggcagaaatcgatcccgaccgttatttgtcgttgattgaaatgtttgaaaatgctgtggcacgctatgccgatcaagtcgcattcatcaacatgggtgaggtgataactttccgtaaattggaagagcgtagccgcgcctttgccgcttatttacagaatggactggggctgaaaaaaggggatcgcgtggcattaatgatgccaaacttattacaatatcccgttgctctctttggcgtcctgcgtgcagggatggtggttgtcaatgtcaaccctttatataccccgcgcgagctggagcaccagcttactgatagcggaacatcagccatagttattgtttctaactttgcgcataccttagaaaagattgttttcaacactcaggttaagcacgttattctgacgcgcatgggggatcaattgtcccgtccgaaagggactcttgtagatttcgtcgtaaaatacgttaaacggcttgtaccgaaatatcacttaccggatgccatttcgtttcgcaacgtgatccacaagggttaccgtatgcagtatgttaaaccggatgtggacggtgatgctctggcatttttgcaatataccggcggaacaacgggggtggcgaaaggagcgatgctgacccaccggaatatgttggcgaaccttgagcagggaaaagctaattacgctccgctgatggctcctggacaagaattagtcgtcactgcgttgccgctttaccatatttttgctttgacggtcaattgcctattgttcattgaacttggtgggcaaaatctgttgattactaatcctcgggatatcaatggaacggtcaaagaattgtcgcgttacccattcactgccttgtcgggagtgaatacgttatttaatgcatggttgaataaccctgaatttcagaaactggacttctcctcattacgtttgtcggttggcggtggcatggccgtccaaagaatagtggccgaaaaatggcaaaatttaacggggtgtcatttacttgaaggttatgggttgacagagtgtgcacctctggtttcgggtaatccttataacctgactcattatagtggcagcattggtttcccggtaccttcgacagaaattaagctggttagcgatgatggtaatgaagttcctttggagcaagcaggggaaatgtgggttcgtggcccgcaggtgatgaaaggctattggaatcgccctgaagcaacggcggaagtattgaaagatggctggctggcgacaggggatattgccaatgtagatgaaaacgggtttttacatattgttgatcggaaaaaagacatgattttggtttccggtttcaacgtttatcccaatgaagtagaagatgttgtttcttcccatcctaaagtgttagagtcggcagcaataggtgttccaaacgataactcaggtgaaaccgtcaaaatatttgtggttcgtaaggatcagagcttaactgagaacgagcttaagacacattgccgtcgttatctgaccggatataaagtaccgaaactcattgagttccgagatgaattaccgaaatcaaatgtaggtaaaattcttcgcaaggaactgcgtaacgaagaattagaaaaagcgaataatgctgcgacagcggcaaattaa

SEQ ID NO: 2632 - DNA, 171 bp, Xenorhabdus bovienii
  Coding sequence Name=Xb4151_4152.C435.gene21.dna; Position on contig =15284..15454bp; Strand=-
atggattcgttaataaatgaatccaatattaacgaagacgtaacacctattcttataggtgttaccatccccaatatctgcccacaattctccccaaactactcgctaatttcccctattggctatttattgactgataattcaaaacatcattctcttagccattcataa

SEQ ID NO: 2633 - DNA, 456 bp, Xenorhabdus bovienii
  Coding sequence Name=Xb4151_4152.C435.gene22.dna; Position on contig =15454..15909bp; Strand=-
atgagcatatcaattacgacaattcaatataaaaatgcatataatttctatcatagaaatgcgatggcaatatacgaaatagataacaagaaatttatgtttggacaatccgaaacccaaggtaataagcatttcattcaagaaatattaccagacggtagattgggtcacacgactgaaagcggtagctcaccaatttattatgattatgcaactattctagaggatggtgataaaaaatatctctgttgtatcaatactagcagtgcagctattcagttcttggaattaactccggatggtaaaacaaaactagtattctccgataattactctcaagatggttttgaaacctttattccctacatgaataatggagttctctttgcttaccgtcagaatgaagcctcgaaacgttgggaaattgtaaaacttgaacaaaaaaatgaattataa

SEQ ID NO: 2634 - DNA, 117 bp, Xenorhabdus bovienii
  Coding sequence Name=Xb4151_4152.C435.gene23.dna; Position on contig =15976..16092bp; Strand=-
atggaattgagtatttatttttatcttctactatgtaagtcgcatcaatatattcgcagatattccatattctacaaatttacaataattatgtcatcctatgtatattttagttaa

SEQ ID NO: 2635 - DNA, 120 bp, Xenorhabdus bovienii
  Coding sequence Name=Xb4151_4152.C435.gene24.dna; Position on contig =16257..16376bp; Strand=-
atgacgttttccttactctactcaaactggcaaagtcaactcagcgcgacttggcaattgccattaaatatagtagctatttgtgattgtgccattcaggtgcatagaggcataatctga

SEQ ID NO: 2636 - DNA, 2274 bp, Xenorhabdus bovienii
  Coding sequence Name=Xb4151_4152.C435.gene25.dna; Position on contig =16375..18648bp; Strand=+
atgaaagtattgatagcaaagaacgaagtaggtacacgatatcacagtcattatattgagaatgccgtacacaggttggcggataaattaaccgatcgaaatgttgaggtggttattgccgattcatttgatgatagttacacgataattgcatccaatgagtcgttcgattgcttaatggtcagttgcgcattgatggatgatgaattatatcgggaaatacagcaattattaaataaattgtttgaacgccaggaaaatgtaccagtatttttattaagtgatcgggaaaaaactgtatttctgctaaatcatgaattgctggaacagttgaccgaatttgcatggatacttgaagactctgccgatttcattgcaggcagagcaattgcggcaatgcggcgttaccgtcaacagttattaccgcctttaatggccgcactcatgaaatatagccaaacctatgaatattcttgggcagcgccagggcatcagggcggagtcgggtttaataaaacccctgtcggtcgcctttatcatgattattatggtgaaaatctctttcgtaccgatatgggaattgagcgcgcttcgttgggatcgctgttagatcactccggcgcatttggtgaaagtgaaaaaaatgcggccagagtctttggcgcggatcactcttattctgttgtggtaggaacatcaggctctaaccgcacgattatgcaagcctgtatgaccgaagacgatgtcgtcatcattgaccgtaactgccataaatccatcgagcaagggcttatcctgacaggcgcaaagcctgtctatctgctaccgagccgtaatcgttatggcatcattggtcccatttatccgcaggaaatgcagacagaaacactacagaaaaaactgaaacagaacccattgactcaaggtatggccagccgtaaacccgcctatagtgttgtgacaaactgcacttatgatggggtctgttataacgccaggcatgtgcaggaattgctggataaaagtgtcgataggatacattttgatgaagcatggtacggctacgcgcgctttaaccccatttaccatgatcattacgcgatgcgcggtaatccgaaggatcatgcggggccgactgtttttgccacccactcatcccataagttgctgaatgccctatcacaagcctctttcattcatgtgcgcgatggtcgaaattccgttgatttctcaagatttaaccaagcttatatgatgcatgcgacgacttcaccgctctatgcgatttgcgcctcaaacgatatcgcggtttccatgatggatggcaatagcggttattctttgacgcaagaagtgattgaggaagcagtggactttcgtcaggcattggcgcgcttgcatcgcgatttcaacgaaaagggcgattggttttttaaaccgtggaatcaggaaaaagtcctcgatcccgcgacaggcaaaaaaattgcgtttgaagatgcaccaagagatttactgaccaaagaacaaagttgctggactatgcgtccgggagacagttggcacggttttgaagacttgcccgatgactggagtatgcttgatccaatcaaagtcagtatcttggcgcccggcatgggagataatggtcaattgctgaagcagggcgtgccagcggcgctggtgacagcgtggttaagtcagcatggtatcgtacccacccgaactaccgattttcaaattatgttcttgttttcaatggggattaccaaaggaaaatggggaacactgctcaataccttactttctttcaaacatcattacgacgctaatacgccgctcaacaaagttttgcctgatctggtgaatcaatatcaggaagtatatggcaacttaggtttgcaagagttgggcgataaaatgttcgcttatttgcgtcagaataatccgggcgataagttaaatcacgcttattctggtctgccggaaatggcgatgatcccaagggcagcttatcaggccattgtgaccaacaacgtcgaaatggtagcgatcgacgatcttcctcaccgtatcgccgccaactccatcattccatatcctcccggcattccgatgctactttcaggggaaaacttcggagataaaaccagcccgcaaatgagttacttacatgccctgcaaaaatgggatcacgaatttcccggatttgagcatgaaacggaaggaacagagattatcaacggtgtttatcacgttatgtgcataaaaaaatga

SEQ ID NO: 2637 - DNA, 1329 bp, Xenorhabdus bovienii
  Coding sequence Name=Xb4151_4152.C435.gene26.dna; Position on contig =18666..19994bp; Strand=+
atgactacggtttctgagacgaaaaaagtcggattgatccccgttacgctgatggtcgcgggcaatatcatgggatcaggcgtgtttctcttgccagccagcctggcttccaccggaggtattgccattctcggatggctggtcacgatcatcggtgccgtggggctgtctatggtgtatgccaagatttcttcactggatgatagccctgggggctcttatgcctatgcccgacgtgcttttgggccatttttaggctaccagaccaacgttctgtactggctggcctgttggattggtaatatcgcaatggtggtgattggcgtcggttatctcagttactttttcgccatcctgaaagacccgataattctgaccatgacttgcatcgcgatactgtgggtatttgtcttcttgaatattatcgggccgcatgtcattaccagagtacaggctgttgctaccacattggcacttattccgatagtggcgacggctgtattcggctggttctggttcagcggtaaaacgtatatggatgcgtggaacgtgagcgggctaaatacctttggtgctatccaaagtattttaaacgtgacgttatggtcgtttattggggttgaaagtgcctcggttgccgcaggtgtggtcaaaaaccccaaacgcaacgtgcctatcgcgaccatcgggggcgtacttattgctgccgtatgctacatcttgtccagcagtgtgattatgggcatgattccgaatgccgcgctgaaactctcatcttcgccttttggtgatgcagcgagattggcactgggtgatacagcaggcgcggtggttgtattttgtgcggcggtaggatgtttaggatcgctgggcggttggacgttgctcgctggacagaccgctaaggctgccgccgatgatggcctgtttcctgctatttttggcaaagtgaacaaggagggaaccccggttgctggcctgctgatcctcggtgtattgatgactatcttccaattcagcagcatttccccgaatgcggcgaaagagtttgggttggtctcttccgtttcagtcatttttaccctgataccctatctgtatacctgcgcagccctgctgttactggggcatgggcatttcagacaggaaaagctgcgctacatagtgatcacctttattgcctttgcctactgtatttgggctgtgatggggacaggcgccgaacaagttgtatggacgctggttgtgatgatgatagtcacggctatgtatacttttaactacaacacaaaacatcctgctcctttcccattggagaaaaatgattga

SEQ ID NO: 2638 - DNA, 147 bp, Xenorhabdus bovienii
  Coding sequence Name=Xb4151_4152.C435.gene27.dna; Position on contig =19942..20088bp; Strand=-
atgcataattgcgtcgaaaaatcgataaaccaaccaacaatagacctaaaaaaggggctgatatttcagccccctgtaataccgcaaactgatgtcaatcatttttctccaatgggaaaggagcaggatgttttgtgttgtagttaa

SEQ ID NO: 2639 - DNA, 348 bp, Xenorhabdus bovienii
  Coding sequence Name=Xb4151_4152.C435.gene28.dna; Position on contig =20185..20532bp; Strand=-
atggctcagggatgggattggcgatcaccagccctcctctcagccctgaattccattttgctttcatggcttgggctatctgccggggattttcaagcgtcacactcaccggaaatgggctggtacggcagaaaaatgccggtaatttttcggtttgatatcccacaagtggcactccatgtgcttccagatgttcagtcggcaatgcccgccatttcagcaataatcatcgttgaagccacggttgtcgccccgtgtttttcctctgccacgacaaacggcagatcacggcggctgacttttgcaaccaaatgccgttctttccccagaaactcaatgttttcctga

SEQ ID NO: 2640 - DNA, 447 bp, Xenorhabdus bovienii
  Coding sequence Name=Xb4151_4152.C435.gene29.dna; Position on contig =20310..20756bp; Strand=+
ttgctgaaatggcgggcattgccgactgaacatctggaagcacatggagtgccacttgtgggatatcaaaccgaaaaattaccggcatttttctgccgtaccagcccatttccggtgagtgtgacgcttgaaaatccccggcagatagcccaagccatgaaagcaaaatggaattcagggctgagaggagggctggtgatcgccaatcccatccctgagccattcgctatgtcggaagttcaaatcaatgccgccattgaacaggctgtccgagagtcgcaggaacagggaattcatggcaaggagagtaccccattcctgctgaccagagtatcggaattgacgggaggcgaaggtttacaggcaaatatcgaactggttttcaataatgcgaaactggcagcgcaaattaccattgcttatcaagcaataaataagcatcagtaa

SEQ ID NO: 2641 - DNA, 102 bp, Xenorhabdus bovienii
  Coding sequence Name=Xb4151_4152.C435.gene30.dna; Position on contig =20719..20820bp; Strand=-
atgtttctctttcaggctggcatttattttattgtaacattggataagatatatcggatgatatttactgatgcttatttattgcttgataagcaatggtaa

SEQ ID NO: 2642 - DNA, 1314 bp, Xenorhabdus bovienii
  Coding sequence Name=Xb4151_4152.C435.gene31.dna; Position on contig =20819..22132bp; Strand=+
atggtaatatcccttgggatttttttaggctggctaaaaaacaatgggaatataatgatggatattttacgcagtttaatgggaatagtaatacttcttctggttggatatttgttctctgtcaataaaaaaataattagcttacgtacggtggtcgctgcattattacttcaagtaagccttggtgcaataatgctgtatgttcccgccggtaaatggttaattcataacattgccaatggcgttaatgccgttatttattatagttctgctggcagttcatttatcttcgggagtttagtcgggccgaaaatgaatgaattatttgatggggcaggttttgttttcgcatttcaggtgctgcccgctattatctttattacttctttgatatctattctttattatattgggatcatgaaatgggtcattaatattttgggatatgcttttcagaaagcgatgcgaattagtaaagtggaagcctttgctgcggtaactacaatctttttgggtcaaaatgaattaccggcggtgttaaaaccttttgtcaataaaatgaaccgcaacgaacttttcactgtgatatgcagtggtatggcttctattgccggatcgatgctggttggctacgcggggttgggcgtaccgatagaatacctgctggcggcatctttgatggctattccgggagggattctgtttgctcgtttgctcagtcctgccacggagccttcacaagtacagtttgaacagatttcattcagtgagacgcgtccggccagcattatcgaagcggctgccggaggtgccatgctggggttgaaaattgctgttggcgtcgcgacggtggtgatggcatttgttgccttgatcgcgttgctcaatggcgtaatcggcggcattggcgagttatttggcctgacggggctgagtatgcagagcctgctgggttatcttttttcgcctttggcttatatcatgggggttaactgggagcatactgatctggcagggagtttgattggacaaaaattagcaatcaacgaatttgtggcttatgtgaatttttctccttatttaaaagatcctgcggttcttctggataccaaaactatcgcggttatttcgttcgcgctttgtggctttgccaattttggttcgatagcggttgttgtcggtgcatttacagcggtagtacccgaaagggcttcagatattgcaaggctgggtctgagggcactactggcagcaacactgtccaatctgatgagtgcaacaattgctggcttgttcattaatttggcaggttaa

SEQ ID NO: 2643 - DNA, 102 bp, Xenorhabdus bovienii
  Coding sequence Name=Xb4151_4152.C435.gene32.dna; Position on contig =22160..22261bp; Strand=-
atgcacgctcctattattcaaataccaagcctagttgattccccgattgtagaggggttcagcataacttactgtgagttatctaacacctcaacatgttag

SEQ ID NO: 2644 - DNA, 429 bp, Xenorhabdus bovienii
  Coding sequence Name=Xb4151_4152.C435.gene33.dna; Position on contig =22262..22690bp; Strand=+
atgtacagaactattttggtaccggtagatatttcagaagaagaactaacgagtaaggctgttcgctgtgcgcttgatatcgccagagaaacaggtgctaagttacatattctacatgtactccctatttcatccgcaattattaatgcttatgcattaggctatatggaaattaaagacaaagcgaccgtcaaggccgaaaaggaattgtctatgctggtagattccattgatttaccgaacgatcgcatttcctattcaatttcttttggctcaccacgagacgaaattacctccacggctgatgagattgaagccgatttgatcgtcattggttcaaggcggccgaatattacgacccatttgttaggttctaactcggcggggatcgtcagatatgcgaaaacctctgtattagttgtgagataa

SEQ ID NO: 2645 - DNA, 438 bp, Xenorhabdus bovienii
  Coding sequence Name=Xb4151_4152.C435.gene34.dna; Position on contig =22802..23239bp; Strand=+
atgtataaagcgattttagttccaatcgatattccagaagatcaactcactgataatgcgattaagcatgcagaattcttggcgaaaatctccggtgcaaaaattcacttgtttcacgccgttccggatatctcaaggttttctgtaaattacagctatcactatgatttgcttagtgcttttgctaaaaaagccgttacaaattctgaagaggaactcaaaaaagtcgtagaaaaaatcaatttaccgaaagatagagtatcgttctccgttgcttttggttctccacgagaaaaagtactctccactgcccgtgaaattggcgcagatttgatcatcgtaggttcaaggcggcctgatatttcaacccatttactgggctcaaatgcgtcaggaattgtttcctacgctaatatatcggtattggttgttcgataa

SEQ ID NO: 2646 - DNA, 120 bp, Xenorhabdus bovienii
  Coding sequence Name=Xb4151_4152.C435.gene35.dna; Position on contig =23187..23306bp; Strand=+
atgcgtcaggaattgtttcctacgctaatatatcggtattggttgttcgataactatctggtaacatgcctaaaaccgtgcagggaattgcacggttatttatgtctgatcagtaaatga

SEQ ID NO: 2647 - DNA, 189 bp, Xenorhabdus bovienii
  Coding sequence Name=Xb4151_4152.C435.gene36.dna; Position on contig =23286..23474bp; Strand=-
atgactattagcaataaaattaaacaacctgagcaagagttgctggaggttgtaaggaaatattcagggaatgaaaaagtgacgataatgacgactaacagctcaaaaaataacttacagattcaagttatcactgctggtaaaaatcaattagatattacccttaattcatttactgatcagacataa

SEQ ID NO: 2648 - DNA, 1005 bp, Xenorhabdus bovienii
  Coding sequence Name=Xb4151_4152.C435.gene37.dna; Position on contig =23716..24720bp; Strand=+
ttgaatagtaaaattagcctgtgggcaagttattttttgtttttcggattaaccatatcttttaatgcatggagtgcgccgaccagctttgagcaagcgaaaatagaatcaagaaaaaatgtctatagtgaacaaaccaaatcagaaattggcacattgtattgtggctgtgattggcaatgggtaggtaagagtggcggacgtgttgatctggcttcttgtggctatcaggtcaggtcacagcagtcacgtgcggaacgtattgaatgggaacatatggtgcctgcatgggtattcgggcatcagcggcagtgctggcagaatggcgggagaaaaaactgtgttgagaatgatccgttttttcgcgtaatagaatcggatatgcacaatctggcgccttcgattggcgaagtcaatggtgatcgcagtaacttcgcttacggaatggttcccaaaaacatggcaaatatgtatggggcatgtagcagtaaagttgattttaaatcacgactgtttgaaccgcgcgatagagttaaaggcgtagttgccagagtttatttctatatgcacgaccgttataaccttgcgatgtctcgtcaacagcagcaacttatgatggcatgggatcgtcaatatccagtagatgggtgggaacgagaaagagataataaaattgcccggattatggggcaccataacccatttgttaccggaagccagaaatgggaactggggcataaaaattcaggccaggggttgagcgtacaaaatggtgtccaaaagcaaaatagctttcaagcggttggcaaccaggcacccgtcagaaacccgaccgtaaaaaccgcgcagagtgaaaaaattaaaggcaataagaatagccagatttatcactttgcccactgttctggttataaaactatagcggataaaaacgcggtctattttcgaacggaagccgaagccaaaaaagcgggatatcgtctggcgggtcattgtaaaaaataa

SEQ ID NO: 2649 - DNA, 747 bp, Xenorhabdus bovienii
  Coding sequence Name=Xb4151_4152.C435.gene38.dna; Position on contig =24988..25734bp; Strand=+
atgataaagctggaaatttgctgttatagcataagctgtgcgctggttgcacaaaatgcgggcgctgaccgaatcgaattaagcgcaagcccgttggaaggtgggttgacacctagttttggggcattacaacagtcgttacagcggttatctattcctgtgcatcccattgtgcggccaagaggaggagacttctgttataacaacatggattttgaagtcatgaaaaatgatgttgcccgtatccgtgatatggggttccccggcattgttttcggcattttgagcgaaaacggccatattgacagactccgtatgcggcagttgatgtcactgtcgggaaatatggctgtgacttttcatcgcgcttttgatatgtgttttaatccgcatgttgcgttggaacaactgacagagcttggagtgcagcgtattttaacatcaggccaacagcagaatgctgaactggggctgactctgttaaaagagctgatgcaagccagctgtgggccgataattatgcccggcgcgggtgtcagggtgagtaatatcagtaagtttctggaagccggaatgacggaagttcatagctcggcgggtaaaatagtgccttctaccatgaagtaccgaaaggcaggggtggcgatgagttcggacgatcgtgatgtagatgaatattctcattacagtgttgatggtgagttagttgagtcgatgaagggagtgatgaacctgattgagcggtaa

SEQ ID NO: 2650 - DNA, 132 bp, Xenorhabdus bovienii
  Coding sequence Name=Xb4151_4152.C435.gene39.dna; Position on contig =25752..25883bp; Strand=-
ttgaaggctaccctgccccattgcgtgctgttctcattgcccgcaagccataatattgaacaaatattaatgagtgaactgtccaatatggcagttcacaccttaatttctaagatttcactttccttatga

SEQ ID NO: 2651 - DNA, 972 bp, Xenorhabdus bovienii
  Coding sequence Name=Xb4151_4152.C435.gene40.dna; Position on contig =25831..26802bp; Strand=-
atgatcgatttcggtaatttttatcaattgatcgccaagcacccactaagccattggctggatagtctgccagcacaattgagccactggcaaaaaacatcacagcacggtcagttcagctcatgggtaaaaattctggaaaatttgcctgagatcaagccaagccaccttgacctgaaaaatggtgtcattgcgactcatgagccggatctgtcaaaaggtgaaaaagctcgcctccacaatatcctgaaaatattgatgccatggcgaaaaggtcctttttcattgtatgacgttgaaattgataccgaatggcgctctgattggaaatgggagcgagtgctgccccatatttctcctttagaaggaaaaaccgtacttgatgtcggctgtggcagtggttatcacatgtggcgcatggttggcgaaggcgctcaattggttgtgggtattgatccaactcaactttttctctgtcaatttgaagcggtcagaaagttgctggggaacgatcaacgagcccatcttctgccattaggcatcgaacaattacccgaactacaagcctttgatacggtattttcaatgggagtgctctaccaccgccgttcacctcttgatcatctgtggcaactgaaaaatcaactggtgtctgatggtgagttagtgctggaaagtttagtgattgagggtgatgaaaatcagtgcctcattccgggtgaacgctatgcacaaatgcggaatgtctactttattccctcggccaagatgctgaaagtctggctggaaaaatgtggttttgtcgatgtcagaattgtcgatcatgcggctacaacacctgatgaacaacgccggacagaatggatgaagaccgaatcactggtagatttccttgacccatcagatcacaataaaacaattgaaggctaccctgccccattgcgtgctgttctcattgcccgcaagccataa

SEQ ID NO: 2652 - DNA, 759 bp, Xenorhabdus bovienii
  Coding sequence Name=Xb4151_4152.C435.gene41.dna; Position on contig =26799..27557bp; Strand=-
atgtcaaatcaagatcctcataatcaacgggacagtttgttctctgccccaatcgccaatttaggtgactggagcttcgacgaacgtgttgccgaagtctttcctgatatggtgaaacgttccatacccggttattccaatatcatctccatgatcggtatgctggccggtcgtttcgtgacgccaggtagccaaatttatgatctcggttgctcccttggggcagcaactttgtccatccgccgcagtatcaatactgatgattgccggattatcgctatcgataattcaccagctatgattgaacgctgtcgccgccatattgattctttcaaagccagtacacccgttgaggtgatcgaacagaatattcttgatacagacattcaaaatgcttcgatggtagttttgaatttcacattacaattcctgccccctgatgatcgccagaaaatattgagaaaaatttacgcaggattaaaacccggcggggttctggttctgtctgaaaaattcaattttgaagaccagaaaattggcgagttactattcaatatgcaccatgatttcaagcgagccaatggttatagtgagctggaggtcagccaaaagcgcagtatgctggaaaatgtcatgcggacagattctgttgacacccataagtcacgccttaaagaagtcggtttccagcatgtagaagtctggttccagtgtttcaatttcggttcattactggcaataaaaggaactgaacaatga

SEQ ID NO: 2653 - DNA, 141 bp, Xenorhabdus bovienii
  Coding sequence Name=Xb4151_4152.C435.gene42.dna; Position on contig =27581..27721bp; Strand=-
atgcaaaccttaatgtacatcatgacacccatgcataagaaagcccatcattaccaagggcggtattccagccgcctgaggtttctgctgattatccctttctgccccttcccgcattctgttagaatgcccacttcttaa

SEQ ID NO: 2654 - DNA, 399 bp, Xenorhabdus bovienii
  Coding sequence Name=Xb4151_4152.C435.gene43.dna; Position on contig =27755..28153bp; Strand=-
atggttagctcgctttatatcgttttgggcgcactattattgattaagctgtctctggatgtcgtcaagttaagaacacaatatcgagtcgcctatggcgatggcggtttttacgaattgcagacagccattcgcgtgcatggcaatgctgttgaatatattcctatttcaatgctattgctgttgatgatggagatgaatggagccgccgtatggatgctacatatttgtggcctattgttgctttcgggtaggatactgcactactttggcctacgtcatcgcgaaatccgctggcgccgtatgggaatgggtgcaacgtatatatcaatgataataatgattatcaccaacatttactacttaccttgggaacaaatattttctttctatgcgtaa

SEQ ID NO: 2655 - DNA, 102 bp, Xenorhabdus bovienii
  Coding sequence Name=Xb4151_4152.C435.gene44.dna; Position on contig =28355..28456bp; Strand=-
atgggccaggctcaactgcccacaataattagtacgcatacaatatccttttactcagctcgttatgcattctgctgcggaaattttggcattgttctttag

SEQ ID NO: 2656 - DNA, 1770 bp, Xenorhabdus bovienii
  Coding sequence Name=Xb4151_4152.C435.gene45.dna; Position on contig =28418..30187bp; Strand=+
atgcgtactaattattgtgggcagttgagcctggcccatgaaggccaaaaagtaactctttgtggttgggtaaaccgtcgtcgtgatttgggcggcctgatcttcattgatatgcgtgatcgcgaaggtatcgttcaggtattttttgacccagaccaaaaagaagcatttgctcaggcttctgaactgcgtaatgaattttgtattcaaattacggggatagtccgagcccgtcctgacagccagatcaataaagaaatggccactggagaagttgaagttttcgcagatagcctgatggttttcaatcgttcagagccattgccactggatagcaatcagaacaacagtgaagaacagcgcttgaaataccgctatcttgacttgcgtcgcccagagatgtcactgcgcttgaagactcgcgcaaaagtcaccaattttgttcgtcgttttatggataatgcgggcttccttgatgtggaaaccccgatgttgaccaaggccacgccagaaggtgcgcgtgactatctggttccaagccgtgtccataaaggcaagttttatgcgttgcctcaatcaccacaacttttcaaacaattgctgatgatgtccggttttgaccgttattatcaaattgtgaaatgtttccgtgatgaagatttgcgggcagatcgccagccagaattcactcaaatcgatgttgaaacctcgtttatgactgcggaacaagttcgagaaatcatggaaaacatgatccgtgaattgtggcttgacgcacgcaatgtcgatttgggtaaattccccataatgacatttgcagaagcgatgcgccgctttggttcagataaaccagatctgcgtaacccgctggaactggtggatgttgctgatttagtaaaaaacgtggaatttgctgtttttgctgaacctgctaacgatccaaaaggccgtgtagctaccatttgtgtaccgggcggtgctgaactgagccgtaagcaaattgatgaatatggcaaattcgtcggtatttatggcgcgaaagggctggcatggatgaaagttaacaatcgtgctgccggtctggaaggagtgcaaagtccagttgctaaattcctgtcagcagaagtggtggaaggtttgttgtcccgtaccaatgcacaggatggcgatatcctgttcttcggtgctgacaagaaaaatgttgttaccgatgcaatgggagcgctgcgcctgaagctgggacgtgatctgaacatcactgatctggcgagctggaaaccgctttgggtgattgacttcccaatgtttgaagacaatggtgagggtggtctgcatgcaatgcatcatccatttacctctccatgtgatatgtcggcgacagaattggaacatgacccggaatctgccattgcgaatgcttatgatatggttatcaatggctatgaagtgggcggggggtctgttcgtattcatcgcaatgagatgcagcaggtagtattccgcattctgggtatcactgaggaagaacagcaggaaaaatttggtttcctgctgaatgccctgaaatacggaactcctcctcatgcgggtttggctttcggcttggatcgcctcgtcatgttgctgaccgatactgataatatccgtgatgtgattgcatttccgaaaacaacggcggcggcatgtttgatgactgaagctcccagttacgcaaatcctgcatcattggaagaattggcaatctcagtcgttaaaaaagagagcgaataa

SEQ ID NO: 2657 - DNA, 435 bp, Xenorhabdus bovienii
  Coding sequence Name=Xb4151_4152.C435.gene46.dna; Position on contig =30187..30621bp; Strand=+
atggattacaagcgccctgagtctgtattggttgtgatttatgcggctaccagcaaaagggtgctgatgttacagcggcgggacgatcctgaattctggcaatccgtaaccggtagccttgaagggaacgaaaaaccgtgggaggcggcgttacgtgaagtacaggaagaaattggcattgatattattaatgcgggttttgaactgacagattgtcaacgctgtctttattatgagattttttcacatttacgttatcgatatgctccgggtgtaacgcgcaataaagaacattggtttttgctggtgttacctgaggagcgtgagatcctgctgacagaacatttggcttatcaatggctggcggtcgaagaggctgccagattaactaagtcatggagtaaccggcaggcaattgaagagtttgttatttaa

SEQ ID NO: 2658 - DNA, 744 bp, Xenorhabdus bovienii
  Coding sequence Name=Xb4151_4152.C435.gene47.dna; Position on contig =30652..31395bp; Strand=+
atggcaggtcatagtaaatgggccaatacgaaacaccgcaaagcagcgcaagattcaaaacgcggtaagatttttactaaaattatccgtgaattagtaacagctgcacgtcttggcggaggcgatccggcttctaacccacgtctgcgtgcagccgtcgataaagcgctgtccaacaacatgactcgtgatacgctgaatcgtgccattgctcgtggtgttggcaatgatgacgcagataacatggaaaccatcatttatgaaggttacggtccggggggtacagcagttatggttgaatgtttgagcgataaccgcaaccgtaccgtttctgatgtacgtcatgctttcaccaaaactggcggtaacttgggtacagacggctctgtttcttacctgtttaccaaaaaaggtgtaatttcctatgcaccgggtctggatgaagatgcggtaatggaagctgctttggaagcgggtgcagatgatgtcgaaacttatgatgatggtgcaattgacgtttataccacaccagaatcttttggcgatgttaaagatgcactggatgcagcaggtttcaaggcagaatctgcggaagtttctatgatcccgtccaccaacgcggaattggatgcagaaacagcacctaaattacttcgtctgattgatatgctcgaagattctgacgacgttcaagaggtttaccacaatggtgaaatctctgatgaaattgcagcgcagctgtaa

SEQ ID NO: 2659 - DNA, 141 bp, Xenorhabdus bovienii
  Coding sequence Name=Xb4151_4152.C435.gene48.dna; Position on contig =31373..31513bp; Strand=+
atgaaattgcagcgcagctgtaattaccatcagggttcacagcgtagagaaagtgttccttatctcagggcactttctctaacgtttttatcccatatcacaggtggaataaatcgatatggcgattattcttggtattga

SEQ ID NO: 2660 - DNA, 522 bp, Xenorhabdus bovienii
  Coding sequence Name=Xb4151_4152.C435.gene49.dna; Position on contig =31491..32012bp; Strand=+
atggcgattattcttggtattgaccccggctctagagttacggggtatggtgtgattcgccagcagggacggcaacttatctatattggtagcggttgtattcgaacaaaagtagatgatttacccaatcgtttgcagaggatctatgccggtattaccgaaattattatccaattccgaccagatgtttttgcgatagaacagattttcatggcgaaaaatgcggattcagccttgaaactggggcaagctcgtggtgtggcgattgtggctgcggccaatgaatccattcctgtatttgaatatgcagcccgtcaagtcaagcagaccgttgttggtactggggcggcagaaaaaagtcaggttcagcatatggttcgctctatgcttaaattgtctgctaacccgcaggctgatgccgcagatgctctggctattgcgattactcattgccatttgaaccaaaatttattgcgtgtgggtgatgtgcggttaaatttaacgcgagggcgtttgaaataa

SEQ ID NO: 2661 - DNA, 618 bp, Xenorhabdus bovienii
  Coding sequence Name=Xb4151_4152.C435.gene50.dna; Position on contig =32094..32711bp; Strand=+
gtgatagggcgtttgagaggaaccgtgttggaaaagcagccaccattagttttattagaaaccaatggtgtcggttatgaagttcatatgccaatgacctgtttttatgaactgcctgaaatcggccaagaggctactttattcactcaatttattgtgcgtgaagatgctcagttattatacggttttaatgataaacaagagcgcgcactttttcgtgaactgattaaagttaatggcgtagggccgaagctggcactggcgatcctgtcagggatgtctgctcagcaatttgtgactgcgattgaacaggaagccattacctcattggtcaagttgccgggagtcggcaaaaaaacggccgaaaggctggttgtggaaatgaaagatcgctttaaaggccttaacggtgatctgttcaaccaaagcaacgatattaatttacctgcggtggctaaacaagccaactctaatacggatattgaagcagaagccgcttccgcattggtttcactgggatataaactgcaggaagccagccggatggtaagtaaggtggctaaaccgggcgcagattgtgaaacgcttattcgagaagcgctgcgtgcggctctgtag

SEQ ID NO: 2662 - DNA, 1008 bp, Xenorhabdus bovienii
  Coding sequence Name=Xb4151_4152.C435.gene51.dna; Position on contig =32728..33735bp; Strand=+
atgattgaagctgaccgtctgatttcagcagaagttctgcaagatgatgaagtcattgatcgcgctatcaggccaaaactactgtctgaatatgttgggcaacctcacgtttgtgaacagatggaaatttttattcaagctgcccggcaacgaggagatgcactggatcatttgctgatttttggccctccaggattgggtaaaaccacgttggctaatatcgtagcgaatgaaatgggcgtcaatctccgcacaacatcagggcctgttctggaaaaggcaggtgatcttgccgccatgctaaccaatcttgaaccccatgatgttctgttcattgatgaaatccatcgcttgtctccggttgtggaagagatcctttatcctgcaatggaagattaccaactggatcttatgattggtgaaggcccagccgctcgttcaataaaaattgatctgcctccatttacgttagttggtgcaacgactcgtgcggggtctttaacctccccattacgcgaccgatttggcatcgtacagcgccttgaattttataacgtagatgatttacagagcatagtttcccgtagtgctcgctatatggggttgggcatttcagaagagggagcaaggcaaatagccatgcgttcccgtggtacacctcgtattaccaatcgtctgctgcgtcgtgtgagagatttctctcaggtaaaaggggatggctctattaacggcgacattgcagtccaagctctcgatatgctgagtgtcgactcggcaggttttgattatcttgaccgtaagctattaattgcgattattgataaatttatgggtggccctgtgggggtggataacttggcagccgcgattggtgaagagcgggaaaccattgaagatgttctggaaccatttctgatccagcaaggttttatccagcggactcctcggggaaggattgctaccaatcatgcttatcggcattttggactgagtaaagaagcggagtag

SEQ ID NO: 2663 - DNA, 162 bp, Xenorhabdus bovienii
  Coding sequence Name=Xb4151_4152.C435.gene52.dna; Position on contig =33759..33920bp; Strand=+
ttggttgctaaaagctggaatgtgtgcgccattcgtcgcggtaacagtgctgaaatcagcctaaaagccagcatacgacgaaaaacgaatatggctaatatgagcagtgagtatttggacaaggtattaattgcaggctttcaggtgttgagtgagaaataa

SEQ ID NO: 2664 - DNA, 141 bp, Xenorhabdus bovienii
  Coding sequence Name=Xb4151_4152.C435.gene53.dna; Position on contig =34054..34194bp; Strand=-
atggttttaaatcagccaaaaatatacctgtttgtctatctttgtgatccaagacagatcacatcttttaaagattttttgtcaaaacaaggtattaatgaatttattatttcatctactaaatatttaaagttgatctaa

SEQ ID NO: 2665 - DNA, 657 bp, Xenorhabdus bovienii
  Coding sequence Name=Xb4151_4152.C435.gene54.dna; Position on contig =34199..34855bp; Strand=+
atgggatggataatgaaaaagatttctgcgcttgtattggctgctgctacattagctccgtcattgacctttgctcatgaagcaggtgacttcctgttccgcgcaggtacagcaacggtaagaccgaatgctggatctgatgatgtgttaggtcagggatctttcggtgtaaataataatacgcagctgggtttgacttttggttatatgatcaccgataacattggcgttgaattattagccgctacacctttccagcatcgtgttaatttaccgaaagccggtgatgtggctaaagttaagcatttacccccaactttgatggcacaatattattttggcgccaaagaaaataacttacgtccttatgtgggggttggtgtgaattacactacattctttagcgaaaaatttaatgacaataatgcaaccgttgaagcagcaaaactaaatagtctggatctgaaagattcttggggtattgctggtcaggttggtttagattatcagttggataaaaactggatactgaatacctcattgtggtgggtgaatatcgaaactgacgtgagattcaaagctggtgatgcagaacaaaaatataaaactcgccttgatccatgggtatttatgtttggtgtcggttataaattctaa

SEQ ID NO: 2666 - DNA, 123 bp, Xenorhabdus bovienii
  Coding sequence Name=Xb4151_4152.C435.gene55.dna; Position on contig =34984..35106bp; Strand=-
gtgagaaagtctacttgcttcgatccgcaatggcgatatcgccattgcggatcgaagatacaacaaggctttcacctaggaagagtcgtttccggtagggaacgaaataacactttaagctaa

SEQ ID NO: 2667 - DNA, 1176 bp, Xenorhabdus bovienii
  Coding sequence Name=Xb4151_4152.C435.gene56.dna; Position on contig =35119..36294bp; Strand=-
atgacacgacgcgaaaaaatcattctgacgagtacgggagtagggataattattggtgtttgtgccctgattttctttttcgtcctgccaaggctcgttgaaacacggatgaatcgtgtgatcggggttactgatgtagcaacacaaaccgcggttgacttgcacaagcgtctgctgatcgccgacttgcatgccgatacgctgctctggggcagggaccttttggatcgatcgacgcgtgggcaagtcgacataccgcgtttgatagacggcaatgtggctgtgcaggtctttgctgttgtttctaagtcaccacgtgggttgaatatcgagaagaatagcgccgaaactgacgatgtgactttgcttgctctggcacaatgttggccttggcgaactctgttcagtttaaaagaacgggcactctatcaagcagcacgcctgcatgaggctgccgctcgttcaaatgggaaactggtggtgatcaaaagccgtgctgatttgaaggccttccttgaaagacgcaggagtgacccaaagattgtgggtgtgctgctcgcctcagaaggcgcacaggttctcgagggcgacccaaccaatgtggatgtgcttttcgaagccggctaccggatgatggcacctactcatttcttcgatacagagttcggcggatctgcccatggtattgaaaaaggtgggctaactgctgccggtgccgatatggtgcggcgaatggaggcaaagagtatgatcattgatttggctcacgcctcgaccaaaaccattgatgacatactggtaatcgcgacgcgacccgtggtcgtttctcatactggcgtcaaaggtacttgtgacaacattcgtaatctgtccgatgaccaactcaggcggattgctgcaatgggtggactgatcggtatcggtttttgggacaaagcagtgtgcgatcctactcccaccggtatcgctaaggcgcagatttatgcggctaatatcgccggcgatgatcatgtagcccttggatctgactttgacggtgcggttgagatgcccttcgacgctactggcctcgttagtattactgacgctttactgaaaaatggcgcacatccagagaggattgctaaactgatgggtgagaatcaaatccgttttctattggaaaaccttccatag

SEQ ID NO: 2668 - DNA, 315 bp, Xenorhabdus bovienii
  Coding sequence Name=Xb4151_4152.C435.gene57.dna; Position on contig =36388..36702bp; Strand=-
atgaaactattaaaagtggtctctacgttttttgtaactgctgttatggcgatgacgatctctgcatgtgctccaacagcaacaacagaaagtacagggaattatattgacgataccgtcattacagccaaagtaaaatcagcattacttgaggccaacaatctaaaatccagggaaatcagtgtagaaactttcaaaggccgtgtacagttaagtggattcgttagctctcctgaagacgtcacacgtgcaatacaaatcactagaggcattaagggtgtcaataccgtgattaattcaatcaagcttcgataa

SEQ ID NO: 2669 - DNA, 174 bp, Xenorhabdus bovienii
  Coding sequence Name=Xb4151_4152.C435.gene58.dna; Position on contig =36730..36903bp; Strand=+
atgtttatttatcgaaacattattctcatttttactttaagtatcatgccattgtgtcatacccgtactcagaaagtattgttgaaaacaggaaaatctacaaatgatagggggaaatatttattttcggatggtgaaaggttggcggcaatagcttcccccatcatctattga

SEQ ID NO: 2670 - DNA, 807 bp, Xenorhabdus bovienii
  Coding sequence Name=Xb4151_4152.C435.gene59.dna; Position on contig =36921..37727bp; Strand=-
atggaacgttatgagcagctatttaaaaaactagaaaaccaaaaccagggcgcttttgttccttttgtcaccttgggcgatcctaatcctgagttatctctggagattattgatgcacttatcgctggcggagcggatgcgctggaattaggcattccattttccgatcctctcgctgatggccctaccatccaaaatgcgaatttacgggcattatcttccaatgttacatctgcattgtgttttgagctgctgtctcaaatccgaaccaaatatcctgatatcccgattggattgctgatgtatgcaaatctggtttttcacaatgggatcgatgaattttatcgctgctgtaaaaatgccggcgtcgactctgttttgatcgctgacgtaccgttatcagaatcgcgtaatttccgctcagctgcactgaaatatgacattgctccgatattcatttgcccaccaaatgcagatgatgatctactgcgtgaaatagcagtatgtgggcggggttacacttatctgctgtcaagagccgggatcactggaactcagaaccgggctgaatatccactaacgcatctggttaataaactcaaagagtatcatgccgctcctgcactacaaggttttggcatatcagagcctgcacaagtcacatcagtactcgatagcggcgcggctggcgctatttccggctccgctgtggtaaaaatcattgaagataatttaaaccagccccaaattatgctggaaaaactggagacgtttgtccgcaccatgaaaaccgcgacacaacgttaa

SEQ ID NO: 2671 - DNA, 1203 bp, Xenorhabdus bovienii
  Coding sequence Name=Xb4151_4152.C435.gene60.dna; Position on contig =37727..38929bp; Strand=-
atgatgcgaataatgagtaaactgaatccttattttggtgactttggtgggcagtttgttccccaaatcttgatccccgcacttgatcagttagaagaagtatttattgaggcgcaaaacgatcctgaatttcaacaaacctttcaagatctactgaaaaactacgcaggccgtccgaccgccttaaccttatgccagaacctgaccaaaggcacaaaaagtcgtctgtatttaaaacgggaagatttgctccacggtggtgcgcacaaaaccaatcaggtattaggacaggcattgctggcaaagcgaatgggtaaaaacgaaatcattgccgagactggagccggtcagcatggtgtggcaaccgcactagcctgtgcacttttggggctaaaatgccgtatttacatgggagccaaagatattgaacgccaatcccccaatgtctttcgtatgcgtctgatgggcgctgaagtcattcctgttcacagtggtgccgcaaccctgaaagacgcctgcaacgaggccatgcgtgactgggctggttgctatgacaaagcccattatttgctgggaaccgccgccggcccccatccttatccaacgatagtgcgtgaatttcaacgaatgatcggcgaggaagccaaggcacagattatggaaaaagaggggcgtttacccgatgccgttatcgcctgtattggcggcggctcaaatgccattggcctgttcgctgaattcattccagaaactaatgttcgcctgattggtgtcgaaccggcaggacatggtatcgaaaccggagaacatggtgcgccattgaaacatggcaagctagggatctacttcggcatgaaatctccgatcatgcagacggaagacgggcaaattgaagaatcttactctatttccgccggcctggattttccttctgtcggcccccaacacgcttacctaaacaatattggacgcgctgattatgtttcagtcactgacgatgaggcaattgacgcattcaaggctctgtcgcacaacgaaggcatcattcccgcgttagagtcctcacatgcacttgcccacgccttgaaaatgatccatcaggctcctgataaagaacaattattgattgttaatttatctggtcgtggcgacaaagacatctttaccgtacacgatattttgcaatccaggggggaaatctga

SEQ ID NO: 2672 - DNA, 1365 bp, Xenorhabdus bovienii
  Coding sequence Name=Xb4151_4152.C435.gene61.dna; Position on contig =38949..40313bp; Strand=-
atgaagaacaacatattacagaagattgttgatgataaggcagcatatctggccaaacgcaaagcagagcagccattggaaagctttattgattcccttgtgccgagccatcgtcagttttatcaggcactgagccataagcaaacagtttttattctggaatgtaaaaaagcttccccttcaaaaggattaatttgtaccgatttcgatccggttcgcattgctaaaacttaccaaccttacgctgccgcaatttctgtgctgacagatgaaaaatatttccagggcaactatgattttctccgcatggttagctctgcggtacaccagccagttttgtgcaaagatttcatcattgatgcctatcaggtttatctggctcgttattatcaggccgatgccattttgttaatgctttcggtgattaatgatgagacttatcgtgaactatccgcactggcacacagccttgatatgggcgtattgacggaagtcagtaccgaagatgaacgtcgccgggcaattgtgctgggagcaaaagtcatcggcattaacaatcgagatctgcgtgatctgtccatagatttagatcgcactcgcaggctggcaactgatttaccagaaggcaccattatcatcagcgaatcgggcatcagccagcatcaacaggtacgtgaattaagccgatttgcccacggtttcctgataggcagtgctttaatggtacagtcagatttagatctcgccttgcgtcggttgattctgggtgacaataaaatctgtggtcttacccgtccacaagatgccaaaactgcattacaggccggtgctgtttatggtggcttaattttcgcagaaaaatcaccgcgcaaaattaatctgcaacaagcccagcagatcatcaatgaagctcccctgcaatatgttggcgtatttcaaaaccaaccattagattttgtcagtggtatcgcccgacaactttcattgaatgcagttcagttgcatggcaatgaagataaaaactacatcaatgcacttcgtcctttactacctgaatattgtgagatttggaaagctattgatatgtcaaaggctacagaattttccgaaatatccaatatcgaccatttattgctggataatggggcgggaggaacagggaaaacctttgactggcaatcaatcgatcagcgttttcaacgtaacagcatgctggccggtggattaaatcctgaaaactgccaacaggcagcagcgctaggatgttatggactagattttaattctggtgtcgaaacaagcgttggcatcaaaaacagtcaaaaaatcaaactaatattccaacaattacgctgttatcactaa

SEQ ID NO: 2673 - DNA, 999 bp, Xenorhabdus bovienii
  Coding sequence Name=Xb4151_4152.C435.gene62.dna; Position on contig =40316..41314bp; Strand=-
atgcagttaattttcgaaaaattgttcagtgcccaaacactgacacaacaagaaagccagcaattatttaccgcaattgtttgcggtgaactgagtgacgctcaattggcggctgtactggtcagcatgaaactgcacggcgagcagccacaagaaattgcgggtgcggcgcaggcattattggcgaatgcctcaccctttccacgtcctgattacacattctgcgatatcgtaggtacaggcggagatgggacaaacagcatcaatatttccacaaccagcgcatttgtcgcggcagcctgtggccttaaagtagcaaaacatggaaatcgcagtacctccagccgttcgggatcatccgatttactgaccgcgtttggcatcgcattaaatgccagtgccgaggattcacgcagtgcgctggatgaaatcggtgtttgttttctgttcgctccacaatatcacagtggattccgccatgttgtacaggttcgccaacagttgaaagttcgcacattatttaatgtactcggtccattgatcaacccggcacgtcccccgctgacactgattggcgtttacagccccgaactggtggctcccatcgcccataccttgcaggtattgggctatcagcgtgccgcagttgtgcatagtggaggaatggatgaagttgccttacatgcccccactctcgttgcggagctaaatcatggtgaaattatccaatatcaattaaccgcaaaagattttggattaccgaactatccaatatcttcactgaaagggggatcaccggaagaaaattgcgatatgttgagactattactacaaggtcgtggacaaaaagcgcatgttgatgccgttgccgcaaatgtagctctcttgatgaaagtccacggacaagaaaatctacgggaaaatactcaactggcattaaatacgatttacagcggtcaagcctacgaaaaagtgaccgcattagcggcaaggatttaa

SEQ ID NO: 2674 - DNA, 579 bp, Xenorhabdus bovienii
  Coding sequence Name=Xb4151_4152.C435.gene63.dna; Position on contig =41329..41907bp; Strand=-
atggcaaatattcttctgctcgataatgttgattcgtttacctataacctcgtggatcaactgcgtgtcggtgatcatcaggtcgttatctaccgcaatacggtgtcaacagaaacaatcatggcacagcttagtcagatgaaatcaccgcttctaatgttatcacccggcccgggaaagccggcagatgctggctgtatgccccagttactcaaacgtattattagccaaattcctgtgattgggatatgtcttggacaccaagcgattattgaagcttatggtggaacaatctctgccgccagagaaattctgcacggaaagtctactctggccactcatgatgggcaggccatgttttccggcctaatcaaccctctgcccgttgcccgttatcattcccttacggggataaatattcccgacacgctggtggtctcagcttcttgtggtgatacagtgatggcggtacgtcatgacaggcacaaagtctgtgggttccagttccatcctgaatccatcctgaccacacagggagctaaattacttgaacaaactctggcatgggtacaggaataa

SEQ ID NO: 2675 - DNA, 1560 bp, Xenorhabdus bovienii
  Coding sequence Name=Xb4151_4152.C435.gene64.dna; Position on contig =41907..43466bp; Strand=-
atgacggatctaaaccttaagatttcaatcaagcaagtagacactgtttaccaaacagacccaactctacttttcaatcagctttgtggtaatcgttcagccacgttattgctggaatcggctgaaataagcagcaagaagaatttgaaaagcctgttaatcatcgacagtgccatgagaattacagccaacgaacaacaagtcacttttgaggccctcaccgaaaatggccgaaatctactacctatactcaccgatttactctcagcaaaagcccaactacatgttggattacatattctccaagcacagtttcccgccaccaggcacaatctggatgaagacagtcgcttaaaggccgattccattttcgatgcattgcgggcactaatgacattatcctccctttctggaactccagacgcaattttcgtgggtggactgtttgcttacgatttagttgcaggatttgaaccgcttcccaaggtcaaaactcatcaacgttgccctgatttctgtttttatctcgcagaaatgctattagtggtcgaccatcgaaataaacacgcattcttacaaacgtcactgtttggtgaatcagattcagaaaaacagcgtcttcatgaccgcctgaccacattaactgctgctattttggaacccggccaaccacttgaatctgtgaaattaccagacatgaccattgcctgtaatcaaagtgatgaccaatatgcagatatcgtgcaacaattacagcaatccatccgtcaaggcgacatttttcaggcagttccgtcacggcgtttcaccttaccctgtccttccccactcaatgcttaccaaacgctgaaacatcaaaaccctagtccttacatgttcttcatgcaggatcaggacttttgtctgtttggtgcttctccagaaagcgcccttaaatatgataccagtagtcgtcagattgaaatctacccaatagccggaacacgtccccgtggacgcaatgccaacggcacactggatgccgatctggatagccggattgaactggaaatgcgtacagatgccaaagagctgtctgaacacttaatgctggttgatctagctcgcaacgatttagcacgcatttgtgaaccgggtagccgctatgtggcagatttaaccaaagttgatcgctattcgtttgtcatgcatctcgtttctcgtgtcgtaggcacactccgccacgatctggatgtctttcatgcttatcaagcgtgcatgaatatgggcacattgacaggagccccaaaagttcgggcgatgcaactcattgcacaacatgaaggtgaacgacgtggcagttatggtggtgcggtcggttatttcactggtaagggggattttgatacgtgcattgtgattcgctctgcctatgtagaaaacggcatagctgtcgttcaagtaggtgctggcattgttttagattccattcccgaatcagaaatcgatgaaactcacagtaaagccagagccgttattcgtgcgattattcaggcacacaaagcggaggtgatattctaa

SEQ ID NO: 2676 - DNA, 165 bp, Xenorhabdus bovienii
  Coding sequence Name=Xb4151_4152.C435.gene65.dna; Position on contig =43556..43720bp; Strand=-
atgattgacaagcgaattttgatccagtttactagtacgaaggttggcaggaacacatggccattattccatttaacaaatgaggcgctggagatgatcatacttatgaaagcaatccgttggtggcaaaacttcccattcagggcggttgaatcacgcacataa

SEQ ID NO: 2677 - DNA, 198 bp, Xenorhabdus bovienii
  Coding sequence Name=Xb4151_4152.C435.gene66.dna; Position on contig =43821..44018bp; Strand=-
gtgataaaactccatctgaagcggttgtatggctatgtaaatcatagcgctttatcatgtcattggttacggtcatcaccctctaatcctcaatcctacagcagcccctattctatcccacttcattctatctttttaatttggtttataaacaggatctttagcaccaacaccctatttttgtatatcttccattaa

SEQ ID NO: 2678 - DNA, 858 bp, Xenorhabdus bovienii
  Coding sequence Name=Xb4151_4152.C435.gene67.dna; Position on contig =43943..44800bp; Strand=+
atgaccgtaaccaatgacatgataaagcgctatgatttacatagccatacaaccgcttcagatggagttttatcaccagagcagcttgtggatagagcggtttctatgggtatcaacgtactggcaatcaccgatcatgacactacggatggtattccgcctgctcgtgtatatattcagcaacagaatttaccactgtcgctggtggctggcgttgaaatttcgacattatgggagaattttgaaatccatattgtcgctctgaatatcgatactgattgcgtttttttgacaaattttctctccaatcaggtaacgttgagaaaacagcgtggtattgaaattggacaacgccttgctaaggtgggtatccctgatgcctgggaaggtgcctcccgcttggcaaatggagggcaggtcactcgcgggcattttgcccgttatttgattgaagcgggagttgaaccgacaatcccgaaagtattcaaaaaatatctggcgaagggaaaaatcggttatgtccctgctcaatggtgtacaattgagcaggctattgaaactattcatcaagcaggggggcaggctgtgattgcccacccgggcaggtatgatttgtcgatgaaatggctgaagcgtttgatagcctggtttcaacagcatggcggtgatgcaatggaagttgcgcagtgtcagcaggcacctaatgaaaggcaacaacttggtcaattggcaaaggaatatggacttaaagtatcattaggatcggattttcaccaaccctgttcatggatagagctagggcgcaatttgtggttacccggtgatgtaataccgatatggcatgattggtcacgctag

SEQ ID NO: 2679 - DNA, 555 bp, Xenorhabdus bovienii
  Coding sequence Name=Xb4151_4152.C435.gene68.dna; Position on contig =44895..45449bp; Strand=+
atgttaaaaaagggtggggttgttatttatccaactgattcaggttacgctattgggtgctgccttgaaaacaaggatgccatgacacgcatatgccgtattcgtcaattggatggacgccacaattttaccctgatgtgccgtgatctttctgaaattgcgacttatgcgcatgtggataatcaggcattcagattgataaaaaataatacgcccggtaattacacttttattttacaggcgacgaaagacgttccccgtcgtttgatgaacgaaaaacgtaaaactatcggcctacgtgttccttctaatcctattgctttggcattactggaaggaatgagagagccactgatgtcatgtagcttgattttacccggaaatgattttgcggagtctgatccagaagagattaaggatgtactgggtaaacaggttgatttaattattcacggtggttatcttgggcagcaaccgacgacagtaattgatttgaccggagattctccggcggttctgcgcgaaggtgaaggggatgtaacgccttttctataa

SEQ ID NO: 2680 - DNA, 954 bp, Xenorhabdus bovienii
  Coding sequence Name=Xb4151_4152.C435.gene69.dna; Position on contig =45515..46468bp; Strand=+
atgagcgataaaacacaaaaaacgcaaaaaacagaaagaacagaaaagttacaaaaaattctcgcgcgtgctggtcatggttctcgccgcgaaattgagggctatatccaagaggggcggattagcatcgatggcaagaccgcaacgttgggtgatcgcatcgaagtcaaaccttccataaaaattcgccttgatgggcgtatcttaagtatcaaagaaccacaaaaaacgatttgtcgcgttctggcttattataagcctgaaggtgaactgtgtactcgacatgatcctgaagggcgtccaactgtgtttgatcgcctgcccaaaatgcaggatgctcgctggattgccgtagggcgtctggacatcaatacttgcggactgttgctgtttacgacggatggagaactggcaaaccgcctgatgcatccaagccgtgaagttgagcgtgaatatgctgttcgtgttttcggtgaagtagacaatgcgaaacttcggcagttgacacaaggcgttcagttggaagatgggcctgcctcctttaaaacagtctcatttaagggtggtgaaggtatcaaccagtggtacaacgtgacattgacggaaggtcgtaaccgtgaagtcagacgtttgtgggaagctgttggtgtacaagttagccgcttgatccgtgtccgttatggtgatatcgatctaccgaaaggtttaccacgtggtggatggacagaattgggattggagcagactaactatttacgtcagctggttgatttaaatgaagaaactatgtccaaagttgcggttgagcgtgaccaacgccgtatcaaggccaatcagatccgccgggcagtaaaacggcattctcaggtcggttcttcccgtccagcggggaaacgccctgcaagtagctctcgtcagaatgcaggaagaaaagcggcacctaaaggtcgttaa

SEQ ID NO: 2681 - DNA, 117 bp, Xenorhabdus bovienii
  Coding sequence Name=Xb4151_4152.C435.gene70.dna; Position on contig =46434..46550bp; Strand=+
atgcaggaagaaaagcggcacctaaaggtcgttaatgttccggagtcgctgtttcagtgttatatcaaggctggaacagcggctttttatctatcttaccaatcaacccctttctga

SEQ ID NO: 2682 - DNA, 597 bp, Xenorhabdus bovienii
  Coding sequence Name=Xb4151_4152.C435.gene71.dna; Position on contig =46529..47125bp; Strand=-
atgccaatggataacggacagtacaaaaaaagacaacagcgcctgaaagaaaaagttgatgcccgtattgaggcggctcaacaaaaacgagggatcgtcataatattcaccggtaatggtaaagggaaaacaaccgctgcgtttggcacagtcactcgtacaatcggccatggtcagcgtgctggtgttattcaatttatcaagggaacttgggaaagcggcgaaaggaacctgctggcacaacagggtgttgagtttcatgtcatggcgacagggtttacatgggaaacgcaaaaccgtgaaactgatatcgcagcctgccaagctgtatggcaacatgccctgacgatgttatccgactcctcattgcagcttgtcgttttggatgagctgacctatatggtcagttacaaatatcttgacctaatcgatgtactgaccgcacttaaacaacgtcctatccatcagtctgtcattattaccggacggggctgccatcgtgaattacttgaacttgcagatactattacagaaatgcgcccagtaaaacatgcgtttgatgcgggaataaaagctcagaaaggggttgattggtaa

SEQ ID NO: 2683 - DNA, 375 bp, Xenorhabdus bovienii
  Coding sequence Name=Xb4151_4152.C435.gene72.dna; Position on contig =47125..47499bp; Strand=-
atgctgactcaggtgttaattcccctgttattaaaatcccccaaaggctctctggtatttaccagttccagtgtggggcgtgtaggaaggagtggctggggtgcatatgctgtttctaaatttgcgacagaaggtctaatgcaggttttagcgcaggagtatcaagaaatcggcttgcgtattaactgcattaatcctggagggacacgcaccggtatgcgtgcgagtgcatttcctgatgaaaatgcgaccaaattaaaaatcccggccgagatcatgccgatctacctctatctgatgggtgatgacagcctgagtgattcaggtatcagctttgatgctcagccgggtcgtaaagcggggcctgccaaataa

SEQ ID NO: 2684 - DNA, 288 bp, Xenorhabdus bovienii
  Coding sequence Name=Xb4151_4152.C435.gene73.dna; Position on contig =47381..47668bp; Strand=-
gtgacggccgaagaatgccaggcctttgcagatgaactcactcaacgttatccccgtttggacggggtattgcacaacgcaggtctgctgggtgttgtcgcacctgtcctagaacaacctgttcagctttggcatgaagtcatgccaagtgaatgtcaacgcgactttcatgctgactcaggtgttaattcccctgttattaaaatcccccaaaggctctctggtatttaccagttccagtgtggggcgtgtaggaaggagtggctggggtgcatatgctgtttctaa

SEQ ID NO: 2685 - DNA, 294 bp, Xenorhabdus bovienii
  Coding sequence Name=Xb4151_4152.C435.gene74.dna; Position on contig =47681..47974bp; Strand=-
atgacagacttcatgtgtcagcctaaaatggcagatgtacacgccttaagtaatagctttaaaaaacaggaagatagtcagatgttagattaccaacccaatcatgatctgctgcaacagaaaatcattttagtcaccggtgccggagacggcattggtcgtgaagcggcgctaacttatgctcgctacggtgcacaggttattttgctggggcgcacaacagcaaaactggaaagcggtcaaacagcaaatcgaaaacgaaggcggcttacccggttaccatttatacaatag

SEQ ID NO: 2686 - DNA, 1047 bp, Xenorhabdus bovienii
  Coding sequence Name=Xb4151_4152.C435.gene75.dna; Position on contig =48134..49180bp; Strand=+
gtggagtatttgtctctatatggactgttcttggccaaagtagctactgtggtattagcagtcgtcgttcttgcagtattttgtattggattgggtgtacgtaaaaccacgcagaaaggtgaattgcgtctgaccaatctgggtgaatcatacagggaaaaacagcgccagatgcagcaggctcggatgaatgatgcagagcagaaaatttggcaaaaggcgttaaaaaaacagcagaaaaatgatgccaagcagaaaaaggcagaggctaaagcgagtcagaaagttttacagaaatcgaacctttatgttctggattttaaaggcagtatggatgcccatgaagttgattctctccgtgaagagataagtgccatactcgctgtggcagatagcaaagatgaagtgttactacgtttagaaagccccggcggtatggtacatggttatgggcttgctgcatctcagttggctcgtttgcggcagaaaggaatacgtttgacgattgccgtggataaagttgccgcaagtggtggttacatgatggcttgtgtggcagatcgtattattgctgccccttttgcgattattggttctatcggtgttgtggctcaactcccgaatatccaccgattgctcaagaaaaatgatattgatgtagaactgcatactgccggggaatacaagcgtactctgactgttctgggagaaaatactgagcaaggacggcagaagtttcaagaagatctgaacgaaactcatcaattatttaaatcatttatttatcagcatcgtccatctctggatgtggaaaaagtagccactggcgaatattggtatggtacgcaggcaaaagaaaatgggttaattgatgatgtgggtgttagtgatgatttcctgattgaacagatcgaacactgtgaagttattggggtcagctattcccgtcgtaaacgtgtgatagaacgtttcatggggagcgcaatggagaatgttgataaattgtttatgcgctggtggcaaagaggcgaaaagccattgttctga

SEQ ID NO: 2687 - DNA, 198 bp, Xenorhabdus bovienii
  Coding sequence Name=Xb4151_4152.C435.gene76.dna; Position on contig =49220..49417bp; Strand=-
ttgaatagtgacaatttgtctactgtgaaaagcaccgttgcgtttaatatttttaaacatttagcacatagattatccgaaaaatatcatttagcagacgataaatttgatcaggtaatctctaacagattattcattattgtgcgggtaataagggagatccaaactgccaccttattaccctttattgttttataa

SEQ ID NO: 2688 - DNA, 129 bp, Xenorhabdus bovienii
  Coding sequence Name=Xb4151_4152.C435.gene77.dna; Position on contig =49558..49686bp; Strand=-
atgcaattgtatgatttaacagttgtaaacaaaatcttccatctgcatgacgaaaagcccacactctacctgataaaaaacgatgcgcaacaacttatttctcagaggagcataatctatgcaaactga

SEQ ID NO: 2689 - DNA, 2592 bp, Xenorhabdus bovienii
  Coding sequence Name=Xb4151_4152.C435.gene78.dna; Position on contig =49876..52467bp; Strand=+
atgggtaaagctcttgttatagtggagtccccggcaaaagccaaaacaatcaataaatatctggggaatgactacgttgtaaaatccagtgtaggtcatatccgtgatttgccgaccagtggagcagcgagtcaaaagagttcgaactcatcaactgataagaataaaaagaaaaaggatgagaagacagcgctggttaaccgaatgggagttgatccctatcacggttgggaagcggattaccaaattttgcctggtaaggaaaaagttgtcgcagaactgaaaatgcttgctgaaaaagccgatcatatctatctcgcgacggatcttgaccgtgaaggggaagccattgcatggcacctacgagaggttattggtggaggagaggctcgtttcagtcgggttgtatttaatgagatcaccaaaaatgctatcactcaggctttcgacaatcctggtgaactgaatatcgaccgtgtaaatgcacagcaggcgcgccgttttatggatcgcgtcgtgggttatatggtttcacctctgttgtggaagaaagtcgccagagggctgtctgccgggcgcgttcaatccgtggcggttcgccttatcgttgagcgggaacgtgaaatcaaggcctttgtgccagaagaatactggcaattacacgcggacttaatggctaaaggagacattgatcttcatatggaagtcacccatgaagggggaaaaccattcaagcccattaacgcacagcaaacacaggctgcggtatccttgcttgaaaaagccagatacaaagttcttgatcgtgaagaccgcccgacgtccagtaaaccgggcgcgccattcattacttcaacactgcaacaggctgccagtacgcggcttgggttcggtgtcaagaaaacgatgatgatggcacagcggttatatgaagcaggacacatcacgtacatgcgcacagactcgactaatttgagtcaggatgcactggacatggttcgtggttatatcaatgatcaatttggtgacaaatatttgccaaaaacggccaatatctatagcaataaggaaaattcgcaggaggctcatgaagctatccggccttccagtgtagatgtcatggcggaagaactaaaagatatggaagccgatgcacaaaaactgtatcagcttatctggcgccagttcattgcctgtcaaatgatgccagcgaaatacgattccactacgctgacaattcaggcggggaattttgaactccgtgccaaaggtcgtacattgcgttttgatggttggactaaagtgatgccagcattgcgcaagggggatgaagatcatactttaccagtggttgaagttggcactgaacttgatttgaaacagttgagcccaagccagcatttcacgaaaccatcggcacgtttcagtgaagcatctctagtcagagagttggaaaagcgtggcattggtcgcccatcaacctatgcatcaattatttcaactattcaggatcgtggttatgtgcggggtgaaaaccgtcgattttatgcggaaaaaatgggtgaaatcgttaatgatcgtttagaagagaacttcaacgaattaatgagctatgattttaccgcaagaatggaagaccagctcgatcacgtcgccaataacgaagctaattggaaaggggtactggacgagttttttaccaatttcagtgaacagcttgatgttgctagcaaagatcctgatgaaggcggtatgcgtccgaatccaatggtgagcacttctattgattgtccgacgtgtagtcgcccaatgggtattcgcacagcgacaacgggggtatttcttggctgctctggctatacgctatcaccgaaagaacgttgcaagcaaaccatcaatttaatcccggaaaacgaaattctgaacattcttgaaggggatgaggcggaaactaatgcattgcgtgcccgccatcgctgtaaagaatgtggtacagcgatggatagctatcttattgataaccaacgtaagttacatgtttgtggtaataacccagcatgtgatggttatgaagtggaagaaggcgaattccgaatcaaaggttatgatggcccaatcgttgagtgtgataaatgtggttcagaaatgcacttaaaaatggggcgtttcggtaaatacatgggatgtacaagcgaagagtgcaaaaacacccgtaagatcctccggagcggagaagtcgccccaccgaaagaagatccagttccattgcctgaactgccatgtgaaaaatcggatgcctattttgttctgcgcgatggtgctgccggcgtatttcttgcagctagtacgttccccaaatcgcgagaaacccgagcaccgctggttgaggaacttgtcaagttcaaggatcgcttgccagagaagctatgctatctggccaaggctcctgttgctgaccctgaagggcataaaacagtagtacgttttagccgtaagacgaagcagcaatatgtatcttcggagaaaaacggtaaggcgaccgggtgggcagcattttttgttgatggtgcttgggtagtaaaagaaaagtaa

SEQ ID NO: 2690 - DNA, 114 bp, Xenorhabdus bovienii
  Coding sequence Name=Xb4151_4152.C435.gene79.dna; Position on contig =52535..52648bp; Strand=-
atgataacgattatcatacatttattgcagaaatattatgttttaattccatataaaaacaaaaaaagccagtcaattaggactggctttttagaaaaaaaattatgctgttag

SEQ ID NO: 2691 - DNA, 114 bp, Xenorhabdus bovienii
  Coding sequence Name=Xb4151_4152.C435.gene80.dna; Position on contig =52662..52775bp; Strand=-
atgttttgtagtctaaacatgttctatattgctaatggttattttcttataactataaagaatatatatttatgggtatataactactatatcacctgctgtatatttatataa

SEQ ID NO: 2692 - DNA, 975 bp, Xenorhabdus bovienii
  Coding sequence Name=Xb4151_4152.C435.gene81.dna; Position on contig =52808..53782bp; Strand=+
atgaaactacagcaattacgttatattgtagaggtggttaaccataatctgaatgtatcttctacggcagaaggattgtacacctctcaaccagggatcagcaaacaagtcagaatgcttgaagatgaattgggtatccaaatatttgctcgcagtggcaaacatctgactcatgtcacaccggctggtgaagaagttgtccgtatttcacgtgaggtactgtcaaaaattgagtcaatccgttccgtagccagtgaacatacttatccggatcgtgggtctctgtatattgcaactacacacacccaagcaagatatgccttacctcctgttatcaaaggttttattgagcgctatcccaatgtttcgcttcatatgcatcaaggttcacccactcaaatcgcggaagaagtctgtaagggcaacagcgattttgcgatagcaaccgaagcacttcatctctatagcgatcttattatgttgccttgttatcattggaaccgttctgtagtggttacgaaagatcatcctctggcggccaggcaaaacgtaacgattgaagaattggcggaatatccgattgtgacatacacctttggttttacggggcgttctgagttagatgttgcctttgaccaggctggtcttaaacctaaaatagtattcacagcgacagatgctgatgtaattaagacttatgttcggttagggctaggagttggcgtgattgccagcatggcggtagaacctgttcaggacagtgatttggtgcgcattgatatgcgtgataaattcagttatagcacgacaaagattggtttccgtcgcagtagtttcctgcgtagttatatgtatgattttatctggcgttttgctccgcatttaacacgagatgtggttgataaagctatcgcgttgcgatctaatgaagaaattgaagatatgttcaaggacatcgaattaccgatagcataa

SEQ ID NO: 2693 - DNA, 144 bp, Xenorhabdus bovienii
  Coding sequence Name=Xb4151_4152.C435.gene82.dna; Position on contig =53900..54043bp; Strand=+
ttgtcagatacacgaatctttttgaaaataataacttactgtaataatcagataagtaattttaactgccattcaaattacactttaaattcaccgttgaaaaaattatcagaattttctattgatgattttttgttattatga

SEQ ID NO: 2694 - DNA, 822 bp, Xenorhabdus bovienii
  Coding sequence Name=Xb4151_4152.C435.gene83.dna; Position on contig =53977..54798bp; Strand=-
atggatataaaagtcgataaaaaccgccaacactatttaaaccatatagcgcaggctgaacaatttttttccgatggaattgagaataactttcccctgtcagaccaccaattcagtgatatagatggacttgtccaatttgtcattacttcacaaatcaatgacaaatccggcgtgatacaaaggttaaatgaaataaagagaacacagatttctctttcctcaattgcgactgattacatcatcaaatatgctaatacccacggccaacaatatagaactgacgtgcaattttggggtgatatcatagagaaactgccattaatgagcgtcaggaatatagaaagccaaacctacagccacgtaatgaaaggattttcaatcgcgacgaacttgctgcaacttatcatggatattgttttgaatacaaattcttccagcatgaaaagtttttctcaatttctgcaaaaacaaggagataccattaggcttgggttgaagaagaataacgatcattattctactctgactttagccagtgtcattgaagctattggagttgaagatcaagtgatttatattcctaaaatgaaactgtacaaagtgaattttgacagaagcaattcagaaattgcttcaaattgtgcttccaatgataatatcaatgtcgaattcacttactcttcctgtgtttcattatttgattatcaagcattggaagatcccgaaattaaggcatcctttgatctattcattcataataacaaaaaatcatcaatagaaaattctgataattttttcaacggtgaatttaaagtgtaa

SEQ ID NO: 2695 - DNA, 2718 bp, Xenorhabdus bovienii
  Coding sequence Name=Xb4151_4152.C435.gene84.dna; Position on contig =54972..57689bp; Strand=+
atgtttaatggtgtagctgaccataataagaaaggaggagttatgtcgtttaaattgaaaacggactgtgcatcaacactctccattggcagtaaaatatatcattattacagtttatccctgttatctgaacgattgggtgagatagcccgtttgcctaagtccatgaaagtcctgcttgaaaatctcctgcgcaatattgatggcgattctgttgtggaagaagatttgaaggcattagtggaatggcagaaaaacggtcatgcagacagggaaatcgcttatcgtcctgcccgtgtgttaatgcaggattttaccggcgttccggctgtagtggatcttgcagctatgcgggaagcggttctgcggcttggcggtaatgttgaacaagttaatccattgtctcccgttgatctcgtgattgaccactcagtcatggtagataaattcggtacagagcaggcgtttgaagaaaacgttcagattgagatggaacgtaactatgaacgttatctatttttacgttgggggcaaaaagcctttaatcgtttccgcgttgtgcctcccggaacaggaatttgccatcaggttaaccttgaatatcttggtaaatcggtttggtatgaaaaccagaatggtaaggattttgcctatcctgatacgttggtagggacggattctcatacaaccatgattaacggactcggtgtattaggttggggtgttgggggaattgaagccgaagctgcgatgttggggcagcctgtctccatgctgatcccagatgtcgttggttttaaactgaccgggaaattgcgggaagggatcacggcaaccgaccttgttttgacggtgacacagatgctgcgcaagcatggcgtggttggcaagtttgtcgaattctatggtgatgggctgtctgatttgccattggcagatagagcaactattgccaatatggcgcctgaatatggcgcaacctgcggtttcttccccgttgatgatattacactgggctatttgcgcttaactggacgcaataaagatgaaatcgccttagttgaagcctactgtaagaagcagggattatggcgtaacgcaggggatgaacccattttcaccaacaaccttgaactggatatgtacacggttgaagtgagcttggcagggccgaaacgccctcaggatagagtagcacttggcgatgtaccacatgcattccaagctgccatggaactggacatccataaaatacaggagcatcgggcggacacgccagtcactcttgataatcagacttttgcactgcaagatggcgctgtagttattgctgccattacttcctgtacaaatacatctaatcccagtgtcttgatgacagcaggtttactggccaaaaaagcgattgaaaaaggtttgcaacgtcaaccgtgggttaaaacctcgctggcacccggctctaaggtagtaacgggttatcttgaactggcaggactcatgccatatctggaaaaattgggtttcaatctagtgggatacggttgtaccacttgtatcggtaactcaggcccattgccagagccgattgaagtagcgattaagcaatctgatctgatggttggcgcagtgctttccggtaaccggaattttgaagggcgtattcatcctctggtgaaaactaactggctagcatctccaccactagtggttgcctatgcactttctggcaatatgaaaaaggatctcactagggagccattggggcaagaccaacaaggccatgatatctatctgcaagatatctggccggatagccaagaagttgctgaagctgttggtaaagttaggacagagatgttccacaaagagtacaatgccgtttttgatggtgatgaaaattggcaatcgttggaagtggaaagctcagaaacttattcttggcagcagaattcaacctatattcgccttcccccttttttcagcgatatgacgattgagcccaaaccgataactgatatccatcaagccaatatacttgtgattttgggggattcagtcacaacggatcatatttctccggcgggaaacataaaagctgacagcccagcagggcggtacttgcaggagcatggcgttttgccgaaagattttaactcttacggttcaaggcgtggcaatcatgaagttatgatgcgtgggacatttgccaatatccgtatctgcaacgaaatggtgcctggtgtggaaggaggatacactcgccatattccatctcaggctcagttggcgatttatgacgcggccatgctttatcaggaagataagacaccactggctattattgcaggtaaagaatatggttccggctcaagccgtgattgggctgcgaaaggaactaggctgttgggagcgagggttgtgattgcggaatctttcgaacgaatccaccgttctaatctgattgggatgggcgtgttaccactggaattcccacaaggtgtcagccgtaagacgctaaacctgactggtgatgaacgaatcgatattgtaggattggggcatatcgagccagggcagatcattgcggtgaaaatcaactatgccaatggaaaagaaactgtcattgatgcccgttgtcgcatcgataccaatacggaactggcgtatttttataatgacggcatcttgcactatgtgatccgtaatatgctgaaataa

SEQ ID NO: 2696 - DNA, 138 bp, Xenorhabdus bovienii
  Coding sequence Name=Xb4151_4152.C435.gene85.dna; Position on contig =57744..57881bp; Strand=-
atggttaaatccttctctgttatggggataacggattcggattttcccatgagtagcattattggcagagccaacctgttgctaaccacctccgcaggaggtggttttcagttaagaataaaaactgcgtcagtgtag

SEQ ID NO: 2697 - DNA, 177 bp, Xenorhabdus bovienii; identical to SEQ ID NO: 1687
  Coding sequence Name=Xb4151_4152.C435.gene86.dna; Position on contig =57823..57999bp; Strand=+

SEQ ID NO: 2698 - DNA, 222 bp, Xenorhabdus bovienii
  Coding sequence Name=Xb4151_4152.C435.gene87.dna; Position on contig =58144..58365bp; Strand=-
ttgatttcgccccaaaggggcgctattagttcagactctgagagccttcacttcacatccctttcaacgataattgattgtcctcatgttcgtgcttctcttgatacttcacatacttccttatcatttcttcatttatacctacggtatctacacagtagcctcttgaccaaaaatgatttccccacaactttttctttctcaaatagggaaatttattaa

SEQ ID NO: 2699 - DNA, 609 bp, Xenorhabdus bovienii
  Coding sequence Name=Xb4151_4152.C435.gene88.dna; Position on contig =58422..59030bp; Strand=-
atgaatactaaaacacagctaaaacgagtagctgaagcgacactgcccacaccatggggcgaatttctgatgattggatttgaagaaattaaaacaggtcgtgaccatgttgctcttgttttcggtgatatttccggtaatgagcctgttttatcacggatccattcagaatgcctcacgggggatgctttattcagcctgagatgtgactgcggttttcagttagaagccgctttttcacaaatcagcaaggaaggtaaaggtgttctactgtatcatcggcaggaaggccgaaatattggtctgctgaataaaattcgcgcctacgcattacaggataaaggcgttgataccgtggaagccaaccatcaactaggctttgctgctgatgaacgagattttactctatgctcagatatgtataaattgctgggtattaatgcaatccgtcttctaacaaataatcctaaaaaagttgaaatcatggtagacgcaggcattaatatcgtcgagcgtgtaccactggttgtaggacgtaatcctaaaaacgcttattatctggataccaaagccagccggatgggacatctactatcccaatcaaactga

SEQ ID NO: 2700 - DNA, 123 bp, Xenorhabdus bovienii
  Coding sequence Name=Xb4151_4152.C435.gene89.dna; Position on contig =59215..59337bp; Strand=-
atgttgatttgctcttttttgtcacattattctatttatttgccgacaaatacacccattttgactcaaatagcgacatcctatgcacctgtgtatatctgcaaaaatctgtttatagtttag

SEQ ID NO: 2701 - DNA, 315 bp, Xenorhabdus bovienii
  Coding sequence Name=Xb4151_4152.C435.gene90.dna; Position on contig =59448..59762bp; Strand=+
gtgaaatattttctaattttattactggcactgattgtttttgtcatctcagtaactctgggagcaaataatgatcaggtagtgacatttaattatctgattgccaaaggtgactactcgatatccacactgctgtctgtattgtttgctatcggttttatacttggctggggtatctgtgggggtttttacctgcgcgtctgtgtgtcattgcgacgtgcgaaacgtaaaattaagcgtctggaagcccaattggaacagcctgctgagtcatccgtaaagactgcatcgcctgtagtattaaccaaggaataa

SEQ ID NO: 2702 - DNA, 1170 bp, Xenorhabdus bovienii
  Coding sequence Name=Xb4151_4152.C435.gene91.dna; Position on contig =59769..60938bp; Strand=+
atgttagagctgttgtttctgttgcttcctattgccgctgcttatggttggtatatggggcgcagaagtgctcaacaagataaacagcaatctgctgaccgactctcacgtggatatgttgatggtgttaattttttactttccaatcagcaagataaagcagtcgatttattccttgatatgctaaaagaagatagttcagcgtttgaggcacatttaacgctgggaaatctattccgttcccgtggtgaagttgaaagagctatccgcattcaccagtcacttatggaaagtgcatctctgacatttgaacagcgtttactcgccatccaacagcttggacgtgactatatggctgctggtgtgtatgaccgggcagaaaacatgttcattcaattggttgatgaagccgatttctgtgagaatgcttttaactccttattaagcatctatcagtcaaccagtgattggaacaaagccatcgatgtttctgagaagctggtcaaactaggtaaacatcattttcgggaagaaatcgcccatttttactgtgagttggcactacaatacatgggcagtgatgcttccactgaagcagtagggtatctcaacaaggcggctcaggcggacaaaaattgtgcccgagtgtcaattatgttcggccgtatttatatagcacaaaaggaatataccaaagcggcggagttgctgaaacgtattctcgaacaagataaacagttggtcagtgaatctttgcccatgctggaagaatgttaccagaacttgtctcaaccggaagaatgggaggcttttgttcaatgttgcgtggaagaaaaatgtggcgccattgcagagctttacctggctgatattatcgagaaaaaagaagggcgtgatatcgcccaaaattatattaaccgccagttggaacgccatccaactatgcggctgttttatcgcttgatggactaccatttagcagacgcagaagaagggcgtgccaaagagagcttgctccttctgcgtaatatggtgggtgagcagatccgcactaaacccgattatcgatgccataaatgtggtttcacttcccgctcactttattggcattgcccatcatgccgttcatgggacactatcaaaccaatccggggtctggatgggcagtga

SEQ ID NO: 2703 - DNA, 123 bp, Xenorhabdus bovienii
  Coding sequence Name=Xb4151_4152.C435.gene92.dna; Position on contig =60894..61016bp; Strand=-
atgaaaagtaaacatgtccgtaatgaaacatgtattaatgaaaacacgcagatattgccactcataatagtgacactgtcactgcccatccagaccccggattggtttgatagtgtcccatga

SEQ ID NO: 2704 - DNA, 741 bp, Xenorhabdus bovienii
  Coding sequence Name=Xb4151_4152.C435.gene93.dna; Position on contig =61038..61778bp; Strand=+
atgacatcccacacagctcaaactttaggtaagcagattgattcacctgttattgtcgcattggattatgacaatcaggacgcggcgttagcatttgttgacaagattgatccgcagtcctgccgtcttaaagtgggtaaagagatgtttacgctgaatggcccgcaatttattcaggtattgcatcagcgtggcttcgaggtgtttttggatctcaaatttcacgatattcctaatacaacggcaagagcggtagcagcagcggctgaattgggggtttggatggtgaatgttcatgcctgtggtggtgcgagaatgatgaccgccgctaaagaggccctgctgccatatggtaaagatgcacctttgttgatcgcagtgacagttttaaccagtatggaacaatccgatctgctgggcgttggtattgatatgacaccagcacagcacgcagagcgtttggcgatattgacaaaacaatgtggtttggatggtgtggtatgttctgctcatgaagcacagcaattgaaagcagtctgcggacaggaatttcaattggttacgcctggcattcgtcctgaaggcgcagaggctggagatcagcgccgcatcatgacaccgccgcaagcagttcaggctggtgtcgattatatggtgatcgggcgtccgattacccgggcagaaaatccagcattagcattacagcagattaattactctattgggatcgttcatggataa

SEQ ID NO: 2705 - DNA, 324 bp, Xenorhabdus bovienii
  Coding sequence Name=Xb4151_4152.C435.gene94.dna; Position on contig =61771..62094bp; Strand=+
atggataataattctcgcttggtttattcgacggatatcggtcgagtccaagaagaaaaaattaaaccttcacgccataaaggcgatggtatcgtgcgtatccaacgccagaccagtgggcgtaagggcaagggtgtttgtataatcactggcattgatgctgatgaccaaacgcttgccaagctggccgcagaattgaagaaaaaatgtgcctgtggtggctcagttaaagaaggtgaaatcgaaattcagggcgataagcgtgatttgctgaagcagctactggaagcgaagggcatgacagttaaactggctggtggttga

SEQ ID NO: 2706 - DNA, 891 bp, Xenorhabdus bovienii
  Coding sequence Name=Xb4151_4152.C435.gene95.dna; Position on contig =62183..63073bp; Strand=-
atgctactttcctcattaagacttacacgaatatcagcaacgatttttcctctacttggtgccctgataacgtttccaatacatgctactactcaacaaaatcaaattaccaatcaactttcggctctggaaaaaaatgccaatggccgtcttggtgttgtattaatagacaccgcagaccattcaacaatcacctatcgtgcacacgaacgctttccattatgtagcaccagcaaaatgatggcggtatccgctcttctgaaaaaaagcgaaaccaatgagggtttgttaaatcagcgcatccactaccagcaatctgacattgtcgaatacagccccattacagaaaaacacctcaaagatggcatgacactggcaaagctaagtgccgcaaccatccaatacagcgacaatacagcgatgaatctgctaattgatcaattaggcggtacgcatgatgtgacacgattcgcccgatctatcggtgacaacgagttccgccttgatcgcaaagaacctgagttaaatatggttacgcctgatgatgaacgcgacacgacaaccccacaggccatggctgacagcctgtataaattggcattgggtaacacacttgctgcaacacaacgcgcacaattggttgagtggttgaaaggaaacacaacaggcggtgccagcattcgtgccggggtgccagataattggattgtgggagataagacaggtcgctgcgactatggttctacaaatgatattgcggtgatttggcctgataaaaacaaggctcccttgattctggtgacttattttacccaaccaaatgataaagacgccgaggcacatcctgatgttcttgccgcagctgcacgtattatgacgcaagaaagataa

SEQ ID NO: 2707 - DNA, 1542 bp, Xenorhabdus bovienii
  Coding sequence Name=Xb4151_4152.C435.gene96.dna; Position on contig =63201..64742bp; Strand=-
atgcgccgtcatccactgaaaggagatcgggggtttcaggctgaaatcactggttatattatcaaaggtgatgatcactatgcaccttggtgggtaactctgacacgccatagtctgcaacgtgaagctccaacaatgcccgattgtcagttggatgatggttcgctggagcgtatcgatctgaccgctctcgattttgtcaccatcgacagtgcgacaaccgaggacatggacgatgcactgcatatcgtcaaaaataatgatggcagcctgaaattgtccatcgccattgccgatccaactgcctatatcaaggctgacagtgaattagacaaaattgcctatcagcgcagctttactaactatctgccaggcttcaatattcctatgctgcctcgcgaactttctgatgatttatgttcgctgcggccaaaagctcgccgtcctgcactggtttgccaggtttccattctggaagatggacaattaggcgacgacatgcaatttttcgctgcatgggtagaatcgaaatttaaactggcttacgatgatgtttctgactggctggaacaccaaaccggctggaaaccagaatcagaagcagtcactacccaaatcactctattacaagagatgtgcgaacgtcgcaatcaatggcgtcatcaatatgccttggttttcaaagagcgtccagattatcgctttgtccttgataaaggtggcaatgttgttgatatcgttattgatcaacgccgttctgccaaccgtattgttgaagaagcgatgattactgcgaacctatgtgcagccaagatcctgcgtgacaaattaggttttggcatttataacgttcatactggcttcgaaccaacacaaattgatcaagttgtggacgttttaaaggaaaatggtattgaagctgaagcaaatgcactgctagaactggatggtttctgccagttacgccgtgaattagatcaacaaccgactcaattcctcgatagccgtatccgtcgcttccaaacgtttgcagaaatcagacccgaaccaggtccacactttggattgggttttgatgcctatgcaacttggacatctcctatccgtaaatacagcgatattattaaccatcgtttgttaaaagccatcattcagcaaaccgaagaagaaaaaccatccgaagaggtctgtctgcaactgacagagcgtcggcgtgcaaaccgcatggcagaacgcgatgtaggcgactggctctatgcgcgttttctacatcctcatgctggcacagataaaactttctctgctgagattgtggatattacccgtggtggcctgcgcatccgtctggttgacaatggtgctatcgcttttgttccaggatcattcctgcatgctgtgcgtgatgagcttcaatgcagtcaagagacaggttccgttcttattaagggtgaagccgttcatcgtttgaatgacattattaatgtacgcattgaagaagtcagaatggaaacccgtaatattgtggcacgccctgttgcctga

SEQ ID NO: 2708 - DNA, 186 bp, Xenorhabdus bovienii
  Coding sequence Name=Xb4151_4152.C435.gene97.dna; Position on contig =64724..64909bp; Strand=-
ttggttgaggcatttctaacccgttttggaggaagagtccagaagaaagagaacgacaaccgactgagggttattccggatcatgcattagtaaaagatacatcctttgtcgtcctgctaatcaagtcacccataattttgagaatggcgattgggcagtggctgaaatgcgccgtcatccactga

SEQ ID NO: 2709 - DNA, 249 bp, Xenorhabdus bovienii
  Coding sequence Name=Xb4151_4152.C435.gene98.dna; Position on contig =64891..65139bp; Strand=-
atgtttcaaaacaatccgctgcttgcacagctaaaacagcaactctactctcagaccctacgcgtagaaggtttagttaaaggaactgaaaaaggctttggatttttggaagtcgatggccagaaaagctatttcattccaccaccacagatgaagaaagtgatgcatggcgatcgtattaccgctgccattcacgccgataaagagaaagaatcgctgaaccagaagccttggttgaggcatttctaa

SEQ ID NO: 2710 - DNA, 144 bp, Xenorhabdus bovienii
  Coding sequence Name=Xb4151_4152.C435.gene99.dna; Position on contig =65155..65298bp; Strand=+
atggagttattatcgataattttggataacagttttacgcgaatcaggggtatggagcaagtaacatcttatcaaaacacgcaaaactgcctgaaaaggtcaataattacccagcttatatctgctgaaagcgagtccctttag

SEQ ID NO: 2711 - DNA, 213 bp, Xenorhabdus bovienii
  Coding sequence Name=Xb4151_4152.C435.gene100.dna; Position on contig= 65310..65522bp; Strand=+
atgtcatcaaatcttgttgtgggcggatccttcctgcaactcatggtcaagcgtgtgatagacagttgttggctggagaatggttcggccagatcgctgattaaggattttcccatacaatatatgagcttatgggtaatatatttatgtcgctgttctacttggtattttgtcactcggttttatcagcatactcacacagatcttcaataa

SEQ ID NO: 2712 - DNA, 633 bp, Xenorhabdus bovienii
  Coding sequence Name=Xb4151_4152.C435.gene101.dna; Position on contig= 65482..66114bp; Strand=-
atgaatcaacaaaaacggatagcaattttaacccgcttacagaataacaacccacagccaaccaccgagttggctttcaattctccttttgagttgctgatatctgtattactgtcagcacaggcgactgacgtcagcgtcaataaagcgaccacaaagttgtatccggttgccaatactccacagactatcctcaatttgggtgttgacaatctgaaagagtatataaaaaccatcggattatataacaccaaagccgagaacgtaattaaaacctgccgcattttgttagaaaaacaccagggcgaagtaccggaagatcgcgcagctctggaagcactgccgggagttggccgcaagactgctaatgtcgttttaaatactgcttttggctggccaacaatcgccgtcgatacgcatatatttcgtgtctgcaatcgtacccaatttgccccagggaaaaacgttgatgaagtcgagagaacattactgaaagttgtaccggatgaattcaagcttgattgccatcattggttgattctacacggccgctatacctgtattgcccgtaaacctcgctgtggatcttgtattattgaagatctgtgtgagtatgctgataaaaccgagtga

SEQ ID NO: 2713 - DNA, 708 bp, Xenorhabdus bovienii
  Coding sequence Name=Xb4151_4152.C435.gene102.dna; Position on contig= 66129..66836bp; Strand=-
atgagtgaaaccaaaaaactactttctcaagggttatggaaaaacaactccgcattagtccagctattggggctttgtcctttgctggccgtctcttctactgccaccaatgctctggggctgggattggcgacaacattggttctattaagtaccaatgttgcggtgtctgccttacgacactgggttccccatgaaatccgcattcctatttatgtgatgatcattgcctctgtcgtcagtgccgtccagatgttaatcaatgcattcgccttcggattatatgaatcattgggaatatttatccctttgatcgtgactaactgtatcgtcattggccgtgctgaagcttacgcatcaaaaaattcgatctacaattccacaattgatggccttgcaatggggctcggcgcaaccttttccctattcgtactaggagccatacgagaaattttaggaaatggcaccatttttgatggtgccgatctgttattaggaagttgggcaaaatcattacgccttgaaattatgcatatggactctccattcctgttagccatcctgccaccgggtgcattcatcggattaggcttgatgctggcaggaaaatatatcattgataaacgcatcaaaaatcgggctgataatcaagcacgtcgctatgacaacgtagagaaaggctgtggcagccatattacgaaaagctaa

SEQ ID NO: 2714 - DNA, 627 bp, Xenorhabdus bovienii
  Coding sequence Name=Xb4151_4152.C435.gene103.dna; Position on contig= 66836..67462bp; Strand=-
atgttagaaaccatgcgacgtcacgggattaccctcgcaatttttgcggcctgcactacagggctgactgctattgtctattctttgacaaaagatcggattgccgagcaagctgcactacaacacaagatactgctcgatcaagttgtccctcccacactgtataacaacaatatgcaagatgaatgctatgtggtaacagctgatgcattgggcaacaaacaaccccatagactttatctcgcccgtaaaaatggctctcctgttgcggctgcgatagaaagtaccgcaccagatggctattcaggtgcaatccaattattggtaggtgctgatttttcaggcaatgtattcggtgttcgtgtaactgaacatcatgaaacaccgggcttaggcgataaaattgacacacgtatttccaattggatctattctctttctgacaaaaaagtcatttcagacaacgaccctcattgggctgtcaaaaaagacggcggggaatttgaccaatttacaggagcaaccatcacgccccgtgccgtcataaatgcagctaaacggacaaccctctatctgaaaaccattcccgcacaactttcttcactaccaacttgtggaactgaataa

SEQ ID NO: 2715 - DNA, 1080 bp, Xenorhabdus bovienii
  Coding sequence Name=Xb4151_4152.C435.gene104.dna; Position on contig= 67472..68551bp; Strand=-
atgaaattcaggccagtaaaaactgacaataaccagctaaaagtcgctagttcgccttttacacacaatcaaaaaagtaccagccagctcatgctgtgggtagttttagccgccgtacccggtattgcggtacaaacctatctatttggctatggaaccctattccagatcttgctggctgttattaccgccttactcgctgaatctgtagccatttccatgaaaaaacaggtaatagctccattcctcaaagacaactcagcgctagtgacaggattactattaggaattagcctgccccctttagcaccgtggtggctgatcgtacttggcacattctttgcgattatcatcgccaaacacctgtatgggggacttggacaaaacccatttaaccctgccatggtgggttatgtcgttttacttatctcatttcctgtacagatgacaagctggctgccaccagtgtcctttcaggcactcacgttgaccccttgggattgcctgatggtgatctttacagggcatacgcctgatggttctactttgattcatctgcaacaaggtatcgatgggctcagtcaagccacacctttggacagctttaaaaccggcagattgacccacaatattgatgaagtattacagcaaccaatgttacaaggcactttggtcggtattggctggcaatgggtcaatgttgcttacctggttggggggctgattatgctgaacagaaaagttattagctggcagatccctaccgcatttattttagcgctgtgcacctgtgctttactcagttggcttatcgacccaacccgctattcaccacctttgctccagattttttccggtgcaactatgttgggcgcattttttatcgcaaccgatccggttagtgcatcaaccacatcaaaaggccggctaatttacggtgctattattggtatgttgatttgggttattcgtgtatatggtggttatccagatgccatagcatttgccgtcttattggcaaatatctgcgtgccactgatcgaccattacacccaacctcgtgcgtacggccataaataa

SEQ ID NO: 2716 - DNA, 2007 bp, Xenorhabdus bovienii
  Coding sequence Name=Xb4151_4152.C435.gene105.dna; Position on contig= 68564..70570bp; Strand=-
atgtttaatctgttcaacttgcttaacaaaaataaaatctgggattttgagggtggtatccatccaccagaaatgaaactgcaatccagccgtaccccattacgctacgcaccaataccggatgaattaattattcctctgcaacaacatttaggcccagaaggtgaattactggttaaagttggtgacaaggtactgaaaggccaacctttgacggttggtacaggccgtaccgtgcccgttcatgcatctacgtcagggactatcacggcaattgaaccctgtgtcactgctcacccttccggactgaaagaattatgtgtccgcctgtatccagatggtaaagataaatggtgtgaacgtattcaaaccacggattacacttccctcaataccagcactttattgcaacgcattcaacaggcaggtattgccggtctgggtggtgcgggcttccctaccgcgtcaaaactacaaggtagtcggcatgatttaaaaacgttgatcatcaatgcagcagagtgtgaaccgtacatcacagcagatgatcgtctgatacaggaacatgccaacgaagtgattgaaggtatacgcattttgatgcacttactcaatccagaacgagtgttgattggtattgaagataataagcctgaagcgattgatgcgctgaataccgctcttaatggtgacgactccatcgttgtacgtgttattcccacaaaatacccgtctggtggtgcaaagcaacttaccaaaatcctgacaggtaaagaagtaccatctggcgggcgttcctccgatattggtgttctcatgcagaatgtcggcacagtcatggccatcaaacgagctattatcgatggagaaccgttaatcgaacgtatcgtgactctgactggagaagccgttactgcacccggaaacttctgggcgcgtctgggtactcccgttcaattcctactgcaacaagcaggattcaaagccaagtcagaacaaatggttattatgggagggccattaatgggctttaccctgccagatttaaacgtacctgtcgtcaaaatcagtaactgcattcttgccccttccattcaggaaatggaaccgaaaacggttgaagaggcctgtatccgctgtggcttatgtgttgaagcttgcccggcggggctattacctcagcagctttattggttcagtcgcgggcaggaacataaaaaagccaaaaatcatcatctgttcgactgtattgagtgtggtgcctgtgcttacgtatgtccaagcaatattcctttggttcaatactaccgtcaggaaaaagcagaaatacgcgccatagatgcagaaacacgccgttcggctgaagccaaaatccgctttgaagccaaacaatcgcgtatggaacaagaaaaactggctcgagaggaacgccataaaaaatcggctgttcaagtggatagcaaagatcaaagcgctatacaggcggctcttagcagagtgaaggaaaaacagaaaaatgcgggtgaagctatcaatgttcaagctgggaaattgcctgataatgaagcagctattgcagcacgtaaggccagaaaagaacaattgcgtactcgtcaggcagagaaaccagcaacaataactgtaaatacagaacccgccacaccaactgaaagtgatgatctccgcaaagctgcacttgcagccgcaatagccagagtaaaagcgaaaaaagcgactcaaagtgaagtggtgacaacgtcacaaaaagattcaccaaataacgcggatgataaacaagatccacgtaaggcagccgtcgctgcggccatcgctcgcgctaaagctaaaaaagccgcgcaaaatcagtccgaacctacgccacagcaagaagatattaccgctgtaccggaagagattgatccacgcaaagctgccgtcgctgcggccattgctcgtgtgaaagccaaaaaagcagcgctagaaaaacaagaaactccaacagaatag

SEQ ID NO: 2717 - DNA, 618 bp, Xenorhabdus bovienii
  Coding sequence Name=Xb4151_4152.C435.gene106.dna; Position on contig= 70563..71180bp; Strand=-
atgatgtcattatggattgctatcggtgtgttgagcctgctgggattagcctttggcttaattctaggttttgctgcccgtcgttttaaagtggaagaagatcctattgttgagaaaattgacaacctgttgcctcagagccaatgtgggcaatgtagctacccgggctgtcgcccgtatgcagaagcaattaccaataatggagagatgataaacaaatgcgctccaggcggagagcaggtaatgctcaaaatggccgagttgctgggtgttgaccctcagccgctggatggcgatgacagtgttcagaatccggcaagaaaggtggctttcattgatgaggagaactgcataggctgcaccaaatgcattcaggcatgtccggtcgatgccattattggcgcaaaccgtgcaatacacactgtagttgaagatctctgtactggctgtgatctgtgtgtcgcaccctgtccaacagattgcatcacaatgatccctgtcgctactactacatcaaactggaaatgggatttgaattccattccagtcagaaatattccgattaatccaatctttgtttctcctactaagcctgttgaggttaaagctaatgtttaa

SEQ ID NO: 2718 - DNA, 582 bp, Xenorhabdus bovienii
  Coding sequence Name=Xb4151_4152.C435.gene107.dna; Position on contig= 71180..71761bp; Strand=-
atgactgaataccttcttttatttattggcacagtgttagttaataattttgttttagtaaaatttttgggcttatgtccttttatgggcgtttccaaaaaactcgaaacagccattggcatggggctggcaacaacatttgttctgaccctcgcctccatcagttcatggctgataaacacctttattcttgtaccattggatttagtttatttacgcacactgagttttatcctcgttatcgccgttgtcgtccaattcaccgagttggtcgtccgaaaaaccagcccggcgctctatcggttattgggaatttttctgccattgatcacaactaactgcgctgttctcggtgtcgcgttgctgaacgtcaatcaatcacataactttctgcaatcagctatatatggtttcagcgccgcagtcggtttttcccttgtgatggtactgttcgccgccattcgtgaacgtctggcagttgccaacattcctgctccttttcgtggttcatcgatagggcttattactgcagggttgatgtcccttgcatttatgggctttagtggtttggtgaaattctaa

SEQ ID NO: 2719 - DNA, 120 bp, Xenorhabdus bovienii
  Coding sequence Name=Xb4151_4152.C435.gene108.dna; Position on contig= 71818..71937bp; Strand=+
atgacagagattgccccaccttgcgatgaaacaagcggggcaatgataacaatcgattgtgggggatgttatcgatcttgtgtgaaagtcattttcacccgatgggaacgcttgatataa

SEQ ID NO: 2720 - DNA, 441 bp, Xenorhabdus bovienii
  Coding sequence Name=Xb4151_4152.C435.gene109.dna; Position on contig= 71886..72326bp; Strand=-
atgtatcaatccaatgattattaccgtattaacggctggttattggctcccgccgcctatctgattatgacacttattgcggccagtttaatgctgttgctatatttaataacgctcatctacagaaacgaagctatccaccaagtagacggaaacttcaccactatgtggtatatatccgtattaaccactgcaatgatgtggtgttttactctttgggtattaaagctgctttttattcattcaaaaagattcccgcgaatctttattatctggctcatggtctctgttctaattgccataaaaaccttcgccttttcccccatttctgacgagatggctattcgttcgctgttatggccgctattagctgccgctgttttcgttccttatatcaagcgttcccatcgggtgaaaatgactttcacacaagatcgataa

SEQ ID NO: 2721 - DNA, 1047 bp, Xenorhabdus bovienii
  Coding sequence Name=Xb4151_4152.C435.gene110.dna; Position on contig= 72477..73523bp; Strand=+
atgagtgattttttaaaagttggcttagtagggtatggttatgcaagcaaaacgttccatgcgccattaattgcaggtacatctaatgttgaattagctgcgatttccagcagtgatacagaaaaagtcagaaaagattggccgactgttactgtagtttcctcgccggaagcattattcagtgatccaaatattgacctgattgtgatcccaacgcccaatgatactcattatccattggcacagaaagcgctagcagccggtaaacatgtcgtagttgataaacctttcaccatcacagtagaagaagcagaagcacttaaggagcaggcggaagaggctaacttgttgctgtctgtcttccataatcgtcgttgggatgccggttttttaacagttaagtcattgattcaagaaaatcgattgggaaaattgaaatattatgaatcccactttgaccgctaccgtccggtggttcgtcagcgctggcgggaagctgcgggagctggtggaggaatttggtacgatctggggcctcatttattggatcaggcggttcaactctttggtaagccacatgctatcaccgtgaatttaggtatgattcgtcctaatgccgaggcggtggattattttcatgctcagttgaattatccagatttgaacgttgtattgcatgcaacaacagtcgcagcggcagagtctccgatttatatactgcatggtatggaaggtagttatgtgaagtatggtttggacacacaagaagagcgcttgaaagcaggggaaagaccaccacggactgattggggatacgatatacgtgatggaagcgtgacaatgtcacaaggagacgatttgataacgcaaattattccgactctaccgggcaattatggagcatattatgcggctatccgtgatgctattgtggctgggaaatccaaccctgtgacggcagacgaggctattttgatcatgaaactgattgaagccggtgaaaaatcggcaaaagagcaacgcacgatccttatcgactgggaatga

SEQ ID NO: 2722 - DNA, 978 bp, Xenorhabdus bovienii
  Coding sequence Name=Xb4151_4152.C435.gene111.dna; Position on contig= 73546..74523bp; Strand=+
atgagctggtggcagaagttaagaatcgacccttttctggtaacactaattacagtagtgatcatcgcaacgcttttcccctgtgaaggagaatcgaagaagtggtttcaatatttgacgaccgcggctattgcacttctgtttttcatgcatggagccaaactgtcccgtggtgcgattttagcgggaattgggcactggcggctgcatctggtgattttcttgagtacctttgttttgttcccgatattgggaatggggctgtattttattgtaccggaatggctgtcgccaacggtctatatgggatttctttatctttgcgctttgcctgctactgtgcaatctgctatcgcctttacttcggtagcaaagggcaatgtcgcagcagccatatgcagtgcttcggcttccagtttgttgggggtgtttgtttctccattattggtcggcttgttgattcagactaatgatggtcatactgatacgtggaaagcaataaaagatattatcctgcaactgatggtgccatttattgtcgggcatctatcgcgcccattaattgccagttgggtggaaaaacataaaaaattagtcaactctactgaccgatcttctattttgctggtggtgtatgttgcattcagtgaggcggtggtggagggtatctggcataaaattgatgcttactcgcttatgattattggcgtcgtgtgctgtgttttattgactatgatattgatgattaatgtatacagctcgcgtttgtttgggttcagtaaagaagatgaaattactattgtcttctgtggctctaaaaaaagcctcgccaatggtgtaccgatggctaatgtattgtttcctgctccaatggtaggtgtgatgctgctaccgttgatgatttttcatcagattcaattgatggtttgtgcagtacttgcccggcgttatgcaaggcgtccaaaaaaggcagattaa

SEQ ID NO: 2723 - DNA, 1002 bp, Xenorhabdus bovienii
  Coding sequence Name=Xb4151_4152.C435.gene112.dna; Position on contig= 74564..75565bp; Strand=-
atgattgatatacggcttccattgaccgatttacaccgtcaccttgacggcaacattcgtcctgaaaccattctggaactcgcccgtcagtataatatcccgttaccggcttatgagctggaagcattgcgtcctcatgtccagattactgaaaacgaacccaatcttatcagcttcctgcaaaaactggattggggggtaacggtactcgcagatttagatgcctgccgccgcgttgccattgaaaatgttgaagatgcagtcaatgctgggcttgattatgcagaactgcgtttctcaccttactacatggcgatgaaacatcagctccctgttgaaggagtggttgaggccgtaattgatggtgttcactctgccagtcagcaacttgatgttcagatccggctgatcggcattctaagcagaacgtttggcgaaaaggcctgtactcaggaactgtctggccttctcgctcataagcaacacattacagcgctggatctggccggtgatgagcttggcttccctggttatttgtttgagcagcattttatccaagcacgtgatgcaggttggaacattagtgtacatgctggagaagctgctggtgcagaaagtatttggcatgctattcgtgaattgggagcaacccggattggtcacggcgtgaaagcaattaccgatcccgcattgatggattacctggcaaaacacggcatcggtattgaatcttgtctgacatcgaacctacaaaccagtacagtaaattccctgtcaacccatccactgaaacaattccttgctcatggcattctggcatcaatcaatacagatgatccagcggttgaagggatcgaaattcaccacgaatataacgttgctgctcctgcagctgggttatcacccgaacaaatccgacaagcacagattaatgggttgaaaactgcattcctcagtgaagcagaaaaacaagcgctgaaaaccaaggctgcaaatcgctag

SEQ ID NO: 2724 - DNA, 1452 bp, Xenorhabdus bovienii
  Coding sequence Name=Xb4151_4152.C435.gene113.dna; Position on contig= 75694..77145bp; Strand=-
atgaaaaaatcgttagtagctgtaggtgttattgttgcgttaggtgcagtatggactggcgcatcatggtatacagggaaacaaattgaaggccgcctgaataacatcattaagactgtaaacactcaacttgcaaaatcatttccagaaagtgctattgaattgcaaacgaaagattttcaacgtggagtattcagttctgatgtccgcttgatcctcaaaatcaaagatggcgtgaaaaatgcggacatcaaaccaaatgaagaaattatcttcaaatccagtatagggcatggcccgttacccatttctgacctgaaaaaatttaatctggttccaaaaatggcatctatccattcagagctagaacagagcaaagtaacaaaaaccttatttgaagctaccaaaggtaaatccctgctcaccatggaaaccaaaataggttatagcagtagcctttctactaatattgattttattcctgttgattacacagcgaaaaatggcaataagctggtcttttcaggtgcaaaaatcgatgctgaaattgcccgtgatttaagtaatttcaaatttaatgtgaacagcgataggctgattttcagttctccttccaaacacgaagaactgactcttaaaggcgttggctttaagggtgataacaaaaaaggtaaatttgacctgtatcttggtgatcaaaattataatattgatgaaatcaccttgagttcaacgagtgatgacagcttctctctcaagggaatgaaaataacttctaaggtaggagaaacggacaagaacctgaatctgaatgtctcttatggcattgatggcctcaaactcaagaacatggatcttggctcaggtcaattggttatcggtatgaataatctggatggtcaatcaatccgtaaatttagtcaggcttataacgatgccacggcaaaatcactaacttcagaggctctatctaccgattcggtgtctaataaagttatcgaaaacgcacatctgctgtttaataatagtccgcaattcagccttgagccgatgacatggaaaaacagtaaaggcgaaagctcggtaaacttcaaactcgcattgaaaaacataccagaaaataaagactcgctgatctccatgggaccggaagaaatgatccgtaccctccttcaagagctatctttggatgttaagatacccaaacctatgttgatagaatccatcacccaagcaaaaatacttgatggaaaaacgaaagaagccgcagaagccgaggcaactcaagaagtacagatgatagccagccaaggtgtttcgtttaaaatcctcaccgatgacaataacgtgattggccttaaactccactatgccagtgataaagttgaattgaatgacaaaaaatccgacttgcatcaattcttgcttgataatcacttaatcggctcctaa

SEQ ID NO: 2725 - DNA, 147 bp, Xenorhabdus bovienii
  Coding sequence Name=Xb4151_4152.C435.gene114.dna; Position on contig= 77146..77292bp; Strand=+
gtggaaattccatcctttttatgcatacaacattatggaagtatgcgttctgtctttaatatcgatatgggtctaaactcattaattagatactttagcaattttcccattaccatgaacagtcaagtttttttctatagcagataa

SEQ ID NO: 2726 - DNA, 1179 bp, Xenorhabdus bovienii
  Coding sequence Name=Xb4151_4152.C435.gene115.dna; Position on contig= 77227..78405bp; Strand=-
atgctgaaaatgaccaaccagatccaacattatgactggggtagtaaaaccgccctgacggacatctacggtattaagaatccaaataatcagccaatggcagaactatggatgggtgcacatccgaaatgcagttctcaggtcacagatcccgaaacaggtgagatcatcgcattgaatgcactaatagcccaagagccaggaaaatatcttggggaaaaagtgtttgaacaattccagcggttaccattcttgttcaaagtattatgcgcagcccagccactttccattcaagtacatccggacaaatcatcagcagaaacaggatttgaccgagaaaatgcagcgggtattcctttaaattcaccccagcgcaactacaaagatgataatcataagcctgaattggtgtatgccctgactccgttcaaggcaatgaatgcctttcggcctttatcagacattgctcaattacttggccatgtttctgctgcacatcccgatattcaggcatttatccataatccgactgaatcgcatctatcgtttctcttttcccagttgctgactatgcaaggcgaacaaaaacgtttggcgatcgccgttttgaaatcagtgctgaacaatcgagagggagaaccttgggataccatcagaaaagtggctgccttttatcccgatgataatggtttatttacccccctgctgcttaatatagttgaactgaaaccaggccaagctatgtttctctatgcccgtacacctcacgcttatctcgaaggtgtggccttagaagtcatggctaattcagacaatgttctgcgcgccggcttaaccagcaaacatattgatgttgccgaattgatggctaatctggattttgtttccaaacccgcagatactctactgactctcccaaaacaggaaaaagatgctctgaattaccctgttcctgtcaatgatttttacttttctgtttataatgtttcagaacagccaataacactggaaaatgattctgcttcagttctattttgctttgaaggtcaaataattatcagctcggatgaacagcaacaacaattgagattattctcaggtgaatcagttttcttatctgctatagaaaaaaacttgactgttcatggtaatgggaaaattgctaaagtatctaattaa

SEQ ID NO: 2727 - DNA, 180 bp, Xenorhabdus bovienii
  Coding sequence Name=Xb4151_4152.C435.gene116.dna; Position on contig= 78417..78596bp; Strand=-
atgcgagtggctgccattactatctccttagcacacagaataattgaatacgccggatcaaaatttgcagataaattagtcggcattctattatcatgccataaagttattatccataatgcgacccaatcgtgtttattgtattgttgtcatataaataagtttagttttttattatag

SEQ ID NO: 2728 - DNA, 1464 bp, Xenorhabdus bovienii
  Coding sequence Name=Xb4151_4152.C435.gene117.dna; Position on contig= 78511..79974bp; Strand=+
atgccgactaatttatctgcaaattttgatccggcgtattcaattattctgtgtgctaaggagatagtaatggcagccactcgcattgaaaaagactcaatggggcctattgaagtacctgctgaccaattatggggagcgcaaactcagcgctcactggagcatttccgcatttctcaggaaaaaatgcctgttgcgctgattcatgctcttgcattgactaaacaggctgcggccagtgtcaatatggatctggggcttttgcctaaagaacgtagtgatgcaattattgctgcggcgaaagaggtgctggaaggcaaacacccaacagagttccctcttgctatctggcagactggttcgggaactcaaagcaacatgaatatgaatgaagtgttggcgaaccgtggtagtgagatccttggcggtcagaggggtaatgaacgtctgattcatcccaatgatgatgttaacaaaagccaaagttccaatgacgtttttccaacagccatgcatgttgcagcagttattggattgagtgagcagctactgcctgagttgaaaacattacaaaaaaccctggcagataaagcggcagcatttaaagatatcgtaaaaattggtcgtactcacctgcaagatgcgactcctctgactctgggtcaggaagtttccggttgggcggcaatgttgactcataacctgaaacatattgaagatagtattcctcatgtatgtgaattggctcttggcggtacagcggtaggaacaggtctgaatacgcaccctgaatatgccgttcgcgttgcgaagaaaatttctgaattatctggccaacctttcgttacttccccaaataaatttgaagcactggcaacttgtgatgcattagttcattcacatggagcattgaaaggtttggctgcatctctgatgaaaattgctaatgatgttcgctggttagcttctggccctcgttgtggtattggtgaaatttccattcctgaaaatgagccaggtagctcaattatgccgggtaaagtgaatccgactcagtgcgaagctatgacaatgctgtgtgcacaagtgatgggtaacgatgtggcaattaatattggcggagcatctggtaactttgagctgaacgtattccgtccgatggtgatcgataatttcttgcaatcaattcgcttgttagcggatggtatgcgtagtttcaatgatcattgtgctgttggtattgaacctaaccatgatcgtattactcaattgctgaacgaatctctgatgctggtaacggctttgaatacccatattggttatgataaagccgcagagattgctaaaaaagcacataaagatggtctgacgctgaagcagtcagcgatgcaactgggttatttaaccgatgctgaatttgacgcatgggttcgtccagaagatatggtcggtagcatgaagtaa

SEQ ID NO: 2729 - DNA, 927 bp, Xenorhabdus bovienii
  Coding sequence Name=Xb4151_4152.C435.gene118.dna; Position on contig= 80047..80973bp; Strand=-
atgaataaatacttttcaatagaatcacttacgtccagcttcaaaaaacaggaagaaaaattggctgaactcgttaggttattaatggactatccgctcattgatgcgcgggtgtttgaattacctcaaattgaaaaaggcgaagaacatgagcagattactgaaattgcagtcaatccattacagggaaataacgctctcaacttaggactacatttctaccaaaagctattcatacaccataaccaccccaatatcagcagcaaagctgcaagtcggttacctggtgcgttatgtttttctgttagccaccagcaatataaaacagcgatgagcgtcatcaatgaagttaaccagcttaaagccgaactggaaaatatcgtcaccaaagagtcaggcgtcaacaaagaacaaagatttgaatttgtccatgatcatctacgcggtttaatcaccctgaatgcctaccgcactattactccccttgtaaatccagactctatcaattttggttgggctaataagaacatcattaataaaataaccaagcaacaagttcttgaacagttggaaaaaagttataattctggacgagcggttcctccctactctagcgatcaatgggcggcattggttgcattagaaattacggatattaagaaattatctgatgacgtaatattaaaaatcaaacgacctgtcaaagttcaacccattacccgcgtttggtattcagaattgcaaaaacaggtacaatatgcctgtccattgccaattattgctttttatacagacgattgtgaaataaaaccgaagataggtacattatcaaattataatgccaacgccatcaaacaccgatataaacccaaagccaaaccacttgaattagttatcccacgcttacatctttatcgggaaatataa

SEQ ID NO: 2730 - DNA, 906 bp, Xenorhabdus bovienii
  Coding sequence Name=Xb4151_4152.C435.gene119.dna; Position on contig= 80995..81900bp; Strand=+
atgtggcgtttacaaactatatttagttacaacatacatattagtataacaacaaaaggagcagatcttcaacaaaacatacaaaaaagcctaataaacaacaaaaagaaaaacgtctgttgcgaaacatttcactgttgtgataaaaatcaaaaaggaattactgattttctaaaaagtctcaataaatattcatgtaacacatataagaaaaactgttcactttatatcgttgataaagtgggggcaaacacagcaccagggttgtttaagatgaaaaaattagtcaaaccagtgaattcctttgaaaaagtggttgatacgctattaccgtattctgaattaattgcttctgatttaccgacacaaggtaaattgcttagagttgaaaatgaattcgctaaactttttttattgcagcaggggtatgtaaatatacgaagggtagatgatggtttaatcattgcaacggttttttcaccttatattatagggttatctttttactctggctctgatgtctattattctattgaacttggacctcattgcaggctatatcaactccctcgtattaatgcttttaatgctataaaaaaacatgatctttatagagaatggatgaggataatttcatacaagatggcttttttgtatgcaagagatgtcagtatttttcgtcctggtgccaaagaagttgtgtgcagtctattatcacgacttataactctgcctgctgaatttcacgaaaacacatctgtcatcaaatatatagaacaaagatgtacgctttcacgcagctgtatacaacgtgtattatcatcgttaaaaagagaaaattatattgagatggttgatgggcatttagtaaaaattaactcattaccgattcattcttattattaa

SEQ ID NO: 2731 - DNA, 1269 bp, Xenorhabdus bovienii
  Coding sequence Name=Xb4151_4152.C435.gene120.dna; Position on contig= 81991..83259bp; Strand=-
gtgaatacagccccaagcgtcagtgaagaatcagcagttcctgacgttgaaagtgatgttaaaatcaatcaacgacgtgaaaaagaacaacgctatattcaacgagatgatgccgtatatcttcgtgttaccctatccttctttgccgtaggactagcaacattcgcgttactttactttgttcagcctatattgcccatcttatcagaggaatttaatgtttccccagcaagcagcagcttagcgctatctctatccaccggtatgttatctcttggcttattgataaccggtcctttatcagatgctcttggccgtaaaaatgtcatggtaatgtcattggctactgctgccatttttacactcttgagtacagtagtgacaagctggaatgggcttttggttgtccgtgcactaattgggttgtcattaagtggtgttgccgctgttgcaatgacctatttaagcgaagagattcatcccagttatgttgcgttgtctatcgggctttacgtcagtggaaattcattgggaggaatgagtgggcgtttgattacaggtgtgattgcggattattttccttggcggttcgctgtcattttattgggttcatttgcactaatttcagctattgcattttggaaaatgttaccaccctctaaaaatttcagatcaagttcattaaaacccaagaccttgtttatcaatctaaaattgcattttcgtgatcaaggcctacctttattgtttgctgaagctttcttattaatgggctgctttgtcactatgtttaactacattggttatcggctattgggtgcaccttaccattataatcaaactattattggattattgtcgatagtctacttaaccggcacttacagtgcgacaaaagccggtattttgacaaataaatatggacgtggaaaggtgctgctggttgcgatcagtatgatgttgattggtggtttcattacgatatgttcttctatttggacagttatgcttggcatgatggtgctaactacagggtttttcgctgctcattcggttgctagtggatgggtcggatggcgagctaagcgggctaaagctcaggcatcgtctctttatttattctgttattacgcaggctccagcgttgctggaacattaggtggtgtattctggctgtattttcaatggaatggtgtagccatatttatgtcattactaacaaccattgcactgtatttaggtttaaaactcaaaaaacttgaaaaatga

SEQ ID NO: 2732 - DNA, 918 bp, Xenorhabdus bovienii
  Coding sequence Name=Xb4151_4152.C435.gene121.dna; Position on contig= 83390..84307bp; Strand=+
atgagtataaacattgaattaaggcacttacgttattttattgctgttgcggaagaattgcattttgggcgtgcagcggaacgattaaacatctcacaaccgccattaagccaacaaattcacgctcttgaaacaaggatcaaggcacagttactggcgcgtaataaccgcaatgtcagtcttactcccgctggaaacatgtttcttaaggaggcataccagatacttacccaagtagatgcagcagcaactaaagccgccagaatgcagcaaggtgaactgggagaaatatctatcggctttacatccaccacacccttcatgcgtaaggttactcttagtttacgtcaattccgtgaacattattctgacgtagccattcatatgcatcaaatgaacactaaacagcaaatagcacctttgcagacaggtagaattgatatcgggattatgcggaatacgttattgcctgatagcttagagcatcgattacttttcagcgaacgctttatgctagcggtatatgatgggcatcccctgctgaattatgctgacgaaggtatcagtttggaaatgttatctggctatccactcgtattttttgagcgtgatgtaggaacagccttgtatgatgaaattatttctctgctagccaatgctggagtcactcctatgatttcacaggaagcgggggaagcaatgacaatacttggattagttgctgcggggttagggatcagtataataacggaatcatttacccggatgaagatcgatggtgttcaatatctccatttagcaaatgcacctgcctgctccgaagtctggttggtcaatcacaagaatcgacagaatagcgcagcagtagaccgattaaccaatctcttaatttcaaacattgttgatgaaatttgttaa

SEQ ID NO: 2733 - DNA, 1221 bp, Xenorhabdus bovienii
  Coding sequence Name=Xb4151_4152.C435.gene122.dna; Position on contig= 84439..85659bp; Strand=+
gtgagtgtcgatattcagccgagacacattgaccagattaaacagaccaatattggtctggtttatcggttaattgatcaatatgggccaatctcacgtatcgcactttctaaaaaatctcaactggctcccgcaagtattacaaagattacacgggaactgattgatgctcatctgataaaagaagcagaatttcccgatctgagttttcgaggacgtcccgctgtagggttgaaaatcgatagtaaagggtggcaattcctgtgcatacgcattaacaaaggaagtgttgtctttggtcttcgtgacttaagtaataacttgagaattgaagaagaacgaccgttctcattttcccttaatcaatcttttctggattgtatcgttgatgaaattgatgatttcttctttcgacatcaatcttgtcttgaacgcctgacggccattagtattaccaccaatgcgattatcgatcccaacagtgggattattcacagttcaccgtattatgatattcaaaatatcccacttggcacattcttgcatcagcgtactgggttaccgacgtttctgcaacatagcataaccgcatggacaatcgcggaatctttatatggtgcgggtgaaaactgccagaacattatccagatcgtcattgacgataatgtaggggcaggggttattacagcggggcagatgcttcatgccggaaaccatagcgttgtggaaatagggcatactcaagtcgatcctgatggtgaacgttgttattgtggtaatacaggttgtctggaaaccgttgtcggaataaaaaacatcttggtgaaagttcatcgcctggcagaaaaccatcctgactcactactttattcaatatcaccattgacaattgattcactttgtcaagcggcgaatcaaggcgatcttctggcaacaaacatcattcatgatgtcggagaacgaatcgggcgcatcatggctattatggttaatatattcaacccagagaaaatcttgatcggttccccactaaatggtgcacagaacattctctatcctgccattcaacaacagatagcccaactttctctccctggctatagccaacaggttaatattgttgccacccaatttgacaataccgggacactgccagcggcatcattgattaaacaatctctatatagtggtgagttactgatcgaactcatgcaaggatag

SEQ ID NO: 2734 - DNA, 669 bp, Xenorhabdus bovienii
  Coding sequence Name=Xb4151_4152.C435.gene123.dna; Position on contig= 85776..86444bp; Strand=+
atgttaacgcgcttatttgttacaggcacggataccaacattggtaaaacagttgttacccgtgcattactacaagtatttaatcgtgaaggaacaaccgccgtgggatataaacccatcgcgacagagaaacaagaaacaccggagggaatacgtaatcatgatgccttagtcatacataaatcttcaccggttcaagtctcttatgaagagattaatcctattatttgggaaagcaattatgaagaagggaaccagattaattttgttcaaatgacaaaaagcctgaaaaatttaagccaaaaagccgatcgtgtgattatcgaaggtaatggtggctggcgtttattgctacaagatgactcattctactcagactgggtggtacaagaaaagctgcctgttattttagtcgtagggattcaggcgggatgcgtcagtcatgccatcctgaccgcccaatctattatcaatgatggtgtcccactgattggctggatagctaaccgtattaaccctgggcttgcgcactatgccaagacactggataggttacggtatcatataccggcaccacaacttggcgaaattccttatcttttgaggcctgaagaaagagatttatcttgctatttggatgtttcagcaatattcaagtttgataactaa

SEQ ID NO: 2735 - DNA, 396 bp, Xenorhabdus bovienii
  Coding sequence Name=Xb4151_4152.C435.gene124.dna; Position on contig= 86497..86892bp; Strand=-
ttgggaacccaatacaaaacgttgtctggatctcaatacaggtcttccgatcaaaccttgatagaccaaacaccgacatcaataaataaggagatgatggtgaaaaagatcctactgactggtgccttgttttttgcgcttgctccctttgcagtacaagcctcacaaaagacaacatgtgaaagcctgagagaaataatttcgcaaaagatcattgataatcatgtctctaaagaagattttaggcttgaagttgttcctaatgatcaagttgtagaaggctctgggaaagttgtcggtagctgtgattatggaaaacagaaaatcgtctatatccgtctttcccacactacaggttctcacgctactagcgatgcaaaagaagctcaaaaatga

SEQ ID NO: 2736 - DNA, 420 bp, Xenorhabdus bovienii
  Coding sequence Name=Xb4151_4152.C435.gene125.dna; Position on contig= 86715..87134bp; Strand=+
atgttgtcttttgtgaggcttgtactgcaaagggagcaagcgcaaaaaacaaggcaccagtcagtaggatctttttcaccatcatctccttatttattgatgtcggtgtttggtctatcaaggtttgatcggaagacctgtattgagatccagacaacgttttgtattgggttcccaataagcattcacgttggtacttttcaaacaggcatctcgattatcaacgtccacctcatacttatcaaactgtttttcttcacgtttgttaatttttttgcgaaggcttccctgttcattccattcttctttttgttgacgagccatttctttgctcatcgaattctcaccgcccccattaatggttacgcaagtactactcgatgtacaaggcgcagaaaatgctggagtttgccacaataa

SEQ ID NO: 2737 - DNA, 213 bp, Xenorhabdus bovienii
  Coding sequence Name=Xb4151_4152.C435.gene126.dna; Position on contig= 87043..87255bp; Strand=+
ttgctcatcgaattctcaccgcccccattaatggttacgcaagtactactcgatgtacaaggcgcagaaaatgctggagtttgccacaataatggcaacaacagagcaaccgcagaaacagtcttagctatcaaagaattatggacattcatatttaaacctctgtcacaaaactatcaattaaagttaccccagaataatagtgtattttga

SEQ ID NO: 2738 - DNA, 756 bp, Xenorhabdus bovienii
  Coding sequence Name=Xb4151_4152.C435.gene127.dna; Position on contig= 87317..88072bp; Strand=-
atgactatgattgtttttgtgacaggagccacttccggttttggtgaagctattgtgcggagattcattaaacacggttctgtagtcattgctacgggacgcaggcaggatcgattggacaggttaaaaaccgaattaggcgaaaatttccaccccattcaacttgatgtgagagatcgtaacgcaatagagaaagttgtacaggaactgcctgatgtacttcgaaatgttgatgtgttagttaataatgcggggttagcattaggactagaacctgctcataaagcaaacccagatgattgggaaacaatgattgataccaatactaaagggttggtgaacatgacacgcgccctgctgcctaatatggtacaaatcaatcatggacacgttatcaatattggttctacagcagcaaactggccatatgccggtggtaatgtatacggtgcgactaaagcatttgttaagcagttcagtttaggattacgggctgatttacaaggcaagaatattagagtgacagatattgagcctgggcttgttggcggaacagagttttctcaagtacgctttaaaggtaatgatgaaaaagtcagcaaaacttacgacggtgctgaggctctcactcctgatgatatcgcagaggccgttttttgggttgcaaccctgccttctcgcgtcaatattaatacattggaaatgatgccagtttgccagtcatttgcaggcttaagtgtgcatagaaattcgtaa

SEQ ID NO: 2739 - DNA, 96 bp, Xenorhabdus bovienii
  Coding sequence Name=Xb4151_4152.C435.gene128.dna; Position on contig= 88194..88289bp; Strand=+
atgacaaaaatcctgaaactctgcaactatagaggaatcactatcatgccattgaaactctacattggttcgcacaatctatattatgttaaataa

SEQ ID NO: 2740 - DNA, 936 bp, Xenorhabdus bovienii
  Coding sequence Name=Xb4151_4152.C435.gene129.dna; Position on contig= 88440..89375bp; Strand=-
ttggacagccgacgtcatgcaatacgtccatctcatcagctcaggtctgagatcatacatttaataaggaggaaactatccttattcatccgtggtatattccctatcgcagactttaacatttttttaggatttttcgtaatgccatggacattttcacatccagcagccgtttttcctttgaagagttttccgggggggaggttgttaaatttgcctgcgctaattactggcagtttgtctcctgatttcttttactctgttgggttatatgatgttgcaacggttgcgcatcacttacccggatggttttataccgcatttcctttatgtttattgatatttttgattgtacgtctattgtcatatcctttatccgtcctttttccaatatcctttgctcgttatgaaaaaccagactataaggacagagttgcttttgtgttgtcgttatttataggagctgtaactcatattggctgggatgcattcacacatgataaaggtttttttgtcgagctaattcctctactacagttccgcgtttttcattccattaccaacgggcaggggataagtatatataaaatactacagcatctcagttcgttattaggattattgtacctcaccatgaagtactggcgatatcagaaaaaattggatctaagcgttcaaaaaatgaacaaaagaaaactttaccatctgattggtattgggtttatctcaggttttttaacatgccctttagcattatttttatcctgggaagtatcggggataaatatgagcaggtttatttttaaggaacttactctatctgtaccagtcttttttattattctggtatttatttcgctatggataaggtattacttttcgaagattaaacctgttcaatcaaaatctattggcattccaatagacaacacatag

SEQ ID NO: 2741 - DNA, 195 bp, Xenorhabdus bovienii
  Coding sequence Name=Xb4151_4152.C435.gene130.dna; Position on contig= 89312..89506bp; Strand=-
atgatcgtttttacgcatatctcagtaaatccagtggtgaaagtatctcgtcaggaagatggcaaaaattctggatcatatagtcatacatatcggttcctttttgttgttttaatccaacttcataacttttggacagccgacgtcatgcaatacgtccatctcatcagctcaggtctgagatcatacatttaa

SEQ ID NO: 2742 - DNA, 951 bp, Xenorhabdus bovienii
  Coding sequence Name=Xb4151_4152.C435.gene131.dna; Position on contig= 89489..90439bp; Strand=+
atgcgtaaaaacgatcattttagtggaattattgcctttgtgatgacagcacaattaggcagttttactgctgcggctgaacgacttggactgacgaaatctgcggttggaaaaagtctaaatcgccttgaagaacgattggggcttaagctttttcagcgttctacaagaagcttgagtctaactcctgaaggtgatatttttctgcaaagttgccaaaatgcgatagcgattttagaacaagccgaagcggggatagcttctcatatcacttcaccaataggtcgattacgtattgatctccctgctgcttttggacgccaacgcattcttcctatcttgttaaatatcactaaggaataccctgaactcacattgtcagtctcttttagcgagcggtttgttgatgtgattgaggacggtatcgatttagtgatccgtattggtgaattagcagatagtagtggtttgattgctagacgcctcacgacccaaaaattagtaatttgcgctactccagactatttacaacgtcgaggaatacctacaagttctgatgaactaaatcaacatcattgtattgtcgggtttcggcgtcatcagcccttccactggtgtttaagaataacgaatagtaataacaaaaatattacgcctccacctacttacgaattggcggatggtgatgcaatgcttactgctgtgttagcgggttgtggattggcacaattgccactatggatggtgaatcgatacctaaaaagtggtgaattaaaaactgttttacctgaatattcgggggctgaagtaccaatcagcgccatttggccaaaaaaccgtcatctgctgccgaagatacgttacgttatgttgtcgatactcttgttgcagcagcagaaaaaggtttattggatgaataataatgaattattaaataatcgttttatctga

SEQ ID NO: 2743 - DNA, 525 bp, Xenorhabdus bovienii
  Coding sequence Name=Xb4151_4152.C435.gene132.dna; Position on contig= 90419..90943bp; Strand=-
atgttttctagttttagctatatttctgattatcttacaaaagtaacctatctcagtaatagtatgattgctattttccttattttatttggtgctagtggttatatgggtaattttatctttagccgtctattacaaaaaaacacagttagaactacctatgcttatacatttttatttattttggtctatttattagtgtggctattgggtttttcaccttttgtaatggtactattgattatattttggggtatttttcactcatcggggttaatcgtcagtcaaacatggttaatgcatgaagcaagtgaagcgcctgagtttgccaacagcctatatatcgctttttctaatttaggaataaccttaggcgcaatggctggtggatttgttatatcacactacggtgtacattcaattgtactgacgggaattctgtttttaatattttctttcttcagtatttacataaaaaatcgtgcaacggtagccaaccaaacctcagataaaacgattatttaa

SEQ ID NO: 2744 - DNA, 684 bp, Xenorhabdus bovienii
  Coding sequence Name=Xb4151_4152.C435.gene133.dna; Position on contig= 90933..91616bp; Strand=-
atgacaaataaatcatttttcttattaatgactttaacgattgccgtttttggagttattacaacggaagtttctgttatagggttacttccgcaattagaacgtcagttaaatataactcccattcaagttggttatttggtgagtgtgtatgcaattgtcgttgcgattgccggccctgttattactttactcttattaagatataatagaaagtatgttttattatgcattttatttatctttattgcatctaacattatttacgccacggaaaatacatttaatataatactgatttttcggatcttacctgcattaactcatgccctatttttttcaatagcactggttatagcagcaaactcagtacctaaagagaagagcgctgatgcggtagcgactgtgttttccggggttgcacttgggatggtactaggaatgcctttaagttcttttattgctgaatatatttcactcagtgcggccttttattttggttctgtgacatgtttaattgcatttataggtgttgtttattttattccgtcattacctgttaaccaacaaattaatatacttgaacaagtaactgtattgaaaaaaacaaagttatggataagcattgcaactgttacttttattttttcagctatgttttctagttttagctatgttttctag

SEQ ID NO: 2745 - DNA, 123 bp, Xenorhabdus bovienii
  Coding sequence Name=Xb4151_4152.C435.gene134.dna; Position on contig= 91766..91888bp; Strand=-
gtgaggttgaaatgtactcgtatttgtagactgacagtaattcaaatgaaagttagcccgaatatcggaacgataactgggctaactgacaactttttttctacaaacagtagacgaaagtag

SEQ ID NO: 2746 - DNA, 132 bp, Xenorhabdus bovienii
  Coding sequence Name=Xb4151_4152.C435.gene135.dna; Position on contig= 91844..91975bp; Strand=+
ttgaattactgtcagtctacaaatacgagtacatttcaacctcacttaagactatctctgccgctcaaggcactagaggcggctgatttgcaacagctcgctgaactgcttaatgagttagagctggtctga

SEQ ID NO: 2747 - DNA, 435 bp, Xenorhabdus bovienii
  Coding sequence Name=Xb4151_4152.C435.gene136.dna; Position on contig= 92082..92516bp; Strand=-
atggaaataaccgtgtttttccctgaatatattgaggcactgagaattctttacttggaatcaagaaaggtcacttttacttggctgaatacggataactatcaacttactgatttcgataaagatactgaaggtgagatgatttatattgccgtagaaaacggtaagattctaggttttatctctgtttgggcacagaatcattttatccatcatctttatgtttctaccgaatatcatcggtgtggcataggcactcaactactggatttcgtcaaatccaaatatccacaccaattaagtttaaaatgtttggttaaaaaccataaagcgattaatttctacgaattcaacggttttatcaagaaagctaaaagctcagatgggctagcagggaattactatctcatggttttttctgatcaaaagagttag

SEQ ID NO: 2748 - DNA, 420 bp, Xenorhabdus bovienii
  Coding sequence Name=Xb4151_4152.C435.gene137.dna; Position on contig= 92520..92939bp; Strand=-
atgaaaattcatcaactcatggaagtaattgaaaataaatatcctgctgctgaaagttgggtatttggtgactcaatcgaaatgtatgacaagctttctgccttagttgccaaaggcactaaaacagcaacgagttgttcatatcatgcttataaacaggttaatgaagagatcgaaattggcaatgagtatattgtcttaaatggtaaaaaccttccggtttgtgttgttagagtaactgctgttcatttaacccaattttcagcaatgacaaccgaactggcttggaaggagggcgagggtgatagaagtctacatcgttggcggatggagcataagtgttcttttgagcgagaaggaacgttttctccagatatggaagttgttgttatcgagtttggggtaattgaggtgctataa

SEQ ID NO: 2749 - DNA, 162 bp, Xenorhabdus bovienii
  Coding sequence Name=Xb4151_4152.C435.gene138.dna; Position on contig= 92993..93154bp; Strand=+
atgctgctgttaaccaccacttctaaccaactctatgatcttcctcttattctaagtatagaaaaatatgagcggtgtttttcaccgctcataagtcaaattttactgagtaagaccgttgatcaccaaccaactcgtatccagttcacacaaccccattaa

SEQ ID NO: 2750 - DNA, 111 bp, Xenorhabdus bovienii
  Coding sequence Name=Xb4151_4152.C435.gene139.dna; Position on contig= 93111..93221bp; Strand=+
ttgatcaccaaccaactcgtatccagttcacacaaccccattaaccgtcaaaaatgttttaacaaaaccggaagaaatgcagtaagattgacacccaatcgtgggaattga

SEQ ID NO: 2751 - DNA, 432 bp, Xenorhabdus bovienii
  Coding sequence Name=Xb4151_4152.C435.gene140.dna; Position on contig= 93236..93667bp; Strand=+
ttgttatcgctttttcgtctatcacaacgccgaatacctgctttgatcgcctcactggcgattttgatgttgttcattggaccagtggtatcaaaaactctggagcatcggcgtgacagcataaaaagcgaagcccaccacaacatgccaatgtctggcatgcaaaatagcaataatcatcattacgcatcatcggtaaatggtcatgatatgcatcatggcgcttcccatacccatacggggttgatggatgatattgcctgtggttattgtcagcttctgattaacctgccattgctgacgtgggtgtttattccgtttatctggctggcactgactatctcccgcacccctccagtccggttttttttgggttctgctattcagctgttttatggcgaatcgcaaccgcgcgccccaccccttaattaa

SEQ ID NO: 2752 - DNA, 2049 bp, Xenorhabdus bovienii
  Coding sequence Name=Xb4151_4152.C435.gene141.dna; Position on contig= 93787..95835bp; Strand=+
atgtctactacacaattatttcgcgtatcacctctgacagccgctttagctgtcattctctttatgcctgccagtagcttggctgcaacaggtgaagataacaacgacaaagagataaaagacacacagacagttaatgatagagaatctgtgataattgtgaccgctccggcaatttcaccactcactatagctacctcacccaaaacacctcgtcagcctgtacccgctagcgatggttcggattacctgaaaactattcctggtttttcccaaattcgtaacggtggtactaatggtgacccagtatttcgtggcatgtttggctcgcgcctccgtatgttggttgatgatggtgaaatattgggttcttgtccgtcacgtatggatgcaccaagctcctacatttcacctgaaagttatgatgttctgagtctggttaaagggcctcaaactgtactttggggtgcaggaaactccgcaggaacggttcgttttgaacgcacccgtcctcagttcgacaaactgggtgctcaaggtaatatcagtacggtagcggcttccaatgggcgttgggatggtaatgctgacctcagttttggtaatgaactcggctatgtgcgtttgagcggtaataaatcacgctctaacgattataaagatggtgatagtaatcgcgtaccttctcgctgggataaatggaataccgacatcgcagtcggctggacgccggatgatgatactttgctggagttaacagctggtcagggtgatggaaaagcacgttatgctggacgtagtatggatggctccaaattcaaacgggaaagttttggtgtgcgttttgaaaagtccaacatcagtgacgtgttcgacaagtttgaaaccaatttttattacaattacaccaaccatattatggacaactattccctgcgtaccccttccccaatgagtatgggaggacatggtagccatggtggtggaaaacatggtggacatggaatgggtgccatggaactggatcgccgtactatgggcggccgtatgatggggacttggatttgggaagattttaagttacagagcggtgtagatactcagtccaatacccatcgaaacaaatatgacactgtttgggtgaaagatgctcgctaccgtaattatggtattttcagtgagttaacttgggacgccactgaacagagtaaagctatcggtggtgctcgcctggatagagtactcgtggataattacgttaaggcagcagaacggacagccactctaccttctggcttcattcggctagaacataatctgacggaagtaccgttgatgttttatgctggcgtgggttataccgaacgttttcctgattattgggaactgttctcatcaaaatcagggaataacgtcttcagagatttgaaaaccgagaaaaccactcagttggatatcggggcgcaatatcatggccaatattttagtggttgggtatctgcttacgtaggtaaagttaatgactttatcctgttccgctattccccaacagataggacaaaaaataaggcgaataatgtagatgccactattatgggtggagaaatgggtgccagctatcagttgagcgaccattggaaaaccgacgcaagtctggcttattcttgggcgaagaatacttccgatcatcgcccattgccacaaactccaccattagaagcgcgatttggactgacttgggagcatggagactggacaagtagcggtttgcttcgtgttgttagcagtcaaaaccgagtgtcaatcaatgaaggcaacgttgtcggtaaggattttgatcgtagtgccggatttgctatcctgtctgcaaacaccacctataaagtgactaaaaatgttcaggttagcgccggtattgacaacatttttgacagaacttacagcgagcaccttaacttagccggaagtaacaattttggttattctggcaatacgccagtaaacgagccgggtcgtacttattgggctagagtgaacgttaaattctaa

SEQ ID NO: 2753 - DNA, 492 bp, Xenorhabdus bovienii
  Coding sequence Name=Xb4151_4152.C435.gene142.dna; Position on contig= 95979..96470bp; Strand=-
atgaagtacgatcacgttgaccgtttgctaatacagtgggaacagcagcgtccagacctcgatccttcaccgatgggtgtgattgggaggttagtccgtgtaaacaaaatcattgaacagcgtctgcaacatgcctttaaagcgcatggtttgagtgccattgagtttgatattctcgctacacttcgccgttataacacgccaattacaccaactgagatgtatcaatcagttatgctgacttccggtgcaatgagtacccgtattgaacatatggtacagcgagggctaattgagcgtatcgccaatgaagaagaccgacgtagctgcaaagtttttctgactcctgaaggaaaaacacttatagataatgctgtcgaaagccatttggagaacgaaagagctattctccagccattgacggaagaagaacaagagcagattaccatattgttacgccattggttactcaccaatgaatctgcgacttga

SEQ ID NO: 2754 - DNA, 114 bp, Xenorhabdus bovienii
  Coding sequence Name=Xb4151_4152.C435.gene143.dna; Position on contig= 96456..96569bp; Strand=+
gtgatcgtacttcattctttttccctattaatttattccaacaaaaagatacttgataaaaatcgtttaggctattattttaatttacctttaaataaagatactttatattga

SEQ ID NO: 2755 - DNA, 888 bp, Xenorhabdus bovienii
  Coding sequence Name=Xb4151_4152.C435.gene144.dna; Position on contig= 96598..97485bp; Strand=+
atgcaggaaacgagaatacacagtaatattttgcttaccgcactagcgcccatcgtatggggcagcacctatattgtcgccactgaaataataccgcccaacatgcccctgttggcttctaccgtcagagcgttgcctgctggcatattattattgttgatttgccgcaccgtgccaaaaggaatgtggtggctgcgtcttaccgttctggggttacttaacattggcgcttttttctatttccttttcgttgcagcggggtatcttcccggaggtatggcgtcgttaattatgtcttgtcagcctgtgattgttatattcctaagtgcttatttattaagaacatcactgacaagaaaacattttttttcggcaatactggggcttattggaatcacattactagtaatgaattcagccaccagcctgaactggcagggcattatcgcagggtttgctggttgtagctgtatggcattggggattgttctgaccaagtattggaaccgccctgttaatctatcattactgagttttacgggctggcaattaacactgggtggattgatgttactaccaatcgcaatttacacagaaggtgtgccacaacagctcacaccaactaatatcatcggctatggttatttgtgtctgattggtgctgttttagcatacatcatttggtttcgtggcattgaaaaacttcccgttgtaagcatttcattcttgggatttctgagtccattatcagcctgcgttctgggatttgtttttctgaaacaaacattttccttgctacaatttttcggagcctgcaccatcattgtttctgtctggctttctattccccggaatcagacacaaaaatccaataactctacaatctaa

SEQ ID NO: 2756 - DNA, 597 bp, Xenorhabdus bovienii
  Coding sequence Name=Xb4151_4152.C435.gene145.dna; Position on contig= 97518..98114bp; Strand=+
atgaaacttacccttatctctggtagtcaacgtccggattctcgtagtcaacgtgttgcatcatacttgcaagaattaagtcgtgaatatggatttactgatatatatctccttgacctgtctaatgtagagcttccatttcacgatggttacacaacggatatatcagcagaatcgcatccttggcaggctttcgctccgaatctaagagaaagtgatgcatttatttttattactccagaatggcacggtatggcaacgccggcactgaaaaatttcctgttgtattgctcagtgacagaactgggtcataaacctgcgctattggccagtgtttccgccagcatgaacggtgtttatcctcttagcgaattacgcatgacaggctttaagaacaatcacgtctgttttctgcctgatcatttaattttccgccaaagtgaagacctgatttcgacagatttggcttgtggtaatgctgaatttgaagcacgtgcgaaatatacgctgaaactattgaaggcttatgctgaagctttgaagcaagtacgcgaagtcattggagaagaaagcaaaaattacccttatggtatgtaa

SEQ ID NO: 2757 - DNA, 108 bp, Xenorhabdus bovienii
  Coding sequence Name=Xb4151_4152.C435.gene146.dna; Position on contig= 98214..98321bp; Strand=-
atggctatttttaaatccaagaaagtctgttttttaaacaaaaatgccaaaaatacggtgtactgtgtttttatacagttattatgtttttcggcatcaaaaacatga

SEQ ID NO: 2758 - DNA, 693 bp, Xenorhabdus bovienii
  Coding sequence Name=Xb4151_4152.C435.gene147.dna; Position on contig= 98631..99323bp; Strand=-
atgagtcagtggaaagaaaaagatatatttaaattattctcacagtacgataatatccttgaggagcaatatggatttactgctatttctaatttcattaaacaacatcgttcaataaataaagtattagatctcggttgtggttcaggcgaactgattccttttcttacatctatcgcctctcaggtagttggtgctgatatttcagaacacgctttagaaaatgcaagagaaaagcataaaaatagcggagctacgtttatttacgcaagcgaactaccaaattatattaataataatagtaaattcgacgctgtcataagttcttttttgctttgcactctaaataccgaagattcaattaagttactgctacgccaagtcaatgatgctcttattgaacatggttactatatcgtttttagttttaacttgaatgcgataggagtagacttcgggacattcaaaacaggagaagagggtaaaatttaccatgatggagaggcactacctgtcagcatgcggacaaaatcaggggaacagtttacttttaatgatacattttggtcttttagcaaattaataactctttcggaggagatgggattttctctttaccaacaatcaattctaaccatcccacaatttactatttctcctttcacgatatttgttttaaaaaagaaaaattag

SEQ ID NO: 2759 - DNA, 3051 bp, Xenorhabdus bovienii
  Coding sequence Name=Xb4151_4152.C435.gene148.dna; Position on contig= 99666..102716bp; Strand=+
atgaaaaaaaacaatcagttacggcctatttttttagggataacattgttattttggcaattacctactggttcggtaattgctgccactgaatatcacgaacagggtaaaaaaggtgtacctgatagttggttgtcagatgaattcaaaaatcaatggggattggcctctatcggtgcccattatgcctatgccagaggttatacgggtaaaggcattaatgttggtgtattagatcagtcagttaccaaccattctgagtttgctgacaaactaaagataatcgctccatccgacatttggagctatagttatgatccctacagcgatctgatcagctttggtgcacatggcaatcatgtgtcaggaaccattgcggcgaacagagatggcaaagaaatgcacggagtagcatttgatgctggcttggtcaccgcaaagtttctgcaaaatgattacaaccgcacagaagctatgattcaaagcgatgctcgcatcattaataacagttggggagttcgtccgcgctattttgtgggtagagacggtaaacctatccgatggcctgatggaactatcgcttactatccagttacactgaaacaactaattaattatgtctcgccaattaaagaaaaactaaacgagttaagccgctccccgctccctgtgacaggggaaccgttagccagtgatgccggcatgttacgtgctgctcgccaaggaaaattaatggttttcgctgcgggtaacgcgaataattataacgtgacttggttacacgcggggatgccttatttcttccccgacgcactgaaaaactaccttagtgtcaccaacctaaaagaaaacgatgtgattgcaccgtcgtcaactagctgtggatataccgccagttattgcctggctgcaccaggcaccaagatttacagtagcactggcgattttgtctcgaagagtggtggcaaaattgatgaggacgctttaaagaaaggcgagctggagattgatcctacctatgattcttacacaggtacgtcaatggccgcgccgcatgtggcaggagccgccgcagttctgatgcaacgtttcccttatatgactgcggcgcaaattgccgatgttatcaaaactaccgcgactgatttggggacgccgggtcttgatgatttatatggttggggaaaactgaatctgaaagatgctatcaatggccccaaaatgtttattactaagcaggatattcccgctaaatattacattgaaggttcgtataccgaaacacagtttatcgctaatattgctggcatcggtagtctgattgagccaggcaccaccgtacaacgagtatgtaacagtattgagtgtgcctacgactattggagcaatgatatcagtggtcatggtggcctgactaaaactggcagtggtgcgctcctacttaccggagccagtacttattctggtccaacatgggtgaatcaagggctgttattggtaaacggttcgataacctccgacgtgacagtgcaacgcgatgcaaccttgagcggaaaaggcacgattggctcactcactgcttacaatggagctaacgttgcaccgggtaatactgacgctgctctgaatgttgatcgcgaagtcatttttgaaacaggctcccgctatcaggtgacactaatgctggatggtaatagtgatcgtatcctgagtaatgatatggcagggttggaaggtggtgaagtgcaagtaactttggaaaaccggggtaacttgctgtcgcagcaaaaggtacacagtttgcttggccagcaatacaatattttgcaagcgagaaatggcatctatggtcaatttgacaccgtatcacaggggcatctgttccttgatatcccgctcaactatcaatctgatcgagcgttgctggatataaaacgcaacacaaccgagtttgccagcctggccacaacggctaatggacgttcagttgccaaagcggctgatatgttgaattcagaccatcctgttcatgaaagtattctgatggtaaattcagccgcacaggccagtcaggcattcagccaactttcaggacaggttcatgctgatattgctgctgcacagatcaatagcagccgctatctgcgcgatacattgaatactcgtttgcgtcaggccaatggcggtgccacttctcaggaaatcaaagcggatacagatggtgcctgggtacagataatgggtaactggcagcgcgccagcggcaacaatgaagtcagcggttatcggatgtccaactacggcgtgttgttgggtgtagataaagacttgtccagcgactggcggcttggtgtggctaccggctacactcgttcttctctacatgggggcgataatgcgtcagcacgcagtgataactatcacttggctttatatggcagcaaacagattgatgctctggcattacgtgctggtgtagcctacagttggcatcgttttgacaccgagcgctcagttgcttttggtgatcagtccgacgatctgaaagctaaatacggtgcacgtactggacaattatttaccgaggcgggttatggtatcaaaacctcttggctgaatttggaaccgttcgctaacctaacttatgttaacttccacagcaatcgtattaatgaacaaggcggagccgctgcactacacggcgacaaaaaatcgcagaatgctaccttctctacactgggtctgcgtgccgaccaaaaatggaaaatcgaacgcgaatcccaaagagaattgcatgtgggtgtatatggtgaactgggctggcaacatcggtttggtaacattaatcgtggtactaagttaggcttcagcaatagtaatacgatgtttaccgtcaacagtgtttcggcggggcgtgatgcagcagtggtgaaagcaggtactgaattagatatcggcaaaaataccacgctggcactgggatataatggcgttttatcaggcagtcataaagataatggtgtgtttttgaatgctaattggagattctga

SEQ ID NO: 2760 - DNA, 522 bp, Xenorhabdus bovienii
  Coding sequence Name=Xb4151_4152.C435.gene149.dna; Position on contig= 102836..103357bp; Strand=-
atgagtgacaacatgccacaatatatcaccattataaaagacacacctatatgggtctggattctgcttgtatttcttgtcataagaggaattaaagctctttcaagccgtgaaatgagcatatggcgcattttcttgctgcctagcgtatttttagtctgggggatacatagtgttctcacggaaacctacttctcaaatttatcactggtgatgatgggaatcggtctgattttcggtactactattggttggatactatggagatcacagccacgattaagaaaaaaaactcacagcaacttaattattcgcccaggtacgcctttgacattgatagtgatcataattacttttgtaagtaagtttattatgactgctttattaagtatttacccaatattgctacactcattacattataatttattcttcgggctattaagcggccttcttgatggtattttttgtggagggacactgaatctttttatttcatggtgtaagaataagagttcataa

SEQ ID NO: 2761 - DNA, 1278 bp, Xenorhabdus bovienii
  Coding sequence Name=Xb4151_4152.C435.gene150.dna; Position on contig= 103481..104758bp; Strand=+
atgatccccttttatccatcccctacccagctatctaatgtggtaactgtcacatttatttcaccaaggctatacattttccctattttcataaaaggaggccagagtatgccgccacgttttattctgtctgtattggcactcgctgtatttttcattggtacaacggaatttatgttgtctcccatgctcaaaccactggccggtgtatttaaaacaacgcttgataatgttgcttggctcgtatccggttatgctttttcctatgcgcttgcagccccttttttcggctggctttctgatcgtgtaaatcgacgcagattgttactgatatccctgctgtttcttatgtttgatggattggcgttaacatttgcccaaaatttgagtactgctattggattgcgtattttcggcggcatcgcttcagcggcactaatcccaacaacgtttgccttgattgcagaacttttcccactccaaaagcaagcgtcagccatgggtctggttatgcttggcatgacagcgggtattgctggtggcccaatatttgcggggattttaacggaattatttgattggcgggcgccatttctggttaatgctgcggggtgtttgctggtttttgtcttaggcaggacatgtattccaattcaagcacctgttgagagaataaagcaccagatggttacatttaaatcaatgtttcagtgggtgcgtcagaaaaatctaatgatttttcttattgcaaaagggttttggaatggtacagcggtgtctgctttgatattggctggagaggtattacgaaaacactatgagataggaacaggaacgattggtatctcaatttcgacattcggaatcggtcttggtttgggcaatttgtccgtcggaatggtgaaacgtctgggattaagggatgaacttatattgttactggcgatcgtgttactttcctcagcgacgactgcgtttatgctgatgcctttatctctgccctttagcctgagctgtttgattgtatggggaagcgcccttggccttgctgcaccgatcagtaccgttattctggcaaatcgagcgaaacagcataaaggccaagtactggcggtttcagaaagcttgaacaatctgatgattttgcttttgttcccgattgctgcaatgctgatgactcatcatggcattgcagtgaccatgctaatgttaggattcattttaataataagtatcgtgctgacaataagagatcttttgagtgacactgtcacttaa

SEQ ID NO: 2762 - DNA, 1044 bp, Xenorhabdus bovienii
  Coding sequence Name=Xb4151_4152.C435.gene151.dna; Position on contig= 104964..106007bp; Strand=-
atgttcactaccaatccgaaatacctggccgggaaattaaggaggcttgagatgtatatcgagaaaggacaagaaaatcgaattaaacgactcgtcagacaaagtaatgctgaatacaccaagggtcatgagcttaaaccagctaaacccatgttgatccgtgcagggatagcaggtggtcttccatttaatagcttaactaccgatgtggtagtaggttgtttaccggaaagtatggcctgctatggaatgtgtttcgctgctatatccagttgggaaaacggtatcgattttggtaaacgggtcgataaccaattggatgaaaccgtttttgttaccgaccttaatgcattgcctcactcacaaaagtatgtcaggtgtgggtggaacagtgatccttcatggaactggtcagtttctacaagaatggctgaattggcacgtgaggcgggattattgatgatatttatcaccaaagcatttagaaaaatgcctgacgatatcatccaacgtttagttgctgcaaaagcggaagtcagagtctcagtcagtgcgttggataccaatgagcaattaaggttgcggctcggtgtgattgaacattatcgccgtgctggtggcattgtcattcctatcgtgttgaccacttttttcaaagatatcgttttgatggagcgtcagaataatattgtcgagtggatggtagaaaatgactatcctgcggcagagaacagtttgagatttccccataatgccaaagtttctgaattagtcgatcctcataatgtaaggcctctggagaaaggtgatgaattctggagtgggcgtttataccccgaaaaactttcttttcctaccaccaccacaattccggatagttatcagggtattgatactggctatctatctgatctgcaactggatgaaattaataagttatttattgatccagttaaaacacatcaggaaataatgcaatccaaattacctttatccagtccaaagatgtgtggtgtatcggatacaagacgccttactgaataa

SEQ ID NO: 2763 - DNA, 774 bp, Xenorhabdus bovienii
  Coding sequence Name=Xb4151_4152.C435.gene152.dna; Position on contig= 105958..106731bp; Strand=-
atgaaaaatcaagcatcttcaatgacgacgggtatatctgtttatggtctgctggtttttaataatcagaaaatggatgatgatgcgcttgttaattttgccctgcgcgtaggagatggaagactggaagagcctgcacggaaaatttccctgaccgataaccgaaaacatattgcttatctgacaaacctatgtgatgaaaagggagagaaattgggtttttctggcaacaatacggacttctggcactcagaccaagaatttcgaatcaatcccgcctccgtcagcatactttatggtgagtctgtaaaatgccagggaggtaatacctcttttgcatcaacttcggccgctcatctgggatactccattgatgaaatctccacgctaaacacattgtggtcaactcgccaaccagctgtctcacatgataatgttcctcatattactgttgctcatccagtgataatcgaaaataagcaaacaaaaaagcagtatgtatatatcagtgaaaacgccatcaaattcctcgacaacgatcagccactgccgcattcagaagcacttaaacaagctattttagaaaaaatattatcctccgataatatctattcacatcaatgggttgatggggatttactgctgtacgataacagtcaacttttacatcgcagggaatgttttactggcgacagatttattaaagcactgaagatctatcctgatgttcactaccaatccgaaatacctggccgggaaattaaggaggcttga

SEQ ID NO: 2764 - DNA, 1050 bp, Xenorhabdus bovienii; identical to SEQ ID NO: 1176
  Coding sequence Name=Xb4151_4152.C435.gene153.dna; Position on contig= 106744..107793bp; Strand=+

SEQ ID NO: 2765 - DNA, 165 bp, Xenorhabdus bovienii
  Coding sequence Name=Xb4151_4152.C435.gene154.dna; Position on contig= 108098..108262bp; Strand=-
atgggggctctaaaaactcccccactgacagtagcgatacatgaaagaggcaattttattcccattcattggcttaaaaatcttgattacttgattacatcggataataaactataccatgccagctttaatactttaactgccctaaatcttaatttttcatga

SEQ ID NO: 2766 - DNA, 96 bp, Xenorhabdus bovienii
  Coding sequence Name=Xb4151_4152.C435.gene155.dna; Position on contig= 108219..108314bp; Strand=-
atgatttccatattaatatataatttatttatatcattaaaaatggtttttaatgggggctctaaaaactcccccactgacagtagcgatacatga

SEQ ID NO: 2767 - DNA, 819 bp, Xenorhabdus bovienii
  Coding sequence Name=Xb4151_4152.C435.gene156.dna; Position on contig= 108380..109198bp; Strand=+
atggttgctacacatgatgatattcagacccgttatgccaatatttcagttctcgatactggtggaagtgggctgccagtgctcctgatacatggtaattcaagctgtaaagaaatttttcgtcatcaaattgaatatttaaaaggggactatcgggttctggcattggatttacccggccacggtaaatcttctgacgccagcgatccgcgtgaagcatactcaatgcccggttatgcccgcaccatcatggaagtactggataagatggacattgataaagtcgtagtctttggctggtcactcggggggcatattgggttggaaatgctggcactgaatcctaaaatgatcgggctgatgatttgtggcacgccgccagtggccgttgggaaagagaatatagcccgtggtttttgtcagagcaagcagatgagactgaccggtaaagcggaatttactgacgaggatgtcagaaactttgcctgtgagacaaacggcgtcaatgcacctcatgaaccgtttatgatagaagccgtggcaagaacagacgggttagctcggcaatatatgtttgaagcttttatttcccctcaggcgacagatcagaaattattggctgaaaccagtgaagttcctttggctatcgtcaatggtgtcggtgatcctttcattaatcacgattatattaatggattaaattatagaaacctttggcaaggtcaggtgtttaacttgtccggtgttgatcatgcgccattctgggaagcaccagatatttttaacccgattctggctgaatttttaaaagatctttaa

SEQ ID NO: 2768 - DNA, 312 bp, Xenorhabdus bovienii
  Coding sequence Name=Xb4151_4152.C435.gene157.dna; Position on contig= 109308..109619bp; Strand=-
atgcaaatccgtgctgcattacctgagcaacttcagcaacagtggccttcaatacaaagtgtgattgaagtcgtcagtaaacgaagtgtgaaagatcaaccttcctgccgtgattcacgctggtatgtcagctctctcccgttagatgcggaaattgccgccaagacaataagaaggcactggtcggtggaaaacaagctgcattgggtattggatgtcacttttagggaagacgctctatcactcaaagaccctgatggcgcggcacaaatggtgctttttaaccgaatggcgttaaatgtgattaaataa

SEQ ID NO: 2769 - DNA, 264 bp, Xenorhabdus bovienii
  Coding sequence Name=Xb4151_4152.C435.gene158.dna; Position on contig= 109556..109819bp; Strand=-
atggatgccctacattgtcagaaagaaacccttgggttgattaaccaacgaggcggggattttattgttggcctcaaaggtaatcaaaaaaattctatgagtttgttaaaccgcattttgctgcaccttatgaccacgataaacgggctgaatttacagagaaaaatagcagtcatggacggaaagaattccgtcatgtcatgcaaatccgtgctgcattacctgagcaacttcagcaacagtggccttcaatacaaagtgtga

SEQ ID NO: 2770 - DNA, 120 bp, Xenorhabdus bovienii
  Coding sequence Name=Xb4151_4152.C435.gene159.dna; Position on contig= 109818..109937bp; Strand=+
atggtgacaagtgcaccatcaagagcaagtcatttaatcaattgcctggcaaccgagccttccttacctttgctttcggcggcacaatggtcgagggcaacacccgattcaacatcataa

SEQ ID NO: 2771 - DNA, 126 bp, Xenorhabdus bovienii
  Coding sequence Name=Xb4151_4152.C435.gene160.dna; Position on contig= 109993..110118bp; Strand=-
atgatattagatatatatagatatagatatagatatactaacggactatcacaatctatcgggaatgatgccatgcacgaaaccgactattctattcagtcaatcgtcaggacagagcgggactaa

SEQ ID NO: 2772 - DNA, 105 bp, Xenorhabdus bovienii
  Coding sequence Name=Xb4151_4152.C435.gene161.dna; Position on contig= 110115..110219bp; Strand=-
atgtggaatttgcaattaaaaattaaaataaaaaaacaaataaaaatgagaaaattcagattattctcactaaaaacaatccaatactattcagggtgcaaatga

SEQ ID NO: 2773 - DNA, 111 bp, Xenorhabdus bovienii
  Coding sequence Name=Xb4151_4152.C435.gene162.dna; Position on contig= 110284..110394bp; Strand=-
atgctattttttctatattctttatccataattagaccaatattaattatccttgagaatgtattttttgagcatttaagaaataaatataaatttatccataaaaaatag

SEQ ID NO: 2774 - DNA, 5379 bp, Xenorhabdus bovienii
  Coding sequence Name=Xb4151_4152.C435.gene163.dna; Position on contig= 110366..115744bp; Strand=+
atggataaagaatatagaaaaaatagcatcctgaaacaaggcgtttttattcgtcgtgttgcatggtttaatattgtattacaatcgttttttcccattgcgggtagcatggtgccagttatatctgcacgtgctgataatgaaattcagagtataccttctgattttgacagccgatggcatattattcagaagaatgaatcgttggaatatattgccaaaaaatatgattcgacagtcaatgaaataaaagaaaataatctgtattttgtttctgctgagaatgacatgccattaacagtaggaagcaagctgcttattccgcctaaaaataaatggctgaattcaccgaatcatcaaaatgaatcacagatcaaggaaaaccaattcgcgaatattgcaacacaggctgggcggtttttacagaataatcctaatcgcgactccgctgttgagctggctcgttctgtggctacccgtaaagtgaatgccgatattgaacaatggttcaggcaatttggtcatgcccgtattcagctaaataccgataagaacttttcgttaaaaggttcccaatttgatctgcttttccctctgtgggatcaaaaagaaaaccttgtttttaaccaaacgagtctgcaccggacggataaccggactcaggccaatttgggtattggctggcgtcattttgagccggattatatgttaggcagcaatactttctttgattatgatttgtctcgtcgtcatactcgtgcaggtttgggggttgaatattggcgcgattatttgaaattgagcgcaaatagttatttcaggttgtcagggtggaaagattctcccgattttgaagattaccaagaacggccagccaatggttgggatattcgcgccgaaggttatttgcctcagtatccgcagttaggcgcaaaattggcttatgaacaatattatggtgatcaggttgctttatttggtaaagaaaatcgtcagagccaacctcatgcatttactgccggtttgacttatacccctgtacccctaatcaccattggcgctgaaaagaggcagggaaaatcgggaaaaaatgatgatagattaaatttgcagataaattatcagttcggggtaccgtggctccagcaaatatcctctgatgccgtctcacggttacgatcattagccaataaccgctacggattggttgaccgtaataaccatatcgttctggaatatcagaaaaaagaggtcatctggtttcacttggatcaaacaatcagcggctatgccggtgaagaaaaaccgctgaatatttcggtttctgccaaatatggccttgaacgcattgattgggaacttgctgaattaacggccagtggtggcaagattgaaaatgacggcggtcattaccgtattttgttgccagattatcaatacagtcatgccgatcccacctctgtggctgcgacggatgatcataaggtcaaaaatacctattctgtttctgccgttgctattgataaaaaaggcaatcgttctaattctgtgcatatgcaggttattgtttcatccgctgcaatcaatacggctaatagcttattttcaccagaaataagtgaattggcggcagaggggaaaagtacgcaaaaactgacattaaccatcaaagataaaatgaatcaaccggttgatgttaatgtcgaggaaataacacttaagattgaatccagtcataaaacccgcgattctcattccagtcaggtttctgatttccaacgtattgcggttgggcaatatgttgtcaccgtaacggcaggtacacgaactgaaacattgacactgacgccttccgtgagaaatcaggcgcttgcagcgactaaaataacggtcaaagctgatgttaaaaccgctcatatcagtgagaatcaactcactattgaacaaaattcagcaaaagcggatggtcagagcgaaaatcggatacaactggttgttaatgatgagtttggtaatcctgttcccgattatgaggtgaagttcagtagtgatgacgatgtagacattggcaaaagcgcgatcaccgataagaacggcagaattacgatgcctgtgaaaagcgaggtagccggttccaaactgattaatatcacggtgggagaacatgtcactcaagctgaggttatttttgttgcagatagtgataccgcctctattcaaaacagtgacttgatcattactcccgcattgtctgttgcggatggtcagacaaaacagactattacggcaaaagtgacggataaacaaggaaaccctgtttcgaatatcaaggttattttcgaggctgataatcaggcggtcattgcaacgcaggaagtcataacggatgagcagggaattgcacaaacaacgatgaccagtttgaaatccggaaccgtcatggtgacgggaacggtgaatcataaccaaaatcagactcagagaaaaacggagttagtggggcacaaggctacggcattaatcaaagaagtgaagacagaaagtgacctgtacgttgctgacggtaaaacatcggtgactgtgaatgctgttgtgactgatgagaatggaaacccgctgcaatcagtggccgttgactggaaatcaaatcgtgatagcaattcggttgaaattcatcaatcacaatcttttactgatgaaaatgggattgcccgtacgaccattaccagtaaaaaagcctatgaggtgcaaatcacggccagtacgaatgcaacttccggcacttcgacgcctattttattcaaagccgatcctgataatggtgaagtgactgacttgtcgcaaggattgcaacatgtggccagtcctggcagtaagacagaaattagcaccagaattaccgatcaatttggtaaccctcttccgggcgtagaagtccgctggagaactgacagccctgatgcccatgttacgtctacaagcatcacagatgagaatggcaaagcaagcacagaattggaagcggataaagcaggagatataaaggtatgggcaagcttgtccaatggcaaggaggttagcacagagataacgattgtcgcagatcagcagacggcggttgtcacattggccagcgagggcaataagatgcaagccgttgctgatgatcaggacagtatcacgctgattgcgaaagtggttgacgccaatcagaacccgttgaaaggcatccctgtgacttggcactcgttatccgcgaagaataaactgcgtgacaatgtcagtgataccaatgatgcaggagaagcacgtaatgtcatctcaggcacacgggcaggcacgacgacgattgaagcggtactccagaataaaggtaaaacggatctgaaggtcacttttaccgcgattaaactgggtgaaaataacgttaaccaagatgatttccaaattaacagtagttttaaattagtaaatcaatctattgttgcggatggctcaagtaaggcacaagcgatactggtattgaaagataagtatggtaacccggttccgggctataaccagaaaatagcttactcttcatcgaataacagcagtatcacattccacaatcagcaggagtcagaaccgggtatttacactgtgctcattgccggtaagcaggaaggaacatttcctattgatgcccggcttgggtcgctcgaatttagtgattctctgggttttgtcgcaaatcagacgacagccgaaatcgataccgtgaccgtactgaggacaacagcacttcaagctgatggtctggaaaacgttacgattcaggctcaggtgaaagacagtaacggcaataccgcgttgcctggtgtttacgttggctggcagacttcattgggtacgttgtcttcaccattgagtccgaccaacgagaagggcatcgctgaaattacgctatcgagcaggcaggcagggaatgcacgagttactgcggtgctgggcagcggtcaaaagacagcagataacccggtaacgtttattgcgggcggtgtttctggcgataaatcctcattagaggtttccaaatctatagcggtcacagatgaggatattgttcaggttaaagtcattgccagagatgagcatgataatttgctgacgggattgcaggataagatcgcaatgagatccacgtccgatttacagataaccgacgctccggtatttaaagaaattgagtatggtatttatattgctgatattaaaggcaagattgcaggggatacgcaacttattgcagagattggtggtactggggttaaacagcaagccgaactgacgttgactggaaatagtaaaacggcgaaacccaaggatgctgaaaacgctatcgacgtaacatcgaataaaatcattgcaggtaacagtgtcacttattccatcacgctaacggattctaatggtaattcattaggcaaagggatccctgttttttggtcggctgatgcagccagtacgttgttgcagcaaatgactacaacagatgagcagggcgttgctcaagtgacattgcaccgcgataaggcaggtacggcgaaggtgacggcgttattgtcttcaggagggcaatatttggcaccggcagtggagtttactcccgctgacattgacccggcgcattccacgtttatggcagataagaggcaaattggctctgatgctaaagaacaggcaatactgacagttaaactggcagataagtttggtaacgccatcagtggtaaaaccgtcaatattcacttgccgaatccgctcaagggctttgtggtaacgccaaccctgatgcaggataacggtgatggcacttattctgcttcagcgacggcgaagaataaaggaagccaggaaattcaggcggctgtggaaggaaaatcaatcggtcagtcattaactgtctcagtgggcgctattacgccagatctccgttttgccaatgccacgcaacaggtgacttataccaaacgttatgctcactcccagaaagtagtagatggcgggataccggcagggatacgtcagatgtggacgagttctgcggatgatgtcgccaccgttgatgatagcggtaaggttacattgtggaaagccgggacagcgaccatcacggtacagacaggaacgaatggtcaatatcattcgtctacagccagctatacattgaagttaagaaggcaacacctcaattgcagcatcagatcaagcagattgtcgctgtttggaatgatggcaaaaattatgccgtcacgccaagttttgcaaatcaggatgtggatgctcaggccttattgcaacaggcgaatttctccagtcacaataatggtgtggtga

SEQ ID NO: 2775 - DNA, 1524 bp, Xenorhabdus bovienii
  Coding sequence Name=Xb4151_4152.C435.gene164.dna; Position on contig= 115495..117018bp; Strand=+
gtggaaagccgggacagcgaccatcacggtacagacaggaacgaatggtcaatatcattcgtctacagccagctatacattgaagttaagaaggcaacacctcaattgcagcatcagatcaagcagattgtcgctgtttggaatgatggcaaaaattatgccgtcacgccaagttttgcaaatcaggatgtggatgctcaggccttattgcaacaggcgaatttctccagtcacaataatggtgtggtgaaggtagataagcagggcaacctcagcatggtgaaacctggaaacaccacaataaccatcaaaacaccggaaacaaatcagtttacggcatcgactgctgatgttgcgtatgtactgaataagggcaaggtggatatttcttttgatgaggctgttgttcaagattgggtagctggaaatagtaaaatacaacaaccattccagttacctgtacatgccaaggagcgttgggagagtggtaataaagaagtcatagaagtatcacgagacgggttgtggagtaaaaaaggtactggtagtgcaacaatgactctatatgtagaacaaaatgattactatatgtccagtcatggtggttatgatgttgaattatatgataaacctgaggtggatataaaatcggtagaatatcctaatgagggaaaattggtctcagtgtcttcttcagagaactggactccagctttcaccgatgatgggatatctataacgtggaatgcactaaattcaaacaagtataaaccgataaataagatgagagtggagatggaagatgctaactctgggaaattgcttgattataaggattacacttatcaggagatttcatcttcgaagttgcataaaactacatttgttcctaagcctgaatattttggaattagtgttcgaataaaattaaccgcgaggggttttattggacttaatacggtagtcagtagcaataatttacccgtaagacatcttaagccacaccagatatggtcatcggtagaagtcagctcacggtacaacatttttgctctatttttcaatctttcagaagtgaaaacatgtcgaagtctttttattgacagggcacattcaatatatcttgatgtaattgatggatatattgattttggagggaaaaagttacttgtaccaatgtatgtttcatataaagccactattaggaaatttaaggactctgatcttgttacacaagatctggataaggctaatctttctgggaatgccagtagggcagcttataaggctaaagtgattgatggaaatgacaataaactactacctgcgcacagattgattcatggtgattgttggatgaaccattcaggtggataccgaattaatctgcatgttaaatatgcaggggaagaatataaatatttggctaaacgtacccatggatatggagggaatggggatggtgtatatgattctgatgggaatcgtgacataaatatagataacgagttttatttggaatag

SEQ ID NO: 2776 - DNA, 213 bp, Xenorhabdus bovienii
  Coding sequence Name=Xb4151_4152.C435.gene165.dna; Position on contig= 117138..117350bp; Strand=+
gtgatctgcgaccaagcgcaaagtgaaattcctttggctattgtcaatggtgctggtgatcctttcattaatcacgattatattaatggattaaattatagaaacctttggcaaggacaggtgtttaacttggccggcgttgatcatgcaccattctgggaagcaccagatatttttaacccgattctggctgaatttttaaaagttctttaa

SEQ ID NO: 2777 - DNA, 105 bp, Xenorhabdus bovienii
  Coding sequence Name=Xb4151_4152.C435.gene166.dna; Position on contig= 117313..117417bp; Strand=-
atgcctgtaatagcggaaatttctttaaataaaacaaaaaattcccgctctggctctcatcaggctattaaagaacttttaaaaattcagccagaatcgggttaa

SEQ ID NO: 2778 - DNA, 102 bp, Xenorhabdus bovienii
  Coding sequence Name=Xb4151_4152.C435.gene167.dna; Position on contig= 117435..117536bp; Strand=+
atgctagtactgttgaaagtattattttgtttatgtttatatttatatttatatttatatttatatttatatttatatttatatttaatagataatatataa

SEQ ID NO: 2779 - DNA, 153 bp, Xenorhabdus bovienii
  Coding sequence Name=Xb4151_4152.C435.gene168.dna; Position on contig= 117560..117712bp; Strand=+
ttggattataggttattttattttaaacgtttgagatttcatatttttgtctcagtagttaaatcagtcatcagagaagcaaataaaaagagcgtccgcttttgcgaacgctctttaaatcgattaatgtcctcttggggtcgtcatggctga

SEQ ID NO: 2780 - DNA, 10737 bp, Xenorhabdus bovienii
  Coding sequence Name=Xb4151_4152.C435.gene169.dna; Position on contig= 117683..128419bp; Strand=-
atgaacataaatgaacaaactttggataaattacggcaggcagtgctccagaaaaaaattaaagaacgcatccagaacagcctgagtactgaaaaatatcagatccagcccagaactgactcacaacaggcgttaccgctatcctgggcgcagcagcgcctatggttccttgctcaattggatcccgccgcacagacggcgtatcacataccggccggccttcatctgcaaggccaactgaaccaaaacgcattgcaggccacgctggatagtctggtggcacgccatgaaattttgcgaaccaccattgcgatggtcgagggaaaagcccagcaaatcattggcgatgcagactgcggctttactctaaccgttcaggatatcagtcagttgcctgaaacagaacaacaggccactgtcgaagaatatacacagtctgaagcgagccatccctttgattttgaacatggtccgttgatacggggacgattactcaagctctcgcaggacagccatatcctgctgttaactcagcatcacattatctccgatggctggtcgatcaatgtgttgatgcaggaactctcgaccctgtaccacacatttgatcagggtctgcccaatccattaccaccattgacgctccagtatgccgactatgcgctctggcaacggcagtggctacagggcgaagtactggaaaaacaattggattactggtgcagtgcactacaggacgcccctgcacttctaacacttcccacagacaggccccgaccagcgcagcagagttatgccggcggaagcgttgaaatcacgttccctgcgacgctgaaagcacaattaaaaacactcggtcaacgtcatgggacaaccttatttatgaccctgttggcgggctgggccgtgttactctcccgcatcagtggacagaaggatctggtgataggcacacccgtcgcaaatcgccagcatcgtgaactggagcctttgctcggtttctttgtcaatacgttagcgctgcgggtacagttgcatgataaccctactgtcagtgagctattggcacaggtgaaagcgcataccctgagtgcttatgtgcatcaggatctgccattcgaacagttagttgaagcgttaaaacctccgcgcagcctgagccatagcccgatctttcaggtcatgctgtctcaggaaaatacaccggggcaacaaaacgttgaattaccgggactaacgatcagtgagctggaattacctgaaaacagctcacacttcgacctgtcgttatccctgaatgagaccgaaaacggattggtgggcggactggaatatgcccgcgatctttttgaccctgccagcattgagcgcatggttggctacctgaccaccctgctcaccgccatgacagcggatgacacactgcgggtggaatcgctgccacttttgatgccacaagagcgtacccggctattggtggatttcaacgagactaccgtggcctatccgaacgatatcctgctccatcagatggttgagcaacaggtcgagcgtacaccggatgccattgccttaatctgggaagacgctcaactcagctacgccgaactgaaccagcgtgccaaccaactggctcacgccctgattgactttggcgttcagcccgatgaccgcgtggcgatttgtgccgagcgtagccccgacatgatcattgggatgttgggcatattaaaagccggtgcgggttatattccgctggataccgaataccctgccgagcggctggcctatattctgtcagacagcgcgccaaaattactgctcactcaacagcatttgcaggcacgattagcggtagacggcctgcccgtctggcgactggacgatgccagccatttaaatgcagtggtacagcttcccacacacaaccctgaacagtaccaaccggagttacagccacagcatctggcctatatcatctatacctccggctccacggggctgcccaaaggcgtgatgattgagcaccgcaacgtggtgaattttgtccattcccaatgccagatcaatgaactcaaatccactgaccgcgttctacagtttgcctcggtttcctttgatacagccgtctctgaagtgttcccgacgttgtcaatcggcgcggccttaatcctgcgtccggcgcatattcgcatacccgatgccgcctttggtcatttcttacaggaacaacggatcagcatcgcagaactgcccaccgccttctggcaccagtgggtacaggagatgaaagccggccgcagtagtttcagctcccatctgcgttcagtcacggtcggcggtgaaaaagccgaacaccggcatttcgtcagctggcaatcaatgccggaaacccggaattgccgctggctcgacacctacgggccaacggaaactaccgtcattgccactgcgctgacactgaacaaccatgccgcccgttctttctgtgcggcggaaaccttgtcgattggccgcccgattgccaatacccggatctatattcttgatacacagggacaacccgtaccgattggagtcaccggagaaatctatattggcggcgcaggtgtcgcccggggttatctgaaccggcctgaactcactgccgaacgttttgtatctgatcctttcagtgaacaacccaatgcgcgtatgtaccggacgggcgatctgggctgctggcgaccggatggcacaattgtctacctcggccgcaatgactttcaggttaagatccgcggattccgtattgagctgggcgaaatcgaagcgcaattggccgactgttccggtgtcagtgatgccgtggtggtggcacgtgaagaaggtgctggtgataaacgtctggtggcgtacatcgtgccgaagtctgatgtcacgttagatgccgccagcctgcgcgaacaactgagcacccgcctgatggaacacatgcttcccagtgcatttgtcatgctggaagccttcccgctgaacccgaatggcaaagtggatcgcaaggcgttgccggcaccggatcgcaccgccatcatcagccgtgaatatcaggcacctcaaggggaaaccgagcagcaactggccgcggtctggcaaaacctgttagagctggagcaaattggacgtcaagacaatttctttgaactgggcgggcactcactgctggttgtcagcctgatcgaacaactgcgccaacgcggtcttaccgtaagtgtcagcgcggttttctcagcaccgacgttggccgctatggccgcacatttaaccgatgacgccgcatctgatacccatacgcaggccattcccccgaacctgatcccggacgattgtcagtccatcacgccggagatgttgccactggtcacgctgacacaagacaatattgaccagcttgttacccgggtcagcggcggtgcggccaacattcaggatatttacccactagggcccttgcaggaaggcattctgttccaccatatgctggaaacaacgggtgacacctatctcgacagccagctaatgacctttgacagccgtcagcggctggatgcgtttctgctggcactgcaacaggtgatcgaccgtcacgatatcctgcgtagcgctgtccactggcatgggcagccggagccggtacaggtagtttaccggcaggctcctctttctgtgatagcgttagccctgtcaccggaggaagacgcagaacagcaattacgccgccatactgactctcgctttatacggatggatgtcacccaagcgccgttaatgtcagccaatattgccaaagatccgcatagtgaaacctggctgctgtccttgctgcaccatcatctggtctgtgatcacctgtcactggaactgatatttaatgaaatccagacattgctgctgggacaaggtgaacatttacagcccgcgttgccctaccgcaattttatcgctcagacccgaagcgttcccgttgaaaaacatcaggcttattttcaacagttgctgagtgatgttgatgagccgaccctgccctttggtttactggatgttcaggcaagtaataatgagatcgcagaagctgtattaacactggatgatgaactggcgcagaggatacgagactgcgcccgtcagcagggagttagcgccgccgttctgttccatatcgcttgggcacaagtgctggctcaatgcagtaatcgggaggatgtggtcttcgggacggtcttgttgggacggctacaggggggtgaggatactacccgggtgctgggtatgtttatcaataccctgcccgttcgtatcaccttacaggatcgcagtgtccaacaaaccgtgcaggaagcttatcagcaactcagccagctactggcacatgagcaggcgccactggcagttgcccagcgttgcagtggtattccggtttccctgcctctgtttaacagcctgctcaatttccgtcacagctcagatgatgacgagcaggatctatcactcgcctgggaaggcatccagaccctcagtggtgaagagcgtagtaattatcctctgtcgctggatgtggacgccttcgatgatggttttgcgctgaccgcacaatgcagccagcaaattgatcctgcccgcattaacgcttatatggatattgccctgaaagggctggtggcggcgctgcaaaatcagcctgaacaaagtatccagtccttgaatatcctgccatcagcagaacgttctcagttactggtggactttaacaataccaccgtggcttatccgcaggacaagctgctggcgcagttattcgagcaacaggtggaacatacccctgatgccattgccctgatctgggagggcgctcaactcagttatgccgaactgaaccagcgcgccaaccaactggctcacgccctgattgcctttggtgttcagccggatgaccgcgtggcgatttgtattgagcgcaatctcgatatggtgattggaatgctcggcatacttaaagccggggcgggttatgttccgcttgaccctgaataccctgccgaacgtctggcctatatcctgtccgacagcgcccccaaattactgctcacccagcagcatttacaggcacgattgccggtagaagatctgaccgtctggcaattggatgaggccagccatttaaataccgtggcaccgcaaccgaccgataaccctgatccacgccagttggggctgcatccccatcatctggcctatatcatctatacctccggctctaccggcctgcccaaaggcgtgatgattgagcaccataacgtggtgaatttcacctatgcccagtgccagaccagtgagctcaaatccactgaccgcgtcctgcaatttgcctcggtttcatttgataccgccgtgtctgaaattttcccgacactggccgttggcgcaaccctgatcctgcgtccggcacatattcgcataccggatgccactttcagccagttcttgcaggaacaggcgatcagcgtcgccgatctgcccaccgctttctggcaccagtgggtacaggagatgaaagccggccgcagtggtttcagttcccacctgcgttcggtcacggtcggcggtgaaaaagccgaacaccgccatttcgtcacctggcaatcgatgccggaaacccggcactgccgctggatcgacacctacggacccactgaaaccacagtcagtgccactgcgctggcactggatgaccctgcttcctatggcatggacaccctgtcgattggtcatcctctgatcaatacctacatttatattcttgatacgcgggggcaacccgttcccattggtgtcaccggagaaatctatattggtggcgcaggggttgcccggggctacctgaaccggcctgaactcaccgcagaacgttttgtgtccgacccattccgtgaacaaccccacgcacggatgtaccggacgggcgatctgggctgctggcggccggatggcacgattgtctacctcggccgcaatgattttcaggtcaaaatccgcggcttccgcattgaactgggcgaaattgaggctcagttggccgcctgtgcaggggtcagtgatgccgtagtcatggcgcatgaagaaggcagcggcgataaacgtctggtggcatacctcgtgccacagtccgatgtcacgctggatacagccgatttacgtgaacaattgagcactcatctggcagaatatatgctgccgagcgcattcgtgatactggacaccttcccgctgaacccgaatggcaaactggatcgcaaggccttgccggcacccgatcacgccgcctccgtcagccgtgaatatcaggcgcctcagggtgaaaccgaacaacaactcgccacggtctggcagactctgctggggctggaacaggtcgggcgtcatgacaacttctttgaactcggcggccattcgctgctggtggtcagcctgattgaacaactgcgtcaacgcaacctgatgctggatgtcagtagcgtcttctcttcgccgacactggcggcgatggcggtgcgtctgaccgcatcagattctgatggatctaccggtgtaagcgtaccaccgaacctcatcaccgacgattgtcaggccattacaccggagatgctgcctctggtggcactgacgcaaaccaacattaaccaaatcgttacccaagtccccgacgggatcagtaatattcaggatatctacccactggggccattgcaggaaggcattctgttccaccacttactggaaacggaaggcgatacttatctggacaacctgttgatgacctttgacagccgcccgcgtctggatgcgtttttactcgcgctgcaacaggtgttccaccgccacgatatcctgcgcagtgcgattctctgggatgacctgccgcagccggtgcaggtggtttatcggcaggcaccgatccccgtcacagagctaaccctgtcgccggaggaagatgccgaacagcaactacgccgctatgttgatccccgctcggtacggatggatattacccaagcgccgttaatgtctgccagctttgccaaagatccgcacagtgaaacctggtttctggcattactgcaccaccatctggtgtgtgatcaccagtcgctggagatgatattcaacgaagtgcaggcaatcatgataggccagagcgacgatttgccaccgtcgctgccctaccgtaactttatcgcccagacccgcgctgtaccgcttgaaaaacatcaggactatttccgccagcttttgggtgatgtggatgaacccaccctgcccttcggcttacaggaagtctatggtgaagatagccatatcctagaagcagaattcgatctggatacttcgtttgcgcagacactacgggaatgcgcccgtcagcagggcgtcagtgcagcggtactgttccacgtcgcctgggcgcaggtactggcacaatgcagcggacgggatgatgtcgtcttcggtacagtgttattggggcggttacaaggggttgccggtgccgatcagacactgggaatgtttatgaatacattacccatacggatcaagctgagtaccttcaatgtacagcaggtcgtccagcagacttatcgcttattgagtgaattactggaacatgagcaggcaccgctggcgatggctcaaaattgcagtggtgtgaccccgcctctgccattgttcagtagcctgttgaattatcgtcacaaccaggatgatacccagcagacaaccctcacggcctgggaaggcatcgggctgttaaatgtcgatgagcgcaccaactatcccctgagtttatctgtcgatgacaccgcacaaggctttacactggtcgcacaatgtgttccggaacttgatcccatgcggattaatcatttcatgaacaccgtattgcagggtttagttgaaagcctgaaaaattcgcctgaacagacttgcctgcaactcaacatactgccgcaggaagaacgcacacagcttctgcgaacgttcaacaacacccgtgaggcttacccacaggatcaactaatccaccagctcatagaacaacaagtcgagcgctccccgacagcaactgcactgatttatgatgacaatcaattgagttacgacgagctgaaccgtcgagccaaccaactggcacactctctgattgcgtttggggtacgtccggatgatcgggtggccatttgtgtagagcgtggtctggagatggtcatcggcttattagcaatcatgaaagcgggggcgggttatattcctctcgatccggaataccccgctgaacgcctgtcttatatgctgtcagacagccagccctccgtattactgactcagcatagcctgcaaacccgtttatctgagaccaatacgccaatattgatactggatagtgatgaatatcaggcaaatatcattcatcaacctgagtgcaacctgccagccgccgatttaggtatcacgtcacacaatctggcctatgtgctgtatacctccggttcgacgggacgccccaaaggggtcatggttgagcatattggggtggtaaacctgctgttatcaatgaaagaccggctgcaaatctctgtcgatgacaccctgctcaccgcgaccacaattggctttgacgttgccgcacttgagctgtatctacccttatgcaacggcagtacctgcgtcatagcaccatcattgaccgccagagatccagagcaattagcggaattgatcgccgcacgcaacatcaaagtcatgcaggcgactcctacgacctggcgtatgctacttgattccggctggacaggtgccgcgatcaaagcgacaagcggaggagaagcattacctcacgaactggcacagcgtttaaaagaaaaagtcagcggattgtggaacctgtatgggccgacagaaaccactatctgttcaacagcatccggcaatctacagacggagccagagagccgctataccacgcctcagatcacaattggccacccggttgccaatacacagatctacattcttgataaacacggtcatcctgtcccggtgggtgtcgccggtgaaatttatatcggcggcattggtgtcactcgcggctattttaatcgtccggatctcacggcagagcgttttgtcgatgatccattcagtgacgaagcgaatacatcggctgatagacgcatgtataaaacgggagatttgggacggtggcttcccgacggcaacattgactatctcgggcgcaatgattttcaggtcaagatccgcggattccgtattgagttaggggaaattgaagccagattactcgcctgtgccgatatcagagaagccgttgttatggttcgtgaagataccgctaatgataagcgtctggtcgcctatctggtattacaaccggaaacgtccctgaatctagagaaactccgtgaaacgttacaggccagtttagccagctatatggttccgaatgctttcgtgacactagattcattcccgcagacaccaaacggtaaactggatcgccaagcgttgccattaccggacgactcagcggttattgctcaaatcggttatgaaccgcctgtcggagaaacagaaaatatcattgctgacgtctggcaagacagcctcggcctcgaacgtgtcggcaggcatgatcatttcttcgaattgggtggtcactccttattgacattgcaggttgtcgtacgcttacgtcaggcgctcggccttgatatcgccatacgcgacctgcttattcacccgacaatcagcgaattagccgcttatcttcaagcgaaaaattcattgagtgcccctctggctcaacagaaaaatatcgtcacaatccgtaaaggaaacggaaattcctcattgttcctcatacatccggcgggaggtgacgttcagtatgcttatgatcttgccccttatattgatgataaggctcagtcaatttatgggattatcgccagtgataccttcggggaagaaaatgcccagttaaccatcagcaaaatcgccgaagagtacgttacctgtctccgtcagatgcagatacaggggccttatgatctggccggatggtcaattggaggaaccattgcgtatgaaatggcatgccaactgacagccgcgggtgaagccgtcaattttgtcggtctgtttgattcaggtgccagctatcaggacgcattttctctggaagaaaaacaggccggtctgccatttaatgaaacagccacattgcttgaggtactgccagaaaatatgccggcctctctgcatgatcagatacagagattagcgaacaaccatgactgctctgcaatattaatgcttgctcaacagaacgatttattacctgcttctgagaatatcaggcaacaattacacctttatcacaacatttctgtcgctgcttatcactatattccctctacagcggcggttaacgtcaccctgttcagagcaacggaagaaaatgatcagagtagtcatgcccttggctgggaagccgttataccgaaggaacggctgactgtcattccgatcaacggttctcatgaatccatcatggagcagccccatatccaagatgtcggaaaagtattactttcagccatgacgaccccaagaggacattaa

SEQ ID NO: 2781 - DNA, 9966 bp, Xenorhabdus bovienii
  Coding sequence Name=Xb4151_4152.C435.gene170.dna; Position on contig= 128416..138381bp; Strand=-
atgaatgataatgaattaatatctttaccattagcagaacgcaaaagactacttgagttagctaaagcagcaaagctaactcgtcagcagacacaaaaaacagaaattcatgcacaaccccgtgatgggaacgtgccattgtcctgggcgcaacagcgtctctggtttttaactcaattagatcccgcagcacaaacggcataccacatgtcggcagggttgaacctgcaaggccacctgaatcagaacgcgcttcaagccgcgttggatcagattgtggcacgtcatgaaattctgcgtaccaccatcgtggacgtcgaagggcagccccaacaaatcattggcagtactgatcgtggttttgcgttatctgtacaagatttcagccagttacccagcacagaacagcagacggcggtagaagaatgcgcccagcgtgaagccctccatcccttcgattttactcaggggcctttgattagggggcgcctgctccgtctggcagaagagagccatgttctgctgttaacgcagcatcacatcatctccgatggctggtcggtcaatatcttaatgcaggaactttccacgctttatcaggctttctgtcaggatcgggctgatccattacccgccttgacactccagtatgctgactatgcgctctggcagcgacaatggttacaggataacgtgttggaaaaacagttggactactggcgcagtgaattgcagggtgcaccggtgatcctggaattacccaccgacaaaccgcgtccgacacagcagagttatgccggaagccgggtcgatatcacactgccgcctgcattgagtaccgagttaaaggcattcagtcagcgtcatggcatcaccttatttatgaccctattggccggatgggcggtattactttcccgtatcagcggacaacacgatctggtaataggctcacccgttgcgaatcgtcaacggcatgagctggagccgctgataggtttctttgtcaatacgttagcgttacggatccaactgggtgacaaccccagtgtcagcgagctgttggcacgggtgaaaaatcatgctctgggggcttatgcacatcaggatctgccattcgagcaattagttgaggcgttaaaaccgccgcgtagcttgggccatagtcctatttttcaagtgatgctggctctggataatacgctgggacagcaacatttcgagttggatgggctacatctccatgaactgccgcgaacccgagacagtgcctattttgatctgaccttaacactgaatgatactgagcaaggtttagtcggtgatctggaatatgcccgcgatctttttgaacatgccagcattgagcgtatggtcggctacctgcaaaccatcctgtcagctatggtggccgatgacagcctgcggatagacgatcttcctttgctgacctctccacaacgtactcagttattggcgaactttaacgataccgccattccatatccaaaaaatgctctgatccatcagttgttcgaacaacaggtggataacactcctgataaaattgccctggtctggggagaaactcaactgagttactccgagctgaatcagcgagccaatcaactggcgcacggcataatggcatcaggagtccatccggatgatcgcgtcgcaatttgtgctgagcgcagtctggatatggtcatcggcctcatggggattttgaaagcgggtgccagttacattccgctggatcccaatcacccgactgaacggctggcttatatgctgtctgacagtcagccagtgttaatgcttactcagcaacatctgaaagcccgcctgcctgtcacaaacatccccgtatgggcactggatagtgaagaacatcaaacctatattgccgatcagccaaaagataatatcgacgcatcgcagacagggctgaccccacagaatctggcttatgtgttatacacctccggttcgaccggcctgcctaaaggcgtcatgatcgaacaccagaatgtagtgcacttaattcattcccagttccagatgtcaaaactaacaccgcaggatcgggtactacagtttgcctctttcgggtttgataactctgttgctgaaattttcccgacattggctatcggggcaacggttgtcttacggccagatcatattaaagtcccggatacagaatttattacctttctgcaaaatcagagcatcacggttgtcgatttgcctaccgctttctggcacctatgggcacaagaaatcagcgccggttatagctggcctcctgagcaattacgttccgtcgcggccggaggcgaaaaagccgagcaccgccatctggtcacgtggctatccagtccgggcacacaaaaatgccgctggatcaatacctatggcccgacagaaaccaccgtcaatgcaacctcaatcgttatcgataaagacgatctctgcacctatgaagatatcccgattggccggcctatcgccaatacccggatctatattctggatcaacggggtcaacccgtcccgattggcgtaaatggcgaaattcatatcagtggcagcggagttgcacgcgggtatctgaaccggcctgaactgacagcagaacgttttattcaagatcctttcagtgacattcccggtgcccgcatgtacaaaaccggcgatttagggcgctggctaccggatggcaccatcagttattcggggcgcaatgattttcaggtcaaaattcgcggtttccgcattgagttaggtgagatagaagcccgtctagctgactgcactggcgtcaaagatgccgttgttgtcgtcagagaagatgacagcggcgataaacgtctggttgcttacttaatccctcagcctggtgcaaccctgaacgcggccagcctgcgtgaacaactcagtgtcaatctggccagttatatgttgccaagtgcctttgtcacactggatactttcccgttaaatcagaacggtaagatagaccgcccggctctgcccgctccggatcgttcagccagcgtcagtcgcgaatatgctgaaccccaaggtgagatcgagcagcaactggccgaaatttggcaaaatttattgggattggaacgggtcggccgctatgacaatttctttgaactggggggacattctttattaactgttcaggtcgcatctcgcttgcgccagtctctgaatattgaaataacgctacaggatctgtttactcaatcggtattagcggatttagcgcaatcattggtgacagcaacccagtcaacacaaccgatgatcctgcccgccaaccgtgaacaaacattacccctatcctggacacagcaacgtctctggtttttggctcaattagatcccgccgcccagacggcatacaacatgtcgggcggattgcacctgcaaggccacctgaaccagaacgcgcttaaagccgcattagatcgcatcgttgcccgtcatgaaattctccgcaccaccatcgtgcagaccgaagggaaagcccgacaaatcattggtgatgccgatggcggtttttctttaaccgtccgggatctcagtcagttatcttcatcagcgcagcaggcaaccattgaggaatacgctcaatttgaagccagccatcctttcaattttgcgcaagggccgctgatccgcgctcaactgctcaaactcggcgagcagcaacatgttctgctattaacccagcatcacattatttccgatggctggtcacttaatgtcctgatgaacgaactttctgcgctgtaccaagccttcggtcagggacaagctgatccattgcctgcattagtaattcaatatgccgactatgcggtttggcagcggcaatggctgcaaggcgaaagactggaaaaacagttgagttactggcgcaatgagttacaagatgctcccaccttactagagctgcctactgataaagtccgcccgtcagtacagagttatcatggcgatcaggtcactttcactttatcgccggaattaaatgcaggattaagggcattgagccaacgccacggtgcgacgttgttcatgacattactggccggctggggaattttgctgtcacggttaagtggccagcccgatttggtgattggtactccggtcgccaaccgtcagtacagcgagttggagcctttaatcggcttcttcgccaatacactggccttgaggatcaagttagaagataacccgaccatcagcgcattattggcaagagtgaaggctcatgcgctggaagcctacgcccatcaggatctgccatttgaacaattagtcgaagtgctgcaaccgccacgcagtttaagtcatagtccgattttccaagtgatgctggctttggataatacatccagtaaacaaagtttcgaactggcggaattgagtctcagtccgctggctctgaccagaaacagcgcccattttgatctgactctggcactgagtgacaccgaaaatagtctgacatgtgagttggaatatgccagcgatctttttgagcgttccagtatcgaacggatggcgggttatctgcaaaacctgctggcggcgatggtcgctgatgacaatctgcgggtggcagatctgccactactgatgtcgtacgaacgaactcaattactgaccgactttaacgatactgccgtcacttatccgcaggacaagctgctggcgcagttattcgagcaacaggtggagcacacccataatgccattgccctgatctgggaaggcgctcaactcagttatgccgaactgaaccagcgcgccaaccaactggctcacgccctgattgcctttggtgttcagccggatgaccgcgtggcgatttgtattgagcgcaatctcgatatggtgattggaatgctcggcatacttaaagccggggccggttatgttccgcttgaccctgaataccctgccgaacgtctggcctatatcctgtcagacagcgcgcccaaattactgctcacccagcagcatttgcaggcacgattgccggtagaagatctgaccgtctggcaattggatgaggccagccatttaaataccgtggcactgcaaccgaccgataaccctgatccacgccagttggggctgcatccccatcatctggcctatatcatctatacctccggctctaccggcctgcccaaaggcgtgatgattgagcaccataacgtggtgaatttcacctatgcccagtgccagaccagtgagctcaaatccactgaccgtgtcctgcaatttgcctcggtttcatttgataccgccgtgtctgaaattttcccgacgctggccgttggcgcaaccctgatcctgcgtccggcacatattcgcataccggatgccactttcagccagttcttgcaggaacaggcgatcagcgtcgccgatctgcccaccgctttctggcaccagtgggtacaggagatgaaagccggccgcagtggtttcagttcccacctgcgttcggtcacggtcggcggtgaaaaagccgaacaccgccatttcgtcacctggcaatcgatgccggaaacccggcactgccgctggatcgacacctacggacccactgaaaccacggtcagtgccactgcgctggcactggatgaccctgcttcctatggcatggacaccctgtcgattggtcatcctctgatcaatacctacatttatattcttgatacgcggggacaacccgttcccattggtgtcaccggagaaatctatattggtggcgcaggggttgcccggggctacctgaaccggcctgaactcaccgcagaacgttttgtgtccgacccattccgtgaacaaccccacgcacggatgtaccggacgggcgatctgggctgctggcggccggatggcacgattgtctacctcggccgcaatgattttcaggtcaaaatccgtggcttccgcattgaactgggcgaaattgaggctcagttggccgcctgtgcaggggtcagtgatgccgtagtagtggcgcatgaagaaggcagcggcgataaacgtctggtggcatacctcgtgccacagtccgatgtcacgctggatacagccgatttacgtgaacaattgagcactcacctggcagaatatatgctgccgagcgcattcgtgatactggacaccttcccgctgaacccgaatggcaaactggatcgcaaggccttgccggcacccgatcacgccgcctccgtcagccgtgaatatcaggcgcctcagggtgaaaccgaacaacaactcgccacggtctggcagactctgctggggctggaacaggtcgggcgtcatgacaacttctttgaactcggcggccattcgctgctggtggtcagcctgattgaacaactgcgtcaacgcaacctgatgctggatgtcagtagcgtcttctcttcgccgacactggcggcgatggcggcgcgtctgatagtgaaaacgtctgatggatctgctggcacccacgtacaaaacgtaccgccgaatctcatcaccgacggttgtcaggccattacaccggagatgctgccactggtggcactgacacaggataacatcgaccagatcatcgccaaaatcccagatggcgtcgccaatattcaggatatctatccgttggggccattgcaggaaggcattctgttccaccatttactggaaacaaccggtgacacctatctcgacaaccagttgatgacctttgacagccgcccgcgtctggatacgtttttgctggcgctacaacaggttatcaaccgtcacgatattctgcgcagtgcggttcactggaacggtctgccggagccggtacaagtggtttatcgtcaagcccctctttccattgccgagttaacgctgtccccggaactcgacgccgaacagcagttgcgcgatgctaccgattcccgctcggtacggatggatctgactcaagccccgttattgtctatcaaactcgccaaagatccgcacagtgaaacctggtttctggctttactgcaccaccatctggtatgtgatcacctgtcgctggagatgatattcaacgaagtgcaggcaatactattggggcaggatgactcgttgtcgccatcgttgccttaccgcaactttatcgcccagacccgcaccgtgccgcttgaaaaacatcaggactacttccgccagctcttgggggatgtcgatgaacccaccctaccctttggcttactcgatatacagggcaaccctgatgaacacagtgaaataacagaagccaatttcattttagataacgaactggctcgcagaatacgtgactgtgcccgtcagcagggcgtcagtgccgcagtattgttccacgtcgcctgggcgcaggtagtggcgcaatgcagcggacgggatgatgtcgtcttcggtacggtgttactgggacggttacagggaggctcaggtgccgatcaggttcttggcatgtttatcaataccctgcctgtgcgcgttttattgcaggagcgcacggttcgacaaaccgttcaggacacttaccggcagttaagtacattgttggaacacgaacagaccccgctggctatcgcccagcgttgcagccgtgttcaagcgcctcaacctctctttaacagcctgcttaatttccgccatagccaacgtgacgataaacagtccgcatcaccggcttgggaaggtattcagatcctcagcggtgaagaacgcagtaattatcctctgtcgctggatgtggacgacttcgatgatggctttgccctgaccgcccagtgcaaccgacacgttaatccgctacgcattaacacttatatggataccgtgctgagagagctggtggccgcactgcaaaacgtctctgaacagagcattcaatctctcgccatcctgccgccagatgaacgcacccggttactggtggactttaacaatacggcagcctcctatccgcaaaatgttctgctccaccagccattcgaacagcaggcggaacgcacaccggatgccattgccttaatctgggaagatgttcaactcagctatgctgaattgaatcagcgcgccaaccaactggcacatcacctgattgcgtctggcgtgcagcccgatgatcgggtggctatctgcatcgaacgcaatcttgacatggtgattagtatgctgggcatattaaaagccggtgcgggttacgttccgctcgatccggcctaccctgccgagcggctggcttatatcctgtcagacagtgcgccgaaattactgctcacccagcagcatttacaggtgcgattagccgtagaggatctccccgtctggcgactggacgatgccgaccatttaagtaccgtggcacagcaaccgactgataaccctgactcacgccaactgggtctgtacccgcagcatctggcctatatcatctatacctccggctctacggggctgcccaaaggcgtgatgattgaacaccgcaacgtggtgaatttcacctatgcccagtgtcaggtcagtgaactcaaatccactgaccgagtcctgcaatttgcctcggtttcgtttgatactgccgtgtctgagattttccccacattagccgtcggtgcgaccttgatcctgcgccccgcgcatattcaagtacccgatgccagtttcagccatttcttgcaggagcaggcgatcactatcgtcgatctgcctaccgccttctggcatcagtgggtacaggagatgaaagccggccgcagtggtttcagttccctcctccgttcggtcacggtcggcggtgaaaaagccgaacaccgtcattacctcacctggcaatcgatgccggaaacccggcactgtcgttggatcgactcctacgggccaaccgaaaccactgttatcaccacagcactggcactggacaaccacaccggagacaagcctaccgccggttcttcctgtatgacggaaactttgtcaattggccgcccgatagccaatacccggatctatattctcgacgcacgggggcagcctgtacccatcggggtcaccggagaaatctacatcggcggcgcgggggttgcccggggttacctgaaccggcctgaactcaccactgaacgttttgtatccgaccccttcagtgagcaaccccatgcacggatgtaccggacaggcgatctgggctgctggcaaccggatggcacgattgtctatctcggccgcaatgattttcaggtcaagctccgtggcttccgcattgaactgggtgaaatcgaatcccaactggctgcctgtccgggtgtcaaggatgccgtggtggtggcgcgtgaagaggatgccggtgataagcgtctggtggcttatgtgatcccgcaacctgatgcgtctttggacgcagtcagcctgcgtgaacaactgagcaatcatctgacagaatatatgctgccgagtgcgtttgtgatactggataccttcccgctgacaccaagtggaaaactggatcgtaaagcgctgccggcacccgatcgttccgccagcgccagccatgaatatgaagcccctcaaggcgaaattgaacttcaactggccgctatctggcagaccctgctgggactggagcaggttgggcgccatgataacttctttgagttaggcggaaattcattatccatcatgcggttatccactcacctgcgtgaagaattccaccttgaaattcctattgcagacatttttcatcactcaacactgtataaacttgctgaacttattctatcaagacaaattgaaacttttttcgcccaagatatcgagtcggtacaaaaagagttggagaacctgtctgaagaagagttgcttgccatgttaaatggagatcaacaatga

SEQ ID NO: 2782 - DNA, 3417 bp, Xenorhabdus bovienii
  Coding sequence Name=Xb4151_4152.C435.gene171.dna; Position on contig= 138419..141835bp; Strand=-
atgatttttcttgctgaaaaacagatcattctgactttatttatcccggattttttagttatagatttggattctagttttattttttgttttatcagttctcagacttttttattttcatatgcccataaaaaagggagctataaaatgaaccaccctgaaaagttgaagccatttgctttatcagaagcacaaagcagccgttggtttcaatatcaaattaacccaagccaacgtgggcgaaataatggtgcattttgtgccagagttaaggggttaaacgttcaagatttagaaaatgcactcaatcacctgatcaagcgtcacccgatgctgcgagccagtttcgggctatacgatggcgaattgggatatcgcatagcagagaatagcgaaatcaaaattcagacacatgatgccctgcacctcagcgaagatacgcttcagcaacttgtacttgacgattgccggcatgttctcgatctggaaaatccgctgcgcttttatgccagttggtatcaatgtaatgcgcaagaaagtgtcatggtattgacgttcgatcatttagttgtcgatggttggtcttactggttgttgctggaagaactcggcatgattctgacctcacaagaattggaaccgatatcagaacacagttatcaagattatgtttcatggcagcagaaatggttaaacagcaaaaacgcaaaaaaacaacaacagttctggggcaataatctggctggggatttgagtacattatcatggccgatgaaaatcggatcggtacagaacagagcagataacaacgtcgcccccccagccacggataaaatcacggcgttcggcagaatccctgatgatttagcgcttaagctgtgtgctatggcatctgaatacggcaacagtctgttcgctatttttctgactgcctatcaaatcctgctacatcgctataccgcgcaggacgatatcgttattggctcaatgatgccgggtcgaagtcaagccaaatggggtaagttggtaggggaatttgtcaatccggtcgctttacgcggtcaaatcaacggtaatatcactgtaagggaacatattcttcaaaccgcaaagaccatccgtcaggcgattgaaaaccagagataccctttcaccaagattctggaacaatttaagttacagcgcactgccgatacacatccgattttccagactctgatgacctttcaaaaacccagatatattagtgagctgccaacgttatggatggataacgattccagcacgacagtacattgggggaacgcggaattaagacctttcccgcaccctctttatgccgatacccccgtccccctgatggtgaatatgatggaggtcaatcaacagatccgttgtcatttccattacgatcctcaggtgttcgacgctgagttaattaatcaactcataaaaaatctcattatcctgctcacggcaatggcggataaccaacaacagtctatcgacagcttaccgctgatggctgaacaagaacgccggcaggttctctatgattttaacaagacggataagccttttcctcaacacgctctgattcatcaactatttgaacagcaagtcgaacgcacacctgacaccatcgccctgatttgcggtgataaggcgttaagctataccgaacttaaccaacaagccaatcgattggctcatgccttaattaaagccggcattcgtccggataatcgtgtctctatctgcatggagcgcagtctggatatggtcatcggcctgctgggaatattaaaagctggcgctgcttacgttccgctcgaccctgaatatccgacagatcggctcggctatattctgtcagacagtgaccctgcacttctgctgattcatcacggcctgcaagatcatttaccgatgacaactatgcctgtatgggtattggagagcgaagaatatcaaaccaatattgccagtcagccgacggataacccggttgccaccgatttgggtctgacatcgcgcaatttagcctatgtgctttatacctccggctcaaccggcttaccgaaaggggtcatgaatgagcaccgtggggtcgtcaaccgtttgttgtgggcgcagggtgaatatcaattaactcagcatgatcgggtattgcaaaaaacgccgttcagttttgatgtctcagtctgggaatttttcctgcctctgctcgccggtgctcaattagtcatggcacgtcccggtggtcataaggaagcgctctatctgctggacgaaatcgaaacgcgggacattactacccttcattttgtaccttccatgctgcaaagttttattcatctgacaccagccggccgttgcccttctttgcgtcagattttgtgcagtggagaagcgttgtcgtattccttacaacaacagtgcctgactcattttgctcacagcgaacttcacaacctgtatggtccgacggaagccgctattgatgtcacctcgtggcgatgtgtacccgatcagcatatcggtctggttcccattggtcgccctatcgacaatacccaaatttatatccttgataaacattaccagcctgttcccattggcgtagtcggggaaatttatatcgctggtgcaggtgttgcccggggttatctgaataaaccggaattgaccacggaacgctttattcaagatcccttcggtcagcatcctgatatgcggatgtacaaaaccggcgatatcgggcgttggctagccgatggcagcattgattatctgggacgcaatgactttcaggtcaagatacgcggaaatcgcattgaactgggggaaattgaagcacgtctggctcagtctgacggtgttcaggatgtgattgttatcgcccgtgaatatgatgccggagatacacggctggtcgcttatctcatcccccagtccggcgtcaccctgagtattcctgctctacgggaacaagtgggcagtaatttgcctgattacatgatcccgagtgcatttgtgatgctggatgccttcccgctcactctgaatggcaaattggatcgtaaagcgctgcctgctcccgatcactcggccgtcctcacacgggaatatgcggcaccacaaggtgaaaccgaagaacaactggccgatatctggcaaaaactactgaaaatcgatcgcgtcgggcgtaatgacaatttcttcgagctgggggggcattcgctgctaatactacagctacagtcaagaataagtgaaatatttgatgtcgaactctctattcaacaattatttgcacaccccactatttgtcaacttgaagagcacattattgatgctcagttactgcaatttgacgctgaatccttgcaagatctctacaaaacaatgggttaa

SEQ ID NO: 2783 - DNA, 1656 bp, Xenorhabdus bovienii
  Coding sequence Name=Xb4151_4152.C435.gene172.dna; Position on contig= 142175..143830bp; Strand=-
atgactctaatagcttatctataccgccaatcttggatattactgcttttatcaacaataagcgcattaattagtggatttgccggtgcatctgtagtaagtacaattagcagaggaattacagaaacagttcaacttaattcctttctctggagcttttttggtatatgtattctttttttcattactaaaacactatccgaggttatcctctcacatttaacccaagcaacaatttattcattacgtctcagtctgagtactaaaatattacgtgcaccttacaaaaaacttaataaacttgggagacacggcctattagctgttttaactaaagatgtcgatgtatttatacaatcttttatgttagccccaactgcttttggaaatatcacccttattttcgcctgttttggttatttagcgtgggtttcctggcaactttttgtcattctgatccttttatgtctagtgataatgtatattttttatcttctggaaaaacgtcctatacggttaatgactgaaatgcgtgatcaggtggacaggttgtatctcaatttccaaagcctgattgatggcagcaaagaactgcaactcaatacacagaaaggcgatgcgtttatcgataaagtcatttctcccggtgccaaaaaatttaaagaaatctgtattaaagcaaccacgggttatgcctgggtgctgaatgcaagttcaatcgctttttatatgattatcggcatcatggtctttgtcgtgccgatctggttacctcaagaccccgccagtctggtgacggtgacattaactgtgctctttctggctggccctatcagtgaagttgtcggtgccatcccagaactgagagaagctgaaatctcgttgaataaaatgcgtcagcttgataatgacttagacgaagggcaggaaaatcaatcagtgcagggtgacacgccaaacccatttttgagtgaaaaacccctggtacttgagttgaaggatatcgtccatcactatacgactgataaggaagaccgtcagtttatgctcggccctttaagcctgaaaatatctcagggcgaaattgtctttattgtcggaggtaatggtagcggtaagaccacgttagccatgatgctggtcggtttattcgaacaggaatccggttctatctggcttaacggtgtaaagatggatacatccaacaatgtccactatcgccaattcttttccgctgtattttccaattatcatctattcgatcagctattaaataccggcacagacgtcacagagaaagcgactcattacattcaggcattaaacatgggtcacaaagtgaagattattgatggtaaattctctacgacagagctttcagccggtcaaagaaaacggctggctttggtcgctgcttatctggaagaccgccctctttatctttttgatgaatgggctgctgaccaagatccggtatttaaacggttgttctatacagagcttctgccggagttaagatctcgtgggaaaacggttattgtgattagccatgacgatgcttatttcgatattgctgaacgtgttattaagctggaagatggtaatattaaagaaataaataatcataaccatgaaactattacagagataaaataa

SEQ ID NO: 2784 - DNA, 585 bp, Xenorhabdus bovienii
  Coding sequence Name=Xb4151_4152.C435.gene173.dna; Position on contig= 144014..144598bp; Strand=-
atgattatgacccacattttggttgttaattcagcaaaagagtttggtgaatcaaaaggagaactaaataacacgttaacagagatcatcaaggatcatctgacgggaatggggcacgagatccaaataactcatgttgataagggttatgatattcaggcagaagtcgataaatttatttgggcagacagcattatttaccagatgccgggctggtggatggaagccccgtggattttgaaaaaatatgtcgatgaagtttttagtgccggtgacggtacgttatttcaagatgacgggcggactcgcagcgatcttaccaaaaaatatggttcaggaggtttatctcagggtaaaaattacatgttttcggttacctggaatgcaccgctggaatcttttgaagatcctgaacagttctttgaaggaaaaggcatcgacaacgtttattacccttttcacaaagcaaatcagtttttaggcatgtcaccattaccgacgtttgcttgctatgacgtggtgaaacagccacagattgcacaggatattgagcggttaaaaatacacttatctgattgttattga

SEQ ID NO: 2785 - DNA, 114 bp, Xenorhabdus bovienii
  Coding sequence Name=Xb4151_4152.C435.gene174.dna; Position on contig= 144647..144760bp; Strand=-
atgatgattaacccatcgccatcaaatgaccttgataaaacgataaatgcgaaaacaatatctctttggaggatcaggcaacgattggaaataactgggcacccttccggctaa

SEQ ID NO: 2786 - DNA, 924 bp, Xenorhabdus bovienii
  Coding sequence Name=Xb4151_4152.C435.gene175.dna; Position on contig= 144757..145680bp; Strand=-
atgaaagcattacatcacccatccggtgcaacagaaattgaaattcagttacaacaattaatcgggaaaatagccagcttgacgcgacccaatacatatgcagtcaaaactgcgatcccagaaatgacattgtgtcatttagaacagccaacaacaccagtaggctggttgtacgaacccagcattatgatcattgttcaagggaaaaaacggataactatcggcgggtgctcttattgttgtgatgccagccaatttatggtgacttccaccgatattcccaccattactcaagtttgcaccgcttcgaaagaagaacccttttttgccatgatgttacagtttaatattcaggaagcctcagaattactgatagaaaatcatgttgcaatccggcaggattcgccagatacatgcgggttagctgtcactcccgttacagctgaactgctggtttgtttcaatcggctgctggatttattaagtactccagaggatattcccgtactttctccattgattcaaaaagagattgtctaccgtctgctaaaaagtgaattgggtggacgactgcaacagatggcctcacaggaaagccccagccatcaaatcagcaagaccattaactggctgaaagatcactttgctgactccgtcaaagtcgaacaactcgcacaaattgcccgaatgagtccttcatcctttcatcaccactttaaggcggtgacttcaatgagcccactccagtatcagaaatggttgcgtttaaatgaagcgagacgaatattattgacacaacaccataacgtatcagccaccgcatttcaggtgggttatgaaagcccttcccagttcaaccgtgaatacagccgtctatttggtgagccaccctgtcgggatatcaaacggctgcgagtaagatga

SEQ ID NO: 2787 - DNA, 117 bp, Xenorhabdus bovienii
  Coding sequence Name=Xb4151_4152.C435.gene176.dna; Position on contig= 145659..145775bp; Strand=+
atgggtgatgtaatgctttcattttctactccctcattcattgccataaacacacaaaatttttactcattattgttacttagcatatcgttagaattggaaagtttatatcagtga

SEQ ID NO: 2788 - DNA, 102 bp, Xenorhabdus bovienii
  Coding sequence Name=Xb4151_4152.C435.gene177.dna; Position on contig= 145738..145839bp; Strand=-
atgattaaatcccttaaccaccttatcctccactatccttgcctaatcctccaatttattattttcactgatataaactttccaattctaacgatatgctaa

SEQ ID NO: 2789 - DNA, 99 bp, Xenorhabdus bovienii
  Coding sequence Name=Xb4151_4152.C435.gene178.dna; Position on contig= 146154..146252bp; Strand=+
atgtatttttataaatctattggcgcatctatttttttagtattgtatctatgttttttaaaagataaaaaggaatatgttcatgatcaaattaaataa

SEQ ID NO: 2790 - DNA, 96 bp, Xenorhabdus bovienii
  Coding sequence Name=Xb4151_4152.C435.gene179.dna; Position on contig= 146337..146432bp; Strand=+
atgctacagcaagtggtgcttctagaagtgacagtgggggctagtatgggcgcgacaaaatatattgttagtagtgttattaaggggggcgcgtga

SEQ ID NO: 2791 - DNA, 117 bp, Xenorhabdus bovienii
  Coding sequence Name=Xb4151_4152.C435.gene180.dna; Position on contig= 146565..146681bp; Strand=-
ttgctttactcacagaaacacctacagagttgtgcgctaccaatagacacaaagatcgcgtattatctgcttattgataacattattagatatatataccgatatttttcaaaatag

SEQ ID NO: 2792 - DNA, 1107 bp, Xenorhabdus bovienii
  Coding sequence Name=Xb4151_4152.C435.gene181.dna; Position on contig= 146709..147815bp; Strand=+
atgtttattttttatacaaggaaaatcatgattagcgacaacacaataaaaaaacctctttcagggaatgtttcacagcgtagatctttaactaatacgatgaagtcaaaacaaagttggaagaaccctgaaagccatttcgagagtgcgatctttgatccatggtataaatcaataactaaaatacattctcttatttcagccaaaacaggaggattttttagctctagagagttgtctccagtactgctacctgttaccactggatctatttcgagtcctatgggacttggatcagattcgatacctgtgaaaattaatctagggggagtggatacttatttggcggattccatgcagtttttgcttgaatacgttctgagattgaatgacaaaggtgtgtattatctcatgcctaccttcagaggcgaagaacaggacaagcgccatttgaatcaattctatcatgcagaaagtgaaatcatcggcagtttggatgatgtcattgaactagccagttcgtacgtgacatacctatgcgattacttcttagaaaacgaaagagcacttttatcgcaatttactgatgaactagaacacctaagaaagctttctatgcttaagggcaacataccacgagtaaggttcacggatgcggtggagttattaaacaatgactcacggtattttagtgagcatgaatctgaatttaaacaaataacaaatgaaggcgaacaaaagttaattgaattattcgatggcgcagtttggttgacccatttccctagcttatcagttcctttttatcaggcagatgcatctgagcaaggctattcacttacagcggatttgttgatggggattggtgaaacgttaggtgcaggagaaaggaatacttatgccgagaatgtagtggagaacttgaatgttcgaaaagtatcccgtgaagagtatgagtggtatatccgaatgagagaattaatgcccctaagaacatcagggtttgggatgggagttgaaagattcattctatggctaattaatcatgatgacattcgagattgtcagttacttccccgcattcacggagaaaatatcctaccataa

SEQ ID NO: 2793 - DNA, 117 bp, Xenorhabdus bovienii
  Coding sequence Name=Xb4151_4152.C435.gene182.dna; Position on contig= 147888..148004bp; Strand=-
atgctattcattcctcctggcggtctattcgtttctctcacaataccgatcatgggaaaatacttaatggttggaattgactctaaagttaagtgtttcatttttcaccttagttag

SEQ ID NO: 2794 - DNA, 780 bp, Xenorhabdus bovienii
  Coding sequence Name=Xb4151_4152.C435.gene183.dna; Position on contig= 147952..148731bp; Strand=+
atgatcggtattgtgagagaaacgaatagaccgccaggaggaatgaatagcattagaagaattgctcagaatgcttttttgaatagcaaaacagaagtgttagaagtgggcacggcgacaggtgtaacagcaatcgaattggctaagcttacctattgtaagattactgcaattgatattgatgagaacaatttgtcagtcgcttgtaatcgggcgatcaaggaaaatgtttctaaactaatttctttcgaaaaaagagatgccactgatacaaagttcgaagataagacttttgatatggttttctgtggcaatgtaacctcttactttgatgacaaagtgaaagctattaaggaatatgaccgggtattaaaagacaatggattgattgccgcgatcccaatgtactatatcaaaaaaccgaaagactcacttgtggatgaggtttcagaagctatcgatgtcaaaattagccctctatacaaaaaagactggattgagttcttcaaccttccagggtacgagcttgtttcttgtgaaaattttgttttcgatgatatttcaaacgccaaagttgaagaatatgtcaatatcattttcaaacaacaacatctagaagaacttgatcctgaaattcggactgcattatacaagagatatagctactttatgcatctgttcagaacgaatttatcacatatgggtttttctttaatgcttcttagaaaggtaacatttcccactgagcctgagttgtttaccgctagcccaatagactaa

SEQ ID NO: 2795 - DNA, 975 bp, Xenorhabdus bovienii
  Coding sequence Name=Xb4151_4152.C435.gene184.dna; Position on contig= 148804..149778bp; Strand=+
atggctaaaataaccattgttgcgccagccaatactatgtgcaatttagacacaaaaatgatagatgttggccttaaaaatctatcaaatcttgggtacgtagtttcaatcaacgacgaatctttctttgacaccgaaaatattgccggaactactgctcaacgtgcgtctagtataaatcgggcaatactaagtgaaaatacagatattattatggcagtttttggcggctacaattgtaatgatttactcgaacacattgatttcatagagctccatcgtactaataaagtattaattgggtatagtgatatcactgccttacttaacgcctactatgcggttactggtggagttagctttcatggtcctggatttggaaccttttgcaacccaagcttaccagccgaaacggttaatggttttaccaaagcgctaaggctgacaaatatagaagagagacttattcaaccccaaatgacagctagtgacttatggttcttgaaaagtggtttcggccctagggaatggaaatctcaccctgaatggcggactattaatgaaggggaaattaaaggcatactaatcggcgggaatattgagtctttggtaaaccttatcggaactaaatactgtccggacttcgacaataaaatcctattacttgagtcaggttttaataccgatccgagccaattcagaatgtgggtatcccaccttaaagcatgcggcatatttgataaaatttccggcttgttaattggaaactttactgagtgttctagaaaaaggtttagtccctcatatttagataatctgatttcagagtttgttccggaaattgttcctacacttgttaatttctcgtcttcacacacagatccaatattgaccttaccaatcggcggtttcattcatatgaaattaagtaacaaacaaaatgaaatctgtatgtccgtaccggaaataccctaa

SEQ ID NO: 2796 - DNA, 756 bp, Xenorhabdus bovienii
  Coding sequence Name=Xb4151_4152.C435.gene185.dna; Position on contig= 149815..150570bp; Strand=+
atgaacaataacttaattgtagatccaaataaatttatttcgtatttacgcgctagtgggtacttacaagtcgaatcagttccaaaaactgttattatggtttttttggaaagtctaatggaacactgcaaagagatttatgacttaaataaaatagaagggtttaatgctggagaactttatgttctatcagacaatgaatctgtaggaattttttattgtagaggaataggagctcctgtcgcagttataaatctggaagagttaatcgcatttggagtacaaaattttatagttgtgggaacggctggagctctcaaccctaacctttccattgcagatattgttctatgtgatagtgccctaagagacgaagggacatcaaaacactatgtttctgacgggcaaatatctttaccaacggaaaagtggcataaagaccttaaactttgcttcagtaagcatataccatctattactgaaggtagaacttggactactgatgcaccttatcgagagaccaaatcaaaagttacgagcttacagcagcaaggggtattgtgcgtagaaatggaagcatcagccctgtttgttgtggccggattccataaagtcaatatcgcatccgcatttgttattagcgactcattggcagacctaaagtggactcctggttttttttccaacaaagtgactgattcactgatttgccttattaagcattcaataaatttcttacataataaaaaggactaa

SEQ ID NO: 2797 - DNA, 591 bp, Xenorhabdus bovienii
  Coding sequence Name=Xb4151_4152.C435.gene186.dna; Position on contig= 150573..151163bp; Strand=+
atgttagatatagttgaatttggtcatataaatattgttgtagatgatatcgacgatgcaacaagattttatcaatctttatttagatttgagctggtacagtcatttccacattttcagaactcaggttttgctaaaggtgctggttttttggaaggctcggaacaagtagttgttgctataaattttcttaaaatacctaatactacagtttatttagaaatcattagctacattaatcccaagccaattaatccacctcaaacatttttgccaaatgaattgggagggcctagacatatagcgttacgtgtgagggacattgccagtgcatacgagaaaatcaagtcttttcccggtgtttctctcatcaatcctaactcggattataaaccctttcaattggatccggtatgtcccgacgattttaccttcgcaaatgcagagctcgaatcagatttagatctgaaactaaagtcgtcaacaatttccagctcaattagttttgtctacttcaccgataaatttggtgttatgtgggaactggaagaggaaccaacaggtgctgatgatccagcattatctgtctag

SEQ ID NO: 2798 - DNA, 414 bp, Xenorhabdus bovienii
  Coding sequence Name=Xb4151_4152.C435.gene187.dna; Position on contig= 151185..151598bp; Strand=+
atgcgaattgcacacacaatgttaagagtttctaacctagttcaatccattaaattttataccaaaatactaaatatggatttacttgtatgtaaggattttccggatggtaaattcaccattgcttatgttggatatggcggagaatttgatagcgccttgattgaattgactcataactgggagactaataaatatgaactcggaaatggattcggtcacattgcaatctataccgatgatgtgttcgctatatgtgatcggataattgcaagtggcggaaatgttgtgcgaatgcctggacccaaaaaatatgggtcaacaataattgcatttgcaaccgatcctgatggttacaagattgaattcgtagagtgcgaaaaagaaataaagaaaagtcctaatgaaaaataa

SEQ ID NO: 2799 - DNA, 2466 bp, Xenorhabdus bovienii
  Coding sequence Name=Xb4151_4152.C435.gene188.dna; Position on contig= 151621..154086bp; Strand=+
atgtccatgaaaataaataaaacatatagtgcgagagatgttgaaaaagaagcacaatcatactggtcatcagcaaaaacctttcttgcagatgaacataacccaggggaaaaattctattctctttgtatgtttccctatcctagtggcaatattcatatggggcatgtaaggaattactccataggtgatgctattattcgttatcaaaaaatgtgtggaaaaaacgtatttcagcctatgggatgggatgctttcggattgcctgccgagaatgctgctattaaaaataatactcaccctgcatcttggacgtacaagaatataaacaacatgcgaaagcaattaaagcaaatggggtacgggtacgattggtctagagaaatagccacgtgttctcctgattattaccgatgggagcagtggctattccttagattatatgagaaaggactagcgtataagaagaaatctgtagtgaactgggaccctgtggatgagaccgtccttgccaatgaacaagttataaatgggcgagggtggcgttcagatgctttagtagaaaaaagagaaatctcacaatggtttttaaaaatcacggattacgcagaagaattgctagatggcttgaaccacttggaagaatggcctgttcaagttaaaacgatgcaaaaaaactggattggtaaatctacaggagttcaagttagtttcaagattaaaggcacaggaaatacagtagaagtatttacgtccaggcctgacaccatttttggttgcagctttatagcgctagcaccagatcactcctttgcacgagaattatctgaacgagagcccgatataaagctttttgcagataagtgtatgcagatgtctactgctgaatctgatttagcgacactgacaaagaaaggcattcaaacagactgcatagctattaatccgttgaatggcgaagaagtgccaatatggatagccaattacattttgtcgagctacggtacaggagccataatgggtgttccagcccatgatgaacgcgatcacgagtttgccggcctctatgatttacccgttaagcacgtcataaaacctgttgataaagaaagtgccaatattgagggcttatttacaggtaaaggaattttaataaactctggggagttcaatgggctggtgagtgatgacgctatcgagggagttactcaaaaactaagggaaataaaggcaggaacattcgaaaccaaatacaggcttcgcgattggggagtatctcgccaacgttattggggggctccaattccaattatatactgcgatgattgtgggactgtacctgtacctgaaaatgatcttcccgtagtgctaccaaaagaatttgaattcacagataaatccaatgtgcttaaaaacatacctgaattttacaatgttaagtgccccagttgtggaaaatgtgcagttagagaaacagacacttttgacacctttgtcgagtcttcttggtattccgctcgatttacatgtgctgaccaaccgaacatgatgttagacgagagagctgattattgggcgccagtagatttatacataggaggcatagaacacgcaattttacacttactgtatgctagatttattcacaaagtaatgcgtgatgaaggcttgttaacatcggatgagccgtttgtccgtctatttactcagggaatggtgcttaaagatggtagcaaaatgtcaaaatcgaaaggaaatgtagtgaaccctcaagattatattgacaactatggtgcagatactttgcgtctatttatgatgttcagcgcacctcctgagcagcagcttgaatggtcagactccggggtcgatggtgcacatagatttattaagaaactctggaatacggttcatggtcatgccgaacactgcatgcccaagataattcattcaagtggaattgttactattgagcaaaaaaatttaagaaggaagctccatgaaactctaaagaaagtaactgatgttatggagacaagattaagcttcaacactgcaattgcagctgttatggaacttatcaatacatacaataagtttacggttaatagtgaaacagacaaagctgtagtaaaagaagtattagacaatgtcgttattatgttatctcctattatccctcacgttacgcatgttttatggcatgttctaggacatgataatgctctcattacagaagagtggcctaaagtagatgagttggctattgttcaagatactgtcactatcgcagtccaagtaaacggtaagttacgagctcaacatcttattagtgtggatgcatcagaggaaatgataaaggataaactgttcactctaaaagaagtccagaaacatattgaagggaaaactgtgaagcgcaccgttattgttcccaatagactcgtgaatatagttacatcttaa

SEQ ID NO: 2800 - DNA, 1152 bp, Xenorhabdus bovienii
  Coding sequence Name=Xb4151_4152.C435.gene189.dna; Position on contig= 154234..155385bp; Strand=+
gtgaggctaactaaacaactatttcttgaaaaatatcgattacctaaaattctaaaccagaattcaactatgtctttattgagttctgggcctttttatcaaatggtagaaaagggaatacccttattcttacctattggtaataagatattaactgctattgagcgttgctgtattaaagaggccgaaaaatttgaattcaaccatatagatatgacccaaataatcccgactgatatcttatcattgggtgagcaattccatgacggttttctagatcaatttgtcttcctgaaaggtaaaatggaacgctatcatttgctatcaactccagaaccgttattattaaatttccttaaggaggggcttcaaagttacagacaactaccaataaaaatgatgttttccgccaaattttatcggcagctcagccaggttcaaggtattctcaaaacaagagagttcagaatgcttgctggtgcttgtttacatgagagggtatctgaaaaggaattggctattgagttctttcataaatacacactacatttagccaatgtattttctatacctatagagttcacttataatgaagaaagtaaattttacgagtatttctatattcatactgatggtgaggaactctttaatgatgtttctgctgtgagtttggcaatggcgtatgaatatggtcaagaaaaaaaagtgattgcccgctattgcagcaattcaaataggaatatgaacgcccaattcgtaacttatgggctggggcttcaaaggttattttttgtgatcctcgattgctatcgagataataaagggttcaacttaccaaagccagtacgcccatttgatattgctataattcccctacgagatgaagacatatcgaggtgcttggagtttgcaaattgtttacaaatcccaccagatcgaatgttgatagatgatcgatgcaagactcaggtattcgaaaaagaacgttttgctgattaccttggtattcctcaaaaactctttattagcaatcaggaagtatttgtcaagaacagggatactggcacgtttttaaaagaagtattccagctatccgatattaaaaaagaaagctgtagtttctttaatatccaaccatatgcacaaaactga

SEQ ID NO: 2801 - DNA, 132 bp, Xenorhabdus bovienii
  Coding sequence Name=Xb4151_4152.C435.gene190.dna; Position on contig= 155323..155454bp; Strand=-
atgattatattatgcgcgtctcgcactgttttattaatttttatagcgagaaaaataatttatatcgaatcagttttgtgcatatggttggatattaaagaaactacagctttcttttttaatatcggatag

SEQ ID NO: 2802 - DNA, 1245 bp, Xenorhabdus bovienii
  Coding sequence Name=Xb4151_4152.C435.gene191.dna; Position on contig= 155559..156803bp; Strand=+
atgacaatgataaataaaatgattggagcaatctcaatttatcgagggttatcatcaaatatctatttcatcgctatagcgagatttattcttggtttaggaaattttattctaccttttatgatgttgttactgactgagaaactcgattactctgtaataattgctggatcgttaacaatgggagtgactggttcatattttatcggtagtattctaggaggtaaattttcagatagtatgggtcataagagagttttggtatttggcgagctagtcggttctcttatattgatagtatgtggattttttgtatataaccctatagtcatacctttgttcttattcggaacatatttcttttttggtctagcactcccggcaagtaacgcattggttgctgacttgtcaaaccacaggaaccgcgatgctgtaatgtccttaagttatcttgcttttaatttaggttcagcagtaggtccacttcttgctggatatctattttggagttatacaagttggatattctgggggaacggtttagctgctctgataggaatattaacagttctttttggagttaattctagtgttaaagaaaggggaacgtgccaaactcagttattgaatatcgagttggaaaaaccagtcattggtaccgtttggacagtactgtccgagagaccaagaattattttttttacatttttttgctctctaatgtgggtagttatgaatcaaatgactatggctagtccgctgtatttgaactatatatttgatactcatggccctattctatttggacagctctgcactttttcctgcttagtcgttgttgcaataacacctatattaatgaaattgactgcctccaagtcggacattataagccttgcgtattcaagtgttattttcgcagttggttacttagttgtaatgtcaagcccaactataccaatgcaatttatcgcatggttcttcttatctgctggtgaaattcttctttatactaaggaaggtatatatttagccaatcaatcaccaaaaagccatagaggtagaattcaaagtttttcaacgtgcatgcgcaatattttgcttatgccaagttttgtattaattggtttcacaatcgataaatttggatatcaatacacatggttacttatagtgtctattgccatgttggctgcatttgggtttatggctatggataaaaaatatgaatctttaagaacttag

SEQ ID NO: 2803 - DNA, 96 bp, Xenorhabdus bovienii
  Coding sequence Name=Xb4151_4152.C435.gene192.dna; Position on contig= 156930..157025bp; Strand=+
atgactaaaggggtaagattgctttactatacaaatactttatcgctgagttccaacctcaacatacgcttagtctcattgaagtcaccgccttaa

SEQ ID NO: 2804 - DNA, 165 bp, Xenorhabdus bovienii
  Coding sequence Name=Xb4151_4152.C435.gene193.dna; Position on contig= 156988..157152bp; Strand=-
ttgacgcgacccaatacatatgcagccaaaaccgcgatccctgaaatgacattgtgtcatttagaacagccaacgacaccagtaggctggttgtacgaacccagcattatgatcatctcatcaccatttaaggcggtgacttcaatgagactaagcgtatgttga

SEQ ID NO: 2805 - DNA, 225 bp, Xenorhabdus bovienii
  Coding sequence Name=Xb4151_4152.C435.gene194.dna; Position on contig= 157101..157325bp; Strand=+
atgtcatttcagggatcgcggttttggctgcatatgtattgggtcgcgtcaagctggctattttcccgattaattgttgtaactgaatttcaatttctgttgcaccggataggtgatgtaatgatttcattttctactccctcattcattgccataaacacacaaaatttttactcattattgttacttagcatatcgttagaattggaaagtttatatcagtga

SEQ ID NO: 2806 - DNA, 102 bp, Xenorhabdus bovienii; identical to SEQ ID NO: 2788
  Coding sequence Name=Xb4151_4152.C435.gene195.dna; Position on contig= 157288..157389bp; Strand=-

SEQ ID NO: 2807 - DNA, 132 bp, Xenorhabdus bovienii
  Coding sequence Name=Xb4151_4152.C435.gene196.dna; Position on contig= 157433..157564bp; Strand=-
ttgcctctttgttcgctgtactcactcaccccagccacacaattatctatgttccgggaaattcgttcccttgccgccgcgacgcatattgaaatccatcggaatatatattcagaagctatacctgtgtaa

SEQ ID NO: 2808 - DNA, 2880 bp, Xenorhabdus bovienii
  Coding sequence Name=Xb4151_4152.C435.gene197.dna; Position on contig= 157643..160522bp; Strand=-
gtgatacaggatactggggaacgtctccggcatgattatgatcctgctacccggactgcacagattaccctgctggccgaagggctgcgttttggcaaaacaaccgtggtatataatgtacgtcaccaacccgtcaccattacacgttatgacagtcaggggcagctttatagccaacagatccatcattatgatggtttgggacgattacgggccaccatcgatgaacttggacaaaagacagaatatatttacgatctgtttagtcgggtttcagccattaaacacagtgatggcacggtgatccgaaaaaactatgcccctttcagcgctggcaatttattgacacaaattgaggctggcggtcatgtattggggacacgcgattttgacagtctgcagcgcaatatctccacctcctgtggcgggcgtacctaccattatgcttatcaggggagcaatctttatcccagccagtccactgatccgttgggtcatacagtgacacatcaatatgagcctttattagggaatgccctgacgaaagtggaggcagaaggaatagaacaacgctttagttatgatcccaaaacgggaacgatgactcaggcttctgcatcgcagattgctacgcatgagatgagctatactgcttcggggcagttgagtcagacccgttaccattttgaagatggacaagccggtgtcgcccgctcggtcgactatacctattctcccattggcctgatgacggattacaaggatgtgacggaaaaaaaatgtcatatgcgctttgattcgtttggtcgtccgatcgcaagacgagatttagatattgagattgccttaatctatgatacagccagtcgtgtaaacagttggacagttcatgacaaacaacacaaccagaaattaaccattaccctgagttttgatgattttggtcgtgaggtcaatcgtcagatccggactaaaaccgatacgctgactttggaacagagctataacgtcaagggacaggtgacctgccgtagcacccgttcacaggcatccggcttgttacggcaggaaacctacacctatgatcccgcacgcagctggttgaaggaatatcactgcactggttcggagtctccccgtgatgcctatggttttggcattgcccgtcagcactttgcctatgacgttctgggtaatatccaaacctgtgtgaccatacttgaagatggcagcagcgatacagcaacttttacttacagtgaggcagatccctgtcagttgcacgggataacccatacccaccccggttatcctgccaccatcacattggcttatgacaaggcggggcgattgatccgggatgaggttgggcgccatttaacctatgatgcgctggggcggttgacctcagtgcgtttaaatgcggccataagtcattacgcttatgacgcagccaactgtctggtgttgcaacatattggtaccaagaaaacctatgagctttattatcagggcgcgacccgtgtagccgagatcttgcgggaaagcggggttgcgacccgtctgttacatgcccacggggaaacggtcgcgacggtgacaggtccagaggtccatttgctggggacagataaacacagcagcgtactgctgagccacaagggagatggcgctgaaacacgctaccgttattccccgtatggacagcaggcggaaaatgaacgtgccaccggcctgcccgcctacaatggcgagcgtcttgatcccgtgtggggaacttaccacttaggtaatggctatcgcacctataatcccgtattgatgcggtttactgccccggacaatctgagtccattcggtgccggtggtatcaacagttatgcttattgcctgaatgatccgataaaccggactgatcccagcgggcatatgagtctggggggcattttgggtattgtttttggtactgtcgggttagccgttggtatcgtcttagctattcccacagggggagcgtcactgtccatcgggggggctgttttggccggactgggatttgccgctgatgctacaggaatagccagtgtggtcaccgaagacagtgatccccatgcctctgcaatcctcggttgggtttccatgggattcggtgtggtcagcatgggggctggtgccatcagcggcttggtcacaggcatgcggcgagcgggacaccggatgataaccagttttagccatggtatgagcggtaggagggttcctgaaactcagctaatcaaacacaacgaatacaccctgactttccagtctatgttaaatgaagatagggttttccaaatcgaaaacccagtaaatagcggtgcttatactttaagcgtggatattaacgggttagataccaacacgattcttcggttggatagatcgggatttgaaatactgagcactaacggggcaacaagaatgattagtaatgtctatcttgtgccatcgaaaccaccagttttgctgaacatcacagaagataactatctaaatttatatgggcaatttataaaaagtgacactcgctatggtagtaccagtctaattaatcaatcgcgccatttacaaaatttgctcagagctacgggaagacatattagtgatgatttaataagagatatggattttctatggagtcatcatagatttagatatgattttaatcgatggctacattttgaaatgctagagaagtccaatatcattggagaatatatgacggaaattcgactgcagtcgtccgcatctgatatatttaattcctttgttccaaatattgcagctattccagttattccagctattccagctattccagctattccaggaccctaa

SEQ ID NO: 2809 - DNA, 426 bp, Xenorhabdus bovienii
  Coding sequence Name=Xb4151_4152.C435.gene198.dna; Position on contig= 160334..160759bp; Strand=+
atgatggatctgttggctataaagctgcccctgactgtcataacgtgtaatggtgacgggttggtgacgtacattatataccacggttgttttgccaaaacgcagcccttcggccagcagggtaatctgtgcagtccgggtagcaggatcataatcatgccggagacgttccccagtatcctgtatcacaagatatcgctgtccccagtcatcatattcaaaacgctgactggaagagacttgcgtgatagaaccagccccctcaccgacgggcagccagtcatgactggatatatttctctatacgccccccgttgtcatagaccgcttcagacgccaaacgccagccctgtttctcctgccctttctccagtttctcctgctgataagcacgccccagtccatcaaagcgggtaccgcatctga

SEQ ID NO: 2810 - DNA, 1398 bp, Xenorhabdus bovienii
  Coding sequence Name=Xb4151_4152.C435.gene199.dna; Position on contig= 160738..162135bp; Strand=-
ttgttaaatatccattatgaattgggctcctatacacgaataacggtctggccaaacacctctgaatcctatgatattcaattattatttaataatgagtatatggtcagtatccaaaaaggcacggcgggtcaaatgttgaaatggaagatggactatgacacagataaccgatttttaacacaggtcttgtccccgacggggctgaaggaaattgtggactataattctaacggccatcagcttccagacaatgcgagcctaccggcattgccctatgtcactcggcacacacaatctcccggtaatggctctgatattgtgcgcacttatgaatacaccaattttaactttctgggttatggggcagtaggaaattgggatcgtaatgaggattatctttataacatcttaaccgactaccaatatggctcgaccgaaagctggctggaggggaaaacacagcgccatatcacccggagctataacaattatcatctgttgacctcagaagtgatccagcaaaatgattgtcagcgtcatcataagacaaagtattatgcacagattggcgttgattttgtggatcagctcccgcaatttcagatgccggaatcggcgattgtcagctttaatgaggccgccaacggggaaaaccaccagacacagtttgatgactcaggtaatcccaccgtgcagattgcgccggatggtacacgtaccgactggacttattatcccgccagcggggagacaggtgcctgtccgccagatccgcatggctttgtgcgtttcgtcaagtccaaaaccgttacgccgggtcagtgttcccccgaggggatcaatgaggaggcacctgtttacaaaacaatctatcgctatgctcagttgccagcccgtcccggttcacccttatcctatgctgtcgtgcgtacttatcagggaatattcagcgcaggtaggctactgcttgaaagacagactcactatgtgaatgaagtcgcttcgcctcatcatggccgtcttcagcgggttgatgaaacggtgcatagtatacaagatggtggtcagtcatggacgagccagcaagttttcagctacgtccttcagggagaggcgctggtgcagggtattcagtggacagggcatgaccaactcagcatagctactcaacgcacacaatcgcggagcagtggcaaattatggcatggcatggatgcgcagggccgtacaacacgttatcactatgatacttttgggcgtatcctgaaacgcatcaataatgagggaaccgattacgcccgggagataacgtatgtctatgccattgaagatgccggtacggtaacaacaacacaaactgatgtttggggtaatcagatgcggtacccgctttga

SEQ ID NO: 2811 - DNA, 291 bp, Xenorhabdus bovienii; identical to SEQ ID NO: 155
  Coding sequence Name=Xb4151_4152.C435.gene200.dna; Position on contig= 162194..162484bp; Strand=-

SEQ ID NO: 2812 - DNA, 279 bp, Xenorhabdus bovienii; identical to SEQ ID NO: 890
  Coding sequence Name=Xb4151_4152.C435.gene201.dna; Position on contig= 162476..162754bp; Strand=+

SEQ ID NO: 2813 - DNA, 216 bp, Xenorhabdus bovienii; identical to SEQ ID NO: 1249
  Coding sequence Name=Xb4151_4152.C435.gene202.dna; Position on contig= 162705..162920bp; Strand=-

SEQ ID NO: 2814 - DNA, 153 bp, Xenorhabdus bovienii
  Coding sequence Name=Xb4151_4152.C435.gene203.dna; Position on contig= 162926..163078bp; Strand=-
atgatcggcgaaatccaaataaatccgcccatagcgacttatatgagtccagcaaggctcagtgatcttcgccgcatcaattatatttttggtgtgaacggtacaagcaaaacgaccatcagctgtgtaattggtcatgtattaaatggttag

SEQ ID NO: 2815 - DNA, 1224 bp, Xenorhabdus bovienii
  Coding sequence Name=Xb4151_4152.C435.gene204.dna; Position on contig= 163088..164311bp; Strand=-
gtgagttggcctcaagctaaattggacgatgttatatcgttcattcgtggagtgaccttcaagcctgatgacctggtagagcctttatcttccaactctactgtggttatgcgtactaaaaatgttcaggttgaaggactcgagcaaagtgatctgattgctattccctcggagctagtaaagagaaaggaacaggctctgtgtgaaggagatattttgatttcatcagctaatagctgggagcttgtgggaaaggccagttacgtaccaaagctgaattatcaggccacagctgggggatttatctctatagtccgtgcgaagcagagggttattgatagcagatatctttaccactggattagtagtccgtctacgcagcatagaatcaggcattgtggccgtcaaaccacaaatatttcgaacttggatgtaggtaggttcaaggatctggaaatccctctcccacccctaacagaacaaaaacgtattgccgctattctcgataaagccggtgccatccgccgcaaacgccagcaagccatccagcttgccaatgaattcctccgcgccgtgtttctggatatgtttggtgatccggtgacgaatccgaaggggtgggaggttaggccattggtggacggcattaaatcgatcatctccggatggagtgcaaaaggcgaaagctatccttgtaatgagggagagtatggggtgctaaaaatttcagcggtaactagtggcaaatttaatcctcaggaaaataaatttgtttatgaaaaagatattcctgcagataagaagttagtatttcctaaaaaaggtgatcttctttttagtcgagcaaacactagagatcttgtcgcagcaacgtgcatagtccctaaagataacaataatgtttttttaccagataagctttggaatgtaaaaacaagtgaaaatatactattgcccgaatatctaaactacttgatttgggagcctagattcaaaggaaagctgacctctcaggcgactggaactagtggctctatgttgaatatttcaaagggaaagttcgagactacggatgcaattttccccgatttgccactgcaaaagaaatttagatcaatttattggagagtacaaaagtacattgacagtttaaatgcatctcttgatggttgtgatgcttctttttcatcattgagccaaaaagccttttctggcgaaatctaa

SEQ ID NO: 2816 - DNA, 1605 bp, Xenorhabdus bovienii
  Coding sequence Name=Xb4151_4152.C435.gene205.dna; Position on contig= 164308..165912bp; Strand=-
atgctaacaggccaaatacgtaacgatatcgacaatctctggggaaaattctggaccggcggtatcaccaaccccttaaccgtgatcgagcaaatcagctacctgatgttcgcccgtatgctcgacatgcaggaagacatggccgaacgcaaagcgaaccgtacaggtaaagattttgatcgcctgtttcccaatacaccggaagggcaattgttgcgctggaaaaactttaaaaatctcagtggcaaagaactgcataaacaccttaagcaaaatgttttcccttactttgcaaaacttggcaaaaagtccgatgaacaagatggtctgggcaacgacggtagtgccatcgaagctttggggcatatcggtgaatacatgcaggatgccgatcttgaaattaaaaatgaatcggtgctcgtcagtgcagtagagatggtggatgaactgcctctaacccaaagcgatgtaaaaggcgatatttacgaatacctgctcagtaaacttaccacagccggtatcaatggccagttccgcacgcctcgccatattatcgacgctatgatcgaactgattaatcctcagcccactgatactgtctgcgacccggcctgtggtacagccggatttctcactcgcatcatggaatatctcaaccgcgtgcattccagtgagttcggcattcttgaagacgacgacggtaacaaacactacaccggcgacttgttagagccttaccgtgaccatatcaacaaaaagatgttctggggtttcgatttcgacacgactatgttgcgcgtcagcagcatgaatatggctttgcacggggtaaatggagctaatatcctctatcaggatagcctgagtaaatccattaaagaaaacttcccgcagcaggaagaaaacttctttgatgtcatcctcgccaacccgccatttaaaggtagcctggacgaaaccaataccaatcccgatgtgttgggcttggtgaaaaccaaaaagaccgagctactgtttgtggcgcatatcctgcgcgccctcaaactcggtggccgcgcagccgtcatcgtacccgatggcgtgctgtttggctcctccaaggcacaccagcaactgcgtcaggagttgattgaaaataaccagctcgaaggtattgtgagtttgcccagcggcgtgtttaaaccctatacaggtgtcagcacggccattttgatgtttactaaaggtggcagcactgaacgtgtctggttctatgacctgcaaactgatagctattcattagatgataaaagaacgccgttaaaaggcgaaggcagcaacgacctgcccgaagctattgccaagtggaagcaatatattgccttggttgagaggaacgctttagccaaagatattaacaaagcctttggcgataaaactcaaaaagcattcgtggtggacgccaaagatattgtcgacaacaaattcgacctctccatcaatcgttataaggaagtggtgtatgaggaagaagcttttgaggacccgaagacgattctgaacaaactgaaaacgctggaaagcgagattatggcggatctggatgcactggaggggatgctgtga

SEQ ID NO: 2817 - DNA, 123 bp, Xenorhabdus bovienii
  Coding sequence Name=Xb4151_4152.C435.gene206.dna; Position on contig= 165912..166034bp; Strand=+
ttgaatagctcgcttaatgattttctgctgtttctgattcgattggcgctgcgcttagcacattgccctgtgccgtgttttccaactggcttggctctatctcttaagccaactcatccatag

SEQ ID NO: 2818 - DNA, 1839 bp, Xenorhabdus bovienii
  Coding sequence Name=Xb4151_4152.C435.gene207.dna; Position on contig= 166015..167853bp; Strand=-
atgcaatcactagaatggacgactaaactcatgattattgcctctgtggcgggcctggttctcgctgcttttggctatctgctggctatggtcctgctaggacgtaagaacactgagctcaacacccaattgcaacaggctgatcaagcccttaagctggccaacactcaaaaccagaaataccaggatgagctcaagcagcttggtatcactctgcacgagaaagaactgtcggaaagcaagctacagacgcaacagaccaatgcaaaggtcacagaacaacgcctgaatgacgcattagccgagcgtaaaggcgagctggcatccttacagaaaacgctggaagagttacgagggcagcaccatagtacagaaaagcaactagaaaccgctcaagccgataaccgagcgttgaaagaacaagcgcaggatttacgagaccgtctggaaaaatgtgagcagaacgttcagcaagaacgcaccttggtgagccaactcaaagatgagctggcacaagaaggcaaaaaggccaaagagttggaggcatccaataccgaagcgcgcgagcagctgaaagacgtcaaacagacccttgtagatcaacaacagcgttatgatcagattcaggagcactatcagtcgctcagtaacgagtatactgagcttaaaaccacgctggagcgcaaagaagaacactttaaagagcaaatgcagcagctcagtgaaaccaagcaatcgctcaccaaagagtttgagaatctggccaataaaattttcgaggaaaaaggcaaaacctttacccataccagtcaggccagtatcgacactatgctcaagcctttccgcgaacagatcgaaggcttccaaaagcgtataaacgaagtacacgatgcttcgttgcaaggcaataccagcctcaatgccgagattaaaaaggtactggaaattggcctgcaaatgagcaaagaagccaataacctcacttctgcgctgaaaggggattctcagaagcgcggagcctggggcgaggcacagcttcgtcgcaccctggaaatgagtggcttgatggaagaggcgcactatgaagttcaaggctcattcagagatgcagaaggcaagcaaaagcagacagactatctgataaagctgcccgatggtaagcacatcatcatcgacagtaaggtagcactgaacgcatacgaccgggctgtgggtgcagaatcaccggaagaataccaactggccatgagcgaacatgttaaagcggtacgcaggcacattgatgatctggcattcaaggattacaccaaccttgttggtatgcgtagccccagctttgtgctcatgttcatgcccattgagcctgcctatatcgaggcgctcaaagataacaaaaacctgttcgaatacggctacaaaaaaggtattgtattggtctcccataccacgctcattcccattctgcgcacagtgtccaatctgtggatgattgaacgcagcaatgccgaagcccgcgaaatcagcgaaaaagcaggtgatatatacaactcagtgtgtactgtagccgagcgtttaagtaaattaggtggcaccctgagtaccgtcagcaaccactacaacagcaccgtcaaagcgctggtaggacagcaaggcttgtatggcaaggtggatcggttcagtcaactctctgccaaagtcagtaaaagcctgccccacttggaggctgcacatatagacttcgaaaccgagcgcctgaccttgatcgttgaacctattgatgagcagacgaaagaacaggtgaaagatccggcagacgaacctatggatgagttggcttaa

SEQ ID NO: 2819 - DNA, 3441 bp, Xenorhabdus bovienii
  Coding sequence Name=Xb4151_4152.C435.gene208.dna; Position on contig= 167856..171296bp; Strand=-
atgcaggtatggacagaatatatggacaaaataattttgatgaaatcagcgaacttcgaattcttgcgacctgaaaatgattttcttgccaacctcggtagtttcgccgaggcggtactgcatattgatccgggtagtgccctgacccgcctgcgcagctttgctgaagtactgaccaaggccatttataaggaagaactgctgccgcacatgccgcaatccaacttctatgagctgatcaaaaacccggtttttgaagactgcgtcagcaagtcactgattcaccagatcaactttttgcgtattcaaggtaacgataccgcccatggtgcagaaggcgaattgcgtaatgctcaaatggcattgggcacggcgcaccagttggccatgtatatgggtattaagtactacaacaaaaagaaggaccagatcccctcttttgtcgatataaaagaccctacggcaactttgaaccaactgcaaaaatccgtttcaagctacgaaaaagaattgcaaaagcagcaggaagaactcgaaagggtgatcgagcagctggaacgtgagcgcacccgaaatatcgacaagcttgagccacccgccaagtctgaccgacaaaaacgccggcagcagagccagttagtggccgacagcctgcaatggaacgaagccaaaacccgtgcactattgatcgacgccatgctgttgcaagctggctgggatatccagaaccccgatcaggttagccatgaatttgaagtgatctttcccaataatccctcaggcaagggttatgtggattatgtgctatggggtgataacggtcatccgcttgctgttatcgaagcgaaaaaatccggcaataccaaccttcaagcaggtcgtgagcaggctcgcctctatgccgatgcctttgaacacatgggctaccagcgcccggtgattttctattccaacggttacgaaaccttcatttgggatgatcatcagtacaacacctatcgtccggtgtatggcttctacagtaaggacagcctggattatctgatctaccagcgccattaccgtgccgctgagctggaaaaattcaacccagagctcagcattgctgaccgtccttatcagatcgaagccatcaaaacagtcgcggcacactttcaaagtcagcgccgcaaggcgctgattattcaggcgaccggtacaggaaaaacccgtgttgccattgcactggctgaattactgcttcgtactggctgggccaagcgcgctctgtttttgtgtgatcgcaaagaactgcgggtacaggccgacgatgcttttaagcaaaatctaccctctgagccgcgttgtgtgattggtgaaaccaacaagattgataaaagtgcgcgtatctatattgccacttaccccggcatgatgaaccgcttctctcaattggatgtaggcttcttcgatctgatcattgccgatgaatcccatcgcagtatctacaacaaataccgcgatctgttcgattacttcgatgcccttcaagtgggcttaaccgcgaccccggtgaaatttatcagtcgcaatacgttcgatatgttcgactgcgaaaccactgacccaacatttgagttcgggctggatgcagcgattaacaacgaaccaccgtatttggtaccgtttcgggttaaagatcttaccactgatttcctgcgtgatggtattcactacaataacctcaccgaagagcagaagcgccaactcgaagaagacttgggcgaggaagaggcccgtaataccactattgcaggtaaagacattggccgtaagatcttcagtgaagatactgaccgcattattctggaaaacctgataaacaatggcatcaaagatgaaactggctccctggtcggtaaaactatcatctttgcccaacgccaggatcacgctgagcatctggaagaactgttctgcaagctgtatccgcagtacggtactaaggtatgcaaggtcatccataattccattccccatgtggaaagcctgatcaaagagttcaaaaaggctgacaacgagtttcgcatcgctatttcggtcgacatgcttgatacaggcatcgacgtgcctgaggtggttaatctcgttttcgccaaacctgtgaaaagttgggtgaaattctggcagatgattggccgaggtacgcgtctacggcacaatcttttcgggcctggcaaacacaaaaccgaattcctgatttttgaccattacgctaacttcgctttctttgaagaggaatatcaggagccagaagacactggcggaaaatctttgctgcaaactaccttcgaatcccggattgagctggctcaggccgccttacagcgaaaccatgcagccgccttcgatgctgccattgagttattgcgtgccgatattaacgacctgccagatactagtattgcagtaaaacgtgaattgcgggtcgtacaccagttacagcaaaccgatctactgaagcgctttgatgcaaaaactcagcatcagttggccaatcacatcgctccattaatgtcggcccgtgtattgcgcgacaaacatgcgacttatctggataagctcatggccaccatagaacgctgcctagtagagcaagccagctgttttgatgatggtcgagagctgctgttggcagaacttaataagctggccgttaacattcaggcagtgcgccagaaagatgtggttatagcagaagtgcgcagtgccgagttctggcaaaacccgactatcgataagctggaaaaagctcgcaaagagttgcggggcatcatgaaatatcgccaaaccgttagcggtggattgtacgctataccagcaacaaaaacgggtgacaccggtttgcaactaaaagaacgtgaggtaacaatcgcaggtgccaacgaggccatgatctaccgccgtagactcaaagatattctagatcagatgatagctgccaaccccacgttacagaaaatccgtaaaggcgaatctattgccgaaccagaattaaaaaccctcacctcgaccatactcaccagccaccccagtgtgagtttggaggtgctgaatgaattctatggccgcactgccgatcaactacacctgaccgtgcgtgaaattatcgggctggactcgcaagccatcgaagaccacttcaagagctttttgcacgcccacccaacacttacagcacagcaagtgcgctttatgaacctactgaaaaactacatcgcccagcacggctcgatcaggatcgaaaaactgtacgatgcgccttttacctcagtttcgcacgagggtattgacggcgtatttaccgccgatgacgtgggtgagttaatcaccgtactaaaaccttttatcaaggctgaacctaaattgttaggctcacagcctgagagcacacaggagtga

SEQ ID NO: 2820 - DNA, 1569 bp, Xenorhabdus bovienii
  Coding sequence Name=Xb4151_4152.C435.gene209.dna; Position on contig= 171347..172915bp; Strand=-
ttgaggctttggataaactttgccgcctatttgaatgtgaggtggctgatatgctggagttcacggatgtgcaaggctaagccccatacactggtcagctggattggggggaacgacctcaaagccaccggcagcaccggagctgatggtcaggcgcttgggccgattgctgcgactcttacagcacaagcgtttgatgccgtagaactgctttacaactacccggaagatcaggtgaggtcctatctggcttggttgcaggagctagttaccacgcctatctgtgctcacgccatttcgctatcttcacctgttaacttcggtgaaatctatgttcaggccaatcagcagctatctaagcttaccgtagagggctgcgagttatccctcttgttaagcccaggaacaccggccatgcaggctgtgtggatcttattgggtaaaacccattatccctgtcagttttatcaatcatcactagagcagggtgtccaacaagtggatatcccctttgaggtttcagcggaatacctgcccgctgctaaaagcattgacagcgcaaagattagccagctggcagaggccagtgcccctatcaatgcagccttcgacaacattgtcacccgtaacccccgcatgcagtctctgaaagcgcaggcgcaaatactggcagaacgtgaagtgccagtgttgatctatggggagagcggtacaggtaaagagctctttgcccgtgctattcataatgccagtcatagagccaacaagccgtttgtgccggttaactgcggtgctattccgaccgagctggtcgattcagtcctctttggtcataagaaaggcgccttcaccggtgctctagccgacaaggcaggtttattcgagcaagctaatggtggaactctatttctggatgaatttggcgaactggaacccagtatacaagtgcgtttattacgcgtattacaggaggggacgttcatccctgtgggcggcaccaaagagcaaaaggtcgatgtccgcttgattacggcgacccaccgcaacctgatagaagcggtttccaatggtagctttagggaggatttgttctatcgggtggctgttggagtactacatctaccgcccctgagggagcgtgatggagatctgtcattactggcagatagcttggtcaaagcgatgagtatccatgactcgatgcttaggcataagaaaatttctcctgatgcaaaaaatcttatccttcaatgcccttggcgaggaaatgtgcgtgaattgcagtccacattgctgcgagcagctctatggtgccaaggtgacgatattaccgccgctgatatccgtcaggcgttgttccatatgccagagccggaaacagggttgatgaatatggatatatctcaaggtattgatatacaatgtataattggcagcgttgctgcgacttatatacgtaaggcgttggatcatagtggccaaaacaagacccgatcagcacagctgctggggctgaaaaactaccagacactgaacaattggatggaaaaatacggtatttcccagtga

SEQ ID NO: 2821 - DNA, 210 bp, Xenorhabdus bovienii
  Coding sequence Name=Xb4151_4152.C435.gene210.dna; Position on contig= 172836..173045bp; Strand=-
atgatacgttgccatctcgctcgcctgatgggagagcgaaaaatgaaaatttccgacgtcttgcgtgaaaccggtcttagcaggaatactgtaacgctgatgtacaaagaatctgcgcaaaagatcgacattgaggctttggataaactttgccgcctatttgaatgtgaggtggctgatatgctggagttcacggatgtgcaaggctaa

SEQ ID NO: 2822 - DNA, 279 bp, Xenorhabdus bovienii
  Coding sequence Name=Xb4151_4152.C435.gene211.dna; Position on contig= 173354..173632bp; Strand=+
atgaaaactgaggggatcacactgatcacccatgttcgtcgtaatatgaaagccaaatttttatcactttgggacagggttatgttaagaacgcggtttttgatagagacagtgaatgaccaattgaaaaatatttctcagatagaacattcaagacaccggagcgtagtcggctttttactggaggttgtatcgggacttattgcttatacattccaacccaaaaagccgagtttaggtttacgtgattctgaaattgggatgcttaaacaaaactga

SEQ ID NO: 2823 - DNA, 171 bp, Xenorhabdus bovienii
  Coding sequence Name=Xb4151_4152.C435.gene212.dna; Position on contig= 173610..173780bp; Strand=+
ttgggatgcttaaacaaaactgaggtttttcagatagagcattcaaggcatcgcagtcagcttggttttttattggaagttgctgccggccttattgcttatatatttcaacctaaaaaaccgagcttgaatctacgggataatgagatcgctatttttaaacgaagctga

SEQ ID NO: 2824 - DNA, 2391 bp, Xenorhabdus bovienii
  Coding sequence Name=Xb4151_4152.C435.gene213.dna; Position on contig= 173788..176178bp; Strand=-
atgacggaacaatataaacatcttagtattgcgaaagaatctcttcagaaccctagacgcacacgtcagtttaacattccgagaacaccacgtgccgacttgcgcctgcatggaagcatgttgtctgagcaattacgaggtattacgcaattagctaccccgcaaattccaggaaaagataatgatggccggtacatgcttaaattacaatatactgggatgttagatattgctcatctggacaggcatggtatcgagttcgttagccaagaagacaaaacgatctgtattgcttttgctgatgaacgaggaattgccctctttgaggagcacctgtcacaattgggacatggacatattacctaccagcagatcctaacagcattggacagtgttgatgtttggtctagtgaggatcgcaaaagctggtcagtcaggcattatggttttcctgaattagaatcattcggtctggatgttgagctttggccgatagaaaccacacgacatccttcacgagagcggatctgcgaagaatttgaaaactggcttcaggaaaatatgattcaccgtttggatcgaattaatcttgatagcttgttgatgtatcgggttcgagtaaattgcgagcaagctgaaaaactactagcccatcgtgatgtccgtatggtagatttgcttccttcaagcgggatttcgtacgaaaaattgaacagagatatcaacgttattcctgcacacatcccctccccatctcctgacgctgcgaaagtttgtattcttgatagtggaattaataccgcacatccattattgcgtagtgctatagctgaaagcgccagctttgtggttaatgaagacgaatttgaccattgcgggcatggtacagctgttgcaggtattgcgctatatggtgatgttgaagcctgcgatgccagtaatttctggcaaccatcagtgtggttatataatggaaaactccttaattctcaaggggaatttgatacttctacgatcgaaacaacgttgactgaggctgtagagtatttcgtagatttaggatgtcgtatatttaacttatcacttggtaatgcaaatgcaccatatgatggtaagcatatcaggggaattgcttatgttcttgatgtgctggctcgtcgtcacaacattctgttcgttgtttctgcaggtaactttagcggaagtagtgaccctgatgttccacaggaaagttggcgtgctgagtacccaagttacttaatccataacagttccgttattatcgatccagcccctgcactcaatgtcctcacgacaggaagttatgccaggcacaatgcaacatttgatgctcaacgtagggcggatgaaattagtcatttaagccctgcgggggaatttcaaccctcaccattcacacgccacgggccgtcagtgaaaggagcttttaaaccggaaatagtagctcatggtggtaatttcgccgtccccatgcgtaatgacggaggccaatggcgagaacatgccaaaggacttggcgttctaagctgccaccatcaattccaaggaagcacatttttctctgaacaaagtggaactagtttttctgcaccatatataacgcatcttgctggacgtttactaaatgaatatccagatatgtcagccaatatgttgcgagcgatgctggtcaaccatgcagtattgactcctcagatggaaaatacattttctgaagaagttgttgagtgttataaagcagagtcagcaactcgaaaccgcagcattattcgggatgttgttggatatggagtcgtcgaggaagatagtttataccgttcatcagaagaagtagttgttatgatgtgtgatgaacaaattgtgaataatacacatcaattttttgagcttccattacccgcttcctttttaagaactcaacgggcagtacgagaactgcacattactttagcttattcaccagccgtcagaacgaccaggctggattatgcggctacgcaaatatcctatagactcataaaaggaacatcgttacaggatgtccagcagtattttaatcatgatgtacaggatggcacaaaatccaggaatgatgatgcggcaagtaatcgttctgttactgcacaacaacgtgaccactgtacagtgcaatcatctagttggacctttaagcgtcgctctcctgatgaaaagtggtttgtagttgtaactagaaatgatcgtgagtggggggctccactcaatagtcaacacgaatcatatgctttagttgttactgcaacggatagagaaaacgctgaggccaatctttacgccgaaattgaggcccgaattcgtgaacaggaacgttctagagcacgagtaagctaa

SEQ ID NO: 2825 - DNA, 987 bp, Xenorhabdus bovienii
  Coding sequence Name=Xb4151_4152.C435.gene214.dna; Position on contig= 176182..177168bp; Strand=-
atggcaaacggtaaggttctcagacagcttataaaagctggggcgacaggtgatgtcgcgaccttccgtcgtgtttcggaagtgatcattgaggaagaacgacaaaaacagcatcatcttcttgcgaatgatcttgaacatatcctgtatggagatcacaccatacagacctcccgcgtgcctgcagctccccagatgcctgttgataaagagagaggcctaccattactggatattaaacagccaagccgttctctgaatgaaatcgtactacccgaatcaagttcagatgcaatcgaagagattcttgaagaaaatcgcagagctgatgtgctacgcagctatggaatgaaagctgttagtaaagtaatcttttttggtcctccgggatgcggtaaaactctggcagcagaagtagttgcttgtgagttggatatgcccttggcaatcgtcaggcttgatactcttgtttcttcttatcttggtgagactgctgctaacctacgccaaatatttgattttatctctcagtatccaatggttgtacttttcgatgagtttgatgctattggtaaagaacgaggggatagtggggatcatggcgaattaagacgggtcgtgaatgcagttctacagatgatggatgcatatcaggggaaaagcttgattcttgcggcaacgaaccatgagcatattctggatagcgctatttggaggcggtttgacgatgcaatcgaattcccactgcccgacaaacatcaattattagaattgatgaagctaaaacttcgtggtatacgtcgccagtttgagcttgaagatgatgccgtgctctcactatttattggaaaaagtggtgccgatttagaacggattgtaagacgtgcaatcaaaagaatgattttacgtagccaagagtttttaactctgaaagaccttaagaatgcactcttgcgggaaaatgtaaataaaactcgtcagggataa

SEQ ID NO: 2826 - DNA, 237 bp, Xenorhabdus bovienii
  Coding sequence Name=Xb4151_4152.C435.gene215.dna; Position on contig= 177055..177291bp; Strand=+
atgctgtttttgtcgttcttcctcaatgatcacttccgaaacacgacggaaggtcgcgacatcacctgtcgccccagcttttataagctgtctgagaaccttaccgtttgccatttctttcccccaacaaaccaatgtgcacaaaatcttgctttcagtttagcatcgccgcatccctataagaagttagctttacctagattttttgaattgttacaacttttttcggctttttag

SEQ ID NO: 2827 - DNA, 99 bp, Xenorhabdus bovienii
  Coding sequence Name=Xb4151_4152.C435.gene216.dna; Position on contig= 177268..177366bp; Strand=-
ttgtgccaagcggacattactcacattaatctacggggagaacgtctcaaatataggacgtttcgatcgttccttctaaaaagccgaaaaaagttgtaa

SEQ ID NO: 2828 - DNA, 168 bp, Xenorhabdus bovienii
  Coding sequence Name=Xb4151_4152.C435.gene217.dna; Position on contig= 177366..177533bp; Strand=+
atgccgactgtttttatatggacgtcccgtaatattcaacttttttcagtgactcagttcgtggctaatttcgcttcacagtcatatatccggcgtctggcaatcattccaatttactgcgccatggtgaagtccgaaccttgcctcctcatcagattaacggattaa

SEQ ID NO: 2829 - DNA, 285 bp, Xenorhabdus bovienii
  Coding sequence Name=Xb4151_4152.C435.gene218.dna; Position on contig= 177625..177909bp; Strand=-
ttggttccccgacaagcaagtagtggtgggaaaactcaattaggtaaaatcactaaaaatagtaatcgatacttgcgttgtattttaattcatggcgccagagcggccatgcaacgcagaacgttacggcacgatgcactgggtgactggatgcagtctttggttaaccggcggggatttaataaagcgtgtgtcgcttacgccaataaatgcaaatgcgccagaatatgctggtcaatcatggttaataatgacgtgtttcaggtgagcaaggcctttgcctga

SEQ ID NO: 2830 - DNA, 768 bp, Xenorhabdus bovienii
  Coding sequence Name=Xb4151_4152.C435.gene219.dna; Position on contig= 177952..178719bp; Strand=-
atgatgatgaggcttaatgagtttttggcgaaattgattatacccaatcatcatgctgttcagattaccttcacaaaacgtcaacacgccctagcaaaatcgatctttcagctctgtttgctcgacggtaatcacgttgtctttaataaaaaagtgactcgcaatcggctactggatgctgtcagacaaatggaatccgggactttggttgcgatggaggcttgtagcactgcccactattggggacggatggttgggcatcttggctttgaggtttgccttatcccccctcagcacgttaaagccttcgtcaaaaaccataaaaatgatgctaatgacgctctggcaatttgtgaggctgcgaatcggcctgatatgaattttgtgccagtgaaaaacctttctcaacaggacctttgtgctctccatcatgtgcgacagtcattagttcaaaaacgcgttgccacctctaatcaaatcagaggactggcggcagaatatggcatcgtttttccgcaacgctctgctgccctgagacaatcgctgtatgaagcacttgaggatgctagtaatggattaacggtgattgcacgtaggattttgaaacaactttatgaagactggctgatattgctccaacgaacagaggaaatagaagaaaccctcaaattgctatcatcacaaacggcacagtggcagcaattacaatctattcccggcattggttccctaatcacctctgcatttatcgcttatgtcggtgattga

SEQ ID NO: 2831 - DNA, 762 bp, Xenorhabdus bovienii
  Coding sequence Name=Xb4151_4152.C435.gene220.dna; Position on contig= 178718..179479bp; Strand=+
atgctacgaactatgttaacagatcccgtctgggataagctatctgcactaatgcaacacactgggctcgtttatcataaagccgaacatcgtcttatccttgaggggatcctttatcggatgagaacaggtatcccatggcgtgacctgccgttggaatttggtcgatggaatacggtctttgtgcgttttaatgcggggtcaaaaaagggcgttttaaatttgatattcaaagggttatctggacttgctgatagggaatggctatttattgatggcagtattgttcgagcgcatcaacacagtgccggggcagcaacaaatgaagaggaagcgataggcaaaagccgtggcggacgttcaacgaaacttcatttggccgtagacagtcagggtttacccgtccactttgaactgtcaggggggcaaacgcacgacattaagcaggcggaaagtctggtgaataactccccggcatcagattttgtgattgcagataaaggctatgatagtgacgccttcagaaatatcgtcgaacaaacaggggcaacacccgtcattccttatcgaaaaaacagccgaaaatcagaaaagcccatagacaaagggttaaatcgttaccgacatttagtggagaatgcctttgccagaataaaacattttcgggctatagcaacgagatacgataaattagaacgaaattatgccagtatgttagcactggcatttactctcgtttggttaccaatgtgggctgattga

SEQ ID NO: 2832 - DNA, 111 bp, Xenorhabdus bovienii
  Coding sequence Name=Xb4151_4152.C435.gene221.dna; Position on contig= 179562..179672bp; Strand=+
atgctatttcattttggtacaattgacgccatgtgggacgtccatctcatcagattaggttgcgctcagatcatcgatagtgtcatatcgagtcttatttggtacaactaa

SEQ ID NO: 2833 - DNA, 132 bp, Xenorhabdus bovienii
  Coding sequence Name=Xb4151_4152.C435.gene222.dna; Position on contig= 179720..179851bp; Strand=-
atggtgacgggcgaggacgttatattcggcaggtgtattaccagaatattgagggtgaataagttgtattggagcacacaaggtctgcttctctggtcattggaatatgagcaaagcaatcttgaattttag

SEQ ID NO: 2834 - DNA, 918 bp, Xenorhabdus bovienii
  Coding sequence Name=Xb4151_4152.C435.gene223.dna; Position on contig= 179790..180707bp; Strand=-
atggcgcagggatcgacacgttcaaaggttgagcagttcagaaaagcctttatcacgcatgcccgacaggcgggcggaagttttgttacggtggcggatcgtgagcgtatggcccggcagttccttgattatttgaaaaacaatggcatcaaactccggcaaatggatagcctgaaggtgaaatatattgagcgctatatggctgagcgcaaagccaacaatctcagtcaccggacactgcaaaatgaaatgtcggtgctgcgagccattttagcgcaggcgggaaagcataagctggttgatcccgataatgctcgcctgagtaaccgggcattgggtatcgcggataccagccgcaagggaactaaaatggcgctggcaccggctgcgttccgggacatttttcaacaggtggagcaaaaagaccggagtgtcgcggctgtgatgcaactggagtatgtgctgggactgcgtaccaaagaagcggtggaagcctacaaatcgttagcgacctggaagaaagcactggaaaacgggcatacgtctgtgcgggtggtgttcggtactaaaggtggacggtctcgacagacgaccatattggatcgggcagcgctgcaacatgccattgcctatgcggagcaagagcaggcaggacatagcggcaaactgattgataagccgacgatcactcaggccatagaccgttaccgctatattgtcagacgtgcaggactgagcggcaataaagcgccacacagtatgcgttatcattttgctcagcaatccggagagcattatatagcgcaaggattcagtgagcgggaagcgctggcactggtctcgatggatttaggacatggtgacgggcgaggacgttatattcggcaggtgtattaccagaatattgagggtgaataa

SEQ ID NO: 2835 - DNA, 144 bp, Xenorhabdus bovienii
  Coding sequence Name=Xb4151_4152.C435.gene224.dna; Position on contig= 180990..181133bp; Strand=+
atgacgatcgtttatcaatcaaacaacagggtggttaatggtctatttttagtggtttcactgagtaatgcagggttcaaatcggtcgtaaagccagaccggacgtgctctggacgttggccgctttgcggcgtcacttggtaa

SEQ ID NO: 2836 - DNA, 207 bp, Xenorhabdus bovienii
  Coding sequence Name=Xb4151_4152.C435.gene225.dna; Position on contig= 181123..181329bp; Strand=-
gtgttattcacaaccggcttatcacgcaatacgggcagagcattctttgcctcgttccgaaaaacattaacctgcgttttgaacactgacaataaacgtcctgatctctgtacagcgattgcgcgaaaagatcagagggcgtcaatgatttcagcgtccactgttatgcggggtcacttgcgtaacagcgcagagattaccaagtga

SEQ ID NO: 2837 - DNA, 165 bp, Xenorhabdus bovienii
  Coding sequence Name=Xb4151_4152.C435.gene226.dna; Position on contig= 181395..181559bp; Strand=+
atgtaccgcaatcttgctctcccttgcaggctacgagagttttgttttcgccactcagaagaggtgatccttgcaggcgatcagatcacaggtagtcacattcaggatggtagcctttgtatcaggccgggtcaaatgtcccttttatcatctctgacaaactga

SEQ ID NO: 2838 - DNA, 96 bp, Xenorhabdus bovienii
  Coding sequence Name=Xb4151_4152.C435.gene227.dna; Position on contig= 181516..181611bp; Strand=-
ttgcgcttcgacgttgaatgcccagcatacaccttattctctctccgtaagatcagtttgtcagagatgataaaagggacatttgacccggcctga

SEQ ID NO: 2839 - DNA, 423 bp, Xenorhabdus bovienii
  Coding sequence Name=Xb4151_4152.C435.gene228.dna; Position on contig= 181622..182044bp; Strand=-
atgaccaatactgataaaaaggataagagcaaaaaaagtcaaaaacaatccagtcattttattccttataaaaccacatatgatttgcgtttaaataaaagagagcccaatttaatcaacatactgatgcagatccagggttatgaatatggctttttgacggtgttaggtgtccgccctttatcacaacggggtaaccataaaaacagtgccatctatgtcgtgcggtgccggtgtggtaaatacgccgtcaggacgctcaaggcaatcagaaatccggctaatgtgactgacatgtgtgagcattgtcttcacctgtacaacctgaggtgcagaaacctctttctcactgagggaaaagaggttggtttgtcagagttaaccggtattaaatataaaaaaactttagaaattaaagaataa

SEQ ID NO: 2840 - DNA, 228 bp, Xenorhabdus bovienii
  Coding sequence Name=Xb4151_4152.C435.gene229.dna; Position on contig= 182073..182300bp; Strand=-
gtggcaataacggcaatagacatcaactttggccatacttcatccttaaaaagccggaagcatatcacagcaactaaccatttaatacatgacccaatggtcgaacccattgaggcttcgccgtttatgataatgaaaataaacagggccggacccggcttacctattcagtttggttttttcgctattgaattaataatgaaagcagttaaattggaacatctttaa

SEQ ID NO: 2841 - DNA, 375 bp, Xenorhabdus bovienii; identical to SEQ ID NO: 2075
  Coding sequence Name=Xb4151_4152.C435.gene230.dna; Position on contig= 182304..182678bp; Strand=-

SEQ ID NO: 2842 - DNA, 291 bp, Xenorhabdus bovienii; identical to SEQ ID NO: 352
  Coding sequence Name=Xb4151_4152.C435.gene231.dna; Position on contig= 182670..182960bp; Strand=+

SEQ ID NO: 2843 - DNA, 909 bp, Xenorhabdus bovienii
  Coding sequence Name=Xb4151_4152.C435.gene232.dna; Position on contig= 182984..183892bp; Strand=+
atgacccagaaagtgacactggactccatccgggcgttgcaggcggcgatggaggggaagttggataaatcccagagcggggcagacattccgaacaaaccggagtttgtgaaaaaccttggtttggggaatgcgctgaaggtgggcgattatggtgttggctctaataatttgtctaacaaaattgctggctatctttgggatgttggcggaaaccagcccagcggattttatggctactcaccgagctcacacaaagatgaggtgtgggggtcattcataaaattgcgttggaatgatggaaaccaacagtatctggtattccctaactttggcggtaacgccatgagaattgttagattttctggcggtaatagctggtcagattacactgtttggacaacgggcaacgccgactttgacggcaacggttttctcaagaagacctcccccatcatccaaatccaccccgatggcacctttaccactaacgacgaatccgaaggggcaactgtgaccagactcggccttggtcactacaaattatccggtatccttggctataactcagacggtgcatggggtgttcatggcggtatcagtgttccccgtgacgtcaacggcaatgagttagtgtatgtcgatgataaggtgctgccggatggggctattgaaatcagggtgacacaccgacagaatgcacacatgcctgcccggttacagaacaggcgcatcaagtcacaggatgagcagacgcactacaccgatgatgaggcctgtgatttgcccgcagggactcggttagacgttcgtgtccagatgccggaggattctatctggaaccagaagcaggtattggcgcctgatcctcagcaggagtacagcgtcacgtcagtcgtcaataaatag

SEQ ID NO: 2844 - DNA, 390 bp, Xenorhabdus bovienii
  Coding sequence Name=Xb4151_4152.C435.gene233.dna; Position on contig= 183960..184349bp; Strand=-
atgaaaatattattatcgataaagcctgaatttgttgaaaaaatactagaaggcactaagaaatatgaatttaggaaaggaatattcaaaaattcatctgtcaaatcagttgtaatttatgcaaccaagcctgtaggtaaagttgttggtgaatttaatatcgaacatattcttgaagatacgccatcatctttatggcgcataacaaaacagaactcaggtataagtaaaattttttttgatgaatattttaaaagaagaaataaagcattcgcaatacagataggctacgtacagaagtacgattatccaatttcattagatgagcttagtgaacaattaggaaagcgaatcactgcacctcaatcttactgttacctaccaaattaa

SEQ ID NO: 2845 - DNA, 906 bp, Xenorhabdus bovienii
  Coding sequence Name=Xb4151_4152.C435.gene234.dna; Position on contig= 184321..185226bp; Strand=-
atgtatttaaaaatagaacatggaattatagatgatgttaccccgccaatatctttaggaaaacatttaaaaattggaacattcaagtttaatccaaagggaacgctacgcggtcagcgtttcttgaaaaaaatatttgataacgcactctcatatggagttgatgatatttatgttacggtttttgaggagcacaactacttaataagattatttaaattatatggtttcaatgaatgcgcaataaaagaaacggaaaatggaaaagaaattgttttattgaaatgtatgaaagacacatgttcaactggggatgtactttcagattacccatttattctaaacacagataaacaaaataaatttttgttagctatatatccagagttccatactaaccttttccctgattcccgcttaataacggaatcaccagatatattaaaagatatatcacatacaaatagtattaggaaagtatacatatgcggaatgaaaggcgtactatccttaaaaccttatgatattttagtgatttataggacatcggatggaaggtcggcagcttattacaattcagtagtttcatcaatctgcgttgttgaaaatgtacaaaatattactaatttctcatctgaagatgctttcattgattactgtataaaatattctgtatttacaaaagaacagttgcaagcattctacatacataagaaatatccatttataataacgtttacttataacttagcattacctaaaagattaaatagagcctcactcattgaaaatgtaggacttgaccctaacgatcggtggggtatactaagattaaccgatgaacaattccatagaataataactttaagtgaaacagatgaaaatattattatcgataaagcctga

SEQ ID NO: 2846 - DNA, 102 bp, Xenorhabdus bovienii
  Coding sequence Name=Xb4151_4152.C435.gene235.dna; Position on contig= 185217..185318bp; Strand=-
atggatttgttgcatggttttacaagaaatcaaatagttcctctgagcaagcttacgttttgttcaatgaaaatgaaaaaattgatggctttatgtatttaa

SEQ ID NO: 2847 - DNA, 129 bp, Xenorhabdus bovienii
  Coding sequence Name=Xb4151_4152.C435.gene236.dna; Position on contig= 185478..185606bp; Strand=+
atgttgatcagaaaatgcctaatttgtgagattatggacataattaattctcttagagatcaactatacgcaattaacttgaagatgcgggttttaaaatctggaagttatcagtcaaccgagtggtga

SEQ ID NO: 2848 - DNA, 1050 bp, Xenorhabdus bovienii; identical to SEQ ID NO: 483
  Coding sequence Name=Xb4151_4152.C435.gene237.dna; Position on contig= 185551..186600bp; Strand=-

SEQ ID NO: 2849 - DNA, 195 bp, Xenorhabdus bovienii
  Coding sequence Name=Xb4151_4152.C435.gene238.dna; Position on contig= 186578..186772bp; Strand=-
atgtcccctgcatttaataataatggagatgaggtaaggcttgccgtaattctaagggaaaataatgatttggctggagaaataatgttaagactaacgaataaagagtcacaacaaggagaaatatacccgtcgtcattgaagatgcttgatttttcatttgtatcagatcatgattgcgcccatgaaaattaa

SEQ ID NO: 2850 - DNA, 192 bp, Xenorhabdus bovienii; identical to SEQ ID NO: 153
  Coding sequence Name=Xb4151_4152.C436.gene1.dna; Position on contig =1252..1443bp; Strand=-

SEQ ID NO: 2851 - DNA, 666 bp, Xenorhabdus bovienii
  Coding sequence Name=Xb4151_4152.C436.gene2.dna; Position on contig =1497..2162bp; Strand=-
atgactatgaaaaaagagaattctccccaaattttgagtaagaaaattgctgaaacaatacggaataaattggttattggggagttgttaccggggcaacgcttatcagaagccattctcagtgaacagcttgagatttcacgcaatacgttacgtgaagtattccgcgttctaacgcaagaaggattgctgaaacaccaacccaatcgcggtgtatttgtagcgattcccgatattgcatccattattgatatctatcaggttcgacgactgattgaatgtcaggctctcactcaggcatattccatgcaccccagcgttgccaaaatgaaagaggccgtgaccagtgcgcaactatatcggaataaccaaaattgggttggcgtcggcaccgcaaatatgcatttccataccgcaattgtagaattaactgacagtaaaagattgattactttctaccgcaatatctcagcagaacttcgtttggcttttgggcttttgaatgatcctgagctactgtatgccccttatattgataaaaatgcacatatactggagcttttagattctggtcagacagaattagcagctaaaaagatgaaagattatctagagttatcagaaagaacagtattggcggcttatactcgtaaaaataacgaataa

SEQ ID NO: 2852 - DNA, 135 bp, Xenorhabdus bovienii
  Coding sequence Name=Xb4151_4152.C436.gene3.dna; Position on contig =2215..2349bp; Strand=-
gtgataaaagttcaatacagatcactttttcaacatcaattatcaaggaaagtaccaagatgcatcatttcagtgcaatacattccctataataatccaatgtcggtaacttgctggttatcagggaatatgtga

SEQ ID NO: 2853 - DNA, 1251 bp, Xenorhabdus bovienii
  Coding sequence Name=Xb4151_4152.C436.gene4.dna; Position on contig =2509..3759bp; Strand=+
atggcaatacaggaaacagtaaaacaagaaacggttaattttgtggtaaatcggcggtcgtctttaatggccgcggtttttttgatggcaacatcggcgattgggcctggtttcattacgcaaacagcaacatttactgcaacgatgggtgccgcttttgcttttggtattttggcctcgatcctgattgactttgtggtacagcaaaatatttggcgaattgttaccttaaccaagatgcaatcggccgatatcgccaatgcagcgatccccggaagcggttatttattggctgcactagtgatgtttggaggattagttttcaacgttggaaatattgctggcgcagggttggggcttaatgctctgattggtttagaacctaaatggggcggattattaagtgccttgatggcgatttatatttttgcctcgcgtagggctggggttgccattgatcggattattgtcgtattgggcgtagttatgatagggctgactctgtttgttgcgatagtttccaatcctcctgtgggggaggcgttgcggcaaacggttctgcctgatgacatcaattttgcgactattacgacaattgtggggggaacagtcggtggttacatatgctatgccggagcccatcgtttgctggataaaggtatgacaggcgtagagaacattgatgctgtatccagtgcggcaaccaaaggaattttagcagtaggactgatgcgttattttttatttttggcaatattgggagtggttgccagtggtgtcacactcgatattgccagtgaaacggcaaatcctgcttcacaagcttttcaggtcgtagcgggtgaatttgggttgcgtatttttggcttgattctgtggtctgcggcaatcaccagtgttattggtgcggcttatacctctatctcttttgcccgcgtatttaaaaaacagttgactgatcgtcatctcaatataattactctctgttttattaccctctcattagcagtttatttattgataggaacacctccagctgctttgctggtgtttgcaggcggctttaatgggctgattttaccccttggtttgactatctttgtttatgttggctggaaacgggctgatctcatgggaggataccattatccccgctggttactatggtcaggggtcgtcacctgtgtactgacatggtatatgggagcgatgtctattagttcaattttcgcttttctgaaagcagcttaa

SEQ ID NO: 2854 - DNA, 768 bp, Xenorhabdus bovienii
  Coding sequence Name=Xb4151_4152.C436.gene5.dna; Position on contig =3770..4537bp; Strand=+
atgataaaagcaattgatttaaatagtgatcttggtgaaagttttggtcagtggaaaatgggtaatgatgcaaaaatgttgggtattgtcagtagtgcaaacgtcgcttgtggttttcatgctggagatccggtaggtattttgcagacacttaaatctgcaaaggaaaaccaagttgctatcggagcccatatatcttatcccgatttagtcggttttggtcggcgtaatatggatattgccagccacgaattgacagcagatgtgatttatcagattggtgctctgcaaggtttggctctagcagcagggacaagtgttcgttatgtgaaaccgcatggtgcgctgtataacacgatcgctaataatgagcgtcaggcacttgctgttattgaaggcattttggtgattgatcctaaccttgctttagttggattggcaggatcaaacattctccgattggcacaggaaaaaggtttgaaaactatcgccgaagcttttgcggatcgtgcttataccgcagaaggggagctagtttcccgtcgtgaagccggtgcggtgttacacgatgtaaatctcgtcgcacaacgcatgttgcaattggtgactgaaggtggagtagattccatcgatggcaaattcacacctatcaaggcggattccatatgtgtgcatggggatagtccgggggctttggatatggcaaaacaggtaaaaaaagttctgcaacaggcagggattaccattcagtcatttatccacgcataa

SEQ ID NO: 2855 - DNA, 1599 bp, Xenorhabdus bovienii
  Coding sequence Name=Xb4151_4152.C436.gene6.dna; Position on contig =4569..6167bp; Strand=+
ttgcgttttttacttgttaatttcaatacaatacttgttgaactcagtggattgccagaaacattggcgttgtttgattcactgagtattgttccggtattggggattgaagagattatacctgcggcgagaaccctaatgattcgttttcgtccaacgaaaatctcaattcaccaactcgtagcagaaattggccaccgtgacttgcatgagtgcagtcatcctcaaggaaaacagattgaaattccggtgcactataatggtgacgatttagcggaagttgctgaaatactggggtgcacggctcaagacgttatccgccagcataccgaaaacgaatatacagtggcttttagcggatttgcgcctggttttgcttatatggtatcggatatggcacagtggaatattccccgtcggcaaacaccaagaacccgtattcctgcgggtgccgttgcactggcgggagaattcagtggtatttaccctcaggcgagtcccggtggttggcagattatcggcatcacaaccgaacgtatgtgggatctttcccgtcctgatcctgctctattacagccgggttatcgtgtcaattttcgggatgctggacgtgccactgtaacggtaagtttgtcagagacctcacgcaccaatccggtttttcaatctgaaacttctcgctatttagaaatccggagtgtgggattgcaaaccctgtttcaagatttaggacgttttggcaaatcgggattggggatctcagaatccggtgctatggataaaagtgctttgcgaagtgcaaaccgtattgtaggtaattcttccgagcaggcgtgtctggagatagtacagggtggttttaaagcggttgcctgtgggcagatgatggttgctgttacaggtgcgctatgtcctattgagataaaaactccgcagggtgaactcattcatgtaagtgcttacaaacccattgacttaagtgatggtgatgaaattatcttgggaagacctgatgcgggaacgcgttcttatttggccgtgcggggtggttttacgatcccttctgtattatccagtcgctcatttgatacgctatctcatatcgggcctgagccactaaaagccgaagataaattggtcgtgggaacaacgtctcattgcgctgcggtgtctttttctgagacgcttgcttttgtgatgccaaataaaaatgagattgtggtattggatgtgctccttggccctcgcactgactggtttactcaagagtcgattgatttattacgaaaccagatttggcaggtgacgccacaatccaaccggattggcttaagattaaatggtgagtgttcactatcacgcattaagtgccaagaactgcctagcgaaggaacctgtgccggagccattcaaattcctgccagtggtcagcctgtgctgtttctgtctgatcatccattgacaggaggatatcccgtcattgcttctgtggcacattatcatcttgatcttgcaggtcagatcccggtcaacgccaaaattcgatttaatcccatcatacaatttcacgaattatcagggagtgaagacttgcgatga

SEQ ID NO: 2856 - DNA, 1779 bp, Xenorhabdus bovienii
  Coding sequence Name=Xb4151_4152.C436.gene7.dna; Position on contig =6164..7942bp; Strand=+
atgaacactattgtgaacaatgtaaataagaatccaaacaaagtgctgattgccaaccgtggtgagattgccgttcgtattattcgagcctgtcgtgattatggtgtgcagactattgctgtttatgcggatgctgatattaatgctcaacatgtgcaattggcagatgaagcttacggtttatcggggaatagccccgcagcaacctacctcaatattccacgtttattggcgatagcgaagcagtcgggagcaacgatggtgcatcccggatatggattcttgtctgagcgagcggaatttgcccgtgccgttatggacgcaggattgatttggattggccctaatccagaaaccattgatgaacttggcgataaggttaatgctcgtaagattgcccataaagttggtgcgcctttggtagtcggtacgtcagagccagtcaaagatgcacaggaagttgtcgcttttgcagaggaacatggcttgccgatagccattaaagcggcatttggcggagggggacgtgggctgaaagtcgcttggcgactggatgaagtggcagaactttatcactcggcagtacgtgaggcgacagctgcatttggccgtggcgaatgttttatcgaacagtttcttgataagccgcgtcatatagaagcacagattattgcggataaacagggtcatgttgtggtggttggcactcgtgattgctccttacagcgccgcaaccagaaattagtggaagaagccccggcaccatttttgactcaacaacaacgggagcgtattcatcaggcggcaaaagcgatttgtgcggaagccaattatgtgggagcgggtacagttgaattcttactaagcgccgatggaacgctctcttttttagaagtgaatactcgcttacaagtagagcatcctgtcacggaggaaacggcaggtatcgatctcgtgattgagcagttgagaatcgcggaaggtcatccattgagtattcaggagacaccagttccaagaggccactcatttgagtttcgcatcaacgctgaagatgcaggcaaaggtttcctaccgatgtcaggggttatcagcgaatttaccccgccttcggggcccggtattcgtctggattctggcgtgatcagtggctccactattcctgcgaccttggattctctgatggcgaagttgattgtcacaggcacaacccgtgaacaggccatctcgcgcgcacgtcgggcactacgggaattcagaatccgtggtgtggcttctgtgttgccttttcatcaagccgtgatggaacatcctgattttgtttctgatgagatcttcaatgttcatacccgttggattgaaacggattttgcgaatgagattgaagcgttaccacgccagattgtgacagaagataacagcatcacgcgtacatatattgaaattgatggccgcaggcatgagctcgggttgtctgccgatttatttgcgggattttctcatttggcacctgttagggaacagcaatcttcccagtctgcaataaaggaaaaaatgccggcagactctcgtcaggtgaaggcaccgatttccggtattttgcattcttggattgtgaaagaaggtgagcaggttaatgagggcgaactcattgccgtgatggaagccatgaaaatggaggtgcaaattaatgcacaccgtgcagggaaaatcacattctgtgtacaggcgggggattatcaggatgcagaaagcactctggcccatattgaatattga

SEQ ID NO: 2857 - DNA, 234 bp, Xenorhabdus bovienii
  Coding sequence Name=Xb4151_4152.C436.gene8.dna; Position on contig =8003..8236bp; Strand=+
ttggttaagacaatatctcagaaagtagctcgtgaaagcttaggatttccagaattctttgaaggaggggtttatgtcaccaaaaatggtgtttctgaattatttgttcaaacggcgaatgaacgagatgccgaattgcaggaaagagtgcttgagcgtcaggttcatgcactattaaaactcatcaacactgaagcactttatcgtcatcaaatccttcattctctccaataa

SEQ ID NO: 2858 - DNA, 354 bp, Xenorhabdus bovienii
  Coding sequence Name=Xb4151_4152.C436.gene9.dna; Position on contig =8273..8626bp; Strand=-
atgaatcaacgacctaagcgttccgatgaaccgattttctggggtctatttggtgccggcggtatgtggagcgccattgtcgggccggcgatggttctgctgctgggctttctgatcccgttgggactggcaccggaagccctctcttatgatcgtgttctgacattctgtcagagtttcattggccgcatctttttgttgctgatgatcagcctgccgctctggtgcggaatgcaccgtctgcaccacggtatgcacgatctgcaaatccatattccagctagtaaaggggtgttttatggtacagccgctattttgagtgtggttgccttgattggggtgtttacgctgtaa

SEQ ID NO: 2859 - DNA, 414 bp, Xenorhabdus bovienii
  Coding sequence Name=Xb4151_4152.C436.gene10.dna; Position on contig =8643..9056bp; Strand=-
atgagggaggagagagtaatgacgactaaacgtaaaccttatgtgcgcggtatggaatcccattggtggcataaattgagcttctatcgtttttatatgatacgcgaaggcactgccattcctgccatttggttcagcctgctggtgctctatggtctgtttgccctgaaagatggaccagaaagttgggcgggttttgtctcttttctgcaacatccggcggtactggtgattaatatcatcaccttactggcgaccttgctgcatacgaaaacgtggtttgaactggctccgaaagccctcaatatcattgtcaaaaatgaaaaaatgtcgccggagccgattatcaaactattatgggcaatcactatcattgccaccgccgtgattctcggcgttgcactattttactaa

SEQ ID NO: 2860 - DNA, 783 bp, Xenorhabdus bovienii
  Coding sequence Name=Xb4151_4152.C436.gene11.dna; Position on contig =9053..9835bp; Strand=-
atggtggtgaagccgcagcacaagataaacaacagaaggagcaggcgaatggctgagatgaaaaacctgaaaatggaagtcatgcgctataacccggaaatcgacagcgaacctcatttcgtcacctacgaggtgccttatgatgagcaaacctccttgctggatgcgttaggctacattaaggacaatctggctcccgatctgtcttaccgctggtcttgccgcatggcgatctgcggttcctgcggcatgatggtaaaccgagtgccaaaactggcatgcaaaatctttctgcgcgattatccgcaagggatgaaaattgaagcgctcggcaacttccccattgaacgagacttagttgtcgatatgactcactttattgagagtctggaagctatcaagccttatatcattggtaatgatcgcaagcctgctgatggcccgaatgtgcaaacaccggcacaaatggcgaaatatcaccagttttcaggctgcatcaactgcggcctgtgctatgccgcctgcccacaattcggtctgaatcctgaattcattggccctgccgcagtcacgctggcacaccgttataaccttgataaccgtgaccacggcaagaaagaacggatgcctcagatcaacagtgacaatggcgtgtggtcttgtacttttgtcggttactgctctgaagtttgcccaaaacacgtcgatccggcgggtgcaattcagcagagcaaagcggaaagtgccaaagatttccttatctccatgctgaaaccacaatga

SEQ ID NO: 2861 - DNA, 1830 bp, Xenorhabdus bovienii
  Coding sequence Name=Xb4151_4152.C436.gene12.dna; Position on contig =9780..11609bp; Strand=-
ttgaaccacccacttgaacaatggagaagcgcagtgcaaaccttcaatgccgatctagccattatcggagccggtggcgcaggcttacgggcagccatcgctgccgctgaagccaatccccaactcaagattgccctgatctcaaaagtttatcccatgcgcagccacaccgtggccgcagaaggcggatcagccgccgtcactcaatctcatgactcctatgactttcacttcaatgacaccgtgtcgggtggcgactggttatgtgaacaagatgtggttgagtatttcgtcaaacactgcccgacagaaatgatccaactggagcaatggggttgtccctggagccgtaaggaagacggttccgtgaacgtgcgtcgtttcggcggcatgaaaatcgaacggacatggtttgccgcagataaaaccggctttcatatgctccatacgctgttccagacttccctgaaatacccgcaaatacaacgcttcgatgagcactttgtgctcgatattctggtagatgaagggcaggtgcgcggtttggttgcactgaatatgatggaaggaacgaaagttcagatccgcgccaatgcggtcattatggcaacgggcggggcaggacgcgtgtaccgttataataccaatggcggcattgtcacgggagatggcatgggaatggcattccgccacggcataccactgcgtgatatggagtttgtacaatatcacccaaccggcctgccgggttctggtattttgatgacagaaggctgccgtggtgaaggtggcattctggtgaacaaagatggctaccgctatctacaggattatgggatggggccagagacgccccttggtcaacccgaaaacaaatatatggaactggggccaagagacaaagtttctcaggctttctggcatgaatggcaggcaggccgtactatcgcgacgccgcgtggtgatgtggttcatctggatctgcgccatttaggtgagaaaaaactgctcgaacgcttgccattcatctgtgagttggcaaaagcctatgtcggtgttgatccggttaaagaaccaattcctgttcgcccaacggcacattacaccatgggtggaatcgaaactaacccgcagtgtgaaacccgtatcaaaggactgtttgctattggcgaatgcgcttccgtcggcctgcatggggcaaaccgcctcggttccaattcattggcagaactggtggtatttggccgtttggcaggtgaagaagccgtcagacatattcagcaaaccacacctgccaatgaaaacgcgctggatgcacaagcccgtgatatcgaaaataaactcaataagctgctgaatcagaaaggtattgaaagctgggcgaaaatccgtgatgaactgggtatttcaatggaagaaggctgtgggatttaccgtactccagagctgatgcagaaaaccatggataaaattacggaattgaaggaacgcttcaggcatatcgaaatcactgaccgttccagtgtgttcaatactgatctgctctacacaattgaactgggctttggtctggatgtcgctgaatgtatggcgcattctgccatgaaccgcaaagagtcccgtggagcccaccagcgccttgatgcaggttgtacagagcgtgatgatgagaatttcttgaaacatacgctggcgttctataacccagaaggtgcaccacgtttggagtacagtgatgtgaaaatcaccatatctaaacccgcgaagcgggtctatggtggtgaagccgcagcacaagataaacaacagaaggagcaggcgaatggctga

SEQ ID NO: 2862 - DNA, 168 bp, Xenorhabdus bovienii
  Coding sequence Name=Xb4151_4152.C436.gene13.dna; Position on contig =11757..11924bp; Strand=-
atgattttacttatatttataataagaataatttcctatataaataatttaaaaaaccacagaaaagtgatctatatcacattattttggcaaaatcccacaaaacccgcatttatatcaaatttactctctttacaattggctatacttaatccatacaaaaagtaa

SEQ ID NO: 2863 - DNA, 147 bp, Xenorhabdus bovienii
  Coding sequence Name=Xb4151_4152.C436.gene14.dna; Position on contig =12238..12384bp; Strand=+
atgtttactaaaaaattattttttatgtcccgctgttttccacatgaaggacaggggtattctgttcacttttatagtggagaatggcaagtaaaaatgatattcactaatctgatgttgaaaatttgtctagtggacttgatatga

SEQ ID NO: 2864 - DNA, 978 bp, Xenorhabdus bovienii
  Coding sequence Name=Xb4151_4152.C436.gene15.dna; Position on contig =12425..13402bp; Strand=+
atgaatgaagtcacggattggcagccaagtgcccctatcgccaatttattgaaaagggcgaagattcttgcggagatacggcgctttttcgcagatcgtggggtgttggaggttgaaacccctaccatgggtcaggcgaccatcactgacatccatcttgtgcctttccagacacggtttgtcgggccgggagcggcggatggtctgactctgtatctgatgactagccccgaataccacatgaagcgtcttttgacagcaggaagtggttccatttatcagatgggtcgcagtttccgtaatgaggaagcgggtcgccaccataatcctgagttcactatgttggaatggtatcgtccacattacgacatgtatcgcttgatgaatgaagtggatgatctgttgcagcagatcttagagtgcgaaagtgcagaatccctttcttaccagcaggtgttcattcgctatctggagattgacccgcttaccgcgagtaaagaaaaactgcgtgaagtggcagcgaagctcgatctcagcaatatcgctgatcaggaagaagatcgggataccttgttgcaactgcttttcactatgggtgttgaaacgcatatcgggcttgaaaaaccgacatttatttatcacttcccggcttcacaagcgtctttggctgaaatcagcaaggaagatcaccgtgttgcagagcgttttgaagtctatttcaaaggcatggaactggcgaatggctttcgtgaactgactgacagccatgaacagcgcctgcgtttcgtgcaggataatcgtaagcgtgaagcgatgggattgcctgttatgccgattgatgaacgtctgcttaaagcccttgaacacgggatgcctgaatgtgccggagtcgctttgggagtggatcgcctgatcatgcttgcgctgggtgctgaacggatcagtgaagtgattgcctttcctgctgggatttcctga

SEQ ID NO: 2865 - DNA, 144 bp, Xenorhabdus bovienii
  Coding sequence Name=Xb4151_4152.C436.gene16.dna; Position on contig =13377..13520bp; Strand=+
ttgcctttcctgctgggatttcctgacgcgactattagcgtcagaggttttttatccaacgattttattgctgaaggtgcagcttccggctgcacctttattgcccttcacctttcaaattgcagtgcggtggctgcaatttga

SEQ ID NO: 2866 - DNA, 1092 bp, Xenorhabdus bovienii
  Coding sequence Name=Xb4151_4152.C436.gene17.dna; Position on contig =13543..14634bp; Strand=-
atgtggagaactccaatgcaaacccctatcaaagccatcatggcaggtctgctgttagcgtcgtcgatgtccggtattgcacatgcagctgataagattgtgatcgcccatcgtggagccagcggctatctgcctgagcacacactgccagccaaagctatggcctatgcacaaggtgctgattatctggaacaagatctcgttatgacccaagataatgaactcatcgtgctgcatgatcattatcttgaccgcgtaacagatgtggcagagcgctttccaaaccgtgcccgtgctgatggccgttactatgctattgattttaccttgccggaaattaagtccctgagatttaccgaaggttttgatatcgaggggggtaaaaaagtacagagctatcccggacgtttcccaatgggaaaatcagatttcagcattcatacttttcaggaagaaattgagtttattcagggtatgaataaatctactggcaaaaacataggtatctaccctgaaatcaaagccccatggttccaccaccaggaaggtaaagatatcaccgccaaggtactggaagtcctgaaacaatacggctacaccaaaaagagcgataaagtttatctgcaatgctttgatgccaatgaactcaaacgcatcaaaaatgagttggaaccgaaaatgggcatggatctgaaattgatacagctcatcgcttacaccgactggaaagaaacttatgagcagaaacaagatggctcatgggtaaattatagttatgactggatgtttaaaccgggtgccatgaaagaagtggcaaaatatgccgatggcattggccctgattatcacatgctcatcgccaatgactccacaccaaacaacattaagctaacgggtttggtgcaagaagcacacgccagccatcttgccgttcatccatacactatccgtgtcgatcaactgccaaaatatgccaccagcggcaatcagttattcgatatcgttttcgacaaagccaatgttgatggtgctttcaccgatttccctgacttagccgtgaaatttctggaaaaacgccacgaacataaataa

SEQ ID NO: 2867 - DNA, 156 bp, Xenorhabdus bovienii
  Coding sequence Name=Xb4151_4152.C436.gene18.dna; Position on contig =14577..14732bp; Strand=-
ttgaataatcatcatattcttcttgctgttttaaaaaaacaagctaaaaaaataacatcatttttatttaagatttttattactatacattactataaatgtggagaactccaatgcaaacccctatcaaagccatcatggcaggtctgctgttag

SEQ ID NO: 2868 - DNA, 144 bp, Xenorhabdus bovienii
  Coding sequence Name=Xb4151_4152.C436.gene19.dna; Position on contig =15062..15205bp; Strand=+
ttgggtttggcaattaatttttcaagtaaccgcagtatcagaagtagtactgcggtcaattttacgtgttattaccgtttatgtggcggcaatttactggctagctatacgagcgatttcctgcttatgtttattctcgcttaa

SEQ ID NO: 2869 - DNA, 1356 bp, Xenorhabdus bovienii
  Coding sequence Name=Xb4151_4152.C436.gene20.dna; Position on contig =15155..16510bp; Strand=-
atgttaagtatttttagaccggcaccccacaaagcccggctgcccgcgcaagaaatagatccactctaccgtcgctttcgctggcaaattttcatggggatcttctttgggtatgcggcttactatttagtaaggaaaaactttggattggcaatgcctcacctagcggaacaaggtttttccaaaggtgatcttggcttcgctttgtcagggatttcgattgcatacggtatctcaaaatttatcatgggttccgtttctgatcgttccaatccacgtattttcttacctgccggcttgatactcgccgcagcagtgatgctgtttatgggtttcgtgccgtgggcaacttccagcattgccgtcatgtttgttctgctatttctgtgtggctggtttcagggcatgggttggcctccctgcggccgtactatggttcattggtggtcacagaaagagcgtggtgggatcgtttctatctggaactgtgcacataacgttggtggcggcttgcctccgttactgttcatgctgggtatggcgtggttccaggactggaaagccgcattttatatgcctgcatttgccgccatccttgtcgcaattatcgtattttccttgatgcgcgatactccacaatcctgtggtttaccgccgatagaagagtataaaaacgattatccgcctgactatacggacaaaaatgaaaaggaattgactgcaaaagagatttttttgcaatacattctgcctaacaaattgctgtggatgatcgcaattgccaacgtattcgtttatctgctgcgctacggtatcctcgactggtcaccaacctacctgaaagaagtaaagcactttgctatggataaatcgtcctgggcttacttcctctacgaatatgcgggtattcccggtacgctgctatgtggatggatgtctgacaaagtgttcagaggcaaccgtggtgccaccggcgtattctttatgacactggtgactatcgccaccatcgtattctggttgaacccggcgggtaacccaaatattgatatgatctgtatgctggttatcggcttcctgatttacggaccagtgatgctgattggcctgcacgctcttgaactggcaccgaaaaaagcggcgggaacagcggcaggctttaccggtttgtttggctacctcggtggttcggttgcggccagtatcattgtcggttataccgttgacttcttcggttgggacggcggatttatggtcatgatcggcggcagtgccctgtccgtcgttctactgttgtttgtcatgttaagcgagaataaacataagcaggaaatcgctcgtatagctagccagtaa

SEQ ID NO: 2870 - DNA, 93 bp, Xenorhabdus bovienii
  Coding sequence Name=Xb4151_4152.C436.gene21.dna; Position on contig =16523..16615bp; Strand=+
atgacttttggtgttagcgaattaccatctctgagcgatgatgatgttaaacgaagaattttcattaactattttctatatagaaggaaataa

SEQ ID NO: 2871 - DNA, 99 bp, Xenorhabdus bovienii
  Coding sequence Name=Xb4151_4152.C436.gene22.dna; Position on contig =17273..17371bp; Strand=+
atgaaattttatgcaatttatttttacgattcagttgaatgtcgacataaggtatttgcaatatctgaatataggcgaaaactgaatattaatgactaa

SEQ ID NO: 2872 - DNA, 144 bp, Xenorhabdus bovienii
  Coding sequence Name=Xb4151_4152.C436.gene23.dna; Position on contig =17368..17511bp; Strand=-
ttgtcatcgggtgaaaatgtttgctcagtgaatgctgtgtgtaatattgccttgtgtgtgtgtgtattcataatgatgttctctttctgtcttccattttatttcatcactttttatgatgaatggagacatcaatgctgttag

SEQ ID NO: 2873 - DNA, 3237 bp, Xenorhabdus bovienii
  Coding sequence Name=Xb4151_4152.C436.gene24.dna; Position on contig =17441..20677bp; Strand=+
atgaatacacacacacacaaggcaatattacacacagcattcactgagcaaacattttcacccgatgacaatattaacagtagtaatatcagtcataggatagcagcacttgaaccatggtttgataacgtgccatctcgcttggcaaaactggcgaaaacgataccgaatgacattgcggtttctgatccctatgaaaccctggtatttggtgaattacagcagcgtgttgaaaatgcagcaaatattttgcatcagtacggtgttaaaatggggagcaacgttgctattgctgccgaacggggaattccatggtttgttactatgctggcggtttggcgaattggggcggtttatattccccttaatacgatgatgccagaaaaacgtctgaatgatattctcgccagcctgtcggaaagtgttctcgtatcggatgatacggtatctgcggggctgaaggcatcaacattaatccctttgcacgcccttctgaataatacccgtgaaataattaatgatgaaataacagaaaacatcgatatgcctgcattgggtgatcacccggcttatgtgatgttcacttctggctctactgggttgccaaaagcggtacaggtgcagcatgacaatctggctgcctgtctgtgtgcattcggcaagttactgtcagtcaatcagcatgattgtatgctcaccctgacgaccttttcttttgatatctcattaatggaattactactgactgtcgttcatggcggcagtatctacattacatcaatcgatactcagcgtgatgcgatggcgttgtcgcaaatactgtctgatccccaattcacctttgcacaagcgacacctgttacttggttaatggccttgaatgctggctggaaacctcgttcagagttgagcatgctttgtgggggagaggcgttgtcacaggatttggccgatcaattaacggcatccggtggcactttatggaatctctatggcccaaccgaaaccactatctggtcaacagcatttcgcatgagaaaaggagataaggttcaattgggtgggccgatccccggcacaaccatcacaattgtagacaaatacttgcgaccggtgccgaaaggaacggtgggtgaaatccttattggtgggcttggggtgacggctggatatcgcaataacccgaccgaaacggctaaacgatatgtacccgatatgacacaaagaggtaaaagagcgtatttgaccggagatatggcacgtatgcttgaagatggctctctcatttatatgggaaggcaggatgatcaggtaaaagtgcgtggatatcgaatcgagttgggtgagattgaaaccgcattaagaaaacaaaatggcgtacaggatgcgattattcgtgttatcggcagtggcgatcttgccaaaattcaggcgtttgtactgttcgatcccaatagggttgtatccgaagattgggtacatgaaacccagatttcactcagggaagttctgcacgaagcctggatacctgccgaatattatcgtatcccttacatcccactgacgagcagtggcaaacgtgatagaaaacggttagacgaagtcgcagaacggttgaatgccagctatgacgttgtactgcctcaaacagaaactgaaaaacaggtttatgcaatttggcgtgacctgctggcgacagacgtattaggtgtcaccgataatttctttcaggttggggggcattctattttggttgcccgcatggtggaacggattgaaaaagccttttcactccggataccgatttcaggtatctatgttgaacctacggttgccagaatctcgtctattctggatgaaatgatagaagcgtatcaggcaaatccggctaatgccgggggagtctaccacagtgaggcgttaattcagcaacatgcagaaacgctcagaaaagatgtctacctgaaagaaagcgtgtgccctgatggcctgcctcatgcgaactggtatcagccggatacggtattgctcaccggcgctacgggatatcttggtctgcatttgctggaacaattgctgaaacagactgcggccagaattatctgtttgtgccgtgactctgatgaagaacacgcccgagacagaatcaaggccgggtttgacaagtaccagattgatgttgttaacggacttgagcgcgtagatgtcattatcggagatttggggcagccacgctttggcttgttaccggaaacatgggcacagctcgctgaaaacgttgatgtgatttatcacaacggggcgttggttaactttatctatccttatagcgcactgaaaagcattaatgtcgatggaacccgaaccgcgctggaatttgcctgcacagcacgactgaaacatttccattatgtctcttccgtgaatgccctgtttgccacagaatcaccccgtccatttatggaagatgatcgtactatgagcgaatcggtacgggatccttctggttactcaggcagtaagtgggtatctgaagggatcattaatattgcccgtaagcgaggtgtacctgtcagtatttatcgtccgggtctgatccttgggcatactctcacaggagccgcacaaggcaatgattatctcgttgcttccctgaaaggttatctggcaatgggcttttaccctgaacatggattgctgcttgatattgtaccggttgattatgtcgctgcatcgttggttcatatctccagtcaaccggaatccgatggtaaattctttaatttgtttaatccggttcaagtctcgatccggcaatttttcgattgggtacaggagtttggctatgtgctcaacccaatccccttcaatgagggtaaagagaagatccttgcactggatgatactcacccattgtacccattgatcccgttgattagggacatgacagagaaaccttatcgcgcgttagatccggcttatgttcatgaaattcacccagaactggagttgaagcaaacgctggcattattggccaacactgacattaaatgccccgtcattacggccggatatgtccatcaagtattgcaatatttgatagatacaggtttcttacccgcagcactgccagaaaacttcaagccggaggcctatcttggaacagctaacaggaaacgaagccatgaattggatagtcgtcgtgaacagcagaaaaaagtattcggtctggcctga

SEQ ID NO: 2874 - DNA, 156 bp, Xenorhabdus bovienii
  Coding sequence Name=Xb4151_4152.C436.gene25.dna; Position on contig =20625..20780bp; Strand=+
atgaattggatagtcgtcgtgaacagcagaaaaaagtattcggtctggcctgaggcctatgtgcttccagtcggatgggtggccgtcgggatgacaggttctaaagaagaatgcctcaatcatattgccggtatttggccgaagccaacaaactag

SEQ ID NO: 2875 - DNA, 135 bp, Xenorhabdus bovienii
  Coding sequence Name=Xb4151_4152.C436.gene26.dna; Position on contig =20846..20980bp; Strand=+
atgccttttatttttcttccactctatgtgtgctttgaattcgtttttgttccttatcaaacaacaactgtagattttaaatatattttgccattgaaacagactccgcttataccccgtccttcagttagctaa

SEQ ID NO: 2876 - DNA, 1101 bp, Xenorhabdus bovienii
  Coding sequence Name=Xb4151_4152.C436.gene27.dna; Position on contig =21043..22143bp; Strand=-
atgctgaaagtgatccagtctccatccaaatatatccaagggccaggtgcgttatctcacatcggccaatacaccaaaatacttgctgatcacgtttttgtgattgccgataatttcgtaatgagcctcattggagatgccgttagcaaaagtctggaagcacacgcagtcaccagccattttgagatcttcaacggtgaatgtagccgtggcgaaatcaaacgcctgtcagacatttcagcgagtcaccaatgtcaggccgtaattgggatcgggggcggcaagactcttgataccgccaaagctatagcgcatgcatgcaggctacctgtaataatttcccctaccatcgcttccacagatgccccaaccagtgccctttccgttctgtataccgagctgggtgaatttgatggctacctgctgtatccacaaaaccctaatatcgtactgatggacacccgtattattgccaaagcaccggttcgtctgcttgtggcaggaatgggagatgcgcttgccacctattttgaagcccgggcaaatagcgctgctcataaaccaacaatggcggggggtgcaacatccaatactgggctggctctggccaaactgtgttacgacaccttactggcagaaggttataaggcaaaactcgcggtggaagcgggtgtcagtactccggcagtggaaaatatcattgaggcgaatacttatctcagtggtatcggttttgaaagtgcaggacttgccgctgcccacgccattcacaatggcttcaccgtgctggaggaatgtcatcatctctatcacggagaaaaagtggcgttcggcacactggcacaattgatgctggaaaacagcccgaatgaagagttggaaaccgtgctcgatttctgtgttcaagtcggtcttcctgtcactctggagcaactcggcttgcgggacagtgagaaattgcaccagaaaatcatggaagttgccaaggccagttgtgccgaaggtgaaactattcacaatatgccgtttaaagtcaccccagaacaggtctatgcagcaataatggccgcagatcgcatgggcatggattggctgtattaa

SEQ ID NO: 2877 - DNA, 669 bp, Xenorhabdus bovienii
  Coding sequence Name=Xb4151_4152.C436.gene28.dna; Position on contig =22367..23035bp; Strand=-
atgtttcatttgaccacgcagcagaaagccacggcgttgatctggctttcgcttttccacattttgatcattacttccagtaactatctggtgcaattgcctgtctccatttttggttttcataccacttggggagcattcacatttccttttatctttttggcaaccgatctgactgtacgcatttatggtgcaccattggcacgtaagatcatcctcacggttatgctgccagcgctgctgatttcctatttcatttctgctctattttttcaaggaacgtggcagggattcgggacattaggaacctttaatctgtttgttgcccgtattgcagccgcgagctttatgggttatgtccttggtcagatattggatgtgggagttttcaatcgcctgcgtcagaaacgccgctggtggatagcaccgactgccgccatgttttttggtaatttgctcgatacactggcatttttctttatcgcattttatcgcagcagcgatgcattcatggcgacgcactgggtagagattgctctggtggattacgctttcaagctgttcatctgtatgcttttcttcctgccagcttatggtgtccttttgaatttaatcctgaaattttctttctctcattcaacagataaaactctggtcaaaaatcattga

SEQ ID NO: 2878 - DNA, 417 bp, Xenorhabdus bovienii
  Coding sequence Name=Xb4151_4152.C436.gene29.dna; Position on contig =23050..23466bp; Strand=+
atgaatggggtaagggaacccaaaaaaacaaactttctttgcctgaatgatcaggtgaaacgcatcatacgcgcgttgcgcaacaaaagcaaagtgcggcagttgatgatattttgtaatataatccatcgccatagtgtgtttgaacctacagagattgttatgtccaatgtttttgctaaccctgacaaaacgcttgatacgcaggggttacgctgtcctgagccagtgatgatgatacgtaagatcgttcgccatatggatgctggccagacactattgatcattgctgatgatccggcgacgacccgtgatattccgggtttttgccgttttatggagcacgccttgattgctcaggagacagggcaaactccttatcggtatttgatcaaaaaaaacgaaaatgtagcttag

SEQ ID NO: 2879 - DNA, 2289 bp, Xenorhabdus bovienii
  Coding sequence Name=Xb4151_4152.C436.gene30.dna; Position on contig =23680..25968bp; Strand=-
atgttctccatattcaaaaaacataagcaatcacagcacggctctttgtctcacaaaaataaagaccataaacattcccacggcgttcatggcaaagaagataaaagttcacacaacgcccatgaacatgatcgaggacactgttcacacgaccatgcccctaccatacaggatacaacccctcttgaattaaccgccaaccagcgttttaactggataatccacggcatggattgcccaagctgtgcaggcaaaatcgaaaatgcggttaaaaaattgcctgaagctaaacaggtcagggtgctgtttactacggaaaaactggtggtcgatgctgattctgatattcgcgcagccgtcgaacaagcggtaaaacaggcgggttttgaaatcaagcaaacggattcgacgattagattgcctccagcagcaaatcactggaaaaccttttccccaattctcattcttatagcattaatggtcatcagttggggcattacaaaaataaatccacccgctggacagattgcattcattgttaccacgttgattgggttatacccggtcgccaccaaagccatcaaactgatccgttcaggaactccctttgccattgaaaccttgatgagtgtcgccgctatcggtgccctattcattgatgccaccgcagaggcagcaatggttattctgctgttcaaagtgggagaagtactggaatcttatgccgcagggcgtgcccgccgtggtgtcagtgccttgatggctctggttcctgaacaggcgctgcgggtgacaggaggagaaaagaaaaccgttccggctgctgacctgcgtccgggggatattattgaaattgcgccgggtgcccgtttacctaccgatgccgaactactcagtccgttcgccagttttgatgaaagtgctctgacaggtgaatctattccagttgaacgccagcagggagaaaaagttgctgcgggctgcctctctgtcgatagcgcagtgcaaatgagagtgttctctgaaccgggacacaatgccatcgaccgcattcttcaactgatagaagaagcggaagagcgccgtgctcccattgagcgcttcatcgatcgattcagccgtatttatacaccgctgattatcttgttctctgtactggtcgtagtaatccctcccctcctccttgccgagccttgggaaacttggatctatcgtggattgaccctgctattaatcggctgcccctgtgcgctggttatctcaacacccgccgcgatcacttctgcactggcggcagcgacccgtcgtggtgctttaatcaaaggcggagcggcattggagcagctcggttcagttaccaccattgcgttggataaaaccggcacactgaccgaaggaaaaccccgggtcacggaaatagaacccgtggaaaacatcagcgtagaaacactgctggcgctggcaggagcggtcgaaagtggctcgcaccacccattggcaaaagctatcctcaacgcggcagaaaataaaggtgtgacggttgtcgaagctgaacaccgtaaagcgttggctgggatcggggttgaagggcgattgtcagggcagaaaattctggtcgcggctccggggcgactgccggaaaacacgttatccaccgcatggaaacaaagggtcacagagctggaaagcaacggtaaaacggcggttgccgtggtacagggtgagcaatttgtgggtttgattgccatgcaggacaccttgcgtcaggatgccatagacgcaatccgcgccctgaaaaaacaaggcgtcaatgctgtgatgctgactggcgataaccctcgtgctgcggccgctattgcagctcaattggggatcgattatcgcgcgggtctgttgccggaagacaaggtaaaagccgtcactgagctaaatgaaaaacaccataccatgatggtcggtgatggcatcaacgatgcccctgccatgaaagcggccagtatcggtgtcgccatggggagtggtactgatgttgcgctggaaacagcggacgccgccttaacacacaatcgactgaccggtttgcctgaaatgatcgctctgtcccggacaacgcactataacatccgccagaatatcaccattgcgttaggcttgaaggcgatattccttattaccagtctattggggatcacgggtctgtggatggccgtgctggctgattcaggtgccacggcgctggttacagcgaacgccatccggctgctacgggttaagtcacaaaaacgatga

SEQ ID NO: 2880 - DNA, 144 bp, Xenorhabdus bovienii
  Coding sequence Name=Xb4151_4152.C436.gene31.dna; Position on contig =25945..26088bp; Strand=+
atgttttttgaatatggagaacataggcggcctctcaatagagttaattcaaatgggttacagttcactctacactctggagtaagctccagagtcaaacttaaaacaatgaatttttttgatgatttgtgctttttgaaatga

SEQ ID NO: 2881 - DNA, 270 bp, Xenorhabdus bovienii
  Coding sequence Name=Xb4151_4152.C436.gene32.dna; Position on contig =26211..26480bp; Strand=-
atgtttattcaattaggaaaagttatcatggttctcgtttggggaattatgattttcaatttgatccatccctttcctaaaccattgagatattttatggatatcgccatggttttcacagtgataatgcatgccttccaacttttactattaaaaaactcccaacccaaagatcaaaagttttctgtttttcttcagaccaagatcttcttttttggtgtgtttgagttacttacttggcaaaaaaaacagcgtcaagataaaaaataa

SEQ ID NO: 2882 - DNA, 600 bp, Xenorhabdus bovienii
  Coding sequence Name=Xb4151_4152.C436.gene33.dna; Position on contig =26501..27100bp; Strand=-
atgactaaaaaatcacagagtgcgtctttgggacaaatccgcattattggcggaaaatggcgcgggagaaaattacccgttcctgatagtgaggggctacgtccgacgactgatcgtgtccgtgagacactctttaactggctgatgcccatcattcaggaagctcgctgcctggattgcttctccggcagcggagcacttgggattgaagccttatcgcgcaacgcaagtcacgcgaccttgcttgaatatgatcgtcatgtagcaaaacaattatcagccaatttagccttacttaaggccgaaaatgctaatgtggtacagggaaacaccctgcaatatctcaaccagacaggtacaccttttgatgtggtttttctcgatcccccatttcgcaaggggatgcttgttgaaacaatcaacttactggaagccaacggttggctggctgaagagagttggatttatgttgaagcggaatcagaatctactgcaacagaagcccccgcaaactggcaattacatcgggaaaaaattgccggccaagttgcttaccgactgtatatccgccgccagcagtctggcgacagatctgcttaa

SEQ ID NO: 2883 - DNA, 120 bp, Xenorhabdus bovienii
  Coding sequence Name=Xb4151_4152.C436.gene34.dna; Position on contig =27093..27212bp; Strand=-
atgtgtggatttcgtggtaaattaatcaatatgtttcttcattctcattttttgtatccgccgtctattatgcaaatagcatcggatgacaaatgcttaaactatataaattatgactaa

SEQ ID NO: 2884 - DNA, 162 bp, Xenorhabdus bovienii
  Coding sequence Name=Xb4151_4152.C436.gene35.dna; Position on contig =27184..27345bp; Strand=+
ttgattaatttaccacgaaatccacacatagatatgtgttgtgatgtgatgaaaatgttagactggattttatcaccgttagaacctatcgcagcaggcgtagtggttgaaaaacaaagcgtctgcggcgataggtttttagcttatcctaataagtattaa

SEQ ID NO: 2885 - DNA, 1398 bp, Xenorhabdus bovienii
  Coding sequence Name=Xb4151_4152.C436.gene36.dna; Position on contig =27430..28827bp; Strand=+
atggcagaagagcaaaaaaaaggtttcttctcttggtttggacgtggtcgtcaggaaaagaaacagcaagaagaacaacttgaacaagacaaatcagcggcggaagaagcggagcagcaacgtttagccgaagaagccgcccgtcgcgcagcggaagaagcggagcagcagcgtttagccgaagaagccgcccgtcgcgcagcggaagaagcggagcagcagcgtttagccgaagaagccgcccgtcgcgcagcggaagaagcagagcagcagcgtttagccgaagaagccgcccgtcgcgcagcggaagaagcagagcagcagcgtttagccgaagaagccgcccaccacgcagcggaagaagcggagcagcagcgtttagccgaagaagccgcccgtcgcgcagcggaagaagcggagcagcagcgcctaatagaagaatcatccatattacccaaagagcaggatcgtccgagcaaagaaggcttttttgcgcgtttgaaacgtagtttggtgaaaacccgccagaatctgggttccggatttttagggttattcagcggcaagaaaattgatgatgatctgtttgaagaattggaagaacagttactggttgcggatgttggtgtcgaaactacccgtaagatcattaacaatttaaccgctcatgccagccgcaaagaattaaaagatgcggaagcgttatacacgaaactgaaagaagaaatgtcagatattctggcaaaagttgataagccactggatatagaaggtaaatcaccttatgtcatcctgatggtgggtgtgaatggtgttggtaagacgacaaccatcggtaaattggcgcgtcagtaccagtctcagggcaaatccgtcatgttagcggcgggagataccttccgtgcggcagcagtggaacaattgcaggtctggggagaacgcaacaaaatcccggtaattgcacagcataccggcgcagatccggcctcagtcatttttgatgcgatccaatctgccaaagcgaaaggcgttgatattctgatcgctgataccgcagggcgcttgcagaataaatcccatctgatggaagaactgaaaaaaattgtccgtgtgatgagaaagctggatgaagagaccccgcatgaaattatgctgactctggatgcctgcacaggccaaaatgcggtcagtcaggctaaactctttcatgaagcggttggattgacggggatctcactgaccaaactggatggtactgccaaagggggagttatcttcgctattgccgaccaatttgatatccctattcgttacatcggtgttggggaaggcattgaagatctccgtccatttaaggctgacgattttatagaggctctttttgcccgagaggattaa

SEQ ID NO: 2886 - DNA, 666 bp, Xenorhabdus bovienii
  Coding sequence Name=Xb4151_4152.C436.gene37.dna; Position on contig =28834..29499bp; Strand=+
atgattcgctttgaacaggtcagtaaagcctatctgggagggcggcaagcgctgcaaggggtggattttcatctgcttccaggggaaatggcattcttaaccggtcattcaggagcgggtaaaagcacgctgttgaaacttatctgcggtatagaacgcccaagtgcaggccatatttggtttggggggcatgacatcagccgattaaaaacccgtgaaaccccttttcttcgtcgtcagatcggcatgatttttcaggatcatcatctcctgctggatcgcacggtttacgagaacgttgctatgccgctgatcatctcaggggcaagcgccgaggatattcgccgacgggtatctgcggcgttggataaggtaggcttgctggacaaagcgaaaaattttcccattcagctttctgggggggagcagcagcgtgttggtattgcccgcgctgttgtaaacaaacccaccgtcctgctggcggatgaacccacaggaaatctggatggggaactgtctgaggggatcatgcgcctgtttgaagagtttaaccgcgttggtgtgacggttctgatggcgacgcatgacgtagctctcatagaacgaagaaattaccgtatcctgacgttgaatcaggggcgtatgcaaggaggacatcatggttaa

SEQ ID NO: 2887 - DNA, 981 bp, Xenorhabdus bovienii
  Coding sequence Name=Xb4151_4152.C436.gene38.dna; Position on contig =29492..30472bp; Strand=+
atggttaaaaatgtccgtcattcagcgaaaaaaatgacaccgcctaaacccaagtccaagtcactgaaagggggctggcgcgtacagcagcgttacgcgtggaaaagcaccttgtcagatatgctgcgccagccgctggcgacgttgctgactatcatggtaattgccatctcattgaccttaccgagcgtgttttacattgtctggaaaaatgtcaaccaagcggtggagcagtggtatcccgttccgcaacttacggtctatctggataaatccttgaacgacggcggcgccagacaggtgattgagcagttgaaagtcattgatggtgtgaaatcggtgaattacctgtcccgtgaagaagccgagaatgaatttcgtgcatggtctggctttgccggtgctttaaatcttctggaagaaaacccgctacccgcggtcgcgattatttcccctcaaatggattttcaagattcgacggtattaacaacattgcgtgatcgggtttcccagatcaaaggtattgaagaagtcagaatggatgagagctggtttacccgcctcactgccttagcaaaccttattggccagattgctgctgtaataggtattttgatggtggttgcgctgcttttggttattggtaacagcgttcgtctcagtatctttagtcgccgcgaaactatcaatgtcatgaaactgattggcgcaacagatggctttattctgcgtcccttcctcaatggtggcgtattgctggggggattaggcgcgattttttctctgatcctttcatcgttactggtttggaaactttccaatgtcgttacggacgttgcaggtgtttttggtactacctttaaattgtacggtttgggatgggatgaatccctgttgctggtactgatttcgggcatgataggctggcttgcggcatggtttgcgactattcagcatttacgccgtttcaggccggaatga

SEQ ID NO: 2888 - DNA, 192 bp, Xenorhabdus bovienii
  Coding sequence Name=Xb4151_4152.C436.gene39.dna; Position on contig =30420..30611bp; Strand=+
ttgcggcatggtttgcgactattcagcatttacgccgtttcaggccggaatgagtccatttgttggtcttcaggtgaacttttgggctgcattacggtcgaagaaattgtggtcgaaagtacagttagcaatttgtatccatattcataccatttagatgatttgaatatgagctctatgatggtaaaatag

SEQ ID NO: 2889 - DNA, 858 bp, Xenorhabdus bovienii
  Coding sequence Name=Xb4151_4152.C436.gene40.dna; Position on contig =30700..31557bp; Strand=+
atgacaaaagaaatgcaaactttggcactagttccacaaggtagtttggaaggatacgtccgtgcctccaatgcttatcctatgctctccgcagaagaagagaaagaactggcagaaaggctgcattaccagggagatctggatgcagcgaaaaagctgattctgtctcacttgcgcttcgttgttcatgtcgctcgcagttattctggctatggtctgccacaggcggatttaattcaggaaggcaacattggcctgatgaaagcggttcgtcgatttaatccagaagtaggcgttcgtctagtttcgtttgctgttcactggatcaaggcagaaatccatgaatatgtactgcgtaattggcgcattgtgaaagtcgcaacgacaaaagctcagcgtaaactgttttttaatttgcgtaaggctaaacaacgtctggggtggtttaatcaggatgaagttgatttggttgccaaagaattaggggtgaccagcaaggacgtccgagagatggaatcccgcatgtcggcgcaggatatggcgtttgatatgtcctctaatgatgacagtcatgacagccagccagtggctccggtgctctacttgcaggacaaggcttctgactttgccgatggtattgaagaagacaattgggaaaaccacgctgcggataaactttctatggcgatagaagggctggatgagcgtagccaggacattatccgcgcccgttggctggatgatgacaacaaatccaccttgcaggaactggcggataagtatggtgtatcggccgagcgtgttcgacagctagaaaagaacgcaatgaagaaattgcggctggcgattgaagcgtaa

SEQ ID NO: 2890 - DNA, 1224 bp, Xenorhabdus bovienii
  Coding sequence Name=Xb4151_4152.C436.gene41.dna; Position on contig =31632..32855bp; Strand=+
atgggtttcctcatatcttcagtctccacttcaatctttggtgtaggtgttgctggccagaagcatcagagcatagaggacattgctatgaaaatcgtaattgctcctgattcatttaaggaaagcctgagcgccttgcaagtagcggaggcgatagagcaggggtttcgggaaatctttccacaggcagcttatatcaaattgccaatggcggatggcggcgaaggtacggtggaatctctggtggctgcaacgggcgggcagataatttcatgttcagtaaccgaccccttggggcagccggttgatgctttctttggtttgctgggggatgggaaaaccgccgtcattgaaatggccgccgcttctggcttacatcttgtgccgatggaacagcgcaatcctttgataacgacaagttacggtaccggagaactcattctggcagcgctggaacacggtgcgcagaaactgattttgggtattggcggtagtgcgaccaacgacggtggtgcaggaatgatgcaggcactgggtgcgcagctctgggatggtgattgccgtattctgccattggggggggcggcactaacccgattggaaagcatcgacctttctggtcttgatccacgtcttagtcagcttgagatcactgtagcctgtgacgtgaagaactcattatgtggtgaatcaggggcatcagcgatatttggcccacaaaaaggggcgacaccggaaatggtcaaagcgttggattcggcattgcaccattatgggatgaaaattgaatcactgacggacaaaaaagtgattgatgttgcgggaacaggcgctgcgggaggtatgggcgcttccctgttaggttgtttgggcgcgaaattgcagtcgggtattgagattgtcattaataccctgaaactggaagaggccattcagggggcggatttggtgattacgggtgaaggtcgtatggatagccagaccatacagggcaaaacaccgattggagttgcccgtgtcgccaaaaagtttggtattcccaccatcgctttggttgggggaatgagctgtgattaccatgttgtgcatcagcacgggctggatgcagtcttttccattgtaccgggtgcttgctctctttccgatgcccttgccaatagtactgataacttacgggtaacggcacgtaatgttgcttcggtctggcgtatggcttattcgtaa

SEQ ID NO: 2891 - DNA, 402 bp, Xenorhabdus bovienii
  Coding sequence Name=Xb4151_4152.C436.gene42.dna; Position on contig =32846..33247bp; Strand=-
atgaagttaacaattaaaccaataagtgttttatcccagcaggataagattgatttgaaaaaaatttggccggaacaagatacgcaggagtgggaagtgctgttagcaggtgatcaaaaactgtttgtagcacaatttaacggccgattgcttgccgcggttaaagtgacgctcaattcatcaacaggaatactggaagatttttgtgtacgggaagtgacccgtcggcgtggcgttggggcttatctgctggagcaggtcaaggccgcattcccggagatcaaccgttgggaatggagcctgaatcattttcctgatatccacgctccagcgttgcgggattttatggatgcctgcgatttccgctatgatgcacaaaataatgcctattattacgaataa

SEQ ID NO: 2892 - DNA, 123 bp, Xenorhabdus bovienii
  Coding sequence Name=Xb4151_4152.C436.gene43.dna; Position on contig =33351..33473bp; Strand=-
atgcgttcaccattaaaagctttagagcggtactgctccccacggaaggaacccgtgccaaagcagattttgttcaaagaatggtatgatgtgctactgatatgcagtgggattaatttttaa

SEQ ID NO: 2893 - DNA, 93 bp, Xenorhabdus bovienii
  Coding sequence Name=Xb4151_4152.C436.gene44.dna; Position on contig =33523..33615bp; Strand=-
atgcttaatatatacgttgccgagggtatgtcaaacccaaaaaaagcctatatattgtgtctttattcccctttattcatcgcaaaatattag

SEQ ID NO: 2894 - DNA, 1788 bp, Xenorhabdus bovienii
  Coding sequence Name=Xb4151_4152.C436.gene45.dna; Position on contig =33742..35529bp; Strand=+
gtggtcattctcacaacatgccgctttaaggaaaaggagtcagttgtgaaatcgtttgaatattattatcagcaggaatttgattatttaagacaactagcaaaaattgtgagtgaagaaaaaccgcaccttcgtgatgtactgggtggtggggatcctgatgtcgaaagactttttgagggtgcttctgtattaacggcgcgcctgaagcacaacatcgaggatggctttcctgaactgacgcggccattgttgcaaaaattacgtgcccagccgctgaaaggccttcctgcaaccagcattatccagttcgacagtcatggacagggagattccgatttttccatcccggcaggaaccgaggtttataccgaggccggtcagccatttgtgatgtgtcgtccgtgcccgattgcccccctgacattggtttcccgtgaaatcatacatcagatacaggcgaccaaaatcatcctgaaatttcgttacaccggtaaagacgcggagtggcagaccagaccgataagcctgttcctgagcagtgacgagccagtcgccgatatactgatgctggggcttatgcagtattacaccgataccgagctgcaccacaacggccaggtttataaagcgcagggagagcggtttgaagcccgttccggtgcatcccgtctgacactatcatcggccaaagatgacaattgggcaccccagttgctcatagaatcgctctatctgccccatatcaaccagtttgtggatttacccctgccagtaatggcgaaacaactcaaactggcggaacatcgcgaattcagtgtggaattgacattaaatacgctactgccgttatcggcggaacaaatcgaatcggcatttcagctacattgtgtccctgttgtcaacatgaagcgcaactgtcaggtcacactgccttttgccgccgaaaccgcccgttatcctctgccgctggcactcaatcagggaattttgcatatcgctggcattgagttgaaaaatgagccgggcagtgaagaagagcaccgtgggggtgagtatctgttctatccggcaagcctgttgaccggcatggagcgttaccactcggaatatgataacgccggcttctacgggcttgaaaccgcccatgatgaatggaatggagtccgctatcaggtagtgttctatgacagtgaaggaaaattaatgcataaaccgcctgagcgcgaatttatctgtcatttttatggttttgaacagaacctaccccccctgatatccggggtgatttctctgggcggtgagaatgttcccgagattttgcaattaaaaaacatcacgcccacttcacgcacctatccccccattaccgacagcctccgctattggcatttcctgtcacactatgccacgggcagctatgccttagagagcgtacgatcggtcagacaactgttgcaggattttgacctgtaccccgagggggatcgcccggtcagccgcagcatccggcgcatgattgacgggatcagcaatatcaccgcgaaatggggcgacaggcttatccggggcagacccgtccgctgcctgcttatcactctggaaatggatgaatcagcctataccagtgccggtgaaatgtaccggtttgccaacgcgttataccaattcttcccgttctgtcttgcccagggatcgtggctgagaatgcgtgtcatcagccagccttcagggacgcaatggtatctgtcaccttcaatgctggaaggttatcgctcaatcatgtaa

SEQ ID NO: 2895 - DNA, 2010 bp, Xenorhabdus bovienii
  Coding sequence Name=Xb4151_4152.C436.gene46.dna; Position on contig =35542..37551bp; Strand=+
atggatggattagtttttacctgccggataggccgactgccgcaaaccacctttcaggtcgtagatttcagtttacaggaagggttatcgcaactctttcacctgaccatgaccgtcgtcagttcactgaataatgtggcgctcagcgagcagcttggtaccagcgcttctctgaccgtcatacgtgatggcgtcactgaacgcaccgtcaacggcattgtggcgggggcagagcagggcaatactgacgggctgcgtacctattacacctttattgtccgccctgaaatgtggctgatgacgctcaatcaggatagccggatttttcattaccaatccgtaccggatattctcgcccggctgctgaaagagcatcgcatcaaggcggagagtaaattctataaagatcaccagcaacatgcgatacgggaatacaccacccaaaaacgtgaatctgcctatgatttctggtgccgtctggcggccgaagagggcatcatgttctggtttgaagaggacaaactgttctacagcaactctcaccttggcatgttggcggcactgaccctgacctacaacgttcaggccaataccgacaacagtgattcaaccgcatggcagtggaattacggcgaatacctgtgccccgatgaaacccgccataaagacaacaacttcctgcgcccctcctatccattgcaacataccgctgcactggaaaaaggcatggggcattcggtttttgaaagttatggccgttttcagaaggatgccgaaggccgcccctttacccaattgcggctggaacagttgcagaaccagagcaaagtggggaaagcggtcaccaactgcatcaaattgcgtccgggtcggatctttatgctgcaatcacacccgattggcgccatgaatgatagctggcagatagtcactgtttcccatcaggggcatcagccacaagcctccggtgaggccggggagggaaccaccctgaccaaccagatttcctttattccgggcaggcaggattggcgcccgcctttccgctataagccgctggcggatggcgatgaagtggccactgtcgtggggccggagggggaagagatctacgtcgacaaacatggcgctatcaaagtgcatttccactggaaccgttacgatgaagcggacgaccgggcatcctgttgggtgcgggtggcgcagggctggaatggtgatggctatggttttatggcgatcccgcgcatcggtcaggaggtgattgtttcctacctaaacggagatattgatcgtccgatcgtcaccggctgtacctacaacgggcgcaaccgcccgccgctggatctgccggcggaaaaaacgcgcaccaccttcaagacccgcacccacaaaggtgagggatttaacgaattgcgctttgaagatgcgaaagggagtgaagagatctatatccacgcccagaaagatcagcttatcgagataaactacgataaaacccagcgtgtgggtcacgatgaaagccaccatgtcctgaacaatcgcaaacacgaaatcggcaatgacgaattcatccggatcatgcatgaacagcacatccagattgacctgaaccagtttgaaaccatcaccaaagatcgcaaaacccgcatcaacaacaactggcaggaaaatatctttgcggatcaccggcaagaagtggggcgggacaaaaccgccaaaattaacaacaactataccctgaatgtggtcaacaacatccagagcctgacgaaagtccataccctacaggccagcgaatccgtgctgatcaaaggcaaggcagggtcgattaagctggatggttcaggggtaacgatcaccggcaaaatcaccttgcaaggggaggtgtcggtaacggggggcagcccgggcacggtgccgtcactcagcggatcagccaatgaagggttggtcatggcagaggattgccgggaaaaagcccgtaaacagcaggagtcatcggaataa

SEQ ID NO: 2896 - DNA, 1212 bp, Xenorhabdus bovienii
  Coding sequence Name=Xb4151_4152.C436.gene47.dna; Position on contig =37551..38762bp; Strand=+
atgtcctggatacccgattatgccgaacattgggtggtggattatgcctataccacgccacaaggcgaacctgactctgcccgggcgattgtccatgcagcgagccagccgcaggcgctgtcggcgctggcggaatatgtcctgcaggcgggagattcaccggggcaataccaaagtattcagccgttgcctgaataccttgccgccagcgctgaggtcgaattgccgctattgcggcagttccggcagggggtggagcggaatgcccgggtgatcccgctgaacgaacacaataacaatcccctcctgccggccgcgcgtggcgtattgcagttcgccgtgacggaaaccctgcccgccagtgcgcgtgggcaataccgctatatggtgattgatgccacggtttaccgtcgggtcatgggcagttttatcgtgccagacctgatggtttccaacctgcgatgggaaagcctgtttcagggggaaacccaaatcacgctcgaagacagcgccccttatttggtggagttaacggatgacccaacggtgcactcggcttttcagcacaagatcacccgaccgatcactccggaaccgggcatttttatcgacagtgaccagccatttcctgtgatccgtaatcacctgcgtaaattcacctatctgagaaatgaacaacaccaatcctgggtgttttaccgtttttatgtgccgcaaggcttgctcccgctactgagaagcctgccggatgaacaactgatgcactttatgcgcccgataatgcagatcggttatttcgacagccagacggggcagtactacgccctttctgtggcagaaaacagtctgaatcaggaaaaaacggctcccgtggccatcaaccgctctctggttgacatactggcggggcagacccaagcgcgggcggtgacgcagatagtgaaattcattgcagagacccagcctgaactgtcggccgaacagcaagaacagctgcccgcctttgtggtgcaacaggccaatcttgcgtgtctggcgggattcgcccatcagcgttccattctgtatctggtggcgggcagaagtctggcacggggtaacgaagcactctggcagcgggcatggcagcatgcctgtgccgaagcacaggcgcaggaggtgcgggcgctggcttgttatgaatattgttttaaaaaccgggcattaagttaa

SEQ ID NO: 2897 - DNA, 3126 bp, Xenorhabdus bovienii
  Coding sequence Name=Xb4151_4152.C436.gene48.dna; Position on contig =38781..41906bp; Strand=+
atggaaaaatcgatattaacgagcgcgggtgacgctcttgagaccgccgcgaaaaaagtggcagaaacgtttgaaaaaatggtcgatgaggcgaaggcacgcatacctcatgagctggacatggataccgttgtcaggccctgtgatgccaatatccggccggtttatcctgtcagatatgcttatatgaatttttttggtgacacatggatagacgctcaattaccgccgccaataagtacgtttattgatcctgatgatgattcattaagtgccagcgttctggggggttatagcattcgcatgcccagaccgggctggatctatgtcaaagaagaaggggcgattaaaacccggggctcccaacagaatggcaatttactgattttcaaattcagccctgaaattgttaccttagagggcaaaagggggatggtcacaaaatacaccaaatatgagcaaaaagccggcagctcatcgtgggaagaaatccaccctgccagcggtacagcaggattaggctatccttttctggcgattgataaagatgtgacccaaattagcctcatttacagtgaagtcgagctggctaaatctgtcctgaataagatggataacgataaaaacttccgcaagaatgcgatgcaatttgtggatttagacagtgaggtatcagattatgccattgatgccagacaagaacatttcgacggattagtggaagatttcaaagatcctgaaaaacaatttcaggcatacaaaaatcaattatccgatccgcttttacacgctgctgatttgggggatatcacgacggaaggcagttttttcatggatgccgatatggaaatgcgttatatcgacagtcttatctgcccttattacaaagataaagcgaagattgtggtattgcatgatccggtgggatatcagcgtgatattttaatggcctatatgttacttaatctttgggagctaagctatagtgcaactaatatgtatcctcttacgatagggaattttgttgagatattagcggcatcaaaaaataaagaagttaaaaaatgtgttgaggagtgtattcaccaagaaaattggaaaacttggtggcctaaattaactacgccgattaagagtgtaaaagatagaaagaaagagattcttgaattttataaatgtttttctgaaagtgaaatgattgcaggtaaattaggtgggcttacacattattttaagaattttttctccgtatctgataaaaaggacatttataccgaaggtgatgcaaaagaatttgaacgattctgtattttacacgctgaattaatggagccgctaaagcattcagaagagggattgttggcgatggaaagtattattgcgggtccattggctatagacggaaatagtgcgtgggaagttgccctcaatggaatagtgaattcattgggccatgatggcgttgataaaggttccattgcaaggttcctcaatcggggaatagatataatactcagtgtcgttggcaatttactggctagactgtatgtatttacaacagagctatcatataaaggggtattacatttacatgtgttgagtgttaaacaggtaacgcataaacttgtgcctaaaatcttagattattttgggcttgaaataaagcaaggacactatctcgaattaaccgagaaagaatattatacgtttctaaaaaaaattgaagaatatgaaaatcaaggagtatcaggtgaaattaagaaaggcatggctcatgctgagtctggcttgaaaaggtttgtaggaaaaaaagtgtttgactggtctaaccggttggataattacaataataatataaagataaaaataccgctgattaaatttaaaaggcctgagttaaatcctcagtttaaatttttttataatgcaaataagtctgcgggctacttattgagctctggattaagtggtttggatttattgatgaagagctatatgttatataaattgacatcaatgtctcgtttcgacaagaatgcgccatttaatgcaaacagacttccttattattatgtttcaagctatgctaatactatattaggtgggttaattgctgcgaaaggtgtttccgctattggtggagatgctattaaagttgcagctagcctggcgggtaaattgaatagccccgcagcaaaagcgttattggattctgcatcacgcaggcttctgttagaaagtgctttaataacaaaatgggtaaatagtggattaattgctacagggtttgtgagtggagtactttcttattacgatgcctacaactcttttagttttggtaatgataaagaagcttattctcatatttcaataggtacaggatcaataataatggctgtaggatggtctatggcggtagccgcatcggaagtgacttttggcgtcagtcttctgattgcgctaggcgcttcactaatgcttggtggaacattcgcagctatatacttcaattggatagatttggaaacgttgttaagtaactgcttttgggggaatgggagtaaatatgctttttggagtacgagtgaaaaacgtttaagtttagaaaatcaatttaaaagaataaaaattatagataaggaaattaaagatatatatctggtcgaatttcaggagtttttaaatatttttattaaaccaactttaaatattgaaaataataaacaaggaaaggtgatttacaaatttatactacctaacttcaaatgggggaaatcagatatataccatgaagttattccatcagctttgtcagatggctatagtgatcctgatgcttcaataattgaacgtggttatagcaggcatcattattctgtggtgaaagataattttgataaagcaatagatatcgctcgtaaaaatcgtgaaaatctaatttatgacgaggagagtggtttaactacactgaccgtagaagtagacgaaaaatattctgtttatatgaaagtcttttggtattataagccaacagaagatactgtttctcctcttcactataaattgggaaaagagccaatattggaaaatgcggtttatggatatgaagatgaggtattacgttaa

SEQ ID NO: 2898 - DNA, 957 bp, Xenorhabdus bovienii
  Coding sequence Name=Xb4151_4152.C436.gene49.dna; Position on contig =41907..42863bp; Strand=+
atgagtaaattaataaaaaaactttttagagtgaagacgcttccaacagagccattatctacttttggtactcctgttctggagcaaaaactaattctgctggataataaaactgtaaaacgtgcaggatttttggattcaataaatagcaaggagtgtcatttccgtcataatcttatcagagcaagaaaagaaattataatacccgtgtttgttgggtttatgttaggtttttctttttttattaatgacaacattaaggcatggaatgcttcggaaaaaactatccttctgcttttaaagagtgcaaaggaaaattatggggaacaattttatttaaattctgaagcatctgcatctactaaattattgaagatagtatcaaataataaaaaggtatcattaatggaatacttatatattagttattctaaggatagtatttatggagaggaaagagctagaaggtctcttattttagattcaagtttcggattatttttccttagtgccaatattcttattatcagcatttttttgagattacgtaagcctgcaaatttcatcattgatcatgaaagacaacttttttatacctggaaaaaagggaaagtgtatgtatctcgctataaagaattaggcgtagcgtttgctaataatattttgcatttcaaatgttatgggctgaacgaaaagaatgaactgacatatcagttttttatcccttatcttagtcttttcaactcagacgaggataaaatttatattttggcatttatgtcaaaatatttattacaaggaaaagaggctgtcagttcagttgattttaaacgccaagaacaattaccgtggtttcgtaagcaaataaaaccagcagattgggaaactcagattacggcaatattagctgaattagataggttttggccaccgaaaggggcgactgaacctaaataa

SEQ ID NO: 2899 - DNA, 681 bp, Xenorhabdus bovienii
  Coding sequence Name=Xb4151_4152.C436.gene50.dna; Position on contig =43021..43701bp; Strand=+
atggctaaggataatgaaattaaattatcaagaatatcaactgtttgcgatcctcttttgaaggaaaatattggaatattagataaggagcagttagaaaatgagggggtttttgaattaattaatgataaaaattgtgtaataattaatgagataaataatcatcggatacatattattgttcctgctcttattggttttttattggggttttgtttctttgttagtgattatattaatgaatggaaatgtaatgaaaaggggtatttgagaacgcttaaatatgccaaaaagtattatggtgaaaatttttatttaaattctaaaataccagaatatatgaaagcgtatgaatatatttctgatgcggagagtgtatctttattgcaatattttcatattcgttatacggatagtgggttctataaaaaatccacagtgcggtatgatttattactggaaggaggttttttcctgtttttccttactgcgaattcttttcttttgtatttgctgtttttctctcataaagtagctccacttgttattgacagagaaaagaaaattttttatacgtggggaaaagagaaattgtttcttctcttcactataaattgggaaaagagccaacattggaaaatgcggtttatggatatgaagatgaggtattacgttaaatga

SEQ ID NO: 2900 - DNA, 969 bp, Xenorhabdus bovienii
  Coding sequence Name=Xb4151_4152.C436.gene51.dna; Position on contig =43698..44666bp; Strand=+
atgagtatattaattaaaaaaatattcaagaaaatttttagagtgaaggcacctccaacagagccattatttacatttggtgatcctgttctggagcaaaaactaattctgctggataataaaaccgtaaaacgtgcaggatttttggatgcgataaatagcaaggagtgtcattttcgtcataatcttatcagagcaagaaaagaagttatagtacctttgatgattgggtttatgttaggtttgggattttttattaatgactttgttaagggatggaaagctaatgaagaggatcttctttggtctgttcagaatgcaaaaaaacgttatggagagcaattttatttaaatccaaatgcacctgcatatactaagtcattacgagtaatatcagatgataaaaaaatatctctaacggaatatttatatatttcttattcaaaagatagctattatggtgaagaaatggctaggcgatatttgattatagatgccagtttcggattatttttcctgagtgccaatattcttattatcagcatttttttaagattacgtaagcctgcaaatttcatcattgatcatgaaagacaacttttttatacctggaaaaaagggaaagtgtatgtatctcgctataaagaattaggcgtagcgtttgctaataatattttgcatttcaaatgttatgggctgaacgaaaagaatgaactgacatatcagttttttattccttatcttagtattttcaactcagacgaggataaagtttatattttggcatttatgtcaaaatatttattacaaggaaaagaggctgtcagttcagttgattttaaacgtcaagagcgattaccgtggtttcgtaagcaaataaaaccagcggattgggaaactcagattacggcaatcttagctgaattagataggcttgagccaccgaaaggggcgactgaacctaaataa

SEQ ID NO: 2901 - DNA, 189 bp, Xenorhabdus bovienii
  Coding sequence Name=Xb4151_4152.C436.gene52.dna; Position on contig =44632..44820bp; Strand=+
ttgagccaccgaaaggggcgactgaacctaaataatcgttggaaaaatattaatacagtaagttatattttttccagaaaaaatagcaccgaaaaatattataattatctcggtgctattttgaaagattctaatgtattcgataaaaacccaattaataaaattggtatgtttaatctgatattataa

SEQ ID NO: 2902 - DNA, 135 bp, Xenorhabdus bovienii
  Coding sequence Name=Xb4151_4152.C436.gene53.dna; Position on contig =44837..44971bp; Strand=-
ttgcctttttcagtaacagcattattatgttgcagtttccttcgtactcggctctacaatattgattaccgcattagtcagtctttatggttgactcaattagcatatagcactaagaaatatttaaatacttaa

SEQ ID NO: 2903 - DNA, 102 bp, Xenorhabdus bovienii
  Coding sequence Name=Xb4151_4152.C436.gene54.dna; Position on contig =44950..45051bp; Strand=+
atgctgttactgaaaaaggcaatcttcttattaatgaagaaaattcacttatcagctaattcttacctcattgcgacagaatttttaataagtttcctgtga

SEQ ID NO: 2904 - DNA, 111 bp, Xenorhabdus bovienii
  Coding sequence Name=Xb4151_4152.C436.gene55.dna; Position on contig =45054..45164bp; Strand=-
ttgtcacagaaagacaaattcaacactgaaacgattttatccgtattctcttctgagatatgtagcaaccctatgcaacggtcaagatgggatttattgctgtaccaataa

SEQ ID NO: 2905 - DNA, 1878 bp, Xenorhabdus bovienii
  Coding sequence Name=Xb4151_4152.C436.gene56.dna; Position on contig =45235..47112bp; Strand=-
atggctaacaaatatacttacacatcatcaaaagcaatgtccgatatcagtgatgttattggtgatcccttaacggcctggaaccaacaggaaggcgggcgggtttataacgtgatttttaacagcaacgtttataccaatacttactgggttgaacgctggcatgtaccgggtcaatctggccagaaaagttcgccgcacaatgcctggcagtacgtccgtgcggcaacagcagaagagatcaacacacatggcaatccaacggatggtacgataaacccgacagaagagattccatcccccgttctgcaatctgaccgatacacggaagaaacttacgagaaggtgaagtacaagcccgatggctcaggcacaaatctctcttataccgcgacccgtgtctgtaaaccgatgtataaccaatatgagcgtgacccggctaaacccaaactttccgcttacattacagactggtgtcaatatgatgcccgtcttgatgacaagaatgaaaaccccgaggatcgcggcagagggtttaatctatcgacgatagatccgacaacttacgacaaattgattttcagcttcttgggtatctgtggggatattggcgttaagaaagaaaaagttaaggaagtctgggacggctggaattcccagactgaccagaaaatcaccgaaggccatatcgtgccactggacccttacggcgatttaggcactgcccgtaacgtcggtctgccggaatcgagtaaaaatacttcaattaatgcggggacttttctgccctattatcagcagagtaaagcggcgggtttgctgggaggattacgggaattacaaaagcgcgcgcgggcagcaggacacaaacttgagctggcattcagtatcgggggctggagtttatcgagttatttctccaagatggccgaaaatgaaggacagcgcactgttttcatcaacagtgtggttgatttttttgaacgcttcccgatgttcagttgtgttgacatcgactgggaataccccggtgctgagggagatgtacacaatattatcagtgaaaacgacggcaaaaattatgccttgctggttaaagagctgagaacggcactggataatcggttcggtacaggcagtaaagaaatttctattgcctgtagtggggtaaaagccaaacttgctaagtcaaatatcgctgaattagttaaaaatgggctggataatatcttcctgatgagttacgacttttttggcaccggatgggccaattatatcgggcatcataccaacctctattcccctaacgagcccgatcctaatggagaatatgatctctcggcagaagcggcgattaattacctgcatcaagatctcggtattcctctgagtataattaacttgggttatgccaactatggacgttcgggtaaaggtgccaagctggaaacgcgtttgtacgataagccgggtgatgctctgggcacaatggaaaaaggggcgccggaattcttcgatattgtcaataactacatggatagtgaacatacactgagtacgggaaaaaatgggtttgtactaatgacagataccaatgctgatgcagatttcctgttcagtgaaaaacaggggcatttcatctcactggatactccccgcacggtgaaacaaaaaggagaatatgtcaccgggcatcaactgggagggatcttttcctggtctggtgatcaggattgcggtctgttggccaatgctgccagagaaggtatgggatatatcgccaaatctaatcatgaaactatcgatatggggccgttatataatccggggcaaccctactatttaaaatcgctccgtgaattgaaatcttcgcgctaa

SEQ ID NO: 2906 - DNA, 4107 bp, Xenorhabdus bovienii
  Coding sequence Name=Xb4151_4152.C436.gene57.dna; Position on contig =47207..51313bp; Strand=-
atgtctaattccatcgaagcaaaattacaagaagatctgcgtgatgcgctcgttgattactaccttgggcaaattgttcccaagggaaaagatttccagttttatcgcgacaaaatcaagaacgtcgatgatctctatgattttctgctactggatacacaagtctcttcgaaagtcatcacatcgcgcgtgtctcacgtaacccaatcgatacagcagtatatcaaccgtattgtgctcaatttggaaccgggtctttccatgactcaggaagaaacctacgactggcaggagtttgccaaccgttacggttactggtctgccaatcagcaactcaggttataccccgaaatttatgttgatcctaccttgcggctgaccaaaaccgagtttttcttccaattggaaagtgtgctgaatcagggaaaactgacagataacgtcgctcagaaggcagttcttggttacctgaacaattttgaagaagtcagtaatctggaaattatttctggttatgaagatggcattgatcttgccaatgacaaaacctatttcattgctaaaacccgtacccagccttatcgctatttctggcgaacactggacatgaaacagcgtaatacggactcgaatgagctgtatccaaccgcctggagcgaatggaagccgatcagtgtgccgttagaaaatgcccgtaatggggttgtccgtccggtcatcatgaataaccgtctctacataagctggtttgaagtctcaaaagaagaagagaaaaacaaaaacgacgaaagcaaaaccatcatccgataccgcaccaaactcaatctggcacatctggggtttgatggtacatggagcagcggcaccaccgtacgcgaagaggtgcttgatgatgcgatggataaaatgattgcggtgcttgaccggacgggtaaagaagaccgtctggtactggtggcatttacccgccgtcatggtatagaaaacaaagtcccttatgactatgacgtagtattcagttacatctgcgataacatgctgatggcttccacggatctgcctccctccagcaccaaactctctgaccaagatgattatggtgacaaactggtttggttcttcttccgtgatccccagaatggtggtatggatgaattcaagcagctgatcctttatcccgtccatattaataggcaatggccgattgagaaggaaagaaaatttgagggcaaactgggtgacgaacaggatttcgacctcaaagctgactatgtggaagattcactggatatgtatctgaccgccatctccacctacaaatacgatttcagcctgagcaaaaacatcctgtactgcatctggctggaagacaaaaataaaaacagatgctggctgaactaccaggtactgacaaaagaagattttgagcgaggggaaatcaagcttagtaccagagtcaaacggtgtcacagcgatgacctcagcgacatcacgattgtcaccggtttcagtttgccgaaagcaaatgccgacgatattggcggcagaatcagagtcatcttgagcgtgggtaaattggttcgtgaaaaattccagatcaaacaaaccaaacaaacccaatacctgcaattccccgaaaatccaccgactcccgtttggtataccgataaacagatccgcttaaataccctgtttgccaaggagctggtcagtaaagccagccagaaactggatctggtgctcagttgggatacccagaacctgcctgaagagtcgatttctggcagtggcacagaaccgattgacctcaagggtgccaatggcatctatttctgggaactgttcttccatatgcctttcatggtggcatggcgtttcaatgttgagcagcgttatgaagaagctaaccgctggctcaagtatatttttgatccttatgaaaatgaggatcaaccggctctgaaacaaggaaagccgcgttactggaacagccgcccattaattgatgagccgaagaaaaactacagcctgatgcagccgagtgatcccgatgcgattgcttccggtgaaccgatacattatcgcaaggcgattttctattttctggtcagaaacctgattgatgacggtgacatggaataccggaagctccaacccacggcaagaaccattgcccgtttgagttatgcaaccgccagttcgctgcttggccgccgccctgatgtgcaattggcaagcttctggcaaccgctgtcccttgaagatgctctctaccgatatgacaacagtgagctgcgccaactggagatgcaaagccagccattgccccatattcccgtcgttcatgacaacacgatccgcgcccttgataatgatctgttcatgaagccgatcaacaatgaactgacggcgatttgggatcgtatggaaaaccggatttacaatttacggcacaacctgacgctggatggcaaagaaatcaacatggcactctatgatgggaagatctcgccacgcgacctgatgaacctgcgttaccagcgcgtagtcactgcccgcaatgccagccggatgaatttcaaaacacctaattaccgttttgaaccgatgctggcacgtgccagagccggcgttgaaacgctgatacagtttggcggcaccttactgagcctgctggaacgcaaagacagtttgagctttgaaaaattccagatgctccagaatagtgatctctaccgcttctcaatcgatcttcaacagcaggaaatcaacatcaatcaagccagccttgaggttttacaggtcagcaaaaaatcggctcaagagcgacatgaacactttaagggattgtatgacgaaaatatttcgtcaacagagcaacaggtgattgaactgcaatcccaatccgcttcggcgttactggcagcacaaactttgcgtaccggcgcggctgcactggatatgctacctaatatctatgggctggccgtgggcggatcgcgctggggagctgcactgagtgcggcggccgaaatggtcatgatcaaacatcaatctgacagtatcaaagccgatagtctgaatgtgtctgaatcataccgccggcgccgccaagaatgggaaatgcaatacaaacaggcggaatgggaagtcaattccattgatcagcaaatcaatgtccaaaacctgcaattgactgcttccatgaaacggttggcacaggttgaggcggaacagcaaaaatcgctggcgctgttagattatttctccagccgctttaccaatgaaagcctgtacacatggatgattagccaactgtcaaacctgtacctgcaagcctatgatgccgtttcatcactttgcctctccgcagaagcctcattacagtacgaattggattcagagcagacctttattgaaggcagtagctggaatgatctctatcagggattaatgtctggtgaaacactgaaactggcgctgcaaagaatggaacgcgcttatgttgaacaaaactcacgcttgcaagagattactaaaactatctctctcaaggcattgcggaaaacagcatgggaaaacgatcttgcaaccctgagacagcactctcccattacttttaacctgcaagaatcagactttgctaaagattaccctaaccttgccaatcgccggatcaaatctgtctcagtttctctgcctatgttaatcgggccttatgaggacatttgcgcccaactctctctgggcgtcaatacccgcatggtgaaagccgacattcagacaatggaaaagctggtgaaagaagggattaatgctgattcgccttatctggcacgcagcatccaccccaaccagcagatttccttatccaccggcataaacgacagcggcatgttcacactgaattttgatgatgagcgtttcctgccatttgaaggtgcgggtgttgaatcaagttggacattcggttttaccaataactcgcaaaatctcgacagtctgaccgatgtgatcctgcatgtccggtataccgcaaaaatcggttcctctgcattcggtaaagccgttcagaaattgttggtagaacaaaagatcacggattaa

SEQ ID NO: 2907 - DNA, 3555 bp, Xenorhabdus bovienii
  Coding sequence Name=Xb4151_4152.C436.gene58.dna; Position on contig =51306..54860bp; Strand=-
atggacaagaatcacgattattctgatgaacagcagaatatgaaaaaagtatcaccattattggcggcagtagctgaaataccattacctgaaatagcattacccgaaaaatattcactcaccacagtaaaacagcacaataccccatcatctgtttcgttagtcgattcactcagaaatctgggctatcactccatcttcgatatagtcaggctgtcaaaacagcgtttcattaaacgccacaatgaatctcttgcgggtcatgctgaaatcatctttgacaaagcagtgagtatggctaaccaactggttcaacactatcggcagaacccgctcagacaatacgatggacagactgcggctttcctgtcaacagcgacagataatcagaatgccagcgagcaaacaggaaaattgcctgattatagtggcctgtttccagaaccctgggatgacttctgtcagccggatgctatcgaatcccttgatagccctgccaactatctgctggatctgtataaatttattcagcagattgaagtggatggcaccaatcaggcaactttgctggcaagcaggcggtcggatatctcatatctgatgcttgatagtgacgctctttataaagagcttcgtgctctgaccatcgtgaatgatgtactgtctgaaagtgccagaatatatattgaccagacaggggaagccaataaaccggttaatcaggtattgggagaaacacgttttccctttacgttgccctataacttgccgactcagcagatcaaccgggggctggcagaaagcaaaaatgaattgggtaccgtgatccggcaagtcgatacgcatttcccgtggcatactgaaatttcaaaatatgatcagatcttgctggcttattcacagttgagcaatgaacaaatcagcctactgaccgaagctgcccctttctctgaaaacctgctgtcacgggatcagctcatcaaagcctattacagcagcagtacgacagaacttgtgcctgacaaagatatttcgcggcatgcttatattgttgctcaagatgacagtgttgaaggcccgactaaactggtcgaaaattcgcccagtgcctacgatagaatttccatcacctgcaaaaatcaggcagacaaaaccatctcggtcaagctacgggcagaaaacgttctcacttactaccgcgtcaaggcaaggatggagccgtttgacaactctccgccctttagccgccagttaaagctgacctatgtggaaagcgataactcagacattggcaatctggatgatggcccatactttggtaatatgaccatttatgcagcgacgcccaaagaaataccatcaggtgaaaatcaacccaccgggccaatagacggcgttatatttcaggcaatgagttatcgtcttgcgattgccaaatcaggtacatcatcttccgaattatcaccgcaggcgaatgacttctttatcaataattatggtctttcagaagaagaaagcgcccagcttaagaaaatcgccatttttggcgatcaaaccggaacgcaagctactcacattgaaaatctattcagcagcggtaactaccagcctatcgtttcccctaatgtacacttttccaacccgatttttttcaacagacagagcaccgctaccttcccggccgcttatcattatggcggggtgtacattaatgccggacaacgagatactctggaaatcattcgggcggataacgggcgtgaaatcaaagctgtatccaacttccgctatgatcggctgaaccgctttatccgcttgcagcgctggcttggcctgccttaccaccagcttgatcttctgctggcttccggtatcaaggcagaagccgataatctggacatgagaattactgacaatgtattgaaggaattggggctgttcaggcatctcaatacgcaataccaagtcactcccgaaatgtttgcgggctggctacaccagattacgccattctcaaccagtgacagcgtaccgttctttgaccagatctttaatcagacgaaactgtttgatcagccgttaacactggatgatgaggtattcaactatacggcaactcagggcgatgatgccaaaaccgtcaagcaactctgcgccgggctgggaatttccacggtaacttttcaattgattgcccccatggttgaaagtgcgctcacaccaactcaggatacgctgacggggcaattaaggcgcaatcttgatgttgtttccagactttaccgtttggtcagcattccacgcattttcggtctttccacggaagacggcgtgttcctgatcgatattctgaccggcaatcaccgctatttggcacaacaacccattttcaccgcagactcgacgcgtcaggacgatattctcatcgtcatcatgaaaatggaagccgtgagccgctggctggcgaaaactaaaatcacagcggcaaaactttccctgatgttggggcagacagtgctgcctgtcgtgccaacagacagcatggtgaccttttttaaaggtatcgcggttggcttgtccgatagtgtgctcctgtcatcatctgattttacccgcccagagctggtaacgatcaactggtgggaactattaacagcagagggcggacttctcaatgcacaagggctggttctggatattccgcctgagtgggataaaacagatgaaatccagatcagggaaaaggtcaaggcactgttcaaagaagggaaaacaccacaggataatgtcatcaatatcgtgacccaactgctgattcaggccaaaaatgcgcaggaaaatctgttatccagcgcgattgcggcggaatatggcgtagaaaaaagtctggttcccttacagcttcgctggttaggcagcaatgtttatctcgttctggagatgattttgacaggtgtcccggaaaccgccgctgagatcagtcatcaattcaccgacttgacctacagtttgttaatttatactcaaatcatcagtaccctgaaaatcaataaaaacctacttttgttgcgcctgacaaaaccagaatggctcggtttatcaaacagtaaaacatcaaatgcattgtcactggatgaaatatatctgttgacccgctaccaagacctcgtgaacaacgccaatcagaacgaagacaaaatccatgactatttttcttacgccaacaaaccacaggccaatggaaaagcagtcaaaaacaacgaggatgaaagtgaaaaatgtgcagagattttggcagatattctgggctggcatgccgatgagattcatctggcctgcacattgcgcggattgacacctccgcaggccaaaaacttactccatatcgattggttacgccgattacaacagcttgcagtcaccaccagcctgtcagtcaaaacgttatgggatgccggtacattaacactcaatactgatttcagcctttaccagagcgtcggtgaagcagtcatggcggcattaaaagcgcaaggagataacgagaatgtctaa

SEQ ID NO: 2908 - DNA, 117 bp, Xenorhabdus bovienii
  Coding sequence Name=Xb4151_4152.C436.gene59.dna; Position on contig =54803..54919bp; Strand=+
atggtgatacttttttcatattctgctgttcatcagaataatcgtgattcttgtccatttttattatcccatttcaattattcggccatattcatcaaaccgtcattaatcaaataa

SEQ ID NO: 2909 - DNA, 1641 bp, Xenorhabdus bovienii
  Coding sequence Name=Xb4151_4152.C436.gene60.dna; Position on contig =54954..56594bp; Strand=-
atggataacacagaaaaagataccgaaagcaagttagtttataaaactgatccgggatatcaacatccaagccctgttcagggttatggcaaggaagcaacacaaaaaacctatcaattaaacggttatgacccggcaacaagcaccgatattctgacctataccgccacccgcatggctaagacggtgtttaacacttatcacgatgatgatgaattcagtatcgcgtgttacttcacggactgggcacaatatgatggaagggcagtggaggcatcaccatcggatgaagtattcagaaatcaggggggacgcagtgccgatttgacccgcattaaaggcgattcaaccaatggcagcccctttaagaaattgatattcagttttgccggcatcgttggtgatgaagggccgaaaggaaacataattctgaaagctgccaaagattggggattcggagccgatgaggctgaaaccctcaaaaattacaccggatggcctattccaatcgacccgtggggtgatgtcagcacttactttaactgcggtttcgatagtggggcatctggagcggctaaagatgtctataaccaagagaaagccacaggattactgggtggtttcaattcactgaaaaaagctgatcccaatctggaggtttccgtcagtatcggcggctggtcaatgagtggtgctttttatgaaatttgtcgcagtgatgcctatcgtaaacagtttattgatggagtcaaaaatctattctgtcgtttctcaatgttcaatcatatcgatattgactgggaataccccggctcggcgggaatgggaaacccatttgataaagatgattatgtctattataaaaaactaattgaggaattaacggcagccaagatccccaatttacaaggtattagtattgcagcttcagccgatcctcaaaaaattgatgatgcccatattccagaactgatggaagcaggtgtcaccggcatcaacctgatgacctatgacttctttactctgggtgatggcaaactttctcaccataccaacctttatcgcaacaaaaatgaccaacattccaaatattctattgacgatgccgttcagcatttaatcactcagggtgttgacaagaaaaagattttcattggttatgccggttatacacgcaatgcaaaaggcgcaaacattaccagcaaaagcccgcttcaaggaacttataacggacaaggcaatatcgtcggcactttcgaatccgcggttattgaatggactgacattatctataactatgttgatttcgaaaatggcataggtcgtaatggctatgaaatcattcaagataatgttgctaaggcagattatctttataaccaagatctcaaagtttttatgtcattggatacgccacgttcagtcagagaaaaagcccgctacgtcaaagaaaaaggattgggcggcttatttatttggtccggtgatcaggataatggcttattaaccaacgctgcccacgaaggtctgggacgtcccgttaagaaaagcgttatcgatatgtcaccgttttatttcgataacgatgatctcccttcttacgataaacccaaagaaccccaatgcaaagactgtgtttaa

SEQ ID NO: 2910 - DNA, 111 bp, Xenorhabdus bovienii
  Coding sequence Name=Xb4151_4152.C436.gene61.dna; Position on contig =56814..56924bp; Strand=-
atgctatccataatctcatcaatgttatctattcctgtacattctaaaatactccagataaaaaataacacttctattttttactgcctacacataaaaaaaattgtttaa

SEQ ID NO: 2911 - DNA, 129 bp, Xenorhabdus bovienii
  Coding sequence Name=Xb4151_4152.C436.gene62.dna; Position on contig =57085..57213bp; Strand=+
gtggcgactattagcatagtcggcattttaatctgttttcagtctgcatgtttcagtgtggtttgtggcttgtttggatatgggcacaaaccccgtgtaatcggtgctagtctggctgatgctgtttga

SEQ ID NO: 2912 - DNA, 132 bp, Xenorhabdus bovienii
  Coding sequence Name=Xb4151_4152.C436.gene63.dna; Position on contig =57446..57577bp; Strand=-
atgaggccagagaaactcgtcagaagcctgctgtacagcctgattcaatctggcaaatcggaggcttctggctttcctgattattttatctacacttccaaagattacccatcacaccaaccatctccgtaa

SEQ ID NO: 2913 - DNA, 303 bp, Xenorhabdus bovienii
  Coding sequence Name=Xb4151_4152.C436.gene64.dna; Position on contig =57578..57880bp; Strand=-
atggtagacgctaatacattagtcggaaaacgtatttgtaccaaaaggaaagagctgggtattaccgcaacggcattggcaaaacaaattggcattagccagcagcagctttctcgttatgaaagaggaacaaaccggattaatataaatcatcttgttgttatctctaagcagttgggtactccaattagctggttctttgaagaatgtttcaaagatgaaaaagaggacagcacagtcaataaactcactgatcaatatattcccattgctgaaacagttataggaaaaaatggtcgttaa

SEQ ID NO: 2914 - DNA, 132 bp, Xenorhabdus bovienii
  Coding sequence Name=Xb4151_4152.C436.gene65.dna; Position on contig =57912..58043bp; Strand=+
atggcgttatcaaggatcattttcctggcgcttcaaaatggtttggctttttcctcaccagttgcgcctattgttacacctgatccgccgttttgtttttctgacattcacttggtttttttaatgacatga

SEQ ID NO: 2915 - DNA, 123 bp, Xenorhabdus bovienii
  Coding sequence Name=Xb4151_4152.C436.gene66.dna; Position on contig =58019..58141bp; Strand=-
atgcagggtgacatcaaaacaaagaatacaacccgtgtcatagaagccccccttatcttggtaagggcactgtttttacaacacgttaataaaaaaggtcatgtcattaaaaaaaccaagtga

SEQ ID NO: 2916 - DNA, 114 bp, Xenorhabdus bovienii
  Coding sequence Name=Xb4151_4152.C436.gene67.dna; Position on contig =58840..58953bp; Strand=+
atggcttactcgcattttagggtattatcaagatgtggatgttttttcgacagtcatggatggtggttttctattttttataataaaaacaatatgataattatttttttatga

SEQ ID NO: 2917 - DNA, 186 bp, Xenorhabdus bovienii
  Coding sequence Name=Xb4151_4152.C436.gene68.dna; Position on contig =59071..59256bp; Strand=-
atgaagggaatcattctacttccgagatctgttcctgtctgcctccagatatccctccatccagccatttgtcagataagatttcgttgtgatctgacatggtgtataggctccatattacgttccgtcatttccccatataaaaacgcaaccatgagtaagagaacacctcagaccactatgtaa

SEQ ID NO: 2918 - DNA, 279 bp, Xenorhabdus bovienii
  Coding sequence Name=Xb4151_4152.C436.gene69.dna; Position on contig =59189..59467bp; Strand=+
atggctggatggagggatatctggaggcagacaggaacagatctcggaagtagaatgattcccttcatctttcaaattacggcttcattggcacccagtcacattgttatctatgtaactggggattcattcacttactactgcgctgcatattgcttaacgcggcatgctggtcggcgatatcgacgtccagttctctcagccgtgttgtcacctgtgtctgatgatgatgataaaagtctacctttcggcacaggcaaacaaactttgctgatgtag

SEQ ID NO: 2919 - DNA, 924 bp, Xenorhabdus bovienii
  Coding sequence Name=Xb4151_4152.C436.gene70.dna; Position on contig =59429..60352bp; Strand=-
atgaaaataaatccagtcatgccgttgattcgcttattccgggaagaagattccaccggagtcagcgcgttgtttcgggtcgtttacggcgaagattacgtctatccggaagtctacctgccaaccatgctgagtcgttataatgcggccagacactggtattctgccgttgcaatacagaatggacaagtgttaggacacgcgacattgtggcggaatgggcgttgcccatcaagtgcagagctctcgcttatcgcggtacatccacaagcgcgcggacagggtatcgcaaccgcgctgggtcgatatttgtgtgatcaagccaaagaaatgggattaggtatgctcacgattaaacaggtatcgtcgcataatcacagccagcgtctggctcaaaatttgggttttcacaccacaggcttattaccggattatgtgatatctccctttgatcaagcacgtccggaaagtattgtactcggttgcctgcctttgcaacgctggccgtttccagaattacactggccagtgaattggcaaacgtggctgacatcggtcactcaaatatttggtcaagaaccgctaaaacccgcggttccaatagatacgggtactagaatcgccagtcatggagggcgactagaagtctggatagaaacacagacaacggagcgggtaaaagaagtgacagaactgccggcgcataagctgatatatgtgaaactaccggtcggagaagagactctccacgcggtacaaattttgcaacaagccggatttgcctgcacagggtttgtgcctggtcaccatcatcgttgggaaatgcttctggttcgggggcatagcagaaaagaactgactctaagttgccagtttgcccacaatctacatcagcaaagtttgtttgcctgtgccgaaaggtag

SEQ ID NO: 2920 - DNA, 1272 bp, Xenorhabdus bovienii
  Coding sequence Name=Xb4151_4152.C436.gene71.dna; Position on contig =60349..61620bp; Strand=-
atgactttatcattacacgatttagtggaatacgcccgtcaccacgcacccttttttagggatctttatagtgatttgccacaatccggctgggcactgacggacttacctttaatcgatcctgctgcttactggcagcaatcgcagccattggagaattggccggtactcaccggccctatcaacagtgggcatatttttaaaaccggcggctctaccagcgaaggtaggttgtcggtgttcagtcgtagcgaatggcaagcctttgtgcgctcgttcggtcagggtcttgcacaacaattacaatctggcgaccgtgttgccaatctcttttttgccggagatctgtataccagcctgttgtttattcacggagcgttatctcattcaccggttccggtggtggaatatccgtttacctgttcagtcgaggatcaggcgttggctgacgccattgttagcttagggattaatgtactggctggagtaccggtacaattgttacgttttgccagtaccttgcagcgttcaggccagtttatgcccaatattgatcgcctgttgtacggcggcgagagcctgtttccggaacaactggctcttttgaatatagtgtttcccaacgcacgcattagttcaatcggatgtgccagtgttgatgcaggtctgattggtgccgcctctcctgactgtcaccacggtgaacatcgggtttttgatgaagattcgattgtcgaaattattgacgaatccaatggtcagcccattactgagtctgggcgcaatggcatgttagttgtgactaacctgcaacgtcgtctaatgccggtgatccgctaccccacaggcgatctggcctgctggtgtgaaggttcgggaagactgaaccgcaaatttgctttgcagggtcgggctggaagtgctcaccgtatccgggtttctacgttatccctgtttcccgatcagattgcccgtttactgcaacaacagaaaggaatactggcttggcagctattattaagccgtcaggacggcatagataagataacactgctattagccagcgactcaccacagatgccatcaacaacatcaatccatcaggcgttagtcacggcccaacccgctatggcagaactctgtagccaagggggattacaggtggaggtagcctcttgtgctctggaaaatatggtgactcacccccgttccggcaagctgatacgggtcgtggatcatcgttgttataatgcagaagagaagacagcatga

SEQ ID NO: 2921 - DNA, 2406 bp, Xenorhabdus bovienii
  Coding sequence Name=Xb4151_4152.C436.gene72.dna; Position on contig =61665..64070bp; Strand=-
atgtatttagttaatggcgaggttatctctaacttggaaccggcggccacattagccgatcttaaaaaccgtcttgccgacgccttggcttgtcctccgactgtgcaagaagtgttggattgtgccgagcgttttgccaataatctcgatacgctggcaacggattttgcactggattcagccacaatcagcacattacgccacttttgccgtcgtgatgcactggaagaaaaactgcgccatgaattgggagaacagccgttttccctgcgccgtttcgattatacccagccacgctttgagacttggcaacctttggggttagtggtgcatatcactcctgccaacgcgccattgctgccatttatggctgtattagaaagtctgttagttggcaatatcaactggttgcgccccagtagcagtgataatggcctcaatgcacggatattggctgaatttctgcgccatgatctcagtggcaaattagcgtcttacgtctccgtaatgccgctaccgtccgatcaattgtcagaattacttgcctgcgccgatgccgtgtctgcctggggcagtaatgccgcattgacggctatccgcagccagttacgaccgggttgccgctggatcgattggggacatcgcatcagttttgcctatcttgacccaatggtcgccagcaacgctgactacgatgctctggctgatgatgtttgccgttttgaccaacaagcttgttccagcccacagtgtctgttggtcgatagtaccgacgagaatgttttgcgcaaagtggctgatgccgtggcttcggcactggaacgacgcgcaccggaatggccagccttacagccagatatccaagaagcggctgaaatcagcagtcagatggcatttctgcgcttggatcacacgtttgccgacgttgccggttcggtaactgaaggcgcaggatggcgagtcgcgtggactcaacgtcgggaactggcggcatctccactgtaccgtactctgcaaattcgtcctgtaccacgcgctcagttgatcaacgtattgctgccgtggcgcccctatttacagagttgtggcttaatcgccggagaacacgaattgccggccttgagccgtcagttgctggcggcgggtgtcagccggatatgtcagcccggcgctatgcatgagggttatgaaggagaacctcatgatggtgtttatgcattgacgcgacttgcacgcagggtctcagtcagtgtaaaagcagaacaactgccaaaccatgtcacactggataaattatccgtcaggccgccggatctggcagggctgccaatcatgggcaaagcacagtttcagcagagcggcacaacaccgaaagcacaagtgtttttccgcagcggcgggagtacaggcgcgccaaaattagcgggattcagccacagagattatcacatccaaatgcaggccgcggcagatggcctattttccgccggtctcgacccggcacaggatcgcgtcatcaatctcctgtacggcggcaatttgtatggtggcctacttagctttttcactgttctggataaattgtccgtgccgcattacccgatgggtggcccgatagacgacgattttagccagatcctgcaagttattatcacgcaaggcgttaatacgttggtaggaatgccaagcacgatatatcagctgtttgaacgtgaagaggccgcgttacgcgcttatggtggtgtgcgcaaaattttcgctggtggcgaacatgtcagtgaagaacggcgtcaattcttatccagttttggcgtgcaggtgatccgctcggcaatttatggttctgttgatgcgggtccattgggtcatgcctgcacttgttgcaacgagggcgaattccatctgttatctgatattcagtggctggagatattagatctggacagtgaacaacctgttcagtcaggcgaaacaggccgactggtgtttacccctctggcacgggaagggcaggtcgttcaacgctatgaagtgggcgatttaggccactggttgccggaaacttgtacctgcggattaccgacaccacgctttagactgaaaggccggcatggtgggttgatacgggtaggttctatttttgtgaatcctacggcattgtcagccgatctggcgtttccggtgcaatggttagtcggaaacctcgataagggtggcgaatatatccatgtgttggctgatggcgatattaaccaagtacgtcaacatctactacgacatgaaatgctgaatcaggttgtcagtagtgaattgttgcagttggaaatcacgtctacaccagccggacagttccgccgccattcccaaagtggcaaaacgccgttagtgctggattatcgcgcctga

SEQ ID NO: 2922 - DNA, 1131 bp, Xenorhabdus bovienii
  Coding sequence Name=Xb4151_4152.C436.gene73.dna; Position on contig =64072..65202bp; Strand=-
ttgacttctcttgcttatgttgacgccctttgttcgcttgatcatccctatcgtgccgatagcgattgtgaccaactatttgacgcggctatgcgtgaattgacacagtatcattgtgaaaacagccccggttactatcaatggttgaaagcaaatggtttggatgctcaaaaattagaaaaattacatgactggtcgcatttaccacctattttcgccaattatttcaaacatcagctgctgctgagtcacaccggtatcgatgcgctggaattgacctcatccgggacaaccggtcaaaagagccgtatgcggtacgatacccgcagcatacaggcagcccagagaatggttgaacgtattttcgaatattacggctggaatacaccgcaacagccttgtaactacatactgttgagctatgaacccgccggagcgattacgctgggaaccgcctataccgatcaatatctgtgtcagtacgcccccgtatcacaagcttgttatgcactgcgccacaatgggaaaagcaatgaattcgacccatttggtgtgatccgcgccttgcaggaatttgccgcacaagggctgccagtgcgtttcttaggcttcccggccttcctctggttcacgctggaacggatgcgggaaatgaatttacccccactacagttgcatcccgaatctttggtctttttaggtggcggctggaaaacccacgctgataaagccatttcaagatccgagctgtaccggcgtttgcatgaacaactgggcattcctgatgaacgctgccgggatggctatggttcagttgagcatccggtgccttatgttgagtgtcaaaatcaccattttcatgtgccgtcctatgcccgtgcttatgtccgtgataccgccagcatggcggtgcaaccctatggtaaaccgggttttctgcacctgatatcaccttatatcacttccagtccggcacacagtatcgtggtgagcgatttagcggtattgcatcctgccgcagagtgtggatgtggattggctaccgattggtttgaactgctgggacgtgccggtataagtaaaaaccgtagttgtgcgattgccgcttctgagttgattaaggaatcctga

SEQ ID NO: 2923 - DNA, 177 bp, Xenorhabdus bovienii
  Coding sequence Name=Xb4151_4152.C436.gene74.dna; Position on contig =65128..65304bp; Strand=+
ttggtcacaatcgctatcggcacgatagggatgatcaagcgaacaaagggcgtcaacataagcaagagaagtcaaaagtcatctccagaaaaagaaagaaaaaaggggaaactcccttcaataataagtaaattgatttaccatccagcaagcaaaaaaggactaataatccactaa

SEQ ID NO: 2924 - DNA, 159 bp, Xenorhabdus bovienii
  Coding sequence Name=Xb4151_4152.C436.gene75.dna; Position on contig =65707..65865bp; Strand=-
atgttaattacttttagcaatatcaaaaaatatttcttagactctaataatattagatatagactctcaattttcgtttaccataatgccatgattaattccgaatattcctcatcaattaatagaaatatagaatatgttagctattctctggattaa

SEQ ID NO: 2925 - DNA, 756 bp, Xenorhabdus bovienii
  Coding sequence Name=Xb4151_4152.C436.gene76.dna; Position on contig =66124..66879bp; Strand=-
atgatacatcttttgattgtagacgcactgaacttgatccgacgcatccatgcggtacagggaagcccttgtgctcccgcctgtgaacatgcgttaaagcaattaattacccattcttctccgactcacgccgttgcggtattcgatgaagatgaccgtggccatagctggcgccaccagcttcttcccgattacaaagccgggcgttctgccatgcccgacgatttacagcaggaaatgccgctgattaaacaggcattcaacgcactaggcgtcgcttgctggcatgccgaagggcatgaagcagatgacttggcggcaacactggcaaccaaagtcacttctacagggcatcgcgtcaccattgtttcaacggataaaggctactgccagctactttcaccgactatccaaatccgcgattacttccaaaaacgctggctggatttaccctttgttgagcgggagtttggtgtttcccctgcccagctccccgattattggggtctgtccgggatcagtagcagtaaaattcccggtgttcaggggatcggtccaaaaacagcggccattctgctgcaacaagctggctcgctggataaccttttccaatatctggaagcccaaccggataaatggcgcaataaattggcgacccataaagaaatggcgtacatcagccgtgaagtagcttcactgcgcactgatttatcactcaatggcaatttacagcaattgcggttagatcacaggtaa

SEQ ID NO: 2926 - DNA, 135 bp, Xenorhabdus bovienii
  Coding sequence Name=Xb4151_4152.C436.gene77.dna; Position on contig =66833..66967bp; Strand=+
atgcgtcggatcaagttcagtgcgtctacaatcaaaagatgtatcatggtcgttatgctccgtccgtggattgattccttggcttcagtctcattgggttttaatgaggacgtgacttatttgatgatttcatag

SEQ ID NO: 2927 - DNA, 1338 bp, Xenorhabdus bovienii
  Coding sequence Name=Xb4151_4152.C436.gene78.dna; Position on contig =66949..68286bp; Strand=-
atggatttactctctcaacttgaagtcgatacactcaagcataccgcaagcagtgatttataccgcctgttccgtaactgctcactggcggtactcaactccggcagtcaaacagataacagcaaagaattgctgtcaaaacatgaagattttgatattaacgtcctgcgtagagaacggggtgtcaaactagaactcgtcaatccaccaaaagacgcttttgttgatggcaaaatcattcgctctctgcgagccaacctgttcgcggttctgcgggatattctgtttgttcatgcgcagattgaccatgcacagaaagtacaccatctgaatatggaaaatggtatgcacattaccaacaccattttttctattctgcgcaatgccaaagcgcttcatctctcagaagatccgaatatgatcgtctgttggggcggccactcgattaatgaaaaagagtatctgtatgggcgcaaagtgggtaacgagttggggctgcgcgaactgaatatctgtacgggctgtgggccgggtgcaatggaagcacccatgaaaggcgctgcggtcgggcatgctcagcaacgttaccagaaaagccgctttatcggcattacagagccttccattattgccgcagaacccccaaatccgctggtcaatgaactgatcatcatgccggatatcgaaaaacggctggaggcatttgtccgcatagctcacggcattattatcttcccgggaggggtgggaacagcagaagagctgctctatctactgggtattttgatgaaccctgataataaagatcaagtgctgccactgatcttgaccggaccaaaagagagtgccgattacttccatgtgctcgatcagtttatcgtcaataccttgggagaacaggctcggcagtactaccgcatcattatggatgatccttcagaagtcgcccgagtgatgaaaaagaccatgccgcaggttaaagaacatcgccgctctaccggagatgcctatagctttaactggtcactgaaaatcagccatgatttgcagcatccgttcgagccattccatagcaatatggctaacctgaatttgcatccgaatcagccttccgaaaaactggcttctgctctgcgctgtgccttttccggcattgtggcgggcaacgtgaaagaagcgggtattcatgccattgaaaaagacggggcgtttaaaatccacggtgatgtggatattatgcgctgtatggatgagctactgaaagattttgtccggcaggatcgtatgaaactgcctggaggcacagcttatgagccgtgctatgaaatcatcaaataa

SEQ ID NO: 2928 - DNA, 846 bp, Xenorhabdus bovienii
  Coding sequence Name=Xb4151_4152.C436.gene79.dna; Position on contig =68355..69200bp; Strand=-
atgtctttgtatcaggataatcaggcactagcccaacttactctgggtaagcccaccccttaccgcgatcactacgatcctactttactgcaagcggttccacgcagtatgaaccgtgaaccacttgggctgtttcctgataatctaccgtttcacggtgctgatatctggacgctgtacgagctttcctggctcaacacacgcggtgtccctcaagttgccatcggccatgtcagcctgaatgcggccagtgtgagcctcattgaatcaaaaagttttaagctttacctgaatagtttcaatcaaacccgctttgcggattgggataccgtgcaaaaaacactgcaacaggatttatccgtctgcgcaaacggtgaggtgaatgttgttttacatcccctgcacgatttcagccagcagccaatcgccgagtttgaaggaaaatgtatcgataatcaggacattgaaattgatgattatcaattcagtcgcgattatcttaacggtgcagcaacaggatcggtcgttgacgaaatattggtcagccatttactaaaatcaaattgcctgatcacacatcagcccgattggggttccgtacagatccgctataaaggccccaaaatcgatcaggaaaaattattacgctatctggtttctttccgccatcacaacgaatttcatgaacagtgtgttgagcgtattttcaatgacttaattgcattatgcgcacctgaaaaactcactgtttatgctcgctatacccgccggggagggttagatatcaatccgtggcgcagtaacgaagcatttatcccagaaacaggaagactggctcgccagtaa

SEQ ID NO: 2929 - DNA, 96 bp, Xenorhabdus bovienii
  Coding sequence Name=Xb4151_4152.C436.gene80.dna; Position on contig =69218..69313bp; Strand=+
atgatggcaactgagatagattgtagtgtatcaaggaatttcaaaggttcgtatttttattgtacattattcactgtgcttaccgagttagcgtag

SEQ ID NO: 2930 - DNA, 333 bp, Xenorhabdus bovienii
  Coding sequence Name=Xb4151_4152.C436.gene81.dna; Position on contig =69274..69606bp; Strand=-
atgaaatcactccattatcataaaattaaagtatcacttatcgatataattaaaaataatatttataatacatcttcagatatattcttattatttttatattatttaaataaatattcaataaaaaacatgaatatttgtttgaattgctaccctgataaaatcactaatagaataaacaaattaaagaataggaaaaggtctgagtatcacattatgacccacatcattgatggaaaaaaacaaatccataattccatcgaaaataaaagactcagcctcgcacagaagtcctacgctaactcggtaagcacagtgaataatgtacaataa

SEQ ID NO: 2931 - DNA, 159 bp, Xenorhabdus bovienii
  Coding sequence Name=Xb4151_4152.C436.gene82.dna; Position on contig =69603..69761bp; Strand=-
gtgcttctgtcacattggagatcatatgattctttcatccatcattttaagttcatcacattatatcgcttattcctatacagttttcagcaaaataacaaccggaaaatgatgccatcattccatcaattagttcaaataaataaaatattaaaatga

SEQ ID NO: 2932 - DNA, 552 bp, Xenorhabdus bovienii
  Coding sequence Name=Xb4151_4152.C436.gene83.dna; Position on contig =69737..70288bp; Strand=+
atgatctccaatgtgacagaagcactttctgattttacccgacgctatgttgaattgtggcaggaagagactgggctgccgccagtcagtagtgatctttatggtgttccttcttcgtgtattgagcggacaggggacggggttgtgtactggttgcccaagctattttctgttcacgaaaaactcagcaaagtggagaccgcgctggatattcgcttacaggattcgattcatgattattatgttacgcagcttgctggtgacatgaccgccagttttgaggggcagaatctcagtttgattcaggtatggagtgacgatgattttatccgtttgcaggaaaatctgattgggcacctcgtgacacagaaacggcttaagctttccccgacggcatttattgcgacgattgattcggatatgggcatgatatctgtgtgtaatctgaccgggcaggtcgttcttgaacagtttggcaaacctgagcgaacgatcttatctgccgatttggcgagttttctgtcggttatcaagccagccacatcgctatag

SEQ ID NO: 2933 - DNA, 108 bp, Xenorhabdus bovienii
  Coding sequence Name=Xb4151_4152.C436.gene84.dna; Position on contig =70709..70816bp; Strand=-
atgacagaagctgccaccacatcattggagggcaataagaatatcactgatatgatttcagcggaaaacttgcggcaagataaaatgaaacaaaaagaggggagataa

SEQ ID NO: 2934 - DNA, 327 bp, Xenorhabdus bovienii
  Coding sequence Name=Xb4151_4152.C436.gene85.dna; Position on contig =70849..71175bp; Strand=+
atgaatatcgaacaacaaattctacttaaattacagctaattgaagctgacatgaaagcggctggcctgtggcggagtcaccctcccaagccggaagcttttgaaagtaccgagcccttttcgctagatacgatgtccgcagaagagtggcttcagtgggttttaattccaagaatgcgagccatgatagaacaaaacgccaaccttccgacggcatttgatatcacaccttatttcgaagaagtctataaggaagaagcagaacgttatctgccgctgcttgaacatcttcgggaattggacagcctgtttacacaggatatttga

SEQ ID NO: 2935 - DNA, 753 bp, Xenorhabdus bovienii
  Coding sequence Name=Xb4151_4152.C436.gene86.dna; Position on contig =71177..71929bp; Strand=+
atgctggatatcatttatcaggacgatcatattgttgcggtcaataaacctgcgggttggttagtgcatcgcagctggcttgcccgccatgaaacggtttttgtcatgcagacgctgcgtgatcaaatcgggcaacatgttttccccgtccatcgactggataaaccgacatccggcgttttgctgatggcgctgtcaagtgaggtggcaagaacgctttcccaacaatttgaatgtcaccatatacaaaaaacatatcacgccattgtacgcggttatgttgaaggtgatggtattatcgactatgcactaatggaagagctggacaaaattgctgataaattcgctgatactgacagggaagcacaatcagcaatcacccactatcgttcattggcaaaagttgaatgtccggtagaaatagggcgttacccaacatcacggttcagcctgctggaactgatgccaaaaaccgggcgtaagcatcaattacgacggcatatgtcgcatctccggcatcccatcattggggataccacacatggcgatttgcgacaaaaccgaggagttgttaagtattatcagactggcaggttaatgctgcacgccagtcaactccaattggcgcatccggtgacaggagaagatctgcttctgactgccagatgggaagcttcgtggcagcatttgctggagcaatttggctggcagggtattgtacctgagttagaatgtccaaccactcatgaatga

SEQ ID NO: 2936 - DNA, 495 bp, Xenorhabdus bovienii
  Coding sequence Name=Xb4151_4152.C436.gene87.dna; Position on contig =71922..72416bp; Strand=+
atgaatgaacgcagtacaaataggctaaagagatcaatatttatggcaaagattggtgttttcgttggtacagtttatggcaatgcgctggcagttgcggaagaggcgcagcaaatccttcagcagcaggggcatgacgttgaggtttttgaagatgcgaccttgacgcagtggcaagagtaccagcaacaggttgttctggtcgtcacatcgacaaccggacagggcaatttacccgataatatccagccactttattcagatatgaatgataagttgggccatcagcccgatttacgttatggcgttatcgctcttggtgacagtagctatgacttcttttgtggcggtggccgcacatttgataaactgttacaggaacagggagcaaagcgtgtgggcgaagttctgctgattgatggtattgacgtggttgaaccagaagtctttgcccagaactgggttgaggagtggggcgctttactgacagaataa

SEQ ID NO: 2937 - DNA, 387 bp, Xenorhabdus bovienii
  Coding sequence Name=Xb4151_4152.C436.gene88.dna; Position on contig =72473..72859bp; Strand=-
atgtacgataacttgaaaagtttggggatcacccatcctgaagatattgatcgctatagcctccgtcaggaagcgaataacgatattctgaagatttatttccgtaaggataaaggcgaattttttgccaaaagtgttaaattcaaatatccacgccaactcaaaactatctctgacgacaattcagcgcaaggttacaaagaagtcaaagagattaacactaacctgcgttatgtaattgaagaactggatcaaatttgcaggcatgaccaagtggaagtggatttgaaacacaagatcctcgacgatctccgccaccttgagcatgttgttgccaataagattgcagaaattgaagcggatttagaaaaactgactcgcaagtaa

SEQ ID NO: 2938 - DNA, 825 bp, Xenorhabdus bovienii
  Coding sequence Name=Xb4151_4152.C436.gene89.dna; Position on contig =72938..73762bp; Strand=-
atgcagcaattacaatccattatcgacaatgcgtttgaaaaccgcactaacattacccccggcactgttgatgaagcaacccgtagcgccgtcaatcaggtgattcagatgctggacagcggcaaattacgtgtcgctgaaaaaatcgcagggcaatgggtaacacatcaatggctaaaaaaggccgtattactctctttccgcattaatgacaatcaggtcatcgaaggggctgaaagccgctatttcgacaaagttccgatgaaattcgctgattatgatcaagctcgtttcgaaaaagaaggttttcgtgtcgttccccctgccgcagttcgccaaggggcatatattgcccgcaacagtgtactgatgccatcttacgtcaacatcggtgcttatgtggatgaaggcacgatggtggatacttgggctacagtgggttcctgtgcacagatcggcaaaaacgttcacttgtctggcggtgttggcatcggtggcgttctggaacccttgcaagccaatccgactatcattgaagacaactgctttatcggcgcacgttctgaaattgtagaaggcgttatcgtagaagaaggtgccgtgatctctatgggagtttatattggtcagagcaccaagatttatgatcgtgaaacaggcgaaatccattacggccgggttcctgccggttctgttgtggtatcaggtaatcttccttccaaagatggtagttacagcttgtattgcgcggttatcgtgaaaaaggtcgatgccaaaacacgtggtaaagttggccttaatgagctgctcagaaacatagactaa

SEQ ID NO: 2939 - DNA, 2655 bp, Xenorhabdus bovienii
  Coding sequence Name=Xb4151_4152.C436.gene90.dna; Position on contig =73804..76458bp; Strand=-
atgtcagttgatatcacctttgcacacgcgcccattcctcccctgtctcctgtggaattttccctcgatgatcttcagtgcccagtattgaaacagcatgttgatgaatttcaattgtggctccagcaggcattcaaggcagggatctcaccagaagcactgatttcagcccgcagtgattatattgatcgtctcctgacgcgactatggcaggctcacggtttcgatcagaacacttcactttccctgattgcagtaggtggttatggccgacgcgaattgcatcctctctccgatattgatttattgattctcagcgaaagccaactgactgaagatcaagcccacaatatcgggcaattcataaccctgctctgggatatccgtctggaagtgggccatagtgtcagaacctttgaagagtgcctgcatgaagggttatcggatttaaccgttgccacaaatctgattgaatcacgtttgatctgcggtgatcttcctttgttcctgcggttacaaaagcacattttcagcgatgatttttggccttcctcaacgttcttcgcagcaaaactccgcgaacagtgggaacgccatcagcgttaccatagcaccagttataatctagagccggatatcaaaagcagccccggcgggctacgggatattcataccctgctttgggttgctcgccgccattttggggcagcctcactggatgaaatggtggatttcggcttcctgacccgtgaggagcgcaatgaattaaatgaatgccagaattttctctggcgcatccgttttgccctccacttagtcgtcacgcgctatgacaaccggctactgtttgaacgtcagttcaatgttgcccaattgctcggttatgaaggagaacgcaatcaacctgtcgaaaggatgatgaaaaatttctaccgcgtgacccgccgtgtcagtgaattgaatgacatgctacttcaactctttgatgaagcgattctgacattacagcccgatgaaaaaccacgtcccttgaacgaagcgtttcagttgcggggggatcttatcgacttaagcgatgaaaccctgtttatccaagatccaacctcaattttaaaaatgttttatcacatggctgaacatcgggaaattaaggggatctattccacgacattacgccagcttcgctacgcccgtagaaacctcaaacatcctttgtgtgagttgcccgaagcacgaaaacttttcatggatatcctgcgccatcctcgtgccgttaaaaacgcactgatcccgatgcaccgccatagcgttctaggtgcttatatgccgctctggagcaatattgtcggacagatgcaatttgaccttttccacgcttataccgttgatgagcacacccttcgggtactgcaaaaactcgaaagttttgctgatgaaaacaaccgtgtgatccatcccttatgtgtcgaactgtatccccgcattcctcagccggaacttttacggctggccgccttttttcatgatatcgccaaggggcgtaatggcgatcattctgaactgggtgccaaagatgcgtttacctttgcacgccaacatggcctgactacccgtgaagccgaattagtagaatggctggttcgcgaccatttgctgatgtcagtcactgcacagcggcgggatattcaagatcctgacgtcatccaacaatttgccggccaggtcaaaaataaaaaccgactgaattacctgctctgccttaccgtcgcagatatctgcgccaccaactctaaattgtggaacagttggaagcagagcctgatccgcgaactctatttcgccactgaaacccagttgcgccaaggtatacagaatacacctgacttgcgtgaacgtgtccgccataatcgtttgcaggcattggcgctactgcgacaagaaagagctgacgaagagcaattacacaatatctggagccgctgtcatgcggattatttcctgcgccatacgccggatcaactggcctggcatgccggccatttgatccaacatcaatctgcagagcccatggtgttaatcagcaccgcattttcccatggtggaaccgaaatttttatctggtgtcaggacagaccttcgcttttcgcggctgtagtcggagagttggacagacgcaacctcagtgtccacgatgctcaaatctttaccaatcgcgatgaaatggcgatggataccttcattgtactggagcccaatggtcatccgctggcgctcgatcgtcatgaacctatccgccgggcattattgaaagtcgtgaatgatccgcatccgaaagcgcccaaagcgcgtaatctgcccgctaaattgcgtcattttgatgtgccgaccaaagtgagttttttaccaacacaaaatgcccgccgttcttatatggaattagttgcactggatcaacccggtctgctggcacgcgtaggcaatattttcgccgaactgggcgtttccctgcatggcgcgcggattaccaccattggagaacgcgttgaagacttttttatactggcagataaagaccatcaggagctggataacaaaatcaagggagaattatcagaaaggttgacagaagcccttaacaccaaggataaagtataa

SEQ ID NO: 2940 - DNA, 192 bp, Xenorhabdus bovienii
  Coding sequence Name=Xb4151_4152.C436.gene91.dna; Position on contig =76368..76559bp; Strand=-
ttgataaacgaagcccttgtacataaactgtccccaagggcttcattatctgccaataacgtctgttcatctcacgtttttctcatcataggtttctgcatatgtcagttgatatcacctttgcacacgcgcccattcctcccctgtctcctgtggaattttccctcgatgatcttcagtgcccagtattga

SEQ ID NO: 2941 - DNA, 111 bp, Xenorhabdus bovienii
  Coding sequence Name=Xb4151_4152.C436.gene92.dna; Position on contig =76536..76646bp; Strand=+
atgtacaagggcttcgtttatcaacgccgtcttatctacgtgatttctgccaatgattgcaaaatcgcgccagccggaaattattcgttaatcagcaccgctgagatatga

SEQ ID NO: 2942 - DNA, 813 bp, Xenorhabdus bovienii
  Coding sequence Name=Xb4151_4152.C436.gene93.dna; Position on contig =76643..77455bp; Strand=+
atgaggttcttcttctttgcgcaatgtcatgatttcacagccattttcggtgactacgatggtgtgctcatactgagcagaccagccgtgatctttggttttgactgtccagccatctttcatggtgcggatacgggaatcgccggtattgaccatcggttcaatcgtgaacgccatccctttctgcaatacaacgccgccatcatcagcgtcataatggagtacgtggggttcttcgtggaagaccctgccgataccatgaccgcagtattcgcggacgacagagtaatcctgcccttccacatattgctggatcgctttgccaaggctgcgcaggcggatgccgggttttaccattttcagcgcaaggtacaggctttcctgggtaacgcggcacagacgctcaccctgaatagtcgatttgccgacaatgaacattttggaggtatcgccgtgaaattcctctttgatgacagtgacatcaatgttgacgatatcgccttctttcagcaccttgtcatcgctgggaataccgtgacaaatcacatcattgacggagatgcatacggatttcgggaaaccgtgatagccaagacaggcagaaattgcctgctgtttattggtaatatgatcgtggcaaatacgatcaagctcaccagtggtcacaccaaccttaacgtaaggttcgatcatttccagaacttcggctgccagacgtccggcaacgcgcattttctggatgtcttcatctgttttgatagaaatagccatgaaatcggtccattcaagtcggaactttacccgactgcttga

SEQ ID NO: 2943 - DNA, 135 bp, Xenorhabdus bovienii
  Coding sequence Name=Xb4151_4152.C436.gene94.dna; Position on contig =77462..77596bp; Strand=-
atgccggcgcgctttataccacaaacagcccccaaattccaacatttgttaccgctttctggtaggcagatctatcaacggttattggcagatattctgtggactgataccataactaccagcatttttccttag

SEQ ID NO: 2944 - DNA, 726 bp, Xenorhabdus bovienii
  Coding sequence Name=Xb4151_4152.C436.gene95.dna; Position on contig =77796..78521bp; Strand=+
atggcaactgtttccatgcgcgatatgctgcaagcgggcgttcacttcggtcaccagactcgttactggaacccaaaaatgaaacctttcatctttggcgctcgtaacaaagttcatatcatcaacctggaaaaaactgttccaatgttcaatagtgcattggcagagctgaacaaaattgcttcccgtaaaggcaaaattctgtttgttggcaccaagcgtgcggcctgcgaagcaatcaaagaagaagcactgggctgtgaccaatactttgttaaccaccgttggttaggtggtatgctgactaactggaaaactgtgcgtcagtcaatcaagcgtctgaaagatctggaagttcagtctcaggacggtacttttgacaagctgaccaagaaagaagcgctgatgcgtactcgtgagcttggcaaactggaaaacagtctgggcggtatcaaagacatgggcggcctgcctgatgctctgtttgttatcgatgctgaacatgaacacattgctatcaaagaagcaaataacctgggtatcccagtattcgctatcgttgatactaactctgatccagacggcgttgatttcatcatccctggtaacgacgacgcaatccgtgcagtaaaactgtacttgggcgctgtggctactgctgttcgtgacggtcgttcacaagatctggctgttcaagctgaagaaggtcttgtagacgctgaataa

SEQ ID NO: 2945 - DNA, 102 bp, Xenorhabdus bovienii
  Coding sequence Name=Xb4151_4152.C436.gene96.dna; Position on contig =78488..78589bp; Strand=-
gtgacaggccccctaaccaatatatttcaatacctggtcaataagggctcaagaatgagcatgccttattattcagcgtctacaagaccttcttcagcttga

SEQ ID NO: 2946 - DNA, 858 bp, Xenorhabdus bovienii
  Coding sequence Name=Xb4151_4152.C436.gene97.dna; Position on contig =78669..79526bp; Strand=+
atggctgacattaccgctgctctggtaaaagaactgcgtgagcgtactggcgcaggcatgatggaatgtaaaaaagcactggttgaagcaaatggtgatatcgagctggctatcgataacatgcgtaaatcaggtcaggcaaaagccgctaagaaagcaggccgtgttgcggctgaaggtgttattctggttgaagttgcagctgacgctaaatatgcgggtattgttgaactgaactgtgaaactgacttcgttgctaaagactctggcttcctggcgtttggtaaagaagtgattgctgccgttatggcggacaaaaatgctgatatcgatgcactgaaagctcagttcgaagaacagcgtgctaacctggtagcgaaaatcggtgaaaacatcaatatccgtcgcgttactattctggaaggtgacgcagtaggttcttacctgcacggtgctcgcatcggtgttctggtttccgctgaaggcgcaagcgaagaactgatcaagcacgttgcaatgcacgttgctgcaagcaagccagaatacgtgaacccaactgacgttcctgctgatgtcgttgcgcgtgaacaccagatccagatggatatcgcaatgcaatcaggcaaaccgcgtgaaatcgcagagaaaatggtttctggccgcatgaacaaattcactggcgaaatctctctgacgggtcaaaactttgtgatggatccaagcaaaacggttggtgacctgatgaaagaaaataatgctaaagttatcaacttcatccgttttgaagtcggtgaaggcattgagaaagttgaagctgatttcgcagcggaagttgctgcaatgagcaagcagtcttaa

SEQ ID NO: 2947 - DNA, 729 bp, Xenorhabdus bovienii
  Coding sequence Name=Xb4151_4152.C436.gene98.dna; Position on contig =79657..80385bp; Strand=+
atggcaaccaatgcaaaacccgtatatcagagaatcctgcttaagctcagtggagaagccctgcaaggcgcagaaggttttggtatcgatgccagcgttttagaccgcatggctcaggaagtcaaagaactggttgagctgggtattcaggtcggtgtcgttattggcggaggtaacctgtttcgcggagccggtctggccgaagcaggaatgaaccgtgtagtcggcgatcacatgggcatgttggcaaccgtaatgaatggcctggcaatgcgcgatgccttacaccgcgcctatgtgaacgctcgtttgatgtctgccattccactgaatggagtgtgtgacaattatagctgggctgaagctatcagcttactgcgtcacggtcgtgttgttattttctctgcaggtactggcaacccattctttacgacagattccgcagcatgcttgcgcggcattgaaattgaagcggatgttgtgttaaaagcaaccaaagttgatggggtctattctagtgatcctgctaaagatactgaagctgttctttacagtaagctcacttatcaggaagtactggagcgtgaactgaaagtcatggatctcgccgcctttactctggctcgtgaccatagtatcccaattcgtgtcttcaatatgaacaagccaggcgcacttcgtcgtgttgtgatgggggaaagtgaaggtacgttgatttctcacggataa

SEQ ID NO: 2948 - DNA, 618 bp, Xenorhabdus bovienii
  Coding sequence Name=Xb4151_4152.C436.gene99.dna; Position on contig =80458..81075bp; Strand=+
atgatatcttatgttgatattcgtgggctacaaaataaccagatcccaagggtttgtaacgtgattaatgaaatcaagaaagacgcacaagaccgcatggaaaaaagcgtcgaagcactgaaaaaccaaatcagcaagattcgtactggccgtgcttctcccagcctgttggatggcatcagcgtcgattattacggctctgcgactccattacgtcagattgccagcgtcgttgctgaagatgcacgtactttagcgataacggtttttgatcgttctatgacgccggctatcgaaaaagcgattatggcttccgatctgggtctgaacccatcttctgctggaaccattatccgtgttccactgccagcactgacagaagagcgtcgtaaagatctgatcaaagttgtgcgtggcgatgcagaacaaggccgtgtgtccgtgcgtaatatccgtcgtgacgccaatgataaggttaaggcactgctgaaagacaaagaaatcagtgaagatgaagaacgccgttcacaagacgaaattcagaaattgactgacagcttcatcaagaaaattgatgaagcattggcaagtaaagaaactgaattgatggatttctaa

SEQ ID NO: 2949 - DNA, 144 bp, Xenorhabdus bovienii
  Coding sequence Name=Xb4151_4152.C436.gene100.dna; Position on contig= 81076..81219bp; Strand=+
ttgccatttcacgaatataacgccgcagtccttgcggcgttattctttgcatcacatttctttctcaggcgatggacataccgatcgagacggctcaaactattgacattttatgtcagtagaatactcagagtattaaaatga

SEQ ID NO: 2950 - DNA, 1197 bp, Xenorhabdus bovienii
  Coding sequence Name=Xb4151_4152.C436.gene101.dna; Position on contig= 81216..82412bp; Strand=+
atgaaacgcttaactatccttggctcaacgggctcgattgggaaaagtaccctttctgttgtcagaaataacctggataaattccaagttgtggcactcgtcgctgggaaaaatattgaaatcatggcacagcagtgtctggagtttcgtcctcaatatgcggcaatggcggatgcgcactcagcaacggtattacggcagttattacaggagcagggaagccagacagaagtgttatccggtagggaagccatttgtgatttagctgcgttggatgatgttgatcaagtcatgtccgcgattgtcggtgttgccgggttattgccgacgctggcggctatccgcaaaggtaagcaagtcttgttggccaacaaagaagcactcattaccagtgggcgtttgttcatgcaggcggtgaatcaatatcaagcgcaactgttgcccattgatagtgaacataatgccatcttccagagcttgcctgaatctgttcagcacaatcttggaaatgcaagcttaaaacaacatggtatctccagtattatcctgacgggatcaggtgggccgttccgcagaacccctctggagacattgcttgatgtcacacctgatgaagcctgtgctcaccccgtctggtctatgggacgcaaaatttctgttgattccgcaaccatgatgaacaaagggctggaatatatcgaagctcgttacctgttcaatgcctctgctgatgaaattgaagtgctgctccatcctcaatcagtaatccattcgatggttcgttatcaggatggcagcatcattgctcagttaggaacgcaggatatgtgtaccccaatagcttatgcaatggcttatcccaatcgtatcgtttctggcgtaaaacctctggattttactgaactgagcacactcacttttgaagcgttggattatcggcgttatccttgtctgaaactggccattgatgcttgccatgaaggtcaggcggcaacaaccgcgttgaatgccgccaatgaagaaacggtcagtgctttcttgaaagatgggatccgcttcactgatatcgcgatgattaatcggttggtcgtcgaaaaattaaatttacctgaacctgaaagcatcgaagaggtcttagaaatcgataaagtcgctagagaattagcaaaagaaacgattaaggcctgctccaaatag

SEQ ID NO: 2951 - DNA, 210 bp, Xenorhabdus bovienii
  Coding sequence Name=Xb4151_4152.C436.gene102.dna; Position on contig= 82393..82602bp; Strand=-
atgaaaaagccgtgtcaacacttaccacggctatttctggggcatggcccgaatgaaagcctctatctttggcacacactcagaaaacgtgtgacaaatattgaactggctattataacaactattatttacccgcgaactataccatttgccaaaacgcaaacaaatatatacttattagcaaaattcgctatttggagcaggccttaa

SEQ ID NO: 2952 - DNA, 696 bp, Xenorhabdus bovienii
  Coding sequence Name=Xb4151_4152.C436.gene103.dna; Position on contig= 82721..83416bp; Strand=+
atggatggcaatggccgctgggcaaaacaacgtgggaagttaagggtttttggccatcgcgccggtgttaaagctgtgcgggttgccgtgagtttttcggttaaacacaatattgaatcactgacattatatgcttttagcagtgagaactggaatcgcccacagcaggaagtcagttcattaatggaattgtttgtttttgctcttgataatgaagtgaagagcttgcataagcacaatgtgaaattgtctgttattggtgatatcagtcggtttagctcacggttgcaggaacgtattcgccgttcagttgaattgacggcgggcaataccggattgcagcttaatattgccgccaattatggcgggcgttgggatttggttcagggcgttaagcaaatcgctgaaaaaatcagggcaaatgagctggagcccgaggaaattactgaagccacagtgggcagcgtcatcaatttgagtgagcaacccgaagttgatctggtgatcaggacgggcggcgaacaccgtatcagtaattttctgttatggcagatagcttatgcagaattgtattttaccgatatactttggcctgatttcgatgaaactgtttttgaaggtgccattaatgcctttgttaaacgagaacgccgattcggcggaacaataccagacgatgccgaagtgggatcatag

SEQ ID NO: 2953 - DNA, 864 bp, Xenorhabdus bovienii
  Coding sequence Name=Xb4151_4152.C436.gene104.dna; Position on contig= 83426..84289bp; Strand=+
ttgctgaagtaccgtcttttaactacgttgatattaattccaattgttattgcagcactgtttttacttcctccatccgggtttggattggttgttattacagtctcagtacttgccgcatgggaatgggggcaatttgccggccttttcacacaagccaaacgtattacgctggccgtgttatttgccgtagggctgctggccttacagtactctttgtcagatttttcccacctcattgaaaaaccacagattgtatatctgttgtgggctggtatgatttggtgggctgcggctatcctgttggtcaccacttatcctgcttctgcctcaatctggaagtcatcaactgcactacgcctgttgtttggcgttctgactatcgtgccattttattgcggaatgatggtgctccgaactcagggatatgaaaacaacacctatcatggtgcatggtggctattgtatgcgatgctgctggtatggggagccgattccggtgcctatgtttttggccggacactgggtaagcacaaaatggcaccgagagtgtctccgggtaaaacacttgaaggtttggtcggaggagtattgactgctgcgcttatttcgtggttgttcggtaagtttgcgccagtaccggtaatgcctgaaaacttattattgatttctgctgtggttgtgattgcctctgtcttcggtgacttgactgagagtatgttcaaaagagaatcaggcatcaaagacagcagcctgctgatccccgggcatggtggggtcatggacagggtagatagcctgacagcagcagttcctgtgttcgcgggattggtactgttaatttcttctggatttgggctctga

SEQ ID NO: 2954 - DNA, 1353 bp, Xenorhabdus bovienii
  Coding sequence Name=Xb4151_4152.C436.gene105.dna; Position on contig= 84299..85651bp; Strand=+
atggatattctctggaatctggctgcatttattgttgcattgggtattcttatcacagtgcatgagtttggtcatttttgggttgccagacggtgtggtatctacgttgaacgcttttccatcgggtttggtaaagcgctctggcgtcgcacagataagcagggaaccgaatacgttattgctcttatccctctggggggatatgtcaaaatgcttgatgagcgggttgagtctgtttctcccgaacgtcgtcatatggcattcaacaataaaaccattggccagcgcgcggcagtcgtcagtgcagggccaatcgctaactttattctggcagtcattgcttattggttggtttttgtgattggcgtgccttctgtgcgtccggtggttttggatgttaagccagattctattgccgctcaggcaaatattttgcccggaatggaactaaaaacggttgatggtatcgaaacctttgattggaattcggtacgtctggccttagtgagtaaagtgggtgaatcttttgtgtcaatggatgtgatgccaatggatgctgctgccagcatgcaaaaaacattagatttacgtgactgggcatttgatccatccaagcaggatgtcttgctgtctttgggcattatgcctgttgtaccacgaatcagctctcaggtagagaacgtttatccggactctcccgctgaaaaagcaggtttacaacgtggggacaggatcgttaaagtcaacggtcagaatgtggatgtctggcacacttttgtatcttttatcaggaaaaatccgaatgttcctctaaaattggacgttgcgagggcaaatagcatcattcctctgtctttgacgccagaggtcaggcggttgtccaatgggcgtgaggaaggcttcgctggtgccgaacttcacgttattcctctggcggatgaatataaggtaattcaacaatatggggctttctctgccatttatcaggcaggagacaaaacttggcaattgatgaagctgactgtcaatatgatcggtaaattaattgtgggggatgtgaaactcaataacctgagtggccctatttccattgccaaaggcgctggagtatcggctgattctggcttggtgtattatttgatgtttttggcgctgattagtgtcaaccttgggatcattaatttgttcccattacccgtactagatggtggacacttgcttttccttgctattgagaagatcaagggagggccagtctccgagcgtgtacaagacttcagttatcgcattggtactatattactggtgttattaatggggcttgcacttttcaatgatttctcccgcttctaa

SEQ ID NO: 2955 - DNA, 2436 bp, Xenorhabdus bovienii
  Coding sequence Name=Xb4151_4152.C436.gene106.dna; Position on contig= 85632..88067bp; Strand=+
atgatttctcccgcttctaaggtgggagaccggttaggaaaacgcataacaacgatggcgatgaaaaagttgctcatagcgtcgctgctgttcggcagcgccactgcatacagttcagacggattcgtggttcgggacattcattttgagggtcttcaacgtgtcacttctggtgcagcattactgaatatgccagttcgcgtaggtgatacaatcagcgatgaggatatcagtcgcacgattcatacactgttcgcgactggaaactttgaagatgtccgtgtcttgcgtgatggcaatacactcgtcgttcaggttaaagaacggccaaccatcgccagcattactttctccggtaacaaatcggtgaaagatgacatgctcaagaaaaaccttgagtcctctcgtgttagtgttggtgaagctcttgaccgcaccatgctgtctaatatggaaaaagggctggaagatttttactacagtgttggtaaatacaatgctacggtgaaagccgttgtcacgccgctgccccgtaaccgtattgatttgaaactcatattttcagaagggatctcagcgcagatccagcagattaatattgtcggcaataaagcattttctacaaatgaattgctcaaccgtttccagctcagggatgatattccttggtggaactttatggctgaccagaaataccagaaacagaaattggcgggtgatcttgaaactttgcgcagtttctaccttgatcgaggttatgcccgcttcaatattgattcgactcaagtcaatctgacgccagataaaaaaggtatctatatcaccgtgaatatcaatgaaggcgctcagtacaagatcgccagtgttgatttgaacggtaatttggccggttatcagtctgaagccacaaaactgaccaacattcagcctgggtcgctgtataacggtacagaagtgacctcgatggaaaaggcaattaaaaacctgcttggtcgttatggctatgcctacccacgagtgattacacagcctgaaatcaacgatacagacaaaacggttaagttacatgttaatgtggatgcaggtaaccgtttctatgtgcgtaaaatccgcttcgaaggtaatgatattagcagagactctgtgcttcgccgcgaaatgcgtcaaatggaaggggcatggctaggcagcgatcgcgttgaacagggcaaagagcgtctggacagactgggcttttttgaaacggttaatgtggatacagaacgtgtatccggtagcccagatttggttgatgtggtttataaagtcaaagaacgcaatacgggttctatgaactttggtgttggtttcggtactgaaagtggcatgagcttccaggtcggtcttcagcaggaaaactggctgggaacgggtaactctgtggggatcagtgccagcaaaaatgactattcgacctctgcggatttgtcctttaccgatccttacttcacagtggatggcgtaagtctgggcggtcgtgtgtactataacgatttccgtgcagatgatgccgaactctctggttataccaataaagcctacggtactgaaggtattttgggcttcccgctgaatgaaaataacaggttggccatgagattgggctatgcccataactcactgtcgaacatgcgtccacaggcagcgatgtggcgttatttgaaaaaaatgggcaaagagccacctttgaagggcaaggcatcgttcgattccaatgatttcccactgacattcagttggatatatggcaactttgaccgtggtttcttcccaacttcgggtttcaagtcttcagtggatgccaaagtggctctgccaggctcagacaaccagtactataaacttacttggagcgctacaggttattatccgattgatgataaaaattcatggataatgatggggcgcacccgcatgggctatggtggcggtcttggtggcaaggaaatgccattctatgaaaacttctatgctggtggttctaatagtgtccgtggtttccgttcgaataatatcggtccaaaagcgatttatttaggtgagaacaaagaaccagaaaaaaatagtccatcccgtgatgctgtgggggggaatgcgttagcgactgccagctttgagctgattacgccaacaccgttcctggatgcgaaatatgccaatactgtacggacttccttctttgttgatgcgggaaccgtgtgggataccaactggaacaatatttcccctggtctgcctgactacagcaagccaaataatatccgtgtttcggccggtattgcattgcaatggttgtcaccgttggggccattgaccttctcttatgggaagccaatcaaggaatacgaaggtgatagagcggagcagttccaatttaacatcggcggcacttggtag

SEQ ID NO: 2956 - DNA, 498 bp, Xenorhabdus bovienii
  Coding sequence Name=Xb4151_4152.C436.gene107.dna; Position on contig= 88166..88663bp; Strand=+
gtgaaaaaagtattgtgtgcggcaagctttggtatcgcattagctttctctgcgggtgttcaggcagcggacaaaatcggagtcgtgaatgttggtgaaatcatccaaaagttaccggctcgtgaagctgctgtaaaacagttggatagcgaatttaaaggccgtatatccgagttgcagagtatggaagctgatatgcagaccaaggtgcagaaacttcagcgtgatggttcaaccatgaaagccagcgaacgcacaaaattagagaaagaagtgatggcacagcgtaacgactatgcccagaaggcgcagtctcttgataacgatagccgtcgccgccagatggaagagcagaacaaactcctgacgcgtattcacgatgccgttaaagtggttgcaggtaaagaaggttacgacgttgttcttgatgctaataccgtattatattccgtatcgggtaaagacattaccgcagatgtactgaagcaggttaaataa

SEQ ID NO: 2957 - DNA, 1029 bp, Xenorhabdus bovienii
  Coding sequence Name=Xb4151_4152.C436.gene108.dna; Position on contig= 88668..89696bp; Strand=+
atggtttcaattcgattagctgatctcgctcagcagttgaatgcgcaattacatggtgatggcgatatcgtcatcaccagcattgcgccaatgtattcagcaaatagcgaacaaattacatttttatctgacagccgttacactgacaaacttgcagaatgtcaggcagcggctgttgtgctgcgtgaatctgatcttactcattgtaaggtcgctgcactggttgttgataatccttatcttgcctatgcacgtatggcacaaatcatggatacgacgccacaacctgcgcaggatattcatccatcagccgtgatattttctgaagtgcaattgggaaaaaatgtggcggttggtgcaaatgctgttgtcgaatctggcgttattctgggtgacaatgtcattgtcggtgcgggttgctttattggcaaaaatacgcgtattggtgcaggaacccgcctttgggccaatgtatcggtataccataacgttgaaattggcgaacagtgccttattcagtcaggcactgtgatcgggtcggatggttttggctatgccaatgaccgtggcaactggattaaaattccacagttaggctcagtggtcatcggtgaccgcgttgaaatcggtgcttctacgactatcgatcgcggagcgctggataacacagttatcggtaatggtgttatcattgacaaccagtgccaaatcgctcacaacgtcataattggtgacaacacagccgtggctggtggtgtcactatggcgggtagcctgaaaattggtcgttattgtatgattggtggagccagcgtcattaatgggcatatagaaatctgtgataaagtgaccgtgactggtatgggcatggtgatgcgtccaattacagagcctggtgtatactcgtctggtatcccattacaaccgaacaaagtttggcgtaaaactgctgctttagtcatgaatatcaatgaaatgaataaacggcttaaatctgtagaacgccagcgtgaaggtgaaaacgagtaa

SEQ ID NO: 2958 - DNA, 189 bp, Xenorhabdus bovienii
  Coding sequence Name=Xb4151_4152.C436.gene109.dna; Position on contig= 89656..89844bp; Strand=-
ttgcagagtacgattatcactcatctaaatactcttcctgtctatataagaatcatagtattaacgacacggcctgcgttaactccaaatgcagagttatcaggcaggccgcaaaaaataaaaacacaaccaaaaaacgtttgtatgattactcgttttcaccttcacgctggcgttctacagatttaa

SEQ ID NO: 2959 - DNA, 1062 bp, Xenorhabdus bovienii
  Coding sequence Name=Xb4151_4152.C436.gene110.dna; Position on contig= 89950..91011bp; Strand=-
atgtgggttatttgccgtctgaagctcaatttctattctggcttcttccagcgttcttccgctacggtaaagcgctttataggcattacggattgcatgcagcgattctttatcaaatccacggcgcttcaagccttcaatattcaacccgaaaggtgtggcatggtttccctgtgcaatgacataaggcgggacatcctgcgcaacaccagagcaaccgcctaccataacatgagagccaatctgacagaattgatggacagctgtcattccaccgataatgacgtaatcgcccagaatgacatgcccacccagcgtgccgttattcgcaatgatacagcgatcaccaatcatgcaatcatgggcaatgtgggtgttaatcatcagcagattgtcactgccaattttagtcaaaccgccaccctgaacggtgccacgatgaatcgatgcgctttcacgaatacggttacgatcaccgatctcaacgcgagtcggctcaccctgatatttgagatcctgatttacttcaccaatagaggcaaattgataaatctggttatcacggccaattttggtgatcccgttgatcacaacatgggatttaacttcagtcccttcaccgatctcaacctgagaaccgatatagcaaaatgggccaatacggacattgccaccaataactgcaccctcttcaacaatggacgagggatgaataacagcagtttgatcaatcatatattaagcctcacgacggcgagcacacatcatttcagcttcgcaagccacttctccatcgacttttgctacgcccttaaaacgcgcaacaccgcgacgttctttaataaattcaacttccagaaccatttgatcacctggcagaaccggacgcttgaaacgagcgccatcgatagcggcaaagtaatacaactcacccggagccagcgagccaacgcttttgaatgccagaattccggttgcctgagccattgcttcaaggatcaggacgcctggaaaaattggcttacccggaaaatgcccctgaaagaatggttcattaaatga

SEQ ID NO: 2960 - DNA, 1185 bp, Xenorhabdus bovienii
  Coding sequence Name=Xb4151_4152.C436.gene111.dna; Position on contig= 91079..92263bp; Strand=+
atgaaggatactcctttggctaccttctcttctgttaacaatcagcgcccgctgacaattgctttggttgccggagaaacgtccggtgacattcttggagccgggctgattcgcgcattgaaagctcaaattcctgatgctcactttgtgggtgttgctggccctcttatgcaggcggaaggttgtgaagcctggtatgagatggaagagctggcagtcatggggatcgttgaagtattaggacgcttgccccgtttgttgaaaatccgcaaagatttaacagcacgatttaccgcgttgaagccggatgtctttgttggtatcgatgccccggattttaacatcacgttggaagggcgattgaaacagcgagggattaggacgattcattacgttagtccatcagtatgggcgtggcgtcagaaacgggttttcaaaatcggccgggcaacggatctggtactggcatttttgccatttgaaaaagcgttctatgatcgatttagcgttccatgcaaatttattggccacacgatggctgattcgatgccactgcaaacggataaaatggcagcccgggaggctttgggtgttcccttaaatgcccattgtctagcgatactgccgggtagccgccatgcagaagttgagatgttgagtgctgattttcttagaaccgtgcagttgctgaggaaaattcttcctgatctgcatgtattggttccattggtgaatgccaagcggcatcagcagtttcagcgtattaaagatgagattgcgccggatttatctgtccatatgttggacggtaacgccggtaaagccatgatcgccagtgatgcgactttactggcctcaggtacggctgcgctggagtgtatgctggccaaatgcccgatggtggtgggctacagaatgaaaccttttacattctggctggcaaagcggctggtgaaaacgccgtatgtttctctgcctaacctgctggcaggcaaagaattagttaaagaactattacaggacgaatgtgagccacaagcattgtctgaggcattgttgcctctcttgcaaggtggtgctgatgtggaagcgttgaaacaaacgtttctgcatttgcatgaaagcattcgctgtgatgccgatgaacaagctgcacaagcggttctggaattagcgagaagataa

SEQ ID NO: 2961 - DNA, 591 bp, Xenorhabdus bovienii
  Coding sequence Name=Xb4151_4152.C436.gene112.dna; Position on contig= 92263..92853bp; Strand=+
atggattttgtttatcctcaggcgaatttgattgccggtgttgatgaagttgggcgtggcccactggtcggggcagtggttactgcggcagttattcttgatcctgccaaaccgattacaggcttgatggattcgaaaaaacttacagaaaagcggcgtgaagcactttatctggaaattaaagaaaaggcgctgtgctggagccttggtcgcgctgaaccagaagaaattgatcaactcaatattctccacgctaccatgcttgccatgcagcgagcggtggaaggtttagctatcacaccggattatgtcctgattgatgggaaccgttgtcccgcattgccgatgtcggcactggcggtgatcaagggggatagtctggtggcggaaataagcgctgcttctattttggcaaaagtgacacgtgacagagaaatggctgagttgggtaagcaatttcctgattatggtttcgcgcaacacaaaggttatccgaccgctttgcatctggaaaaactggctttgctgggcgctacggaacatcatcgtaaaagctttgcgccggtcaaacgagcgctgggtcttggataa

SEQ ID NO: 2962 - DNA, 3483 bp, Xenorhabdus bovienii
  Coding sequence Name=Xb4151_4152.C436.gene113.dna; Position on contig= 92870..96352bp; Strand=+
atgacagaaccacgttttgtacacttacgtgttcacagcgactattcaatgattgacggtttagccaaaacagggtcactgataaaaaaagtggctaaattggatatgcctgcttttgcgatcactgattttactaacctgtgcggcttggtgaaattctatggcagtgcccatagtgcaggtatcaagccgattataggcgctgatttttatgtggaaagtgatctgctgggggatgaatatgcccatctgacgatccttgcccgtaataacgaaggttatcaaaacctaacctttttgatctccgaagcttatcagaaaggctatggtgcgattggtccgacgatcaaacaagaatggctgataaaatacaaagccggcttgattcttctgtctggtgggcgaatgggggatgtcggcaaattcttactgcgcggaaatcgggcgatggcggatcagtgcctcgatttctatcaggaacattttccggacagctattaccttgaattgatccgtacaggacgtcaagacgaagaaaattatcttcatgctgccgtcgaagtggcagcagaaaaaaacttacctgttgtggcaactaatgacgtttgtttcctggaaagtgacgactttgaagcccatgagattcgggttgccattcatgatggctatacgatggctgatccaaaacgccctaaaaactatagccctcagcagtatctgcgcagtgaacaggagatgtgtgagctattctctgacattcctgaagcgctgcaaaatagtgtcgaaattgctaaacgctgcaatgtgactattcgtctcggtgaatatttcctgccacagtttccaacaggggatatgagcactgaagactatctggttgaaaagtcgaagcaaggcctggaagatcgtctgaattttctctatcccgatccgcaaatcagagcggaaaaacgttccgaatacgatgagcgtctggatatagagctggaagttatcaaccaaatgggcttccccggctattttctgatcgtgatggaatttatccaatggtcgaaagataatggcgtacccgtagggccggggcgtggttccggtgcgggttcccttgtcgcctacgccttgaaaattaccgatattgacccgttggcatttgacttgctgttcgaacgtttcctcaaccctgaacgtatttcgatgcctgactttgacgtcgatttctgtatggaaaaacgtgatcaggtgattgaccacgttgcggatatgtacgggcgggatgcggtatcgcagatcatcactttcggtacgatggcggcaaaagccgttattcgtgacgttgggcgtgtattggggcacccatatggctttgttgatcgaatatcgaaactagtgcctcctgatcctggcatgacgttggaaaaggcatttgcggctgaacctcaattgcctgaaatttacgaggcggatgaagaagtcagggtgctgattgacatggctcgcaaattggaaggtgtcacccgtaacgccggtaaacatgcgggtggtgtggtcattgccccgaccaagatcactgatttttcaccgatttactgtgatccggaaggcctgaaccccgtcactcagtttgataagaacgatgtggaatatgcgggtctggtgaagtttgacttccttggcctgagaaccttgaccattatcaactgggcgcttgatatggtgaacgcccgtcgtactcataaaaatctggaaccgattgatattacggcaattccgctggatgaccagataagtttcgatatgctgcaacgctctgaaactacggcggtgttccaacttgaatcccgtgggatgaaagatctgatcaaacgcctgcgtcccgactgtttcgaagatatgatcgcattagtggcgctgttccgtccggggccattacaatccggtatggtggataactttatcgaccgtaaacacgggcgggaagagctttcatacccagatgttgagtggcagcacgaatccttgaagcccgtactggagccaacatacggtattattctgtatcaggaacaggtgatgcagattgctcaggtgctggcaggttataccctcggtggtgcagatatgctccgtcgcgcaatgggtaagaagcagccggaagagatggctaaacagcgctcggtatttgaagagggcgcgataagccaaggtattaatggcgaactcgccataaaaatcttcgatttggtggaaaaattcgcgggttatggtttcaacaaatctcactctgctgcctatgcgttagtttcttatcaaaccttatggttaaaagctcattatccggcagaatttatggcggccgtgatgacggcggatatggataacacagaaaaagtcgttgggctggtggatgaatgctggcgcatggggcttaaggttttaccaccggatatcaacagtggtctgtatcatttccatgtcaatgacgaaagcgaaattgtttacggcattggtgcgattaaaggtgtgggtgaagggccgattgaagcaatcctcgaagcacgtcaaaaagaggggcatttcaaagaactgtttgatctgtgtgcgcgtgttgataccaaaaagctgaaccgtcgtgtgatggaaaagctgattatgtcaggagcgtttgacaggctgggaccacatcgtgcggccttgatgtcttcgttggaagacgcgttgaaagcggctgatcaacatgctaaagcagaagccattggccagacagatatgtttggtgtgctggctgaaaaaccagagcaggttgagctttcatatgccagtacaccgaaatggccagaacaagtcgtgttagatggtgagagggaaacgctggggttgtatttaacgggtcacccgatcacaagttatttgaaagagattgaacgatatacgaatggattgcgtctaaaagatgtgagcccgacacctcgtggtcaagtcacgactgtggtaggtttggtgctggcatccaaaatcttgacaaccaaacgaggcaatcggattggcatctgtactttggatgatcgttcaggacggctggaaatcatgctgttttctgatgcactggaaaggtatcagcatttattggaacaggacaaaattttaattgctaccgggcaagtcagctttgatgacttcagcggcggccttaaaatgacagtccgtgaattaatggatatcagtgaggcgcgtgaaaaatttgcacgcgggatagctatctcgttatcagacaggcaaattaataaacaattatttaatcgtctccgtggcgtattggagccgcatcgttcaggtacgataccagttcatctttattaccagcgggtagatgcccgtgcccgtttacgattcggtgcaacatggcgggtaacgccgacggatacccttttgacagatctgcgaactctgctgggtaacgagcaggtagaattagaatttgactaa

SEQ ID NO: 2963 - DNA, 960 bp, Xenorhabdus bovienii
  Coding sequence Name=Xb4151_4152.C436.gene114.dna; Position on contig= 96365..97324bp; Strand=+
atgagtctgaattttctggattttgaacagccgattgccgagttggaagcgaaaattgattcgctcaccgcagttagccgtcaagatgaaaagctagatataaatctggatgaagaggtccagcgtctgcgagaaaaaagccttgaattaacccgcaagattttctctgatctgggggcatggcaaatatctcaactgtcacgtcacccgctccgtccctatacgctggattatattcagcgcgtttttactgactttgaagagctggcgggtgatcgtgcctatgcggatgacaaggcgatagttgctggtttggcacggcttgatgggcgtccggtcatggtgattggtcatcagaaaggccgtgagacaaaagaaaagatccgccgtaactttggtatgccatcgccagaaggttatcgcaaggcgttgagattgatggagttggcagagcgtttcaaactgccgatcattacctttattgatactcctggcgcgtatccgggcgtaggggctgaagagcgtggacaatcagaagccattgcccgtaacctgcgtgaaatgtcccgcctgtccgtacctgtcatctgtacggtgatcggtgagggcggttctggtggtgcgttggcactcagtgtgggtgacaaggtgaatatgttgcaatacagcaccttttctaccatatctccggaaggttgtgcttccatcttatggaagagtgccgaaaaagctccactggcagccgaagcgatgggtaataccgcaccacgcctgaaagagttgaaattgattgattccgttattccggaaccactgggcggggcgcatcgtaactatgatgcgattgctcaagcattaaaagcgcaattactggctgattttgctgatttggatcatctgaacagcgaagaattagttaatcgccgttatgagcgtttaatgcaatacggttactgctaa

SEQ ID NO: 2964 - DNA, 156 bp, Xenorhabdus bovienii
  Coding sequence Name=Xb4151_4152.C436.gene115.dna; Position on contig= 97301..97456bp; Strand=-
gtgctgatttcattacctataaacaataaaacaggtggaaatactgaagttctatctctccccagtactgtccacctgcaaataacaatattaaaaataaagctggattgtaataaaaacagctttcaggacttagcagtaaccgtattgcattaa

SEQ ID NO: 2965 - DNA, 918 bp, Xenorhabdus bovienii
  Coding sequence Name=Xb4151_4152.C436.gene116.dna; Position on contig= 97552..98469bp; Strand=+
atggacaaatataaatatattatttacgcgttttcctgtgtgttgatctggagttttgttccctccatatcccgtttgggtcaaaaagggatggaccatttccaatatttgttctggtcaaatattctatccgttctggcggttttctttgttgctgtcctgatgggtagaaatttgaaacaacttttatttattccctttccagttatgtttaaagttttgatattaggtactctggactgtttcttctatttattgctctattacggttattccatcgaaaacggcgttgctgtcttggtcgttcaatatagctggccgctgatgatcatcgggttgtcgtttttactgttaaaagaaaaattgtcaatccggcagatgattggcatcacgcttggttttattgccgttgtgatcacgtttacgcaaggaaatattacccggattgcagtagaacatccgcaggctctgttgctggtattcagtggggcattttgttttgccttgatgtctgtgttatcgaaacatttcgcgattgacccttatataaatacattttgggtatttgcttgttctaccttagtatcggcggtgtttttattggtatttagcagcttcaattggccagtgggtgattcactgatgccaacgctgctcaacggcatcatattgaatggcgtatcctatattatctggtttaaggctatgaatagccctgattcgcctaaaattgcctcaatcttatttttatcaccggtgttgtcgatgatatggcttattctgttctttggtgatgcatttgtccccgcttatgttgtgggtttagtgcttgttatcatatcggggctgctctgcatcagtgcaaagaccgaacctgcgacacagaataaattgagtgatgatttgattgaggattga

SEQ ID NO: 2966 - DNA, 1350 bp, Xenorhabdus bovienii
  Coding sequence Name=Xb4151_4152.C436.gene117.dna; Position on contig= 98502..99851bp; Strand=+
atgatcaatactcatatacctctgttaacgatgttaatcgatcagttagggcgacataaaaaagtcttggttggatttagcggtggattggattccaccgtattgctgcatttgctggttcagttacgttaccaatcccacagcggagtcattcgtgatcaaatagagctaagagcaattcatatccatcacggtttaaatccaaaggcggataagtgggttgaacattgtcgccagatttgtgccgactggaaggtcgattttcgggtcgaaaaagtcagccttgatatccggcaaaatggcattgaagcggcggctcgtgatgcccgttatcaggcattccagcatgaattgcaacagggtgaaattttggtcacggcgcagcatcttgatgatcaggcagaaacctttctgctggcattgaaacgggggagtggccctgccggattatcatctatgccttcttccatgccattttctggaacaacgctgattcgtccattgctgaatgccagtcgtgcagaactcgaaacgtatgcacaaacacagaggttgcaatggatagaagatgatagcaaccaagatgatcgttatgatcgcaattttttgcgtttgcatattatgccattgcttaaccagcgctggcctcatttccctcaatctgcttctcgcagtgccagcttgtgtggagagcaagaacaattgttggatgaattgcttaatgaatcgttgaatgagctgataactccggaaggtgcgatagccatttcaccgttggtggattgttctgaggccaagcgtaatgctttattacgtagatggttcaatcagcatggtgtgaagatgcctgcgcgtgaacaactccagaaaatttggtcggaagtggcgctttccagacaggatgccgagccacgttttagattggggcagcacgatgttcgccgttatcggcaacaactctggctggttcctcaatgccaatcgttggcaggaactctacttgaatgggatatagcacaagaactgcgattacccgatggtttgggcatgctggtgttgtcagaagaaagtggtattaatgtcagaatgcccgatagaaatgagcgggtaaccattcgttttggtgtacagggaaatattagcatcgtgggtcgtcggcattcccggcacagtaaaaaattatggcaggaattaggtatcgcaccttggcttagggaaagaacaccattgctttattatgatgaaaaattggttgcagcattggatgtttttgtaaccaaggagggacagcctttggcggaaaaggagatactttcaatcaaatgggacagaatgccgtattctgcttaa

SEQ ID NO: 2967 - DNA, 93 bp, Xenorhabdus bovienii
  Coding sequence Name=Xb4151_4152.C436.gene118.dna; Position on contig= 100021..100113bp; Strand=-
atgagggctttcttttcaaatgactatttttatctacgtttggtttttccagctatgactccagcaatttgttcatttatcactgtggtataa

SEQ ID NO: 2968 - DNA, 123 bp, Xenorhabdus bovienii
  Coding sequence Name=Xb4151_4152.C436.gene119.dna; Position on contig= 100121..100243bp; Strand=+
atgaggactttgtgtgtgattttgtgtatcaatgtgagctttctgaacacggtcaggtcgagcaatgctcaatgctcaataacaatcgtaccaatttccgggttgctgaaactgatgatgtga

SEQ ID NO: 2969 - DNA, 258 bp, Xenorhabdus bovienii
  Coding sequence Name=Xb4151_4152.C436.gene120.dna; Position on contig= 100189..100446bp; Strand=-
atgtctatagatactgaatatcaaccaattaattgtgatgattatgataaccttgagctagcttgccagcaccagcttcatttacacatccaactgcaaggtggtggcatatttgaaggaaaagctagtaagctgattttaagaaaaaaagtcgaatatattctcgtagaatcaaatgaagaaacccgtgaattaaggttggatcacatcatcagtttcagcaacccggaaattggtacgattgttattgagcattga

SEQ ID NO: 2970 - DNA, 99 bp, Xenorhabdus bovienii
  Coding sequence Name=Xb4151_4152.C436.gene121.dna; Position on contig= 100641..100739bp; Strand=+
ttgatttttttccctatgcattttgagatacggtacagtaatgtcaatcttgttaagaaaagttcatgttttacatggtatggacgttatgaatattag

SEQ ID NO: 2971 - DNA, 702 bp, Xenorhabdus bovienii
  Coding sequence Name=Xb4151_4152.C436.gene122.dna; Position on contig= 100761..101462bp; Strand=+
atgaaaatgatgatgaataaaaaaatattgctcgctgtgggagtgttaaccgcggttgggtgtcagaacaaagtggcctctcaagataatgctacgcttcaggagaatacacttcagaataaattgcagacagctgagagagtgtttactggcgttgtaccttgtgcggactgtacaggtattgagactactttgcagctttcaagtgatggctcatatatattggggcaaatttatctggaagctaaaaatgaagaaaacacttttttcgaaacaggtcattggataaaaagcggcaaaaagatagatttgacgcatgaggatggtaagaaatcttattatcagatgaaaggtgaaaatctggtcatgctggatatcgacggtgaaccaatccagtcaaatttcaattatgaattgggaaaagttacgccgaaaaagatggcgggggaatacagctatatagctgacagtgcgacatttacagagtgtcgtaccggaaaacactatgatgcgtctgaaaatatcgatttggaacgtggctacagtgcgactggtgtggaagggggagagcctgtttatgtggaagtcgaaggttactactcgcttcggccttcgatggaagatggtatgtttgatcatgcactgattcaaacaggcaaaatccattttgataagtcagcctcttgtcagaccagaaaataa

SEQ ID NO: 2972 - DNA, 1722 bp, Xenorhabdus bovienii
  Coding sequence Name=Xb4151_4152.C436.gene123.dna; Position on contig= 101548..103269bp; Strand=-
atgcgtactagccaatatctgctctctactttaaaagagacgcctgctgatgcggaggttgtcagtcataaactgatgcttcgtgccggcatgacacgtaaactcgcctcaggtctgtacaactggatgcctacaggtgtccgtgtattaaaaaaagtcgaaaacattgttcgtgaagagatgaataatgctggggcgattgaagtttccatgccggtagttcaaccggcagatttgtggcaggaaagtggccgttgggaacaatatggcccagaattactgcgttttgaagatcgtggtgcccgtcctttcgttctcgggccgactcatgaagaagtcatcaccgatctggttcgtaatgaagtgacttcatataaacaacttccactgaacctgttccagatccaaaccaaattccgtgacgaagtccgtccgcgcttcggtgtcatgcgttcacgcgaattcattatgaaagatgcttattctttccataccagccaagagtctctacaagagacttacgataaaatgtatgatgcctacagcaaaatctttacccgtattgggctggatttccgtgctgttctggcagataccggttctatcggcgggagtgcttcccatgaatttcaggttcttgctgacagcggtgaagatgatattgccttctccacagaatctaactacgcagccaatattgaattggctgaagcagttatgccatcccacgaacgagctgtcccatcagaagatatgcatttggtagagacaccaaatgctaaaaccattgctgaactggtcgaacaattcaacttgccgattgagaaaaccgtcaaaactctgatcgtccatgcggcaaaagaaagcagtcatcaactggtcgcattgctggtacgcggtgaccatgaactgaatgaaatcaaagcagagaaactaccattggtggcaagtccgctgagtttcgctaccgaagaagaaattcgtgccgttgtacaggcaggcccaggttccttagggccagtaaacctgcctatgcctgttatcattgaccgtagcgtatctgtcatgagcgacttcggcgcaggcgcaaatgttgatgataaacattatttcggcattaactgggaacgtgacttaccactgcctgaaatcgccgatatccgtaatgtccttgaaggtgatgctagcccagacggtcaaggtacactgctaatcaaacgtggtattgaagtcggtcatatcttccagttaggcaccaaatactctgatgccctgaaagccactgtacaaaatgaagatggtcacaatcaagttgtctcaatgggatgttacggcattggcgtaacccgtattgttgccgcagctattgaacagaaccacgatgatcgtggcattatctggccagatgccattgctccattccaagtcgctcttttacctatgaatatgcacaaatcttatcgggtgaaggaagttgctgaaaaattatatgcagacttacgtgccaatggtattgatgtgattttcgatgatcgcaaagagcgcccaggtgtcatgtttgctgatatggaactgatcggtgtgccgcatactctggttattggcgatcgtaatctggataacggcgaagttgaatacaaataccgtcgtaatggtgataagcaaatgcttaaactggaaggtattattgaatatctgaaagaacaaattaaacagcattaa

SEQ ID NO: 2973 - DNA, 147 bp, Xenorhabdus bovienii
  Coding sequence Name=Xb4151_4152.C436.gene124.dna; Position on contig= 103255..103401bp; Strand=+
ttggctagtacgcatagtaagtttccattggacagcaaattgcttctgggcgacaagattgtgccacccaacccagaaaataaagataaaccgctagtctaccagcgagtttgctatgtcaaaaggggttttaacggtgttcaatag

SEQ ID NO: 2974 - DNA, 726 bp, Xenorhabdus bovienii
  Coding sequence Name=Xb4151_4152.C436.gene125.dna; Position on contig= 103385..104110bp; Strand=-
atgattaaaaaaacgctcatggccgattttcattttactcaaataggaaccatccattctccttataaagagaagtttgccattccccgccaaccgggtttggtagaagatggggcgggacaactagagttgctggctccttataaccagattgatgcgatacgtgggattgaacaattcagtcatttatggattatttttgtttttcaccaaactatgaatggtggctggaatccattagttcgcccaccccgtttggggggaaatgccaaaatgggcgtgtttgctacccgctcgacattccgccccaatccgattggtatgtcgctggtagaattgaaaggtattcaatgccagaacaatcgggtcatactggaacttggcagtctggatttagttgatggtacacccgttatcgatatcaagccctatctgccttttgccgaatctcgcccagaagccagagcgggttttgcacagaaggcgccagacaccggaatggaagtctcgttcttgccaatagctgaacatcaactatcgtcccatcaggcaaattatcctcatttacgacgtttcatcagtcagatattggcgcaggatcctcgcccggcctatcgtaagaaagaacaggaaaaccggatatatgcagttcatattctggatttcaatgttcgctggcagatacgtgacgccatgacggaagtggtttctattgaacaccgttaa

SEQ ID NO: 2975 - DNA, 393 bp, Xenorhabdus bovienii
  Coding sequence Name=Xb4151_4152.C436.gene126.dna; Position on contig= 104113..104505bp; Strand=-
atgcgtatgctacctatctgtttcataacactatttatggttgggtgtacttctctgtcaactcaggtcgaaaaacctactcagacaggctcaaagttgaaacatcagccagccaagaaaagtaaagtgtcgtcttacgttcagctatacactaagacagaagaactgttaggcactccatttaaaaatttaggcatcgttttcggggaatcctgtcgcactacacgacaagatccgcctgccagcattgcagttgcacggaaaaacatgctggtaaaagccgcatctctgaaagctgatgcagtattacttcatcaatgcgcaatactgtctaatcacaactgctaccagactgcgatttgtgaaggatctgccctgcttaccactaaataa

SEQ ID NO: 2976 - DNA, 120 bp, Xenorhabdus bovienii
  Coding sequence Name=Xb4151_4152.C436.gene127.dna; Position on contig= 104478..104597bp; Strand=-
ttgggggagccaaacgctttttatcgcagtttcatgtatcgacattcacagtcccccactcaccggccttaccagaataaggattcaacgcgatgcgtatgctacctatctgtttcataa

SEQ ID NO: 2977 - DNA, 816 bp, Xenorhabdus bovienii
  Coding sequence Name=Xb4151_4152.C436.gene128.dna; Position on contig= 104663..105478bp; Strand=-
atgtcagtaaaattgaaatccatcgttgcaatcagtgcattattaggaacattaattcttgcaggctgcgatcaggaaccaagagatccagaccacattaaggttggggtaattgttgggcctgaacttgaagtggcagaagttgccaaaaaagtggccaaagagaaatatggacttgatgttgagctgattacgttcaatgactatgttctgccaaatgagtcactgaacaaaggagatattgatgttaacgttttccaacataaaccttttttagatcagcaagtgaaagaacgcaattataagctgactattgttggtaactctttcatctatccaatcgcggcttattcaagaaaaattaaatctctgggtgagctagaaaatggtaatcagattacgataccaaatgatccaaccaaccaaggccgggcgcttttattattacaaaagcaaggcttaatcacgctaaaagaaggagtgggtctactaccaaccgttttggacattatcaataaccctaaggacttagatattgtagagttagaagcaccgcaattaccacgctcgctagatgatcaaaaaattgcctttgctattatcaataatgcctatgcgggtcaggttggtttgacgccagaacaagatggtttatttgtggaagacaaagattcaccttacgtaaatatcattgtcagccgtgaagacaataaagacgctgaaaatgttcaaaagtttgttaaagcctatcaatctgaggaagtagaacaagctgcccagagaattttcaagggtggtgcgctaaaaggctggtaa

SEQ ID NO: 2978 - DNA, 654 bp, Xenorhabdus bovienii
  Coding sequence Name=Xb4151_4152.C436.gene129.dna; Position on contig= 105505..106158bp; Strand=-
atgtctgatggaatgattttcttattgtttaaaggagtctgggaaactttagtaatgacttttgtttcaggtttttttggttttgtaattggtttaccaatcggtgtgcttttatatgtcacccgtgcaggacagattatggagaatattacactttatcgtattctttccgccttagtgaatatcggtcgttcaattcccttcattattttgttggtatggatgatcccgtttacccggctaattgtcggtacatccattggcttgcaagcggcgattgtccctctgactgtgggagcagcaccttttattgcccgcatggtggaaaatgccttattggaaattccgcctggattgatcgaagctgcacgtgcgatgggtgcaacgcctttacagattgtcaaaaaaatcctgcttcctgaagcccagttgagtttaataaatgctgcaacgattactttgattactttggtcggctattccgcaatgggaggtgccgttggcgcaggtggcttaggccagattggttatcaatatggttacattggctacaatgcacctgttatgaatactgttttagcattgttgattgttttagtgttcttaattcagttaggcggtgatcgcttgattatagcagttaatcacaaataa

SEQ ID NO: 2979 - DNA, 1032 bp, Xenorhabdus bovienii
  Coding sequence Name=Xb4151_4152.C436.gene130.dna; Position on contig= 106151..107182bp; Strand=-
atgataaagctgactcaaataaataaagtatttcaactagggacgcgttctatcaacgcgctttcaaatatcaacttacatgttcctcagggacaaatttatggtgttattggttcttctggcgcaggcaaaagcaccctgattcgctgtgtaaatatgctcgaacgtccaacatcgggcaaggtattggttaacggtcaagatctgacttcaatgtcaaatcgtgagctgacccacgcccgacgccatattggtatgatttttcagcacttcaatctgctgtcatccagaacggtatttggtaatgtggcattgccactggagttggataatacgccaaaaaacgaaataaataaaagagtcagcgagttgcttgaattagttggtctctctgacaaacatgatgcgtatccggcaaatttatctggtggacaaaagcagcgtgttgccatcgctcgcgcattggcaaactcacccaaaatactgttatgtgatgaggccaccagcgctctcgatccagccacaacccgttctattcttgaactattaaaagacattaatcgtcgtctgggcttaacgattctgttaattactcatgaaatggatgttgtaaaacgtatttgtgaccaagttgcggtcatcaatgcaggtctgttaattgaacaagatgttgtaagcgaaattttttcacaccctaaaacgcctgttgcgcaagaatttattaaatcaacgctgcatatcgatattccggaaagttatctaaaaaagttaaaacctgaatgcacgccagatagtctaccattattgaaactggaatttacgggcaaatcggttgatgccccactaatttctatggctgtacgccgttttaatattgatgtcagcatattgagttcacaaatggattatgctggtggcgttaaatttggtgtgatgttggccgaattgggcggtgaatacagtagcattgaatcaacaattgagtttttaaaagaacaccatgtaaaagtagaggttctcggttatgtctga

SEQ ID NO: 2980 - DNA, 120 bp, Xenorhabdus bovienii
  Coding sequence Name=Xb4151_4152.C436.gene131.dna; Position on contig= 107461..107580bp; Strand=+
ttgggattaataatttggattctcattccttatcatttaagttacttaatattactagcctcaatacgtagggcgcgagcacactattttaggtgcttttctaagattattatttcttaa

SEQ ID NO: 2981 - DNA, 114 bp, Xenorhabdus bovienii
  Coding sequence Name=Xb4151_4152.C436.gene132.dna; Position on contig= 107792..107905bp; Strand=-
atgaattccttcgatacagaatctgtaactaatttcccagtgccaatatgcaattattctaaaattgacaaatggcttctgtatcaggttaatagcgtaaaaaagttaaggtga

SEQ ID NO: 2982 - DNA, 639 bp, Xenorhabdus bovienii
  Coding sequence Name=Xb4151_4152.C436.gene133.dna; Position on contig= 107902..108540bp; Strand=-
atgctatctaattattggggagaatttctagggctagcaatgattcattttttagcagtagtagcaccaggcccagatttcgctgtgaccatacagcagagtgtaaaatttggtcgtttagctggggtatgcacggcaataggtattggtgcaggtatatcagtacatgtagtctatacactggtgggaatcagttcattaatgcattccaccccatggttaatggaaatggcaaaactggtaggctcactttatatcatatggctcggtatcaaatttattaaaagtaaacctgtcaatccggatactttggaaagtaaaaatattattcagacctcacaaagtaaatggcaagcatttctgatggggtttatgacaaatgctcttaaccctaaggcaacattgttctttttagcagtttttacgaccgtggtgagtattaatacacctattctgatacaagtcttttatggcttgtggatgtgtatagctaatacagtatggtttgtgctggttagtgttattttttcgaatgtattgattcgtaataaattcatggaaaaagggtattggtttgaaagagtaatggggattgtacttatcagttttgctattcggttattatttatatctgtatga

SEQ ID NO: 2983 - DNA, 771 bp, Xenorhabdus bovienii
  Coding sequence Name=Xb4151_4152.C436.gene134.dna; Position on contig= 108542..109312bp; Strand=-
atgattatagaaacagatcgtcttaatagcgcatgtatagaaaaacttgctaaacaagaaattttagccatacgtataaaaaaatttattcctacttccttagctgaaaaaataagtgaaaaaatattaggaaaaggatttgataaatatttaaatgcgccgagtataggtcggatcgggatggcattttacgagacagaaaataaggcactccgtgtagcagattattttgaaaatgtgctcaataatatcaacgaactgaggcagcgttgttcaccttatctatcaccaatagatcaactgagatgcgttttagacgaagtttggccagcaggggctcaactcgaaacactttatgggaagaaaatgtatgtgggattgtcaagggtagttgaacccggagtgacttttcttgcacatcatgatatttttgctaaagatgctccagatagtttcagagccaagagccttcaggcacagtttgccgctaatgtttatctttctatgcctaatgaaggtggtgctttacaagtttggaaaaataaattatctcctgaagaatttgattctatgcgcagggatagttatggtattgaaccttctttgcttggaaaaccggcactagaggttcaaccggacgcgggcgaacttttgatttttaatgcccaatgtatgcacgctgtaactgctggtatcggtagctcacgtttaagtctgtcttgctttataggttatcgtggagaagcagctcctctgtcattctggagttaa

SEQ ID NO: 2984 - DNA, 102 bp, Xenorhabdus bovienii
  Coding sequence Name=Xb4151_4152.C436.gene135.dna; Position on contig= 109336..109437bp; Strand=+
atgaaattcgaaagtgttgctagttacaaaccactttataatgtactatttcgcatttttatgtttttatatctttttatttttataaatgtctttatataa

SEQ ID NO: 2985 - DNA, 135 bp, Xenorhabdus bovienii
  Coding sequence Name=Xb4151_4152.C436.gene136.dna; Position on contig= 109617..109751bp; Strand=+
atgtgtaatacaatttatatatggattaaaaacgctcaatttagtcttgttcaagtattgaaaagtatttcatttaaatcaattaaccaaaaaataatcatttatgctctctatatgaacgcgtttcatttgtaa

SEQ ID NO: 2986 - DNA, 132 bp, Xenorhabdus bovienii
  Coding sequence Name=Xb4151_4152.C436.gene137.dna; Position on contig= 109695..109826bp; Strand=-
atgcaaaaaggttgcaggggcaacggtaataatataaaactgcagactaccgtcgatgtcaaagtcactattatcttacaaatgaaacgcgttcatatagagagcataaatgattattttttggttaattga

SEQ ID NO: 2987 - DNA, 93 bp, Xenorhabdus bovienii
  Coding sequence Name=Xb4151_4152.C436.gene138.dna; Position on contig= 109907..109999bp; Strand=+
ttgtccgtgaatccatcacgtcatttttgtttcccatcatatcgggaatgctgtcacaaatttggcctgaaacagacgaatctcgaaccctaa

SEQ ID NO: 2988 - DNA, 306 bp, Xenorhabdus bovienii
  Coding sequence Name=Xb4151_4152.C436.gene139.dna; Position on contig= 109954..110259bp; Strand=+
atgctgtcacaaatttggcctgaaacagacgaatctcgaaccctaatttttgagttctcacgcccaatagtgagttcccctacaggcttctatgccgataaggctcccggttgccagggaggggaattactgccgctggagctacttatcgacgacttcactagtatattcatcgacaaaatgaacctgcatcagatgttttgcaatatcgaagccaaacggagtatatttcatgggtggttcttcctgttatcagggagcaataagcttcacgtatttaggcactataaggttggaaatctgtga

SEQ ID NO: 2989 - DNA, 252 bp, Xenorhabdus bovienii
  Coding sequence Name=Xb4151_4152.C436.gene140.dna; Position on contig= 110266..110517bp; Strand=+
atgcctcatctctcacttccaacactgtggttgggatgcgttcgttacattccctgtcattgtgaatatacatcaataacaaggaatttgaataataacatagaacagatattcgccattgtgttttcatattctattatgtcaaattataagatattttattattttaaatcacaaagtgtcttattagctctcctattaatctacataatagttatattaaattcaagtgataaatatactattttatag

SEQ ID NO: 2990 - DNA, 120 bp, Xenorhabdus bovienii
  Coding sequence Name=Xb4151_4152.C436.gene141.dna; Position on contig= 110873..110992bp; Strand=+
atgggtcattcaatggagttcgtcattcagagtaaatcacaatttatggcctcccacgtttttgcaacactgattttgatacattgttggtttgcttcaatctatccggagtctcaatga

SEQ ID NO: 2991 - DNA, 207 bp, Xenorhabdus bovienii
  Coding sequence Name=Xb4151_4152.C436.gene142.dna; Position on contig= 110969..111175bp; Strand=-
atgggggatccgaccactttccgatcaggccgggagttttccacctatctgggtttggttccccggcaaacaggaacaggtggccgtgttaaacctgtaaatgtcaatggctcagtgaagctggggctgttgttagattcgtcaggtcaggtgcaaacctcactaaggcgcggacacatttgctcattgagactccggatagattga

SEQ ID NO: 2992 - DNA, 180 bp, Xenorhabdus bovienii
  Coding sequence Name=Xb4151_4152.C436.gene143.dna; Position on contig= 111291..111470bp; Strand=+
atggatattgatagaaccttgcttgcccctattcattcaaagcgagcaggacgtccacatgctgaacaccgccgtgtcatgaatgggatgttctgggtgctatgttcagggacactgtggcgcgacttaccggaatgttatgggccttggaaaacggtctataaccgatttaaccgttga

SEQ ID NO: 2993 - DNA, 108 bp, Xenorhabdus bovienii
  Coding sequence Name=Xb4151_4152.C436.gene144.dna; Position on contig= 111430..111537bp; Strand=+
atgggccttggaaaacggtctataaccgatttaaccgttgatcaaaatcgggcattatcaataagatatttaatcggttactgtccattctggatgaaaaaggtttga

SEQ ID NO: 2994 - DNA, 132 bp, Xenorhabdus bovienii
  Coding sequence Name=Xb4151_4152.C436.gene145.dna; Position on contig= 111562..111693bp; Strand=+
atggcagcaatattcgcgcgagtaaagatgttctgctcaagacaagaaaaatcggacactattacaaaggccatttcatcttccacaggtgttaaatcattattggccgtgtgcaatcgtgttaaattgtaa

SEQ ID NO: 2995 - DNA, 183 bp, Xenorhabdus bovienii
  Coding sequence Name=Xb4151_4152.C436.gene146.dna; Position on contig= 111740..111922bp; Strand=+
atgatgggttttgaagagctaatcatgtttcaaactgccaaagaaacgttcgacaaaagcgttatcccaacatgccccgacatccccctggcttgctcttatgtcataactgctgagcaagtcccggtattgctggcttgtatattggctccctctatcacgatgaaaaacacagccttgtga

SEQ ID NO: 2996 - DNA, 888 bp, Xenorhabdus bovienii
  Coding sequence Name=Xb4151_4152.C436.gene147.dna; Position on contig= 111951..112838bp; Strand=-
atgcataatttagttgacttattttgtcatgtcgatgatttttgcaaattgttcatgcctcaatggcaaaaatatctgattgaaagtggtcaatgccagcggttacgcccaacaagaatgacaaccagtgaaatcatgacgattatcattgccttccatatgtcccatcagcgtgattttaaacatttttatattgggttcatgacggtataccacaaaaaagactttccctcattattgagctacacacgttttcttgaggtcatgccgacggttttggctccattaagctccttctttacccacctaaaaggccagccaacaggcctcgaattcattgattcaacccgcattaaagtgtgccataacctgcgaataccacggcatcaagtttttaaaggggcagcagctagagggaaaggaacaatgggatggttctacggatttaagctacacattatcgttaaccatcttggtgagattgtcgccacgaagctcacgtcagctaatgttgatgatagaaccccagttaaggcgctttccaaggggcttttagataaactctatgcagacaaaggttatataagcaaagccttaacggaagagttagaaatggaaggcatcacattggtcacagggcaacgcaaaaatatgaaacccaaattattagcggcttgggatagagcgatgctcgctaagcgattcattattgagactattaatgaccaactgaaaaatatcactcagattgagcattctcgccatcggagcttacatggcttcatgttgaatttgctgggcggtttgattgcctattgtttgaagccaaaaaagccatcactgaatctctcaaataccgagaaaacaggacttcaagtaatggcttaa

SEQ ID NO: 2997 - DNA, 141 bp, Xenorhabdus bovienii
  Coding sequence Name=Xb4151_4152.C436.gene148.dna; Position on contig= 112833..112973bp; Strand=+
atgcatagcgggttcctcagtgaaaagtttcttttttggtcaaaagatctgatcacagaacccgcttttagttctcttcttttttgtttctcttatcccgagttcaggttaagtaatacgcattcattaaagcctggctga

SEQ ID NO: 2998 - DNA, 522 bp, Xenorhabdus bovienii
  Coding sequence Name=Xb4151_4152.C436.gene149.dna; Position on contig= 112936..113457bp; Strand=-
atgcagagccatttcccatttgccaatatatgtcgcgtgatgaaagtcagtcgttccacgttttatgcctggcaggcaaaacccgttcggttactttctgatgagcaacaagcattaaaccgaaaagcgacggcgctctttaaagaaagccgggaaagtttaggctatcggatgttggcgaaaaaattacgcaaagaaggccttaccatcagtgactatcggacccgagagcttatgaatcagcgcggattatccgtcagacagcggcagcgctaccgggctccgcgcaaagataaagcgatatcaacagcctgtaatctacttaaccggaactttaatccgttggcgccgaatgaagtttgggctggagatatcacctatttgaagacgcccgaaggttggttatctctagctattgtgatggatttgtactcacgtcggacagtgggatggcagatctcaacggaaatagatacgaccttaatcagccaggctttaatgaatgcgtattacttaacctga

SEQ ID NO: 2999 - DNA, 294 bp, Xenorhabdus bovienii
  Coding sequence Name=Xb4151_4152.C436.gene150.dna; Position on contig= 113399..113692bp; Strand=+
gtggaacgactgactttcatcacgcgacatatattggcaaatgggaaatggctctgcatgttcctttatgaacccacattttacagcagttctcccgcaaagaaggcgctcgccttctttaagatctccttctccattttcagctgtttattttctttacgaagctgcaacaactcctgtcgctcatcgggggttaaagcactgggtttagattgctcaacatcatgtttccgccacgtatacaggagttttgttggaatacctaaggtttcagctgcctgtgggactgtatag

SEQ ID NO: 3000 - DNA, 111 bp, Xenorhabdus bovienii
  Coding sequence Name=Xb4151_4152.C436.gene151.dna; Position on contig= 113791..113901bp; Strand=-
ttgttcaatatcagttctgaatgcctgactatcgtaccccttgtcagctatcacaaagtccgaaggcggtattgtgctttaataaattcggacactttggtaaaggaatag

SEQ ID NO: 3001 - DNA, 129 bp, Xenorhabdus bovienii
  Coding sequence Name=Xb4151_4152.C436.gene152.dna; Position on contig= 113998..114126bp; Strand=+
atgggtttgccagaatcaaacattttcgtgcaatcgcaacaagatacgataaattggcgcgaaattacgccagcacattggcactggcatttgtcattatatggttacccatgtggctcgagtaaatga

SEQ ID NO: 3002 - DNA, 558 bp, Xenorhabdus bovienii
  unsure (1)..(558): unsure at all n locations
  Coding sequence Name=Xb4151_4152.C436.gene153.dna; Position on contig= 114238..114795bp; Strand=+
gtgactcaaagtattcccgctgtatttttggatcgtgacggcacgattaacatcgatcatggttatgttcatgaaatagacaattttcaatttattgatggcacgattgaagccatgctcgaattgaaaaaaatgggttacgcactggtattggtaactaatcagtctggtattgctcgagaaatgtttacagaagatcaatttttgcagttaacagaatggatggattggtctctggcagaccgaggtgtcgatcttgatggcatctattattgcccgcattatcccgaagggagtgctgacgcatataagaagaactgtcattgccgcaaaccgcaaccgggtatgttattggatgcacagaaagaattaagcatcgatatgtcagcttcttatatggtgggagataaaatagaagacatgctggcagcaaatgcagcgaatgtaggaacaaaagtgctagttcgtactggaaaagcggtaacagaagcagtagaacaggctgctgatctggttattaatagccttatagatcttccaaatgcgnataaaaaatag

SEQ ID NO: 3003 - DNA, 120 bp, Xenorhabdus bovienii
  unsure (1)..(120): unsure at all n locations
  Coding sequence Name=Xb4151_4152.C436.gene154.dna; Position on contig= 114764..114883bp; Strand=-
atacgattcgagctcggaccctttagacagcttttttntgaattatttacccaagtgattataattcaggcaaaaaggctatttttgcctattttttatncgcatttggaagatctataa

SEQ ID NO: 3004 - DNA, 108 bp, Xenorhabdus bovienii
  Coding sequence Name=Xb4151_4152.C437.gene1.dna; Position on contig =1..108bp; Strand=+
actcttgcgaaaaagccctcttacccaaaagtgagcgtcttatcgcggaagcgttggaacgcacgccagaagaaatttggccttcacgctacgtcaaaaaataattga

SEQ ID NO: 3005 - DNA, 315 bp, Xenorhabdus bovienii
  Coding sequence Name=Xb4151_4152.C437.gene2.dna; Position on contig =147..461bp; Strand=-
atgtcttggttaatccttctggttgcgggtttgcttgaagttgtgtgggcagtcggccttaaatacactcagggtttttcccgtttgatgcccagcctgatcaccatcagcgcgatgatggtcagtatagggttattagcctattccatgaaaaatttacccgcaggaaccgcttatgccgtgtggacgggaattggcgctgtaggaacggcaattttcggtatcatggtatttggggagccagccaattctgccagaatactgagccttggtttgattgttgcaggtattattggtttgaaattagcaagttga

SEQ ID NO: 3006 - DNA, 204 bp, Xenorhabdus bovienii
  Coding sequence Name=Xb4151_4152.C437.gene3.dna; Position on contig =394..597bp; Strand=+
gtgtatttaaggccgactgcccacacaacttcaagcaaacccgcaaccagaaggattaaccaagacataccattttccctttatcaaaaaggcaatggggtcgtccccgatgagatgatatttatccgggtcgtcccggataataataagaaatgccgctggattataactagcctttctgatagccgcaatgatagttcctga

SEQ ID NO: 3007 - DNA, 207 bp, Xenorhabdus bovienii; identical to SEQ ID NO: 1041
  Coding sequence Name=Xb4151_4152.C437.gene4.dna; Position on contig =655..861bp; Strand=+

SEQ ID NO: 3008 - DNA, 480 bp, Xenorhabdus bovienii
  Coding sequence Name=Xb4151_4152.C437.gene5.dna; Position on contig =887..1366bp; Strand=-
gtggggaccatagatttacatgcccattatctttatcttgtcgaacagctcaccgagcttgagacggcactggagcaggagctgagacgtgatgaaacaggacagcgtcttcagacaataccgggcgtgggtccgataactgccagcgtcttatcatcgcagctgggcgatggtaagcagtatggctgtagccgggattttgctgcttcaaccggtctggtaccacgccagtacagcacgggtggcaaaaatacgcttttagggataagtaaacgcggagacaaaaatctgcgacggttacttgtccagtgcgccagagtctttatccagagaatcgattatcagtcaggaaggctggctgaatgggtaaaggctcagcttgagcgaaaacactcaaatgttgtggcctgtgcgctggccaacaaattagcccggatagcctgggcaatcacaacacggcaaactgtgttcgaaaggtaa

SEQ ID NO: 3009 - DNA, 207 bp, Xenorhabdus bovienii; identical to SEQ ID NO: 1041
  Coding sequence Name=Xb4151_4152.C437.gene6.dna; Position on contig =1394..1600bp; Strand=+

SEQ ID NO: 3010 - DNA, 1041 bp, Xenorhabdus bovienii; identical to SEQ ID NO: 1291
  Coding sequence Name=Xb4151_4152.C437.gene7.dna; Position on contig =1626..2666bp; Strand=-

SEQ ID NO: 3011 - DNA, 567 bp, Xenorhabdus bovienii
  Coding sequence Name=Xb4151_4152.C437.gene8.dna; Position on contig =2750..3316bp; Strand=-
atggctacttatagtaccaacgaattccgttcaggtcttaaaatcatgttagatggcgagccgtgcgctattctagaaagcgaatttgttaaaccaggtaaaggacaggcatttgcccgtgtgcgtcttcgtaaattgatctctggcaaactgctagagaaaaccttcaaatcaacggattccgttgaaagtgccgatgttgtggatatgaacctgacctatctatataacgatggtgagttctggcacttcatgaacaatgagacttttgaacagttggctgcggatgaaaaatctgtcggtgacagcacaaagtggctgatcgatcaggctgaatgcattctgaccctgtgggatggacgtcctatttctgtgactccgccaaactttgttgaactggaaattattgagacagatcccggtctgaaaggggatactgcaggcactggtggtaaaccagcaacccttagcacgggcgctgtcgtgaaagttcctctgttcgtacagattggtgaagtcattaaagttgatacccgttccggcgaatacgtttctcgcgtgaaataa

SEQ ID NO: 3012 - DNA, 1032 bp, Xenorhabdus bovienii
  Coding sequence Name=Xb4151_4152.C437.gene9.dna; Position on contig =3357..4388bp; Strand=+
atggcacacattataacccatattccccctgtcagagaagtctggctaaaacaacttgcagatgtcattactgatcctgatgagctgctacaattattatccttaaatacgcacgccatgctgaaagaaggcaatgaagcgaagcgtttatttcccctgcgtgtaccaagagcgtttgcagcacggatgaaaaaaggcgatcctcatgatccattgttattgcaagttctgaccgcacaggaagaatttgaaactcaccctggtttttcaaccgatccgttggaggaacagcacagcgcagttcccgggttactacacaaatatcgcaaccgtgctctgctgctggtcaaagggggatgcgcggttaattgccgttactgtttccggcgccatttcccctatgaggataacaaaggcaacaaaaacaactggcaactcgcactggattacattgaacagcaccctgagcttgatgagatcatcttctccggcggtgatcctctcatggcaaaagatcacgaactagactggttaatgactcgccttgaatccatttcacacatcaaacggctacgcattcatacccgtttgcccgtggtgatccctgataggatcacactttcattgtgtaatcgtttcgaaaaatcacaattgcagataattatggtaactcatattaaccatgcaaatgaaattgataatacatttcgcgacaaaatgatgtggctaaaacaggctggcgtaacgctactgaaccaaagtgtgctgctgcgtaatgtaaatgacagtgcagatactctggcagatttaagtaatacattatttgatgcaggtattttgccttactacatccatatattagataaggtgcaaggtgccgcacactttctggtaggcgatgaagaagcaaaagctatcatgcgggaattattgactaaaatatccggttatttagttccatgcctggcaagagaaattggcggtgagccaagcaaaacccctctggatttgggattgaagcaaaaaagttga

SEQ ID NO: 3013 - DNA, 141 bp, Xenorhabdus bovienii
  Coding sequence Name=Xb4151_4152.C437.gene10.dna; Position on contig =4390..4530bp; Strand=+
atggcaagcgtagccattagacacgttcaggaacggacaacgccagaaactaaaacgtacacagagccaaccatgctctgtcacgtttttctggctgctgccctgactgactgcttattaaaccaaacaataacactgtaa

SEQ ID NO: 3014 - DNA, 363 bp, Xenorhabdus bovienii
  Coding sequence Name=Xb4151_4152.C437.gene11.dna; Position on contig =4585..4947bp; Strand=-
atggggaaagacatgcgaattaagatcttactcggagcgtcaatcttattgctggctggatgtgtaacgaacaatcaattaacagccgcaggttccaatgtacgttttgtggatactcagccgggcagtgaatgtcagcgattgggcgaagtgatagggatgcaaagcaattggcttaatggtattgataatgaaagcagttcaatgcgcaatgcggccaatgacttgcgtaataaagcggcagaattgggtgggaacgtcatttatggcgcaaatagcccacttagtcggacagaaaacctgttgggcatttttgtgccactcgatagcaaaatggtaggtcaggtttataagtgcccataa

SEQ ID NO: 3015 - DNA, 1647 bp, Xenorhabdus bovienii
  Coding sequence Name=Xb4151_4152.C437.gene12.dna; Position on contig =5092..6738bp; Strand=-
atggcagctaaagacgtaaaatttggtaatgatgctcgcggcaaaatgctgcgtggtgtgaatgtactggctgatgcagttaaagtgactctgggtcctaaaggccgtaacgttgttttagataaatcttttggttcgcctgtaatcactaaagacggcgtatctgtagcgcgtgaaatcgaattagaagataaattcgagaacatgggtgcacagatggttaaagaagttgcctctaaagccaacgatgcggcaggcgacggtactaccactgctactgtactggcacagtctatcgtcactgaaggtctgaaagccgttgctgctggcatgaacccgatggatctgaaacgcggtatcgataaagcagttattgcggctgttgaagaactgaaaaaactgtccgtaccttgctctgactccactgccattgcgcaggttggtacaatttctgccaattccgacgaaaccgtaggtaaattgatcgctgaagcgatggataaagtcggtaaagaaggtgtaatcaccgttgaagaaggtactggtctggaagatgaactggatgttgttgaaggtatgcagttcgatcgcggctacctgtctccttatttcatcaataaaccagaagcaggttctatcgagctggaaaacccatacatcctgctggttgacaagaaaatttctaacatccgtgaactgttgccagttctggaaggtgtagccaaggcaagtaagccgctggttatcatcgctgaagacgttgaaggcgaagcgctggcaacgctggttgtcaacaacatgcgtggtatcgtgaaagtggctgcggttaaagcccctggttttggtgatcgccgtaaagcaatgttgcaggatatcgctactctgaccaacggtactgtgatttctgaagagatcggtctggagctggaaaaagcgactctggaagatctgggtcaggcaaaacgcattgttatcaataaagacactacaattatcattgatggcgtaggcgaagcggccgcaattgctgcacgagttactcaaatccgtcagcaaatcgaagaatcaacttctgattatgaccgtgaaaaactgcaggagcgcgtagcgaaactggcaggcggtgtggcagtgatcaaagtcggtgctgcaactgaagttgaaatgaaagaaaaacgcgctcgtgttgacgatgctctgcatgcgacccgcgcagcagtagaagaaggtgttgttgctggtggtggtgttgcactggttcgcgctgctgctgctatctctgctctgacgggcgacaacgaagatcaaaacgtgggtatccgcgttgctctgcgtgcaatggaagcgccaatgcgtcagatcgtagaaaacgcaggtgaagagccatctgtggttgtgaacaacgtgaaagcaagccagggtaaccacggttataacgctgcaactgaagagtacggcgatatgatcgagatgggtattctggacccaactaaagtcactcgctctgcactgcaattcgcaggctctatcgctggtctgatgatcacgactgaagcgatgattaccgatctgcctagagacgacaaagctgacttaggtggagctggtggcatgggcggtatgggtggaatgggcggcatgatgtag

SEQ ID NO: 3016 - DNA, 294 bp, Xenorhabdus bovienii
  Coding sequence Name=Xb4151_4152.C437.gene13.dna; Position on contig =6794..7087bp; Strand=-
atgaacattcgtccattacatgaccgcgttatcgtcaagcgtaaagaagttgaatcaaaatctgctggcgggatcgttctgactggctctgcggcgagcaaatctactcgtggagagattttggcagtcggcaatggtcgtatccttgaaaatggggaaatgaaagcgctggatgtaaaagtgggtgatatcgttatttttaacgaaggttacggtgttaaggcagaaaagatcgacaatgaagacgtgttgatcatgtctgaaagcgacattctggcaattgttgaagcgtaa

SEQ ID NO: 3017 - DNA, 507 bp, Xenorhabdus bovienii
  Coding sequence Name=Xb4151_4152.C437.gene14.dna; Position on contig =7265..7771bp; Strand=-
gtgcgttggctcccatttgtcctgatatgtttgctggtttacatcgaatcagtcttatttgttcgcattgcctctgaagccggagtcttactgactctgctgctagtcatttttacttcttgtgttggtgtttcccttgtacgtaatcagggcatcaaaaattttatgtcgatgcagcaaaaaattgctgctggcgaaagccctgcgaaagaggctatcaaaagtgtttctctggtgattgcgggagttctgctaatattgcccgggttttttactgactttctcggattgctgttgttattgccacccgcgcagaagctgctgacagcaaaattgctgcctcatatcaccttttaccgtccgaataatcatgggcaagatggtcagggcggccatcatgggcagacttttgagggcgagtatgagcgtaggcaggatgatgcttcctatacactggatggtcagaaacgtcacgatgaacatggcaacgagcacgacaaaaagtaa

SEQ ID NO: 3018 - DNA, 153 bp, Xenorhabdus bovienii
  Coding sequence Name=Xb4151_4152.C437.gene15.dna; Position on contig =7747..7899bp; Strand=-
atgtcaataaatgatgaacatgcaaatttaagggtggtttactggccatgtagctctttgctaacaatattcaaggggaatattttcatcccaatggttttatcactcattaatgaaaggagaaccacgtgcgttggctcccatttgtcctga

SEQ ID NO: 3019 - DNA, 216 bp, Xenorhabdus bovienii
  Coding sequence Name=Xb4151_4152.C437.gene16.dna; Position on contig =8002..8217bp; Strand=-
atgttgtttgacatgagaaccttctttaatttggatacgtttttttactgttctatatacgtttttgttgagaataatgtcaccgtcggcaactgccgtgatattaatcacttatcactggattgctggcgcgatcatatgtggatttaccagaaatgccttgtacctggatcactttatagtgcgaattttattaatgaaatgacatatgtgtga

SEQ ID NO: 3020 - DNA, 1425 bp, Xenorhabdus bovienii
  Coding sequence Name=Xb4151_4152.C437.gene17.dna; Position on contig =8204..9628bp; Strand=+
atgtcaaacaacattcgtatcgaagaagacctgttaggtaaacgagaagtccctgctgaagcctattacggtattcacactctgcgtgcgattgaaaacttttatatcagtgaccgtactatcaatgatgtgcctgaattcatccgtggcatggtgttggtaaaaaaagccgcggcactggcaaacaaagaactccatactatccctggaaaaattgcggatattattgtcaaagcgtgtgatgaagtcctcaacacaggcaaatgcctggatcaattccctgttgatgtatttcagggcggtgcaggcacctcactgaacatgaataccaatgaggtactggcaaatatcggtcttgaattgatgggacacccaaaaggtgaatatgagtacctgaatccgaacgaccacctgaacagaagccagtcaaccaatgacgcttatcctactggtttccgtattgctgtttataattcaatcataacattgattacctccattgagttattacaagtcggtttcgacaaaaaagccgttgaattttctgacatcctgaaaatgggccgtacccaattgcaggatgcggttccgatgacactgggccaagagttccgcgccttttccgtgttattgaaagaagaaatcaaaaacatcacccgcacagcagaattactgctggaagtgaacctcggtgctaccgctatcggtactggcctgaataccgcgccaggctaccagacgctggtggttgaaaaattagctgaagtcacagggttaccttgcctaccagcagaagatctcatcgaagcaacgtctgactgcggtgcttacgtgatggttcatagcgcattgaaacgtctggcagtcaagatgtccaaaatctgtaacgacctgcgtttactttcttccggcccccgcactgggctgaatgagattaacctgccagaattgcaggccggttcttccattatgccagccaaagtcaacccagtggtgccagaagtcgtcaaccaagtctgcttcaaagttatcggtaatgatatctgtgtcaccatggcatcagaagcaggtcaattgcagcttaacgtgatggagccagctattgggcaagcgatgtttgaatccatttctatcctgagcaatgcatgccgtaatctggttgaaaaatgtgttaacggtattacggccaataaagaagtttgcgaaagctttgtatttaactctattggtatcgttacttacctgaacccattcatcggccaccacaatggcgatatcgtaggcaaaatctgtgcagagacaggcaaaagtgttcgtgaagtcgtattggagcgcggtttgctgaccgaggcacaattggatgatattttttctgttgagaacctgaaacatccgacttataaagcaaaacgttttgacgactaa

SEQ ID NO: 3021 - DNA, 285 bp, Xenorhabdus bovienii
  Coding sequence Name=Xb4151_4152.C437.gene18.dna; Position on contig =9791..10075bp; Strand=+
atgaaactgataccaaaatcaaaggaatggcgttacctttaccgtgcggtggattcagatggcaataccattgattttttgttgaccgcccatcgggataaggaggcggccttgcgtttctttaagaaagccatacgccagaatggacaacccgacggggtaacgatggatccgaatggcgccaataaagccgcagtggacaagttaaacaaggaaaaaatcaccttatcttcactcgtactttctttattaatgcgacagaaccatgttttttactatgattag

SEQ ID NO: 3022 - DNA, 276 bp, Xenorhabdus bovienii
  Coding sequence Name=Xb4151_4152.C437.gene19.dna; Position on contig =10317..10592bp; Strand=+
atggagaattccactttttgcccttcgtctaaggttttaaaatcgttaccttggattgcggagaaatgtacgaatacatctttgctgccatcttctggagaaataaaaccaaaacctttaccagcatcaaaccattttactaaaccagtcattttattagacatagatatttcctttaattttaagccactttatgtggtgaacatggcctgtttgcagagatttacttattgggcacttaggaggaggctcacgaagaaggatatctatggataa

SEQ ID NO: 3023 - DNA, 114 bp, Xenorhabdus bovienii
  Coding sequence Name=Xb4151_4152.C437.gene20.dna; Position on contig =10673..10786bp; Strand=+
atgatttatttagcaagaattaattttcattccgaagcttcccgatcaagtaaacggcaagaaatgaggcactatttttcgcatatcgcaatgaaacgtcgaagacgccagtag

SEQ ID NO: 3024 - DNA, 147 bp, Xenorhabdus bovienii
  Coding sequence Name=Xb4151_4152.C437.gene21.dna; Position on contig =10820..10966bp; Strand=+
atgcaattcagcccgttgcaataccccaaaatttcgagccgcctccctaacttgatcaatacgctaaaaatccgatacattcccgatctcaatcctgataacctaccgtcctattcttccctactacggccttgccacatgagatag

SEQ ID NO: 3025 - DNA, 258 bp, Xenorhabdus bovienii
  Coding sequence Name=Xb4151_4152.C437.gene22.dna; Position on contig =10908..11165bp; Strand=-
atgacaaaacctaaatataatcagctaaggatggaacgcaatgaacctcatcccgggcgaaaacgttatcttatcactgataatcggtgtgattcatctgtggatttgattgattacattaaagccagaaaaccaagttcgggcaaactaaggccagaaaaattaaagtcagaaaaaccgttcccaagcctgtcatctgctatctcatgtggcaaggccgtagtagggaagaataggacggtaggttatcaggattga

SEQ ID NO: 3026 - DNA, 2562 bp, Xenorhabdus bovienii
  Coding sequence Name=Xb4151_4152.C437.gene23.dna; Position on contig =11237..13798bp; Strand=+
atgaaagaatcaccagcaaaggatttagacagccatactcccatgatgcagcagtatctgcgcctgaaagcccagcatcctgacattttgctgctttatcggatgggagatttttatgaactgttctttgacgatgccaaaaaagccgctaaattactggatatttctctgaccaaacgcgggcaatccgcaggccagcccattccgatggcgggagttccttatcacgcaatcgaaaactatctggcaaaactagtacagctcggtgaatcagcggcgctctgcgaacaaataggtgatcctgccaccagcaaaggccctgttgaacgcaaagttgtgcgcattgtcactcccggcactgtaaccgatgaagccctgctgcacgaacgtcaggataatctgctggccgctatctggcatgacagccaagggtttggatatgccacgctggatatcacctccggccgtttccgtgtctctgaaatggcagacgaagataccattgccgccgagcttcagcgtacccgccctgcggagttgctctatcccgaaagctttggctccatggcactgattgaacgctgtagtggcctgcgccgtcgcccaatgtgggaatttgaactcgatacagcaaggcagcaactgaatttgcaattcggtacgcgtgacctgatcggttttggggtggaaaaatctacgctagcactgcgtgcggctggctgcctgctgcaatatgtgaaagatacccagcgtaccgccctgccccatatccgcaatattacggtagaacgccagcaagaaacggtcattatggatgctgcaacccgccgcaatctggaattgacccaaaatctggcgggtggtactgaaaacacactggcttctgtactcgatcaatgtgtgacacccatgggcagccgcatgctgaaacgctggctgcataccccgattcgcgacagaaacgtgctgcaaaaccgccaacaagccatttcagctttacaagagattggctttgaattgcagccgtttttacgtcaggttggtgatttagagcgtgtacttggccgtcttgctcttcgttccgcccgtcctcgtgatctggctagaatgcgccacgctttccagcaattgcctgatattcatcagatcatggcatcatctgattcaccttatattcaggcactgcaacagcgtgttggtcattttgatgaattacagacgctactggagaaagccgttgttgaaactcctcctgttctggtacgtgacggcggtgtcattgccccgggttaccatgccgaactggatgagtggcgtgcattagccgatggtgccagtgattatctggacagactggagatccgcgaacgtgacaaactcggccttgatacgctgaaagtcggctttaatgcggtgcacggttactatattcaggtcagccgtggacaaagccatttagtcccgattcattatgtacgccgtcaaacgctgaagaatgcagaacgctatatcattcctgaattgaaggaatatgaagataaggtgctgacttccaaaggcaaggcgctggccatcgaaaaagcgttatatgaagagctattcgatctgctgttgcctcatctggctgaactgcaaactagcgcagaagcactgtcagagctggatgtgctggcaaaccttgctgaacgcgctgaaacgctaaactacacctgcccgacactgagcgataaaactggtattcaaatcacgggtggacgccatcctgtcgttgaacaagtcttgagtgaaccctttatctcaaacccactaacactttcgtcacagcgtcgtctgctgatcgtcacggggccgaatatgggggggaaaagtacctatatgcgtcaggccgccttgattacgctgctggcgtatatcggtagttttgttcccgccgaaaaagtgctgattgggcctgtagaccgcattttcacccgcgtgggcgcttccgatgatttggcatcagggcgttctacctttatggtagaaatgaccgaaaccgccaatattctgcataatgcgacagagcatagcctggtcttgatggacgaaatcgggcgcggtacgtccacttatgatggtctgtctcttgcatgggcctgtgcggaaagtctggccaatcgcatcaaggcgatgacgttatttgccactcactattttgagctgacaacgctgcctgaaaaactggaaggtgtggttaatatccatctggatgctgtcgagcatggcgatactattgccttcatgcacagtgtacaagaaggggcggcaagtaagagttatggattggccgtcgcctctctggcaggagttccccgtgatgtcattaaacgagcgcgccagaaattaaaggagctggaatctctctccaacaatgcgacggcaggccacgtcgatacaccgcagttgacgctgctgacggaagaggtatctccggcagttgaagcgttggaaaatctgaatccggatacattgacaccgcgtcaggcattggagtggatttatcgtctgaaaaatatggtatag

SEQ ID NO: 3027 - DNA, 159 bp, Xenorhabdus bovienii
  Coding sequence Name=Xb4151_4152.C437.gene24.dna; Position on contig =13768..13926bp; Strand=+
gtggatttatcgtctgaaaaatatggtatagcagtgaagtttgatacccgtcggttagaaccaagcaaaataaaagatgggctaaataagcccaccttttggttaaaccataatatccctttcatctttcaagttgctactttattagttgcaacttga

SEQ ID NO: 3028 - DNA, 996 bp, Xenorhabdus bovienii
  Coding sequence Name=Xb4151_4152.C437.gene25.dna; Position on contig =13947..14942bp; Strand=-
atgagccaaagtacgcttaaagttaatgagttgtatgatgaggcggatttagacgaacatggcatggaagccgatgactttgatgaagcgttgctgaaagacggggatggtttaaccaacgctgatgaaaatttggatttgttgcaagaggttaaccaacgggttctcgatgcaacacaactctatctcggagagattggtttctcacctctgctgacagcagaggaagaagttcttttcgcgagacgggcacttcggggagatattgctgctcgccaacgtatgattgagagtaatttgcggttggtagttaaaatatctcgcagatatagtaaccgagggttggcacttttggatctcattgaagaaggtaaccttggccttattcgtgcggtggaaaaatttgatcctgaaagaggttttcgtttttctacgtatgcaacatggtggatccgccagacaattgagcgggctattatgaatcagacacgtacgatccgtctgcctattcatattgttaaagaattaaatgtttatttacgtactgcaagagaattagcccataaattggatcatgaacccagcgtcgaagaaattgcagaaaaactggataggccgatagatgatgtgagccgtatgatgcggcttaatgaacgcattacttctgttgacacaccaataagtggggattcagataaagccttactggatattttatctgatgaaaatgactcagggccagaaacaaccattcaggatgatgatatgaagcaaagcattgtgaagtggttgtttgaactgaatgcaaaacagcgtgaagtcttggctcgccgttttgggttgcttgggtacgaagcagaaacattagaagatgttggtcgagaaattggtttgacaagggaaagagtccgtcaaattcaagttgagggtttgcgccgtctcagagacatactgcatactcaaggcttgaatattgaatcattattccgcacttaa

SEQ ID NO: 3029 - DNA, 1059 bp, Xenorhabdus bovienii
  Coding sequence Name=Xb4151_4152.C437.gene26.dna; Position on contig =14996..16054bp; Strand=-
atgaatttaggaaactcagtgaaaaaaataaagtggataagctctgttatgggagtggtactggcaggctgtagcaatacatcggatcgtccagcgccgatagtgagtattgataagcaggaacaaaatagaggaatcccttccagaacctcgtccatctcgacacccatgccatcttctccttcaactatttcagcaaatcgttcatcagagcatcgtgcttcggaaaatcgttatttagtgaatcgtgctgttgaaaatggctcacatcagggacggatcatctataaccgcaattatgggaatattcctaaaggaagctatagcggcagcacctacacggttaaaagtggcgatactttgttctatgttgcatggattacaggcattgattttcgtgatctatctcacataaataacatttcagagccttataacctcaatgttggccaagtcctgagaatgggtaatgtaaactccagtaatggtgtattactagcatcaaatagtacccaatctaaaattgagcaggttgattttcaaaaaagtaatgcgtatcctgcaaacattgatagacagagttccgaaaagatgttgccaagaaaaacaatttctgttagcgaaagttcagctatgaaattatcatcggcaacagatataagtcctggcagcaccatcagcagtggtagcagtagttggggatggcctgcggaagggaaagtgtttgaaggtttttcggattctaagggtggaaataaaggcattgatattgcgggtagtcgtggccagcccgtttttgcaactgccagtggaaaagtagtttatgccggaaacgcattacgtggatatggaaatctcataattataaaacataacgatgactacctgagtgcctatgctcacaacgataccatgctggttcgtgattcgcaggatgttcaggcggggcaaaaaattgccactatgggtagtactggaacaagtttagtcaaattacattttgaaattcgttacaagggaaaatccgtaaacccgctgcgtcatcttccgcagcgataa

SEQ ID NO: 3030 - DNA, 627 bp, Xenorhabdus bovienii
  Coding sequence Name=Xb4151_4152.C437.gene27.dna; Position on contig =16206..16832bp; Strand=-
atgctgagtcggtcaatgaaaaatttgctgacccaattacgccagcaaggaatacaggacgagcacttgctggaaattatcgccagagttcctcgggaatgttttgttgatgaagctttggcgcataaagtttatgaaaatacggcattgcctattggacatggacagaccatatcccaaccttacattgttgctcgcatgacaaaactgttgagcttaactcctgaagccaatgtgctggagattggaacgggatctggttaccagacggcgatactcgcccatctggccagacacgttttctccgtggagcgtattaaaggtttgcagtggcaggctaaacgcaggttgaagcagcttgatttacacaacatatcaacccgccacggtgatggttggaatgggtggccgtcaaaagggccatttgatgccattattgtcacggcagcgccgcccgaaattccacaggcactattgtatcaacttgcagataacggagtgatggttctgcctgtgggggagcgctctcagtcgcttaaagtggtgcatcgctatggcagtgattttcacagcgaagtgatcgaacctgtccgttttgttcccctaattcaaggcgaactagcataa

SEQ ID NO: 3031 - DNA, 765 bp, Xenorhabdus bovienii
  Coding sequence Name=Xb4151_4152.C437.gene28.dna; Position on contig =16826..17590bp; Strand=-
atgctgcggatattgctgagtaacgatgatggtgttaccgcaccgggtattcaaaccttagcggccagattgcgggaacactatcatgttcaggtggtcgcacctgatcgtaaccgcagcggagcatcgaatgcgttaacgctggatcgtcccttgcgtatcaatacgatgaataatggtgatattgccgttcaggaaggtacgccgacggattgtgtctatctgggcgttaatcgcctggttcttcctcgcccggatattgtggtttcaggaatcaactgtggtcccaaccttggtgatgatgtgatttattccggcacagtggcggccgcgatggaaggacgccatttaggattaccggcgctggcggtatcactcaatggtgacagacattatgaaacagccgcagaagttacgatgcgcctattaaacctgttgcaaaaatctcccttaagggccggcaatattctgaacatcaatgtgcctgacgtccctattgagcagatcaaaggttttcgggtaacacgatgcggcagtcgatgtgctgctaaagaagtttacgctttggaagatcccaaaggtaacatgctttactggatagggcctcctggcgagaaacatgacgcagggccagaaacagactttgcagcgatagaagacgggtttgtctccattactcctttacaggtggacttaaccgcttataaggcacaggagttaatcaacgattggttggtaaaagtcggagatatgggagaatgctga

SEQ ID NO: 3032 - DNA, 120 bp, Xenorhabdus bovienii
  Coding sequence Name=Xb4151_4152.C437.gene29.dna; Position on contig =17812..17931bp; Strand=-
gtgttggcagggattgaattagtctgtatgttgcgcaaagggcaataccgacaaaatggtgaacaggggcaagggtgtccgatttcactcgcggcatttttctatcaattagctgagtaa

SEQ ID NO: 3033 - DNA, 99 bp, Xenorhabdus bovienii
  Coding sequence Name=Xb4151_4152.C437.gene30.dna; Position on contig =17941..18039bp; Strand=-
atgttgattctgctatatcttaataatctgcttgaacaggatcaccgcaacgtcaaacggcggacacgtcctatgctgggatttaaaaacttcagatga

SEQ ID NO: 3034 - DNA, 294 bp, Xenorhabdus bovienii
  Coding sequence Name=Xb4151_4152.C437.gene31.dna; Position on contig =18017..18310bp; Strand=-
atgccgatgttttttatgcgtggatggacgcaagatttgctgccaaagcttccacacggagcagtgatagtgatggataatgcgcctttccataaacggaatgacacgacacaagcgatagcagacagcagatgtcaactggaatggcttcccgcttatagtccggatttaaaccctatagaacacaaatggggcggagcaaaagcgataaggaggcaaaaagatgttcagttgatgagttgtttacggagcatattgaataggtcaggttatgttgattctgctatatcttaa

SEQ ID NO: 3035 - DNA, 141 bp, Xenorhabdus bovienii
  Coding sequence Name=Xb4151_4152.C437.gene32.dna; Position on contig =18367..18507bp; Strand=+
atgacgttgagacggccttttgcgtgccagtcatgcgtaccaaaacagcgtaacccttgccctgtttacgtggcatcgattgagcaaaaccactttcatccaagtaaacaatgggtctgccagtctgttcatcatcgctga

SEQ ID NO: 3036 - DNA, 366 bp, Xenorhabdus bovienii
  Coding sequence Name=Xb4151_4152.C437.gene33.dna; Position on contig =18498..18863bp; Strand=-
atgggctacagcttagattttcgaaagcgagtactggcatacaaagacaagcattcgttgactttcgaacaaacgagtgcccattttgagatctccatgcgtaccttgttccggtggtgcaataaaatagaaccttgcatgacccgcgataaacccgccacgaaaatccctgatgaggtactcattgcggatgtccaaaattttcctgatgactatcaatgggaaagagcaaaacgcttaagtgtttcacaatcggctattcattacgccttgaaacggcttcggatcacccagaaaaaaaacgctccaacaccctcgcgctgctcctcaagctcgtcaggcatttatcgagcgcatcagcgatga

SEQ ID NO: 3037 - DNA, 93 bp, Xenorhabdus bovienii; identical to SEQ ID NO: 1411
  Coding sequence Name=Xb4151_4152.C437.gene34.dna; Position on contig =18824..18916bp; Strand=+

SEQ ID NO: 3038 - DNA, 168 bp, Xenorhabdus bovienii
  Coding sequence Name=Xb4151_4152.C437.gene35.dna; Position on contig =18918..19085bp; Strand=-
atgtctgaacggggaattgcggttgatcacgctgcgctctctcggtgggttcatcgcttggttccgttgatcgtgaaacgttatcggcgaagcaagcctgacgttggacgtcggtggcgcatggatgaaacgtatatcaaaatcaaagggcaatggcgttatagctaa

SEQ ID NO: 3039 - DNA, 120 bp, Xenorhabdus bovienii
  Coding sequence Name=Xb4151_4152.C437.gene36.dna; Position on contig =19153..19272bp; Strand=-
atgcagaaactgggttctgtcgcattaagcggtcatcaggtaagctcccctgtttttgagcgagtccagagcgatgttccttatccgaaaagcgttcaaacgcctgcactatcctgttga

SEQ ID NO: 3040 - DNA, 501 bp, Xenorhabdus bovienii
  Coding sequence Name=Xb4151_4152.C437.gene37.dna; Position on contig =19590..20090bp; Strand=+
atgtttaaatctaaatcaggattttcaatattaaataagctatggttatttgcagtaaaaaacaaaaaaacatctgatgacgatctaataaatgaaataatggaagtggaaaagtttaatttttactacaatacaaacgcaacatcaataagacagaaggaaaattttgaaggctggataagaagatatgaattggattttaaaattatctctaaaatgaaaataaactttgacattgatacgcttaaaataaaaataatatcaatctcaattccatttctgtttttattttttatgtatttatgtatttatgtatttatgtatttatgctttatatcagcaatgcctgtggctttaaagcctgcaggcttgataaagataaatgatgatgacgggtggttttggattaataaaaatgaagctatggaatatggttttttaaataaacgaaaagacttatgggttgttactccagaaatgggtcatgtattaaatgattag

SEQ ID NO: 3041 - DNA, 291 bp, Xenorhabdus bovienii; identical to SEQ ID NO: 155
  Coding sequence Name=Xb4151_4152.C437.gene38.dna; Position on contig =20099..20389bp; Strand=-

SEQ ID NO: 3042 - DNA, 279 bp, Xenorhabdus bovienii; identical to SEQ ID NO: 890
  Coding sequence Name=Xb4151_4152.C437.gene39.dna; Position on contig =20381..20659bp; Strand=+

SEQ ID NO: 3043 - DNA, 126 bp, Xenorhabdus bovienii
  Coding sequence Name=Xb4151_4152.C437.gene40.dna; Position on contig =20610..20735bp; Strand=-
atgggaaaggaaatggcggacatcctcgttatcgctgttatagctgctgtaaggtctttcagttggcgtatacctatcaggcctgcaaacccggcgttaaagaacagattgtcgatatcgcgatga

SEQ ID NO: 3044 - DNA, 183 bp, Xenorhabdus bovienii
  Coding sequence Name=Xb4151_4152.C437.gene41.dna; Position on contig =20758..20940bp; Strand=+
gtggcaataacggcaatagacatcaactttggccatacttcatccttaaaaagccggaagcatatcacagcaactaaccatttaatacatgacccagaaatgggtcatgactctattttattgatagtgatgaatgttcagataatatcctataattctgtcatgcatttctatggattttga

SEQ ID NO: 3045 - DNA, 504 bp, Xenorhabdus bovienii
  Coding sequence Name=Xb4151_4152.C437.gene42.dna; Position on contig =20875..21378bp; Strand=-
atgtcgggcgacagcacgagtgatggggattggcctgaataccgtacttcggcatttaaaaaactcaaacccaaatcggtaacagaagcgattaaacctggcactgaagtgattgtctgctgcgaaatggatgaacaatggtcttacgtaaagtcaaagaagccgcctcgttggctcttttatgccgacgacaggataaggcgaaaagtgatcgcccatgtttttggtccaagaacaaaaaagacattaatgcgcctattagctttactggcacctttcaacattattatttacatgacagatagctggaaaagttacgaaaaagcactcgcagggaaacgccatgtggccagcaagcgttatacccaacgcatagagaggcataacctgaatcttcgtcaacatttggcaagactgactcgcaaaacattgtctttttcaaaatccatagaaatgcatgacagaattataggatattatctgaacattcatcactatcaataa

SEQ ID NO: 3046 - DNA, 291 bp, Xenorhabdus bovienii; identical to SEQ ID NO: 1703
  Coding sequence Name=Xb4151_4152.C437.gene43.dna; Position on contig =21324..21614bp; Strand=+

SEQ ID NO: 3047 - DNA, 213 bp, Xenorhabdus bovienii
  Coding sequence Name=Xb4151_4152.C437.gene44.dna; Position on contig =21666..21878bp; Strand=+
atgcatattgtggatcagtttgaaactctgtcccaaataaaatatacatatcaatatagaactgaacgggaccgcgttgatcaaaaccgtcgttttttgctttttctacggcgtttgtcagtgcggtgcttaatccctccttacccaattttatttcaaggtagggataggattcattacaatacgctaccaattcatcaatataagcattga

SEQ ID NO: 3048 - DNA, 156 bp, Xenorhabdus bovienii
  Coding sequence Name=Xb4151_4152.C437.gene45.dna; Position on contig =21922..22077bp; Strand=+
atggccatatttatggtatctccaatcataatgactaaggctatagtcgctggtgaaatatattgtttatgtcattttcagttcagcgactatagtttccaatttattatttatatgaatcaatcttaccttctaggtaatcgcggcaggtcataa

SEQ ID NO: 3049 - DNA, 153 bp, Xenorhabdus bovienii
  Coding sequence Name=Xb4151_4152.C437.gene46.dna; Position on contig =22028..22180bp; Strand=-
ttgctaacaataagaataattagctcatatgataatggctatttttaccagcctataaattttattaatagagaaaatgaatggcataatagtcatagagatattatgacctgccgcgattacctagaaggtaagattgattcatataaataa

SEQ ID NO: 3050 - DNA, 363 bp, Xenorhabdus bovienii
  Coding sequence Name=Xb4151_4152.C437.gene47.dna; Position on contig =22316..22678bp; Strand=-
atggtttcttctttggctctatcggcgttgagcgtcgcctttgccgggccgtggctgtttgatatgcgtcaggctcaggcatgggaagacaaattcctgcggctggaaagcgctgcaccggctgtttcctggctgtataccacacagtcactggataaactgacccgtcatctcgaatcctacttgaatatccagttaaagacgggggaaacagcgttgttgcgtttttacgatccccgcgttctgaatcaaattccacacctttttacgccggaacagttgactcatttcactcaggatattgaagaatggcaatatcagcttaataacaccgcctatattgtaaaaggaattgcatcatga

SEQ ID NO: 3051 - DNA, 195 bp, Xenorhabdus bovienii
  Coding sequence Name=Xb4151_4152.C437.gene48.dna; Position on contig =22713..22907bp; Strand=+
gtggagcaagatcaccgcaatatcaaacgtcggacacggccgatgttaggttttaaatcgtttcgccggactcaaacgattttagcggggatagagctcgtttcaatgctgcgtaaaggacaccatttgatagcgtattatcttaaacggcagtcgctaaggctttatccatcacatgatgaaaatcacgtttaa

SEQ ID NO: 3052 - DNA, 519 bp, Xenorhabdus bovienii
  Coding sequence Name=Xb4151_4152.C437.gene49.dna; Position on contig =22855..23373bp; Strand=-
atgtctgtagaaaatgaacatcgcctgcgttttcggaatgcgatggcgagcctttccgctgcggtaaatatcatcaccacggatggccctgcggggcaatgcggtataactgcaacggcggtatgctctgtgacagatacgcctccgactctgatggtatgcatcaatcgcaatagcgctatgaatccgatatttcaggaaaatgggcgcctgtgtgtcaatattctgaatcatgaacaagaattgattgctcgtcattttgccggaatgacgggcgtcagcatggaagagcgctttggctggaatatctggaaaacaggcgctctgggacaaccgatgctgaaagaaacactagccaatctggaaggaagtattgaacaagtacaggaaatcggcacgcattatgtctatctggtggaagtcaaacagatcgcggtcaaggaagaaggccacgggctgatttattttaaacgtgattttcatcatgtgatggataaagccttagcgactgccgtttaa

SEQ ID NO: 3053 - DNA, 1563 bp, Xenorhabdus bovienii
  Coding sequence Name=Xb4151_4152.C437.gene50.dna; Position on contig =23395..24957bp; Strand=-
atgagattagaagatttgcgtgccgatcataaacgcccgtttaccagcaaagagtacctgaaatcgcttcaggatggccgggaaatttatatttacggcgaacgcgtcaaagacgtcacgacacatcccgctttccgtaatgccgcagcctcgataggtcaattgtatgatgtcctgcatgagccggaaacccacgatatactctgctgggataccgataccggcaatggcggctatacccacaagttcttccgctttgcaaccagcccggatgaaatgcgccagcagcgggatgccattgcagaatggtcacgccaaagctacggctggatgggacggactcctgactataaagcggcattctgttgtgcattaggtgcttatcctgaattttacgggcagttcgcggataacgctcgcacatggtataaacgcattcaggaaagtggtatctatttcaaccatgccattgtcaatccaccgattgatcgacataagccagccgatcaggttaaagatgtttttatccagatagaaaaagaaaccgatgccgggattattgtcagtggtgccaaagtcgtcgcaaccaattcggcgctcactcactataattttattggttttggttctgcacaagttatcggtgataatcctgatttcgccttgatgttcgtcgcacccatggatgccgatggcgtgaaattgatctcgcgcgcttcttacgaattggttgccggcgccatgggttcacctttcgattaccccctttccagtcggtttgatgaaaatgacgccattctggtcatggataaggtgttaattccgtgggaaaacgtgttaatttatcgcgattttgatcgcgcccgcaattgggctgtccaaggcggttttgcccgtctgttccccatgcaggcctgtgtacgcttggctgtcaaactggacttcattacgggattgctgcaaaagagccttgaatgtactggtgtggtagatttccggggggttcaggccgatttgggggaagtcgtggcatggcgtaatttgttctggtcactgacggatgcgatgtgggcagaagccaaaccgtgggaaggcggcgcttatctgccggatactcaggcgattcagacttatcgtgtcatggcaccgatggcttatagcaaaatcaagaatatcattgagagcaatgtcaccagcggcttgatttatctgccatccagtgtacgcgatatgaataatcctgaaatcaataagtatcttgagaaatatgtacgcggttctaacggtattgaccatgtagagcgaattaagattttgaaattaatgtgggatgccattggcagcgaattcggcgggcgtcatgaattgtatgaaatcaattatgccggcagtcaagatgagattcgcctacagtgcctgcgtcatgcctatggctccggtaatatgaagaaaatgacggaattggtggatcgctgtctttcagactatgacttgaatggctggacaaaaccccatttacacaataaccgtgatattaacctgttagataagctgctgaaataa

SEQ ID NO: 3054 - DNA, 126 bp, Xenorhabdus bovienii
  Coding sequence Name=Xb4151_4152.C437.gene51.dna; Position on contig =25145..25270bp; Strand=+
ttgtgttttagcggcagtcttaaagtgcccggtcatgtattcaatatgtgtattgtgagttttattgtgttgagccaattgctgcttataacactaaaatcaccttatgatcttggtagtagataa

SEQ ID NO: 3055 - DNA, 108 bp, Xenorhabdus bovienii
  Coding sequence Name=Xb4151_4152.C437.gene52.dna; Position on contig =25251..25358bp; Strand=+
atgatcttggtagtagataatactggagtcgccaagttcaacatattaaatacacaaccaaaacatgaggtgagatacagtgagactaacaaacctcagctatattga

SEQ ID NO: 3056 - DNA, 1050 bp, Xenorhabdus bovienii
  Coding sequence Name=Xb4151_4152.C437.gene53.dna; Position on contig =25411..26460bp; Strand=-
atgacattaagtgaattacactggctctatgggcagccagaagcgactggcgtagttaaagcctcacccgaagattttattgttcgtgaagatttaggattttctcctgatggagaaggcgaacatttaatggtacatatccgtaagacaggatgtaacacccagtttgttgctgatcaccttgctcgttttgccaaaataccggcgcgctctgtcagttacgcgggattaaaagaccgtaacgcagtcacagagcagtggttttgcgtgcatctgccaggaaaacaagatccggatttaactgcgttccagttggagggatgtgaagttttgaccgcttctcgccaaaaacgcaaactacggattggcaccttgaagggtaatgacttcactcttgtattgaggcaaatttctgacaggcaatctgtggaaaaacgcttgcagcagattgcacaggcaggtgtgccgaattattttggtgaacagcgttttgggcgggatgggcaaaatcttgttcaggcacagcgctgggcggataacgaaatccaggtcaaggaacgcagccgccgcagtttttacctgtctgccagccgcagtgccatgtttaatactattgccagtctgcggatcgctcaggatacgcaccagcaggtattgaacggggatgccttacagctaacgggacgcggtagctggtttgttgcagatgaacttgaactgcctgtattacagcaacgaatcatggatggtgaattgcagataacagcacctttgccaggcgataaaacgctgggtactcagcatcaggcattggatttcgaacagcactgcctgttagattacgcatcgctatggtcattggtcaaacgtgaacgcgtggaaagtgtgcgtagagcaatcttggtgcaaccactcaatctgaactgggaatggttggatgagcgaaccgtcaccctccatttctcactgccatcaggcagttttgcaaccagtgtcgtcagagaacttatcaatcaggatcaaaataatgctgcggatattgctgagtaa

SEQ ID NO: 3057 - DNA, 624 bp, Xenorhabdus bovienii
  Coding sequence Name=Xb4151_4152.C437.gene54.dna; Position on contig =26463..27086bp; Strand=-
gtgtatcacggacgaatcttcggcactggaatattgtggttatcacccggtgctggtacatgggcgggcagacaatataaaagtcactcaacccgaagatctggcattggcggagttttacctatcccgaaaatcaaaggaacatatcgtatgagaattggacacggttttgatgtgcataaatttggcggagaagggcctctggtcatcggtggtgttcgcattccttatgaacaagggctgatagcccattccgacggtgatgtggccctgcatgcggctacggatgctttattaggtgcggcagcactgggagatatcggaaaattgtttccagataccgatccggcctttaaaggtgcggatagccgtgaactgctgaaggaagcctatcgccatatccgtaaaaaaggctatcggattggtaatcttgacatcaccattattgctcaggcgccgaaaatgctgccgcatattcctcagatgcgggtcaatctggcagaagatcttgaatgccatatggatgatattaacgttaaggcaacaacgactgaaaaactgggatttgttggccgtaaagaaggtattgcctgcgaagccgtggctttgctggtgaaggaataa

SEQ ID NO: 3058 - DNA, 780 bp, Xenorhabdus bovienii
  Coding sequence Name=Xb4151_4152.C437.gene55.dna; Position on contig =26933..27712bp; Strand=-
atgaataacccaatatttcattctcctgctgatacttctcttgctgatattgtcgcattgatccctgctgcggggatcggtagccggatgaaatcagattgcccaaaacaatacctccctcttgctggtaaaactattattgaacacacattggcagcattacttgaacatccccgcatacagcgagtcattgttgcgctgaactctgctgataatcagttcgggcggcttgcgattgcctctgacccacgaataactacagtggtaggaggagcggagagagctgattcggtactggcagggctggattatctggcgagcctttcgacagacagctctgcttgggttttggtgcatgatgctgcccgtccttgcttacatcgtgacgatctcgataatctgctacagctcatcaatagaagtgcaccgtctccggctgtctgtggtgggcttctggctgctcctgtcagggacaccatgaagcgtatggtgatggcatccgaggaggagccatccaccattgatcataccgttgatcgccgaggcctctggcatgctctgaccccgcagttatttcccttacagttattacgtgactgcctgacaaaagcgcttgcagaacaagcgtgtatcacggacgaatcttcggcactggaatattgtggttatcacccggtgctggtacatgggcgggcagacaatataaaagtcactcaacccgaagatctggcattggcggagttttacctatcccgaaaatcaaaggaacatatcgtatga

SEQ ID NO: 3059 - DNA, 321 bp, Xenorhabdus bovienii
  Coding sequence Name=Xb4151_4152.C437.gene56.dna; Position on contig =27718..28038bp; Strand=-
atgggcaaactaacgctactattattggttttactcggctggttacagtactcgctgtggttcggcaaaaatggtattcacgattatgtgtgggttaaagatgaggttgtcaggcggaatagcgctgatattacccttagggcgcgcaacaaccagctatttgctgaaattaaagatctgaaaaaaggtcaagaagcgattgaagaacgtgctcgtaatgaattgggtatgattaagccgggagaatctttttaccgtctggtgcctgatacctctaaacacaatgcgcaacaatctttgaaagaaaatagtaaacaataa

SEQ ID NO: 3060 - DNA, 132 bp, Xenorhabdus bovienii
  Coding sequence Name=Xb4151_4152.C437.gene57.dna; Position on contig =28083..28214bp; Strand=+
atgacgccactatcacaaaacatgatcacaagatgtgatggaaaagtactggatgagatgagtgtagaaacacattattccacgcgcaataatgtgtttcttaacggctcaatgggtatggtgttcaaatag

SEQ ID NO: 3061 - DNA, 618 bp, Xenorhabdus bovienii
  Coding sequence Name=Xb4151_4152.C437.gene58.dna; Position on contig =28207..28824bp; Strand=-
gtgtctcagatcaaggaacactcgttttctaatgtcgtttggcattcacatacgttggacagaaagcaaagggaagtggtgaatggccatcctgctttagtcatctggttcactgggttgtctggctcagggaaatccacacttgcaggcgcactggaacaagccctgttttcgcgggggatcaaaacctatttattggatggagataatctgcgtcatggcttgtgcagcgatttgggattttctgaaactgaacgacgagagaatatccggcgtatcggagaagtctcaaaattgatggttgatgctgggctagtagtcttaacggcgtttatttctccccatagagctgaacggcaaaaactacgtgaattgatgggagccgatcgatttattgaagtctttgtggatacgccgctggcgatatgtgaagcccgtgatccgaaaggcttgtataaaaaagcgcgggcgggggagctgcttaacttcacgggaattgattcagcttacgagacgccagaacagcccgacatctatttggatggctcactacctgttgaatcatcgatagaaaaattgcttgctgcgctgcataaccacaactttttgcctatttga

SEQ ID NO: 3062 - DNA, 1443 bp, Xenorhabdus bovienii
  Coding sequence Name=Xb4151_4152.C437.gene59.dna; Position on contig =28825..30267bp; Strand=-
atgcccgcacttgcacacaatgaaaccatcgccagccagatcaaacagcagggtggggtggaagcctacctgcggatacagcaggaaaagggactactgcgttttttgacctgcggtagcgtagatgatggtaaaagcacattaattggccgcctgttgcacgatacccgccaaatttatgaagatcagcttgcgacattacaaaacgacagcaaacggctgggaacacaaggtgagaaactggatctggcgttgttggtggatggtcttgccgccgagcgggaacaaggtatcactattgacgtggcataccgttatttctccacggaaaaacgcaaattcatcatcgcggatacaccggggcatgagcagtatacccgtaatatggcaacgggagcttcaaccagtgatctttccattttactgatcgatgcgcggaaaggcgtacaggagcagacacgccgacacagttttatcagtactctgttgggtattcgtcacttggtggtagcggtgaataaaatggatctggtggattatcgacaggatatttatgaacagatcaaacaggattattggaatttcgccggccaattaccgactgacctgcacgtttatttcgtacctatctcggcactggagggggacaatatcgtcagtcgtagcgaaaaaatggcatggcatacaggggaaacgttactggatactcttgaaagcgttgatgtaaagaaaaaagcaacagagcagcccctgcgttttccagtgcaatatgtcaatcgccctgatctcgattttcgcgggtacagtggcacactgtcatcgggtattttacgtcaaggccagcaaatcaaagtcatgccttcaggtgtgatttccaccgtagaacggattgtaacttttgacggagatctgccatttgccgtacctggtgaggcgattaccgtcgtgctgaaagatgaaattgatatcagccgtggtgacctgctgattgccgttgaagatcacatgaccgtagcacgtcatgcattggtggatgtcgtatggatgtctgagcagccgctgattcaggggcaaagtttagatatcaaggttgcgggcaagaaaagccgtgggaaagtcgataatgttcaatatcaggtagatatcacaaatctgacgcaaaaagtggcggttgaattgccattgaatgccattgggctggtggaattctcatttgatgagccactactgatcgatagttatccgcaaaacgccgataccggcggcatcatcctgattgatcgtctgaccaatgtgactgtcggtgcgggtctggtacgtgaaattcaaactgaagtttacgaagagccgaaggagtacagcgaatttgaactggaattcaatcgattggttcgtcgtcattttccacactggggtgcgcgtgatttactgggaggtaaataa

SEQ ID NO: 3063 - DNA, 909 bp, Xenorhabdus bovienii
  Coding sequence Name=Xb4151_4152.C437.gene60.dna; Position on contig =30279..31187bp; Strand=-
atggacgaaaaaaaactgacacacttgcagcaactcgaagctgaaagcattcatattattcgcgaagtggctgccgaatttgctaatcccgtaatgctttattccattggtaaagattcctcggtgatgctgcatctcgcccgcaaggcgttctatccgggaaaattgcctttttccttactgcacgttgatacaggatggaaattccgtgaaatgtatgacttccgtgatcatacagcggaaaaatacggttttgaattactggtttaccgtaacccacaaggtgaagcactgggtattaacccctttatccatggcagtgcaaaacacaccgacatcatgaaaacggaagggctgaaacaggctctggataaataccgatttgatgcagcatttggtggggcaaggcgtgatgaagaaaaatcccgggccaaagagcgcatctactcattccgtgatcgttcccatcgttgggatcccaaaaaccagcgtccagaactctggcgtaactataacggtcagatcaacaaaggggaaagcatccgtgtattcccgttatccaactggactgaattggatatctggcaatacatctatctggagcagatagacattgtccctctttacttcgccaaacaccgtccggtcattcagcgtgatggtgcattgattatggttgacgacgctcgtattgatctgaaatcaggtgaagtcatcagccaaagaaaagttcgcttcagaacactgggctgctggccactgactggcgctgtggaatcagaagccgaaacgctgccggaaatcatagaagaaatgttgatatcgaccaccagtgagcggcagggacggcttatcgacagtgatcagtccggctcgatggagttgaaaaaacgtcagggttatttttga

SEQ ID NO: 3064 - DNA, 1461 bp, Xenorhabdus bovienii
  Coding sequence Name=Xb4151_4152.C437.gene61.dna; Position on contig =31198..32658bp; Strand=-
gtggactatttacccttatttgttgagttaaaatcccgacctgtattgctggttggaggtggagaggtagctgctcgtaaggcaagcctgctgctacgtgcgggtgcgtcgctaacaatagtcgcccctgaattgcattctgagctgcaacaacgctatcaaaaagcggaatttgaatggaggcagggtggatttcgaacagaatatcttgatggcgtatttttggttattgcggcaacagatgaccacgatttgaaccagcatatttttgctgaggccaatgctcgcgctattttggtcaatgtagtggatgatcaaccgctttgctcggctattttcccctcaattatcgatcgttctccgattatggtggcgatttcatccgcaggaaaatccccggtattggcaaaattgctgcgagaaaaactggaatccctactgccctttcatcttggcatcatggcagagattgcagggcgctggcgtgagcgcgtgaaacagcgtctgacttccatacgccagcggcgtcacttttgggaaaaagccttgaatgggcgttttgccacattggtagctaatggacaactacagcaggcagaagcacaactcgatgaacaattgatcgatgaacaacgagccaacgaacaactcgcgccagccggcaaacagggcgaattggctttagtaggagcagggccgggcgatccgggattgctgaccttaaaaggtttacaagtgattcagcaggctgatgttgtgctttatgaccatctggtcagtgcagatattttggaattggtacgccgcgatgcagatcaaatctgtgttggcaaaagggcagggaatcactcagtagctcaggaagagactaatgcattaattattaaactagcgcgtcagggtaaaaaagtagttcgtctgaaagggggcgatccattcattttcggtcgtggtggagaagaattgcaggttgctgctgaagcgggtattccctttcaggtagtacccggtattaccgcagcggtaggcgcttctgcttatgccggtattccactgacacacagagagcactcccaaagtgtcacctttattacaggacactgccgtgaaaatggcgatgaactggattggcctgcattagcgcggggtaatcaaacattggcaatttacatgggtatcataaaagctgccctgatcagccaaaaattgatttcacacggacgagatgccaataccccagtagccgtgatcggctgcggaactcgtccagaacagcaggtactgaccggaaccctatccgaactggatcggttggcacaaaaagcaccatcgcctgcacttctggtggtgggagaggtggctcaactccaccaccagatagcatggttcgggcaacagtctgttgatcaaaaacaatctgttgctcaaataaatcgccctgctgttgttgatctcgtataa

SEQ ID NO: 3065 - DNA, 93 bp, Xenorhabdus bovienii
  Coding sequence Name=Xb4151_4152.C437.gene62.dna; Position on contig =32816..32908bp; Strand=-
atgacggatgatgtcagggatttctattggggcgtgctgcttaaaaaagaggtgcggcggcctgcccttaccctgaatattccgaatagttaa

SEQ ID NO: 3066 - DNA, 735 bp, Xenorhabdus bovienii
  Coding sequence Name=Xb4151_4152.C437.gene63.dna; Position on contig =32915..33649bp; Strand=-
atgagccagcttcatttagcagaattgctggcattgaatcatgatcagcgtgccgaagcattagctgacatcaatcaacaactggaattactggatgcccgccagcgtgttagctgggcattggaacatctatctggcgaattcgtgctttcttcaagttttggcattcaggctgcggtctgcctgcatctggtgacacaagaatatcctgatattcccgttatcctcacggataccggttatttgttccccgaaacttaccaatttatcgataagctgactgacgaactgaaactgaacttgacggttttccgggcagaactttctcctgcctggcaggaagcgcgttatggcaaattgtgggaacagggagtggaaggcattgagcgctataaccagatcaacaaagttgagccgatgaaccaagcattgaaatcactgcatgcacaaagctggtttgcagggttacgccgccagcaatcggaaagtcgcgctaatttacctgtgctggccgttcagcgcgatgttttcaaaattctgcctattgttgattgggataatcgtcgagtgcatcaatatttggcgcagcagggtcttgaataccatccgctatgggagcagggctacctctctgtgggggatacccatacaactcaaaagtggcagccgggcatgagcgaagagcaaacccgcttttttggcttaaaacgtgagtgtggtttgcacgaaagctaa

SEQ ID NO: 3067 - DNA, 1731 bp, Xenorhabdus bovienii
  Coding sequence Name=Xb4151_4152.C437.gene64.dna; Position on contig =33646..35376bp; Strand=-
atgagcaatgaaaaacaaggtcctttgaaggttgaaggtaaactcgctgacagtgaacgcatgaaattaaatagcgactatttgcggggtacaatcagcgaagatttaaaaaatgggctgacaggcgggtttgagggggataactttctcctgatccgtttccacggcatgtatcaacaggatgaccgtgacatcagagcagagcggacggaacaaaaacttgaaccccgtcacgctatgatgctgcgttgtcgcttgccaggaggcattatcacacccagtcaatggctgggtattgatcagtttgcgacagaagataccttatacggcagcatccggttgaccaaccgacaaacgttccagtttcatggcattttgaaaagcaacctaaaacctgcccatcagttgctggcaaaaatggggctggattcattggcaacggccaatgacgtcaaccgtaacgtactttgcacatcaaatccggtgcaatcggctttgcaccagcaggcttatgaatgggcgaaaaagatatcggaacacttattgccacgcacgagcgcttatgccgaaatctggctggataaagaaaaagtagcgactaccgatgaagagcctattcttgggtcaacttatctgcctagaaaattcaaaacatccgtggtgattccgccacaaaatgatgtcgatctccatgctaatgacctgaactttatcgctattgcagagaatgaccagttgatcggctttaacgtgctggtgggtggcggattagcgatgacccacggtgataagaagacttttcctcgactggcgagtgagtttggttttattccactgaaacacacattggcgattgcagaagccgtggtgacgacacagcgtgattggggcaaccgaacagaacgaaaaaatgccaagaccaaatatacccttgaacgagttggtgtcgacaccttcagacaggaagtagaaaaacgggcaggagtgcactttgaggctattcgtccgtatgaatttacgggtcgcggggatcaaattggctggttgaaaggcatagatgatcaatggcacctgactttgtttattgagaatggccgcttgctggattatcccggtaaaccgctaaaaacggggatcgcagaaattgcgaaaatccacaaaggtgatttccgtctgacggccaatcaaaacctgattgtggcgggagtgccagaaagcgaaaaagcacgcattgaagaaatcgcccgcacacacggcttaatagataatagcgtgacattcctgcgtcatcattccatggcgtgcgtttcatttccaacttgcccattggcgatggcggaagccgaacgtttcttgccgacatttgtcgattatgttgatgcattaatggaaaaacacggtgtttctgacgaacatatcgtcctgcgtgttacgggctgcgcgaatggatgcggcagggcgatgctggcagaaatagggttggtaggtaaagctcaggatcgctataaccttcacctcggtggaaaccggattggcagccgaattccccgcatgtacagggagaatatcacttcagcggagattctggtgatactggatgaattgattggtcgctggtcagcggaacgcaatgtccatgaatgctttggggatttcttggttcgtgccgacattatcaaacctgtcttgaattcagcccttgatttttatgactggcaggaggcgttatga

SEQ ID NO: 3068 - DNA, 1866 bp, Xenorhabdus bovienii
  Coding sequence Name=Xb4151_4152.C437.gene65.dna; Position on contig =35378..37243bp; Strand=-
atgattaatccatgtatagatttcaaaatcatggatattggctatagcaaagggcacgggatcatgaccacaaaaccaccttcaactgcattactaccggtttctcctgaacaattatcacgtctgcaatctgcaatcggtgatttttctccacatcaactggcgtggttatcgggctatttctggggaatggtaaatcaaaagccacaaactgaagtcgttacaccagctgcccctatatcggaaactgtcacactgatctctgcctcacaaacaggaaatgcccgtcgtttagccgagcaactcagagactcgttgttggcggaaaagctaaatgtgaacttggttaatgcgggcgattataaattcaagcaaatcgcacaagaacgggtattgattattattgcttcgacacaaggtgaaggtgaacctgccgaagaagcggtagcactgtataagtatttgaattccaaaaaagcgccatcaatgaaagagacggcttatgccgtatttggtctgggggatacctcttatgaaaacttctgtcaggctggtaaagactttgaccatcgcctgaatgaactgggcgcacaacgattactggagcgtattgatgtcgatgtggaatatcaagaacaggcagcacagtggcgtcaacaaataacggaagttttaaagcagcgcctgccagcccagacacaagccggcatcactgtcaatcaagcgggttcggtcagtgaaatcatttccagcccttataccaaagacgcgccactgaccgcttcgctcctgaccaaccaaaaaataacggggcgcggttcagacaaagatgttcgccatattgaaattgatctgggggattccggcctgcattatcagcccggagatgcgctgggtgtctggttcgaaaatgatccggcactggtggatgaattgattgaattgctttggctgaccggatctgagcaggttaatgtacatgggaaatcactgccactgcgtcaggcgctgattagccatgttgagctgacccagaatacgggattaattgttgagaaatatgcggtattggcgaaagatcaaaaacttttcgctttaattgctgacaaacaggcattacaacagtacgcacaaaaaacgcctattgtggatatggtcaggcaagcggccttacatccagaagcccagcagtttatcgacttactacgccccttgacgccgcgtctctattccatctcctcctcacagactgaagttaaaaatgaagtacatgttacggttggcgtggttcgctatgagatagaagggcgtgcccgtacggggggcgcatcgggctatctggccgatcgattgcaggaagacgacaacatccgtatttttatcgaacataacgataactttcgcttacctgccgatccacagacatctgtcattatgattgggccgggtacgggagttgcaccgtttcgggcatttttgcaacagcgtgacaatcaggggtctgaaggcaaaaactggttgttctttggtaatccacatttcgttgaagattttctctatcaggttgaattccagcgctatgccaaagatggcttgctgacccgcattgacttggcatggtcacgggatcaacaacataaaatctatgtacaggacaaactgcgtgagcagggaaaagaaatctggcgctgggttcaggatggtgcacatttgtacgtctgtggtgatgccaatcgtatggcaaaagatgtggagcaggcattgctggatatcatttcacaacagggtggcatggatgctgaacaggctgatgaattcttgagtgaattgcgccttgagcgccgttatcaaagggatgtttactaa

SEQ ID NO: 3069 - DNA, 207 bp, Xenorhabdus bovienii
  Coding sequence Name=Xb4151_4152.C437.gene66.dna; Position on contig =37187..37393bp; Strand=+
gtgccctttgctatagccaatatccatgattttgaaatctatacatggattaatcataaggttatcccagataaggaggagattttaaagaaaggtttgcaatatctcataactaaaatgcctaactttatttacagatttcatatatcgataaagtcgttaagcgttgtgctttattcctccagaaaaatcacgttatgcttgtaa

SEQ ID NO: 3070 - DNA, 366 bp, Xenorhabdus bovienii
  Coding sequence Name=Xb4151_4152.C437.gene67.dna; Position on contig =37439..37804bp; Strand=+
atgagcactaccatctttaaagattttcaatttgaagcggcgcatcgcctgccgcatgttccggaaggacataaatgtgggcgtctgcatggacactcattcatggtacgtctggaaattaccggagaggttgatcctctcagcggatggatcatggattttgccgatgtaaaagtcgcatttaagccgatttgggaacggctcgatcataactatctcaatgaaattcctgggctggaaaatccaaccagcgaagttttagctaagtggatctgggaaaagctaaaacccactctgctgccccaactcagtgccgtcatggtaaaagagacttgtagcgcaggttgtatctatcgtggcgaatag

SEQ ID NO: 3071 - DNA, 672 bp, Xenorhabdus bovienii
  Coding sequence Name=Xb4151_4152.C437.gene68.dna; Position on contig =37841..38512bp; Strand=-
atgatttacccaataaatgaaatttttcaaactttgcagggagaaggtgtgtttaccggtgtgccttcagttttcatccgcttacagggatgtccggtagggtgcagttggtgtgataccaaacatacgtgggaaaaagaggctgataaacaacagcctatggaaaacatcctcgtgaaatcgcaggatagtgatacatggggagcagccactgcaagacaaattattaacttattcatccgtcagggttatacggcgcgtcatatcgtcgttaccggaggtgaaccgtgcctgtataatctgcgtcccttgaccgaaacattggaaagtgaaggctatcagtgtcagatagaaaccagtggtacacatgcgatccagtgttctgaaaaaacgtgggtcacagtttcaccgaaagtaaaaatgcgtggcggatatcaggtattacctgaagcgatgaaccgtgcaaatgaaatcaagcacccagtcgggcgggagcgcgatattgaagcattggatgaactgctgacgatgctcgatgaaaaggcagatccggttattgccttacagcccatcagtcagaaagaagaagcaacccgcctgtgtattgaaacttgtattgcccgtaactggcgtttttcgatgcagacacacaaatacttaaatatcgcctga

SEQ ID NO: 3072 - DNA, 150 bp, Xenorhabdus bovienii
  Coding sequence Name=Xb4151_4152.C437.gene69.dna; Position on contig =38509..38658bp; Strand=-
atgccagagagtatttcaggcatacaatgctctgtctggcgtcaaataccagcaaaagcaaccccgtacaataccataaagatggatgttcgcgggatagatatctgtaataatacccggcagtttagtaaaaccagagtttttttatga

SEQ ID NO: 3073 - DNA, 1389 bp, Xenorhabdus bovienii
  Coding sequence Name=Xb4151_4152.C437.gene70.dna; Position on contig =38681..40069bp; Strand=+
atgcaacataatgaaaatcagcttaaacagggtctgagcgtacggcatattcgctttatggctttaggctctgcaataggcactgggctgttttatggctcggcagcggcgattcagcatgctggccctgctgtattgctggcctatttaatcggtggtgctgctgtatttatggtgatgagagcacttggcgaaatggccgttcaccatcccgtttccggttctttttcacaatatgccagccattatctgggaccattggccggctttctgaccggttggatttatgttcttgaaatgctgtttgtttgtctggctgatatcaccgcattcggcatgtatatgaggctatggttcccacacgtcgatcaatggatttgggtgctgggtattgtatgttttatcggtgccctaaatctgtgccatgtaaaaatattcggtgaaatggagttctggctttcgatcgtcaaagttaccgccatcattgctatgattatcggcggcatcataattatgatctacggttttggtcaatcaactgaacatgctaccggtatttccaatttatgggagcatggcggcttcatgccaaatggtatcagtggggtggttgcctcattcgcaattgttatgttcgcttttggtggcatagaagtgatcggtattactgccagtgaagcgaaaaacccagaaaaaacgattcctaaagcaatcaatgccgttccattccgtattttgatcttctatgtcctgacgttgtgtattctaatgtgcatctatccatggaatcagattgatcagaatgcaagcccatttgtacagattttttccaatctgggaattaattcagcagcgaatattttaaatgtcgtcgtgattactgccgctatttcagccatcaacagcgatatttttggtgcaggaaggatgatgtacggcatggctcaggaaagacaggctcctgaagcattcaagaaactgacccgtaatggtgtaccgtggatgaccgtgcttgtcatgactatagttctattacttggcgtatggctgaatttcttgatccctaatgatatttttatccttatcgcgtctgttgcaacatttgcaaccgtctgggtatggctgatgattttaatttctcacgttgccatgcgccgtcaaatgagtgcaaaagacatcaagtcattgaaatttcccgttccaatgtggccaattgcgcctgcaattacgatcgttttcatggtcggtgtcatcatgttgctcggctattttgagcaaacaagggatgctctgtatgttgggataggttgggtgttagtcctcacactggcttattctttctgtgtgaagaagaaattatcaaaaaatcatctttctactaaccaataa

SEQ ID NO: 3074 - DNA, 831 bp, Xenorhabdus bovienii
  Coding sequence Name=Xb4151_4152.C437.gene71.dna; Position on contig =40138..40968bp; Strand=-
ttggttagaagctatgcaagaaggaggcgggctaagaaaaactcagccccaaaaaactatgcaatacggtatgttgcaaatcagccagtagagcgggttttacctacatctaaacgattacttgaagacaattcattaccacatgggcaaccgttacctgctttcaatcatgagctttgtgttgccatctggaatatttacaaacaacagcgtccatcatggcaagaagttttgggttctttgattgagagcagccagcttattttattgcaggaagcgcaaacaacgcctgatttactgaaattcgttacagtcagtgggttagttgcagatcaagtccctgcattttccatccctcagcatccatctggcgtaatgaccttagcatcttcttctcccgtttattgctacccactacgtgaaaaagagccgatactgcgactctcaaaatcctcactgattacgatttatccattaccagataatcgtcaattgatggtaataaacgtgcatgcgatcaattttagctttggtgttgacgtttacagtcggcaattgaataacattggtattcatatcaatttgcatcatggacccgtgatttttgctggggattttaatgcgtggagccatcggcggttgagagtattggtgcgttttgctcagcgtatgcaattgaaagaagtctattttaatgatgatcaccgaacgattgtttttggcaaaccgttagattttgttttttatcgtgaattgaaagttttaaatgcggcagttttaacgacaatggcttctgatcacaatccattaattgttaatttctctttataa

SEQ ID NO: 3075 - DNA, 189 bp, Xenorhabdus bovienii
  Coding sequence Name=Xb4151_4152.C437.gene72.dna; Position on contig =41013..41201bp; Strand=+
atgtcaattattgatttcaatctattacgtacaaaaaggttctgtcgcattaacagagaaaatctgagtcaatgtggggttcgttgtattttatgcagcatcgaaacgagctctattcccgctaaaatcgtttgggcccggcgaaacgatttaaaacctaacatcggccgtatcaacgggataatgtaa

SEQ ID NO: 3076 - DNA, 138 bp, Xenorhabdus bovienii
  Coding sequence Name=Xb4151_4152.C437.gene73.dna; Position on contig =41185..41322bp; Strand=-
gtgttttaccgacttttgctcgtttttctaaaagaacgtagcaaaagtcttacattcattgaaaaatatatgaccttttgcagagcaaaccgtgtatttaattcgaaaagccttcaaacgtttacattatcccgttga

SEQ ID NO: 3077 - DNA, 606 bp, Xenorhabdus bovienii
  Coding sequence Name=Xb4151_4152.C437.gene74.dna; Position on contig =41323..41928bp; Strand=-
atggaaaagttttatcagttaaaaattacgcttaccgaaaccgaaccggttatatggcgtcgttttgttgttccatccaatatttcattggatcgtttgcacgatgtgatacaagctgtgatgggttgggaagacagccacttacacgagttcatttttagcgccaaacgctttaccgaaatgccggaagaaatggagaatggtcaggaagaaggaaaattcaaactggattcgctaatcaagcgcaaaggcagcaagtttgcttatctttatgattttggtgacagctgggagcatgagattgtactggaaaacagtaactattctcccgaaaaattgccgatgcctattttttgcgttgaaggtgaacaagcctgcccaccagaagattccggtggggtatatggctatatggaactgcttaacatccttaaagatcccactcatgaagactatcaggacatgtttgaatgggttaatggcgatgctgatatttcccctgatgacgttttttcccctgagaaattcgatgtagaagaaattaataataagctggccttatattatcgctggtcaagagatcgttatttatcgatgtttgagtga

SEQ ID NO: 3078 - DNA, 93 bp, Xenorhabdus bovienii
  Coding sequence Name=Xb4151_4152.C437.gene75.dna; Position on contig =42117..42209bp; Strand=+
atgaatatattggcagaaaaaagggatattacggcgacagcagtattacgttttgtgttggtgacgtgccttctcatgccaaacgtttggtga

SEQ ID NO: 3079 - DNA, 288 bp, Xenorhabdus bovienii
  Coding sequence Name=Xb4151_4152.C437.gene76.dna; Position on contig =42227..42514bp; Strand=-
atgatccttggtcattactgtccagccatccttatgctgttttatctcctttttcccctgattaatcattggctcaatcgtaaacgtcataccttcttccagcacaactccctctcccgcactgccataatgcagaacttgaggctcctcatgcatattacggccgatgccatgaccacagtattcacgcacaacactgtaattattcgcctcagcatgttgctgtatcgtatgaccgatatcccccaaggtgataccaggcttcacaagtttaatagctttatatag

SEQ ID NO: 3080 - DNA, 207 bp, Xenorhabdus bovienii
  Coding sequence Name=Xb4151_4152.C437.gene77.dna; Position on contig =42425..42631bp; Strand=+
atgacgtttacgattgagccaatgattaatcaggggaaaaaggagataaaacagcataaggatggctggacagtaatgaccaaggatcatcgattatcagctcaatttgaacatactattttagttacccgtaatggtttcaaggtgttgactctgcgagacgaagaacgtgaaatttttaaacgctatatgagcatcaatcattaa

SEQ ID NO: 3081 - DNA, 1569 bp, Xenorhabdus bovienii
  Coding sequence Name=Xb4151_4152.C437.gene78.dna; Position on contig =42962..44530bp; Strand=+
atgtttttttttgataaaaacaagaaggcatcttgttttgtttcgctattttttcttatttttcttatacataaatgctttgggtatcaattaaagctgatatatgtcttcagtgcctttgctttattcttatttttggcggcgctcagtaaacgtgtatatctctttttgattactttcttttctcttgtggcaatactgtacgcgccagttggcctgaattacggttttccagatattaatgcggtaggctcactgctttacacaaaccagaatgaaacgctggaatatattagtggatttcctatttcaacttacttaaccgtaataggtatttttgccttgatgatgttctcattcaggctaaatgtaaacttatcaggaaaaaataaaaaatggttattttttctgttcttcattcctgcattttggtcaccagccaaaggatatattaaatctggttttgaaaacggtacggagcttttgaacaccagtttacctgaagtccgctttttcagtgatgcttaccagagttatactaaagtaatgtctgaaaatagccgtttcgccaaaattatcaaacttcaggatgattggcagcccgtagtcaaagaagaaaaatacgacacttatattatggttattggtgaaagtgtccgaaaagattttctgggcgcttatggtttccccgctaaaaatacaccgtggctggataatgcgaatgcaaccctgtttacccactatatttctgccgcaccatcaacccagctatcactgacaaattctctggcaatccggcagtcgaatgaggttaatttgaataacagtattgtcacgctggcaaataaagcggggtttgaaacttactggctctctaatcaagggatgaagggagggtttgattctcctgtggcaatgattggccaacaggctaaacatccgatgttcttgaaagaaggtagttcagatgacaggagctatatgccggatgaaaatttattaccttatgtccgtaatgcactgaagaatgatcagcatgataaaaagaaaaaactggttatcatccatttgatgggttcgcatccgcagccctgtgccagaacgaataaccaatacagtactgatttccattccaaaaatatctcatgctatgtacagagtatccataataccgatagcctgctggctgaaatagaaaacatcgccaatcaaaaccagttgaactggacaatgctctattttgccgatcatggattgtcttttgtacataaaggaacggataacgagaacttgactcatggcgataaaaatcaacagaattatcaagttccttttattattacctcttatgactattctgccagaaataaaatagatgcccagcgcagcggcctgcatcttttgcccatgttatctctatggttagggattgaagagcctcggctggtctcagagtgtgactggttttccaatcaaaaatgccagaatcaacataatgtcatttcatttgagggtaagcatatggactttaatcgcctgcataacgacgccattcattttggtttataa

SEQ ID NO: 3082 - DNA, 108 bp, Xenorhabdus bovienii
  Coding sequence Name=Xb4151_4152.C437.gene79.dna; Position on contig =44554..44661bp; Strand=-
atgaaactttcacccacgatatcaggaggatctgagccaacggctgaataccgtattaaacggtcagaatcctctaatcagtggttcgggtacgggtgcaatgggtga

SEQ ID NO: 3083 - DNA, 2154 bp, Xenorhabdus bovienii
  Coding sequence Name=Xb4151_4152.C437.gene80.dna; Position on contig =44785..46938bp; Strand=+
atgaacaataataaatttttaaaacatatcccctggatgatattggggataattggcgcattctgccttggcgtcgttgcgctgcgccggggagaacatgttagtgccttatggataatcgttgcttccgtggcggtttatcttgtggcttatcgatattacagtctttatatcgccactaaggtgatgaagctggatgcgacacgggcaacccctgcggtcgtcaataatgatggattgaactacgtaccgactaacaaaaatgtcctgtttggccatcactttgcggccattgcgggagcggggccattggtagggccagtattggcggcacaggtcggttatctgccgggtactttgtggttgctggcaggggttgtgcttgctggggcggtacaagattttatggtgctgttcatctcttcccgccgcaatggggcatcactgggtgaaatcatcaaagaagaaatgggacaggttccggggacgattgccctgtttggttgcttcttgatcatgattatcattctggcggtgctggctctgatcgtcgtaaaagcactggcggaaagtccgtggggcgtatttaccgtttgctccactgtaccgattgcgcttttcatggggatctacatgcgatatatccgtccggggcgtgtgggtgaagtctctgtgatcggggttctcatgctgattgctgtaatctggtttgggggtgttgttgcggctgatccttactgggggcctgcactgacctttaaagataccactatcacttacacactgattggatatgcgtttgtttccgcattactgccagtctggctgattttggctccacgtgattatctggctaccttcctgaaaatcggggtgatcatcggtcttgcgattgggatcgtgatcctgaatcctgatttgaaaatgccggccgtgacgcagttcgttgatggtaccgggccagtctggaaaggcacactgttcccattcctgttcattactattgcttgtggtgcggtatctggcttccatgcactgatcgcttccggtactactcctaaattgctggcaaacgaaaaagatgcccgttttattggttatggtgcgatgttgatggaatcatttgttgcgatcatggcgctggttgctgcatccattattgaaccgggcctgtattttgccatgaacacgccaccagcagctttgggtattactatgcctaatctgcataatctgggaacggcagaagcgccgatgatcatggcatcactgcaagaggtgacagcccatgcagccgcgactgtaagctcatggggctttgttatttcacctgagcaaattctgcaaacggcgaaagacattggtgagccatcagtgttgaaccgtgcggggggagcaccaacattggcggtgggaattgcttacgtattccaccagattattccagcggcaaacatgggattttggtatcacttcggcattctgtttgaagcgttattcattctgactgcactggatgcaggtacgcgctccggtcgttttatgttgcaggatttactggggaattttgttccattcctgaaaaaaaccgattctctggttgccggtatcatcggtacagcgggctgtgtcggcttatggggctatctgctgtatcaaggtgtggttgatccgttgggtggcgttaagagcctgtggccgctgtttgggatttcgaaccagatgctggcagcggctgcgctggtactggggactgtcgtactgattaaaatgaaacgcgccaagtacatctgggtgactgttattcctgcaatctggttgctgatctgtacgacatgggcactggggctgaaattattcagcgacgacccacgactggaaggtttcttcttcctggcgaaagaatataaacagcgtatcgctgaaggcggggcagaactgacagcccagcaaatcagtaatatgaatcacattgtcgtgaataactataccaatgcgggcttaagtatcctgttccttgtggtggtctatagcatcattatctatggtatcaaaaccgcgataaaagcgagtaaaaacccagaacgtacagataacgaaacgccttatgttcctgttcctgaaggtggggtaaaagtttcttctacgcactga

SEQ ID NO: 3084 - DNA, 204 bp, Xenorhabdus bovienii
  Coding sequence Name=Xb4151_4152.C437.gene81.dna; Position on contig =47058..47261bp; Strand=+
atgtttggtaatcttggcaaggcgggtaaatatttggggcaggctgcacgcatgttggtgggagttcctgactatgacacttatgtccagcacatgaaggaaaatcaccctgataaaccttacatgacctatgaagaatttttccgtgagcgtcagaatgcgcgctatggtggtgatggcaaaggcggcatgcgctgctgttag

SEQ ID NO: 3085 - DNA, 1089 bp, Xenorhabdus bovienii
  Coding sequence Name=Xb4151_4152.C437.gene82.dna; Position on contig =47188..48276bp; Strand=+
atgaagaatttttccgtgagcgtcagaatgcgcgctatggtggtgatggcaaaggcggcatgcgctgctgttagtgttttagtgagcagaagatcaaagagaagaaaatcgttgtcagtgaaacaggaaacgaaaatgaaagctatatccgtcacaatcctggcaggttttttgggttcgggcaaaacgacgttattgcgtcacatcctcaaggccgaacatggttataaaattgccgtcatcgaaaatgagtttggtgaagttcccattgaccatgaattaattggggatagggcaacccagattaagacattaagtaacggctgcatctgttgtagtcgctcaagtgagcttgaagatgccttgctggatttactggacggaattgacaaagggcagatcgatttcgaccgtctgattattgaatgtaccggtatggcagatcccggtcctattacgcagacctttttttcccatgaaattctgtgccagcgctttttactggatgggattatcacactggtggatgcgatgcatgctgatcagcagcttaatcgcttttccattgcgcagtcacaggtgggttatgccgatagaattttgctgacgaaaacagatgttgcccctgagcatgatgccctgtttgaacgtttacagcgaattaatgccaaggctcccattcataaagtggttcacggtgaggctgatttaagtttgctgtttgatattgaaggcttcatgctaaatgataagctgacggtttcgaactcggtattccggtttattcccaaacaacagaataccatccaatcgattgtcattaacttgacgcatccggttgggttggccgaggtttctgacttaatggaagagttactgctgagtttcgctgacaatctgctgcgttacaaaggtattctcgctattaaagaagagccacgccgattgttgtttcagggagtacaacgcctatatagcgcagactgggatagagcttggcacgataacgaggaacgtcttagcgtgctggtttttatcggcatggatttacctgaacagaaaatccgtgaaaagtttgcagaattgtag

SEQ ID NO: 3086 - DNA, 159 bp, Xenorhabdus bovienii
  Coding sequence Name=Xb4151_4152.C437.gene83.dna; Position on contig =48277..48435bp; Strand=+
ttgatcatattttattctttattgagcagtgaaatagtttgtataaaaatccgctgctcatatttaaatagaaaattatattatatatgcactcttttagtcttaattccttgtaaaaagataagtaatattttaacaaaaataagacaacaagaataa

SEQ ID NO: 3087 - DNA, 552 bp, Xenorhabdus bovienii
  Coding sequence Name=Xb4151_4152.C437.gene84.dna; Position on contig =48602..49153bp; Strand=-
atgaagcaacgtaaatttttaacccgatacgaaatagacgcaattttggagcaaacaaaacaagggcgtcatgcagaacgggattactgcatgctattaatgtgttttattcacgggtttagggttagtgaattgtgtaatttatgtttatccgacctcgatttaaattcatcaattattcatatcaggcggttaaaaggtgggctatcaacaacacatcctctgattccaaaagaaattgaagcacttaaaaaatggcttgatatccgccagaaatggcgggatgctgatgcgccgtgggtgtttctttcccaaaaatccggctctatttcacgccagcaagtttatgcgttattaaagcgctatgggaagcaggcgtctgtcagtgtttctccacatccgcatatgttaaggcatgcctgcggctacgcactggcggatcttggccgtgatacacgtctgattcaagattatctcgggcatcgtaatatttcacatacggtgatttacactgccagtaatgtgaaacgtttttccagaatttgggagtag

SEQ ID NO: 3088 - DNA, 150 bp, Xenorhabdus bovienii
  Coding sequence Name=Xb4151_4152.C437.gene85.dna; Position on contig =49241..49390bp; Strand=-
ttgccccattctgtacatcagggtcacctaacacgtatttatacaattacaatcaatattttcattaaagataagacgaatagaagccgcaaattttttctttactgttttccaattagattaatctggtattttgctaatcatgtttaa

SEQ ID NO: 3089 - DNA, 147 bp, Xenorhabdus bovienii
  Coding sequence Name=Xb4151_4152.C437.gene86.dna; Position on contig =49575..49721bp; Strand=+
atgatcaaaaaacaccctaatttcatttttaccaaccagttttcaatactaaattttgtttttttattatatttggtttttaattctaatctttatggaggtaatctaaagtcaacgtggcactcagatgctattaatagagagtga

SEQ ID NO: 3090 - DNA, 168 bp, Xenorhabdus bovienii
  Coding sequence Name=Xb4151_4152.C437.gene87.dna; Position on contig =49978..50145bp; Strand=+
gtgtttgcttattcaggcaacccttgccttatacaccataatttcgatgatttatgtatcggtttgttgcatcgcatgatgagcgagtggacaaaactgatcgtaattcacctttctcacgttaagaaaaggctagaaaaggagaaatacataacaaaatcccggtga

SEQ ID NO: 3091 - DNA, 1326 bp, Xenorhabdus bovienii
  Coding sequence Name=Xb4151_4152.C437.gene88.dna; Position on contig =50099..51424bp; Strand=-
atgaaaacagcaacaaaaaacaatgaggttacgacccatacctctccggcagccaagcgcgccaacatgactgaagttgaatggaaaaaagccataaaattcgacagtaccgacaccggttggatcatcatgagtattggtatggcaatcggtgccggaattgttttcctgcctgttcaggtcggtttgatgggattatgggttttcctgttatcttccatcattggctatcccgccatgtatctttttcagcgattgttcatcaataccctcgcggaatcaccagaatgtaaagattatcccagcgtgatcagtggctatctcggcaaaaactggggcattttgttaggtattctctactttatcatgctggtgatctggatgtttgtgtactcgactgccattaccaacgatagcgcctcttatctgcacacatttggtattaccagtgagctattatccaaaaatccgttttatgggctgattttgatttgtattctggtggcgatttcctcccgtggagaacagtggctgttcaaaatttccagcctgatggtgctgacaaaattatttgttgtcgccgccttgggtctttcaatgattgggatgtggcatctgtacaatatcggcgtgctgccacctttcgctatactgatcaaaaaagccattattacgttaccttttacactcacttccatcctgtttatccagacgctaagtccaatggtgatttcttaccgtaaccaccagcacaatcgtgaagttgcgcgctataaaacactccgagccatgaatgtggcgtttggcgtcctgttttgtacggtatttttctatgccatctcttttactttggcaatgggtcacgatgaagccgtcaaagcctatgaacagaatatttctgcactggctatcgctgcacaattcttccctgacggctgggtagttacggtcagtgttattctcaacatttttgcggtaatgactgccttctttggtgtgtatctcgggtttcgcgaagccagtcagggaattgctatgaatattctcgggcgcctgatgcccactgaaaagatcaatgaaaaatgggtgcaaaaaggcattatgatttttgccatcttattggcatggggtgccattatcctgaatgcaccagtcttaagcttcacttccctctgtagcccaatatttggcatcgtcggttgtttgatcccctcttatctggtctacaaagtacctagcctccaccattataaaagcgcctcgctaatcctgattatcttcaccgggattttgttatgtatttctccttttctagccttttcttaa

SEQ ID NO: 3092 - DNA, 150 bp, Xenorhabdus bovienii
  Coding sequence Name=Xb4151_4152.C437.gene89.dna; Position on contig =51357..51506bp; Strand=+
atgttggcgcgcttggctgccggagaggtatgggtcgtaacctcattgttttttgttgctgttttcataatagctctcgcttacatctttggtgttgtaataggtattgaacaggtacagaaagaaacgcatcacataaacacaaaataa

SEQ ID NO: 3093 - DNA, 132 bp, Xenorhabdus bovienii
  Coding sequence Name=Xb4151_4152.C437.gene90.dna; Position on contig =51665..51796bp; Strand=+
ttggtgatattaacaattcaaacaattagagagaaaagttgtgcgctgtatcacgtctgctcctgctcaaaacaccctgtcagtattaaatcctttttattgttaatattatggggtagttcagcatgttaa

SEQ ID NO: 3094 - DNA, 1047 bp, Xenorhabdus bovienii
  Coding sequence Name=Xb4151_4152.C437.gene91.dna; Position on contig =52262..53308bp; Strand=+
atgaaaattatcggaatttcaggtttattaccgtcaagatgcgtaactaatggtgatgtacttaatttaatagagcagcattcaaaaaaaactttccagggtgattttcccaaaacactaagaacaattcaacggttactggaaaaaacaggacttgaaagcagatattggctgggtgaaggtgaaaaaccgatgcgtctgatggaagaagcttttgaacaggctttgagacaggcgaatatcaaaaaatctgaaattgatctattgatttaccctaacgtaactcgtggtttcactgagcctgcaaacagtacttttattgcaaaagctttaggattgaattgccggaattatgatgttcttgatgcttgtaatggttgggtaacggcaatggatattattaatggtaaaatgaaagcgggtgaaatacgttatgcggctattattaatatggaatttggcatgtctgaaggcggtccattcagaaagaatttttctttgaattctgcttctgaattggcctataaatatcctagttttacaataggtgaagcggcttctgtaaccatattgagtaatgaagatacagataattttaaatttgattatatcagcagacccgatttatgtgacatatgtaatatctctttacctaattgggaattgttttgcaatgatagtgatattgagcttatttcccctctgggaggtaaatatcagttcaattcatatgccgcagcactccatgaatatgcaggagaagaagtgcccaaggtattcaaacagcataatattgccagtagtgatatccataagattttcattcatacaggtgcaccaaatatgtgggatggctttggtaaagccgtcgatgccgccgataaaatgcacaatatcggccagaaaaccggtaacattattactgcttctattccttttggcatcgctgatgctcttgggaaagatcaggtcgaaagagataaactttgcatgggatgggcaggcagtggtggaatggtattttccgcgatgtcgtttaaattataa

SEQ ID NO: 3095 - DNA, 93 bp, Xenorhabdus bovienii
  Coding sequence Name=Xb4151_4152.C437.gene92.dna; Position on contig =53449..53541bp; Strand=+
atgatttcagttggtctggtgaataaaaatagagtctttttgattgtgttagcaggggaatatttctccttaaatgacatagacagtcaatga

SEQ ID NO: 3096 - DNA, 672 bp, Xenorhabdus bovienii
  Coding sequence Name=Xb4151_4152.C437.gene93.dna; Position on contig =53842..54513bp; Strand=+
atgaaaagtaaattcactctggcttcactttgtttggcttctcttatgctggcaggatgtgcgacagaatcatcttcaactcttcaggttcaaaaagtctcttcgtataacactatttatcaaggtatccgcagtcctatcgctgtgggtaaatttgaaaatcgctcaagctatcagaatggcattttctctgacggtattgatcgtttaggcaatcaatcaaaaacaacgctggtgacacatttacagcagaccggccgcttcaatgtgttggagcgtaccaacatggcagaattgcaaacggaagccggtttgcagggtaaagcccagaagctgaaaggggctaactatgtcattacgggtgctgtgactgaatttggccgtaaggaagtgggtgaccatcaattatggggcattttgggacgtggtaaatcacaggttgcctatgcaaaagtgatgcttaatgttgttaatgttgaaacttctgaagttatcttctcctcagcaggggcaggagaatataaattatccagccgtgaaattattggatttggcggcgcatccggttacgactcaactctgaatggcaaggtgttggatttggcgattcgtgaagcagtcaacgaccttgtggcaggtattgaaagtggcgcatggaagccagttaactaa

SEQ ID NO: 3097 - DNA, 357 bp, Xenorhabdus bovienii
  Coding sequence Name=Xb4151_4152.C437.gene94.dna; Position on contig =54535..54891bp; Strand=+
atgtttttgatgaaaaagacggggatattgttagggatattactgttggcgggctgtgtcaacgcgccgaagaccatttacgaatggggtgattaccagccaacagtttatcaatactatcaacaggacaaaatggggctacaggagcagattcaagcgttgcagaaggtgattgaattagccaaagcaaaagataagtcagttcctcctggcctgcatgctcaaatggggttgctttacagtcaaacaggcaaaattgatgaggcctttcagcagtttgtcatagagaaaagcttatttcctgaagcggcagcttatatggatttcctgttgagcaaaagtaagggagtgaaataa

SEQ ID NO: 3098 - DNA, 660 bp, Xenorhabdus bovienii
  Coding sequence Name=Xb4151_4152.C437.gene95.dna; Position on contig =54891..55550bp; Strand=+
atgaaccgtttttggggcgcgattggtgctttattattgctgacactgaccggatgtgttcaacaaaaaccttatgattatacggctctacgggaaagtaagcctaaatccattctggtactgcccgcagtgaacaaatccgtggaaatacaagctggaggcagcctgatttctcaggtgacttacccactggctgaatctggctattacgtttttccggttgcggtggttgaagaaacattccgacagaatggtgtgacagaagcgcaggatgtccaaaatatcagctataagaagctgcatgatatttttggtgcagatgctgcgctttatctggatatcacgcaatacggtacacaatatctagtcattagcagcgatactcgtgtcagcgcagcagcccgtttagttgatctacgcagtggcaagcaactgtggcgtggtacggcgacagcctcttcaacagaaaatgataattactccagtggtgggctggtaggaatgttagtctctgcggctatttctcaaatcgcgaatacgatcactgacagaggccatgatattgcaggcattgccagtcatcgtctgttaagcgcgggtcaatatggccgattgctgtatgggccgcgttcagaacactacggtaaagagaaattataa

SEQ ID NO: 3099 - DNA, 1341 bp, Xenorhabdus bovienii
  Coding sequence Name=Xb4151_4152.C437.gene96.dna; Position on contig =55628..56968bp; Strand=-
atgcatcaatctgatgttgttgatcgctcgcttttctcactgagctggccgatcttcattgatatttttcttcacatggcgacgttattaattaatacctatatggtcagccatatttcttcggcttatctggctgccatggggggaggcaatcttgttttcgatctctgcattacgattttcaatttcatcagtgtaggttgcagtgttgtaatcgcgcagtatcttggttcaggaaagcgggataaagccagccaagctattcatatctccattgctttcaatttcgtactgggtcttggttgtgcgctggtcacggttttcttcggttataaaatcctgcacatcatgaatttgcccgaaaacctgatggaagatgggagcgcttatctgcgggttctgggtatctgtctgattccagaagctatttctatcattctcgccgcctgtctgcgggtttatggtaagtcgaaaactgccatgtatgtcaccctgattgccaatctgctcaccattgtcggcaatatggttgttctgtatgggttctttggattacctaaatatgggctggaaggcgtggcgtggtctaccgtgtttggccgtactgtcgcgattattttactcagtgggctgctgttttatggcttgaagattaagttcaaccccagattgctcatacactggtcgaaaaatatgctgggcaaaatcctgcatatcggcttgcctgctgccggtgaaaatctggtgtggatactgcaatatatggccgcgcaggcatttatcggtctgatgggggaaacttctctggccgcacaaaccatgtatttccagttatcgctgttcattatgttgttcggcatttccatcagtattggcaatgaaattatggttgggcaccttgtgggcgcaaaacgcttcgaagatgcctatatccgcggattaaatagcctgaaaatcggggttatcgttacgtctggtgtcgtactggttttctggatactgcgggagccactcctcaacatgatgacggaagataaaaagattattgaacttctgctgcctctgttcctactatcggtatttctggagccagggcgcaccttcaatattgtgatggtcaatgccctgcgcgcttccggtgacgcccgcttcccgctctacactgcactgattttcatgtggtgtatttccattcctgtcggctattttctggggatcgtgatgaatatgggcattctggggatctggattggcttcttctgcgatgaatgggtgcgagggcttgtgaacgcttggcgctggaagtccaaaagatggcaatccaagcgattggatatttga

SEQ ID NO: 3100 - DNA, 120 bp, Xenorhabdus bovienii
  Coding sequence Name=Xb4151_4152.C437.gene97.dna; Position on contig =57014..57133bp; Strand=+
gtgacatacctagaaagtgtaggtgattctacaaggtttattggtcagttggtaggcggattacgttatttgcaccgatggcacagggaaggactggggataaaaaatctcctgcggtag

SEQ ID NO: 3101 - DNA, 147 bp, Xenorhabdus bovienii
  Coding sequence Name=Xb4151_4152.C437.gene98.dna; Position on contig =57079..57225bp; Strand=-
gtgaagagtactatctggaaattcatctggttggcatgtttgttctggaagaggaaatttagagttagtctggcgtcagactcctgcggtttctaccgcaggagattttttatccccagtccttccctgtgccatcggtgcaaataa

SEQ ID NO: 3102 - DNA, 1050 bp, Xenorhabdus bovienii
  Coding sequence Name=Xb4151_4152.C437.gene99.dna; Position on contig =57164..58213bp; Strand=-
atgacacaacaacattttgtcgagctaaaaaatgtgactaaacggttcggtagcaacgccgtgatcgactccctgaacttatccattcctcaagggcatatggtaactctgctggggccatcaggatgcggtaaaaccaccgtactacgtttagttgctggtttggaaaagcccagcgaaggaaatattttcattgatagtgaggatgtgacagaacgttccatccagcaacgggatatttgtatggtattccagtcttatgcactttttcctcatctgtctttgggcgaaaacatcggttacgggctgaaaatgcaggggcggccaaaagcagaaattcgcgagcaagtcagggaagcgctggaattggttgatttagccggatttgaagatcgctatgttgaccagatctctggtggacaacagcagcgggtcgccttggctcgtgcgttgatcctcaagcctaaagttctgctattcgatgagccattgagcaaccttgatgccaacctgcgccgcaatatgcgagagaaaatccgcgaattacagcaacgctttaatatcacttccctctacgtgactcacgaccaaagtgaagcctttgccgtttctgataccgtgctggtgatgaataaaggcaaaattatgcagattggctcgccacaaacactctatcgccatccagcctcacgatttatggcaagttttatgggggacgccaatatttttccggccacattagggttggattatgtggaaatcttccgatatcggttgccccgacctgcgcattttacgacaacccgctcttccattacggtaggcattcgccctgaagccatgactctgaaccaacagggaagtgaaagccaacgttgcaaagtcagttatgtggcctatatgggagcgcaatatgaggtgacggttgattggcatgggcaaaccctgttgttacagatcaatgccacacaactgcaaccgcgtgtcggtgaagagtactatctggaaattcatctggttggcatgtttgttctggaagaggaaatttag

SEQ ID NO: 3103 - DNA, 2079 bp, Xenorhabdus bovienii
  Coding sequence Name=Xb4151_4152.C437.gene100.dna; Position on contig= 58229..60307bp; Strand=-
atgtctcatacccttaccttgcccaagaagcagggtcgggatgccgttttctggtggattatgctggcatggctatcatttgctctgctgccatcatggagtctggattacggccttctcgagtcgacacaagaagaaatactggcagcttatagttggcatagtgtcaatagcagcatattgtggttcctgctgccatccctattgttattacgtccactgactcccgccagtcgcaaccaacgtcagcgtcactattttgatgccgggtatgccctgttatgtacgctgttcatcatcactagtgctacattggccggacgtgggctaggttacgctactatcgtgctgtttattgcattgggagccatcatcactctagccctgacccgtctggaatggctcggcggtgatagttttgtgattggttcactggtagcgatcaccgcgctggttggcgtatttattctgttccccagtatcgctatctttatccctatgtttaaggatgaagctgatcaattcgcgccatttgcctttatttctatattggggcagccccacatcattaaagttatggccaactcaattctgctttccgttgctgtgggtgtgggatgtactgtttttgggctgattctggccatttataccgccagaatcgccaaacgttccgccatcatcggtcgtattttttctattttaccgattgtcacaccaccttttgtcgttggtttaggtgtaacactgatgatgggacgctcaggttatatcaccgagtttatggcaacgtggtttggtctgacgaataccaactggttatacggttttacagggatttggatcgcccaagtgctggcatttaccccgatggccttcatgattctggatggtgccatcaagacgatccacccatcactggaagaagcctcctataccctgcgagccaatcgctatcaaacgtttttccatgtctttcttcctctgctgaaacccgctctggccaatgctttcctgattgtagttgttcaatcactggcagatttcagtaatccactggtattgggcggtaacttcgatgtactggcaacccagatttatttttatattacgggttcacaacttgattatcagtctgccagtacgcttggtgcatcattattagtcttctcgctattggttttctgtatccagtatatgtggatcggcaaacgttcttacgtcacggtttccggtaaatcataccgtggtgatgtgcagccattacctgtttctctggtatggggcgtttgtactactctgtttatctgggtgactttcaatattctgttgtatggcagtattttctacggcagtttcacggtgaactggggcgtagattacacactaacactggataatttcatcaatctatttggtcagggaatgagtgacggtgcatggccttcactgctggatacgctgctttatgcgggtattgccgctcccattacggctattttgggtctgttaattgcctatgtcgtagtacgacaagaattccgaggcaaaaaagccattgaatttacaaccatgctctgttttgccgttcccggtacggtagctggcgtgtcctatatactggccttcaatgatgctccattttacctcactggcacagcggtgattattatcgtttccatgacaatgcggaacgtccccgttggcattcgggcgggtatcgccggacttgggcaaattgataaatcgctggatgaagcctctctcagtctgcgggcaggttcgatgagaacaatctttcacattttgctgccgctcttacgccccgccattttatccgcgctgatttacagttttgtccgtgccattactaccgtcagcgccatcgtatttttagtgacaccagacacccgcgtggcaacggcctatattctgaaccgcgttgaagatggtgaatatggtctggctatcgcttatggctcgattctgatcgtcgtcatgctggcggtgattttcctgtttgactatttggttggcgaagcgcgaatttcccgttcgaaagccaaaaacacccagtaa

SEQ ID NO: 3104 - DNA, 1032 bp, Xenorhabdus bovienii
  Coding sequence Name=Xb4151_4152.C437.gene101.dna; Position on contig= 60405..61436bp; Strand=-
atgaaattgacatctctctttactctcatcactatgggattaactgcgacggtgatcaccaataacgcacaggcggctggccgtttgaatgtctattgcaatgctaccaacgccatgtgcgaagcggaaacccgagctttcggtgaaaaatataatgtaaaaactaccttcgttcgcaatggctccggtagcacattggcaaaaatcgaggcagaaaaacgcaatccacaggcagatgtatggtacggcggtactctcgatccccattcccaggcgggtgaaatagatctcttacaaccttatcaatccccgaatttggcgcaaatcatgcctcaattccgtgatccggcgaaacgcaaaggcaactatacctctgcggtctatatgggcattctcggcgttggtgtaaataccgaacgcctgaaagagaaaaatctgcccgtgccaacctgctggaaagatctgatcaaaccggaatataaaggcgaaatccagatagctgatccgcaaagctcaggcacagcttacaccgcattagccaccttcgcccaattgtggggtgaagacaatgcgttcgattatctgaaaaaactcaatggtaatatttcacaatataccaaatccggcattgcaccagcacgtaacaccgcccgtggtgaaaccgccattggcattggcttcctgcatgattattcactggaagttgaaaatggcgcgccaatgaaactcattgctccctgtgaaggaacaggctatgaaatcggcggcgtcagtattatcaagaatgcgcgcaatctggataacgccaaattatttgtcgattgggtgctgtccaaagaagctcaagagttgagctggaagaagggaaaatcctatcagatcctgaccaataccaccgcagagtcttcacctacaacactgaaccctgctgaattaaacctcatcaattatgatatggataaatacggctccagccaagtacgcaaagaattgatcaacaaatgggtgattgaagtgaaaatgagtaaataa

SEQ ID NO: 3105 - DNA, 240 bp, Xenorhabdus bovienii
  Coding sequence Name=Xb4151_4152.C437.gene102.dna; Position on contig= 61408..61647bp; Strand=+
atgagagtaaagagagatgtcaatttcattaggatgatgtccttatattcggaattttttgttttgaatttttttaatgcgggtactaataagcctaattatttcttgttaaataagattgaattgttaattcaggtgaaagacatcatgaatagtaaaatctctttgtgcaaatttatagacaaaatttgtaatcgtgataacaaattaaaaatagttttgcatgatataatcacgtaa

SEQ ID NO: 3106 - DNA, 135 bp, Xenorhabdus bovienii
  Coding sequence Name=Xb4151_4152.C437.gene103.dna; Position on contig= 61724..61858bp; Strand=+
atggctgcaaaaaaaatatatgatatggcagagaatagagaatcacttgatcctgatggttggtttagtccttatctgaaaaacagaggaaattacgttttttctctgtttttcagatatcaattatatgattaa

SEQ ID NO: 3107 - DNA, 153 bp, Xenorhabdus bovienii
  Coding sequence Name=Xb4151_4152.C437.gene104.dna; Position on contig= 61851..62003bp; Strand=+
atgattaattttatttattctaatatcatcattaatccaagaataataagaataataccgggaatacatccgagaatgaatattcagataatattctataattctgtcacgcattctatggattttgaaaaagatattgaaaggggtcagtaa

SEQ ID NO: 3108 - DNA, 156 bp, Xenorhabdus bovienii
  Coding sequence Name=Xb4151_4152.C437.gene105.dna; Position on contig= 62021..62176bp; Strand=+
atgtcttttttattctgggaccaaaaacatgggcgaccatttttcgttttatcctgtcgtcagcataaaagaaccaacggggcggcttctttgactttacctacgaccattgctcatccctttcacagcagacaattacttcggtgccagatttaa

SEQ ID NO: 3109 - DNA, 141 bp, Xenorhabdus bovienii
  Coding sequence Name=Xb4151_4152.C437.gene106.dna; Position on contig= 62121..62261bp; Strand=-
atggacagcacgagtgatggggattggcctgaataccgtgcttcgtcatttaaaaaactcaaacccaaatcggtaacagaagccattaaatctggcaccgaagtaattgtctgctgtgaaagggatgagcaatggtcgtag

SEQ ID NO: 3110 - DNA, 117 bp, Xenorhabdus bovienii
  Coding sequence Name=Xb4151_4152.C437.gene107.dna; Position on contig= 62334..62450bp; Strand=-
atggcaaagattgatgtgacttgcccctcttgttgtgcagttaaagagatctatcgcaacgggtgttcacgttctggtcatcaacgttatttctgccaatactgccgtcattcctga

SEQ ID NO: 3111 - DNA, 150 bp, Xenorhabdus bovienii
  Coding sequence Name=Xb4151_4152.C437.gene108.dna; Position on contig= 62497..62646bp; Strand=+
atgtcacgacccaaaactaagttaagaatatattctccttttgaaatgggaatgctggatattgccgtagctgaaaatatctattctgatttgaaggatatatctggcgttacaatctcagattttcaccctttacccgtaatgagatga

SEQ ID NO: 3112 - DNA, 240 bp, Xenorhabdus bovienii
  Coding sequence Name=Xb4151_4152.C437.gene109.dna; Position on contig= 62667..62906bp; Strand=-
atgtttgatcatgcgctgaatagacggaatcattttcatcgcatcttcttcattggcgaggacacctgttacaaaatcattcaacatgtcgattacgataagtgctttcatctgtatgaccttcttttgactcttgtatgcttaaagggcaattggaaaaatactaccgagcctccatcatatgcgatatatcgtatattttatattaaaaaaaataatcctcttgatttaggatgttaa

SEQ ID NO: 3113 - DNA, 540 bp, Xenorhabdus bovienii
  Coding sequence Name=Xb4151_4152.C437.gene110.dna; Position on contig= 62796..63335bp; Strand=+
atgaaagcacttatcgtaatcgacatgttgaatgattttgtaacaggtgtcctcgccaatgaagaagatgcgatgaaaatgattccgtctattcagcgcatgatcaaacatgccagaaacaatcctgattggttggtggtctatgccaatgatgcccatcgtgcggatgatcgggaaatggaaatctggggaaaacatgccatggctggtacgtggggggcggatgtgattgatgagttggctccaatcggcatggagcgtgaaattgtttctcccaagcgattttataatgcgttcgacggaacggggctggaagatgttctcgcacaatatggcgtgactgaagtggtgctgacaggtcagcatatccattgctgtgtccaccatacggcttacggtgcatttattcgtggttatggcattacggtattatccgatgctgtttgtgcttttcccggtatcgatcaacaagctgcccttgattatctgaaaaccatctatggggctgaaattacgacaagcaaagcattcggagtatga

SEQ ID NO: 3114 - DNA, 348 bp, Xenorhabdus bovienii
  Coding sequence Name=Xb4151_4152.C437.gene111.dna; Position on contig= 63408..63755bp; Strand=-
atgcaaaaaattgctttactcacttacattctggttctgttcagtttcgctcaacccgcaaaagctctgtctgaggaagaggctgaaagtcttgctgatatgacagccgtctacatttatttgaaatatgattgtggctatagccagatcccagatcgtgagatcaggcgtgcagttatttattttgctcaacgtaataagtgggatctcaataactacaacagtcagttaatggaagaactgaatcagtccggttacaacgatctgaagggaatcaatctgccccaaaagacaaaatgtcaggcgcttgcccgcccctctctcagcttgctcgcttatgtaaaataa

SEQ ID NO: 3115 - DNA, 228 bp, Xenorhabdus bovienii
  Coding sequence Name=Xb4151_4152.C437.gene112.dna; Position on contig= 63814..64041bp; Strand=-
atgtttttatataagaaactgattttaaatgactatatttttattttcataccttatttcatcagaggtagtcatacgcattcatcttgtgtcataagaaaaatgtacatattgatgtacataaactacagtgagtggtcatgttggtttttgaggaaattaatatggctatcgctgattcatggctccgctctaccaattaaagttaagaaaataaagtttggctaa

SEQ ID NO: 3116 - DNA, 1920 bp, Xenorhabdus bovienii
  Coding sequence Name=Xb4151_4152.C437.gene113.dna; Position on contig= 64084..66003bp; Strand=-
atgaaggagactgccatgaatgataatatcgctcgtaaaatgcgacagacctacaatatcgcatactggggtggcggctattactatgtcaacgatctgggtaatgtcagtgtttgtccaaaccctgatttaccggaagctcaagttgaacttactgagctggtgaagaaagttcaggaagaaaaaaaacagctgcgcttgccctcattattttgtttccctcagattctgcaacatcgtctacgttctattaatgccgcgtttaaacgtgcacgtgaatcttatggttataagggcgattatttcctggtttatcccatcaaggttaatcaacagcgccgtgtgattgaatcgttggcaaatgcgggtgagcccatcgggctggaagcgggctccaaggctgaattgatggctgttctggctcatgctggcatgacacgtacggtcattgtctgtaatggctataaagatcgcgaatacattcgtctggcactgatcggtgaaaaactggggcacaaagtgtatctggttatcgaaaaaatgtctgaaattgcaatggtgctggaagaagctgaacgcctcagtgtgatccctcgtcttggtgtgcgggcgcgtttggcgtcgcaaggagcgggcaaatggcagtccagtggtggtgaaaaatccaagtttggtcttgcggcagcacaagtactgcaattggttgaaactctgcgctcagcaggaaagctgaatagtttgcagctgctgcatttccatctgggttctcaacttgccaatatccgtgatgtggcaaccggcgtacgtgaatctgcccgtttttatgtcgaactgcataaattgggtgtcaacatccaatgctttgatgttggtggtggattaggtgtcgattatgaaggcacccgctctcagtcagaatgttcagttaactacggcctgaatgaatacgcgaataacgtcatttggggaatcggtgatgcgtgtgaagagcatggtctgccgcacccaaccgtgattactgaatctggccgggcgttgactgctcatcatacggtcttgatctctaatgtcattggagtagagcataacgaatttactgaaacaacaccgccagcagaagatgcttcacgtcctctggcaagtttgtgggatacgtggcaggaaatgcaggatggcggctattctcgttccctgcgtgagtggctgcatgatagccagtttgatcttcaggatgtccatacccaatatgcacacgggatgttgaacctgtctgagcgggcttgggcagaagaactctatttaaatatttgtcgccatattcagcgggatcttgacccaagtaaccgtgcgcatcgtccgttcattgatgaattgcaggaacgtatggcggataaattctatgtgaatttttcgctgttccagtcgatgccggatgcgtgggggattgatcaggtgttccctgttctgccgattgaagggctggataagccactggatcgccgtgcagttctgttggatatcacttgtgattctgatggcattattgaccactatgtcgatggtgatggtatagcagcaacgatgccaatgccggcttatgatccagagaatcctcccttgatcggtttctttatggtcggggcgtatcaggaaattttgggtaatatgcataacctgtttggtgatacggctgccgttgatgtttacgtttcagaacacggcgaagtgacctacttgcagagcgaagagggtgattctgtagccaatatgctccaatatgtaaaactggagccgcaggtactgatgagccgcttctgtgatcaggtgaaagcggctgatctggatgaaaatttgcaggagcagttcctgcaagaattcgaaagtggactgtatggctacacctatttggaagatgaatag

SEQ ID NO: 3117 - DNA, 147 bp, Xenorhabdus bovienii
  Coding sequence Name=Xb4151_4152.C437.gene114.dna; Position on contig= 65940..66086bp; Strand=+
atgcgatattgtaggtctgtcgcattttacgagcgatattatcattcatggcagtctccttcatggagtagaggtttgccttcacctgtaaagtcaataacccaagacactattaacagcgctaatagtacgtatcttgcgcattaa

SEQ ID NO: 3118 - DNA, 162 bp, Xenorhabdus bovienii
  Coding sequence Name=Xb4151_4152.C437.gene115.dna; Position on contig= 66150..66311bp; Strand=-
atgcaccattatctgctgattgttaacggccaacagccacactatgctattgatgtattcacatctagttcctttcttttcaatatgaactcattccgatgttaccgaaagcattcaaacagactggtaatatcgagtcggcaccatattgtcacaccgtaa

SEQ ID NO: 3119 - DNA, 147 bp, Xenorhabdus bovienii
  Coding sequence Name=Xb4151_4152.C437.gene116.dna; Position on contig= 66466..66612bp; Strand=+
ttgcaaaatgaaatttatcaaaatacattcactctgactgatctttttttaaaaacgccgaaaaatgtcacacggcaaaagatttttaaaactaaaaaaactggtatccttgacaagagtgccttaaaatggccgtctagatggtaa

SEQ ID NO: 3120 - DNA, 1155 bp, Xenorhabdus bovienii
  Coding sequence Name=Xb4151_4152.C437.gene117.dna; Position on contig= 66659..67813bp; Strand=+
atgactacacacctttttacttctgagtccgtttcagaaggacatccagacaaaattgccgatcaaatttccgatgctgttcttgatgcaatcttagaacaagatcctaaggctcgtgttgcctgcgaaacttatgttaaaactggcatggtcatggttggtggtgaaatcactaccagcgcttgggttgatattgaagaaattacccgccgtactgtccgtgaaatcggctataccagctcagacatgggttttgatgccaattcatgtgcagtgattagtgcaattggtaaacagtctcctgatatcaatcagggtgttgaccgtgcagatcctctggagcaaggtgcgggtgatcaggggctgatgtttggttatgcgaccaacgaaaccaatgtgttgatgccagcacctatcacgtatgcgcatctcctggttgagcgtcaagctcaagtccgcaaaaacggtatcctgccgtggctgcgtccggacgcaaaaagtcaggttacctttcagtatgacaacggcaaaattgtcggcattgatgccgtagtgctttctactcaacactctgaagatatccagcagaaagaactgcaagaagccgtgatggatgagatcatcaagcctgtactgccggctgagtggcttactccaatgaccaaatatttcatcaacccaacggggcgctttgtaataggtggtccaatgggtgactgtggtctgactggccgtaaaatcatcgtggatacttacggtggtatggcgcgtcacgggggcggagcattctccggtaaagatccctccaaggttgaccgttccgcagcttatgcggcacgctacgtcgccaaaaacatcgttgcggcgggtctggctgatcgctgtgaaattcaggtgtcttacgctatcggtgttgctgaacccacttctatcatggtagaaacgttcggtactgaaaaagtgccaacttccaccctgatccaattagtccgtgaattctttgatctgcgtccatatggtctgatcaaaatgttggatcttctgcacccaatctatcgcgatactgcggcatacggtcattttggtcgtgaacatttcccgtgggaagcaacagacaaggcagaaattctgcgttctgcggcaggattgaaataa

SEQ ID NO: 3121 - DNA, 573 bp, Xenorhabdus bovienii
  Coding sequence Name=Xb4151_4152.C437.gene118.dna; Position on contig= 67882..68454bp; Strand=+
atgagtgaaattaccataccgtatactgccgttatgaaattcgttagagtccccctcgcactacagcaaaccgtcatgcgcactctacggcaaaaattagcacaggcgagtgattaccttgaaacaacatttcctgaaccctgcgtgacctatcgacagagaggaacaattgccggcagcgcctgcctgcaaggttgggaaattcgcctgaatcccgttctacttatcgaaaaccagcaatcattcattgatgaagtgatcccccatgaactggcacatttattgacttaccatcaatttggcaaggtagcccctcatggaaaagagtggcgctttgtcatggaaacggtgcttaaagtgcctgccaaccggacacatcagttctcagtggattctgtccgcagcaaaatatttatttattattgccgctgccagcaacatgagttgaccatacggcagcacaataaagtccttaaaggaaaaagttgctatctttgccagcaatgcaaagaaagattaaaactattagagcaaaataaatccaataccccacagtcagagagttcgacctaa

SEQ ID NO: 3122 - DNA, 348 bp, Xenorhabdus bovienii
  Coding sequence Name=Xb4151_4152.C437.gene119.dna; Position on contig= 68528..68875bp; Strand=-
atgaaaaatttgttggcagtatgtttattgagctttgtattaacaggatgtgataatcacttgagtattgatggtacaaatgaaatagcggtaaaaacatccatcgaaaaaatcagagatacgttaccggaagataaaaaattaaaatttgatgattcattgaatattgccatgaccaatagcattgattttgatgatttgtttaaagagagtgcgaatggaaatattaaatctggggatatagaaagattggaacagaaattttttcgatcactgcatggaaaaacggcagatcaacttattgcagaagcagaaaaaattaaagcagcgaactttaccagccaatga

SEQ ID NO: 3123 - DNA, 138 bp, Xenorhabdus bovienii
  Coding sequence Name=Xb4151_4152.C437.gene120.dna; Position on contig= 69087..69224bp; Strand=-
atggtatttatctcatttcgcattgtactcaggaattttgtcgggtttgaacagattttaaaattaataatcatggtacacaaatacatttcgttttttgcggtaatgagaaaattattaggagtatggctggcataa

SEQ ID NO: 3124 - DNA, 177 bp, Xenorhabdus bovienii
  Coding sequence Name=Xb4151_4152.C437.gene121.dna; Position on contig= 69569..69745bp; Strand=+
atgaaggaagatgaattatggaaaaacatggtttgtgaaacaaaaaatatttttgataatcataaaacattattttcaaaagaacacttaaaaactgaattcagtgtattactacaagtaacagttaatcataaagtctttttgaaaatgcaattaaccaataatccgaaaatatag

SEQ ID NO: 3125 - DNA, 1137 bp, Xenorhabdus bovienii
  Coding sequence Name=Xb4151_4152.C437.gene122.dna; Position on contig= 69838..70974bp; Strand=+
atgtctgtcattcattactccataaaatattttatattggtattatttgtgttattaccaatatgttcacaagcagaaaatattactgttacggatattgccggacgagaagtcacagtgaatgctccggctcaacgggtcatactgatagatagccggagcattattgcgttgaatatcctgcaccccaacgatccattgaaaggtattgtggcatgggataatgcactggagaaaacagcacctgaccttgccgcagcctatgaggaaaaatttcctcaattaaggaaaattcctattttcccgactccttatacccgtgattttagtgtcgaaaaagctttaacctataaacctgatctggttattttcaatatgggcctgaagcctaaactggataacagcaatgcggttaagctactggaaaaatcgggaattcctgtcattttcatcgatttttgccaatatccgctgtctaataccgtatccagtatggaacttctgggtaaggtgtttaaaaaagaagaaaatgccggtaaattcattgcgttttatgaaagccgtctgtctttgatcaataagcgtatcgccacactgtaccaagagcagatccccagtgttttcatcgagcatcatgccggtatgctgggagcaaaagattgctgcgataccattggtgccaatagcttcggcgagtttgtcacaaccgcaggaggagataacatcggcagtaaatggttctcagacatgggaggcagaattaacgaggagcaattgctggtcagcaatcccgatacttacctgatgacagtagcagattgggatcaggttcacgcagggagccaatctgttcctttgggttataccggcaatttagaaaaatccgaaaagcgtttgcaaaacttgctctcccgcccaaacctgaaagtactcagctcgtaccgtgaaaaacgcgtgatggcgatttaccaccaatattacgattcaccattcaatattattgctgtagaagccattgctaaatggctgcatcctgagttgttcaaagatattgatccccatgcagatagtatctatgttcataaaacatttacggcattggacggtagcggtgtattctgggtaacgaccaaatag

SEQ ID NO: 3126 - DNA, 162 bp, Xenorhabdus bovienii
  Coding sequence Name=Xb4151_4152.C437.gene123.dna; Position on contig= 70917..71078bp; Strand=-
atgttggctaatataaaaattactcctaacgcctgtcagaaaaaatcccccggatctatagaaaaacccacaggaaaaacctgtaggtttagattaagaaggtactatttggtcgttacccagaatacaccgctaccgtccaatgccgtaaatgttttatga

SEQ ID NO: 3127 - DNA, 1341 bp, Xenorhabdus bovienii
  Coding sequence Name=Xb4151_4152.C437.gene124.dna; Position on contig= 71182..72522bp; Strand=+
atggacaacacttccaagaaaaaacctttataccagatcctttatattcaagtcatatttgccatcttactgggtatagcgctgggtcatttttatccagatattggtgaatcactcaaacccttaggtgatgctttcatcaaaattgtaaaaatgattattgctcctgttatctttttgacggtcgtcacagggatagcaggtatgaataatatgaaagccgttggaagtgtcgtaggaaaatcgatgttgtatttcttgacgttttcaactcttgctttaattattggtttgattgctgccaatatcattcgccccggagatggcttaaatatctcacctgaatcgttagatagtagcaaagtcatcggttatgtggagaaggcacatgaatcatccatcgtcggctttctcatgaatattataccggaaacggttgttagcccacttgtaaatgggaatattctgcaagtactctttattgctgttattttcggtatcgctttagcgtcgacaggaaaaaagggcgaacctatattggtgtttttgcaaaacttctcagagcctgttttcaagatggtaggcatattgatgaagctggcaccgattggcgcatttggggcaatggcatttaccatcggtaaatatggcatttcatccattggaaatttaatgatgttaattgtcactttttacatgacatcattactctttatttttgttgtattgggggctgttgctaaatataacggtttctccatcattaaattaattaaatacattaaagatgaactgtggttggttttgggaacatcatcctctgaagcggctttacccagcctgatgagaaaaatggaaaatgcgggctgtgagaaatcggttgtcggattagttattccaacaggttattcatttaatcttgatggtactaatatttatatgacgatggcggcattatttatcgctcaagcaacaggcattgagttgagtttcacggagcaaatatctttattattagtcgcaatgatcagctcaaaaggtgccgctggagtaacgggtgcaggctttattacgctagccgctactttatcagttgttcccagtttacccgtagccggtatggctctcattttgggcattgatagatttatgtctgaatgccgcgcattgaccaatttagttggaaatgcttgtgccagcattgttgtcgctcgttgggaaaatgctttagataaggataaaatgcatcaagctttaaatggtaatagacaaaattcagtagaagatatatcattttccctatcaagtaaaaaaaacatttctcctccagagaataaataa

SEQ ID NO: 3128 - DNA, 105 bp, Xenorhabdus bovienii
  Coding sequence Name=Xb4151_4152.C437.gene125.dna; Position on contig= 72822..72926bp; Strand=-
atgttttatggggttaattcttatttttctgtcagaattgcatttaaatataaaagatttttatcaataaacaaattaaataataaaagagagggtgaaatataa

SEQ ID NO: 3129 - DNA, 1482 bp, Xenorhabdus bovienii
  Coding sequence Name=Xb4151_4152.C437.gene126.dna; Position on contig= 72977..74458bp; Strand=+
atgaaaaaactgcataatatcgcaaaagaaatgttacctgctaaatcgtataaaatgctgattaatggagaatgggtagatagcgtttcaagagaaacccgtaaaagttataaccccgcaactggtgagttactcacagaatatgctgctggcaatgctcaggatgttgaactggcagttaaagccgcccaaaaagccttacctgcatggagtaaagaatcagcaaccgaaaaacaatctctgctactgaaaatcgctgacttgctggaagctgaatcagaacgtttcattactcttgaagccttagacgccggtaagacactaaatctatgtcggacgtttgacattccttttgccgttgatcactttcgctacttcgctggcgtcattcgtgcccattccgatgaagccgatgtgattgatgccgataccctcagcctagtgatcagagaacccattggcgttgtagggcagattatcccgtggaactttccactgctgatggctgcatggaaactagctcctgccctcgccgccggtaataccatcgtgatcaaccctgccagcctgacttcaattagtctactcgaatttggccgtatcctgaatcaagttctgccagcgggcgttgtcaatatcgttacaggtcgcgggtctagtgttggtcaagcgatcctcgatcatgaaggcattgacaaggtagcctttacaggttcaacagaaatcggttacaacgttgccgcagcggcagccagacggatcatccctgccacattagaactcggcggtaaatctgccaacattattttccctgatgccaatatgaaaaaggctgtcaaatatgctgctgacggcattttgttaaatcaggggcaagcctgtgaatctggcgctcgcctgttcctgcataaagatattcatgacgagttcctgaaatcgctgaaagcggtatttgaatccgttcgggtgggcgatcccatgatgaccgaaaccgagatgggttgtcagatcagtcaggaacaaatggactttattctgggctatattgaccttgcgaagcaggaaggtgcaaccgtgctgaccggtggaaaccgcataacaggcgcgggatacgatgatggtttctttgttcagccaaccattattaccaatgtgaccaataaaatgcgggttgcacaagaagaaatctttgggccagtgctgtgtgtcattccatttagcagtgaagaagaagtcgtggaaatggccaatgattcggaatatggtttgggaggcgcggtctggacgcaggatatcaaccgtgctctgcgcgtggcaaaagcggttcagacaggccgcatgtgggtcaatacctatcatgccctccccgcccatgccccatttggcggttacaaaaaatccggtcttggcagagaaacccacaaaatgagtctggatgcttacactcaggtgaaaaacatctatatcagtacgaaagaatag

SEQ ID NO: 3130 - DNA, 138 bp, Xenorhabdus bovienii
  Coding sequence Name=Xb4151_4152.C437.gene127.dna; Position on contig= 74437..74574bp; Strand=-
atgtatcgccattatctctgtggttgcctggttcttctggttgtaattcatctcaataaaaaattgatcataaaaatcgccactcggaagggtggcgattgtcttggaacctataactattctttcgtactgatatag

SEQ ID NO: 3131 - DNA, 1386 bp, Xenorhabdus bovienii
  Coding sequence Name=Xb4151_4152.C437.gene128.dna; Position on contig= 74529..75914bp; Strand=-
atggacgcttctgaatctttaaccccagcgattgggccaaatccctcaaataaaagaggcttaattattctcgcgctggatattatcttgcttgtcgctctgcttaagtttttgccgtatggcgaaaaaaccaatgcgggtctggcattgatggcatttgttggtgtgctatggctgactgaagccatacacgtcacaattacggctctgtgtattccaattctggctgttggtatgggattgatgaacacgggtgatgcgctgcaatcttttgcaaacccgatcatctttctgttctttggtggttttgcactggcaacggcgctgcatattcaaggtctggatcggctgatcgccaaccgtcttctgatgattgcccgtgggcgtttatcggtggctgtattgctgatatttggtattaccgccgtgctttctatgtggatcagtaacactgcgactgctgcaatgatgctgccactgatactgggcattctggctaatctggatgtgcgcactgaacgcaatacgtttgtttttgtgttgctgggggtggcatacagcgccagtatcggtggtttgggaacgctggtgggaagcccaccgaatgccattgcagcggcgcaactgggcatggacttcttcacatggatgaagtatggcgtgccgatggtcatcattttgttgccagtcatggtggctgtgatgtacatcatgctgcgtccgaacctgaagcataaatttgatctgaaattggaacatctggagtggaacagtaagcgcattatcactatggctatcttcctgctgacggtgtttagttggattttcagttcaatcatcagtgatgcttttggcggtatcaaagatctggatacgattattgcagtgagcgcagccatcctgattggcatcactggcgtgtcaacttggtcacagattcaaaataacaccgaatggggcgtattgatgctgtttggtggcggcctgacgctgagtgctgtcctgaaaaactccggagccagcgaagttatggcgaatggcatggcggcaaccttcggtgccagtcactggtttgtgatcatccttgctgttactgcgttcattatcttcctgacggaatttaccagtaataccgccagtgccgcactgctggtgccgattttcgctacggttgcagaagccttggggatgcctgttatggcgctgaccatgattatcggtatcggtgcatcctgtgcatttatgctacctgtggcaacgcctcctaacgcaattgtttatggctctggctatatcaagcaaattgagatggtgagagtgggcatggtgctgaacgtggtatgtatcgccattatctctgtggttgcctggttcttctggttgtaa

SEQ ID NO: 3132 - DNA, 117 bp, Xenorhabdus bovienii
  Coding sequence Name=Xb4151_4152.C437.gene129.dna; Position on contig= 76047..76163bp; Strand=+
gtgtatgattttgggatctatcacgtggggtttgttcaattaacgaatgattgtatagaaaatatactaatattatgtcgttatttcatacttttcatttcatcatcgtatttataa

SEQ ID NO: 3133 - DNA, 105 bp, Xenorhabdus bovienii
  Coding sequence Name=Xb4151_4152.C437.gene130.dna; Position on contig= 76127..76231bp; Strand=-
atgttttggcgaaagggtatatgctctttcgccatcttaacgaaagataattttatccgtataagtgattataaatacgatgatgaaatgaaaagtatgaaataa

SEQ ID NO: 3134 - DNA, 1302 bp, Xenorhabdus bovienii
  Coding sequence Name=Xb4151_4152.C437.gene131.dna; Position on contig= 76268..77569bp; Strand=-
atgtccaaaatcgttaaagtacttggccgtgaaatcatcgattcccgtggtaacccaacggtagaagcggaagtacatctggaaggtggctttgttggtctggctgctgcgccatcaggtgcatcaacaggttctcgcgaagcactggaactgcgtgatggtgacaaatctcgcttcatgggtaaaggtgtactgaaagcgctttctgcggttaatggctcaatcgctcaggctctggttggtcaggatgcgaaagatcaggctaacatcgacaaaatcatgatcgagctggatggtactgaaaacaaatctaacttcggtgctaatgcgattctggctgtttcccttgcgaacgctaaagcggcagcagcggcaaaaggcatgcctctgtacgagcacattgctgagttgaacggtacgccaggcaggttctccatgccactgccaatgatgaacatcatcaacgggggtgagcacgctgacaacaacgtggatattcaggaattcatgatccagccaattggtgccagcacgctgaaagaagcggtacgcattggttcagaagttttccacaatctggcaaaagtgctgaaagcaaaaggcatgagtacggcggttggggatgaagggggctatgcgccaaatctggaatctaacgcagcagcgctggccgcgatcaaagaagccgttgaacaagcgggttatgtgctgggtaaagatattactctggcgatggattgcgcagcttctgaattctataacaaagaaacgggcaactatgaactgaaaggcgaaggcaggacgttcacttctcaggaatttacccactatctggaaggcctgaccaaagaatatccaatcgtttctatcgaagatggtttggatgaatctgattgggatggttttgcttaccagactaaagttatgggcgacaaaatccagttggttggtgacgatttgttcgtaaccaataccaagatcctgaaagaaggtatcgaaaaaggcatcgcaaactccatcctgatcaaattcaaccagattggttctctgactgaaactctggctgcaatcaagatggcaaaagatgcgggctacactgcggtgatttctcatcgttctggtgaaaccgaagatgcgactattgctgacttagctgtcggtactgcggcaggtcaaattaagacgggttctatgagccgttctgaccgtgttgctaaatataaccagctgatccgtatcgaagaagcactgggtaaccgtgcgactttcaatggtctgaaagaagtgaaaggtcaggcataa

SEQ ID NO: 3135 - DNA, 1638 bp, Xenorhabdus bovienii
  Coding sequence Name=Xb4151_4152.C437.gene132.dna; Position on contig= 77656..79293bp; Strand=-
atgaaaactaattatatttttgtgaccggcggggtcgtatcctctctgggtaaaggcattgctgctgcctctttggctgctatcctcgaagcccgtggactcaaagtcaccattatgaaactggatccgtacatcaacgtcgatccgggtacaatgagcccaacccaacacggggaagttttcgttaccgaagacggcgctgaaactgatctcgatttaggccactacgaacgttttattcgtaccaaaatgacacgccgcaataacttcacgacgggccgtgtctactctgaagtgctgcgtaaagaacgccgcggcgattatttgggtgcaaccattcaggttatcccccacattactaatgaaatcaaagatcgtatcatccgtggcgcagaaggctatgatgtggtgctggtggaaattggcggtactgtcggtgatatcgaatctctgccattccttgaagctatccgtcagatggccgtggaagtcggtcgtgaacataccctgtacatgcatctgacgttggtgccctatctggcagcggcaggtgaagtcaaaaccaagcctactcagcattccgtgaaagaactgctctccattggtattcagccggatgttctgatctgtcgttcagatcgtatcattcctgccaatgagcgtgcaaaaatcgcgctgttctgtaacgttccagagaaagccgttatctctttaaaagatgttgattctatttataaaatcccagccctcttgaaatctcagggcttagatgattatatttgtaaacgattcagcctcggataccctgaagctgatctgtccgaatgggaacaggtcgtttatgaagaagccaacccatcgggtgaagtcaccattgggatggtgggcaaatatgttgaactgccggatgcttataagtcagtgattgaagcactgaaacacggtgggttgaaaaaacgcctgaccgtcaacatcaaactgatcgattcacaggatgtcgaaacccgtggtgttgatgtattgaaagatctggatgccattctggtgccgggcggcttcggtggccgtggtatcgaaggcaaaattatgactgcacgttatgcccgtgagaacaacgtcccttacttggggatctgtctgggtatgcaggttgccctgattgagttttcacgtaatgtggcgggcatgaaagaggccaactccacagagtttgagccagagtgcaaattaccggttgtaggtctgatcactgaatggcgtgatgagaacggcaacttagaagtacgtagcgaagagagtgatctcggcggaacgatgcgcgttggcggccagttatgccgtctgtctgaaggcagtctggtacgtaaactttatggtcaggacgacattattgaacgtcaccgccatcgttatgaagtgaacaatttattgctgaaacgaattgaagaagcaggcctgcgcattgccggccgttcaatcgataacagattggtggaaatcattgagaatccggcacatccgtggtttgtggcgtgccagttccacccggaattcacttcaacgcctcgcgatggtcatccgttatttgcgggcttcgttgaagccgcaggcaaatatcagaaaggccagttgaaataa

SEQ ID NO: 3136 - DNA, 801 bp, Xenorhabdus bovienii
  Coding sequence Name=Xb4151_4152.C437.gene133.dna; Position on contig= 79533..80333bp; Strand=-
atggataagataaaaaccacctcgattgaacgacttaaggggattatgacgcagttgcgtcatccccagcagggttgcccgtgggacaaagtgcagacttctgccaccattgcgccttacacgttggaagaaacctatgaagtcattgatgccattgagcgcaacgacgcaaatgccctgaaagaagaactgggggatctgctgtttcatatcgtgttttatgcccagatgggtcaagaacagcagttgtttgattttgacgatatctgcgacgcggtttgtgacaaattagagcgcaggcatccccatattttcgatcaacaggcaggcatcagcagtgaagaagcgatcgggagctgggaacaacgtaaaacggcagagagggcggaaaaagaccagcattctgtgctggatgatattcccgccagtctgccagcgttgatgaaagcctataaaatccagaaacgctgtgcttcggttggttttgattgggatacacttggcccggtgctgggcaaggtatatgaagaaatcgatgaagtgatggatgaagcccggcaggtggtggttgatgaagccagactggaagaagagctaggggatttgttgttttctgttgtcaatttatcccgtcatttagggcataaaccagagatggcattgcagaaagcctgcggtaaatttgaaaatcgtttccgaagcgtcgaaaagctgatcttcgaccaaggtctgtcattggaaacggcgacactggaggaaatggaacagatgtggcagcaagtcaaaaaacagcagccgtag

SEQ ID NO: 3137 - DNA, 2238 bp, Xenorhabdus bovienii
  Coding sequence Name=Xb4151_4152.C437.gene134.dna; Position on contig= 80340..82577bp; Strand=-
atggttgcggtaagaagtgcacatctcacaccagcaggtgaatttgcagtcgataagtggatcgcgagtttacatatcacgaatccacaatccagtgagaaattagccgaaacatggcattactgtcacgaaaaagtccaggatcaccctgatgcggcgctgttgctgtggcgcggtgtggaaatggtggagatcctgtccacattgagtatggataatgacagtatgcgcgctgcgctgctctttcccatccttgatgccaaactgctcgataatgaaacagtgacagaaacatttggtacggctattaccaatctggtgcatggcgtgatggaaatggacgccattcgccagttgaaagccacccacacggattccaccagttcagtgcaggtcgataatgtgcgtcggatgctgctgtcgatggtggaagatttccgctgtgtgatcatcaagctggcggaacggatcgcccatttacgggaagtgaaggatgccagcgaagatgagcgagtactggcggcaaaagagtgttccaacatctatgcgcctcttgccaatcggctgggtatcggtcagctaaaatgggaactggaagatttctgtttccgctatctgcatcctgacgaatacaaaaagatcgccagactcctgcatgagcgccggatcgatcgcgaacagtacatcgaaaagtttgtgacgaccatacgcaaatacatgctcaaagaagggattccggtcgaaatttatgggcgtcccaagcatatttacagcatctggcgcaagatgcagaaaaaatccctcggctttgatgaactgtttgatgtgcgggcagtgcgtattgtcgttgagcgtttacaggactgctatgcggctttaggaatagtgcatactcactatcgtcatctgccggatgaatttgatgattatgtcgctaacgccaaaccgaatggttatcagtccattcataccgtcgtgctggggccgaatgggaaaacgctggaaattcagatccgcacccgccagatgcatgatgatgctgaacttggggttgccgcccattggaaatacaaagaaggcaccgccattggcggcggcaaatcgggcagttatgaaagccgtattgcatggctgcgtaagctaatcgcatggcaggaggaaatggcggacactggcgaaatgctggatgaagttcgcagccaagtgtttgatgatcgcgtttatgtctttacgccaaaaggcgatgtgattgacttgccggcaggctctacgccgttggattttgcttatcatattcacagtgatgtcgggcatcgctgcatcggggcaaaaatcagtgggcgtattgtgccgttcagctatcagcttcagatgggtgatcaaattgaaatcatcacccagaagcatccgaatccaagccgtgactggctgaatccgaatctgggctatgtaaccactagccgggggcgagcaaagatccacaactggttccgcaagcaggatcgtgacaagaacatcattgccggtcgccagatgctggacaatgaactgacccatttggggatcaccctcaaggaagccgagaaagaacttattgcccgttataacgttcattcgctggaagaagtgttagcgggtattggtgttggtgacatccgaattcaccaattgatgaatttcctgcaaagcaagttcaacaaaacgacggcggaagaagctgatcgtaaggcgctgcgcaatctagaaaataaaacctacactccgcgcagtgtaaaacaagacaatgggcgcatcgtcgtggaaggggtaggtaatttgatgcaccatgttgctcgttgctgtcagccgatccccggtgatgaaatcatcgggttcattacgcgcggacgcggaatttccatccacagtgccgattgtgagcagctggccgaattggaaattagcgcaccagaacgcattgtggatgcggtttggggagaaaattattccagcggctactcccttgtggtgcgggtgcttgctaatgatcgcagcggattactgcgtgatatcaccactattctggccaatgaaaaggtgaatgtactgggggtgagcagccgaagcgacgtaaagcagcaactggcgactatcgatatgaatattgagatttataatctacaagtattgggacgggtactggcgaagctcaaccagctatctgatgtgattgaagccagacgtttgcacggtaattaa

SEQ ID NO: 3138 - DNA, 1353 bp, Xenorhabdus bovienii
  Coding sequence Name=Xb4151_4152.C437.gene135.dna; Position on contig= 82587..83939bp; Strand=-
atggtgcaattttactccccaaaccgccgctccgtaaaccgaggcattatttccgttaccgcagataaccttgatgcacaagggcaaggcattgcccgtcatcagggaaaaacgatatttattcagggattattgccgggtgagcaggctcagatccaactgacagaagaaaaacgccagtttgccaaggccaaaatagtgaaacggctgtcagacagcccgtttcgtgtggtaccgcgctgcccgcatttcaatgtgtgtggcggttgtcagcagcagcacgttgcgattgagttgcaagccaaaactaaggccagcgtgctggaacaccttatccagcgggaaactggcattagtatcagtgctcatcccatcattcacagccctgaatatggctaccggcgtcgggtacggcttggcctgcaatacgatgttaagaaaaacccgggcaggcagcaaaaattattgatgggatttcgccagagccagaccaacgatttggtagccgttgcacattgtccggtaatgcgccctgaattggaacagttattgcaaccgttatcccagtgtctgaatagtctgagtgcggttaaacggctgggacacgttgaattagtgctggcggataatggcccgttaatggtgttacgtcatcttgctccactgaagcacgaagacagggaaaagctgcgcactttttcggtgcagcataaggcggcagtctatctggctggcgatgaaaaaatccttgagcctttgacagaagggcagactgctccgtggtatcaggtggatggcttgaaactgaaattcagtccgtgggattttattcagattaatgatgaagttaaccagaaaatggtggtacaggcgttggcatggctggatttgcagccgacggatcgggtattggatctattttgtggcatggggaactttaccttgccgatggcaaccaaagcacagaccgtagtgggtgtagaaggggttgccgcgctggtcgcgaatgggcaatataatgcccagctcaatgaacttaataacgtcgattttttccacgaaaatctggaatcggatattcaccaacagccttgggcggtgctggggttcaataaagtgctgctggacccagcccgtgcaggtgcggcgggtgtcatgtcacatattgtaaaactggcccctgaaagagtggtgtacgtttcctgtaaccccacaacactggcgcgggacagcaaaattctgctggaggctggttatcatcttgtcagtgtgcggatgctggatatgtttccgcacaccggccatctggaatccatggctttgttcagccgtgagccaatggctatcgagtag

SEQ ID NO: 3139 - DNA, 2352 bp, Xenorhabdus bovienii
  Coding sequence Name=Xb4151_4152.C437.gene136.dna; Position on contig= 83993..86344bp; Strand=+
atgaccaaatatagcctacgcacccgtatgatgagcctgatattggttcctgttttactggtcggaacgcttgtgagtatatcatttatctcataccgttattacgagttgaagaacctgatagtccgcagtgggatcagcattattgaaccgttgtccatcgccagcgaggtgggcatcaatctggataatcgtcgacgggtcgaagtcttagtcaatagcctgcatcgccgcaattccgagattgtcaaagccattgcgatttttgataaaaatcataagcttttcgacatttctaatgataaatatgacgcgaaccagttgcggcttcctgctggtgagccaatcccaaaggttctactgagtcaatcaggacacgataataatatcattttgatgatgccgctgattgcagaaaacatccaagaaaacgaatggcgcactaccaccagcaaggccaatcccatcggctatatcgccattgatctggatttgagaacagcccaaatccagcaatataaagaaattacgacgtcaatcatcctgctgatcctctgtcttggcggcactgccctgtttgcccacattttagtgcgtaaagtgacacaaccactaggtggcatggtgagggttgtagaacagatacggcagggacaattgaacattcgtgttactggcgcgatgccgggagaactggccgcactccagaatggcatcaataccgtcgcggaatcgctgtcgaaatataaagatgagatgcagttgcatattgatcaggccacatctgacttacaaatcaccatggaacagttggaaatccaaaacgttgaactgactctagccaagaaacgcgcacaggaagcggttaagatcaaaacagaatttctggcaaatatgtctcatgaattacgcacgccgcttaatggcgttattggctttacccgtcagatgctcaaaacccccattacgtctcagcaagccgagtacctttatgtgattgaacgttctgccaataatttgctgaaaatcatcaatgacattctggatttttcacggctggaatcgaataaactggtgctggatcaagttccttttctactgcgagatacggtcaatgaagtcatcgaactactcacccccgtggccagcgagaaaaaccttcccctgcaacatcgcatagatgacaaattgcctaacctgatgatcggcgatcccatacgcttgcagcaaatactcactaacctgattggcaacgcgattaaattcacagataaaggcagcgtgatactggaggtcagattacgccagcagcagcatcatctcgtgcagattgatttcaccataaccgatactggcatcggcattaaaccagaatatcggccgattctgtttcaggcattcaatcaggctgatgccagtattacccgccactacgggggaaccgggctgggtttgagcattaccaaaaggctggtcaatgagatgaagggagagatcgatttcatcagcgaacccgcaaaaggaaccgtattttattttgatctctggctggaaaaagaagcgtttttattgggttcattacctgaacgcctgcccattcccccacgtttgcccataaccgtgatggcggtggatgataatccggccaatctgaaattaattggtactttgctggacgaacaaatcgagaataccctgctgtgcagcagtggtctggaagcactgactacggcacagcaacacgcgctggatctgatcctgatggatattcaaatggcagatatggatggtattcaaacctctgaacaaatccatcaattaccacagcataaagagacgcccattgtggccgtgacggcttttccctgtaatgaaacccaaaatgggggacgttccccatttgttggctgcctgtcaaaaccgttggatgaacgtcgcctgaaagcgtggctgaatcaatacagccaaaagaaaaaatcacagttcatcgattgggatatcgctttgaaaaaaacggatggaaaagaatctctggcgcgggaaattctggagatgctagtacaatcgctgccagaaatgaaagcgatgattgaacagatcttggcagcagatagcgacgttgatcacaaacagtttcagtatcatgtccaccaattacatggcagttgctgttacaatggcgtccccaaactgcaagcgatttgtgaattcatcgaaaaacaattgaaacaagctattcctctggcggatctggagccagaattactggaattcatcgatgagatcaatcacgtcattgccgccgctcccgatatactgagagcgcccgggtctctcacttcgataccataa

SEQ ID NO: 3140 - DNA, 1551 bp, Xenorhabdus bovienii
  Coding sequence Name=Xb4151_4152.C437.gene137.dna; Position on contig= 86328..87878bp; Strand=-
atggggggattaatgactaaaattgatttcaagcagaagttgaattaccagcgtaagtacagcaactcttccatacatcctgacgatgaagatcaggtgaatcgtcaattcgaaagtgaccgtgggcggatcatcaattcagccgctatccggcgtttgcagcagaaaacgcaggtttttccgctggaacgcaacgccgccgtgcgcagccggttgactcactcgctggaagtgcagcaaatcgggcgctatatttcaaaaacgattattgcagaactgacaaagcagaatttgctggaaaaatatgggctgagtgatcgcttacttgcttttgaaagcctgattgaaatggcctgcctgatgcatgatatcggtaatccgccgtttggccattttggtgaggcggcgatcagagattggttctcgcgtcgattagatcctgattatttttcagactgcgtttctgaaagcaccgctcggcaagatggctgtaaagtggcggcattgagctacaatggtgaaaccaaaaaagatctgttccggcgtcagttacgtaaggatttatgtgaattcgagggcaatgcccaagcgatccggctggcacataatctgcttaaactgaatctgacttatgcccaaatcggctgtatcctgaaatatacctgcccggcttaccgtcttgaaggatctcccgacgaattcagttacctgatgaagaaaaaaggctattactggtcggaagacagttttatccatgaattaaaaaaagcgctgcaattgggggatttctgccgttttccgctgacgtatattatggaagccgcagatgatatctcttattgcattgctgatttggatgatgcggttgaaaagggtattttcaatgttgagcaattggtggaatacctgaaaaaagagtgggaggaaaatgggggacacagtaaaggggatttattcgaattcacggtaatgcaggctcataagaaaacggccagtaatgaggcccgtcgcagtattcatgagcagtttttcatgtatctgcgggtatttatcactggtaagttggtgccctataccgctaaacgttttattgagaatttgcctgaaatttatgcaggcacattcaatcatgctttgttggaagaagatggcgatgaacatcgtctattgcagattttgaaaagtgtcacgcggaaatgggtatttagccaccctgaagtcgaagagctggaattgcagggctatcggattattaccggattgctggatgtttacagcccattgctggagttatctcggcaggattttatgtcactgcaccggaataattttcacaaaaaatattttattgaaacgcgtctgctgcacaaattatctaccaaacaccgtctggcctatgaagaggctgtagaaaacattgtcgccactgatgaagttgaaaaagatgtgctcgaattttattatcgggcgcgtttgattcaggactatatcagtggcatgactgaccattatgcttacgaagaatatcgtaaatttatggtatcgaagtga

SEQ ID NO: 3141 - DNA, 111 bp, Xenorhabdus bovienii
  Coding sequence Name=Xb4151_4152.C437.gene138.dna; Position on contig= 87893..88003bp; Strand=-
gtgtcatactcatggttaattaatggattagtgtctatgaaaaggcactcttattcgatgcggcagtgtaacattgaatcactgtttactggttattccggctataaataa

SEQ ID NO: 3142 - DNA, 699 bp, Xenorhabdus bovienii
  Coding sequence Name=Xb4151_4152.C437.gene139.dna; Position on contig= 88005..88703bp; Strand=+
atgaaagtaggtgtaataggcgcaatggaacaagaagtaacactactgcgtgaccagattgaaggtctgcaaactgtgtcgcggggcggatgtgaaatctacaccggcaagctgaatggcgttgacatcgcattgctgaaatccggcatcggtaaagtctcttccgcccttggcaccaccctgttgattgaacattgccagccagacatcgtgattaacaccggctcagccggcggccttgaccctaaactgaatgtgggggatatcgtggtttccggagaagtccgctatcacgatgccgatctcactgcctttggttatgagccgggtcagatggcacaatgcccacctgcttttatcgccgacagccaattaattacactggccgaaaaatgcattaaatcccttaacctgaatgcggttcgtgggctgatttgtagcggtgatgcttttatcaatggtgcagaacctttggcgcgtatccgtgcgactttcccgcaagtcgccgcagttgaaatggaagcggcagctatcggccatgtctgccacctgtatcaaattccattcgtggtggttcgtgccatttctgatgtggccgatcaggaatctcatatcagctttgatgaattcttagttatcgctgcccgtgaatcgacacggatggtcaacgccatgttgagcgaactcagccaacattag

SEQ ID NO: 3143 - DNA, 849 bp, Xenorhabdus bovienii
  Coding sequence Name=Xb4151_4152.C437.gene140.dna; Position on contig= 88735..89583bp; Strand=+
atgaaaccttggatgaaaataatctcacttagatcaatctggttatcattctcattcctgctcttcagttttctgtacagtgtcagtgcgccacttcacgccgcagcctctcgtgttatcagccttgctccctcgacgaccgaactcgcgtatgcggcaggactgggcgatcggcttgttgcagtcagtgcttactccgattatcccgaagccgctaaaaaattagagcaagtcgctgattggcaaggcatcaatgttgaacgcatcattgccctgaaacccgatctgattctggcctggcggggcggtaatccccagcgtccgttagaacagctcgcggcattaggtatcccggttttttattctgatgtgaaaaaagtggaagatgttgcaaccgatctggaacggctggctgtccatagcccacgccccgatattgccaaaaaatcagccgcggatatccgccagacattcagcaaattaaaacagacctatgccacccccaatcccaagccggtgtttttacaatttggcatgaatccgatttttacttcatccgatcacaccattcaaagtgaaatcctatccgcgtgtggtggtaaaaacatctttgctgacagcaccgtaccgtggccgcaagtcaatcgtgagcaagtacttacacgcaaacctgaagtgattgtgctgggaggaactgaagatcaaaaacagcgcgtggcggatttttggcagccacagctaaatgtcaagatcatcactctgaatgacgattggttcagccgtgcagggccacgaattattctggcgacagagcagctttgccgggagctgaatctttctggcggctag

SEQ ID NO: 3144 - DNA, 120 bp, Xenorhabdus bovienii
  Coding sequence Name=Xb4151_4152.C437.gene141.dna; Position on contig= 89580..89699bp; Strand=-
atgcaaaaaccacttgtggttgtggttcttctttcagcgtctgatcgaaaatatgatactgctattaaaaataagggcagcttaagcgccgcctttatttttttctacgttggcctctag

SEQ ID NO: 3145 - DNA, 345 bp, Xenorhabdus bovienii
  Coding sequence Name=Xb4151_4152.C437.gene142.dna; Position on contig= 89656..90000bp; Strand=-
atgagcgatgatgctgcattgcctttgcagtttactgatgccgcagccaataaagttaaagtactggttgctgatgaagataacccgaacctgcgtctgcgggtttatattacaggtggtggctgtagtggtttccagtatggtttcactttcgatgatcaaatgaacgaaggtgatctgacgattcagaaacaaggggttgagctggtggttgacccgatgagcctgcaatatctggtggggggctgtgtcgattataccgaaggtctggaaggttcccgttttatcgttactaacccgaatgcaaaaaccacttgtggttgtggttcttctttcagcgtctga

SEQ ID NO: 3146 - DNA, 195 bp, Xenorhabdus bovienii
  Coding sequence Name=Xb4151_4152.C437.gene143.dna; Position on contig= 90107..90301bp; Strand=+
ttgctacacaaaggcaacaagcttctccatgtcaggatgatttggcttccccatcaggctgctttaaaatggcctcccccctatctgtacccttatttttcaggagcttttattaatgaaccagtccgaaatgctttactctcaggcaaaacaggtgatccccggcggtgtcaactcgccggtacgcgcctttaa

SEQ ID NO: 3147 - DNA, 1284 bp, Xenorhabdus bovienii
  Coding sequence Name=Xb4151_4152.C437.gene144.dna; Position on contig= 90222..91505bp; Strand=+
atgaaccagtccgaaatgctttactctcaggcaaaacaggtgatccccggcggtgtcaactcgccggtacgcgcctttaatggcgttggtggtacgcctgtctttatccaacgcgccgatggtgcttacctttacgatgttgatggcaatgcctatatcgattatgtcggctcatgggggccaatggtactggggcacaatcaccctgccattcgcaacgccgtgattgaagccgccgagcgtggcctgagctttggtgcaccaacggctgccgaagtggaaatggcaaaacgagtgacagagttggtgccttccatggatatggttcgcatggtgaactccggtacagaagccaccatgagtgccattcgtctggcgcgtggttataccgggcgcgataagatcatcaaatttgaaggctgctatcacggccacgccgactgtctgctggtcaaagcgggttccggtgccttgactataggccagcccaattctccgggcgttcctgccgatttcgccaaacataccctgacctgcgtctataatgacctgaattccgtgcgtgaagccttcgaaaaatacccagaagagatcgcctgtatcatcgtagaacccgtcgccggtaacatgaattgtattcctccacgaccagaatttctgccgggtctgcgtaagctgtgtgatgaattcggtgcgttactgatcattgatgaagtgatgaccgggttccgtgtcgctttgggcggcgcacaagagtattacaacgttaaaccggatctgacgtccctcggcaaaatcatcggtggcggtatgccagtgggtgcatttggcggccgtcaggacatcatggaaaaactggcaccaaccggcccggtttatcaggcgggaaccctctcaggtaacccaatcgccatggctgcgggtctggcttgcctgaatgaagtcgcccaacccggcgttcacccgcgtttgagcgaactgacagacaaattagcttctggcctgaaaaacgcggcatcagcagcaggcgttcctctggtggttaaccacgttggcgggatgttcggtattttctttaccgacgcagaaagcgtgacttgctatcaggatgtcatggcgtgtgatgttgaacgcttcaagcaattcttccacttgatgctggatgagggcgtctatctggctccttctgcgtttgaagcaggctttatgtccatcgcccattcagatgaagatattcagcgtaccgttgatgccgctgcccgctgttttgccagactgaattaa

SEQ ID NO: 3148 - DNA, 180 bp, Xenorhabdus bovienii
  Coding sequence Name=Xb4151_4152.C437.gene145.dna; Position on contig= 91521..91700bp; Strand=+
gtgacgccacaatcccgtggcgtcacattgggtaaacatgcctgcggcctatttcaggatctgataggcgtcaataaatatgtttcatcaacccatctcattaaatcatctccctttttactaaattatcgagcggcaccatgcttttgtgcaacacgccgaaaaccaacaattgagtga

SEQ ID NO: 3149 - DNA, 120 bp, Xenorhabdus bovienii
  Coding sequence Name=Xb4151_4152.C437.gene146.dna; Position on contig= 91779..91898bp; Strand=-
atgctcaaattgcaattattgcaagcaagagcggctcaggccaaagttgatatggaagcaggaaaactgactagtggcgatgtcttttttgatgagttagaagttggtcagtacgattga

SEQ ID NO: 3150 - DNA, 201 bp, Xenorhabdus bovienii
  Coding sequence Name=Xb4151_4152.C437.gene147.dna; Position on contig= 91849..92049bp; Strand=-
atgatccgcagagtttatgccagcaatctacgccgcagccggttgaggataacaaagaagaagcaccgggctggctacaggagatgtttaatcagtaatagagtatcgcccccatcgattccgatggggggtagtttagattttgaccgaaatgctcaaattgcaattattgcaagcaagagcggctcaggccaaagttga

SEQ ID NO: 3151 - DNA, 2463 bp, Xenorhabdus bovienii
  Coding sequence Name=Xb4151_4152.C437.gene148.dna; Position on contig= 91952..94414bp; Strand=-
atgtctgatgatgaccgtcagccaatcggacgcaagggcaaaaaaccagaacttcgtcgtgagcgtccagcaaaaaaacgccatcggcaggatgactatgaaaatgatgaaaataatgattttgataacgacgatgaggaacaggtcatgacgaaaaaagggaaaaaaccccgtccgccaaggagtcgatggcgaggattctggttgctgctgttgaaaatatttattgtgctggcagtgctcatagctatttacggtttttatctggataacaaaattcgccatcgcattgatgggaaagtatgggatttacctgctgcggtgtatgggcgtatggtcaaccttgaaccgggcatgaattacagcaaaaacgaaatgattcggttgctggaaggcatgcagtatcggaaggtgaccaaaatcacgcgtgccggtgagttcgttgtcaggggcaacaatattgaaatgctgcgccgtccgtttgatttccctgacggtaaagaaggacagattcaggctcggctggtcttcagtgataaccatattgccagcatcgaaaacatggagaaccagcgtcaatttggtttcttccgtctcgatccgaaactgattacgatgatgcaatcgccgaatggcgaacagcgtttggttgtcccacgttcaggttttccggatttactggttcagactctgctggaaaccgaagatcgttatttctatgaacacgatggggtcaggccgctttccattgcccgtgcggtgctggcgaacctgaccgccgggcgtacggttcagggaggcagtacactgacacagcagttggtcaaaaacctgttcctctccaatgaacgtaccttcagccgtaaagcgaatgaagcttacatggcgttactgatggatgcccgctatagcaaggatcgcattcttgaactgtacctgaacgaagtttttctggggcagagcggcgatgaacagatccacggcttcccattggccagtctgtattatttcgggcgtccgattgatgaactgagtttggatcaacaggcgctgttagtgggaatggtcaagggagcatcgatgtataacccgtggcgcaatcctaaactggcattggaacgccgcaacgtggtattgaaaatcctcctgaacaggcaaattattgatcaggagctttatgatctgttgagcgcccgtccgctgggtgtgaaatccaaaagtggggtgattaccccacagcctgctttcatgcaattggtacgtcaggaattacaggaaaatctgggtgataagattaacaacctgtcgggcgtgaaaatctttacaacactggacccggtatcacaggatgcggcggaaaaatccgtggaagagggcgttgccgatctgcggaaaacccgcaaggtagatgatctggaaggcgcgatggtcgttgttgaccgtttcagtggtgaagttcgtgcgatggtcgggggttctcaaccaggatatgcaggttttaaccgggccttgaatgcacgccgtctgattggttctcttgccaaacctgcgacttatttgacggcactgagtcagccggataaataccgcatgaatacttggctggcggatgagcctatttcgatacctctgtcgggcggaaaatcttggcaaccgaggaatttcagccgtaattttagtggacgtgtcatgctggtggatgcgttggctcgttcgattaatattccgacagtgagtctgggactgagtatcgggctggatcgcattaccaataccttgatctcactcggaattccggctaaagaaatccaacaggttccttccatgctgctgggtgcaatcaacctgacgccgatggaaatggctcaagagttccagaccattgccagcggcggcaatcgggcgaaactttcggcattgcgttcaatccttgcggaagatggtacagtgatttaccagagttatccgcaggcagagcgggcagtgcctccacaggcggcttatctgacactgtacggtatgcagcaggtggtggctcgtggtacaggcagttcgctgacgaaaaaatacggtaaatacaatctggcaggtaagacaggaaccaccaacgatctgcgtgacagttggtttaccggcatcgatggtaaggaagtggcgatcatctggacagggcgtgataataatggcctaaccaatctgacgggagcaacgggggcattgaagatctacctccgttatctggaaaatgaaacgccattggtactgaataatcgtccaccggaagacattgtggatatgtcagtcaacgaagatggcagtttcaactgtactggtaatggcatcaggatgttgccggtctggacagatgatccgcagagtttatgccagcaatctacgccgcagccggttgaggataacaaagaagaagcaccgggctggctacaggagatgtttaatcagtaa

SEQ ID NO: 3152 - DNA, 2466 bp, Xenorhabdus bovienii
  Coding sequence Name=Xb4151_4152.C437.gene149.dna; Position on contig= 94468..96933bp; Strand=-
ttgttattaccaatttatgacgttttggactctgttataactaagttgaaaacgtcgaaacaggtattgttgcatgcacccacaggggcaggaaaatcgaccggattgccattggcgatcctgaataaagctcaactgacagggcgcattattatgctggaacctcggcgccttgcagcgcgcagtgtcgcagagcgtcttgccgaacaattgaatgagcctgttggcgtgacggtaggttatcggatgagggcggaaaccaaagtcagtgcctctacacgccttgaagttgtcactgagggtattttgacccgaatgctacaacaagatcctgaattaagcgatgtttctctggttattcttgatgaattccatgagcggagtttacaggccgatctcgcgttggcgctgttgctggatgtacaggaaggtctgcgtgaagatctgcgtattctggtgatgtccgcgacactggacaatcaacgtctttcttctttattacctgatgcgcccgtgattgtttcagaaggtcgtcgctatccggtagcacgatcttatcatccgttgccgattcatcagcattttgaacaatcagtggcttcggcagtgttgcgtttattgcagcaggaaacgggatcattgttactgtttctgcccggcgcgggtgaaatccagcgtgtgttggcgcaacttgaacaaaaaatcaacgacgatactttattgtgcccactgtacggcgcgttgtcgttatccgatcaacggaaggcaatagcacccgcgccagcaggaatgcgcaaggtcgtgctggccaccaatattgcggaaaccagcctgacgattgaaggtatccggttggtggtggatagcggtcttgaacgtaccagccgctttgagccgaagagtggcctgacccgactgatgacccaacgtatcagccaggcgtcaatggtacaacgggctgggcgggcaggaaggctggaagaaggtgtctgctggcatttattcagtcgcgagcaggcggaacgagccacggaatacagtgagccggaaattctgcattcagatctgagcagcctgctactttcactattacagtggggatgtcgtgacagtaatcagttgaactggctggacagtccaccacagcccgcgcttgcagtggctcaatcgctgctgctgcgattggggacgctggatgataatcaacaattgactgcccgtggctggcaaatggcggaagcgggcagtgaaccgcgtctggcggctatgttatgtgcaggcaaagagcagagtgatgaggcgctggtaacggcagcaaaactggtagcgatcttggaagagcctccccgcagtggactgccggatctcactcattggataaattcaaaccaacctcattggcagcagcgcactaatcagcttatcaggaatcttgcgagcaagactgcaaaaataggatctaaaaaaatcagcacagaaaagattaatgctgcatttgtacccgaactattagtacagggatttcctgatcggattgctaaaaaccgtgataatcttgggcgttttcagatagccaatggtttgggtgtggcactggaaccgggtgatccgctgtcaggagagcagtggctgatagcgcctacattgcagcaaaacagtaaaaaccccgatgccagagtcttgctcgcttgcccgctgaacatcgaacacattattcatcaatatccgagcctgtttacagaacagacagccgtagagtgggatgatagtaagggcactctgcgagcatggaaacgtctgcaatgcgggcgtttgactgtcaaagcgcagcttttagcaaaaccttctcaggcggaattacaggaatccctgctgaactggattcgacaggaaggattggcggcgttgaattggtcgccggaagcattgcagttgcgcatccggctgcaaagggcaacagaatggctatctgaaattgagtggcctgcggtggatgatgacaatctgctggattccctcgagcaatggtttctgcctatgttggcgggagtgggggatttgaagggattacgtcaggttgagctgtcgtgtgctcttttggctctgcttgattggcagcaacggcaaatactggataatgaattgcctactaattacactgtgccgaccggaagtaggattaccatccaatatttccacgataaaccgcccttgctgtcagtcagaatgcaagaaatgtatggagaacagcagaatccggtattggcgaaggggcgggttcctgtggtcgttgaactgttatctccggcgcatcgtccactacagattacacaagatctcgcggcattctggcagggggcttatcgtgaggtgcaaaaagagatgaagggacgttatcccaaacatttatggccagacgatcctgctaacacagcgccgacaaggcgtgtaaaaaaatatatatga

SEQ ID NO: 3153 - DNA, 711 bp, Xenorhabdus bovienii
  Coding sequence Name=Xb4151_4152.C437.gene150.dna; Position on contig= 97037..97747bp; Strand=+
atggaattttcgcctcccctgaagtcagcgaccctaatccgtcgctataagcgctttcttgccgatatcctcaccccagaaggcgaaacgttgaccatacactgtgctaataccggagcaatgacaggatgcgcgataccgggagataccgtgtggtattccacatcagacaatcccaaacgtaagtatccgaatagctgggagctgactcagacccaaaatgggcatttgatttgtgtcaatacactcagagccaacgaattggtctatcaatccattgaaaaaaatgcaatttcagaattatctgactatgaacaaatccgccgtgaagtggtctatggaaaagagaaaagtcggatagatttattgttacagtcaaaacagagagttaattgctatattgaagtcaaatcggtgacattgttgcaggaaaataagggttattttccggacacagtgacaattcgagggcaaaaacatttacgtgagctatcattgatagcacaacaggggcagcgtgctgttctgttctttgctgttttacattctgggattagtcaggttacggcagcaaaacatattgaccatgattatgcatgtcttttggaacaagcatgcaattcaggggtcgaagtagtctgttacggggccagtatgacaaaagacaggatggttctaaatcgcaaattaccttttttatcaataggataa

SEQ ID NO: 3154 - DNA, 168 bp, Xenorhabdus bovienii
  Coding sequence Name=Xb4151_4152.C437.gene151.dna; Position on contig= 97678..97845bp; Strand=-
ttgttcctgccattagttttgcaatggtgtgaaggctaccgtgtttactgcctaaatatgttgcaaaacttgcctcatcagtatgttctgtttacaaattatcctattgataaaaaaggtaatttgcgatttagaaccatcctgtcttttgtcatactggccccgtaa

SEQ ID NO: 3155 - DNA, 126 bp, Xenorhabdus bovienii
  Coding sequence Name=Xb4151_4152.C437.gene152.dna; Position on contig= 97868..97993bp; Strand=-
atggcgagaatgcttaaggacgaggttttacgtttttgcccttcttgcataatgcttctccttacacacgcactatcaaacgacccccccaacaatggagggaaaaaaataggccgctataaatag

SEQ ID NO: 3156 - DNA, 456 bp, Xenorhabdus bovienii
  Coding sequence Name=Xb4151_4152.C437.gene153.dna; Position on contig= 97944..98399bp; Strand=+
atgcaagaagggcaaaaacgtaaaacctcgtccttaagcattctcgccatcgctggggtagaagcttaccaagaaaagccaggcgaagaatacatgaacgatgcccagttaacgcatttcaagctgattctggaagcatggcgcaatcaactcagggatgaagtagaccgtactgtatctcatatgcaagatgaggcagcgaacttccctgatccagttgaccgtgcggcgcaagaagaagaattcagtcttgaactacgtaatcgggatcgtgaacgtaagttgatcaaaaagatcgaaaaaacgctgaaaaaagtcgaagatgacgatttcggctattgtgagtcctgtggggttgaaatcggcatccgccgtttagaagctcgcccgacagctgacttatgtattgactgtaaaacgttggccgaaattcgcgaaaagcaaatggctggctga

SEQ ID NO: 3157 - DNA, 921 bp, Xenorhabdus bovienii
  Coding sequence Name=Xb4151_4152.C437.gene154.dna; Position on contig= 98435..99355bp; Strand=+
atgctcccttatattgctcctgatatgactcaatctgaacattccgcattatatatcgggcgtttcgctccgtccccttccggtgatctccacttcggttccctagtaactgctctcggcagttacctacaggcgcatgcctgccatggcaaatggctggtgcgcattgatgacatagatcccccaagagaagttcccggatccgccagccggatattgcagtcccttgagcattatggtctttgctgggatggtgaggtgctgtatcaatcccagcgccatgaaacctatcgggcaatactcgctcagttgcaacaacagggaaacagctattactgcacctgtacccgccagcgcattcaacaattgggcgggttttatgacgatcattgccggcatttacatttgcttgctgacaatgctgctgttcgcttgaaacaacgccatccaatttatggctttcacgataaattgcagggttacatcactgttcctgctaaaatggcagaagaagacttcaccatttatcgcaaagacggtttattcgcttataatcttgtcgttgttgttgatgataaccatcaaggcgtgactgaaattgtcagaggagcggatttgattaaacccacggttcgccagctatcactgtatcagaacctgaattttgcgattccagattatgtgcatttacccctcgttctcaatcaagagggaaataagctctctaagcaaaatcatgcccagccgatcccattggatgatccacggccattacttattgatgcgttatcatttttgaaccaacccaccattgcaggctggcaagatctcacgacagatcaggtgctgcggcaagctatcgtcggttggaatataaaccctgttccgcagaaaaacataacctatcgccaattcaaataa

SEQ ID NO: 3158 - DNA, 1512 bp, Xenorhabdus bovienii
  Coding sequence Name=Xb4151_4152.C437.gene155.dna; Position on contig= 99496..101007bp; Strand=+
atgatccgcgaaaacaaaacaaaacgcgacacacaggcagccagtgaaaggccagtcaccgtatctgaccatactgctcaaatagagagcagaactctgcctaaacatcgcagagaacatcactcatcttcatcaaatgctgataacgccgcaatgaagaaaaaatccgtaaaggctaagccttctacccccccgatcacggtgctccctcgggatcagcacccaatttcacgtaaagacatcagtgacaatgccctgaaggttttgtatcgcctgaataaatcaggttttcaagcctatctggtcggtggtggtgttcgtgatttattgctgcacaaaaaacccaaagatttcgatatcgcaacgaatgccacaccagagcaggtacgcaaactcttccgtaactgtcggcttgtgggtcgccgtttccgccttgctcatattatgtttgggccagatgtgattgaagtcgccactttccgtgggtcacacgagcaagttgaatccaatgaccggaatcagtcacaaaaagcgcaaagcggaatgttgctgcgcgataatatcttcggttcggtcgaagaagatgccgttcgccgcgatttcaccatcaatagcctctattatggcattgaagatttcgccttgcgggattatgtcggcggaatggctgacctgcaagctgggatcattcgcctgattggtgatccggaaacccgttaccgtgaagatcctgtccgtatgctgcgcgcagtccgttttgccagcaaacttgacatgaccatcgagaaaaccactgccgaaccgatcccgcagcttgcctttctgttgaaggatattccctccgcacgcttgttcgaagaatccctgaaactattacagtcggggcatggctacagcacctataaactgctgcgcgagtacaatctgttccaactgctattcccgatgatgcagcgcggtttcactccaaacagtgactcaccgctggaaaaactactggaacaggtgctgaaaaataccgattatcggctccagaacgacaaacgtgtcaatccggccttcttattcgcggccatgttgtggtatccgttgattgaacatgcagagaaactgtctcaggaaggtggtttaccgtattacgatgcctttgctctcgcaatgaatgacattcttgatgagcagtgcggttctattgccattccgaagcgccataccacgaccatgcgtgacatttggttattgcagcttcgtctgccacgccgtcagggaaaacgcgcgaataagctgatggagcatccgaagttccgagctgcgtatgatttattggaattacgcgccagcgttgaaccacgacatgaactgaaagagttggtactgtggtggtcagaattccaacaggcgacagcgcctcaacagcgtggcatgatatcagaactgggcaccgaccccgttcgtcgcagaacacgtccccgccgtagcagccggcctcgtcagttcaaggacaacggttga

SEQ ID NO: 3159 - DNA, 483 bp, Xenorhabdus bovienii
  Coding sequence Name=Xb4151_4152.C437.gene156.dna; Position on contig= 101009..101491bp; Strand=+
atggcacgggtttacatcgccattggcagtaatctggctgatcccttgcagcaagtcgataatgcacttgctgccctgcatgtgatccctgacacaagctttgttatgcgatcctctttttatcgtagcaaaccgatggggccacaagatcagcctgattacctcaaccttgccgttgcactggaaaccaagctgcaaccagaagcattgctcgatcacactcaagccattgagctggcacaagggcgtatccgcaaagatgagcgctgggggccgagaacactcgatctggatatcatgctgtttggcgattgcattattaagactgagcgcctgactgttccccattacggcttaaaacagcgcgagtttatgctttatccgcttgcagaaattgcgccggatcttgtattcccagatggagaaacactggcagcacgattaaaacatgttccagaaaatggcctgacgttttggttgtag

SEQ ID NO: 3160 - DNA, 120 bp, Xenorhabdus bovienii
  Coding sequence Name=Xb4151_4152.C437.gene157.dna; Position on contig= 101482..101601bp; Strand=+
ttggttgtagcacggatagccggatttatcgttgtaacacgccgttttatgaaggaaaagttattcaatatctcatacagccgtggccgatttttggataatcagggcctgtcccattga

SEQ ID NO: 3161 - DNA, 792 bp, Xenorhabdus bovienii
  Coding sequence Name=Xb4151_4152.C437.gene158.dna; Position on contig= 101654..102445bp; Strand=+
atgaaaccaacaaccctgactgatctgagtcagttaaaaaaagagaaacgcaagttcgctacaatcacagcttacgatgccagttttgcccacctttttgccgaacaaggcatcaacgtcatgcttatcggcgattcactcggcatgactttacaaggacttgactcgaccttacctgtcacggttgaagatattgcctaccacacccgctgcgtccgtgctggtgcccctcactctttcctgatctcagacatgcctttcatgagttacgccactccagagcagagttttagcagtgctgcgacattgatgcgttccggggctaatatggtaaaaattgaaggcggaagctggctgtgtgaggcggtcaatatgctgaccgagcgtgccgtgccagtgtgtggtcatttggggctgacgccgcaatcagtcaatattttcggtggctataaagtgcagggtcgtgatgaaacttccgcccaacaattgcttaacgatgcgatagctttggaaaaagcaggtatgcagctactggtgctggagtgtgtgccgacagcattaggccagcgagtgagcgaagcgctggaaattccggtcattggtattggcgcgggcaatctcactgacggtcagattctggtcatgcacgatgccttaggcatcaccgccagaccacctaaatttgccaaagatttcctcaaagaaaccggcaacatacgggatgccatccgcctgtatatcgagcaggtagaaagtggtgcctatcccggtcaagcacattcattcaaataa

SEQ ID NO: 3162 - DNA, 858 bp, Xenorhabdus bovienii
  Coding sequence Name=Xb4151_4152.C437.gene159.dna; Position on contig= 102485..103342bp; Strand=+
atgctgattatagaaacaatccccattttacgccgtgaaatccgccgctggcatcaggcaggcaaacgtattgcctttgtaccaactatgggtaatctgcatgatggccatatgtcattggtggacaccgccagagcacaggctgacgtagttatcgtcagtatttttgtcaatcccatgcagtttgaacatgaagatgatttggtcaattatccacgaaccctacaggaagactgcgaaaaactgagccatcgcaaggtcgaactggtctttgctcccaatgcaaatgaaatgtatccgaatggctctaacagcagccagactttcgtcgaagtaccagatctttcttatctgcttgaaggtgctaaccgtccggggcatttccgtggtgtcaccaccgttgtcagcaaactgttcaatctgattcaacccgatctcgtttatttcggagaaaaagatttccagcaagtgcagattatccgcaagatcattgctgatatggcttacgatattacgttggtttccgttcccatcgtccgtgaaaaaagtgggttggcactgagttcccgcaataatcttttatcggctgaagagaaaaaaattgctccggtattacatcagatcatgcagtgtattgcagaaaagctgacgcatggagaacgagcgaccgaacagttgctcgaactggcatcgacacatttgcgtgaagaaggctttatgccggatgagttatttatccgtgatgcagaaaacttgactcctctgacgttgcaaagtaaaaaagccgtgatcctaatggcagcctggttagggcaagtacgcttaattgacaatcagcaagtcgatttggttggctga

SEQ ID NO: 3163 - DNA, 99 bp, Xenorhabdus bovienii
  Coding sequence Name=Xb4151_4152.C437.gene160.dna; Position on contig= 103307..103405bp; Strand=-
atggcctcagggatatgtgcatcatgttacggctccactaacacacacatcccttcactaaaatcagccaaccaaatcgacttgctgattgtcaattaa

SEQ ID NO: 3164 - DNA, 102 bp, Xenorhabdus bovienii
  Coding sequence Name=Xb4151_4152.C437.gene161.dna; Position on contig= 103381..103482bp; Strand=+
atgatgcacatatccctgaggccatggcttcaatttactgataatggtgaaggtttaaataatacccacactcacaccgtgagtaaaaaaataaaattttaa

SEQ ID NO: 3165 - DNA, 471 bp, Xenorhabdus bovienii
  Coding sequence Name=Xb4151_4152.C437.gene162.dna; Position on contig= 103479..103949bp; Strand=-
atgcttaatatgatagttcatatgaatactgctggttctggagttattcgcccctcaacttatgagattatgaaagattatttgttttctgaatttaaaatgggaacttatgaagctgaattgaaaagtgaatctattttaaatcacgatgtttataataattgtgaaccagaagatgtggtattgtttacaagtgctacagatgcatggattaatattattaggatgttacgtgttaaagaaaattcggaagtatgggttagtgattcagaatatgcagccaatataatatatttctcatttttatccaataaatataatgtaaaactacgacgagttccgtcaactttaaactttactcctgatttagaatggatgaaaaataatttatctgataatgtttctatttgtggtttcaataattcattaaaaataaggattgatgatagtaatttcaacaatgaaaattaa

SEQ ID NO: 3166 - DNA, 1221 bp, Xenorhabdus bovienii
  Coding sequence Name=Xb4151_4152.C437.gene163.dna; Position on contig= 103942..105162bp; Strand=-
atgtttgatacaatagcaactatccgcggattgaacgtaaaacttcgatctctgttttttgtaactctttcattcagaatggggaccatggggttcccgttttttgctgcttatcttatacaggaaaaatcattaaatgcaattcaggcaggtgtattagttggtgtttttggtgcaggagctctactttgtgatgttattataggatatttcattaaaaattttggctctaataaagttattgtgttctcattgttatttacatcaattatattatttcttattccttttttggattattattacacaataattgcattttctttcctgtggggaattagttacgaatcttttactccagcagcatactctgaaactgttacacattcagattcttcttcgaggaagattgcattttcatgtaatagacttgctataaatataggtatggctattgggcctcttgtaggaggcattatattttctgttcatcctatacttgttttttttgttaattctatttttacttttttctcgcttattttttatcttttatccatgaaatctaaagaaaatattaataactctcttggcagtcttgatggaaatgattgcataaaaaaagaatgtgaagttatagaggataaaaaatatcattatccaagattgattgttattctttcttcagttttgcctgtgcatattgcatatgcacttcctccgacatttctttctgcatatatcattaactatacatcatttccaagttattttgtcggtgttattttctttgttaatgcttttttagttattttatttgagcttcctattaataaaaaaatgaataatgtaaacagtaggctttcattaattctggggcttttattagcgggaggaggattttcattaatgattgatattaatagtgctattattcttataatggctaccatattatggtctttgggagagatgataatatttccatctataacacactatgttagtggtatttcttccagtgaaaatgttgatagaaatctaggcttttattctgctggggtaaatataggagtgatgataacaccttctattgctttttatatgatggaaaatgaatttatttctccatggttgtttgttggatttgttttattatttatttctgcttttttggtatgtataaagaaaagtaaaactttatggaagaataatgcttaa

SEQ ID NO: 3167 - DNA, 471 bp, Xenorhabdus bovienii
  Coding sequence Name=Xb4151_4152.C437.gene164.dna; Position on contig= 105155..105625bp; Strand=-
atgaatggtccagctcatgcggaaattatattgactaatgaaggccctgtgttggtagaagtaggagctcgtctaaatggaaatatggaacctgattttcatgatattgtattaggtaataaccaggcgagaatcacttatatttcttattgctcacctgatagatttattaaaaatttttccgggaaaaaatatagtaaattaaaagaggcatgtgttttaaatacatcaacgaaacttgatggagtaatatcagctattaatgaaaaaatagtgaatgaaataaaagagttgaacacggtttttaaattaagtgtaaaatatggcattggtagaaagataactccaaccatagatcttctatcaagccccctaagaatatttattttttctgatgagataactgctatagaaagtgattgtaaaaatattgattctattaaagatggagtatatgagttaaatgtttga

SEQ ID NO: 3168 - DNA, 99 bp, Xenorhabdus bovienii
  Coding sequence Name=Xb4151_4152.C437.gene165.dna; Position on contig= 105853..105951bp; Strand=-
atgcatcgcttggcagagcatcctgaaaatatttatcaagcgtttgatgatctttatttaataaataaaaacaaagagttatatagccatcattattaa

SEQ ID NO: 3169 - DNA, 123 bp, Xenorhabdus bovienii
  Coding sequence Name=Xb4151_4152.C437.gene166.dna; Position on contig= 106237..106359bp; Strand=+
atgtgcattattttaaaaatgggtacagaggaaacttttacctactcctcctttctggttggcaaaactgattatttttgccatacccacctcaatccaaattttcgactgtttttcttatag

SEQ ID NO: 3170 - DNA, 165 bp, Xenorhabdus bovienii
  Coding sequence Name=Xb4151_4152.C437.gene167.dna; Position on contig= 106385..106549bp; Strand=-
atgactatatcaggttgtcaaaaaaacaccaaaatgcgactagcagtttttttgagccgaacccacctcccggtaataccctttgtaagggatagtggctcaaggccgcaggtttttggtggcatcttacgtgaaggtgatggacggctgtcctttaccgtgtga

SEQ ID NO: 3171 - DNA, 381 bp, Xenorhabdus bovienii
  Coding sequence Name=Xb4151_4152.C437.gene168.dna; Position on contig= 106610..106990bp; Strand=+
atgttacgcaccatgctacaggggaaactacatcgagtaaaagtgacgcaggccgatcttcattacgaaggttcctgtgccatcgatcaaaattttatggatgcagccggcattctggaatatgaagcgattgatatttataacgttgataatggagaacgattctcaacttatgcaattgccgctgaacgtggttccagaatcatctccgtaaacggtgccgcagcacgtcgggcggcggtaggcgataagctgattatttgttcatatgtccaaattgctgatgagctgactaaatttcacaaacccaaagtagcttattttgacggtgataatgtgatgagccggctggcaaaagcggttcccgttcaggttgcataa

SEQ ID NO: 3172 - DNA, 114 bp, Xenorhabdus bovienii
  Coding sequence Name=Xb4151_4152.C437.gene169.dna; Position on contig= 106983..107096bp; Strand=+
ttgcataaccgttcccaccaacgaccgactcactattgcgccactccgccgttgtttacggcggagcgttatatttacaaattcttgtttttaggttctcagccctcgccctga

SEQ ID NO: 3173 - DNA, 771 bp, Xenorhabdus bovienii
  Coding sequence Name=Xb4151_4152.C437.gene170.dna; Position on contig= 107073..107843bp; Strand=-
atgattcaactgtactgggtagcgctaaaaaccctctggatgaaagaaataacccgctttggtcgtatttgggtacaaaccttattgcctccggtgatcacgatgtccctctatttcgtcatattcggcaatctggttggttcccgtattggtgagatgggtggattcagttacatgcagttcattgttccagggctgattatgatgtctgtgatcaccaactcatatgctaacgtttcctcctccttctttggtgctaaatttcaggggagcattgaagaagtgctggtcgctcccgtgccaacccatatcattattgctggatttgttggcggtggggttgcccgtggagtatgcgttggtattttggtgacactggtttcccaattattcgtacctgtgcagatccactcatggagtatggtggtgatcaccttgctgacaacatccatagtgttttctctggcagggttattgaatgccatttatgcaaaaacgttcgatgacatcagcatcattccgacttttgttctgacgcctttgacttatttgggcggtgtattctattccctgaccctgctgcctgaattctggcagctagtatccaaactcaacccgatcgtttacatgatcagcggcttccgctacggttttcttggtattactgatgtttctctgacgatgacgttaggtatgctcggtatatttatctttgttttttatctgttggcttggtatttgatcgagtcagggcgagggctgagaacctaa

SEQ ID NO: 3174 - DNA, 927 bp, Xenorhabdus bovienii
  Coding sequence Name=Xb4151_4152.C437.gene171.dna; Position on contig= 107840..108766bp; Strand=-
atggcttatgcattggaattgactcagcttacgaaaacctatgcaggtggtgtgaaggcgttgcgtgggattgatttacgtgtcgaagaaggcgatttctacgccctgttgggaccgaatggtgcagggaaatcgactactattggtatcattagttctttagtcaataagagcagcggtaagatcaaagtgtttggttacgatattgacacggatctcgtcaatgctaaacggcaactggggcttgttccgcaggagtttaatttcaacccatttgaaactgtgattcagattgtactgaatcaggcgggatattacggcgtaccccgcaatgtagcgtatagcagagcagaaacctatctgtcccaactggatctatgggaaaaacgtaacgaacgggcgaatcggctgtcaggaggaatgaagcgccgcctgatgattgtccgtgctctgatgcaccagccgaagttgctgatccttgatgagccgacggcgggggtcgatattgaactgagacgctccatgtgggagtttctgaaggctttgaatgcgcagggaaccaccatcatcttgactactcactatctggaagaggctgaaatgctttgccgtaatatcggcattattcaatatggcgaactggtggaaaataccagtatgaaagatctactcagccaattagaacgcgaaacgtttttgctcgacttaacgcccagaggtgtgatgcctgtcgttgagggttatgattatcgtctggtcgatgcggtaacgctggaagtggatgtcaagcgtggtcagggattgaatgatctgttttcccaactgagcatgcagggtattcaaatcagcagtatgcgcaacaaagcgaatcgtctggaagagctgtttgttgggttgaccaataataatcaaggagcgaatcaatga

SEQ ID NO: 3175 - DNA, 180 bp, Xenorhabdus bovienii
  Coding sequence Name=Xb4151_4152.C437.gene172.dna; Position on contig= 108693..108872bp; Strand=-
atgtttttttatttgatccctatcgttgcaaagaaaggcagaaaaaataatggcataatttgcatcttgcactcaaagatagcaaagaataaaggtgtttttacttatggcttatgcattggaattgactcagcttacgaaaacctatgcaggtggtgtgaaggcgttgcgtgggattga

SEQ ID NO: 3176 - DNA, 654 bp, Xenorhabdus bovienii
  Coding sequence Name=Xb4151_4152.C437.gene173.dna; Position on contig= 108948..109601bp; Strand=+
atgatgagaaaaattgaagaattgtttgccaggaacaagcagtggtcgcaatccgtaaacgaagaaaatcctcacttcttcaaggaattgtcaaaagtacaaaaaccccattttctgtggataggttgttctgatagccgagtgcctgctgaaaaactgattgacgctgcacccggcgatctttttgttcaccgaaacgtcgctaatctggttatccatactgatttaaactgcttatctgtagttcaatacgccgttgatgtgttacaggttgagcacataatcatctgtggtcactacggctgcggaggcatagaagcggcggtagatggcactgaattaggcttaatcaataactggctgctccacattcgggacttgtggtacaaacacagctccatgctcggcgagttgccgcctaacgatcgactgaatcgtttatgtgagttgaacgtcattgagcaggtttataatctcggccactccaccattatgcaagcagcatggaaacgtgggcagaaagtcatgatccacggttgggtctatggcttgaaagatggcgaactgcatgatttagatgttaccgctgacagccgtgaaaaactggaactcaattaccgtcaggccatttccaagctggcacataagaaataa

SEQ ID NO: 3177 - DNA, 546 bp, Xenorhabdus bovienii
  Coding sequence Name=Xb4151_4152.C437.gene174.dna; Position on contig= 109678..110223bp; Strand=-
atgagtaaaccaaaacatattgtagaagtgatgatctccgaacaagagattaaacaacgtattgctgaattggggcaacagattacagaacactatcgcaatagcgaccgtgaactggtgctggttggtttgttgagggggtcatttatcttcatggcagacctgtgccgtgaagttcaggttccccacgaagtggattttatgactgcgtccagttatggcaatgagatgaactctacccgcgatgtgaaaatccttaaggatttggatgaagatattcgtggcaaagatgtgttgatcgttgaagatattatcgactcaggcaatacactgaataagatccgtgagatttttgcgctccgtgaaccgaattctctggcgatttgtacgttactgaataaaccctcccgccgtgaagtcgatgtgccggttgagtggattggctattcgattgaagacaaattcgtggtcggttatggcattgattatgctcagcattaccgccacttgccttacattgggcatgttactctgctggaagagtaa

SEQ ID NO: 3178 - DNA, 123 bp, Xenorhabdus bovienii
  Coding sequence Name=Xb4151_4152.C437.gene175.dna; Position on contig= 110260..110382bp; Strand=+
atgtgtctttttacgaaaagtgatacaccgattgatataccgtcaccacacaaagacgcacacacaaaaaacatgagaacaaaatattttgcaaagcatatcagaattcaccacctacagtaa

SEQ ID NO: 3179 - DNA, 105 bp, Xenorhabdus bovienii
  Coding sequence Name=Xb4151_4152.C437.gene176.dna; Position on contig= 110459..110563bp; Strand=+
gtgataggaggttgcgacgcatttcgtcggatggtattaaagattacggtgacggataaccaattgtgctacctcaccaaaataaataacgccatgaataattaa

SEQ ID NO: 3180 - DNA, 291 bp, Xenorhabdus bovienii
  Coding sequence Name=Xb4151_4152.C437.gene177.dna; Position on contig= 110532..110822bp; Strand=-
gtgcccgatattgatgccgtcgtcgccagtctgaccaatgtaaaacctgttcgattgttgtcctttccgctgaccgtgttttccagtcagcggaagtcagggtatcgggactccagccagactcttagacgacgctcacccagtgacagggcacgccggcatcccatgtgcgttccagcaaatattgaatgtcatcgggggtactttctcccattcattcagccagttgccagctattcttacataatagccacaaaatttaattattcatggcgttatttattttggtga

SEQ ID NO: 3181 - DNA, 156 bp, Xenorhabdus bovienii
  Coding sequence Name=Xb4151_4152.C437.gene178.dna; Position on contig= 110827..110982bp; Strand=+
atgtcactgtcgtcgccgggaagatcattggcttacagagcaattacggctgtagtactaattaggtatgataaagaatcaacggaagtttataaccatttagctacaccgccgtggcgagaacatgcacctttatgggttttgctcttactatag

SEQ ID NO: 3182 - DNA, 417 bp, Xenorhabdus bovienii
  Coding sequence Name=Xb4151_4152.C437.gene179.dna; Position on contig= 110916..111332bp; Strand=-
atgaaatcattcaaagctatactccaaactgcaagagttggtttcgggttaaggcactctaatcagaggacatatatgatgaaaagcttaaagttatcagttgcggcattactggtgttgttttcgagtacagcacttgcagtgccggcagtatcactcgaacacgcttcaaaaacagccaccgcggtagaacataatgtcaaaacggctaaagacaacgttagttcattagaaaagaaagtcaccaaaggatcaaaaaaccaaaaagcgtcacagaaaaacaacagtaataaatcaaaagctggaagcacaaagcaaggggctaatagcgctctttgtaaagacggaacctatagtaagagcaaaacccataaaggtgcatgttctcgccacggcggtgtagctaaatggttataa

SEQ ID NO: 3183 - DNA, 147 bp, Xenorhabdus bovienii
  Coding sequence Name=Xb4151_4152.C437.gene180.dna; Position on contig= 111502..111648bp; Strand=+
ttgctgtatctgaatcaatggcacttcagacaggggcatggttgcactgagcggcacagatggcgttatttaaccactcaccctatccccaaaatcgccgcctcaggcgcttccccattaactaacttcgccgttgcaccatcataa

SEQ ID NO: 3184 - DNA, 885 bp, Xenorhabdus bovienii
  Coding sequence Name=Xb4151_4152.C437.gene181.dna; Position on contig= 111579..112463bp; Strand=-
gtgttttatcgattggggattttggcgttgtcgcgttatttggcaacgaagatttccgcaccttgcctttctatctttatcagcaaatcggggcatatcgcagtcaagacggtgcagtcaccgcattcctgctgctgcttctctgttttatcttgttcagtgtgcttgaacgcttaccgggccgacgccatgattaaactcgaaaatgtcatttatacctacgagcaccttgccatgcatttccatgtcaatattgaggcaggcgaacgtattgcaatcctcggccccagcggagcgggtaaaagtacgctgttaagtttaatggcggggttccaatccgcagaaagtggcgatatctggttaaatgatgaaaatcatgcccatacctcgccttccaaacggccagtctcaatgttgtttcaggaaaataatctgttttcccacttaaccattgaacaaaatatcggtctggggttacatcccggcttacggctaacgggtgagcaacaaaagacgctacagcaaattgctgcccaagtatcactgcaagattatcttaaccgcctgccagctcagctttccggcggccagcgccaacgcgcagcactggcacgctgtctggtacgccagcaacctatattattgctcgatgaaccattttcagcacttgatcctgctttacgcaatgagatgttggagttactgacacaagtttgtgatacgcgccagctcactttaatgatggtatcccataatcttgatgatgccgccaaaatagcaccgcgttctttacttattgtggatggacggatttattatgatggtgcaacggcgaagttagttaatggggaagcgcctgaggcggcgattttggggatagggtga

SEQ ID NO: 3185 - DNA, 1605 bp, Xenorhabdus bovienii
  Coding sequence Name=Xb4151_4152.C437.gene182.dna; Position on contig= 112267..113871bp; Strand=-
atggcaaagcgccgtaagccgttaattgcgggttggttattgccgggggtgattgcctccggcctgttacttgtggttgctctgtcagcatttggagcgctttggttcaatgcgccggaaaaccactggcaagggttcttaagtgacagttacttgtggcatgtcattcgattcactttttggcaggcttttctgtctgccgtgttatcggtgacgccagcgattttcctcgccagagcgctttatcgccgtcgttttcccggcaggatgctgtttctgcgcttatgcgccatgacgttggtactccctgttttggttgccctctttggcatactgaccgtttacggccgagtcggctggttggcaaatatttcccaatggatgggtattgaataccgttttacgccttacgggctgcaagggattctactggcgcatatttttttcaatatgccaatggcagtccggttactgctccaatcgctggaaaatattgcggtagagcagcggcaactcgcagcgcagcttggcatgaatgagtggcaacattttcgttttgtagaatggccttatctgcgccgccaaattctgccgaccggtgcactgatattcatgctgtgctttgccagttttgccaccgtgctcgcactgggaggtggccccgcagcaactaccatagagctagccatttatcaggcactcaactatgactacgatctcggccatgctgccctgcttgcgcttatccaactattttgctgtcttggtctggtgttggtcagccaaaaactcaaaggcacactcgttgtcggttacggtcaccagcaaaaatggcggaatccgcaggattcatggctgcaaaaaggctgtgatgggctattcattattattgcactactacttttgatcccaccattactggcagtcattgtggacggtctgaacggtgctgtacttaatgttctgcgccagccagctttgtggcaagcctttacgacttcagcggttatcgctctgggagcaggtttgctgtgtgtcatgctgactataatgctgttatggagtagccgtgaattacgcttgcgccactctccccgctggggacaggcaatggaaaccagcggtttattaatccttgccatgccgggtattgttcttgcgacaggcttttttattctgctgaacaccaccgttggcttgccacattctccttacggattagttatcttgaccaatggattaatggcgatcccatatgctctgaaagtattggataacccaatgcgtgatttggcggaacgttacaatcccctgtgccgttctcttaatattcaagggattcaccgactacgctggattgaacttaaggcactgaaaattcctttggctcaagcactggctttttcctgtgttttatcgattggggattttggcgttgtcgcgttatttggcaacgaagatttccgcaccttgcctttctatctttatcagcaaatcggggcatatcgcagtcaagacggtgcagtcaccgcattcctgctgctgcttctctgttttatcttgttcagtgtgcttgaacgcttaccgggccgacgccatgattaa

SEQ ID NO: 3186 - DNA, 1014 bp, Xenorhabdus bovienii
  Coding sequence Name=Xb4151_4152.C437.gene183.dna; Position on contig= 113847..114860bp; Strand=-
gtgtttaaaaacttattttccagatttatcacaatcagtacgctattgatttctgcatgtgtctttgctcaaacggcacagactaagcctacactgacagtttacacttatgattcatttgcttctgaatgggggccgggacctgccattaaaaaagcctttgaagcagagtgtaactgtgaactgaaactcgtcgccctggaagatggagtatccctgctgaaccgcgtgagaatggaaggcaaaaagacatcagcagacattgtgttagggctggataacaacttgattcaggctgcccagcagacagggttgtttacaccaagccatattgatacctcaaaactgaaattgcctgtcacatggaacagcaaaaccttcattccttacgattacggttactttgcctttgtttacaacaagaacaccttacctcaccctcccaaaagtatggatgaattaatcaacagtaaccagaactggaagattatttatcaagatccgcgcaccagcacccctggcctggggctgttactctggatgcaggatatttatggcgataaagcggtacaggaatggccgaaagttgccaaaaaaacgctgactgtcaccaaaggctggagtgaagcctatggattgttcctgaaaggtgaaggagatatggtactcagctataccacatcaccggcctatcacattctgtcagagaaaaaagataactatgcggctgccatattcagcgaaggccattacctgcaaattgaagtcgccgctcagttagtctcaagtaagcaacctaaactggcgcagaaattcatgcagttcatgatttcacctgccttccagcaagcaattccgacgactaactggatgtatccggttatcgacattcctctgcctgaggttttcaagcagctttctgtgcccgcaaaaccactgcaattcagcgcagatgatgtggccaaacatcgtaatcagtggatccgtacatggcaaagcgccgtaagccgttaa

SEQ ID NO: 3187 - DNA, 165 bp, Xenorhabdus bovienii
  Coding sequence Name=Xb4151_4152.C437.gene184.dna; Position on contig= 114914..115078bp; Strand=+
atggaaaatatttttatatcaatgattagcgtctcaaagtcctacgtcggtactagccggatcaggttcgacgggtttttctcagcaatacggttttacaacagcagcaccccgttgagatggcggtattgtagagacttccgctacggctgcaaagtccaatga

SEQ ID NO: 3188 - DNA, 531 bp, Xenorhabdus bovienii
  Coding sequence Name=Xb4151_4152.C437.gene185.dna; Position on contig= 115154..115684bp; Strand=+
gtgattgatgatgatggctaccgcccgaatgtaggaatcgtaatttgtaatcgccaagggcaggtcctttgggctcgccgttatgggcagcattcctggcagtttcctcaggggggtatcaatccaggggaatcaccagaacaagcgatgtatcgcgagttgttcgaagaagttggtttaaatcgcaaagatgtacgggttctcacatctacccgtagctggctgcgttacaaattacccaagcgtttggtgcgttgggatacaaagcccgtttgtattgggcagaagcagcgttggtttttattacagttgctttgtaatgaagccgatattaatgtgcagcgcagcaacgcacccgagtttgatggttggcgttgggtcagttattggtatcctgtcaggcaggtggtttcttttaaacgggatgtttatcgccgcgtaatgaaagaattctcttctattgtgatgccagtgcaggaatccgctccacagctacattcaccttatttacatcgtcgcagaagaagttag

SEQ ID NO: 3189 - DNA, 2247 bp, Xenorhabdus bovienii
  Coding sequence Name=Xb4151_4152.C437.gene186.dna; Position on contig= 115694..117940bp; Strand=+
atgctcatgcgcttacgggaaattgtcgaaaaggttgccatggcagctaatttgtctgaagcgcttgaactattggttaatgaaacctgtctggcaatgagcacggatgtctgttctatctatctggcagatcatcagcggcattgctattacttgatggctacccgaggcttaaagaagccagaggaacgagcgatcagcctggcctttgatgaaggtgtcgttggtgtagtcgggcgtttatctgaattaatcaacctcgccgatgtgcgagatcaccccagttttaaatatatcccccaagtaaaagaagaaggtctgcgggcttttttgggcgtaccgattgtttatcgtcgtcagttgcaaggtgtactggttgttcaacaaaatgaacggcggctattcgatgaaagtgaagagtcttttatggtcacgctggccatgcaattggcggttattctcgctcaggcacaaacaaaagggctatttggtcagtatcgtcagacacgcattaaggcgcttgccatttccagtggtatcgtcatggctcagggttggcaagatggttctcagccatcacttgaacaagtttttgaagcgtccacgctggaatatcaggcagaacgttctcggctgaccgaagcccttgagcaggcaaccgccgaatgtcgccgtatcagtaagcgttttacctccagctcacagaaagaaagtgccgctatttttgacctctattctcatttgctgaatgatcccaaactcaagcaggatctgtttttttccgtcgataacgggtttgtggcggagtgggcagttaaaagcgttgtcgaaaaatatgccgaacagtttgccagcttgcaagatccctatatgcgggagagagcttctgatttgcgggcgcttgggcagcgggtattgttccatctggatggttctttcacaggtgatagcgaatggccagagcgctttattctggttgccgatgaactcagtgccaatttactggctgaaatgccgcaggaacaactggctggtgtgattgtacgggatggtgcaactcactctcattccgcaatactggttcgggcgatgggaataccggctatcatgggagccgatatccagcctgaattactgcataatcggatgctaatccttgacggttatcgcggcgagttttttgttgaaccagaaccactgattattcaggaataccgacagattattgaagaagagcaggttctcagcgaattagccgagggggagctgaaacaaaaagcacaactcaaaaatggtgaaagagtgctggtgcagctcaacgcaggattaagcttaaaatacgagcaacagataggtggtagtattgatggtataggcctgtatcgtactgaaatcccttttatgctgcaccgtggttttccatcagaagatgagcagaaaaaccgttatcaagagatgttggcgcttctcccagataaaccggtggtactacgaacattggatattggtgccgataaacaactgccttatatgcccatcagtgaagaaaacccctgtcttggctggcgaggaattcgtatcacgctggatcagccggaaatattcctgattcagctcagagcgatgttgaaagccaatgtgctgattggtaacctgaaaatattgctgccgatgatcaccagtatcgaagaaattgatgaagccagaaagttgatcgatagggcgaaagctgaagttgaacagacaatcggcagtacgattaccatgccccagattggcattatggttgaagtaccctccaccattttcttgttgccgcagttgaagaaacggattaattttatctctattggcacgaatgacttaacccagtacctgcttgcagtggatcgcaataatacacacgttgccgctttgtatgacaatttgcaccctgcggtcattaaggccttgaaactggcttttgatgagagccagcgtgttggtcttcccgtgagtatatgtggagaaatggcgggtttgccgatgggagcgttaatcttaattggccttggttaccgtagcctgagcatgagtggccgaagcgttccacgcataaaatatttactgcgtcatttggataccaacgatcttgagctgcttatcaaagaaatattgaaagcagaaaccagccggcaggtgaaagccctgtctactgagtttatggaggccaatggtctcggtggtttggtgcggggggggatttag

SEQ ID NO: 3190 - DNA, 879 bp, Xenorhabdus bovienii
  Coding sequence Name=Xb4151_4152.C437.gene187.dna; Position on contig= 118082..118960bp; Strand=+
atgagcactagctatctggcatttcctaatattgaccctgtcatattctcaatcgggcctgtgtccctccactggtacggttttatgtatctggttggttttgtttttgccatgtggctggcaaatcgacgtgcagcaaaaccaaacagtggctggaataaaaatgaagtagagagcttgctttatacagggtttgtcggggtgttcgtcggtggacgcctcggctatgttctgttctacaatctcccaatgttccttgataatccgttgtatctgttcaaggtctgggatggaggcatgtctttccacggtggtctggtcggggttatatgtgccatgttgtggttcgcccgccgtactaaacgtcactttctacaggtttctgatttcgtcgctccattggttccctttggtttggggatgggacgtatcggtaactttatcaatggtgaattgtgggggcgtgttacgcttgatacaccgtgggcgatcttgttcccgagttctcgcagcgaagatatcgcgctcgcgacaaccgatccttctctatggccgattctggaaaagtatggtgtcctgcctcgccatccatcacaactgtatgaaatggtgctggaagggatagtgctgtttatcattcttaatttatttatccgtaaaccccgtccgatgggaagtatttcaggcctgttcctgattggttacggagccttccgcatcatcgtcgaatttttccgccaacctgatgcacagctcgggttgtttgaggggatcagtatggggcagatcctttccattccaatgattttagtaggaattttaatgataatctgggcttataaatgccagcgcaataacaagatacaagaggcaaaatga

SEQ ID NO: 3191 - DNA, 795 bp, Xenorhabdus bovienii
  Coding sequence Name=Xb4151_4152.C437.gene188.dna; Position on contig= 118957..119751bp; Strand=+
atgaaacagtatctggatttaatgaaaaaagtgcttgaagacggcacggcaaaagatgaccgtacaggtacgggaacactctcgatatttggtcatcagatgcgtttcaatttgcaagatggtttcccattggtgacaaccaaacgctgtcatattcgctccatcatccatgaactactgtggttcctgaatggtgataccaatacccaatatctgcgtgataataatgtgactatctgggatgaatgggcggacgaaaatggcgatctggggccagtttatggcaaacaatggcgtgcctggagctctgcggatggccgtcaaatcgatcaattggcaaaagtccttgaacagttgaaaagtgaccctgattcgcgtcggattattgtttctgcatggaacgtcggggagctggataaaatggcattagcgccctgccatgcttttttccagttctacgtagcggaggggaaactgtcctgccagctttaccagcgttcctgtgacgtctttctagggttgccattcaacattgcaagttatgctttactggttcatatgctggctcagcaatgtgatctggaagtgggcgattttgtctggacaggcggtgatacccatctttacagcaaccacttagaacagaccaaacttcagttgagtcgtgaaccacgaacgttacctaagttgatcatcaaacgcaagccagcgtcattatttgattatcggttcgaagactttgagattgtggattatgatccgcatccgggtattaaagccccagtcgcgatttaa

SEQ ID NO: 3192 - DNA, 147 bp, Xenorhabdus bovienii
  Coding sequence Name=Xb4151_4152.C437.gene189.dna; Position on contig= 119760..119906bp; Strand=-
ttgcgtatacattttatttgcggagcggtacgcagaaatagtaagtcgctattttttatattgagaacaaccgccgataaatgtaaaaagagcaggctgaacccgctctttaacaatttggtagatacccttcatcttttgagttga

SEQ ID NO: 3193 - DNA, 1038 bp, Xenorhabdus bovienii
  Coding sequence Name=Xb4151_4152.C437.gene190.dna; Position on contig= 119907..120944bp; Strand=-
atgaaaattaatctaacagatgcccaaaaagacgccctcgaattgatgcatgatacgactcgcgatggacgagtacgtgaccgcatcaaggccgtgcttttggcctcagaaggctggactgcccagatgattgctcaggctttgcggatccatgaaagtacggtgagccgccatctgaaagattacttctctgaggaaaaactcgcccctgaaaatgggggctctgaaagccgtttgtctgccgaacaaacaacagaattagttgagtatctgatggcaaatttgatgcacactaccgcacaaattgtggcctatgttcgggcacgatggcaggtgactttcactgtcgcaggaatgacgaaatggcttcaccgtcaaggtttcagctacaagaagccaatgggtgctccgcataaatttgatgcggataaacagcaacagtttattgaaacctacaacgcgctgaaagaagaatgtggccagaatgcgcctattttatttattgatgcggttcacccgaccctgtccacaaaattaagttatggctggatgaagagcgggcggaagcacgtcaaagtggttgaaaccacaggcagtcgtactcgactcaacatcatgggtgcccttaatttacaacggattgaagagactattgttcgtgaatatccgacgattaacgcgaaaaatgtcgtcctttttttcggctcaatccgggaaacctatccactttcgcaaaaaatccacattattctggatggtgcgggttatcaccgttccggagtcgtccaattttttgccgaggttttgaatattgagttgcactacctgccgccttacagccctaatctcaacccgattgagcgattatggaagtatgtgaatgagcaggtacgaaacaatgtctattttccggataccaaaacattccgtgaaacgctgcgccacttttttcatgtcacattgccagaaaaagcgaaagaactcaccactcggttgactgataacttccagattttaaaacccgcatcttcaagttaa

SEQ ID NO: 3194 - DNA, 225 bp, Xenorhabdus bovienii
  Coding sequence Name=Xb4151_4152.C437.gene191.dna; Position on contig= 120969..121193bp; Strand=+
atgaaaaatcaagcatcttcaatgacgacgggtatagaaaagcaatggatcgtgttaataaagcagtttcagtccaaaccactccaaattacgataatttcaataactgctgcttatctaatgcagctctctactcaaccaaaactaaaacccgccgtcgtctggaatcaggcgaggttactgctagagtgtgatattttctttattaaaataatcttgaattga

SEQ ID NO: 3195 - DNA, 162 bp, Xenorhabdus bovienii
  Coding sequence Name=Xb4151_4152.C437.gene192.dna; Position on contig= 121226..121387bp; Strand=+
atgaaaacttttatctttgccgcaatagagcgagctaataccgatcaacagctccctattaaaattaaatgtgttgctgaaagttatcaccaagcaaaagcgatgctatctggtgaatatatcacagcgtgggctggtcaaattattaatcacggaaattaa

SEQ ID NO: 3196 - DNA, 387 bp, Xenorhabdus bovienii
  Coding sequence Name=Xb4151_4152.C437.gene193.dna; Position on contig= 121390..121776bp; Strand=+
atgaacaataaactacaagcagccgtcgagattgcagaagaaattgaagcctcaatatttcccgtagtgactgcaattcaaaatgaagccgaaccggatacttatttaatgtgtcgtggtgtacatcgtcaaacgtgtgatttagcccaacggttaagggatattaataaggaatatattatggaaggtgtaattgatacatgttctaatttagatattgaactagagccagctaaaaatgcaatcgaaaaattaagatcactattgagcacaatgattgatgtccgtggagatgatgacgacgcaaatttacttcttattgcgatagatttagcctttgatgccggtaaagaaatagcacgagtcagaggagtggaatactcatga

SEQ ID NO: 3197 - DNA, 354 bp, Xenorhabdus bovienii
  Coding sequence Name=Xb4151_4152.C437.gene194.dna; Position on contig= 121773..122126bp; Strand=+
atgaatgacatccgaaaacacatttgcgttaatgaagaccgtttatctgaaatgaaagaagatgatttaaattatctaatctcatcaagtgaagatgtcatattcgcaatgacaaatggattattatccattggcaacttagcaagtgccgcagttcatagtgaagaatattcccaagatgatgccatgactgatctagaaagaatagcgcatctgttaactgtagtacctcttattatagaagcggaacacgaaaacaatattagtgcaggaattgagttaagagaaaggcaagcaattaaaaaagaaaagcaattaattcaattaataaggaattaccatgaaaatacttaa

SEQ ID NO: 3198 - DNA, 411 bp, Xenorhabdus bovienii
  Coding sequence Name=Xb4151_4152.C437.gene195.dna; Position on contig= 122113..122523bp; Strand=+
atgaaaatacttaaatccattgaaactgcaaccatccaagatatcaaaattgaactgcgtgaagtctatgtcgttcgtggtgctagcaagacttatctgagcgagaaaggtgcactgaataaactggcttatgttcgggcgcagaagcaattcaataaggaagacaggccaagtaacttccctgcccaagaggtcattcaggaagacggcacttctgcattacgcaagggaaagatgcgccctgagtttatggaacgacatgctcaagtactggaagaactgaaagctgatgttagacaggtaagagaaattgctcgacttaaaaaggaatgcaagaaagcaaaagagaaactcctaacagtcttggatgatttagaaaacgcagaaaataaatacaaaaattcaaaataa

SEQ ID NO: 3199 - DNA, 354 bp, Xenorhabdus bovienii
  Coding sequence Name=Xb4151_4152.C437.gene196.dna; Position on contig= 122596..122949bp; Strand=+
atgacaaaattaacgttgcttgaaagaaagcgaaaggcatttatacatgccaaattggacacattgcaaaagaagcacagttctcactctgtaatagtcaaagtggcagaaattaattaccgactggatttagacgaggagatattaaccatagcgttaattcgtttctttgaactcgacgcattggcatcaaaaaataaacaaaaggctgaacaacttcttatatcgacatacaacagcttttataccaagttcggaaatttaaccgcagaaggcaatgagtttatgaatgaaattctaaaactgattgcaaagaaaacggaacccataaatggagataacaatgaaaaatga

SEQ ID NO: 3200 - DNA, 345 bp, Xenorhabdus bovienii
  Coding sequence Name=Xb4151_4152.C437.gene197.dna; Position on contig= 122927..123271bp; Strand=+
atggagataacaatgaaaaatgaaacttatttagattttgctgaaacagccatccagaaagagaaagaagaaaagtacgaccttgcagctttatattggggaaaagccagaagtgtagccaccagctttaatactcaagcatggtctgaatatcgtcaggagcataacgaaaaaaggtattcattgcataacagctatagcgaagcaataagagatcaaaaagaaagtagaaaaatagcggcaataaacaaacgaacggcggaggtattggaaagtcatctcgaaaatcacgctgaaacaaataagtggaaacaaaagcttcaacaggcggcgaataatgattga

SEQ ID NO: 3201 - DNA, 189 bp, Xenorhabdus bovienii
  Coding sequence Name=Xb4151_4152.C437.gene198.dna; Position on contig= 123264..123452bp; Strand=+
atgattgaatatgaacaggcaacagaattagcgcagagtttagaactaaaaggcttattccgccgtgctgctgataaatggggtgaggcactttcattatcccgtaataaaaagcaagaacaggaatgcatcaagaataatttgcgctgtgttcgagaagcaaaaataactattagggaggggttgtaa

SEQ ID NO: 3202 - DNA, 219 bp, Xenorhabdus bovienii
  Coding sequence Name=Xb4151_4152.C437.gene199.dna; Position on contig= 123452..123670bp; Strand=+
atgacaaagcgaagaaataaaacccaacaaggttatgcgggaatgaccattcctcaaggactcagcttggaacgcaacgaggttgctgattataccaatgtatgtaagcacctctctaactttaaaagaatcggcgatcaaatcctgatgccattaaaccgaaaacagagacggttagccaaaaaattaaatattgaaattaccgaggtggaacaatga

SEQ ID NO: 3203 - DNA, 765 bp, Xenorhabdus bovienii
  Coding sequence Name=Xb4151_4152.C437.gene200.dna; Position on contig= 123667..124431bp; Strand=+
atgatcaataagactgaattaatcactattaataaaactcaaatgcctgtcgtggaatatcaaggacaacgggttgtgacgttctccatgattgatcaggttcatgcacggccagaaggaactgcaaaagctgcctttaatagaaacaatcaccgttttgtacaaggcgtggattatcaagttttaagtcaggacgatatacgtaccgacctccctgacggcttattttctaagttcgcccccagcgggattgtgctttttgagtctggttatctgatgttaaccaagccgttcaatgatgatgttgcatggcaggttcagcgtgaactggttagcagttattttcgcaagccacaaacagtactgagcgaacttgaaatgattgccaggatcgccagccatacagcccaacaacaacgtcagattaaccacattggcgaacaagttgagcaagcccatgaagctattgagcaaatcaaacgcggaaccattccagcaggttggattgggttctccctggctgcgaccgaatccgggctaaccaatcccaaatgccgcaccttggctgaacagtataacgtacctatcgacaccgtcaccatcatgacaccagatggacagcctcgccctatgaaagttgtattcaaagaagacttcatgagcgcgttccgtctgatgatgggcgaagcagaaaaacgcggcactcgctggtcacatcccaaaatggggatctttcaggttatcggatgggaggacaagcaatga

SEQ ID NO: 3204 - DNA, 531 bp, Xenorhabdus bovienii
  Coding sequence Name=Xb4151_4152.C437.gene201.dna; Position on contig= 124428..124958bp; Strand=+
atgattattaattcatgcctgttacgtgcggctttggtttgtgtcgctaaaaacgaccctcgttattatctgtgtggagtgcatataacccctaagtatctggagtcatcaaatggttttgtggctttccggttagagcacggcatcaacacacgccgtaaagccattatccagttccacggaaagatccccaaaaaggctgacactacagaactgcatttcaccaaagaaccttatgctgtacacagggatattgccggggtaagggtgggatttacagccttatccatgctggatggtcgctttcctgatttagaccgggttatcccaaagaaagtggaaaatgttattcctcaatttcaggctgagttcctgacctatcctcaaaaaatgttcggggatgattcgaggttcatcgctgtttccatgcatccatccggcatgactgagggatgtgtaatgaagttcagcgacaacattaatcaacgttatggcaaccctcagcttgttgtcatgccctgccggatatag

SEQ ID NO: 3205 - DNA, 432 bp, Xenorhabdus bovienii
  Coding sequence Name=Xb4151_4152.C437.gene202.dna; Position on contig= 124968..125399bp; Strand=+
atgataacgaaaaactttcgccttaacgcactggcaaacgcttacgcagccgccatctatcacgatgtaacagcccgtaacggtggcgatcacttcgcgatgcgagtcggcaaaacagaaatcagtgtcgcgattgtcgatggcataaaaggtattcgtgagttagtcgatagttacgcattggaagcactacagcagaattacccggcatgggaagtgatagccataaacctgatggaaaaatgcgtaatcaatgactgtctgacaggccacgggcgtaaaatatggcaaagcatgatcaatgacatggggacatgctggcagctaagggggcgtttcaatgaaaatcgaatatcaggacaagggcagcacagcgcaaatagtcattgtcagtttcattacagaacgccgaaaacacaaccgttgtgttga

SEQ ID NO: 3206 - DNA, 189 bp, Xenorhabdus bovienii
  Coding sequence Name=Xb4151_4152.C437.gene203.dna; Position on contig= 125465..125653bp; Strand=-
atgaatgtaaaagttctgtctgaggcggtggataatctgatccgtatgatccctgccgtcgtcgatgtggaacgtggccttaacaagcacattgtcaatgtctgccatctggcgctgcttatctgtcactgtccgcctccttgcaaaggattttgtaagcgcgcatcatgtgattggctttgcctgtga

SEQ ID NO: 3207 - DNA, 189 bp, Xenorhabdus bovienii
  unsure (1)..(189): unsure at all n locations
  Coding sequence Name=Xb4151_4152.C437.gene204.dna; Position on contig= 125705..125893bp; Strand=-
tctttatgcgaattcgacctcgttacccggtgcttttatcttcaccctctcactgngccttatgtaatgtgttcaggttgtagcgcccgaattcatcaaggggaatttcaacaccaacaaccacaggaagtaatttgcctttcattattctttacctcgcttattacccgctttcttcaccggtgttaa

SEQ ID NO: 3208 - DNA, 171 bp, Xenorhabdus bovienii
  Coding sequence Name=Xb4151_4152.C438.gene1.dna; Position on contig =1..171bp; Strand=+
atgtcgcaggaagcttttgccgataagtgcggattggatcgcacttatatcagcggcattgaacgtggaatcagaaatcctactttagaaattatttatgtcattgctaatggcttacagattgaactgaatgaattgtttaatcttgaaacaagattacctccgaattaa

SEQ ID NO: 3209 - DNA, 165 bp, Xenorhabdus bovienii
  Coding sequence Name=Xb4151_4152.C438.gene2.dna; Position on contig =264..428bp; Strand=+
atgatgttactgatccctgaactcgcgattggtgtgtatcttcttgttcctgatcttcttttgaccattgaagctgacaagcagcttcaatggtattccaaggatatattgaacgctgctgttaatatcagtactctgtttcgccaatatttttcagggcattaa

SEQ ID NO: 3210 - DNA, 957 bp, Xenorhabdus bovienii
  Coding sequence Name=Xb4151_4152.C438.gene3.dna; Position on contig =391..1347bp; Strand=-
atgaagatgctccccaagaaaattatccttgattgcgatcccgggcatgatgatgccattgcgttactgcttgctcatggaaatcctgacattgaactactggcggtgactacagttgttggcaaccaaaccttgaataaagtcacccgaaatgccctttcaattgcccgcatcgctaatattcacaatgttccttttgccgcaggatgtcacagaccattggtcagagatatccaaactgccccagaaattcatggtgaaaccggcctggatggcgttattttgcctgaaccagcattaaggctggatgcccgtcacgctgttgatttgattatcgacatcatcatggaaaatccccccaagagcgttaccttggttccaacggcaggtttgacaaatattgcccttgccgcccgtaagtctccacatattgttgaacgcgtaaaagaagtcgtgttgatgggaggtggctaccatactggcaactggagtgctgtcgctgaatttaacatcatgatcgatcctgaagcagcacatattgtttttaatgaaaaatggcccctgacgatggtggggctggatctgacgcatcaagctcaggcaacgcctgatatcattgacgctatctccaagatcaaaacccgtcctgcccaattcgttttagatgcgttgcagttttatggggagaggtatcgggaatcgcagtattttgactatcctccggtgcatgatccctgtgcagtcgcttatgtaatcgatcctaccgttatgacaacacaaaaagtacccgtgaatatcgagctggccggaactttaacaacgggcatgaccgtcgctgatttccgcttcccgccaccaaaagattgccatacacaagttgccgtaaaattggatcaagccaaattctggcaattggtgattaatgccctgaaaaatattggcgaaacagagtactga

SEQ ID NO: 3211 - DNA, 159 bp, Xenorhabdus bovienii
  Coding sequence Name=Xb4151_4152.C438.gene4.dna; Position on contig =1424..1582bp; Strand=-
atgataacaccagcaactatctgtttgttttttatagcatacacatatgaatcatatgtacttacaatgctcaaaccatttattatttatatgttaattatgtcacaattattaaacattttattaataagtttagatttttatcttatcgttttgtga

SEQ ID NO: 3212 - DNA, 1401 bp, Xenorhabdus bovienii
  Coding sequence Name=Xb4151_4152.C438.gene5.dna; Position on contig =1643..3043bp; Strand=+
atgttaaataaatgcgacaaagtgtccctgaagaaacagagtaacaaaattgtcggctgtacatcatcagggaataggcagatgctcacggggtataacatgaataataatcttgattcattaacatactatgctgcaaccaaaaaatatgatcttcgctttcccacactgacagaagacttggatgttgatgttgttatcattggtggcgggttttccggtgtgaatacggcactggagctggctgaaaaaggcatcaccaatattgctattttggaaggtcggacgttgggatatggcggaacggggcgcaatggcggtcaagttatggcgggtattggccatgatttggataggattaaacgtcatgtcggtgagaaaggtttagaggctatttttaaaattagcaacatgggtgcaggaattattcgtgaccggatcgctaagtacgatatcaaggcggatttttgtaagggttacggttatctgggatataactcccggcaggagaaaactttacggggctggctgaaagagtttcaggcagcgtgtcccgatgaagagattgaactttatgccggtgctgatgttaaaaaagtcattggttcagatctttatacctgtgcgctgaagcatatgggtgggggacatgttcattcactcaatctgttgctgggggaagccaaggctgcaacggagcagggtgtcagaatttttgaaaatagccaggtggtgaatgtggaatatggcccacgggtcacagttcgcacagcaatggggacggtacgggcaagtaagatactgtgggcgtgcaatgctttcctgaatggtcttgaaccgactatctacaaaaaaacgatcaatacttacgctttccagctaatgacggaagagctgtcagacgatctgattgaaaagatcagcccgattcgtggggcatacagtgatattagtccggtcatcaactactatcgagtcaccaaagagaaccgagtgctgtttggcagtgccacacaatattttgagtatatcccttctgatttaaaagcatggaaccgcaaacgtatgctggatgtcttcccctacctgaaagatgtgaaaattgaattggcatggggcgggccactatcttgtagcgtcaatttattcccacaaattggttctctgccagaacataataatgtgttttatgtacagggttattcaggatttggtgtaacgccgagtcacattgtctgcaaaatcttggcagaagggatgagtgaaggctctgaacgttactcactgatgagttcgattcctcatctcaatgttgtgggcaaagacaaattaaggaacctgctcctttctgccggtaaaacctggcaccaagcctcagggtattggaaaggccgtcgctag

SEQ ID NO: 3213 - DNA, 369 bp, Xenorhabdus bovienii
  Coding sequence Name=Xb4151_4152.C438.gene6.dna; Position on contig =3113..3481bp; Strand=+
atgataaagccattattgttagatcaagcacttcctgaattaatgccaattggcagtgttactcatcttggttctattgtgttagagggagatccccaggcaagtggtgcaatgacccacggagagcctacggataatctgacttgtggtatttttgcctgcaccaagggtaaatttaaaatgatttatccctttgatgaaatggcgacggttcatgaaggctcggtgaaactgaccaatgtcaaaacgggggctacggttgaataccataagggcgactcttggtttgcggcgaaaggcactgaaattttgtgggaaatcaccactgaacgctttgttaaacattacatggcttgtgtgaacgcttaa

SEQ ID NO: 3214 - DNA, 1497 bp, Xenorhabdus bovienii
  Coding sequence Name=Xb4151_4152.C438.gene7.dna; Position on contig =3507..5003bp; Strand=+
atgatgagtgaaataaccttactaaagcccgttacggattttctgcaacgtcctcatggtaattatatcaatgggttatctcttcctggtcagggaaacagaaccttttctgttgttaaccccgcttctgatgaaatgatcgctaaagttaatcaaggagaggaagctgagataaatttggcaatggaagcagcctcgaaggcttttcatggttcatgggcacagacatcgcctatggagcggggtaagtgcctgaaccggctggctgatttattgcaaaaacacggtgaagagttagcccaactggaaagtttgtgttcaggtaaaccaatccaacttgctcgaatgttagatgtgggcgcttcggctgattacctgcgttattttgctggttggtcgagcaaaattagtggtgagacattgaatgtttcattgccatcactcaaaggggagaaatacaccgcctttacccgccgtgagccaattggcgtggtggttggcattattccgtggaatttttccattatgattgccatctggaaattgggagcggcactggcctgtggctgtactttagtactgaagcccagtgagtatacccctttgacgatgcttcgtgtggcagaattggcgaaagaagccgggatacctgatggcgtgattaatgttgtcaatggttctggcgctagagttgggtcagccctgctcgctcatccccattgtgccaaagtcacttttactggctcagtcccgactggcacgattatcggtaagtcggcgatagagtacggcttgtctcgtgcgacgctggaactcggaggcaagaatgctgctgctttcctgtctgatatgtcagttgaaaagattgttgagggtgtgctggaagccggttatttgaatcaggggcaaatctgtgcggcagcggaacgtttctatatcccatctgttcacatggatgcggtcttaaaattactttctgaacgtttgtcagcgatgaaaatcggctctcctcttgatgaatcaaccgaaatggggcctttggcaaacaaagagcattacgaaaaaatcctgtccctgtttgataaagcgcgtcaggatggcagtgaaatcgtatatggtggtcatgcactggaaggtgcaggtttttttgtcaccccaacgattatccgggccaagagtgctgaagacacattaatgcaagaagaaaccttcgggccgataggcactttcctcagctatgatgatgaagaagagttaattgtcatgatgaacgcgacgccatttggtctgtctgccagtttatggacgaatgatctcagtaaggcgatgcgtatgatcccccggattcaagtaggtactttgtggattaatatgcatacgtttctggatccagcgttgccttttggtggcgtgaagtcgtcgggcattggacgggagtttggtagtgcatttattgagcattacaccgaactgaaatcggttatggttcgttattaa

SEQ ID NO: 3215 - DNA, 267 bp, Xenorhabdus bovienii
  Coding sequence Name=Xb4151_4152.C438.gene8.dna; Position on contig =5108..5374bp; Strand=+
atgatcagcgcaaagcggggtttaaaactggctttttggcagagtatcaccgggttatgggggagtttattatttagtctgatggcgtcaatactggtaataaccggggcagggatcgagcaatttaagataagtattctgggtgctatgctttcgactcttgtgctgctgctgcatcgcgatgcacgccatttcctcttaattcctgcgggtattgctgtgatgtgcagcttatttgctggtttgcgctatgcggagtatttttga

SEQ ID NO: 3216 - DNA, 303 bp, Xenorhabdus bovienii
  Coding sequence Name=Xb4151_4152.C438.gene9.dna; Position on contig =5253..5555bp; Strand=-
atggcagtacctgcgagggtggcggaattggtagacgcgctagcttcaggtgttagtgtccgtacggacgtgggggttcaagtcccccccttcgcaccactgttaatatttatctgctccctgtattcatttctttatttcatcccattatcagccaatctttttaagaattcacgctatctcaaaaatactccgcatagcgcaaaccagcaaataagctgcacatcacagcaatacccgcaggaattaagaggaaatggcgtgcatcgcgatgcagcagcagcacaagagtcgaaagcatag

SEQ ID NO: 3217 - DNA, 120 bp, Xenorhabdus bovienii
  Coding sequence Name=Xb4151_4152.C438.gene10.dna; Position on contig =5569..5688bp; Strand=-
gtgtctgaatttgcgagggtggcggaattggtagacgcgctagcttcaggtgttagtgttcttacggacgtgggggttcaagtcccccccttcgcaccaaatcagacagtcgtcggttaa

SEQ ID NO: 3218 - DNA, 189 bp, Xenorhabdus bovienii
  Coding sequence Name=Xb4151_4152.C438.gene11.dna; Position on contig =5708..5896bp; Strand=+
atggaggcgcattctagagattttacggctaacgtcaatcattatttattgagaaagagcatgaatggtgcaaaaaacggcacactggtgttatgggtgaggcagatacacaagaattgcctgcccgttaaaactgagcaggcaagaaacggcttgcttattaccttttggttgcttggtagaccttga

SEQ ID NO: 3219 - DNA, 1014 bp, Xenorhabdus bovienii
  Coding sequence Name=Xb4151_4152.C438.gene12.dna; Position on contig =5868..6881bp; Strand=-
atgtcagtattaaccccggccagcgaagttatcctgcgccatcatgaacagtttctcactcgtcacctgctaattgccggtgatattcaagacaatctggcaacggaaatcgaagccggaagtgtgcgagtacatactaaccaatatcaccactggcaatccctgatccgtcaactgggtgacaatgcctcctttggcctcgtcgcggacagcacatttgtcaaaggctgtgatacattgatttattactggccaaaaagcaaacatgaagcgcgcttccagttacgcagcctgttttccattctgccgcccggaaccggtgtttttgtggtcggagagaatcgcagtggtgtacgcagtgttgataaattaatggaaggcattgtgactttccagaaagtggacactgcccgccgttgtagcctcttttatggccaactggaaaatcaggttcaatttgatcaaaataattggtggaacagctatccagtgggtgatgtcatcgtcaacacactgcctggcgtattcagtcaagatgatctagatgtcggcagtcgtttgttgctttctacttttgatggccctgtttctggtagtctgctggatatcgcttgtggagcaggcgtattggcagcggttctgggcaagaaaaaccctgaattgacactgacactgagtgatgtcaatgccgcagccacaatatccagcaaggccacactgaaagccaataaactggaaggcaatgttatcaccagcaatgtgtattccgccattgaggaaaaattcgactggatcatttccaatcccccattccacgatggtttaaaaaccaatttagccgcggctgacgacctgatccgcatggcgccaaactatctgaaatctggcggtaaattgcggatcgtagcgaacgctttcctaccttatcccgctctgctggatagtacctttggtaaccataagcttatcgcgcagacaggtaaattcaaggtctaccaagcaaccaaaaggtaa

SEQ ID NO: 3220 - DNA, 153 bp, Xenorhabdus bovienii
  Coding sequence Name=Xb4151_4152.C438.gene13.dna; Position on contig =6884..7036bp; Strand=+
atgtataagctccttataaatctttatccaagtataaacatcggggggcaaaattgtgatgccatgctgattggcgcagagataagccctctgatagtatattacctgttattttttatggcagatggaataaaacacgatgacgaagcgtga

SEQ ID NO: 3221 - DNA, 411 bp, Xenorhabdus bovienii
  Coding sequence Name=Xb4151_4152.C438.gene14.dna; Position on contig =7023..7433bp; Strand=+
atgacgaagcgtgacagattactcgcccaattggggatcacccagtgggttgtgcgcagcccgaaggccttgcagggtgaattgtctgtcctcatccctgactcaactcgtctgttgatcattacccatgatcatattgatttaagtcattcattgtttgctgatatttttacagccatgaggattgatgtctcatcggtttattgcatcacgacaaaagatgttgagctgctttcggaatcaatccattgtccatgctggctgttgggggttgatattaccttatcaacacaagggatttctttgagaagcccagcattaaatgacttatcccttgacgggaatgcaaaacgctctttttggcaacaaatttaccattatgaagaatatttctctattaattcccactga

SEQ ID NO: 3222 - DNA, 507 bp, Xenorhabdus bovienii
  Coding sequence Name=Xb4151_4152.C438.gene15.dna; Position on contig =7345..7851bp; Strand=+
atgacttatcccttgacgggaatgcaaaacgctctttttggcaacaaatttaccattatgaagaatatttctctattaattcccactgatcttcccgcagcatttcaaatagaacagttcagtcatgcattcccgtggagtgaaaaaaccttttactccaaccagggagagcgttatctgaattataaaatcacgctgaatgaccagattatcggcttcgcaatcatacagtgtgttgtggatgaggccacgttatttaatatcgtcatccaccctgagcatcaatcgcaggggtatggaagagcgttgctgactcacctgatcaatgtgctgccggaaaagcagattaatacgctatggcttgaagtacgaagttcaaatgcatcagcgattggtttgtatgaagatctgggtttcaacgaagtttctatccgtaagaattattacccaacggcgacgggaaaggaagatgccattattatggctttgcccctgttttctggttga

SEQ ID NO: 3223 - DNA, 240 bp, Xenorhabdus bovienii
  Coding sequence Name=Xb4151_4152.C438.gene16.dna; Position on contig =7870..8109bp; Strand=-
ttgataccattagggaagcgccccgaacgacccttcacctgcaaatccgtcatgttaatcgtgattggggcttattttcgccgaacttggatttataaacaatcaatgattgtctggctgagtactatcatatttttcactcatggcgtggcgaactcgttcaacgacttcaggagtgacagactcctcggccagacaggaaaagtcgtatattttctgacaacacaaagcaaacaatga

SEQ ID NO: 3224 - DNA, 1590 bp, Xenorhabdus bovienii
  Coding sequence Name=Xb4151_4152.C438.gene17.dna; Position on contig =8139..9728bp; Strand=+
atgtcaaattttccattccagcaggaagtcgcgaaacggcgaacctttgcaataatttctcaccccgatgcggggaaaactaccattactgaaaaagtgttactgttcggacaggcgatccagaaagcggggacggtaaaaggccgcggctctaaccagcacgctaaatcagactggatggagatggaaaaacagcgtggtatctccattaccacttctgtgatgcagtttccttatgatgattgtctggttaacttactggatactccgggacacgaagacttctccgaagatacttaccgtactctgacggcggttgactgctgtctgatggtcattgatgccgcaaaaggtgttgaggatcgtacccgtaagctgatggaagtcacccgtctgcgtgacactccaatcctgacattcatgaataaactcgaccgcgatatccgtgatccgatggaagtgatggatgaagtggaaaatgagttgaaaatcgcctgtagcccgattacatggccaatcggctgtggtaaatccttcaagggggtttatcatctttaccttgatgaaatttacctgtatcaatccggtcaagggcataccattcaggaagtccgtgccattaaaggattgaataaccctgagctggatgcggctgttggggaagaattggcggatcaattacgtgaagagctggaactggtcaaaggggcatcacatgagtttgatcaggaagcctttttacagggtgagctaacaccggtgtttttcggtacagcgctgggtaacttcggcgttgaccatatgctggatggccttgtcaaatgggcgccaatgccaatgtctcgtctgactgatgcgcgtgaagtgacagcagaggaagaaaaattcacgggttttgttttcaaaattcaggctaacatggatccgaaacaccgtgaccgcgtggcatttctgcgtgttgtttccggtaaatatgaaaagggtatgaaactgcgtcaagtccgcatcaagaaagacgttgtcatttcagatgcactgaccttcatggcaggagatcgctctcatatcgatcatgcttatgcgggggatattatcggcttacataatcatggcacgatccagattggtgatacctttactcagggagaagaactgaaatttaccggtattcctaactttgcgccagaattgttccgtcgtatccggctgcgtgaccccctgaaacaaaaacaattgctgaaaggtctggttcagttatcggaagagggggcagtacaggtatttcgtcctctggctaataacgatctgatcgttggggcggtgggtgtgcttcagtttgacgtcgttgttgcccgtttgaaaagcgaatataacgttgaagcattgtatgaatccgtcaatgtttccaccgctcgctgggtagagtgcaacgatgcgaagaaagtggaagagttcaagcgcaagaatgaattgaacttggcactcgatggtggtgataacttaacttatattgcaccaacaatggttaatttaaatctaaccagcgaacgttatccagaaatttctttccgtaaaacccgcgaacactaa

SEQ ID NO: 3225 - DNA, 387 bp, Xenorhabdus bovienii
  Coding sequence Name=Xb4151_4152.C438.gene18.dna; Position on contig =9913..10299bp; Strand=+
atgacggaaggtgataggatgaaacacataaagtttacacattcactactggctattgttttaggttcagtgctgataagtagtagcgcactagctgcagtaacatttccaactaacacattggaaagtgcaggccaaaaaattgacaattctttgaaacacgcagacgcttatgtgaacgatagtagtattactgcgcaagtaaaagcggatttactgaaaactaaaggattagatagcaatgatatttcagtgaagacagaaaaaggtgttgtttacctttcaggttttgtcaaaaacacatatcaggctaaacaagtagccaaaattgttcataaagtacatggtgtcaagtcagtgaaaagcacattaaaggttaaaaaataa

SEQ ID NO: 3226 - DNA, 291 bp, Xenorhabdus bovienii; identical to SEQ ID NO: 155
  Coding sequence Name=Xb4151_4152.C438.gene19.dna; Position on contig =10798..11088bp; Strand=-

SEQ ID NO: 3227 - DNA, 279 bp, Xenorhabdus bovienii
  Coding sequence Name=Xb4151_4152.C438.gene20.dna; Position on contig =11080..11358bp; Strand=+
atgagccactattcgcttcaggcggggttcccaagcataccaaagccagcgttggtttttcttattgccgacaaacgaccattgctcgtcgatttcacagacaatctggatgccacattccgcaaggggaagtgtcgttacgtttcggggtctgaggtttttaatgttttcatgacggtggcggtggcgactttcaggatccgagcggtgtcacgaattcccccgttattcatcgcgatatcgataatctgttctttaacgccgggtttgcaggcctga

SEQ ID NO: 3228 - DNA, 171 bp, Xenorhabdus bovienii
  Coding sequence Name=Xb4151_4152.C438.gene21.dna; Position on contig =11309..11479bp; Strand=-
atgtctattgccgttattgccacaaatcagaacaggtcaaaggacatgggaaaggaaatggcggacatcctcgttatcgctgttatagctgctgtaaggtctttcagttggcgtatacctatcaggcctgcaaacccggcgttaaagaacagattatcgatatcgcgatga

SEQ ID NO: 3229 - DNA, 120 bp, Xenorhabdus bovienii
  Coding sequence Name=Xb4151_4152.C438.gene22.dna; Position on contig =11690..11809bp; Strand=+
atggtacgctctgtctttcactatttaacgaaaattttacaaacgtattgtttgaacagcaatatactgatagatagtcattattcagattacgctatgacactgacattgattttttag

SEQ ID NO: 3230 - DNA, 1116 bp, Xenorhabdus bovienii
  Coding sequence Name=Xb4151_4152.C438.gene23.dna; Position on contig =11818..12933bp; Strand=+
gtggggaaacatattccaataacgttgggtaacatagaacctttagcttataaatcacagatcaagccaggaaaaattgccctggtttgtgaaggtggtggtcagcgggggatttttaccgcaggtgttttggatgaattcctccggcttggctttaatccgtttgaattgttccttggaacttccgcgggtgcccagaatatctctccctacatttgtggtcagcggggttatgcccgcagagtgatcaatcgttacacaaccgcccccactttttttaatccgttgcgttttgtccgtggtgggcatttgatcgatctggattggtatattgatactatatctgaacaattaccattgaataccactgctgcaatgcatcagtttgatgctggccgtgaattctacatgtgtgcctgtcgcgcagataactttgaacctgattactttcaccctgatgaacataattggatggagatcttgaaagcctccagcgctattccggggttttatcgcaatggtgttacccttggtgacacggtttatcaggatggtggcatttgcgatgcgattccggtacaagaagcctatcgccgtggcgcagatacgattgtcgtgatccggacagtgccttcacagctttattataccccgcagtggttcaagcggatggagcgctggctggaagccagtagcctgcaaaaaatggtcaagatgatcaatctccatgctaagagttacagccggacgcagcaatttatcaaaaacccgccggatgatgtgcaggtatttgaaatttatccacctgcgccgttggctacgatggcattgggaagccgaatcagtgcattaaatcaggattaccatttggggcggcgctgtgggcgatactttttggctaccattgggcatacctttgttggtgggaaatttgggttggaaaaacgtaaaggttatggtgtctgtcgcagtggtttaaataatgatgggattaatcataatggcttcaggcgatatagcttgctggacagcataaatcgtccggtaaccgaggtgcaggaagagggtataacaccgctgacaggctctattatattggatgacgtggataaatag

SEQ ID NO: 3231 - DNA, 771 bp, Xenorhabdus bovienii
  Coding sequence Name=Xb4151_4152.C438.gene24.dna; Position on contig =12934..13704bp; Strand=+
atgtttattgatacacattgccattttgattttcctccctttacagggaatgaacaaacgagtctgaaacaagccaggcaagcgggggtggaaaccattatcgtccccacagttagtcaaatgaatttccagcgggttgctgcgctggcatatgactttccctccatctatgccgcgtttggtttgcatccactgtatatcaatgaacatcaaggttctcatttggctgagctggcgcagaaactgaaggcaaacaatcccaaatgtgtggctgtaggagaaatagggcttgatctttatatgccggagccacagtttgagaaacaaaaaagagtgctggaagcacagttagcgttggctaaaaggcacgatttgccggtgatactccactcccgaaaaagccatgatcaactgtccgctatactacgaaaacatgacttaccacgcacaggcgttattcatggctttgctggtagcctgtctcaggcacaggcttttattcgtttgggattttatattggtgtcgggggaacgatgacttacgagagagcgcaaaaaacacgcagtacaatttcccaactgcctctgtcgtcccttgtgttggaaacggatgcacctgatatgccgctctctggataccaagggcagccgaaccgaccagaaagagtcgcacaggttttttctgcgttgtgtgaattgcgtcgagaatctcctgatgaagtgtccgatcagatttatcataacagcaaggcactatttgcgttaagctga

SEQ ID NO: 3232 - DNA, 96 bp, Xenorhabdus bovienii
  Coding sequence Name=Xb4151_4152.C438.gene25.dna; Position on contig =13706..13801bp; Strand=-
atgagtaaagaagaccaattaaggattattaatatttatttaatacggatactcacttcctgttaccctaaaaacatatcatttctgtggttataa

SEQ ID NO: 3233 - DNA, 108 bp, Xenorhabdus bovienii
  Coding sequence Name=Xb4151_4152.C438.gene26.dna; Position on contig =13863..13970bp; Strand=-
gtgcgaggccgattatacctagtagtaaaaaagaacaagcaactaacatcacaaattaataccgcaaaaagtaatataaaaacacaaaatgagatccagatcacataa

SEQ ID NO: 3234 - DNA, 1278 bp, Xenorhabdus bovienii
  Coding sequence Name=Xb4151_4152.C438.gene27.dna; Position on contig =14047..15324bp; Strand=+
atgcaactcattatgagcctgatagggatggtagtgctgatttttatcgcagtacttttctccagtaattaccgagctattaagatccgcacagtcttgggcgcctttttgattcaggttgctattggggcatttgtactttatgtgccagcgggtaaagacattctgattggaatgtcaaaaggcgtttccaacgtcattggatacggccagaaaggaactgatttcatctttggtggactggtttccgacaaaatgtttgagctgttcggtggtggtggctttatctttgctctgcgcgtcctgcctattatcgttttcttctcctcacttattgccgttctgtattacatcggcgttatgcagattgtgatcaaaatactcggtggtggcatgcaaaaactgctgggaacatcacgaaccgaatctctgtctgcgactgcaaatattttcgtcggccaaactgaagcgccgctggttgttcgtccttatatttcaaccatgactcaatcggaactgtttgctgtcatgtgtggtggtctggcttctgtggcaggttcagtattggctggctacgcatcgatgggcgttccattggaatacctgattgccgcttcattcatggcagcaccgggtggcttgctatttgcgaaactgttagtgccggaaacggaaaaaacacgcgacaccgacgatgccatgtcgctgattgcggctgaagatcgccctgccaatatcattgatgctgcggcatcaggtgcggcatcgggtatgcaactggctctgaacgtgggagcaatgctgctggcattcaccgccttgattgccttactgaatggtatgctgggtggtatcggtggctggttcaactatcctcaactgtccatggaactgattctgggctgggcgttctcaccagtcgcctacctgattggtgtaccgtggaatgaagcgactgttgcaggttctttcatcggccagaaaatagtagtcaatgagttcgtggcgttcatgaactttggtgaatatctgaaaccgaacgaggtcgttcaggccgcaggtctgcaagtgctttctgatcataccaaagcgattatttcctttgcactgtgtggcttcgccaacctgtcttctgtcgctattctgctgggaggtttaggtggtatggcgccaaatcgtcgtggagacattgcacgttttggtctgaaagccgtactggccggttcactctctaacttgatgagtgcaaccattgctgggttcttcctcgcgttataa

SEQ ID NO: 3235 - DNA, 183 bp, Xenorhabdus bovienii
  Coding sequence Name=Xb4151_4152.C438.gene28.dna; Position on contig =15528..15710bp; Strand=+
atgccctccggggcagtaaaagctgaagaaagtatagtgcggagagaaggagctctactgttgctgttgtgcataattatggcaacatcttcaaggaaccaagtccgctcgccaacaaacgaactaactaatcgttcaaaacaatcgttcaaaagaatgtgtgaacgggttcagtcacgataa

SEQ ID NO: 3236 - DNA, 780 bp, Xenorhabdus bovienii
  Coding sequence Name=Xb4151_4152.C438.gene29.dna; Position on contig =15731..16510bp; Strand=+
atgaccgatttaaccgcaactgctcagcgtgcgctgagtttgatggatttaacgacactcaatgatgatgatacggatgagaaagtggcgatactttgtcatcaggcaaaaagcccggcgggtcatactgccgctatctgtatctatccacgttttattcctgccgcacgtaaagtattgcgtgaacagggtactccagacattcgcattgccacagtgaccaatttcccgcacggcaacgatgatatcgatcttgcactggctgaaactcgagcagccattgcttatggcgcagatgaagttgacgtggttttcccctaccgcgccttgatggcaggtaatgaacagattggcttcgatttagttaaagcctgcaaagatgcctgcgctgcatccggtgtttggctgaaagtgattattgaaacaggtgagttgaaagaagaaaacctgatccgcaaagcctctgaaatttcaatcgacgcaggtgcggattttatcaaaacctcaacaggcaaagtccctgtcaatgcgacactggaaagcgcagaaattatgctcagtgtgatccgcgacatgggcgtaggtgaaactgttggctttaaacctgccggaggtgtgcgtacagccgaagaagccgcacaatatctggcactgtctgctcgtatcatgggggatcaatgggccgactcccgtcatttccgttttggggcttccagtctgttgagcaatttattgacagcacttggacatcagagccaaaagcaaagtagtggttattaa

SEQ ID NO: 3237 - DNA, 1335 bp, Xenorhabdus bovienii
  Coding sequence Name=Xb4151_4152.C438.gene30.dna; Position on contig =16595..17929bp; Strand=+
ttgtttctggcacaggaaattatccgcaaaaaacgggacggtcaccggttgaatgaagaagagatccgtttctttattaacggggttcgtgataataccgtttctgaaggacagattgctgcactggcgatgaccatttatttccatgatatgacgatggaagagcgtgtggctctgactttggcaatgcgcgattccggtacggttctggattggaaaaaattgaatttgcatggcccgatcgtagataaacattcgacggggggtgtcggcgatgtgacttctctgatgctgggtccgatggtagccgcctgtgggggttacgtaccgatgatatcaggacggggtttggggcataccgggggaacactggataaattggaatccatccccggctttgacatctttcctgatgaacagcgcttccgtgacattatccgagatgtaggtgttgcgattatcgggcagactaacttgctggcacctgcggacaaacgtttttatgcgactcgtgatatcactgctaccgttgattccatccctttaattacggcctctattttaggcaaaaaactggctgagggattggatgcgctggttatggatgtgaaagtgggctctggagcattcatgccgacttatgaacagtcagaacaactggcagaatccatcgttggcgttgctaatagtgcaggttgcaagacaaccgcgttgttgacggatatgaatcaagttttggcatccagtgccggtaatgcgctagaagtgcgtgaagccgttcaatttctgactggagaataccgtaatcctcggttatttgaagtcactatggcattgtctgcggaaatgctggtatcgggtaatctggcggctgatcgtgccgaagcacgccgtaaattgcaggcagtgctggacaatggcaaagcggctgaaacctttgagcgtatggtagcagcacaaaaaggcccgatcgattttgtcgaaaattatgctcgttatctaccgactgccccttttagcaaaccggtgtttgccgggcaaaatggcataattactgaaatggatacgcgggcattgggaatgtctgtggttgcattgggaggcggtcgtcgcaaggccactgaccctattaattacagtgtggggctgagtgatatcgttgcacttggagcagaagtgaacgcagatactcctctggcaatgatttatgccaatagtgaaaatgactggcaggaagcggcggaggtcgtacgtaagtccatcgttttgggaattgatgtgaataccgaaacaaaagccgccacacggatggtttaccgccatattgatggctaa

SEQ ID NO: 3238 - DNA, 99 bp, Xenorhabdus bovienii
  Coding sequence Name=Xb4151_4152.C438.gene31.dna; Position on contig =17934..18032bp; Strand=-
atgatgaacgtacgtttcataattttctcctgcgtcagtcaattcacgctatcaatgcggaaactgtcggctgttaaaatctattttcattattcgtga

SEQ ID NO: 3239 - DNA, 1224 bp, Xenorhabdus bovienii
  Coding sequence Name=Xb4151_4152.C438.gene32.dna; Position on contig =18013..19236bp; Strand=+
atgaaacgtacgttcatcatggtattggattcctttggcatcggtgcgagtgcagatgcagagaaatttggtgacaaaggatctaacactttagggcatatcgcagaacagtgcgcccgtggtgaggctgatatcggtcgtaaagggtcattgcagttgccaaacctgagccgtttggggttgggtaaagcaacagaggaatccagtggaaccttcccgataggtttggatcaagatgctgaaattattggagcctacggctatgcgagtgaactttcttctggtaaagacacgccatcaggccactgggaaattgcgggggttccggttctgttcgattggggctattttcaggatttagacaacagtttcccacaagaattgctggataagctggttgaacgcgctaatctgccgggctatctgggtaactgtcactcttccggtacagttattctggataacttgggcgaagagcacatgaaaaccggcaagccgattttctatacctctgcggattccgtgttccagattgcctgccatgaagaaacattcggcttggatcggctgtatgaactctgtgaaattgctcgtgaagagttgaacatgggtgattataacatcggccgggtcattgcccgtccatttgtgggtgacaaggctggcgattttcagcgtaccggtaatcgtcatgatttggcggttgaacccccagcgccaaccgttctgaaaaaactggttgacgaaaaacagggtgaagttgtttctattggcaagattgcagatatctacgctaacgtcggtatcaccagaaaggtcaaggcaacgggaattgatgcactgtttgacgcttcattggttgaaatggaacaggctgggaataacaccatcgtatttaccaactttgttgattttgactcctcttacggtcaccgtcgtgacgtagcaggctatgcagcggcgttggaactatttgatcgtcgcttgccagaaatgctgaaactggttaaagaagatgacattctgatcctgacggccgaccatggttgtgacccaacctggccgggtacggatcacactcgtgaacatattccagtgctggtttatgggccaaaagttaaacctggctcattaggacatcgtgaaacgtttgctgacattggccagacagtggcgaaatacttcgacctgacgccaatggattacggtaaagtgatgttctag

SEQ ID NO: 3240 - DNA, 717 bp, Xenorhabdus bovienii
  Coding sequence Name=Xb4151_4152.C438.gene33.dna; Position on contig =19310..20026bp; Strand=+
atggctaccccacatattaatgctgagatgggcgattttgctgatgttgttttgatgccaggcgatccattgcgggcaaaatacattgcggaaacttttttagaagatgtccgccaagttaacgatgttcgcggtatgctgggcttcaccggtacttacaaaggccgcaagatctctgtcatgggtcacggtatgggtatcccatcctgctctatctatgctaaagagttgatcaccgaatttggtgttaaaaagattattcgcattggttcctgtggtgcagtcagccacgatgtcaaaattcgtgatattgtgattggtatgggggcatgcactgattccaaagtaaaccgcctgcgttttaaagatcatgatttcgcggcgattgctgactttgatctggttcgtaatgcagttgatgcagcgaaggcgaagaatatcaacgctcgtgtcggtaatattttctcagcagatcttttctatacaccagatccacaaatgttcgatgtgatggaaaaatatggcattctgggcgttgaaatggaagcggcgggtatttacggtgtagcagcagaatttggtgccaaggcattggcaatctgcaccgtttctgaccatatccgtactggcgaacaaacctcggcagaagagcgccagacaacgttcaatgatatgattgaaattgcgcttgaatcaattttattaggtgataattaa

SEQ ID NO: 3241 - DNA, 522 bp, Xenorhabdus bovienii
  Coding sequence Name=Xb4151_4152.C438.gene34.dna; Position on contig =20778..21299bp; Strand=+
atggttctgggttttggtgtagctttgacggctggtgcagcaagcgcagctaaccaaggtagcggcacagttaaattcagcggttctattattgatgcaccttgctcaatcaaaaacaccaatattgacgttgatctgggcgcagtttctaacagtatcctggaaaaaggtggccgttcagcatctaaagcgttcaaaattgaattacaaaactgtactactgaaacaaaaaacggtgtgaaaacaacctttactggcgcagaagctgatgagaaaggtttgttaggcattgaagggacggcttccggagctgcaattgccatcaccaatgctggcggtaaaattattcctctgggtacagaatcagataaattttctctgcacgaaggtagcaatgatctgaatttcgccgctcatctgaaacgccttactacagtacagggagcagatggtaaaaatcagaatgaaatcaaaccaggtgaattcactgccatcgcaaactttactttaaactacctgtaa

SEQ ID NO: 3242 - DNA, 180 bp, Xenorhabdus bovienii
  Coding sequence Name=Xb4151_4152.C438.gene35.dna; Position on contig =21556..21735bp; Strand=-
atgtcctgcttatccgtcatatctcacgctttctcttctttgtgctttacggattttaccgtacagcgggaagtagaggaaaaatgtcactacaggtatgccattaaaattacatcaaaatggctaatagcttggttttccgagtacagccaattagagagaatgccattggttaaataa

SEQ ID NO: 3243 - DNA, 96 bp, Xenorhabdus bovienii
  Coding sequence Name=Xb4151_4152.C438.gene36.dna; Position on contig =21786..21881bp; Strand=+
atggaatttaataatgccatgtatcaggtgagaagccctatattctcactcgtttggcaacatcaggcagcggctaaattcaaattggattattaa

SEQ ID NO: 3244 - DNA, 2661 bp, Xenorhabdus bovienii
  Coding sequence Name=Xb4151_4152.C438.gene37.dna; Position on contig =21905..24565bp; Strand=+
atggctttgttttcaaattccatgaatcatcatttttcagctattaatataaaaaacaacattaataaagagaacgtcgctaataaaaaaacagtagataataaagcgaaagtagttaatagaataaaaccagtccacttaaaaaatagaattaaacctctttcggcattggttttgtttgcactggcgggtatgcagaccgcatattctaatccatcaattgaattcaatatcgacgcgctggatgtcggtgaacgtgccaatatcgatttggataaattttcccgagcaggctatatcatgcccggtaactatattatgggtgtccggatgaataaaaatgaatttccggacatgtattcgattgattttacctcgcaacccgatgatcccaaaaacagcgaagcctgcatatcccctgaactggtgaagcaaatagcattgaaacaggagtgggcaggaaagttaggttggcagaatgatgggaaatgtcttgatctcagtagcttgccaggtatgtcagccagaggagagctggcaacttatactctgtatttaattgttccacagatctatttggaatatgacctaccggattgggacccgccttcccgctgggataatggtgtgcctggggtgctgtttgactataacgtcaatgcgcagacgtctaaacctactcatggcagcagcaatcaacaggtgagtgccaacggaacggcgggtatgaatgcgggagcatggcgttttcgggctgattggcaggctaattataaccactcgaaaaccaaggataataagcagggcgcttctggagaaagagagcgtgattggaattggagccgttactacatgtaccgcgccatacctcaccttcaggctcaattgacttttggggaagattacctgaattccaatattttcgacagtttccgttatacggggttgagtctggtcactgatgacaatatgttgccgccaaacttgcgtggatacgcccccgaagtttccggagtcgcgagaaccaatgctaaggtgacagtgcgtcagcaggggcgagtgttgtatgaaactcaggtcgctcccggcccgttccgcattcaggatctcagtgatgcagtaacgggtaatctggatgtcagagtagaagaacaggatggtggcatacaggaatttcaggttaatacggctacggttccttatctgactcgccccggacgcgtgcagtataaattggtcggtgggcaatcgaccaatgacaaacatcgtcgggaaggacccgcatttggattgggtgaattttcctggggaattaataacggttggtcattgtatggtggattgctgggagcaggggattacaacgccttgtctctggggatcggccgtgacttgatgatgtttggtgcgctgtcttttgacatcacggaatcaagggcaagaataccgaaagagaataaaacctttacgggtggttcatatcgcctcagttattcgaaacgtttcgagcaatacaatagtcaggtgacattcgcgggctatcgtttctccgagcgtaattttatgagtatggcgcaatacatcgaccgccgttaccgcgatgttaactctgacaatggaaaagaactttataccctgattttcagtaagcaatttaaggatcttggtcttaatgcccatattaactatagccatcaaacctactggaacaggccaacaaatgatcgctataacatatcactgtccaaatatttggatattgggcgttataaaaatatcaatgtgaacttatccgcctatcgcaacaattttgacaataaaaaagatgatggcgtgtatctgaatctgtctattccgtggggagatagcggaacacttagctataacggtttggccaatcgtcagggtaattcgcatatggctagttatttcaaccgcattgatgaacgaaataactatcgtatctctgcgggtagcagcatcggtggtaaggctgccgcagatggttattacacccattatggtgacaaaacgttgctgtctgccagtgccagttatcaggatggcgggcatacctccgcagcacttggtcttcgaggtggagtgaccgtgacagcaaatggcgcagcattgcatcgtatcaatcttcctggtgcaactcgcctgatggtggatacggaaggggttagtgatgtaccggtcagggggtttggctctgtcgttcatacaaactactttggtaaggcagtgctagtggatgtcaatcactattaccgcaattctgcaaatatcgatttagaccatttgccggataacgtagaagccctgcgttctgtacaacaggcaaccctgacggaaggcgcgattggttatcggaagttccaggtaatgtcaggaatgaaggcgatgactgttatccgtttgcctgatggttcatttccaccttttggcgcttctgtcatgaacacagctcaacgcgaaattgggattgtcagtgatgatgggtatgcctatctgagtggaatgaatgcaggtgagaaattgcaggtgcattggaatggcggggctcagtgtgaaatcaccgtaccgcaggaaatatccgaagcctctttgacttcattcttgctaccttgtcagtttttaaaaggtgaacatcagtaa

SEQ ID NO: 3245 - DNA, 153 bp, Xenorhabdus bovienii
  Coding sequence Name=Xb4151_4152.C438.gene38.dna; Position on contig =24608..24760bp; Strand=-
ttgcctgataagcgggcatcaggcttgtcaacgttagagcggttaccattagaatttttttcattttcattattgcttgcccattctcaaagagattcgtttttagattgctctgctaacaacagtactttccatgttaaatcagcaacataa

SEQ ID NO: 3246 - DNA, 738 bp, Xenorhabdus bovienii
  Coding sequence Name=Xb4151_4152.C438.gene39.dna; Position on contig =24712..25449bp; Strand=+
atggtaaccgctctaacgttgacaagcctgatgcccgcttatcaggcaatggctgcgatggcgctggatcgtacccgggtaatttttaatggggatgtcaagtctgttagcttgaatatcgaaaaccagcatgtcgatttaccttatctggcacaggcatggattgaagatgataaggggaataagattaacggtccgctcgtggttgttcctcctgtacagcgtgttgaagccggagcgaagagccaagtcaaaattcagacattaccgacaatagccgaattgcctcaagacagagaaagcctgttctatttcaatttgcgtgaaattccaccacgcagcaataaacctaatgtgctgcaaattgcgttacaaacccgggttaaattgttctatcgcccggaagccgtcgtcgctcgccgtatcgaccttgataacccatggcaggagaagctcactttaacccgtcagggaaatcaatatctggtaaataacccgacatcttattacgtcaccatttcggaagcctctaataaggttaatggtaagaatatcgatggttttcaacctttgatgctggcacccagaagtagtgaaaaactcggggcagacctcagtgcgctgggcaataagccagtactgacctatgtcaatgattatggcggacgtccacagctgacattcagctgtaatggtgatacctgcacggttgcgaaaaccacagttgaagaaaactga

SEQ ID NO: 3247 - DNA, 564 bp, Xenorhabdus bovienii
  Coding sequence Name=Xb4151_4152.C438.gene40.dna; Position on contig =25559..26122bp; Strand=+
atgagtccgttaaatatgaagctatccaaatatgtactgtcagccctgtttattttcggcattggtggccagaaaagtgcctatgcacaagatagtctgcgccaggatgtcaaaattacgctgactgtactcgctgctccctgtgtgattaagacagaagataaagcgatggaggtatatttgggtcgcattcttaaccgtgacctttatcagaactatcgcactccaggccagaatttcgaactgcatctggaggagtgtgatcctcgggtcgcacaaagcctcaagatcaagtttatggggccagagagtcgtacactgcccggattgctggcattcggtgctggcagcggtgcttccggtgctgctattggtatggagagcatagatggtaaaccacttccttttaacaaagtcagtaaatttccgctttctcgtaccagtagcagcaatgtgattccgttccgagcgtatgtacaagctgaacccggcgccctccagcacaataggattggtgctggtgcattcaatgcaattgcgacctttgaagtcagttatgagtaa

SEQ ID NO: 3248 - DNA, 837 bp, Xenorhabdus bovienii
  Coding sequence Name=Xb4151_4152.C438.gene41.dna; Position on contig =26189..27025bp; Strand=+
atgcgccatattaagaaatcactgatgaagtttgtagcattgttgtttttcttaagtacctcatatgcctatggtggtgcttatgttatggcggttgatactcaaccattcggtaatcaggccatcacaaccatggaaattattgcctggacagaggaggaaggggcgccaaacccttgttatggtagtaataaatgttatgtcgggcctgatgttttgtatatgaatggcaataagccaggtatgtatggttcctgcatggatgccggtgcgtgtttggatgatgccaatcgctatcgtaccgctgcagaagtcatgcgggcgtataaaaggaaactgggtattccttttagagcaacatttaccatcacgaatcggaatgctgattgtgtaggattgttctactcctatggaacacacccttttcatggtacagcggaaaaattccctaactccacttgcggtaaattacccccgcaaaatcagagttgctctatttctgtgccttctgaaattgcttatggcgcattaaaagcatcagacgttaataatgcgacacgttcgatcacggggcaggtgaaatgtgctcttaaaggagatttccgattagaaggtttctcaatcggtagagaagcaaaaatttatttggattctaacagacagatgtattccacattgcagattaatgggcgggaagcaatggatggtgtgtcttttaaagcgaaaggaagagatcaaccggaaaatttcacgctgacatccatattgcgcacgctcacaccaccaaaagccggtaaatatgaaggcatcgcagtcgttttattaagttataactaa

SEQ ID NO: 3249 - DNA, 279 bp, Xenorhabdus bovienii
  Coding sequence Name=Xb4151_4152.C438.gene42.dna; Position on contig =27043..27321bp; Strand=+
atgcgggtcagtatgctggtaggaaaacgaatccaaataaaaaggaaagaaattgggatgacagtagcagagctggcggacagaattagcgttagccaacagcaattgtcgcgttatgaacgaggaaccaataaaatcagtctggaacatttggttgatgtttccattgctttgaaaacgcccgctgattggtttttggaagattgcttcaataaaacccaagtctctgttaagaatcaatatgcttttgtggcggaaacaattttggacttatattga

SEQ ID NO: 3250 - DNA, 96 bp, Xenorhabdus bovienii
  Coding sequence Name=Xb4151_4152.C438.gene43.dna; Position on contig =27565..27660bp; Strand=+
atgtgtcatatcccccttactccatcatcagagttctcctgtttttctacgtcggtgaatactcatttaaattgtctcatatcgaaagtcatataa

SEQ ID NO: 3251 - DNA, 612 bp, Xenorhabdus bovienii
  Coding sequence Name=Xb4151_4152.C438.gene44.dna; Position on contig =27716..28327bp; Strand=-
atgcaaaaacgtaattatttaacccactcggagattgaaatactcctcaaagagttgggaaaacaccctcatgctgaacgaaatatatgcatgatatttatgggctttattcatggattccgagtttctgaattgcttgggttaaagctttctgatgcggatttggaggggaaaaagctacgtgtacagcgcctgaaaaatggtttttccacaattcatccgatggtgatgcgggaggttcaactgatacgccagtggcttgcccaacgtcagaagtacaaaaacagtgagcagaatgactggttatttttgtcacgtacaggggtaccgatgtcccgtcagcaattttataaaatcatccgacaaacgagtttacaggccaatttagcggtttgcgcgaatccgcacatgctacgacattcctgcggctacgcgctggcggacaatggcgtggacacccgcttgattcaggactatttaggacatcggaatattcgccatactgtacgttataccgcaagtaatgcgggtcgtttcggggctatctggcaggaaagagggaaacgaaaattgtctacaattagtaccaaactgttaactgaagatgattaa

SEQ ID NO: 3252 - DNA, 210 bp, Xenorhabdus bovienii
  Coding sequence Name=Xb4151_4152.C438.gene45.dna; Position on contig =28391..28600bp; Strand=-
atgaggatcgggacaataaaagcgacgtttctcaacgctgaccttcttcccccattcatcatttcatctgaattcggcataaacactgaattcagatggtcttattttctatttttcctgcataaccccctatttttacagataaatgactgtgtatttttatcatcacatcatttattactaaaccctgatgttgcagtctgtgaataa

SEQ ID NO: 3253 - DNA, 735 bp, Xenorhabdus bovienii
  Coding sequence Name=Xb4151_4152.C438.gene46.dna; Position on contig =28560..29294bp; Strand=-
atgcttttcaaactatcctatcaatacagcatctggcaacatgatgtgttccaaagcatggatggaataacgatgatcaaagcaaaactgaaatttcgactgcacaagacggcgattatcttaatatgtatagcactgctggtattactgctgcagggcgtctcctattttagtcgttctcagcaacaggctcaggtaaatcagtttgaagatctggcgaaaactctggcaaaacaggtagcatacagcttgtctgattatatggagaatgacagcaaagatcttaataataagaagattgtagccagtctggactatctgaccagcaaaagtcgcattttggatgccagtgtttatctggaaaatggcacccagatcgcgcggagcggtgaacctatttctgttcgtgaccggttatcgttagatggcaaaaaatccggcagctatttcaatcagcaactcgttgtccccataccaggcaaaaatgaaccaaaaggttttctccgcctgacactggatagccacaggctggaaacagaagccaagcaggtggataatacgacgaatgtactcaggatcatgatcctgttggcattggcgattgggtttgttctggcacataacttactacgactcacccccagccgctggcagcagtcaccttatctcttgaccgccaatactaaatcccctgatgaggatcgggacaataaaagcgacgtttctcaacgctga

SEQ ID NO: 3254 - DNA, 984 bp, Xenorhabdus bovienii
  Coding sequence Name=Xb4151_4152.C438.gene47.dna; Position on contig =29333..30316bp; Strand=+
atgtttatgtctaataatctggcctaccgttatctacctgatgagatccataaatggccgggattaccgttatccctcagtggcgacgaagtgatgccgctggactatcgcgcaggggatagtggctggttactgtacggccgcggtttggataaacagcgtattagcgattttcagcaccgtctgggagttgccattgtcgtggtttcttcatggcgtattgatgattatcaagttgtccgcattgccggcagcccttccccacgtattaaacggttggcagatgagtgcagccttgatgtcgttcctctgggacagatcccacgcctgcgttcaccgggtttgttagtgatggatatggattcgactgccattcagattgagtgtattgatgaaattgcccgtttggcgggcgtcggcgataaggtggctgctatcacggagcgcgcgatgcagggagagctggacttctccgaaagcctgcgtgaacgggttgctcaactggcaggtgcagatgcatcaatattgcagcaggtgatggaaacccttccccttatgccaggactgacgagtcttgtccgcaagttacagtcgctggattggcatgtggcgattgcatcgggaggttttaccttctttgcggataaccttcgtcagcagctacgcctgtttgctgcggttgccaatcagcttgaggtcaaaaatggcaaattgacgggcaaggtcaaagggccggttgtcgatgcaaaatacaaggcaaccacgttggtacggctggcaaaagagctgggtatcccactgagtcaaactgtggccattggggatggtgctaacgacttgaaaatgatccgcaaggcggggctggggattgcctatcatgcaaaacctaaagtgtatacacaggccaaagtaggtattcgccatgctgatttgatgggtgttctgtgtgttttgagcggtggtttaaaacacgaagagcgttaa

SEQ ID NO: 3255 - DNA, 1383 bp, Xenorhabdus bovienii
  Coding sequence Name=Xb4151_4152.C438.gene48.dna; Position on contig =30363..31745bp; Strand=+
gtggcaaaagcagtaaaaagggcatttgtctgtaatgaatgtggcgcggattatccccgctggcaggggcaatgtaccgcatgtcacgcatggaataccattacggaagtgcgtttggccgccgcttcatcttcccgcagtgagcgtttcagtggctacgcgggagaagtcagtatcagcaaagtgcagaaactcgctgaaatcagtctggaagaattgccgcgattttcgactgggtttaaagaatttgaccgtgtgctgggtggtggcgttgtccccggcagcgcaattttgattggcggtaatcctggtgcggggaaaagtactctgctattacagatcatgtgtcagttatctgaacagatgaaaactctgtatgtgacaggggaagaatcattgcagcaggtggcaatgagggcacataggttgggattgccgacggataaattgaatatgctgtcagaaacgagcattgagcagatttgtctgattgccgagcaggaacagcctaaactgatggtgatcgactctattcaagtcatgcacatggcggatattcaatcttcaccgggcagtgtcgcgcaggtcagagaaactgcggcttatttgacgaggttcgcgaaaacacgtggtgtggccattatcatggttgggcatgtgacaaaagatggctccctggcggggccaaaagtgttggagcactgcatagattgctcggtaatgctggatggtgaggcggattcccgttttcgcactctgcgcagtcataaaaaccgttttggtgcagtaaatgagctgggcgtgtttgccatgactgaacagggattgcgggaagtgagtaacccttcggcgattttcttgagccgaggagatgaggttacgtcgggaagttccgtgatgatcgtatgggaaggcacccgtcctttgctagtggaggttcaggcgctggttgatcactccatgatgcctaatccgcgtcgcgtcgctgtagggcttgaacaaaatcgtctggcgattctactggctgttttacatcggcatggtggtttgcaaatggctgaccaagacgtctttgttaacgtcgttggcggggtgaaagtgacagagaccagtgctgatcttgcattattgctttctttggtttccagtttccgtgatcgtcctttacctcgtgatcttgtggtatttggtgaagtcggtctggcaggggaaattcgccccgtccccagcggtcaggaacgcatttcagaagcagctaaacatggttttaaacgcgctattgtgcctcacgccaacatgccgaaaaaaacattgccagaaatgaaagtctttggcgtcaaaaaattggctgatgcactatctgtgctggatgagttggattga

SEQ ID NO: 3256 - DNA, 1227 bp, Xenorhabdus bovienii
  Coding sequence Name=Xb4151_4152.C438.gene49.dna; Position on contig =32307..33533bp; Strand=+
atgggacaatttgactacttaaaagaagcgattaaacaggcgaattacacattgcagcaagtggctgatgcctgtggaatgacaaaaggctatttgagtcagctcattaacggcaaaataaagagcccgagtgcgcagaaactggcatctattcatcaatatttagaattagcgtatcccatggaaaagaaaacagtcggtgtagtgtttggtaaattttacccgttgcatactgggcatatttatttgatccagcgggcatccagtcaggtcgatgaattgcacgtcgttctctgttatgacgaattgcgggatcgtgaattgttcattaatagttctatgtctcagcaacccacagtcagtgaccgcctgagatggcttttacaaacgttcaaatatcaaaaaaatatccacattcacgcttttgatgaacatggcatggagccttatccgaatggttggggagtatggagccagggagttaaagggtttatggcagaaaagagcatcaatcctgaatatatctattccagtgaagcgcaggatgtggcacgttataaagaatatttcggtattgaaactatccttattgatccacaacgttcattcatgaatatcagcggcagccagatacgacaggcacctttccgctattgggaatatattccaacagaagtgaaaccattttttgtgcgcaccgtcgcaattctgggtggtgagtcgagtggtaaatccacactggtgaacaagttagccaatatgtttaacacaaccagcgtatgggaatatgggcgagaatacgtgttctcacacttgggaggggatgaaatggctctgcaatactcagattacgataaaatcgccttgggtcatgcacaatatattgatttttcagtaaaatatgctaataaagttgcttttattgacactgatttcgtgacgactcaggcattttgcaagcgttatgaaggaaaagagcacccctttgtacaggcgatgattgatgagtatcgatttgatctggtcattctgttagaaaataacaccccgtgggtggctgatgggctgagaagtttaggtagtgaacgggaacgtaaagagtttcagcagttacttgagagtttgctgaagaaaaataacatcgattatgtttgtatcgactcagcggactatgatcagcgttttctgcgttgtgttgagttagttcaacaaatgttaatggcgtaa

SEQ ID NO: 3257 - DNA, 132 bp, Xenorhabdus bovienii
  Coding sequence Name=Xb4151_4152.C438.gene50.dna; Position on contig =33759..33890bp; Strand=-
atgattgctttagtagttcaatattttctttgcatcacctccatctttggtaaaacacctaatacatttgtgggtttattaataactaataaattttatataaataaatcaataggcctgttcattaaatga

SEQ ID NO: 3258 - DNA, 726 bp, Xenorhabdus bovienii
  Coding sequence Name=Xb4151_4152.C438.gene51.dna; Position on contig =34208..34933bp; Strand=+
atgaacttaaatcaatttaaatcgattgatgttatcaatatttcatatggtttgactagcaattcagttaatcatgaaatgatttcagatatcacattttctattataccaggtgaaattactttgataacaggcccgaaagcatcgaccaatagcacattgctatcgattgcatcgggtatgttacaaccagatcaaggagatgtattaatcaataataacaaattgaaactaatgaatgatatcgaattaggaaagtttcattctgaaaatagcgggtttatttttcatgactttaatttatccaataaactaacgctcttagataacttgttattatcaacttcttatggattaacactttctagtgagcaagcgacaaaaatcgcgcagaaatcattggatatcgtcaaattgggtcataagagccgttattaccctggagagttatctgaaaatgaaaaacagctggctgcgatggcaagagcaatagtcagaagacctgaatatctatttgccgatgatccgacacgtaacttgggtcatcaggagcttcagatgttcgttgatatctttaaatttattgcacacgaacaaaaaggcacggttgtgattgcttctcaagataaccgcctggttcaatacgctgatagtatgattacgttagaaagggggaaggtcgttaagacttatgaatcctttcaagaaaaaagagtgatggtgtag

SEQ ID NO: 3259 - DNA, 222 bp, Xenorhabdus bovienii
  Coding sequence Name=Xb4151_4152.C438.gene52.dna; Position on contig =34937..35158bp; Strand=-
ttgctttctttgaagggaacttcagcgaatacgaagattataaaaagcggacaatgggggctgaagcactggagccacaccgcattaaatataagaaaatcagtaaataaacctgatcgcggaaacggcctgatatcaggccgtttttccgagttgacttattccctttctctttcaaattgctgtcttgttggctgcaacttgaaatttattgggatataa

SEQ ID NO: 3260 - DNA, 1647 bp, Xenorhabdus bovienii
  Coding sequence Name=Xb4151_4152.C438.gene53.dna; Position on contig =35049..36695bp; Strand=-
atgcatcgggttggtaaaattgttccccccaaaaggcatattctgaaaaatatttctctgagttttttccctggagcaaaaattggtgttctcggcctcaatggtgcgggtaaatcgaccttactgcgcatcatggcaggtatcgataacgatattgaaggggaagctcgtccacagcccggcattaaaattggttatctgccgcaggagccaaagctcaaccttgaacataccgttcgcgaagctgtagaagaagcggtcggcgaagtcaaaaatgcgctgacgcgtcttgatgaagtctatgccgcttacgccgatcctgatgcagattttgacaagctggcaaaagagcaaggtcaactggaagcgattatccaatcccatgatgggcataatctggataaccaactagagcgagcggccaatgccctgcgtctgccagcatgggatgccaagattgagcacctttcagggggtgaacgtcgccgagttgcgatttgccgcttgctgctggaaaaaccagacatgctgctgctcgacgaacctaccaaccaccttgatgccgaatctgtcgcatggctggagcgctttctgcacgattatgaaggcactgtcgttgcgattacccacgaccgttacttcctcgataacgttgctggctggattttggaacttgaccgtggtgaaggcattccatgggaaggcaactattcttcatggctggaacaaaaagacgcacgtctggcacaagaagcctcctcagaagctgctcgacgcaaatccattgaaaaagaacttgaatggatacgccaaaatccgaaaggacgtcaggcaaaaggtaaagcgcgtctggctcgctttgaagagctcaataacgttgattaccaaaaacgtaatgaaaccagtgaattgtttatcccgccaggtccgcgtctgggtgataaagtgctggaagtgaccaacctgactaaatcttatggcgatcgggttttgatcgacaacctgagtttcgctctgccaaaaggggcgattgttggaattatcggcccgaacggtgcgggtaaatcaactttgttccgtatgttgtccggtcaagagcaacctgattcgggttcaatcacactgggcgaaactgttacgctggcttccgttgagcagttccgcgatagtatggatgataaaaaaaccgtctgggaagaagtttccggtggtcaggacatcatgcgcatcggcaactttgaaataccaagccgtgcctatgttggacgctttaacttcaaaggcgtagatcaaggcaaacgtgtcggcgaattgtctggtggtgaacgtggccgtctgcatttggctaaactgctgcaagttggcggcaatatgctgctgcttgacgaacccaccaatgatctggatatcgaaactctgcgggcactggaaaacgccctgctggaattccctggctgtacgatggtcatttcccatgaccgttggttccttgaccgtatcgcgacacacatcattgattatcaagatgaaggtaaagttgctttctttgaagggaacttcagcgaatacgaagattataaaaagcggacaatgggggctgaagcactggagccacaccgcattaaatataagaaaatcagtaaataa

SEQ ID NO: 3261 - DNA, 141 bp, Xenorhabdus bovienii
  Coding sequence Name=Xb4151_4152.C438.gene54.dna; Position on contig =36774..36914bp; Strand=+
atggatggggcattttaccctaaattttacatatcgtgttgctacctgattagcacgagttcaagcatccaattaccgcaaacggtaaaaactatctgtgcggaacgtgtgtttataagtgggatccccgttcctgtctga

SEQ ID NO: 3262 - DNA, 96 bp, Xenorhabdus bovienii
  Coding sequence Name=Xb4151_4152.C438.gene55.dna; Position on contig =36886..36981bp; Strand=-
atgaaagaatcgtttagaagaacacacctaatctcatttgtattccgtcccacagtgaatacaatcgtcagacaggaacggggatcccacttataa

SEQ ID NO: 3263 - DNA, 186 bp, Xenorhabdus bovienii
  Coding sequence Name=Xb4151_4152.C438.gene56.dna; Position on contig =36978..37163bp; Strand=-
atgtgctgcccctgcaacaaaaaccagacccacagctatcgtaaaatgccgccatttattcattactacatgctcctccaaaggactaaacggataaccaccaatacaaaaatgctattcaattataaccatattattgacatgattgattacaacagtgaattcataaggataagatttttatga

SEQ ID NO: 3264 - DNA, 1920 bp, Xenorhabdus bovienii
  Coding sequence Name=Xb4151_4152.C438.gene57.dna; Position on contig =37101..39020bp; Strand=+
atgaataaatggcggcattttacgatagctgtgggtctggtttttgttgcaggggcagcacatgcggattctttggacgcccaacgtgagcgatatcaagcggtaaagctggcgtgggagacgaaaaatatggcggaagttgaacgattaatgccaacgctgaaagattatcccctatatccttatctcgaatatcgccagttaactcaagatttggatattgccacgcctcagcaaatccgccactttattgatacttatccgactttaccaccagcgcgttctctgacatccaaatatatcgattctctggcaagcaatggagactggtctggtattttggcattcactccaaatgcaccaagggctgttatgacgcgctgcaattattactttgctaaatgggccaccggaaatcagcaggtagcatggaaaggtgcccaagaactgtggttgagtggcaacacattgcccggcagttgcgataaattgtttgatgtctgggaacaggctgggtatttatctgcaaatttaattttgcagcgtgtggaattggcgattaaatcaaataacactcagttggttaattatctgattaaacgcttgcctttgagctatcggagcttgggtgagaatctactgaaattgcaaagtgatcctgctttcattgagcattttgcccaaacatccacatcaacggattttacccgttccgttatcatgaccacgttttctcgttttgcccgtaaagacgcagaagttgccagacacagtattcctgctattgttcggacgcagaaaatgaatgactccgagcatcaattgttaaaagatgcagtggcgtggaatttaatgagcaatgtcacaccagagcaggcgaagtggcgggatgaggtcatacgagattcgcaatctaccaatctgcttgagcgacgcgtccgtttgacactgcaagatggcgatgaaaaagggctggtacagtggttgtcattgcttcccaaaagtactctgcaaaaaaaagaggagtggcaatactggagtgccattgtcttgcttaatgaaggtaagcaagcagagggtgaagcaatattgcataaccttagggaaaagcgaggtttttattccatggtggctgcgcagaaattaaatctcacttatccattgatgattgataaagcagaaaaaccagatgattcgattgcaaaaatgcgggaaataaagcgtatccatgagttgatatactggaatatggataatctggcgaactcagaatggaataactttgtttcttcacaaagcccgtttaaacagcaacagttggcccgttacgctcttgagcagcattggccggcactcagtgtacaggccactattacgggtaaaatgtgggatcatcttgaggagcgtttccctctggcatggcagaaggaatttgcgaattttactgttgataaaaatatttcacaaagttatgcgatggcgattgcccgacgggaaagtgcatggaatcctcaggctcgttctgggaagggagctagcggattgatgcaaatcatgccaaaaaccgcagagcataccgtgaaggagcagaagattcaggggtattccagcagtagtcaattaatggatccagcgatgaacatcaaagtgggtacagcttatctggacttggtttaccagcgttttggcaataaccgtgttcttgccagtgcggcctataatgctggccccaaaaatgttgaacgctggctggcgaatagtgctgatcgtattgacgcgatagcttttattgagagcattcctttcggggaaacacgcgattatgtcaaaaacgtactggcttatgatatgtattaccataattttatgggaatacattcaaatgcgttgactaacgcagaatggcaaaggcgttattaa

SEQ ID NO: 3265 - DNA, 324 bp, Xenorhabdus bovienii
  Coding sequence Name=Xb4151_4152.C438.gene58.dna; Position on contig =39077..39400bp; Strand=+
atgataccaaatcacttgattgatccggcactcaccccggaaaatagcgatgactggctcacttttgtgggattgttacagtcagcatttgaacaaaatttgcaacatccgattttgcagctattattgactcccgatgagcgcacggctctgtcaactcggattcggattgttcaggaattaatgcgtgggcagatgagccagcgtgagttgaaaaatgaacttagtgtaggtatagcgacaattacgcgtggctccaacagcttaaaagcagcaccagctcctgtcagggcgtggttggaagcgcaattattaaaaagctaa

SEQ ID NO: 3266 - DNA, 534 bp, Xenorhabdus bovienii
  Coding sequence Name=Xb4151_4152.C438.gene59.dna; Position on contig =39449..39982bp; Strand=-
atgtaccacgttattgctgcaacaactaaccctgcaaaaataaaagcgattaaccttgcattcgatgatgtttttggccccggcacttaccgcatagaagatgtcaacgtagacagcagcgtccctcaacaacccattggcaatactgagacccgtaccggtgcccgtcaccgcgtgatggcagcccgtcaggttcggccagaagccgatttttgggttggagttgaagctggaattgaagatgacatgacgttcgcctggatggttatcgaatacaagcaaattcggggtgagtcgcgctctgccagtctgatgctgcctgaaaaagtattggaaggcattcgtgaaggacgcgagcttggccatgaaatggcttatttgaccggcgtcgataatatcaagcagaaaggtggcgcaatcggcttttttactaacggtattcttacccgcaccagcgtttatcatcaggcgctgatattggctcttgttcctattcatcatgaaatttacaaagagttgaataaccaaccttaa

SEQ ID NO: 3267 - DNA, 648 bp, Xenorhabdus bovienii
  Coding sequence Name=Xb4151_4152.C438.gene60.dna; Position on contig =40037..40684bp; Strand=+
atgttacaggtctatcttgttcgccatggcgaaaccgaatggaacgtggctcgccgtattcaggggcaaactgacagtcccttgactgaaattggcctgcgtcaggcacgcttggtagcacagagagtaaaatcacaaaacatcacacatgttatcaccagtgaccttggtcgaacacgtcaaaccgcagaaatcatcgcgaaagcctgtgggtgtaaagtgctgctggaaccccgtttgcgggagttaaacatgggtgttctggaaaatcgtgaactgaattccctgactcctgaagaagaatcctggcgtaaaagtcttgtcgatggtacaccaaatgggaagatcccagaaggtgaatcaatgaatgaattgtcagctcgtatgcgggcagcgctggaaagttgccttggcctgccagcaggcagccgcccgttgttagtgagtcatggtatagcattagtctgtttggtcagttctatcttggggcttcctgccaactcggagcgccgcctgcggctaagaaactgctctatctcaagagtggattatcaagatagcccgtggctggcttcgggctggattgttgaaactgcgggtgatatcacacatctggatatgcccgcattggatgaattacagggttaa

SEQ ID NO: 3268 - DNA, 882 bp, Xenorhabdus bovienii
  Coding sequence Name=Xb4151_4152.C438.gene61.dna; Position on contig =40681..41562bp; Strand=-
atggatcaaaccaacatcattcgagatttgctgcattggatggataataacctagatcgtccactatccctcgataacgttgcagcaaaagcaggttactccaagtggcacttacagcgcatgttcaaggacgtcacaggtcaggctattggttcttatatccgagcaagacggttatccaaagccgcagttgcattgcgtttaaccagtcgccctattctggacattgcattgcaatatcgttttgattctcaacaaacgtttactcgggccttcaaaaaacagttcaaccgaacgcctgcttcctaccgccgaaatgaagagtggtgtgctacgggtatttgtccacccattatgttggataacaaaccgttgccagcacacaagtatgtcacgttggaagatcagcttcttatcggtactgagcatacttgttcttatactctagagcagtggtcaagtgcctgcacagagatgcgtcacggtttttgggtaaactatctgcaacatgctgaaacacttccccccaggctgtacggattgcaccattccgatctcagcgcagagcatgaagatgagcagactgttttctataccacagcaatagaaccagaatatgccacatttaatacgcaagacaataggcctgttgttctacctggcggtgactatatttcattcagttattttgggggcaaagaacaattaaaagagttcctctttacagtttatggtatctgcttgcctaaattaaacatcactcgcaggaaaggatacgatgttgagcgatactaccttactaatcttgaatggaaaaactttgaggatgagtctcaaacccacgttgtggaatttgagtacctcatcccaattgagcgttaa

SEQ ID NO: 3269 - DNA, 183 bp, Xenorhabdus bovienii
  Coding sequence Name=Xb4151_4152.C438.gene62.dna; Position on contig =41678..41860bp; Strand=-
atgagaaggtttttccgtaaaagtgggtattacatgctcaggtttacacaaaacaaaattaatcattcatggcatctagaattaacaacttttaccagtgagaataggaataatttctgctctccgaccatcaagaggcatcataagctatgttttttaccttttggaaatggtaggtgttaa

SEQ ID NO: 3270 - DNA, 102 bp, Xenorhabdus bovienii
  Coding sequence Name=Xb4151_4152.C438.gene63.dna; Position on contig =41966..42067bp; Strand=-
atgacacttaaaaatacgcctattttgagaaagtttttatcagcctgttttatgttcaacatccaccaacctatgtatgttggcgggtggaaatggttgtga

SEQ ID NO: 3271 - DNA, 477 bp, Xenorhabdus bovienii
  Coding sequence Name=Xb4151_4152.C438.gene64.dna; Position on contig =42266..42742bp; Strand=+
atggtaacaatcaagaaaatagtaatagcggctgccttgatcttttctcctgtgatcctgcatgctgaggagatcggttctgtcgataccgtgttcaaactattcggtcctgataacaaaatagtaatagaagcttttgatgatcctgatgtcaaaaatgtcacctgttatctgagcagggctaagacaggcgggatcaaaggcggattggggttggcagaagatacttctgatgccgctatatcctgccagcaggtcgggccgattgaattgagcgacaaaatcaagacatctcccaaaaaagggcaggttgttttccaaaaacgtacatctctggtgtttaaaaaacttcaggtggttcgtttctacgatcctaaacgtagttctctgatttatttaacttattctgataaagtcatcgacgggtcgcctaaaaatgcgatcagtgcggtgccgatgatgccgtggaaagagtga

SEQ ID NO: 3272 - DNA, 717 bp, Xenorhabdus bovienii
  Coding sequence Name=Xb4151_4152.C438.gene65.dna; Position on contig =42823..43539bp; Strand=-
atgcaaaccccgcacattttgattgttgaagacgaaattgtcacacgcaataccctgaaaagcatttttgaagctgaagggtatgtcgtttatgaagccactgatggctcagaaatgcacaacattctgtcagataacgatatcaacttagtgattatggatatcaatctgccaggtaaaaatgggttacttcttgcccgtgaattacgtgagcaggcaaatgtcgccctgatgtttttaacagggcgtgacaatgaggtggataaaatccttgggcttgaaattggcgctgatgattacatcaccaagccatttaacccacgagaattaaccatccgtgcacggaatttgctttcccggactatgaacctgagtcattcaggtgaagagcgccgtcaagttgaaagctataaattcaatgaatgggaattagatatcaacagccgctctctggtaagcccaatgggagatcagtataaactgccacgcagcgaattccgcgcgatgctccacttctgtgagaatccggggaaaatccagactcgtgcagaactgctgaaaaaaatgacagggcgcgaacttaaagctcatgatcgcaccgttgatgtcactatccgtcggattcgtaaacactttgaaaccacaccagatactccagaaatcatcgccaccattcatggtgaaggctatcgtttctgtggagatttagaagactaa

SEQ ID NO: 3273 - DNA, 150 bp, Xenorhabdus bovienii
  Coding sequence Name=Xb4151_4152.C438.gene66.dna; Position on contig =44118..44267bp; Strand=-
atggttccggtggtaatcgtcgtaatggtttctgtagtaaccttatttttcgggctgatatggcgcatgatttcctgtctgtcttttaattcggttgaccccctattggttaaagcaaactgtggccgaagtcaaatatttttgtcatga

SEQ ID NO: 3274 - DNA, 2460 bp, Xenorhabdus bovienii
  Coding sequence Name=Xb4151_4152.C438.gene67.dna; Position on contig =44368..46827bp; Strand=+
atgcgagtactgaaatttgggggcacctcagttgcaaattaccagcgtatactgagtgttgctgatatcgccgaaagtgaactatcccttgggcaagtggccctggttctttctgcacctgcaaaaatcacgaaccacttggtggcgatgatagacaaaacggttgcagggcaggatattgtttctaacatgagcgatgtgtcccaaatctttgctgatttgctgtcgggcttaaaagaacatcagccgaatttcggttatgaatacctgaaaggcgttgtggaacgtgaatttgcctacctgaaacagaccttgcatggcatttcgctattgaagcagtgtccagacagcattaatgctgctctgatttgttgcggtgaaaaactgtccattgccattatgggggcggttttacaggcgcggggtcataaagtgacagttattgatccggtcaaaaacctgcttgcccacgggcattatcttgaatcgaccgttgatattcacgaatcgtccaaacgcattgctgcgttgaacatcccggctgggcatatcattctgatggcgggttttactgcgggtaacgataacggtgaattggtggtactggggcgcaatggttccgactactcagcggcagtgctggctgcgtgtttacgcgcagactgctgcgaaatctggactgacgtagatggcgtttatacttgcgatccaagggctgtacccgatgcacgtctgctaaaaagcttgtcatatcaggaagcgatggagctttcttatttcggtgccaaagtccttcatccgcggacaatcgcgcctattgcccaatttcagatcccttgcctgattaaaaacacggcgaaccccgatgtgccgggcacctttatcggagaaggacagaaagacgaaaatctgcccgtcaaaggcatcaccaacctgaacaatatggcgatgatcaacgtctcaggtcctggcatgaaaggtatggtcgggatggcggcgcgggtgttttccgtcatgtctcgcaaaggtatttctgtcgtgttgatcacacagtcttcatcggagtacagcattagcttctgtgtgccgcaaaaggagctgacaaaagcacagaaagcgctgaccgaagaattttatctggagctgaaagatggtgtactcgatcccattgatgtgatcgataaccttgccatcatctctgttgttggggacggaatgcgcactcagcgaggtatctctgcccggtttttctctgcgctgacccgcgccaatattaacattatcgccattgcacagggatcatctgaacgttccatttcggcagtgattgacaatgataccgctaccacagcggttaggttctgccaccaaatgttgttcaacaccgctcaagtggttgaagtcttcgtggtgggtgtgggaggggtgggtagtgcattgattgaacagatccgtcgccagcagtcatggctcaaacaaaaacacattgatctgcgagtgtgtggcattgccaattcacgggcgatgttgacggatatgcagggcatcggtctggataattggcaacagtcactgtcggaagcgatcgagcctttcagcttgagccgccttatccgtcttgaaaaagaatatcatcttctgaatccggtcattgtggactgcacttcgaatcagtcgattgcggagcagtatgccagctttttaggcgatggttttaatatcgtgacaccgaataaaaaggctaatacgttgtcgatggcctactatcgtcaaattcgtcaggcagccgaaaaatcgaaacgaaaattcctgtatgacaccaacgtaggagcaggattgccggttatcgaaaacttgcagaatctgctcaatgcgggggatgaactggtgcagttcaacggcattctgtccggctcgttgtcttatattttcggtatgttggatgaaggcatgacgctttcacaagcgactctgctggcaaaagaaaagggctttaccgaaccggatccacgggatgatctctccggtatggatgttgcccgcaagctattgatccttgcacgtgaatctggctatgaactggaattggaagatattcacgtcgagccagtcttgccggctgcgtttgatgccagcggtgatgttggtcgcttcctgcaacgtttgccacagctggatcaagaattcactcatcgtgttgcggatgccgcaaaacaggggaaagttctgcgttacgttggcatcattgaacaaggccgttgtagggtgaaaattgccgcagttgatggcaacgatccgctttataaggtcaaaaatggcgaaaacgcactggctttctatacccgttattatcaacccattccgctggtgctacgtggctacggtgctgggaatgatgtcacagccgccggggtttttgccgatatattacgaactctgtcatggaaattgggggtttaa

SEQ ID NO: 3275 - DNA, 951 bp, Xenorhabdus bovienii
  Coding sequence Name=Xb4151_4152.C438.gene68.dna; Position on contig =46809..47759bp; Strand=+
atggaaattgggggtttaatggtggtcagaatttatgcacccgcctctatcgggaacgttggcgttgggtttgatgtgctcggcgcagcggtttctcctgttgatggctcgttgcttggagattgcgtctctgtctgtgaagctgaacatttcagtttaagtaatgaagggcggtttgccgacaaattgcctgctgatcccaaacacaacattgtttatcaatgctggcagcttttttgccagcatctgggaaaagagctgcctgttgccatgacactggaaaaaaacatgccgattggttcagggctgggttccagtgcctgttcggtggttgctgctctggtggcattgaataagtatgctgactgtccatttgacagcaaccaattgttggacatgatgggcgagttggagggacgtatttccggcggtgtacactatgataatgtcgctccatgctacttaggggggttgcaactgctccttgcgcagaaaaatgccgtttgtcagtttgttcctacttttgatgattggttgtgggtgatggcttaccccggcatcaaagtttcgacatcagaagcccgtggcattctgccggcaaattacccccgtgaggatatgattgagcacggtcgttattttgcgggatttattcacgcctgtcatacccagcaatccgaactggcggctaaattgatgaaagatgtcgttgctgaaccttatcgcacacaacttttacccggatttgccaatgcgcgtgatggagtaaagaaacgaggagctctggcgtgcagtatttcgggttctgggccgacattatttgcgatctgcaatgacatggctgtagcgaaagaagtcgcacagtggctgcaacaacattacgtacaaaatgatgaaggttttgtgcatatttgccgtctggatctcgcaggcgcacgacaggtagagtaa

SEQ ID NO: 3276 - DNA, 1293 bp, Xenorhabdus bovienii
  Coding sequence Name=Xb4151_4152.C438.gene69.dna; Position on contig =47762..49054bp; Strand=+
atgaaactatataatttaaaagacagcagcgagcaggtcagcttttcacaggcggttaaacagggattgggcagacagcaggggctgttttttccgcaggacttacctgaattcagtcgtgacgaaatcgacgaattattgaaactggattttgtcagccgtagccagcgaattctctccgcttttattggtgatgaaattcccgcagaacaattggcggctcgtgtcaaaaatgcttttgcctttcctgccccggtgacgggcgtcgaagacgatatcgtttcgctggagttgtatcatggaccgacactggctttcaaagattttggtggtcgttttatggcgcaaattctcacacaaatcgcgggagaacagccggttactattttgactgcaacttccggtgataccggagcggcggttgctcatgccttctatggcctggacaacgtacaggtggtgatcctctatccagaagggaaaatcagcccattgcaggaaaaattgttctgcacactgggagggaatatccacaccgtcgctatcaagggcgatttcgatgcttgtcaggcgttggtaaagcaggcttttgatgatgaagaactgaaacgtgcattgtatctcaattctgccaactcaattaatatcagccgcttattggcacaaatctgctactactttgaagctgttgcccagatcccagcagaaaaacgtgaacagttggtgatttccgtgccaagtggcaacttcggtaacttgacagcggggttgctggcgaaatcgttggggctgccagtaaaacgttttattgctgcgacgaatgtcaatgataccgttccccgttatctgtctgaaggagcatggcagccacatcagaccgttgcgactctttcgaacgcgatggatgtcagccagccaaataactggccgcgcattgaagagttgttccagcgcaaaggctggtcactcagtgaattagccaatggtgtggtggatgacagcaccactcaggccacaatgcaagaactggccgccaaaggctatatttccgaaccccatgccgctgttgcctatcgtgtactgcgtgatcaattacaggcaggagagtatggtctgttcttgggaacggctcacccggccaagttcaaagaaagcgttgaagcgatcctcagccagccgctgccattgccacaggaattggcagagcgtgcggatttagctctgttatctcactttctgcctgctgactttgcgagtttgcgcgaattcttaatggaaagagcgccgacataa

SEQ ID NO: 3277 - DNA, 777 bp, Xenorhabdus bovienii
  Coding sequence Name=Xb4151_4152.C438.gene70.dna; Position on contig =49101..49877bp; Strand=-
atgcttattactatttcacctgcaaaaacactcgattatgaaagtccacccgcaacaaagaaatatagccagcctgcattgctgggggaatccaagcaattgatcgatgtctgccgaaccttaacgccagcgcaaatcggtagtctgatgggcatcagtgataaactggccggcctgaatgcggctcgttttggtgaatggcagccgaatttcaccccggaaaatgcccgtcaggcgatcctcgcctttaaaggtgacgtctataccggtatgcaggcagaaactttctcagacgccgattttgactttgcccaaacgcacttgcggatgttatccggcctgtatggcgtcttacgccctcttgatctcatgcagccgtatcggctggaaatggggatcaggctggacaacccgcgtggcaaggatttgtataagttctggggggatctcatcactgaaaatctgaatgctgcactggaacagcaaggtgatgatgtgttggtcaatctggcatcagatgagtatttcaagtcagtgaatactaaaaagctagcggctcaaattatcaaaccaatttttctggatgaaaagaatggcaagtataaagtgatcagcttctatgccaagaaagcgcgtgggctgatgagccgctttatcattcagaatcaactgactgatcctgcccggctggtggaattcaatctggaaggatacgccttcgatgaatcgctctccaaaggcagtgagcgggtatttaaacgccctgaacagcattga

SEQ ID NO: 3278 - DNA, 132 bp, Xenorhabdus bovienii
  Coding sequence Name=Xb4151_4152.C438.gene71.dna; Position on contig =49876..50007bp; Strand=+
atgattttgttccgatatgattttgtttcgaatcgttttccccataatgcaggctttctcaactttagcaaaaacaaactgaaaagggcgaataacagcgataagattttcctaccttacagcagcgcttga

SEQ ID NO: 3279 - DNA, 1005 bp, Xenorhabdus bovienii
  Coding sequence Name=Xb4151_4152.C438.gene72.dna; Position on contig =50026..51030bp; Strand=+
atggcgaggcaacagtgccaatattttacgtataacgatgagatattaaacatgaccgataaactgacttccctgcgtaaactgacaacagtcgtagcagatactggggatatcgcggcaatgaagctgtatcagccgcaagatgcaaccaccaacccttccttgattttgaacgcagctcaaatccctgaataccgccaactgattaatgaagccattgaatgggcgcgtggtcagagcgattctcgtgagcagcagattattgatgccggcgacaaattggcagtcaatattggtctggaaattctgaaactgatccctggccgcatttccaccgaagttgatgcgcgcctttcttatgacactgaagccagcgtagcgaaagcaaaacgtttgatcaaactgtacaacgaagcgggtattagcaatgaccgcattctgatcaaactggcttctacatggcagggtatccgtgcggcggagcaactggaaaaagaaggcatcaattgtaacctgaccctgctgttctcttttgctcaggcgcgcgcttgtgcggaagcgggtgtttatctgatttctccgtttgttggccggatccttgactggtacaaagcgaatggcgataagaaagaattcgcaccacatgaagatccgggcgtgatctctgttgctgaaatttaccagtactacaaagaacatggttataacacggtggttatgggcgcaagtttccgtaattccggtgaaattctggaactggctggctgtgaccgtctgactatctctcctgcgctgctgaaagaattatctgaaacagcaggtgaagttgagtgcaaactgggttatgaaggcgagatcaaagcgcgtccagctcgattgacagaagctgagttctactgggaacaccatcaggatgcgatggcgaccgaaaaactggcggaaggtattcgtaaatttgccgtagatcagggcaagcttgagagcatgatcgctgatctgctgtaa

SEQ ID NO: 3280 - DNA, 576 bp, Xenorhabdus bovienii
  Coding sequence Name=Xb4151_4152.C438.gene73.dna; Position on contig =51149..51724bp; Strand=+
atgaatctactgcgcattggcctcgtgtctgtttctgatcgtgcttcaaacggtgtctatcaggacaagggcctccctgcattggaaacatggttggaaaaagcgattaccacgccttttagcgtcgaaactcggctgatccctgatgagcaaatcctgattgaacaaaccctgtgtgaattagtcgatgaacggggctgccatttggtactgacaacgggaggaaccgggccagctagccgtgatgtgacgccagatgcaacactggcgattgctgatcgtgaaatgcccggatttggtgaacaaatgcgccagatcagccttcaatttgtgccaacagcgattttatcccgtcaagtgggcgttattcgtcatcaagcgttgatcctcaacctgcctggtcaaccgaaagccattgcggaaacgttgggaggtctgaaagatggcagtggcaaggtgttggtgtcagggatttttgctagtgtcccttattgcatccaactgctggatggcccttatgtggaaactgatgaaacggtagtcgccgcttttcggccgccgctaaaaaatggataa

SEQ ID NO: 3281 - DNA, 303 bp, Xenorhabdus bovienii
  Coding sequence Name=Xb4151_4152.C438.gene74.dna; Position on contig =51790..52092bp; Strand=-
atgagggagcgagggatcgttatggcattagttgaagtgaagtgtcgattttatgaccaaagcacgacaaaggaaaagctgggcatcaacgatattattgccagtcctgtcgtagaaccttccagctcgaatacacttaccgggcttgccatgaataacgccggtattcgtgatacggcacgggcacttcatgtcagtattaacgctgttgtacgcactctaaaaaactcgtgccatgatgtgtattcagcggcaacagaaaacggcaatgctggctgtggtacgcgtgggagcctcgcttga

SEQ ID NO: 3282 - DNA, 741 bp, Xenorhabdus bovienii
  Coding sequence Name=Xb4151_4152.C438.gene75.dna; Position on contig =52154..52894bp; Strand=-
atgaaagaaattacttttaccccagttaaaaccactgccatcgatgatcccttcttcaccgtcatccaaagaggcaacttacccaaataccctgatattcaggtaatgcagacttattataatcaggcttgctatcaggatattttatttgataagtacggtattacctatccggcaaggctacagaacgcggtaaacaaacggaaagctgaatatctggcggctcgctactgcactcaacagatcttaaatagcatggactatcctgaatttcaggtcataaatgcgccagaccgctctcctgtctggcctgataagatttgcggctccctgtcccactccgccaactgcgccattgtttttgccgcttcccgcgagaaatatcagataattggggtggatatcgaacaagaaattaagcaggatactatcgatagtgtttcacgcactgtcattaatgaaaccgaagcagaattgctgaaagaatgtacactctctttcgctcaagcatttactcttaccttttccatcaaagagagccttttcaaggcacttcacccccatgtaaaacgcttttttgattttcatgctgctgaaattacagccattgattgccgtaatcacaccgtgagcatcaaattgctgaaaacattatctgatgaatatcaggctggctcgcaatttcatgggagttttgtcctgatgccgcaacaacaggtgctgacgtatttgattggttaa

SEQ ID NO: 3283 - DNA, 117 bp, Xenorhabdus bovienii
  Coding sequence Name=Xb4151_4152.C438.gene76.dna; Position on contig =52854..52970bp; Strand=+
atggcagtggttttaactggggtaaaagtaatttctttcatgatcaatagaatattatgggtgagttattatctattaattttgccacactttagcgcttgttcactaacttactga

SEQ ID NO: 3284 - DNA, 114 bp, Xenorhabdus bovienii
  Coding sequence Name=Xb4151_4152.C438.gene77.dna; Position on contig =52964..53077bp; Strand=-
atgcaaagattcgataaacacgatatcacattcttccgcgtgccagtttttgttagtgtcactgtttcacacaataaaaatgataacaagaaagagtataaaaagagtcagtaa

SEQ ID NO: 3285 - DNA, 993 bp, Xenorhabdus bovienii
  Coding sequence Name=Xb4151_4152.C438.gene78.dna; Position on contig =53131..54123bp; Strand=+
atgggatatatcggcagtcatacttgtgttcagatgatggaagcgggaatgacgccgatcattatcgataacctgtgcaatgccaatcgcgaagtattggcgcgcattgcggcattgacgggtgtgatgcccctgttttatgaaggggatattcgtgatgaatcattcctcgatactattttttcccgccatcaaattcagtcggtgattcattttgcaggtttgaaggcggttggggaatctgtcgctaaacctattgaatactatgataacaatgtcaatggtacgctggtgctgatgcgcagcatgcataaagcgggcgtaaaaagcattattttcagttcatctgcaacggtgtatggcgatccggagatcgttccaattacagagcaatccgccgtgggcaataccactaatccttatggcaccagcaagtatatggttgagcgctgtctgtctgatcttcatcacgccgaaagtgattggtcggtagtgttattacgttactttaatccggttggtgcacatccttctggtactatgggcgaagatccgcagggcattcccaataatttgctgccatacatcgctcaagtggccgtaggccgcagagaaaagctgtccgtttatggcagtgattactcaacgcatgacggtacaggcgttcgcgattatatccatgttatggatttggctgatggacatattgcggcactgaatgccgttggcaagaaatcaggtctgcacatctacaatctaggaaccggaaaagggactagcgtattggaaatggttacggcatttagccacgcttgtggcaaacccgttccttatgaaatctgtccgcgtcgtccgggtgatatcgccgaatgttggtcaagtccagaaaaagcagaacgtgagctgggctggaaagccagccgcactctggttgaaatgacggctgatgcatggcgctggcaatctcaaaaccctaatggttatacccaatag

SEQ ID NO: 3286 - DNA, 153 bp, Xenorhabdus bovienii
  Coding sequence Name=Xb4151_4152.C438.gene79.dna; Position on contig =54201..54353bp; Strand=+
atgcattattacccatttctttaccaactattgtcattcatcacaataagtatgcttaactgtcttgaaatcacagtaacggctttacagacagtcggtgaaaaaggttgggatggttttgcgttattacggataaacacggaaaatcattaa

SEQ ID NO: 3287 - DNA, 459 bp, Xenorhabdus bovienii
  Coding sequence Name=Xb4151_4152.C438.gene80.dna; Position on contig =54547..55005bp; Strand=-
atgaaatggcgtagttacacatacggagcgatgttactggcgggtagcctgtttagctctgccttatgggcgaaaggcgaagcgcacctgttattccacatggggttgggagccaatggcaaattctttgtagggggcacgctagaaaataaaggcaataaacctgtagcaggcggctatctggcggttttacctctgaataccaaatgtgaacctcaggctccggcagtacaatcatttgaatcactggcgccgggagagaaaaaagaattccgtatccccgtaaatacccaactaagtggctatcgcctgattggttttggtgcttatgatgatatgggttttaccctccctactgtggatgaaacagcaaaagtgattaaagaccgagagtccaatgaacgtaaagcctgtcagttagcccgtaaatctgaaaaaactgcggtcaaaaaacaataa

SEQ ID NO: 3288 - DNA, 912 bp, Xenorhabdus bovienii
  Coding sequence Name=Xb4151_4152.C438.gene81.dna; Position on contig =55106..56017bp; Strand=-
atgtatacgcatactgaagcagcaaaactggcatcattaatcatgtatgcatatgatatgaatgaaaaatattacaataatcccactccccctgctgatccacgtatcaaagaggatggatggaatcttatcgcttatatttctggagatgacacttctttctcagtagaaaaaaaaatgttgttcacattgccgcagagtatctgttacggatatattgcagagaagaagaatgccccgggagagtacgtcattatattccgaggaacggatgacacaaaccttctggaggatctccataatatcattgccatttttacatcgccttggtctagtgctccagaacggaaagtaagccgcggtttttatagcgtttacgactcactgaaactcattgcgtttaattctgaatgtgattatagccaactcaaactggccaatgcgattactcaaatcataggtataaacggccaattcacaatacttgctcatagtcttggagccgccatcgcttcttatttgatgtgtgatatcgcttttttagcccccaatcattctgcctgtttgtttgcttgtccgagacccggaaataatgaatttgttgaatatgttgataataattttagccactatgaagtattcaactatgcaaaagatatcgttcccaatttaccgcctgatttgccggtacttaatatttctcagcaatgggactacgaatacaaatcactacctaatatcaccctccttaaccctccggaagcgctgaacatagccgacagcataggttgcaaccactatttaaccagctatattgctatattggatccggatgaattcaccagagttacaacagataatgatgcagtacagggagaagtcaatagtcattgcgtacatacgaataaataa

SEQ ID NO: 3289 - DNA, 165 bp, Xenorhabdus bovienii
  Coding sequence Name=Xb4151_4152.C438.gene82.dna; Position on contig =56067..56231bp; Strand=+
ttgaagaaattgtggagaatttgggcgtgtagtgtggagtttcagagcgctattgatgatctattgatgttaaagagataccctttttatcgggttggccgagtatttagtaaaaataacgatctatctattaatatagaattaatcacattttgttatatatag

SEQ ID NO: 3290 - DNA, 1371 bp, Xenorhabdus bovienii
  Coding sequence Name=Xb4151_4152.C438.gene83.dna; Position on contig =56330..57700bp; Strand=+
atggctgtaccacgttcggttcttgaactgattggcaatactccgctactggagctgacccatctggatactggcccatgccagttgtttatcaagttggagaaccaaaatccggggggctctattaaagaccgagtggctctttcaatgattgaaaaggctgaaaaacagggattgttgcagccaggtggaaccatcattgaagcgacggccggtaataccggtatcgggctggcgctggtcgctgccatgaaaggctataaactgattctggttgtgcctgataagatgagccgggaaaaaatttatcacttgcgggcattgggaacggatgtacgtctgacccgttctgatgttggcaaagggcatcctgagtattatcaggactacgcgctgcgtttgtcgaaggaaatcagtggtgcctattatatcgatcagttcaacaattcctctaattcactggctcatgccacgacgacaggccccgaaatctggcaacagatggagcataacgtggatgctgtggtggttggtgtaggttctggcggtacgcttggcggtttgagtcaatacttcagagaagtctctcccgatacagaatttgttctcgctgatccgaaagggtcaattctggcagattatgttgagtacggccgttacgatgaagccggaagttggtttgtggaaggtattggtgaagactttatcccgccgctcggggatttttctcaagttcagaatgcctatcggattactgatgcagaagccttttccagcgccagagatttgctcctgcaagagggcattctggcgggttcatcttcgggaactttactggccgccgctctacgttattgccgcgcccagaagacgccaaaacgggtggtgacgttagcctgtgacagtggtaacaaatatctgtctaagatgtttaatgattactggttattggagcaagggttacgttcacagccacaagagaatgatttgagtgattacattacctatcgttatcgggagggtgcaacagtttcagtttcgccgcaggatactttgcaaatcgctcatggccgaatgcgcctgtatgacatttcacagttgcctgtgctcgaaaatgaacaggttgtgggcatcattgatgaatgggatttaatgcatgccattcactcagattctaataatttttctttgccagtcagcaaggcaatgacgggtcaagttaataccctcaataaaaaggctccactggagcagttgactgcaacttttgatgcgggtcatgtggctttgattgtggatgataacaatcgttttctgggtctcgttacccgtactgacgtgctgaatgcatggcgccaacaactcaattga

SEQ ID NO: 3291 - DNA, 1161 bp, Xenorhabdus bovienii
  Coding sequence Name=Xb4151_4152.C438.gene84.dna; Position on contig =57719..58879bp; Strand=+
atgactacaactaagtttgatacaaaaagcgttcatgcaggctatgtccccgatcataccggcgctgtcatgcccgcaatttatgccacttccacttatgcacaacctgctcccggccagcatacaggctatgagtactctcgcagtggtaacccaacccgcgatgccctggagagtgctattgctgaattggaaaacggtacgcgtggctatgcttttggttcagggctggccgccagctctactattttagagctactggataaagacagtcacattattgccgtagatgatctgtatggcgggacttaccggttattggaaaaagtccgtcgccggacggctggcctgcgtgttacgtatgttgaagcggggaatactgctgcactggaagccgccattgagcctgatacaaaaatgatttgggtggagacaccaaccaatccactgctgaaactggctgatctggctgccattgctcagatcgcccagcgtcataagattatcagcgtagcggacaatacttttgcatctccctatatccagcgccctcttgatttaggttttgacattgttgttcactcagcaaccaaatatctgaatggtcattctgatgttgtcgcgggtcttgccgtggtgggaagcaatgctgaactggcggaacaggttgctttcctgcaaaactccattggtggcattctcgatcctttcagcagttttcttgtcctgcgtggtatacggacgttggcactgcgtatggagcgccatatcgataatgcagagaagattgcacattggctggagcagcaacctcaaatagagaaagtattttatccgggtctggcttcccatcctcagcatgaattagcaaaacgtcagatgcagggttttggtggcatgatttccgtggtattgaaaggcgatgatgactatatacgccgagtgattaaggaactgaaattatttacgctggcagaaagtcttggcggagtagaaagtttgattggccagccatttacgatgacccatgcttcgattccactggaaaaacgtctggcatcaggtattacaccccaattgatccgtatttcagtcggtattgaaaattcagaagatttgattgccgattttgctcaggcgctagaaaaagccagtctgtaa

SEQ ID NO: 3292 - DNA, 291 bp, Xenorhabdus bovienii
  Coding sequence Name=Xb4151_4152.C438.gene85.dna; Position on contig =59078..59368bp; Strand=+
atggcaattttaaatatactcacgatccctgatgaaagattgagacaaaaatgtattgatgtcacgcatgttgatgaaatacaaacactgattgatgacatgttggatacaatgtatgacacagataatggcattggcttggctgcaccgcaggttggccgaaaagaagccgttctgatcattgatatctcacctaatcgggatcagccaatggtgttagtcaatcccaagattgttgaaaaagagcgtcgggtcgtgaatcaagaaggatgtctgtctatacgcaattaa

SEQ ID NO: 3293 - DNA, 1050 bp, Xenorhabdus bovienii; identical to SEQ ID NO: 483
  Coding sequence Name=Xb4151_4152.C438.gene86.dna; Position on contig =59365..60414bp; Strand=-

SEQ ID NO: 3294 - DNA, 516 bp, Xenorhabdus bovienii
  Coding sequence Name=Xb4151_4152.C438.gene87.dna; Position on contig =60587..61102bp; Strand=+
atgacaacaaagaatggaggaagtattaatggacagtctggatttacactactggaattactgatagctatggccttaatttcaattagcctatcatgggggttatatcattgggggcaatatcaaaaccgcctgcgtttacagtcagcagtacagaatgtattgtcttttatggaaaggcaacaagggttggcaaattatatgaatcaggagcgtacattgtggctggtaatagggcaaacgtggtgtctgatttcttcggtatccaggatatctgattgccgcgagggggagggagagcgagtcaactcaccttatgacgatgtatttttggcatcagcaaccagtgatcgcgttgatttttatggtgtcagaaacaccgctatgccagccagttttgtgctggcaaattcagcaggagagattagcgtcgtgatttcaggacgtggaagaatcagaacatgcagcaataatattagccaacttcctaattgtgagggaataaaaggttcatga

SEQ ID NO: 3295 - DNA, 612 bp, Xenorhabdus bovienii
  Coding sequence Name=Xb4151_4152.C438.gene88.dna; Position on contig =61099..61710bp; Strand=+
atgacattggttataccccttttaaagagaaaacagaccggattctccttacttgaagtcatggttgccatgttgatcagtagtgtgatttttatcgccatgacaaaaacttatccggttttatcaggtcagatcctcgaactataccggaaatatcgcctccattatctggtaaatagaactatttatatgatggaaaaagatctcaggcgtgcgggttattgtcgggacagaaaacaatgtgaaggtgagccattactgattaacaataaaaatacagaagctgctgattcctgttttattgttgcttttgaccttaatttaaataaccaatgggaaaaacccgatcatattgaatcggagttttttggttatcgattaaataatcatgccctcgaatggaaaagaggcgtggagaattgtcagggaaatggttgggaaagattgtttgatccaacggaggttatggttgatatttttcaccttgaaaaattacaggcaaaaaatgggctgacttttattacgttgtccattaatacccgctggcttaaatctccgtccattatatatcgtcaccaaatgacagttcgcctacgtaatataaggaaataa

SEQ ID NO: 3296 - DNA, 441 bp, Xenorhabdus bovienii
  Coding sequence Name=Xb4151_4152.C438.gene89.dna; Position on contig =61715..62155bp; Strand=+
gtggatgggcagcggggcaatattttgctggtatcgatactcatgttaatggcactgagcttaatgatgttgaaagcactccattatcaacaagagagtgccatgctcatgatgatggatgagaaaaagtacctgaacgcttttcagcgggcagaatcatcgctggaatggggaaaggtgcagtcatggcaatttaatatgcaggaaaaggaaaactggttttgccagcaacagccggaatttcatttgcaaagctgccttaaacactatgcggataatctttttctattaaagggggtggctcagttcgcgtcaggggaaactcttgaactttatcaatggatgaaacagatgaaaaaagcaaatagagatacacttattcctattgaaagtggttggctggatttctgccctgttccgcaggctgaattttgtttatga

SEQ ID NO: 3297 - DNA, 378 bp, Xenorhabdus bovienii
  Coding sequence Name=Xb4151_4152.C438.gene90.dna; Position on contig =62152..62529bp; Strand=+
atgaaacgattccatctccatcgacacaagcggcaaaatggtatgagtttgccggaagttatgttggcatctgtcgtgtttgcgatctctttgttgggcttaatgcgttaccatcaggcactgtcatcaaattttcagcagtactggttgcagcttaaggcggtaagattggcgcatgaccaattggaacaatacgagcggttggaagggcagatggtgttggaggaaactgaatcacagcaagggtggaaaatcgaacttcaacgggaatttcgttctttgggatgctatcaagtcactgttcatgtgacaaaaagttataatcaatctaataaattagatcgctggttttgtgcaagtgggagtattgatgtttag

SEQ ID NO: 3298 - DNA, 3390 bp, Xenorhabdus bovienii
  Coding sequence Name=Xb4151_4152.C438.gene91.dna; Position on contig =62522..65911bp; Strand=+
atgtttagagtttatcattcaaatcaactcgatattcttaaggagttgatggcaatatttatcggggaaaatccccttaccaacccatttggcaaagaagtggttctagtgcaaagccccggcatgtcacagtggctgcaaatccaactggcagaaaaactgggagttgccgcgaacatggaatttccactgccggctacttttatctggcagatgtttacgcaggtattacctgatgttcctaaagatggctcattcagtaaggatgccatgaaatggaaattgatgacgctgttacccggcttgttgacagagcctgatttttcatctctcaggcactatctcgaccaagatatcgataaacgtaagatccaccagctggcaggccgagttgccgatttgtttgaccaatatctggtttatcgcccccaatggctggaaagctgggaaagcgatcagtcaattgatggattaagtgatacccaagcttggcaaaaaagattatggcttgaactgacagaatatactcgtcagctagaacaaccactgtggcaccgcgctaacttatatcatagatttatttcaactttgcaagaaggtcgttttccactggaaaagctgcctgcacgggtatttatctgtgggatatctacgttacctcctgcttatctgcaaatatttaaggcattggggcaacatatcgatattcacctgatgttcactaatccctgcctgtactattggggggatatccagagttatgcctttctggccaagttaaatagccgtaaaccaaaacattatcaaagccagcagtcattggaacgatttagagatccggaaaatgcgtcatctcttttcaatgatgagggagagcagagcctgaacaatcccttgttggcgtcatgggggaaattaggcagggataacctctacctgctatcgcagttggaacctgactctgatgttcatgcttttgttgaactggagccgagttgtatcctgcatcaaatccagcgggatatgctgaatcttgaagatcacgctcaaattggctccacggaacactctttcaaaaatagcctaaaaaaacgtcagattgatggtaaagaccgctcgctatcttttcattcatgtcatagcccccagagagaggtggaagttttgcaggatcagatcctgcgtcttttggatgatgatccctcactgacaccacgagacattatcgtgatgatggcggatatcgacagttatactccctatattcaggcggttttcggcaatgcaccggaggagcgctatatcccctttgcgatttctgatcgtaaagcccgtcaggctcaccccgttttgcaggcttttattaccttactagagctgccgcagagtcgttttacggcggagcaggtactggcattactggaagtgcctgcattggccagcaaatttgccattcaggaagacggattgcgtctgttacgacgctgggtgaaagaatcagggatttgctgggggttggatgacgacaacatagaagcactgtcgttgcctgctaccggacagaacacgtggcgttttggtttaacacgtatgctattggggtatgctatggacagccatgcaggcccatggaatgacgttttgccttatgatgaatccagtggtcttgccgcagaactggcgggacaactggcggaatttttaatggagctgaaccgctggcgtaaaattctgagtgaagatcagaggctgtcgggttggctggcagtatgtccgcagctgttggaaactttctttgatgcggatgaggaaacagaactggtattggcattgatcactcagcagtggcagaaagtcattgataatggtctgaatgctcattacagcgagagtgtccctttggtgctgttgcgtgatgaattggtgctgcgttttgatgatgagaagatcagtcagcgttttctcgctggttcgttgaacttctgtactcttatgcccatgcgttccattccttttaaagttgtctgcctgctgggaatgaatgatggcgtttatccacgaactattccgccactcgggttcgatctgatggcagaaaaaagccagcggggagataggaagcgtcgcgatgatgaccgttatctttttctggaagccctgatttcggcagaaacgtgcctttatattagttatatcggtaaatcaattcgtgatgatacagagtgtaatccttctgtactggtcagtgagttactggattatgtctgccagagctgttgcttgccgggagatgagatgctgaatgttgatgacagcgcaagaaaagttagaaatcacctgctgttacagcatactcgtgttccttttgcgatggaaaacttcgtgcctgatcattatcagcaaagttatgccgcagaatggttgccggcagccagtcagcaaggtgcttcccccatcgatttttgccagccggttgagtttgagaccagtgagataaaggaagtggcactcgatgaactgatccgtttttaccgttaccccgtcagggcattttttcagcgtcggctgaaagtgcatttcatcattgaagagacggaactgcctgaagaagaacctttcgtactcgatcatctgcaacgttatcaatttaaccaattgttgttgagtatcttgctagaagaaggatcacctgaatctctgttttatcatctccgcgcatcgggaggtttgccacatggggcgtttggtgaggtttactggctgaatcaattagaagctatgcagccactggcaaataagattcgggaagagagaacggagtcttctttcatagagttacaccatgagttagatactgtggtattgactggaaaaatccatcaggtgcagcccgatggaattttacgttggcgtccagcgaacttaatggctaatgatggtatccaactatggattgaacatcttgcctattgtttttcaggcaacaatggtgagagccgaatgtatggaagggaaaacagcgagtggcgtttttcaccattgacatcggatgaggcaaaaaaatacctgaatcagatggttgctggttattttcagggcatgtctgaaccactccctttgttttgccgaagcggttgggcatggctggatgattgctttgacagagagagccagaaaatcaatttcagtgaggaagctcagcaaaaagctgaaaacaaactgatgcagcaatggctgggaacacagggaaaaagtggagaaagcagtgatgcttacgtccaacgagcatttaggcaagttgatcaattattttgggtgcgtatgaaacgcgaagtacagagttatttgttgcctatggcttgtcatttaagtcgttcttcatctaaataa

SEQ ID NO: 3299 - DNA, 2886 bp, Xenorhabdus bovienii
  Coding sequence Name=Xb4151_4152.C438.gene92.dna; Position on contig =65931..68816bp; Strand=+
atgcctaaatatattattcgcatcatgacgatgctttttctgctcttttggggaaccacagcgtatgcaaagttgccttggcagcctttgcctgaaactattaataaaagtgaacgagatcttcgtcaatataaagccatccaattacccaatggcatgacggttttactggtttctgatgagaaggccattaaatcattggctgccatttcagttccggttggccatatggaaaatcctgataaccagcttggtctggctcattatttggagcatatggtgctcatgggctccaagcgataccctcaatctggggggttcaccgagtttttgcagaagcacggtggaagtcacaatgccagcacttcaagcaatcgtaccgcattttatctggaagttgagaatggttcactgacagaagcgacagaacgccttagcgatgctcttgctgaaccgcttcttgatccggttaacgccgatcgtgagcgtcatgccattgataacgaaatgaccattgcccgtgctggtgagggtcatcgcatatggcaggtccgctctgaaacgctcaatcctgcgcatcccaatgcccgttttggtggtggaaaccttgaaacgctgaaagataagcccgacagtaaattacaggccgcactcattgatttttaccagcgctattactctgccaatctgatgaaaggggtgttgtatggtcagcaaccgatcgacaaactggctcatattgcggtagaaacctttggccggattccgaacagacaggcttcagtccccgctattacggttccggcgataacggataaagaaaaaggcatcattatccattatgtgccttcgaagccttacaaatcgttacaactggaattcagcattgctgacaacagcgcggattttcgcagtaaaacagatgcctatctgggatatctgattggtaatcgtagtgcgaacacgctgtctgactggctgcaaaaacagggattggctgagggcatcagtgccagcgccagcccgacgacagatggtaactcaggaacgtttggcatttatgtctcattaacggacaaagggcttgagcagcgtgatcgggttattgcggccatcttctcttacattaatctgttaaagcaaaagggcattgaaaagagctattttgatgaaatggctaaagtgctcaatttatcattcgagtatgcgtcaatcgtgcggaatatgggctacattcagtggttgtctgatgttatgcaggatatccctgtttcccatgtactggacgccggctatcttgcggacgaatacaacccacaagctatcttcagccgtctggctgaactgacacctgaaaatgcgcgtatttggtttactggcccgaaagagccacataacaaggaagcttactttgttcatgcgccctatcaggtcaataaaatcacaccacaacagcggacggaatggcggaaactcgaaaaagaggtttcgctctccttgccagaactgaatccgtatattcctgatgatttatctttgattaaggcatcaggcagtcaaaaacaccctaaaatgattttagagcagccaaatgttcgtttgctctatatgcagagccaatattttatggatgaacccaagtccatcatcacattgaatatgcgtaatgcggatggaatgagtcatgccaaagatcaggttacttattcgttattggcctatttgagtgatatgggattggatcagctgggctatcaggcatctgtaggtggcatgggattaacattagggtattcagaaggcctgcaaattggggtgagtggttatactcagcacttgtctgaactgttaacttcggccatcagccagtacattgcgttcacacccactcaggaagagctgaatcaggcaaaatcgcgctatcgtgaccaagtggaagccgtcaataatggcaaggcttatgaaatggcgacacaccccgtctcccgtctttctcgtgtgccttattttgagcagactgaccgtttgaaagctttggataccatcacgattgacgatattgttaaataccgtcagagaatgattcagcattcggctttacaggcgggaattttcggtaatttaacagaaaagcagagtatcgatatcgttaagtcggcacataagcaactcgcgaatcaggggactacgtggtggagtggcgaccatatcgtggttgatcgtgattatgcggtgaattttaaaggaactgccagcagtaccgataatgcactgtctgaagtctatattccaacgggatatgaccgaatcaatggttatatttattccaacctgttagggcgtattttgtcaccctggttctttgaacaactcagaacatcggaacaattgggctatgttgcttctgctttcaacaccagcgtgggtgaacaatcgggattgggcttcctgttgcagagtaacagcaagcaacccgattacctgcatcaacgctatcagagcttttatcaacaggccgcaaaaaaattacaggcaatgcctgatgctgattttgaacagtataaaaaagcgttactgacagaaatgcggcagccaccagaaactttttatgcagaagcatcccattataattatgattttgggagtaataacttcaaatttgatacacacgaaaaaaccattgccgctacggagaaagtgactaaggcacaactaattgctttttatgataaagcggtgataaagcgtcaaggattggcactgatttcccaaattaccggtaaaaaaggggcagctcatcaatatgctgagctgaaaggctggaaaacttactctaacgtgtcagatttccagaaacagttgccggttaaggtgaatgctcagtga

SEQ ID NO: 3300 - DNA, 3618 bp, Xenorhabdus bovienii
  Coding sequence Name=Xb4151_4152.C438.gene93.dna; Position on contig =68813..72430bp; Strand=+
gtgagcacagaaatactaaaccataaacttaacccattaacactgccgctgcatggtcagcggctgattgaggcttcagcgggaacaggtaaaacctacacgataggtttgctctatcttcgtctgttactcggattaggcggtgatgccgcctttttccgcccgctgaatgtcgaagaaatccttgttgtcacctttactgaagcggcaacggatgaattgcgtggacgtatccgcgaaaatatccatcagcttcgtttggcgtgtattcgcgaagggacggaggaaagtgatcctgtttatcagcaattgctggatcaaattcctgacagagcaagtgctgccagttggcttctggctgctgaacgtcaaatggacgaagcggcaatttatactattcatggtttttgccagcgaatgctggtgcacaatgcctttgaatccggtgttctgtttgaccaaacgttgattcaggatgaatacccgctacgcaaacaaggctgtgccgatttttggcggcgtcactgttatccgctctcgttgtcaatggcgacagtgatcaatcaagaatggagtgggccagaggcactgcttaaggatgtttcctctcatctgcaaggagatatgccttatatcgtcaatccgcctgacagtgatgaaaccctgattggccgtcatgaaaagatcattagtctgattgatacagtcaagcatcggtggagagatgtagcaccggatttacacgatctcattgccaattctgatgtcgataagcgtagttacagtaaaaaacacttacccaactggctgaacagtgtttctgaatgggctgaatcgcagaccagagattatcagcttcccaaagaattggacaaattcagtcagtcacgattggcggaaaagaccaaaaagggagagactcctcagcatccggtgtttactgccatcgacgatttatatcaacaaccgctaacactacgggatatcatcatctctaaggcgattgttgaaatacgtcagtccgtcaatcaggaaaagttgatgcgcggacatatgggatttgatgacttattgacgcggctggacagcgccttacaacgagaagggggaaagcagcttgcgacgactatccggcagcgttatcccgttgccatgatcgatgagtttcaggatactgacccgcagcaataccgcatttttcaagccatatattgtgatcaaccggaaaatgagcagcgggaaaatggcttgatgtttatcggcgatcccaagcaagcgatttatgcgttccgtggtgcggatatttttacctatattcgggcgcgttcccaagtcagtgctcattacacactggaaaccaactggcgctcttctgtgccaatggtgcaagccgtcaataaactgttttcccacacagagcgccccttcctgttcagccaaattccgtttattaatgtgaaagcagcggaaaaaaaccataatctgagattcttgttccaccatcaggagcaggctgctttacagttttggttacagcccggagagggggttgccaaagggggatatgaacagagcatggcgcggcactgtgctgcccaaattcgggattggttgctggctgggcaacaagggcaggcacttttgcagcaggcagaaaaaagccagcccgtcacggcggcagatattaccgtgctggtgcggaaccgccgcgaagcagcaatgatccgcgatgaattgaatgcgctcaagataccgtcggtgtttctttccaaccgtgatagtgtatttgatacgccggaagcaaaggatttgctttggctgttacaagcggtgctatcaccggagaaggaacgtgaactccggagcgcattggccagtagtttgtttggcctgagtgcacagcaaattgatcagctgaatcacgatgaaactgcatgggatcatctggtggatgaattttccggttatgcccggttatggcgctcccgtggggtgttgccgatgttgcgggcggtcatggtgaaataccaggttgcagaaaatctactggccgggtatgacggtgagcgccggctgactgatgtcatgcacattggcgagttgttgcaggaaacatcgctgcaattggatagcgaacatgcagtagttcgctggctggcacaacagatttcccgtcctgacccacaatcagaaacccagcagatgcggctggaaagtgataaacatctggtgcagatatgtaccatccataaatcaaaaggattggaatacccactggtttgtctgccattcatatgtagtttcaggaaacaggaacaggcgatttaccatgatcgtcagagttttgagactcacttcagtatcttccaggatgatgaaaagaaggcactggcagatgaagaacgattggcagaagatttgcgtctgctctatgttgccttaacacggtcgatttatcactgtagtgtcggggttgcaccactgattcaaggcaataagaaaaaagcaggcaatacggatttacacttatctgcccttggttatttgttgcagaaagggcagcaaggtgatgcgcaattgctggcagatagcctcaatgaactcagtaatgatgatattcaggtcacactgatggaggaaactgatgatgtgcagtggtgttcgcaaaataacaatgactcattgctggcggccagaaaattccggcgttccattcaggatgattggcgggtaaccagttattctggcttgcagtattcctcttcgcactctatttcccatgcttataccagcgcgtttggagaatcggtggatgtcattgtgcagtcgattgccccgaaactggatattgatgctcgtggcgaaaagcaggaggaaccttcatcgcagatgacaccacatacttttcctcgcggggcatctgctggtaccttcttacatagcatcttggaagatctcgacttcagcgagctacctgagcaggtgtggctggcagaaaaattaacggcagccgggtttgatgagaactgggcgccagtattgcagcagtggatagcggattttgttaccgcagagctggatgagcagggaatacaacttgccaatgttcctcgtcatcagcaacaaagtgaaatgcaattttatttacctgtcgataagctgctgcattcacatgcattgagtgcattgacccgccgttatgatccgttgtctgcacaatgtgcacctttatcctttcatcaggttaagggcatgttgaaagggtttattgatttagttttctgctggcagggtaagttttatgtggtggactacaagtcaaactggctgggggagagcagtcagtcatacactcaggaagccatggccaaagccatgatagaacatcggtacgatttgcagtatcagctttatacgttggcgttacatcgttatttgcgtcaccgattggtgaattacgattatcagcagcattttgggggagttatctacctgtttctgcgcgggattgataaggctaatccaggacatggtgtttatcgttatttgccctccattgaatttgttgatgaactggataggcttttcagtgcggctggcgaggagcagggcgtatga

SEQ ID NO: 3301 - DNA, 1908 bp, Xenorhabdus bovienii
  Coding sequence Name=Xb4151_4152.C438.gene94.dna; Position on contig =72427..74334bp; Strand=+
atgagtgacatgaaattattgttgcagcaagccgttgcccaaaaattactgcgcccgctggatgtgcagtttgcttatgcaatgattgaaaacggagatcctctgttattgctgattacggcattggtgagtgcggaatcaggagcagggcatgtctgcctgccattagagcggatctcgcctgaatatttatttgaggggcggcagcctgaattagcagcatcgctctggttttcggcggggaaaccaaatcagcagcaagttatttcagcgttacaagcatgttctgcagtgagcactggcgaatctcccgcaccgatcattctttcccgccacgctcttgctgattatcgcctttacatgcaacgcatgtggcaaagtgagcgtcgggtcgcggagttttttgcgtcggtagaattatctgacgatattgatgaagtgcaattacatcgcattttggatgaactttttggtgtcaccgctgaaggggaaatagactggcagaaagtggcggcggcagttgctgtaaccagccgtatttccgttatctctggcgggccagggacaggaaaaacgacgacggtagctaagttgctggccgccttgatcaaactgaatgaaggcagaacactgagtattcaattggccgcacccactggtaaagcggccgccagattgactgaatcgctgagtgaggcagtcaataaactggctttaacatcacaacaatcgaatagcattcctgagcaggcacaaacaattcatcgcctgttgggagcgcagccagatagccagaaactgcgttatcaccgcgataatccgctatctcttgatattttgatcatcgatgaagcctcaatggtggacttaccgatgatggcacgtttgatagaagccctgccaccacgggcaaaagtgatttttctgggggataaagatcagttggcctcggttgaagcgggagccgtattgggggacatctgccgcttcgctgaacaaggttatagtgccaagcgtgccgaacaattgagtcagttgacaggctgtcagctaacatcgtattcaatgcctgattctggagaacatacactggcagtccgggattgcttatgtctgttacgtaaaagctatcgtttcaactcggcttcgggtatcgggcaattagcatcggcggttaatcaaggcaatagtgccggggtatctgccgtcttgggtcagtctttgcctgatgttcacttcaatcctcttgcaggagatgaagattatcagcgtttattgatgcaaactgcagaaggttattaccgttatttagcgatggtgaacgaacaagcatctgacaaagacattttggcagagtttaaccgtttcaggttgttgtgtgctttgagggaagggccgtttggtgtaagcggcttgaaccagcgggtagagcaattgttacatcgtaaaggcgttatttctctgcccagaagtgcggagagcgggggttatgccggacgtcccattatgatcttacgcaacgatagtacactggggctatttaatggtgacattggtattatgctcaggaataaggataatgagctgaaagcccattttcagctatctgatgggacgataaagccatttcagccgagccgattgcctcagcatgaaacggcctatgtgatgactgtccataaatcccaaggttctgagtttgaacacaccgcgttagtcttgccgactcaattctcgccagttgtcagccgggaactggtgtacacagccttaacccgtgcccgtgaaaaattgacgctttacgcacataaaccggttctggataaggcggtgagtacatcaacacagcggcgtagtggcttggcagaatggctcaagccaaagggagagtgtcaatcaggtcagtaa

SEQ ID NO: 3302 - DNA, 1335 bp, Xenorhabdus bovienii
  Coding sequence Name=Xb4151_4152.C438.gene95.dna; Position on contig =74328..75662bp; Strand=-
atgaaagaacgctgtaccgaattggttgaagttttccggcattcagttccgtatataaatgcacatcaaggcaaaacctttgtcattatgttggacggtgaggctatcgcccacgagaattttccaaatatcgttaatgacatcggcctactgcataatctgggcatccgtttgatcgtcgtgtatggcgctcgtccccaaatcgaccaaaagcttgccgaataccatagccagccaatttatcacaagcacatcagagttacggatgccaagacactggagctggtcaaacagtccgcaggtctgctacagcttgatattacggctcgtctttccatgagcctcagcaatacaccattgcaaggtgccaatattaacgttatcagcggtaactttattatcgcccagccactaggtgtcgatgatggcattgattactgtcatagtggcaggatccgccgtattgacgaggaggccattaaccagcagttggataaccatgccattgtattaattgggcccgtagccgtttccgtcacaggtgagagtttcaacctgacgtccgaagatatagcctcacaattggcgattaaattaaaagccgaaaaattgatcgggttttgctcatcacagggcgtacttgatgcagaggggaatatcctgtcggaaattgttcccaatgagggagaagcacggctaaatgagctgggaagtgagggagattattcttcaggtaccgcccgcttcttaagaggagctatcaaagcctgccgtcgtggggttcgtcgtagccatttgatcagctatcaggaaaatggctcactggttcaggaattattctcccgtgaaggcagtggaacccagatagtcatggagcgctccgaacagatccggcgagccaatatcaatgatattgggggcattcttgagcttattcgtccattggaacagacaggtatcttagttcgccgctcacgggaacaactggaaatggaaattgataagttcactctgatagagcacgataatgtaacgatcgcctgcgctgcgctctattcttaccctgacgaaaaaattggtgaaatggcttgtgttgcggttcatccaaactaccggaactcttcccgaggcgaagtattactgaattccatcgctggtcaggccagacaggcagggctggagaaactattcgtactcacaacccgcagtatccactggtttcaggaaaaaggctttgaacctgctgaaatcaatatgcttcctgtggaaaaacaagcgctgtataactaccagcgctgttcgaaaatcttgatgttaaatttagaggtttactga

SEQ ID NO: 3303 - DNA, 108 bp, Xenorhabdus bovienii
  Coding sequence Name=Xb4151_4152.C438.gene96.dna; Position on contig =75723..75830bp; Strand=+
atggcaagagggaatatggataaaaataacaatattatttatatttatattgatattaataaattgagagaacgtaaaatgttttttttgatgacagccactcgctaa

SEQ ID NO: 3304 - DNA, 1248 bp, Xenorhabdus bovienii
  Coding sequence Name=Xb4151_4152.C438.gene97.dna; Position on contig =75906..77153bp; Strand=+
atgagtcattcagaccataatccttcacgtcgcaatttgttgaaaggcgcagcagccatgtggttgttgagcattagctcaataggacacgcagcaacgtcaaaaattattgctgttcgtatttggcctgcatcaagttataccagagtgacactggaggctaatattctacttaaatatcgtcaattctctctttcaaaccctaaccggattgtcatcgatttgcagggtgttcagcttaatagtgccctgagcggtatggggtcgcagattcatcagcgagacccctacttaaaattggtacgagtcgggcaatttaatcccaaaaccgtgcgcctggtgtttgaaattaagcagccagttgccccacatatttttacactaccacctattgcgaaattcaaacatcgtctggtgttagatctttatccgagcaaggcggcaaatgtggaggatgatcccttgcaagcgttgttggaagaatacaacagcggggatttggagaaaaatctgcctgctgaaaagcgaaaaccggggcggccgggcaagaacagaccgattgttattatgcttgatccggggcatggcggtgaagattcaggtgccatcgggaaatacaagacccgtgagaaagatgtagtgttacagattgcccgtcgcctgcaagcacttatcaaacgtgaacccggcatgaaagtatacatgacgcgtaatgaggatgttttcattccattgcaggtcagggtagcgaaagcacgtaagatgcaggcggatttatttgtttctattcatgcggatgcgtttaccaatcgagccgcacggggatcttccgtgttcgcgttatcaaccaaaggagcaaccagtaataccgctcgttttctggcacagacccagaatgagtctgacttgattggtggagtcagcaaaagtggtgatgaatatctggatcatactatgttggatttggttcaaaccgcgacgattaatgatagcctcaaatttggcagtgaagtgctcaaacggattggcaaggttaataaactgcataaaaatagtatcgatcaggcgggatttgcagtattgaaagcaccggatattccgtccattctggttgaaacggcatttatcagtaatctggaagaagaacgcaaattgaaaacggcgaaattccagcaacaagtggcggaatccatttttgcaggtattaaggcttattttaaaagtggtgtagagctggcacggcggtga

SEQ ID NO: 3305 - DNA, 225 bp, Xenorhabdus bovienii
  Coding sequence Name=Xb4151_4152.C438.gene98.dna; Position on contig =77532..77756bp; Strand=-
atgaacaaaaacacgacaaatagtgctatttttaatcatacaagaaataagttcggtaaatatcaacaaaaaacttgcaacagcgccgaacctgcgtatagtgtgccgacatcagacgcggggtggagcagcctggtagctcgtcgggctcataacccgaaggtcgtcggttcaaatccggcccccgcaaccaatcctatacgatgtcacatcggcagggtttag

SEQ ID NO: 3306 - DNA, 147 bp, Xenorhabdus bovienii
  Coding sequence Name=Xb4151_4152.C438.gene99.dna; Position on contig =77718..77864bp; Strand=+
atgattaaaaatagcactatttgtcgtgtttttgttcattcatggggttatggaacagtaatctattttttcttaacgacattttattatttaccggggtttgatattgttcgtcgtcgaatcataatgacaggagataaggtataa

SEQ ID NO: 3307 - DNA, 1098 bp, Xenorhabdus bovienii
  Coding sequence Name=Xb4151_4152.C438.gene100.dna; Position on contig= 77866..78963bp; Strand=+
atgaaactttggggcaaatatcttttatggggatttgtcatttcgttattatcgggttgccagatgcgtcctacagatcaagggcagcagtataaagatgggcgcattagcgaagatctccagcttgttaatattccaaatgcacaaggctctcctaccaacgccggagattttcaggcacaagtcaaatttatcagcaaatcttctcctcggctctatgggaataatcgtgcaacgcttgatgctatccagaattggatgctgtctggtggagatccccgcgaattaaaccagtatgggttgctggcctatcagatggacggtgacgataattacggtaatgttaagtttaccggctattacacaccagttttgcaggcacgccatgttaagcagggcgaatttaaatatcctttgtaccgaatgccaggtaagtcacgtctccgtctgccaaaccgtgcagctatatataatggagctttgagtgaaaaattgatcatagggtacactaattccctgattgataattttttgatggaagtgcaggggagtggttatatcgattttggtgatggcagtccattgacctttttcggttatagcgggaagaatggccatgcttatcagagtatcggcaagatacttgttaaccgaggagaagtacctcttgaggaaatgtcactgaaagctattcgccagtgggtatctcaacataatgaatcagaggtacgagagctgctggaacagaatccctcttttgttttctttaagcccgaaccctttacgcccgtgcggggagccagtgctgtgccccttgtcgcggaagcatcggtagcatcggataaagcattaattccacccggaacggcgttattagcggaagtgccggtgttggataaaacaggaaaatttaccggccagtatcggatgcgtctgatggtggcattggatgttggaggcgcaataaaaggcaaccatttcgatatctatcatggtgtgggtcatgatgctggagaaacagctggtttttataatcactatggtcgtgtctgggtattgaagaaatcgtcgtctggctttttgacggcaaaccagtaa

SEQ ID NO: 3308 - DNA, 813 bp, Xenorhabdus bovienii
  Coding sequence Name=Xb4151_4152.C438.gene101.dna; Position on contig= 79075..79887bp; Strand=+
atgcaagtttctctctctgatgcttatcttcagcgttttgctggtactgcgcggttatatggccagaaagcactgtcattatttgcccgttcacatgtctgtgtcgttggcattggcggtgttggctcatgggcggcggaagctctggctcgcacaggtattggggcaatcacgctgattgatatggatgatgtctgtatcaccaatactaaccgccagttgcatgcactggtacagaatgtaggattgtcaaaaaccgaggtgattgctgaacggatacgggcaatcaacccggagtgccaagtcacctgcattgatgattttgtgacccccgataatgtggctgagttggtgtcggctgagttcagttatgtaattgatgccattgacagtgtgcgtccaaaagcggcgttgctggcttattgccgccgctataaaattccgattgttacgacgggcggggctggggggcagcttgaccctgctcagattcaggtggtggatctggcgaaaacggtgcaagatccgctggcggctaaattgaaagaacgcctgaaatctgactatcgcgtggtgaaaaacggcaagggtaaattgggaattgactgtgtattctcaacggaacaattggtttacccgcaatctgacggtacggtctgtgctgccaaaaacacggcggatggttcgaagcggatggattgtgcgtccggttttggtgccgcaacgatggtcacggcaacgtttgggtttattgccgtgtctcacgcactgaaaaagatggtggcaaaagccgagcgggaaaacagactttaa

SEQ ID NO: 3309 - DNA, 459 bp, Xenorhabdus bovienii
  Coding sequence Name=Xb4151_4152.C438.gene102.dna; Position on contig= 79909..80367bp; Strand=-
atgacatcaatttcagattcaatccttgccccgcatccgtttggaacggagatatcggagcaacaacttattgaaaattttcagcaatgccagttatgggaagatcgctatcggcagcttatcggactggccaaaaaactgcctccattagcggatgaactgaaacagcagaacattgaaatgtccggctgtgaaaaccgtgtctggttagggcaccagttacgctctgacggctgtttgcatttttatggcgatagcgaaggccgtatcgtcaaaggcttattagcggtacttttgactgctgtagaaggaaaaacagcggaacaagttttacaggcacccttatctgagttatttcagcatataggtcttgaacaacaactgagtggttcacgacttaatgggatcaaatccctgatcaacaccgttcaagtgattgcccgttcacatttgtcttaa

SEQ ID NO: 3310 - DNA, 1206 bp, Xenorhabdus bovienii
  Coding sequence Name=Xb4151_4152.C438.gene103.dna; Position on contig= 80417..81622bp; Strand=-
atgaaatcctttgactcagaaaaatttcgccagcaatttcctgccctgcaacagcagactgtgtttttggatagcgcggctacagccctaaagcctatatgcatgattgaggcaacccagcactattatcaaaaccacagtgcaacggttcatcggagccaacacgcaagcgcacaggccatgacggctcgttatgagcaagctcgttcgctggtggcggaattgatcaacgccccgcggcctgaaaatatcatctggacaaaaggcaccagcgaatccattaacctgaccgctcaaggctattttcgccctcgcctgaatgttggtgatgaaattataatcagcgaacaggaacaccactccaacctgctgccgtggctgattttggcggaacaaacaggagccagaatcgttaagtggccaataggcaatcagaatcggccggacatcaatactctcgcgacactgctaaatgaaaaaagccggctagttgccatcagccaaatgtcgaatgtcactggcaccacagtcgatctggcacaggtctcgacactcgcccaccagtatgattgcctggttttggtcgatggcgctcaaggcattgttcacactcccgttgatgtacagcggctgggtatcgatttttataccttctctgcccataaactgtatggccctaatggtctgggagtattgtatggcaaaggggaattgctggatgtaatgtcaccgtggcagggcggtggaaaaatgctgactcaggtatctttcaacggtttcacaccagaagccgttccttatcgctttgaagcgggaacaccgaatgtcgcgggcgtggttggctttgccgctacgctggaatggttaaaaaccgttgatattccgctcgctgaatcccatgccgttaccctgactgactatgccgaacagcagctcagtactctgacagggtttatcagctaccgcgatggcgatgccagtttgctggccttcaatatccaagggatacatcacaatgatttggcgacgctgattgctgaacagaatatttctctgcgttcaggccagcactgcgcacagccccttttagatgccctaggggtcagcggctgcctacgtgcttcttttatgccttataataatcagcaggatgtggataagctggtcagtgctgtgaaatttgccctgtcgctactggaagaataa

SEQ ID NO: 3311 - DNA, 291 bp, Xenorhabdus bovienii
  Coding sequence Name=Xb4151_4152.C438.gene104.dna; Position on contig= 81761..82051bp; Strand=-
atgacaagagatcagaatatcaactatcagccagttgatattagaaaaccgattgataaatcctcacctctgttagctcaaaatttaaccaataatgaaagattgacttgtagttttcatttctatagaacatcaatgcaaggtgggttggaactgtattataagataaaactaacaggtgctacattagggtctgtaatgagcaacaatggcgactttgtttggcttacctgcttcggtcaatctcttgtagaaagcgcaaagaacggggttaaatctaattgccgttaa

SEQ ID NO: 3312 - DNA, 780 bp, Xenorhabdus bovienii
  Coding sequence Name=Xb4151_4152.C438.gene105.dna; Position on contig= 82610..83389bp; Strand=+
atgccctctttaatcatgaggacaactgccgtcttcgctttctttctctcattaatttttaccggtctgagttatgcttcgaccagtacctcaaaaatgaaagagtattctcacaatggcatacaggagagtttgccagatttgcgacaatatccttcaggtacaccccggaagaaagcgtttttaaacattgttgtccctgtcattgatgagcataatcaaaagattatgcaagaccgaaaatggctgctgtcacaccaggaaactcgtcactggtctgtacaggataccagtcgattgcagaagatctgcgcaagttacaaaatggcctgcacatcacctaaacaggtcaattggaataaactgctaagccgagttgacattataccgacccattttgttgctactcaggcagccgcagaatcgggctggggaacatcagaacttgccaagaaaaacaataacctgtttggtatgcgttgcaactcatgcggcaaaaccaaaggaaaaatcaaaggttattcagtttatcgcaatgttgatgattccgtcatcgcctacatgaaaaatatgaatacacaccgtgcctacgaatcacttcgtacttcacgggcaaaacagaggacagcacaaacgcctctgaataccagtaaattgatcgataacctgaacggttattccgagctgggagctcactataatcgctatttgcatcaggtatttaatggcaataaaaagctgatttcacaggcacaggaacaggaactgacagacctatag

SEQ ID NO: 3313 - DNA, 291 bp, Xenorhabdus bovienii; identical to SEQ ID NO: 155
  Coding sequence Name=Xb4151_4152.C438.gene106.dna; Position on contig= 83488..83778bp; Strand=-

SEQ ID NO: 3314 - DNA, 279 bp, Xenorhabdus bovienii; identical to SEQ ID NO: 890
  Coding sequence Name=Xb4151_4152.C438.gene107.dna; Position on contig= 83770..84048bp; Strand=+

SEQ ID NO: 3315 - DNA, 171 bp, Xenorhabdus bovienii; identical to SEQ ID NO: 2071
  Coding sequence Name=Xb4151_4152.C438.gene108.dna; Position on contig= 83999..84169bp; Strand=-

SEQ ID NO: 3316 - DNA, 186 bp, Xenorhabdus bovienii
  Coding sequence Name=Xb4151_4152.C438.gene109.dna; Position on contig= 84147..84332bp; Strand=+
gtggcaataacggcaatagacatcaactttggccatacttcatccttaaaaagccggaagcatatcacagcaactaaccatttaatacatgacctatcgccgcgctgtaacttgaaatctattgggtatagattaacgtgccagaaatatcacctacgtattcgtaatgcctttcgtactgtttaa

SEQ ID NO: 3317 - DNA, 1422 bp, Xenorhabdus bovienii
  Coding sequence Name=Xb4151_4152.C438.gene110.dna; Position on contig= 84539..85960bp; Strand=+
atgaatttcttttcttttgagtttcttggttcgtttgttattctgcttcttgcctattggcttttacaaaaagcccctaagctacagaatggcctattaattttagttagttatttatttatcttctcttttgcagcaaaatttgcctatatcttattcgcctataccctgttcatttactttttggcgaatattcttagtcgttatttgtccaacaaggccatattcacgcttctgattttcggtattgtgggttgttttaccgccttcaaatattattctttctttcaagaggcgatccagcaatcgttagccaatttaggcatttctgtcgagctacccatacttgagctgctgatgccattaggcttatcattttatgcctttcattccgtcagttacgtgatgtcggtttgcaagaaagaactgcctcctgctccgctgattgatgttattttgtatctctgcttttttccaagcattgtggccgggccaatcaatagagccaaagatttcctgccgcagatccagacttcatccagagtgatgctggagccattcaaagcgctgttattgattgcactggccatcgcgaagctgtttctgttcagttcgacgctctctgaaaattttgttaatccagtctttgatgaccccactggctatcatgcggggcaagtccttgtcgcgatttatgcttatgcatggaatatctatttcaacttttcaggttataccgacctcgtgacgggtattgccctgctgttaggttttaaagtgccacagaactttaatgccccttatcttgctgagaatttacaagaattttggcggcgctggcacatcagcttatcgacgtttatccgcgattacgtttacattccactgggcggtaataagaaaggtactatccgcaagaatatgaatctattctctgcaatggtcatttccggtctatggcatggcgccggattgagctttattatttggggcgccattcatgggctaggattaattttccacaatattaaaaactcactgtttccctctactgggaatcgcaataaggcacaaagaaaaaatccgatttcattatttttatcacgagtgatgacattccattttgtctgttttgcatgggtattctttcgcagcccaacatttaatgaggctctgactgtattaaaccaactattctcaggggatgtgttgacggcactgctatccagtagcactttattaatcgctttttggggattctttattatctacccttggctggtggatatcagaaacactattgaaaagaactatagactgatgtcatgggtttattacccaatccccttagctctgctactcactttggtatttatgctgtcaccttctggaatgccgggatttatctatgccaatttctga

SEQ ID NO: 3318 - DNA, 1137 bp, Xenorhabdus bovienii
  Coding sequence Name=Xb4151_4152.C438.gene111.dna; Position on contig= 85947..87083bp; Strand=+
atgccaatttctgaatttacctttaatctaaaaaaagtcgggcaggtcgtttttatcgtcaccttaaccagcctgctgctgatctggctgaatcaacgttctctggagagtttctggcaacagaagtatcaccgtaatagtccgtggacaacccttaagggagagccaatgtgggatttgggcagcaatatgcagcaaggtgcaattgctgccagcgaaacatttatggcatatgcaagagggattcatcaggataataatctacaggccataaatattgatgctactccaagcatgattcttcctgattttcaggttggtttgaattttctggggggatatacgtactctatcgagagtcgctatctgacgttccctgatttgctgcaaaaagatgtccggcacactcaatcatccttattacgaaatcattcaccatcaaatgcggttaccgaaattaccccaaaaacgaatgtcagtctggggaaaaaagatcaggtactgtttgcaggggattcgatgatgcaaggggttgctccgcatttaaaacgccgtctttaccaggaacatggcatcgccagtattaatttgagcaagcagagtacaggattggcctatcccggtttctttgattggcccaaaacaatcggtgatacactaaggaaaaatccggatattaaattggttgtggtgtttttaggccccaatgatccgtgggatatgccgacaaaacgcggaggagcctatttgaaattcgcgagtgaggattgggaaaacctttatcgtcagcgaatcgaaacgattttaaatgatgctcaccagcataaggtggatgtgatttgggttggcccacccaacatgcggcagaaaaaactttccggcggcatggcttatctcaataaattgtatcaggcagaggtggcaaaaatgggtgagatctatgtttcagttaatgatatgttcaaatatcggtcggagaattattcagactatattggtgatggcagtagtacaatcaagctccgaagtggtgatggtattcatttcagtttgaatgggcagcagactatcgcgaacgctattttttcattgatgacatttattcaggagccagttaaagaagatgcaaccatttag

SEQ ID NO: 3319 - DNA, 1215 bp, Xenorhabdus bovienii
  Coding sequence Name=Xb4151_4152.C438.gene112.dna; Position on contig= 87070..88284bp; Strand=+
atgcaaccatttagacagttccgttggttttatcggataatgggtgcaggtttggttattgcgctttctgtgagccttttatcatgccacggcaaaaaatccaaaccctcatctgaattgcagatgacacaaatacatcggcaaaaacaactgacgaattttggcgatcccaatttaccattactggcggataaactgcgtcatagcaattcgcgccaactccatttcgtacaactgggcgattcacacactgccgccgatttttttactggtaagctgcgtagtttattgcagaatcgctatggtgatgctgggcctggttttatcagcccgatcagcattcccggccagcgcaccgctaccgttaagttcacggatgataaaaaaaactggtggctgtcgagcagccggaaagataaccgtgctgattatccgctaggcggttttattgccacacccgaaaatgtcagcagcacaatacggatgaatttatcaccctctacttttgagaagtacgggataagcgcgctttatcaatcccatgaggcaacccaaatcaggatgcagttcagccagtggaatctgccggccacacaaagcgaatggcaattttcgcaacaacacagtgtttctttcccactcagggtcgatgcacaggatacgcatttgaaaatcggcggctggctgatcaaacgccaaagctccggcattatgttatccgcgttggggattaatggcgccaccatcagtatgttggataaatggcagccacagtggatcaatacactggttcaactgaaaccggatatggtaatccttgcttatggcactaatgaagccttcaacgattcactggatcttgttgcctatcagaaggaactgacatcaaaagtgcaggaaattcgcaaggtcatgccagaagtggttatcttgctggttgggccgagtgattcgctgaaaaacaaaactgctgcaagctgtgctgaacagcaacccgctctgctcaatggcataattcaggctcagcaggccgtcgccaaacagcagcacaccctgttctggaattggcaggagtttatgggtgggtcatgttcagtcagaagctggcagcagcagaaccttgctcgtcccgactatgttcatctctccgccgcagggtatgaacgcagtgccgaagcgctttatagccagattattggtttgattgagcagtga

SEQ ID NO: 3320 - DNA, 138 bp, Xenorhabdus bovienii
  Coding sequence Name=Xb4151_4152.C438.gene113.dna; Position on contig= 88386..88523bp; Strand=+
atggcagatcacatgggatggcggtttatccccgtacctacggggaacactgagggaaaatcagtttccagttgtcatagttcggtttatccccgtacctacggggaacactttgtatcgatagtgaaaactcagtag

SEQ ID NO: 3321 - DNA, 135 bp, Xenorhabdus bovienii
  Coding sequence Name=Xb4151_4152.C438.gene114.dna; Position on contig= 88803..88937bp; Strand=+
atggccggaacaaccgaagtaaacacaggggcggtttatccccgtacctacggggaacactatattctgccctttaacttcttcttccctgtcggtttatccccgtacctacggggaacacaaacccacgtttga

SEQ ID NO: 3322 - DNA, 384 bp, Xenorhabdus bovienii
  Coding sequence Name=Xb4151_4152.C438.gene115.dna; Position on contig= 88991..89374bp; Strand=+
atgagatatcccctcactacatttctcggtttatccccgtacctacggggaacacttgaacccaatcatcagacggtcattcgcctctggtttatccccgtacctacggggaacacacgttgggcgcgttcaaagtgccgtgttaggacggtttatccccgtacctacggggaacaccgtaatggcgaaacaggctgtctgggtacagacggtttatccccgtacctacggggaacaccaaaatcaaatgcattagccattatttttagccggtttatccccgtacctacggggaacactttacgcacagaaattttttctctggatgatccggtttatccccgtacctacggggaacactctaaatataaccgtctgttttaa

SEQ ID NO: 3323 - DNA, 111 bp, Xenorhabdus bovienii
  Coding sequence Name=Xb4151_4152.C438.gene116.dna; Position on contig= 89439..89549bp; Strand=+
atgatttttactcaaatcacctcgccatccccacagcaaacacccatcaggttttttattgaaaaacccgaaaataaatataaaaaaaacggcattttaatcaatcagtaa

SEQ ID NO: 3324 - DNA, 1341 bp, Xenorhabdus bovienii
  Coding sequence Name=Xb4151_4152.C438.gene117.dna; Position on contig= 89579..90919bp; Strand=-
atgactacattaactttggtgctgacggctgtcggttctgtcctcctgctattgtttttggtgatgaaagccagaatgcatgcttttatcgcgctgatactggtttcaatgggggcggggatcttttccggtatgccattagaaaaaatcacccagaccatgcaaaacggcatgtcaggcactttgggcttccttgccgttgtggtggcgctgggtgctatgtttggcaagatcctgcatgaaacaggggcgctcgaccagattgctgtgaaattgctgggaagttttggtgaaaaacgcgcgaactatgcactgggcatcgcggggcttatctgtgccttgccactgttttttgatgtggcggttgtactgttgattggcgtggtatttgccgttgcacgtcgtactggtggtaatgtggtgaaactggcaattccactgtttgccggtgttgcagccgctgcggcgtttctggtgccggggccgacgccgatgttgctggcttcccagatgggagccgatttcggctggatgctcctgattggcctgagtgctgctatccccggcatgttgctggccggcccgatgtacggcaatttcatcagtaaacatgtgacactggaattacccgaggatctgaatacaccgagcattggtaaaaatcagatgccttcctttggtttcagtctggcactggtattattcccgctggtactcgtgggtttgaagacgattgctgcacgtttcgtcgatcagcgatcaacgttgtatcaatggctggagtttatcggccatcctttcaccgcgattttaattgcctgtctggtggcgatttatggcttggcgattcgtcgcggtatgagtaaagacagagttatggaagtatgctctgcggcgattcagcctgcggggatcatcctgctggtcacgggggcaggtggcgtgttcaaacaagtgctggtggattccggtgtcgggccagcgctcggtaatgctttggtgggagccggtctgccaattgcgctggcatgttttattctgtcaggggcagtgcgcgtgattcagggctcggctactgtagcgtgtctgactactgtgggtctggtactgccagtgattggtgaactgggttattccggtgcacaaatggcggcgttgtcagtgtgtattgctggtggttcgttgatactcagccatgtaaacgattctggcttctggctgttcggtaagtttacgggtgcgacagaaatacagacactgaaaacatggaccattatggaaactattttgggtactacgggtgccattatcggcatgatctattttgctatgctgagttaa

SEQ ID NO: 3325 - DNA, 540 bp, Xenorhabdus bovienii
  Coding sequence Name=Xb4151_4152.C438.gene118.dna; Position on contig= 90916..91455bp; Strand=-
atgagcaatacccaacagccaaatcatgtttttgtattgatgggggtatccggcagcggtaaatctgcggttgccagtggggttgcccgtaagctgggcgcggcgtttctggatggtgactttcttcatccccgcgccaatattattaagatggcacaaggccacgctttgaatgacgatgatcgtcagccgtggttaaaagcactcaacgatgccatttttgccatgcagcgtacaaataatatctctttgctcgtgtgctctgctctgaaaaaaaactatcgggatatgctgcgtaatggcaacaaaaacctgtcatttctgtatatgcagggggatttttatttaattgaaagccgtctgaaagctcgcaaggaacacttcttcaaaccccaaatgctgatctcgcagtttgaggtattggaagaaccgactgacgatgaaaaagatgtccatcacattgatatcagaccagaccttgatgaagtaatcaaaaacacaatgacaacaattgactgcattaccgaggggaattcatga

SEQ ID NO: 3326 - DNA, 996 bp, Xenorhabdus bovienii
  Coding sequence Name=Xb4151_4152.C438.gene119.dna; Position on contig= 91677..92672bp; Strand=-
atgaagaaaaaacgtccagttttacaagatgtcgcagacctcgttggggtcacaaaaatgacggtcagccgtttcttgcgtaatccggatcaggtctcggaagcattgggaaaacggatcgctgaaacgttggatcaactgggttatattcccaaccgtgtgccggacatcctttccaattctaccagccgaacgatcggggttttacttccttcactgactaatcaggtatttgccgaagtcattcgtgggatcgagcaggtaactgattgtaatggttatcagacgatgctcacccactacggttattccgctcagaaagaagaagagcgcctgctttccctgctttcttacaatattgatggcctgatcttggcagagcggacgcatacgcccaagaccttgaaggtactggagacggcaggcattccggttgtggaactgatggatagcgtctctccctgccttgatattgcagtcgggatcgataattttgaggcggcgcggcagatgacggtggctatgatcgagcatggctgccaaaacgtgatctacctcggagcgcggcaggatgaacgaacgctgatccgcttggatgggtacgaaatggcgatgcgcagcgcagggttgcagccgagaaatgtgatgacgcctgccagttcgtcctattcacttggcgcgcagcttttgcgggaaacctggcagaaataccctgatgttgatggtctgttttgcaccaatgatgatatcgcgattggtgcgatttttgaatgtcagcgacaggggatcaatgtcccggaacagatcgctgtcgctggattccacggccatgatgttggccaggtgatgatgccaaaactggccagtgtactgactccgcgtgatctgatcggacgcagggcggcggaagccctatttgcccgtttgcagggacaaaaactggaacaaacccttattgatgttggatttacgctttcattgggagaaagtgtttaa

SEQ ID NO: 3327 - DNA, 972 bp, Xenorhabdus bovienii
  Coding sequence Name=Xb4151_4152.C438.gene120.dna; Position on contig= 92819..93790bp; Strand=-
atgataacactggaagatgtggcaagttattctggcgtctcgcgtgctacggtgtcacgtgttgttaatggtgacaacaaagtgaaggcagcaacccgtgccaaagttgagaatgccatcgtagaattgggttacagccccaatctggcagcgcgtgaactggcttcaaatcagagcaatacgctgggattagtgactacctcctatcgtggcggcttctttggtgctttgatggatagcatccagacggaagctgaatcacatggcaaacagcttttggtcatgcaggggagaaatcgtgctgaaaacgaatggcaggctattacgcatttgcatagtctgcgctgcggcgggatgattttacatgtgcgtgccatcagtgatgataagctgaggcaactcgctcaaagtggccgttcgtttgtgttgctggatcgtctggtggcagggctggagccccgctgtgttgtgtttgatcaccacaaggccagctatctcgccacgcaaaccttggtcgagaatggacatattcgcattgcctgcgtgagtggccctttgtcacgcaatccaagccggcagcgccgtcaagggttcttggatgccatgcagaatgcgggattgaatcctgttgcttgtctggaaggggagtatgatctgcaaagtggctaccggcaaactcgaaccattctggcaaaatcacggccggatgccctgttcttctgtagtgaagagatggcgctcggcgcattgctggcgattaaagagttggggctgagtgtgccagaggatatttccatcatctgttatgatagcggagagcgggcggcatttgtctatcctgcactgactagcgtccattttcccattactgacatggcgtgtttcgcagctcgtttattgatcgaacctgatacacctcccccagaatttacgccccaaattatttatcggaattctctcagacaagggtaa

SEQ ID NO: 3328 - DNA, 1311 bp, Xenorhabdus bovienii
  Coding sequence Name=Xb4151_4152.C438.gene121.dna; Position on contig= 93837..95147bp; Strand=-
atgaaaccgatcaaaattgccgttattggcggcgggagcagttatacaccggaattggtggaagggattattcagcgtagccaaattattccgctttctgagctggcgctggtggatgtagaagccgggcggcacaagctggaaaccatcgctgcgctgactcgccgtatgctggatcgtcatgatctggagcacgttactgtcacggcgcattattcaccggatgaagcgattaaaggagccagtttcgtactcactcaactgcgcgttggtcagcttcctgcccgtgctgctgatgagcgtctggggctgaaatatgggttgctcgggcaggaaacaacaggcgtaggcgggtttgccaaagcattgcgtaccattcctgtgttactggatatcgctcataaagttgaacgccttgcgccggaggcgtggatcatcaatttcagcaatcctgccggcgttgtcacggaagcggtttcccgctatagcaaagccaaaatcatcgggttatgcaatgtgccaatctcaatgcaccatatgatagccaatatgctgcaacgtccatatcaggacgtacaattacgttttgctggccttaatcatatggtctgggtacatcaggtactagtgaatggcagggatgaaactgagcaggtattagaattgctgtgtaatggcgcagagctgacgatgaacaatatcaaagaagaaccgtggcctccggagtttttacaggcattaggcgcaattccctgcccgtatcatcgctacttctatcaaaccggtaagatgttacaggaagagaaagaaatcgcggcgagcaaagggacacgggcagagcaggtgatgcaagtggagcgggagctgttcgagttgtatgccgatcctaaactggatcacaaacccgctcagctcagttttcgtggcggatctttctattctgaagtagcgttggaattgatctcggctattcataataatctcggtacgcaattggtcgtcaatacggagaatcggggagctatcatcgacctgccagatgatgcggtgatcgaagccaactgtattgttgatgctcaaggggcgcacccactggcgtttggtcacctgccggacagtatgtcagccctgacccagcaagtgaaagcatttgagcgcctgaccatcgaagccgccgtccatggcgatcgcaaggtcgcactgttggcgctggtcactcatccgttgattggcgatgtggcgttggattcgacattattgaacgaaatcttagagattaaccgcatgtatttgccccagtttaaacgataa

SEQ ID NO: 3329 - DNA, 435 bp, Xenorhabdus bovienii
  Coding sequence Name=Xb4151_4152.C438.gene122.dna; Position on contig= 95159..95593bp; Strand=-
atgaaaaacagcttttggcagaagagcagcagcaggccaaaaaactcgccgacgctcaggcgtagcaataaccttggaggatgcagtgtgaatatgggttctgaacagcaggattttgaacaacagatcgtcgaattgctggtacatgccggcagtgcgcgcagcagtgcgttaatggctttacagcaggcgaaggtgggagattttcagcaagcaggaatattgatggaagaagcgcgacaggaaacgcgtgccgctcatgctattcagactaagctgatcggattggatgaaggatgcggaaaattaccgattaatctgattactgttcatgctcaggatcacctgatgaatgcgatggtgattcaagatcttgccagcaatatgatcgatctttatcagcgcttgccgccacaagatcgccagccagaataa

SEQ ID NO: 3330 - DNA, 1323 bp, Xenorhabdus bovienii
  Coding sequence Name=Xb4151_4152.C438.gene123.dna; Position on contig= 95529..96851bp; Strand=-
atggagtggattatgagtttttatacttccttaacgcgtattgtagaaaatcatattgcgcccattgccggacggatcggtagccaacggcatattattgcgatacgtgatggttttatctcggccatgccctttctgattattggcagtattatgctgattgtggcaaatccgccatttgatgcccaaaccacctctttcttgggtcaggcttggctggaattcgccaaagcgcattggcaaaccatcactatgcctttctttatgacgatgggattgatgagtgtgtttgtctccattggtacggcttatagtctggcgaaatcttatggactggatggactgacatcagccttactgtcattgatggcgtttctgttggcagcagctccgcaggttgataacaaaatgccgctcgattttctgggaggaaccggagtatttacggcgctgatctgtgcgatttggtcggtggaattaatccggttgctgaaaaagtacaacatttctatcaagatgccatcacaggttccacctgccattgcccgctcttttgaactactgtaccccgtggttggtattttgctgacggtttatcccgtcagcctgctgctgcaaaacgaatttaatttactgctgcctgcggctgtcatgcagatattcgaacccctgattgcgatcggggatacgttgcccgctgttatgctggtggtgttgattgccaatttattgtggttcgccggtattcatggcgacaatatcgtcactgggctgctgaatcccatttttatggcgaatatcgccgctaatgccgccttgatgacacagggaatggcaacgactcaaatcctgaccgcaccttattggtctttttacgtctgtatcggcggctcgggttctacgctggtattggcattcctctatctgcgcagccgctcaattcacctgaaaaccattggcaaactgagtgttgtacccgccatgttcaatatcaatgaaccgttgctgttcggctctccggtggtgatgaatccgacgttattgatcccgttgttggttgtgccgctgattaatgcagtcttggcctatggtgcactgcatttggatctggtgcagaagatgatcgcgattgcgccgtggacagcgcccgcgccggtgggggcgctgatttccgccgcgtgggattaccgtgcggtcgtattggttgggctgttgatggtgattgatctgctgatttggtatcccttcttcaaagtatatgaaaaacagcttttggcagaagagcagcagcaggccaaaaaactcgccgacgctcaggcgtag

SEQ ID NO: 3331 - DNA, 306 bp, Xenorhabdus bovienii
  Coding sequence Name=Xb4151_4152.C438.gene124.dna; Position on contig= 96867..97172bp; Strand=-
atgaaaaccattctattgtgttgtgcggcggggatgtctaccagcatgttggtgcagcgtatgcaggcggaagcggaaagaagggaactggaggtagccattaaagcagtgcccgcattggagttggaaatgtatatcaatgaagccgatgtgattttactggggccgcaaatcaagtatgaactgcctcgatttaccgctcttgctgagccactgggtaaacctatcagcttgattgagatgatggattacggcgccttacgtggtgataaggtactggatcacgccttaagtctgctggaataa

SEQ ID NO: 3332 - DNA, 219 bp, Xenorhabdus bovienii
  Coding sequence Name=Xb4151_4152.C438.gene125.dna; Position on contig= 97072..97290bp; Strand=+
atggctacctccagttcccttctttccgcttccgcctgcatacgctgcaccaacatgctggtagacatccccgccgcacaacacaatagaatggttttcatgattttgttctctttgctgttgtctattatgatttcgtctaattcgaagatgagagcgctctcattttggttaaggctaacaggttatttttccgttgctgcgataaggttcgcataa

SEQ ID NO: 3333 - DNA, 297 bp, Xenorhabdus bovienii
  Coding sequence Name=Xb4151_4152.C438.gene126.dna; Position on contig= 97389..97685bp; Strand=-
atgggatgtttgtcgctcaaggcggtttatccccgtacctacggggaacacggaatggcgctacatttctttgacagttctgccggtttatccccgtacctacggggaacacaccaaggactattggatcagagaaaactgggacggtttatccccgtacctacggggaacactgtgcatgcactaaatcgatactcatttgtgtcggtttatccccgtacctacggggaacactctaatttcatctatctgttttataaaatgttttttgaccttcaaaattctaccattttttaa

SEQ ID NO: 3334 - DNA, 114 bp, Xenorhabdus bovienii
  Coding sequence Name=Xb4151_4152.C438.gene127.dna; Position on contig= 97817..97930bp; Strand=-
atgagttgtattaattggtgctttacagcaatcatcagcttcatccgtgattttggtgatttgtttggcgacgattatcaaatcataaatgaagtttttttgtatctaaaataa

SEQ ID NO: 3335 - DNA, 240 bp, Xenorhabdus bovienii
  Coding sequence Name=Xb4151_4152.C438.gene128.dna; Position on contig= 97887..98126bp; Strand=+
atgaagctgatgattgctgtaaagcaccaattaatacaactcattgatgaggattctttgcaaaagattaagttaaaaaaacaattaataacctattataaatatcttatggaatttaaacatcacctcgaacttctatattttttgacttttaattctttcttttttattaatatattcttaattaaatttattacaattaataaatttaacaacatattaataatctattttaactaa

SEQ ID NO: 3336 - DNA, 132 bp, Xenorhabdus bovienii
  Coding sequence Name=Xb4151_4152.C438.gene129.dna; Position on contig= 98123..98254bp; Strand=-
atgcaattttttattattttttatataagtttcttttttgtgccatttgtatttgaggtgttaaagtgtattttatacttatacatcaaacactttgtgtattatataatattaacaagaaattatttttag

SEQ ID NO: 3337 - DNA, 609 bp, Xenorhabdus bovienii
  Coding sequence Name=Xb4151_4152.C438.gene130.dna; Position on contig= 98353..98961bp; Strand=+
atgacacgaaaaagagggagacctctcaattttgacaaagagttggctcttaaaaaagccatggatattttctggactaaaggattcgaaggaacccaacttgtagatttaacggcagttatgggaattaatcctccgagcttctatgccgcttttggaagcaaattcaatctattttgtgaagctgtacagctttatattgaaacagtaggtaataaaacagtaaatgcactaaatgatgcaaagacaacgaaagaagggcttaaggccatgttggaaaactccataattaacgcatcttcaaatgaagcaggtggttgcttaatgataatgggagtagttaataatcgtgctgaaaattaccctgcctgggagtatttgagagaagaacgtgccaaaacccttacactgatacagttacgtattgaacgcggtattatggaaggtgatttgcccaaaaatactgactcaaaaacattggcagaatattttttgggaattacacaagctatttcatttcaggctagagatggtgtgtctaaaaatactttacagcgcctgattgaacccgctttagccgcattgccctcccccaaaacactggagtag

SEQ ID NO: 3338 - DNA, 1200 bp, Xenorhabdus bovienii
  Coding sequence Name=Xb4151_4152.C438.gene131.dna; Position on contig= 99456..100655bp; Strand=+
atgcaaaatacatctgccacagacaataaaagtgaaacattgccattggctgtgtacatactggcattcggtatttttgctttggtgacaagcgaatttcaagtagcaggtatgatacctgttatggcaagtgatcttggtgtttctatttcacaaattggttatctggtatctttgtatgcactagcaatggcggttggaggtccattgctaaccataggactattaaaaataccacctaaattcgcacttataattctttacgtgatatttaccattggtgaggttttaggagctatagcgagttcgtatcactttcttgtagtagcgaggcttattactggtgctgcatctggggctttttatggagtagcgatagcaatctgtgttgaaattgtatcagaacataaaagaggttgggcaatttctattgtactagctgggattatggcagggacaatactaggtttgccaatggccaatttgattggaacacattttggttggagagagagcttctgggttgtaagcgttttagttgtgcttggtttaattgtcagcatattatggatcccaagccttccaaagcagcaggaaattagcctaaaaagtgaattaatcgctctaaagagccctagattatgggctgtattctctacaagtttattaataatcggcgctacattttctgcattcacttatttcatacctatactgaaaaacattactggctatagtgatggtgctgtcgctgtactcctgactgtttatgggatagcaactatgttaggtaatatcgttgttggaaaattagcagatcgccatacgataactattctggctgttggacttgccttactgacaattttccttgccttatttgctatttttgctgagaacaaattaatctctgttctgtccttaataggtattggtttagttggtgtaacaatgaatccggctatggttacacgagtcatcagaactgctaatggtcgtcctctggtaaacactattcacagttctgtaattacactaggcattgtcattggagcatttcttggtggtttaggtattagctttgatcttggtttaacatctccaatgtgggttggctttttcatggctatagtcggtttcacaacgctaattccagatttgcagttataccaccgtgaacgagtaaaactgaacagctaa

SEQ ID NO: 3339 - DNA, 180 bp, Xenorhabdus bovienii
  Coding sequence Name=Xb4151_4152.C438.gene132.dna; Position on contig= 100729..100908bp; Strand=+
atggtgattattcggggttcttatctctttgctcaagaggtagcttcctatatttctgacaatgggagaataatgaatataggaagctgtttaggtgagcgaatgcccgcggctgggcttactttatacgcaatgagtaaatcagcaatagttggccttacccaaaggattagcgtgtga

SEQ ID NO: 3340 - DNA, 390 bp, Xenorhabdus bovienii
  Coding sequence Name=Xb4151_4152.C438.gene133.dna; Position on contig= 101060..101449bp; Strand=-
atgttgacggcggggcaagcccacgaaagtcaatcggccacccctttgctcgacggcattggaatacagcgcaaaaatggtttcatgaaacggcgcggcaaagctgtgctggccgataaaggctattcgggcggaaaacttcgcagttatctgcgtaaattgaggataaagcgcgttattccttataaaatcaatgaaaaaggaagcggagatggtcgcacacaatttgataagctgacttatcgtaaccgcaatgttgtcgaacgctgtttcggttttctcaaaggaaatcggcgtattgcgacacgctacgaaaaaaccgcacgaaactacttgtccatggtgaaattaggctgtattcgactcttttgccggcgattatataattaa

SEQ ID NO: 3341 - DNA, 456 bp, Xenorhabdus bovienii
  Coding sequence Name=Xb4151_4152.C438.gene134.dna; Position on contig= 101449..101904bp; Strand=-
atgagggcacgttacgacattcctgatgaggcatggatactgatagaaccttgcctgccccctattcattcaaagcgagcaggacgtccacatgctgaacaccgccgtgtcatgaatgggatgttctgggtgctatgttcaggggcaccgtggcgcgacttaccggaacgttatgggccttggaaaacggtctataaccgacttaaccgttggtcaaaatcgggcattatcaataagatatttaatcggttactgtccattctggatgaaaaaggtttgattgactgggctgaaatttgtctggatggcagcaatattcgcgcgagtaaagatgctgcaggcgcgaaaaaaaacatcccgatatcgctgacgctcatgcgctgggtcgctcatgcggtggttatggcaccaaaatccacctggccaccgatggaaaggggtttcccctcaacctga

SEQ ID NO: 3342 - DNA, 222 bp, Xenorhabdus bovienii
  Coding sequence Name=Xb4151_4152.C438.gene135.dna; Position on contig= 101836..102057bp; Strand=+
atgaatagggggcaggcaaggttctatcagtatccatgcctcatcaggaatgtcgtaacgtgccctcatctttttcccgtattgaaaacagttcagatgataatactatcaatttgcattaagggacacgccctagtgcctgtgtgctgtatttatcgtggccggatgtggtatatcccacgatggtattgctgcctgcggcacttttgctgggtatggtag

SEQ ID NO: 3343 - DNA, 198 bp, Xenorhabdus bovienii
  Coding sequence Name=Xb4151_4152.C438.gene136.dna; Position on contig= 102079..102276bp; Strand=-
atgcagcagctaacggcgatatcactgcaattcaggcagaaatcgagctttctgcaatcatcattgcgatggttgaaagaagtctttgattgccaggctgactcgccgccatgcagcttgtctgctgacgatgtcatacaaaacaaaaaccgttttgcatgccatcgtacagcgtcatgcgctataaatattttttaa

SEQ ID NO: 3344 - DNA, 690 bp, Xenorhabdus bovienii
  Coding sequence Name=Xb4151_4152.C438.gene137.dna; Position on contig= 102188..102877bp; Strand=-
atgataaaagacaagcgtaatctatatactaaaagtaggttaccattagtaagttacctttggtatataaacatgtcaagcaacaaagcccattcaaaactggctaattcacaaacacgtattcgccttacaagagaagaacgctatcagcaactaactgccattgcctggcagatcattcgaaacgagggaacagaggctctgactctgggcagattggctgagaaagccagcgtgacaaaaccggtcgtgtatgaccattttggtacacgttctggtctattggcagcactgtatattgaatttgataaccgccaaacgataatcatggacactgccattcaacaaagtgaacacactttggaaaaaaaagccgctgtaattgcatcctcttacatcaattgcgtgctttttcaaggaagtgaaatacccagtattattgccgccttagccggctcacctgaactcgaaaaaatcaaacgcgaatatgccaaaatttttgtagagaaatgcagggtaatactggtgccctacacccaaagcggaaaaatgaccgctgcaagcctttgggcaatgctgggagccgcagaaacgttatcctatgcagcagctaacggcgatatcactgcaattcaggcagaaatcgagctttctgcaatcatcattgcgatggttgaaagaagtctttga

SEQ ID NO: 3345 - DNA, 612 bp, Xenorhabdus bovienii
  Coding sequence Name=Xb4151_4152.C438.gene138.dna; Position on contig= 102895..103506bp; Strand=+
ttggtgcacgcacttatcgttatctcacaccctatttctgactctctcagtggtcatgtggctcaatatattgctgatggcatcacgcaatcaaatcccgaaaatagtgtcgaacttgctgatcttgctaaagaaggatttgatccaagatttactgaatcggatattgtggctttttacaaagaaagtttacctccggttgatgtgattgctgagcagtcacgaattgccttggctgatgcgcttgtcttggtttatccggtctattggtggacaatgccggccttactcaaaggatggatcgatagggtgttttgtcatggttgggcttataacgagcatcctgatggcagactggaaaaaaaacttcagcaccttccagtacatctggttgctattggtgctgctggccgagaaacttatttaaaacatggtttttgggacgccatgaaaacccagattgaccatggcatttttgattattgtggagcccctgtcatcacttcagaattactgcttcatcctgagttaaaagatacaaatgcctatgaggaggctgcatacgatattggtcgccacattttcagtatggctgaagtttcagaggcatga

SEQ ID NO: 3346 - DNA, 123 bp, Xenorhabdus bovienii
  Coding sequence Name=Xb4151_4152.C438.gene139.dna; Position on contig= 103514..103636bp; Strand=-
atgataaaagatacctgttgtcagttaactagccgctcaggcggcctgtctgcgagcacaggcatcatacttttattgatttctttaatatatgacagaaagttgactttgattctgctttaa

SEQ ID NO: 3347 - DNA, 627 bp, Xenorhabdus bovienii
  Coding sequence Name=Xb4151_4152.C438.gene140.dna; Position on contig= 103694..104320bp; Strand=-
atgcggccgaccaaacctggtatatcgacagcagttttgatccggagccatttatgcaatggctgccgttctacaatgtgcatgcggaatactggtatctcgcgcaaacccggacagtctgtccgcactgtcatgaaaccaccaccgtcaccgcgtttatgcttcctgtcggacaccagctactggaagcggataacggcgatgagcccagcacggaagttgactacacagagtaggacagcccggcgtttttgttttatatcgccgatattcccactctcgtgcgtagcgtgctgcccggttttcaccacactctgcgcaaagccgtccgtcagccagcggctgcaccgacagcactggataaaccactgtgaacattgtggcgctcagcaggatgataccgaactgtttgcagaagtcggcggcgcgttttttcctgcgtccagagagcaagcggcgactattcagctacaccggattgatcagccattcgtggggtattgtgaagatatttcgcaccatcacgaccgttttgatccgaagcaggattaccatctctgtaatgcgtgtgattggtttgcatccatgacactgattatcaacaatcaatcaacatctcgtcattaa

SEQ ID NO: 3348 - DNA, 276 bp, Xenorhabdus bovienii
  Coding sequence Name=Xb4151_4152.C438.gene141.dna; Position on contig= 104187..104462bp; Strand=+
atgacagtgcggacagactgtccgggtttgcgcgagataccagtattccgcatgcacattgtagaacggcagccattgcataaatggctccggatcaaaactgctgtcgatataccaggtttggtcggccgcatcccagtgtgctcccagcttgcctattcccgaataatagtctcctcaatgtgctgtaaattgaggggcaccatgatgtttagacgggtgcggcttgcggtggttccgattatctttgtttgcccagcccgtatccagctgtag

SEQ ID NO: 3349 - DNA, 204 bp, Xenorhabdus bovienii
  Coding sequence Name=Xb4151_4152.C438.gene142.dna; Position on contig= 104470..104673bp; Strand=-
atgcatgatacgacccgtgataaacgagtacgtaatcgcatcaagtccgtccttttggcttcggaaagctggactgaaataattgcccaggctttacggattcatgaaaccacagtaaatcgtcatatgaaagattatcttaaccaagaaaatctcacccctgaaaatgggaggattaccatcccactcaggtcacaaaattaa

SEQ ID NO: 3350 - DNA, 456 bp, Xenorhabdus bovienii; identical to SEQ ID NO: 3341
  Coding sequence Name=Xb4151_4152.C438.gene143.dna; Position on contig= 105050..105505bp; Strand=+

SEQ ID NO: 3351 - DNA, 390 bp, Xenorhabdus bovienii; identical to SEQ ID NO: 3340
  Coding sequence Name=Xb4151_4152.C438.gene144.dna; Position on contig= 105505..105894bp; Strand=+

SEQ ID NO: 3352 - DNA, 108 bp, Xenorhabdus bovienii
  Coding sequence Name=Xb4151_4152.C438.gene145.dna; Position on contig= 106035..106142bp; Strand=+
atgtgcagaggaaatgctaaattttgtcctaatatgagtagtaaacagtatgtaatcactgataaaaacgcttctttgcttaatatcacaatcaggaaaatcagttga

SEQ ID NO: 3353 - DNA, 387 bp, Xenorhabdus bovienii
  Coding sequence Name=Xb4151_4152.C438.gene146.dna; Position on contig= 106181..106567bp; Strand=+
atggtgccggaactcacagtgacaaattttcctgtgtccttagatttctatgtacaaatattaggattcaacatcatgatacggcgaaaagatcctgattttgcctatcttcatttagggaaagctcaactgatgctggaagcgtttcacgaaactggctggaatacggcagagcttaataaaccactgggacgtggcattaatttgcaaatagaagtggatgatatcaactctattcttaatcgcctgcaaatcaacaagataaaactttaccatccattgaaggataataactacgccacaggcgatacccacatctgtcagagagagtttctcgttcaagaccctgatggttatttgctaaggttcagccaatacatagggtaa

SEQ ID NO: 3354 - DNA, 2748 bp, Xenorhabdus bovienii
  Coding sequence Name=Xb4151_4152.C438.gene147.dna; Position on contig= 106632..109379bp; Strand=+
atgcctatgttaataaataattttgattacctcatccgatattggggcaaagcccagaaaaatatctattctgataccgattatcaccttctggcctatcactgtctggatgttgcggcagttggcaaatatctactggctccccacaaaaaaattaccgccgatattgcggattttctggaattatcaaaagaagaattacaaaacctatttgtattttttttgctcctacatgatatcggtaaatttgcttccgcattccagcaattatattctccaaaacaacacactgaactactgaaacctcagcattgcaaaccctacgatagcaaacattttcgtcatgatcgtttagggctgtttttctggaagcagatccagaacgatgtgctatttgctttggtgggagataataacctgcaacgcagagataaagatcgggcgcaagatacgttgatggtcttaatgcagtgtatgctcggccaccacggtaaaccgattgatgatggtgatgactggcgcgcgattggcgattttaccgaagccccaaatataactgatgcaaaagccttcacaaatgatctcattactctgttccagcctcgcctgtcactggaaaaattactttccaaagaatggaaagataacctgaagcaagtcagttggcagttggctggcatcgttgtcatggccgactggataggctctgacaatgcacactttcgctatcaaaccaaccccgtgccattggcagaatactggcaaaccgccgaacaacaggcgcaaattgccctgaatgccattgatatgcaatacacaccagccatatcgccgtataaatctatccagcattattatggtttttcaccaacgccattacagcaatgggcagaagaagtgccgattgatgattctccccagcttttcattctggaagatgtgacaggtgccggaaaaaccgaagccgctttcactttaacccatcgcttgatgcaggccggagtcgcagaaggtttctattttggcctgccgacgatggcaacatctaacgccatgtttagccgcgtcgccaaacactatcgtgagatgttcaataccagcggtaagccaccgagcatcgttctggcacatggtgccagtaagatgaacaatgctttcaatgacattattctgacctctcaaaacaacgatagcgactacaccaaagatgagatcacagcgacagcacaatgccatcaatggctggcggactcgcgcaaaaaagcactactggcacccgttggcgtagggactatcgatcaggcgctgcttgccgtcttgccccgaaaatatcagtcgctgcgtttgattggcttgaatcgtaagatcctgatttttgatgaagtccatgctgcagatgaatacatgtttgccctgctggaaaatttgctgaacctgcatcttcatcaagggggatcggtgatattacttactgccacactttccctgaaacaacgccagaaactggctgatatctggctatcttccgcaggccaaacaccgcaaaaactgcggcaaacagcctttccgttggcaaccaaaattacgctcactcctgaaaatccgattattgagcaacccctgcacagccgctcagatgtcagccgtgaagtcatcgtaaaaacactggactctctggatgcttgtgtgcaaaccgccctgaacgccgccaaaaaagggcgatgcgtggtttgggtacgcaattccgttgatgatgctttacacgctttccgattgattcagtcacagatgaataatccagaagattgcctgttgtttcacagccgctttattttgcacgatcgcaagaagatcgaagatcttgtactggagatatttggcaaaaatagcacccaactgcatcggcaaggcaaaatactgattaccacccaagtttttcaggaaagtctagatgctgatgctgacgagatgattaccgatatctgcccaatcgatgatttgatccaacggacaggccgtctgcaccgtcatactcgcgatgcagaaggaatttatcagcaaagtattagcgattgccgcccagcccctgtgttgtatctccacgccccaaaatgggacgatcaaccacaagcagactggctgagtaaagattttcgcaatactcaatatgtttatcgctcaccggggcgcctgtggctggggttgcgtgaattgcggcgatcgggcgctatcagaatgcctgccgaagccagaactttaatcgaagcggtttacagtgacgatgcgtatgaacacatacctgacaccttaagacataaggaaaatgaatttattggagaaggccacagcaaagaggccaaagcagaatcacagaccttgcgatggaaacatggatattgcaatcacagtgccagcggatggtatgacgatgacagcgatatcagcacacgattcagtgatatcgaaacggttgaaattctgcttgtaaaactggctgacaaagatgcattaataccgtgggcgaacgagggagaatttgccgttcaactcagtaccatcaggctaccaaaaaacaaatttgccgataagttactggcggttccagaatcgttttctcatgctgtagaacagctaaagagccaattcaaatccgctaaatacctgcaaatctggctgcctgaactcgaccccaatttcagttacgaccctaccatcggtttttatgaaatccaccagcaggaggcatga

SEQ ID NO: 3355 - DNA, 1605 bp, Xenorhabdus bovienii
  Coding sequence Name=Xb4151_4152.C438.gene148.dna; Position on contig= 109376..110980bp; Strand=+
atgatgaaccttgttaaaaacgcatggctgacctttaaaatgcgggatggcagtcaaaagaaactgccactggcggctatctgcgatcccaacgtcatggattttgccctgccacgggcagactttcagggcgcggcctatcagttagccatcggcttactgcaaacagtgtttgctcccgtggataagtttcaatggcatgatttttatgaggcttccccaacacaagcagatttacagacagcctttgaccgtgtggaacatgcctttaatctgtcaggtaacgggccgctatttatgcaggattttgattcgctggatagcgtcaaatcaacgacgatttctgggttactcattgaagcgcccggagcgaatacgctcaaacttaacaccgaccattttattaaacgcggccaatatgaaatcatctcgcctgaaatggcggctatcgcacttttcaccttacagattaatgcgcctgctggtggtgtcgggcatcgtgtcggcttacggggcggtggccctctgaccactctggttcaaccccaaacgctggataccccactctggcacaaactctggcttaatattgtcaatcaagaatactgcggctatcccgaagcagacctccacagccccagtgtctttccgtggttaggcaaaaccaaactcagccagcccaccggtacggaaatttacgcttctgatgttcatgaactctatatgtattgggcgatgccacggcgtatccgtctgcaaatcgacgataaacccgctatttgccaactgaccggacaacccaccgaacaatctgttacccgctaccgaacccaaaactatggcaacaactacgccggaaattggcaacacccactcacgccctataaatggaatccgaaaaaagctaatgacgatcacctttctatcaaaggacaaccgggagggataacttataagctatggaatagtttggcgttttccagaaataacgagggacaaaaagccgctctggtcgtcgatcatttccaccagatttgtgattattttgcagaggaacacagcgcaacaccccggctatgggtctttggctatgatatggacaatatgaaagccagaggctggtattccactacacttcccctgttttccatcgccgttgaaaagcaggatgtcattttccggcgagccagaaatttacagactctttccgccaatgccctgatccaatgccgttcccaaatcaaaagtggatggttcaatcgcccaaatgatgtgaaagggaatatgtcatttattgatgctgcgttctatcaacgtactcaaacagctttttttaaagcgatacaacagattatcagcagccagcaggcgtcttcttatctctcgccagaagaggccaaaagctggctctaccaactgagaaatacctgtttcgatctgtttgatgaatatgtgctgtcagaaagcgtcgatccgaaaacgctgccgaaaaaagtcaaggcaaggcactttttgactcagtggttatttggtgccaaagagatcaaatcatttatgactgaataccaaatcgaacgccaacagaaggaggtgatcaatgaatag

SEQ ID NO: 3356 - DNA, 552 bp, Xenorhabdus bovienii
  Coding sequence Name=Xb4151_4152.C438.gene149.dna; Position on contig= 110973..111524bp; Strand=+
atgaatagcttgagcgaaagtaccttgctgtgctggtgggaaagcatgtttctatcaccatcagaactgaaagctaaaggcagataccccgctccaacggtgtataaagcacagttaaaacgctgccagaatatcgacacggccatgttaaccggaggctttcgcgcgttatggcagaatttgtccgaaagcgacgctgaaaccgttgatgaaaaaaccatcataaaatgggcaatgattgccatgacggtcgtgcatgtgaaatacaatgtaaccacaacactggcaaccgcagccggcaccaaaacagaaaatgataaacctgtcgtcagtgaactccgttttgcccaattacagggtgccaagacccccgacgaattagttacccgcttacgacgcaccttgcagctcattaatggaacagtttccatgctggatctggcaaaagatattgagcaatgggttcgcgaatgccaccagcaaagaccccgtcgagcgaatcagcgtctcagcgtgcaatgggcgctggagtattacaaagcagcaaaataa

SEQ ID NO: 3357 - DNA, 1038 bp, Xenorhabdus bovienii
  Coding sequence Name=Xb4151_4152.C438.gene150.dna; Position on contig= 111552..112589bp; Strand=+
atgagccaatttattcaattacatctgctgacctcctacccgcctgccaacctgaaccgtgatgatatagggcgccctaaaacagccagaatggggggagttgatcgattaagaatcagctcccaaagcctgaaacgccactggcgagtctcagatctgtttcaggcagcacttgcgggacaccttggatttcggacaaaacgctttggcctcgaaatttatcaacaattgatcgaagcggacgttaaagaaaagcaggcgatagagtgggcttctgccattgcgggagtatttggcaaaaagaaaaaagacacgccactggaaatagaacaactggcccatatcagccctacggaaaaagccgccgtaatctccctgataaaacaactggccgacgaaaaccgggcgccaaccaaggaagagctaagtctgttgagcaaagagagaatggccgtagatatcgccctgtttggccgtatgctcgcttccagcccggcctataatattgaggccgcctgtcaggttgcccatgccatcagcgtacatgatgtggtgattgaagatgactattttaccgcagtggatgatctgaacgacggcaaaagcgatacaggttcagcgcatatcggagaaaacggatttgcagcagccctgttctacagctacatctgcatcaacaaaaccctgctgatggaaaatctggcaggcaatgaaactctggtcaatcaagccattgccgccctaaccgaagccgccgtcaaaatctccccttccggtaaacaaaacagttttggctcccgcgcctatgccagttatgttctggcggaaaaaggagaatatcagccccgctccttgtcggtcgcgtttttgaaacccattaacgatgaagatcaggctgcgtcggccattgccgcattggaaaaacaggtcgaaaacttcgataaagtttatggtgactgtgctgacacccgtcatagcatcaatactctcaccggagaaggcagttttgccgaactgattaaattcatcacgaattaa

SEQ ID NO: 3358 - DNA, 753 bp, Xenorhabdus bovienii
  Coding sequence Name=Xb4151_4152.C438.gene151.dna; Position on contig= 112602..113354bp; Strand=+
atgcaaacctatttggtttttcgattatatggtgtgctggccagttggggcgtagaagccgtcggtgaaagccgccccaccagcctgcatccgactcgttcagcgattttggggctattgggtgcagcgctgggcatccggcgtgatgatgaaatgcgccttgccgagttacagcaaagtgtcaacatcgccatcaaacaaatcgtggccggttcattgatgagggattatcacacgagtcaagttccctcccaaaacaacaaacagcaacacttcacccgtaaaagtgagttgggtgaatctgaactgaatacgattttatcctcacgggattaccgcagtgatgggctgtggatcatcgcaatttcactgaccgaccaagcccatctgacactgacaaccttgcgtgatgcgctgttaaaaccggttttcaccttaagccttgggcgcaaatcctgccctctgtgcgttcctacgatgccgcaaataacccaatctccctgtttgaaggcagctctggatacggaatttccgcctttaacgcagtcagagaaagctgatcactattggctgggtgacagcggtatcgtgagctatttttgggaaggggataaaaacgagattgagatccccgatgtggcggtattgaccagccaattgtgggacgaaccgctttcacgaacccgctggcagttcacccaacgtactatgcaccaattatcgctgatggagaaggcacatgtacctgtctaa

SEQ ID NO: 3359 - DNA, 675 bp, Xenorhabdus bovienii
  Coding sequence Name=Xb4151_4152.C438.gene152.dna; Position on contig= 113341..114015bp; Strand=+
atgtacctgtctaaagtcaccttacgaccttctgcctatcgagaacagtttttgtcaaaaatggcgaaaaacagtgtttattcttcccaccagctattatggcaactgtttacggaacaggtagaacgcaattttctgttcagggaagatattggcatcaacggtacacctgagttcttcgtactgtcccatacagcgccaatacccaattcggcgatgttccagattcagagcaaggcatttaccccgcaattacgcagcggacagaaactggcgtttaaactccggctgaatcccaccatctgtattacagataaggattccggcaaacagcggcgtcatgatgtactgatgaatgccaaacgtcaggcacagttggcgggtgctagcactgacgaaatccagccactgatgatgcaggctgtacaggcttggatacaggatgaaaaacgactgactagctggggtattcagtttgatttcgatcctgatgttgaacgctatacccaacatcgctgtcgcaagtcttccggccagaaagtggctttttcgagcgttgattttcagggcgtactcaccctttcagatcataaactttttctggcgcaatacgctaagggatttggtcgggcgaaatcttttggctgtgggatgatgctgataaggactctgtaa

SEQ ID NO: 3360 - DNA, 921 bp, Xenorhabdus bovienii
  Coding sequence Name=Xb4151_4152.C438.gene153.dna; Position on contig= 114015..114935bp; Strand=+
atggcgtttattccactgaaaccgattcctatcaaaaacagaaattccatgatcttcatcggcatggggcgtatcgacgtcaaagacaatgcattcgtcgttattgatgaagtgaatggcgaacgtatgcatattcctgtcggttccattgtctgtatcatgctggaaccgggaacccgcgtcagtcatgaggcagtaaaattggcgtctgcaacaggaacgttgctgatttgggtgggtgaagcgggtgtcagactatattccgttgggcagccgggtggcgcccgttcagacaaattgctttatcaggccaaactggcgttggatgaagaactgaggctgaaagtcgtacgtaagatgtttgaactgcgctttggcgaacccgcaccgcaaaagcgcagcgttgaacaactcaggggaatagaaggcgcccgtgtcagaaaaacctatcaaatactagcgaaacaatatggggtacagtggcatggacgtaattatgaccataccgattgggataaaggcgatttaatcaaccgctgtatcagtgccgcaacatcctgcctgtacggcgtgactgaagcggcaattttggcagccggttatgcgcccgctattggttttctgcatactggtaagcctctgtcgtttgtttatgatattgcggatattttgaagtttggtactgtcgtccccatcgcctttaaagtggcggccaccaaccgtattgctcctgaccggcaggtgaggattgcctgccgtgaaaaattcaggacagataggatattgaagcgtttaatcccgttgatcgaggaagtgctcgctgcgggtgaaatatcccctccaccaccgccagatgatgcccaacctcccgccatccccgaaccgctctccatcggcgatattggtcacaggagccgataa

SEQ ID NO: 3361 - DNA, 363 bp, Xenorhabdus bovienii
  Coding sequence Name=Xb4151_4152.C438.gene154.dna; Position on contig= 114868..115230bp; Strand=+
atgatgcccaacctcccgccatccccgaaccgctctccatcggcgatattggtcacaggagccgataacatgagtataacgatcgtcgttaccgaagcagttcctccgcgcctgcgggggcgtctggctatctggctgcttgagatacgggcaggggtttatgtcggtgatgtctcgcagaaaatcagagaaatgatttgggaacaaatcacagaattaaccgaagcaggaaatgccgttatggcttggggaacaaatacagaatcagggtttgattttcagacgttcggtgaaaatagaagagaaccaatagattttgatggcttacggctagtgaaatttaaaccacttcctgagggttaa

SEQ ID NO: 3362 - DNA, 132 bp, Xenorhabdus bovienii
  Coding sequence Name=Xb4151_4152.C438.gene155.dna; Position on contig= 115289..115420bp; Strand=-
atgacatggcgtgagtctccggtttatccccgtacctacggggaacacacaataagagtgaaaatgtatacatttgaaccggtttatccccgtacctacggggaacactctaaatataaccatttgttttaa

SEQ ID NO: 3363 - DNA, 297 bp, Xenorhabdus bovienii
  Coding sequence Name=Xb4151_4152.C438.gene156.dna; Position on contig= 115527..115823bp; Strand=-
atgacgagtttgagtcatagtgagtcttgctattatgggaagatatgttctgctgttggtttatccccgtacctacggggaacactacgaccccgcgaagtatgttcccattgcaggcggtttatccccgtacctacggggaacacaatttcaatccccgtttttaatccggcattaccggtttatccccgtacctacggggaacacgacaataaactcagtgctggacgctcaatagacggtttatccccgtacctacggggaacacattggctgatcctgatgagtcctatatga

SEQ ID NO: 3364 - DNA, 1020 bp, Xenorhabdus bovienii
  Coding sequence Name=Xb4151_4152.C438.gene157.dna; Position on contig= 115958..116977bp; Strand=+
atgaccttaactaacttcagcaaattgttagccgctacactttgtcttgcgacttcatacagctatgcagatggtgagcgcccacttttttcattgacgatggcagagtctggtgtatcgcagacgaataacgatgggagtttatctcattctacaaaatcagaatcccgcattctgccgatttggggtgatgaagcgcgagctaaaggctacgatctgcctgagccatttggcgcaagttatggttatatgaatctgcgtcaggatatcattatagacagcattaaatttcaatttaccaatccgcttgtagataagagctttcgaaatctgattgcagtcaatgcaggtgatacccgagaaaaaaatgaatctcatatgcttaaactggatacttgggttctgccttttataaatgtatacggtgtatatgggaaaaccaaaggtacatcaaaaaccaatcttgatagtatttactttatggacatggaagacccctggcttaaaaacattccttttgaattaaatttcgaaggaaaaacctatggtggaggggcaacttttgccggtagttataaccaattttttgctacattagatgctaactacacacgtaccactctagatattttagatggggatattagtgcccttgtcattactccacgcgttggttatgaatttgtcttcgaaccattattcactggtcagggaaacaccaaagttcaggtatgggtaggtgctatgtaccaagatatcacccagcgttttaaaggtgatgtaagtaaactcaatttaccatccgacctagctgatttgtttggctcacttacaaataatacagcggataacggcaaatataaatcagacatcaaattcgacgtcgagcagcaccttgcccataaatggaataataccgttggcgcacgtttcgaaatcactcgtaacttcaatatcctatctgaagtgggtttcggcaaccgaaacagcctctttgtttccggtgagtttcgtttctaa

SEQ ID NO: 3365 - DNA, 1152 bp, Xenorhabdus bovienii
  Coding sequence Name=Xb4151_4152.C438.gene158.dna; Position on contig= 116977..118128bp; Strand=+
atgttcggctacaagacaatcaagaggctggtgatatccagccttcttatttttagcgtatcgtcagcacaggctgatatcttgcccaatcggcagaaaatcgatggttggctcagcgaattaggtggcagcaatcaactcgatgccagcaaaaaggttgattggggtgtgctgcccggtcctttttacactcctgaaatgggaatgggcgtcggagtcgctgtagtcgggctttaccgtcccgataactcagaccacaccagccagacctcctcactgggtctcagcggttttgcttcatctaccggcgcatttggcctgaattttaccaattacaattttcttgcccgtgatcagtggcggttatttgtttccggaacgctaaataacacgccgacttattattggggcaagggttatgatgccggtaaaaataatggcaataaagagaaatatcgagcgcaggaatttgatattcgccctcgcctgctctatcgcgtgacagatgctacgtatatgggattaggctggcatttctcatccctcaacgccagtgatccggatatcggtgccgcaaaatatttcgcgcagtccgtcggcggacgctccgtcaccagttccggtgtaagtgcatacttcagttatgacacgcgggatttcctgcctaatgcaaaacacgggcaggcgtttgaaatcgtttatacctatttttccccggaattagggggagataatcgtttcaataccacacagttacagttttcgacttatcaccagctatccgaaaaatccgtgctggctttcgataattatgcccgtttcagctctggcgatgtgccgtggaatcaattatccctgctgggcagtagtcaacggatgcgcgggtactatgaagggcgctatcgcgataccaatatcttaacgtcacagttagaattaagacataaacttgactggcgccacggtattgtcggctggataggcacaggtacattaagtgattctccttcaaagctaggtgcaaagcactggctcccttctatcggtgtgggctatcgtttcgagtttaagccacgcatgaatgtcagattagattttggtgttggtaaagacagcactggattctactttcaggtaggggaagcattttga

SEQ ID NO: 3366 - DNA, 1071 bp, Xenorhabdus bovienii
  Coding sequence Name=Xb4151_4152.C438.gene159.dna; Position on contig= 118194..119264bp; Strand=+
atgcctgtagagcctgtactcatcagtgacactcaagaacagccagagatcgactggccagtgttgacacctattgaaccacctgaaggcttaagagcctgctgcgcattcggttacgatcttaaaaccgaggtggtggggattcccgttcctttctatgatatcgacaatatcgtggaggccgagaaactgggcgaacatcactataacgacagtgctctgggtgccagtgctgctttattggggataagcaatgaaaaaatcggcctgttatatacccagaaaggtgggtttattgatatctcccatgtgagagataccgcagactatacgctgtacctctttagccagatttatgctcacctaggtcaggagcggaaattaagcctaagtaatgagcttgcggcgcgtaaaattcacttttttgcctttactccacctgtagatcccgttgagcgctacactttaagcgcttatttagcggcaaaactggcatttcagttggcggcttggcacgaaatcgcccaatggtatggctatcaatcagtcccagggttccccgagggcatttctgcgttttccccggaagacctctattccaatctcttgggagcaaggctggctctgaccctgattctgcaaggtcacgcttcttcggtaactcaatttactacctcaatggcagccatattgccttctgctttgcataaactcgagccttattccaaatcagacacaaaaaagatgtttaatcaggtcgacgggctatggtggaacagtcatgaacgtattccacaaaagtttttagtcctgcgcaggaattatgaaatccaagacaatcgttatccattaatgccttcaggcaaagaaaagtttgcgcggcgtctgtccctgcctgatgaatataagccgttttcgctggataaattggctgaactacagttatggccaaccgaacagatgaaaaacttacctgttcccaattcctattggacagtgaaagactttaacgcgttggcagaacatgcccagcatgaagatgcgcgacaattgttattgagtagcaaataa

SEQ ID NO: 3367 - DNA, 531 bp, Xenorhabdus bovienii
  Coding sequence Name=Xb4151_4152.C438.gene160.dna; Position on contig= 119332..119862bp; Strand=-
atgaaccttttagaatcggaagacaaaacttcccgaaatagaaaggttgttgaaactatgccggattcaaaagtgtttgttgataattacttgcctgctttgcttgggcaagcatggatgctggtttcttctgagtttcatgacatcgttgaggcgcgggggttgtccgtgctggaatggcgtgttttatcggcgttggctggaagtggtccgattggcattagcctgctagcgcaaaaaacagtcagtaaacaaccgacaattacccgagtattacagcgtcttgagttgcaggggcatgtcactcgtttttccaatggtaggggagatcgccgtatcacgttagtgcatcttaccgacagcggccagcaagtggtggtcggattactggcagaagcagaatcccatgaaaaaaacatactagaaccgctgggaagcggtaaaagtcagttactgaaagaggttttgcaggaactgattaagcggcatacgccgatgcgcagggcgttggggagattcgggaaagagtaa

SEQ ID NO: 3368 - DNA, 114 bp, Xenorhabdus bovienii
  Coding sequence Name=Xb4151_4152.C438.gene161.dna; Position on contig= 119940..120053bp; Strand=+
atgcagcccaagttgtttcaatatcatgcaggctatcgtaatagatggggagataacaggcgtgagactcttcagcgcgggatacaaagcccgttatggtcagatgccgagtga

SEQ ID NO: 3369 - DNA, 96 bp, Xenorhabdus bovienii
  Coding sequence Name=Xb4151_4152.C438.gene162.dna; Position on contig= 120078..120173bp; Strand=-
atggcttcccagccacgctgcaatgagattaatgttatgtctaacgtagcccacgcgataacaatgggctgcgttaaattttgccatataaattaa

SEQ ID NO: 3370 - DNA, 1188 bp, Xenorhabdus bovienii
  Coding sequence Name=Xb4151_4152.C438.gene163.dna; Position on contig= 120148..121335bp; Strand=-
gtgagatcaaccacaagtcacacgggtgaaacaaatgctttgccattagcgtcattgcttgcactggcaatgacgggttttttggcgctgatgacagaaactgtccctgcgggaatgttggcgcaaattagtatgggattgaatatttcggaatcgatggcaggacaatttgtcacgttgtacgccattggctctgtgattgcggctatcccattaacgacggcaactcaaagctggcgacgccgtccgcttttattggtagttttaggcgcgttgtttgtttttaatacactgactatattgacatctaattatacttttgcgctgattgcccgattatttgcagggatggccggaggtttaatttggggtatgttggcgggttatgcgcgccggatggcatcagaaccactaaaagggagagcgcttgccattgccggggtaggagcaccactggcactttcattaggcgttcctttaggggcatttcttggctcactgattgggtggcgcatgacgtttggcctactctcattgttgactttagcggtcatggtttggattcgtttacgggtgccagattatcccggccaatcatcagaaaaacgtttatcgataagttcggtatttgccactcccggtgttcggccagtattaacggtacttattttctgggtgctggcacatagtatcctttatacctacatcatgccatttcttgctcctgcgggtctttcccatcgagttgacataattttgctaatcttcggggcttcttcagtccttggcatatggttgattggggtattgatcgataaatatttgcggtcgcttgttttgataagcatcggattatttgctttggtcgcactggcattggggcttgctggtattttgcctgctgtaatttatatctctatggcaatatgggggctaacttttggcggagcagccgcgctattgcagacggcctctgcggatgctgcgggttctggtgcagatgtcgctcaatcaatcttggttaccgtctggaatttgtcgatagctgctggcggtatgttgggaggcatattgctagacactcagggtgttcatatcttcccttggactttgcttggattgcttgtggtgggattgataatcgcttggggagctaaaaaacatggcttcccagccacgctgcaatga

SEQ ID NO: 3371 - DNA, 972 bp, Xenorhabdus bovienii
  Coding sequence Name=Xb4151_4152.C438.gene164.dna; Position on contig= 121454..122425bp; Strand=+
atgaaggcgcatattagtattaaaaacaggctacagttcaaaatatatatgacaaatatgtcatcaataggaaaacgaataatggataactttagcgtccttgaagtgtttgttcgagtcagtgaagtacggagtttcacggcagcaggcaatcaactcggcgtgtcatcctccgctataagcaaggcaataagtcgcctcgaagaaaagctacgcgtacgacttttccaccgttccacacgcacagtgaccttaactccagaaggtacactttttctcaaacgctgccgccgcattctgaatgaaatagaagccgcagaaaatgaactttcccagtcacaatctgtaccgtctggaaagttaaaagtgagtatgccatcaattggcgtactctttatgcccaagtttgccgagttcagtcagcagtacccagaaattgaattagaaatagacagcactgacggcttagttgacttaattgaagaaggattcgatgccgtaatacgcaccggagaacctgctgattcacgattaatggcacgtgtgctaggctcttacaaaagagttatcgtcggttctcccacctactttcaaaaatttgaaatacctaaaaaaccagaagaactgattaatcatttctgcatgatgtatcgttataaaagcacaggcaagctggatatttggccaataaatcaagataacccaactttgcagctagaatggcctaccagaatggtaactaacacacttgaccctctcgtgtcttttgcagaaaatagtcttggaattacttgtattcctgatttagccatcagagaacagttgaaaacaggaaagctgataacaattctgaatgatttcaataatgacataacgacatgcaggatactttggccttcaagcaaatatttatctcccaagttaagagtatttataaatttcatggtcgaaaatctatttaagaatgagtga

SEQ ID NO: 3372 - DNA, 1710 bp, Xenorhabdus bovienii
  Coding sequence Name=Xb4151_4152.C438.gene165.dna; Position on contig= 122479..124188bp; Strand=-
atgaaaacaatggagtcaagtgaaaactacacttttgtaattattggtcaaggtactttagctgttagatgctgtcaattcttactttctataggtattcatcttgaggtagttatgcctttagattcagtatttcttttatgggctaaaaaagaaggtttaaaatgtatcaatactattcaggatttagaatctttagtatctaacaactctgttgaatggctgttctctatatcaaatccaattattttaacctctgcactattagataatattaaattaggtgcatttaattatcatgatgctccgttacctaaatatgcaggaactcatgcgacttcatgggctctttttgcaatggaggataagtatgcagttacttggcatcgaattgctaccgtggttgacgcgggagatatagcagttcaacaaaatgtagaaattaatcgttctgacacagctctttcattaaatatgaaatgctataatgcggcatttgaaggatttaaaaaattaatatctcttattaaaggaggaaaatccatagaatatgtgaagcaaaatgtatcagagagaagttttttttctagtcggaaacgtccatatgctggagcatgtttacagtgggcacattcagcagaagaactgtcagctttagtacgtggtttgtctttcggtgagcgttatcgcaatccattatgtgttccgaaagtttatttgataaatattataggaatagtgaaaacacttgaagtactttctgtctcaacacataagcaggcaggtattttagtggatatagcacaaaatttctggattgtaactaccggaacgacagatatcagaatagaatttattcaattgaccggggaagatttgcgggcagattttctggctgatatgctttgcataagcgttggtgattcattaccaattattaataattctgatttagaagatttaactcaggaacatgaggagttagcaccatatgaatcattttgggttaatcgtttagaatcatttagaccattaaatttcaaatttgacactctgtatcatgacttagattgtatttttgaaatatattataactggaatctttatattgatattgaaaatgttacaagtgaagaaagattggttaatatattgggagcatttgctgtatatttagcattggttaatgatgttcaatattttcatttggattgtgcaactgaactgcctaaacatgaggttatagattactctatctttttttcagcttcagttccttttgaatttaatattgactttaattgctctgcattggatttatatagttctatatcagttgagcgttctatacttaataaatttaaaactttccataaagatataatttgtcgatatccacaattgcgctcaactgaatctttgtattcaaagtatatctgtaatgttagaattagcattatagatttcataaactcagaagttaaaccagcagtctatcaattatatgaaaaaaataatgcttctctgacaatgcaaattgatccggttaagggggcttttcgttggatatctaattcatcacatattgaaaatgctgatttaaagagaatggctgatcatataattagtttggatagactccttttatctaatccaaatcttcctttgaagagtttattatctcaatgcggaacccttggaattatttag

SEQ ID NO: 3373 - DNA, 1005 bp, Xenorhabdus bovienii
  Coding sequence Name=Xb4151_4152.C438.gene166.dna; Position on contig= 124267..125271bp; Strand=-
atgcctgaaaaaaatagtatttctgtttatgatgacttcttttctcttggtggtgattcattaagtgcggtagatatcatacaatcaataaataatagactaggttctaatttgccacttcatgctttatttgaagcgtcgacaattgaaaaactggcttgtttagttgatgtaaatagtaataaatatgctgagagattggtttctctacagccacatggggcgttatcatcaattttttgttggcctggattaggtggatatcctatgagccttaggctacttgctgaaaaacttggcaaagctcgtcccttttatggaatacaggcgtttggactaaatgaagatgaacgaccatatggttctatccaaaaattagttcatgctgatattactgcaataagaaataaacaaccacgaggtccttatgtcctttggggatactcatttggaaccattttagcttttgaagctgcttatcaacttgagcagttgggggaaaaggttgaagaacttgtactgattgctccaggtatgactaaaggacattcgttacaactccagtcatcagataaatctagtggctatgagaataaaagtttggtctctctgctattttcagttttttcaagaagttcagatgatcaagatttattggaatatttagactatgtaaatgatgaggatgatttcgcaagtcttattagtaaaagacattcaggattaagccttgatctaattaaaagaatttctagagttgtcataactacttctgaaagcttaagttcggaatcggaaagtatctttcataatagattaattactgcccctgtaaaaatatttagtgctaagggcgatcaattgtcttattttgaaaccaatagtaattgttttattaacattcctgatgttgcccaaattaatgtacctcattttgagttactaaaagagccagggattaatgagttactgtcaagaatgcgtatgttgattaattggatgtga

SEQ ID NO: 3374 - DNA, 1860 bp, Xenorhabdus bovienii
  Coding sequence Name=Xb4151_4152.C438.gene167.dna; Position on contig= 125208..127067bp; Strand=-
atgcattcagtaacacaaaataaatcttgggaaaggctattgaatataaatggatttgaattagatattcgagagttagtggaactaaaaaattcattatcttatgataagataagtatatcttggtctactagtggtcaagaagaacgttttgaatatgccattgatcaatgtttgccaggcctttttttatcaagtgtacgccatataccggataatgtcgctattgtggatggtgatgataaactctgcttctggcaattggcacatcttagtttgcatgttgcaaattatttacgctatctgaattgttctatagatgaatgtataggtctttttgttgaaccatcattagaacaattaattggggtatggggaattattttttcgggggctgcctacttggcattggcaccagattatccacctgagcgtttgaagtatatgatagaaaattcctcaatgaaatatatatttgttcaggaaaaggtaaaatttaaaattttagatattattagtagtgatattactttaataacgattagtgatgtcattgattatgtaaaaatgagtgcgaagacaaaatctgtttctaaaccaagggagctaaaaccagaaaaccttgcttatattgtatatacatcaggtagcactggaaaacccaaaggagtaatgatagagcaccgttcaatagttaaccaaatgctatggttgaataaaaaaggttttttaagcagagataaaaaaataatacataaaacatctattagtttcgatgctgctcaatgggaaatgctatctgtttgttgtggtactcagttagttattagtgattttagtataaacaaaaatatttcgaagttaatagatgatattataaaaaacaatgtctctttgttgcagtgtgtaccgactttgttgcaatcgctggttaacaggcataaatttgcgaaatgttcatcactttcacatattctttgtggtggagaaagtttaacaaagaaattggcactgcaatgcttggatacattacctaattgcgagttaattaatgtctatggtccgacagaattcacttgtaatgcatcattctataatgtttcaattggaataaaaaaagaacatcatgaaggagtatcaattggtagaccggttgataatactgagtttcatattttagatgaaaacggtagatctgtttccagtggtaattctggtgaactctatatatcaggcattcaaattgcacgaggatattttaatcaagaaaacttaacaaataaacatttcttttctttcatcccaacgggatctaatacgcctatcatgtcctataaaactggagatcttgcttatcaaagcatggatggttcattttatttcattggaaggaaagataatcaaataaaaattagaggtatgagagttgaattagaagaaataaaaatagaattagaatcattacctttaattaatgttgctgctgtaatgaataaatatcatgatgttagccaatctattctgattgcatgtgttgaacttagtacagaaggagtgatattaaaagaaaatcacgatcaccaagagttagtttctattctaaaaaaagagttggccagacgtatccctgattacatgattcctactttattcgtttttgttgatgttatgcctttaacaataacaggaaaaattgatttcaataagattgaaaaaatttttggcaaggagagtcttaaagaaaaatctgaaccaaaatctataaacgagagagtgatacaaagtatctggatggaatgcctgaaaaaaatagtatttctgtttatgatgacttcttttctcttggtggtgattcattaa

SEQ ID NO: 3375 - DNA, 801 bp, Xenorhabdus bovienii
  Coding sequence Name=Xb4151_4152.C438.gene168.dna; Position on contig= 127106..127906bp; Strand=-
ttggctttagcaaataaatatcattctaatgttactgcaatttcgtttggtttacctggttcagacgatatcaaaatatcaaagaaattttgtgaagaaaataaaatacgtcagataatatatacatttacagagcaagatttaattgatgatattgatagcgcagtatattatggagaattcttcgaaaaaatagactcagtagactctattatagcaaattttggttattttattgctaataagcttggtttcaaagtggctttatgtggagaaggaagtgacgagattttttgcggctatgatttattcaaaacatatccttctattgatgagctttcactttatagattaaataatttacatcgtactgatttgcagcgtgttgatcgcgctagtatgcgtaactctgtagaagcaagagtaccctttatgaataatcaagtggtacgttatgcattaagccttcatgaatcattgaagataaataatggagttgaaaaatatatacttagagaagcgttccgagattttctgccggattacattattgacaggcctaaaattagaatgccagatggcagtggtgtaaagaatatattaattgattatgtcaatagtgtcgatctgcaaattcctaaagatgtgctcaggatgctagaaagtattggtttgaacgataaaagttcttttcattttgcaaataaatatttaaataatggatatcatttacctgatgaaaggtttaaaaaactaggaaaagattatacagcatcaggatatttcgatttcatatcttag

SEQ ID NO: 3376 - DNA, 291 bp, Xenorhabdus bovienii; identical to SEQ ID NO: 155
  Coding sequence Name=Xb4151_4152.C438.gene169.dna; Position on contig= 127956..128246bp; Strand=-

SEQ ID NO: 3377 - DNA, 279 bp, Xenorhabdus bovienii; identical to SEQ ID NO: 890
  Coding sequence Name=Xb4151_4152.C438.gene170.dna; Position on contig= 128238..128516bp; Strand=+

SEQ ID NO: 3378 - DNA, 171 bp, Xenorhabdus bovienii; identical to SEQ ID NO: 2071
  Coding sequence Name=Xb4151_4152.C438.gene171.dna; Position on contig= 128467..128637bp; Strand=-

SEQ ID NO: 3379 - DNA, 414 bp, Xenorhabdus bovienii
  Coding sequence Name=Xb4151_4152.C438.gene172.dna; Position on contig= 128746..129159bp; Strand=+
atgtatgtcagccagaaatgggatgttgctgaagaatatgctatggctcttgttacacttgacccatactggtcggttaactatcaagagcttgctgaagtttatcttaaacaaaataagtatactaaggcattggaacaatatcaaaatgcgaagcaggcaggtttgcctagagtgacttttactgagtatatgattggtgtatgccatgaacaccttggcgatcatcaggaggccattaatagtttcaaaaatgtcctgacaatggatgaaacaaatatctcagcaggattatctggttataacatatcatcaaagtatgatttagaatctaaagaatattttcgagagttcatcaatcgttgggatgagcaaggttttctcacacctatgcataaggagatgatagtatga

SEQ ID NO: 3380 - DNA, 414 bp, Xenorhabdus bovienii
  Coding sequence Name=Xb4151_4152.C438.gene173.dna; Position on contig= 129156..129569bp; Strand=+
atgaataaaataacatctattaatgtaacgcgtttcgaccatatccaaatggaagtggctaatcttgatgaaagtattcgtttttatgaagaagtatttggatttaaaaagaaggaggctggattaagaagaatggttcgctgggttattttagggaatgaaagtaaattatatttgtgtttgcatgagtatgctgaacgaactggaattgaaaattctgggttggaaattacccacgtcggttttattgttgataatttcgactctgttttgcaaaaattaaaatcacataatgtgaagttacctgatggtgatataattcaatatcattcttctcgttctatctactttcttgatcctaatggttataaaatagaaatctctgagttcaatggtggtggaattgatccttga

SEQ ID NO: 3381 - DNA, 1056 bp, Xenorhabdus bovienii
  Coding sequence Name=Xb4151_4152.C438.gene174.dna; Position on contig= 129671..130726bp; Strand=+
atgtttttattagaggtcatgattatgctaagtgaagaaaacgagatatttaaatcaattagtgaaaggtcaaataaagaaatatattcacaatgtgttattcaattagatgaatatcgtgcaagaaaggttatgtctgaattatctaatggattcacacagtcttttgatggaaaaatgggtcataaacctgtcgagagtgagttaagaaaactaataacagagatttatgagcgtgtcaaaagtggcaatggaattgttttattaaaaggaatttctattactgaaataaatgaaattgaattaggtgagcgttttttgcggctttgtagtttgatggggaaaccagtttctcagagtgtgatgggagatacacttgggcgggtagaagatatgacgcatattgatcctgatgccagaggttatagaaacagagaagagttatttatgcatacagatcaaccagatatggtgtgtatgctttgcgtcaggcaagccaaacatggcggtgatagcaaatttgctagtgcggtggcgcttcatgaagctattaagcaaacgagactagatttattatcggctttatacacgggctatccttatcatcgcttgaatgaacatcctccaggagccagtgaaatcactgagcataatgttcctgtattctctgaatacaatggtgaactcagtattaggtacttaaggtttaatatgtttgcagctgcatttgctcgaaatgaaaaagtgccacctcttctgcaaaaagctgtcaattatctcgacgaattggctacatctcattatttttgttggattacttcacttgaaaaaggagatattctttttttcaataactaccttttcctacattcacgcactgcatttgaagacaatgaagatccagtgaaaaaaagattaatgtatagggtatggctggcgtgtgataatttccgttccatacgatctgaacttgctgttcatcctgaaggcgctggtggccgaggggggatcactcctcaacatggtaaaagaccacgttttgattatgacttatag

SEQ ID NO: 3382 - DNA, 969 bp, Xenorhabdus bovienii
  Coding sequence Name=Xb4151_4152.C438.gene175.dna; Position on contig= 130729..131697bp; Strand=+
atgattacttatatgaaatataaaacacttggaaatagcggtgcttatgtttcaaccatatgccttggtacgcagcaatttggtcgatgggttgatgaaagaagtgcccgtgaaatattaaatatatttactgagtatggtggtaattttattgatactgccgattgctaccctatttatctatcagatggaagtgatggtggtgaattatcagagtcttttattggtaggtggttaaaatcttattcaagacgagatgacctgatcatagcaacaaaattttcagcgccaatgggtgacaatccaaataataagggtgtttcaagaaaatatattatcagggctgttgaacaatcacttaagcgcctgaaaactgattatatcgatctttatcaggtacatgatgattatttcgatgttcctatggaggaaacgctaagtgctttggatgatttagtaagaagaggtttggtacgctatatcggttgttcaaattttgcagcttggaggataatgaaatctttaagtttatgcgagaaacgtggttatgttccctatgtgacagtacaggaaaaatataatcttctggaaaaagatgaatatgaatctgagcttatgggattatgtcaggaagaaggaattggcatgttaccctatgttccactcgcgaaaggtttcttgaccggtaaatatcatcgaggaagtattaataatggatttttcagagaaaaggatgtgagaacactttatgataatgaaagaaattgggaagtcttatatcttattcaggaaattgctgaaaaaaatgaaataacctgtacacaagttgctttggcatggttgttgcaaaggcctagtgtggttgctcctgtagtaggggttaatagtatcaagcaattgaagatagtattagcatcagtcgatgtttctttatgtagtacggatatagaggaacttgaccgactctag

SEQ ID NO: 3383 - DNA, 936 bp, Xenorhabdus bovienii
  Coding sequence Name=Xb4151_4152.C438.gene176.dna; Position on contig= 131684..132619bp; Strand=+
ttgaccgactctaggaatatccaggaaaaagggggatgtgtggcaattgctttgatagatcactgttatagtattcttccgactggaaatagacaacaagccatttctttgttaaaccgatctggttttttggttagttctgagcgcatacagcatgatggtggaaaagagagtattttcatccattttactggttcttatctggaattgattgagattattgacctgaatcagtttgaatcttcttgtactgttactgaattgcgagcatcaaagtttggttatccctatgcgttagttgctgcgacaggaaagattaaaaattgtgcaaataaactgaaaaaattttatcaagatgttgctgatattaggtatgttattcctaatatgcaagggtgggaaaaagcggcatgggctattttaaatattcctgagcattatacaccaggatgttattttcaatttatacaatatcttttacgaaagccttcatgggcagaaataaactatggacaaaataatatttatggagtttgtggtttttatttttgtacaaatacgcctatcgaagatagggaacattggtacaactttttttctttgataggagattgctataaatttgaaggaaaaacattatctataggcatacagcagatatattggttacatcctgatgagttttatgcctattttggtgttgaacctaatttggatgaaagtcagggagccagattaagtgctgtaaaacttttatcctctgatatagaagtttcatttaactacttaaaaaagggtgggtttcttatagaaggttataccgaacaaggtttttatacaaaaattgatccaagcttaggatatgccttacatatagtgaaaggaaatggtgcgtttgattatgccgaggatattaatcgacggttactggaataa

SEQ ID NO: 3384 - DNA, 876 bp, Xenorhabdus bovienii
  Coding sequence Name=Xb4151_4152.C438.gene177.dna; Position on contig= 132650..133525bp; Strand=+
atgaaagactttgatattaatgtatttgatgctcatgttcataccgaatttgaaggtgctccagaccactttagtgggataatatcaagtttagattcctttaaagaatcaataaatgggatcaattttgttggagctttgtcagactctgcagtaccttcacaaaatcatggtgatttgagtgaatatgggatttaccattgtgctgttataagggatttaaattataaaattgatataattgagaaaaatattctttctggcaagatttatgcaataaaaatcaatgttggttttatacatcggtatgcatctgatgaatttttccagccactttatattctcgctgaaaagctaaaagtgccgataatgtttcatagcggtgatccaggttggtctcatgctaaggttaagtatgcagatcctatttcttttgacgaaattgcggttgattatccaggtgtcaattttgttctggtacatgcgggaaatccctggtttcaaagtgcagcagttgttgccgctaaaaatgccaatgtgtttctagaaggttcatcactgattgatggagacacaaaagcatgttctgacgaacgggcaaagaggctgatctcaaaaccattatcttggataattgattatcttggttcttcggaaaaattaatttttggttctggctggccgatggtatatttaaaatcctatctcgatctttttcgtcagggggtacccgaagaagcttggaaagatgttttttgtgataatgccctcaagttatatggattcgtaatagaaaaaagatctgatgggcaattaatatgtgtaccaaaatacaaacggaaagattcaaataatgtccattattcaagtaaataa

SEQ ID NO: 3385 - DNA, 996 bp, Xenorhabdus bovienii
  Coding sequence Name=Xb4151_4152.C438.gene178.dna; Position on contig= 133503..134498bp; Strand=+
atgtccattattcaagtaaataatttatgtaagtcctatgaggtttatactaaaaatccagggttattaggtagcctaaaatcattcattaaaagagaatatgcgatagtagaagcagtaaaatcaatcaatttttccattgacaaaggtgaaattgtaggatttcttggcgctaatggagcaggaaaaactaccacaatgaaaatgttaactggtattattaaaccgtcttcaggacatatccaagtattaggttatactccttatgaacgcaagaacgaatatttaaaatccataacatttgtggcagggcaaaaacagcaattagcttgggatctaacaccaaatgattcttttatactacataaagttatttattccattaatgaaaaagagtttttaaattatcgagatgaacttgtggaaatgctttccctgaattcagtgattgatagaccagtccgccatttatcattaggcgaacggatgaaatgtgaacttgccttgtcattattgcataaaccatccgtattgttcttagatgaaccaactattgggcttgatgtcaatatgcaacgttcagttcgtgaatttattgctcattataatcaaataaacaatgcaactattcttttgacatctcattatatggccgatgttgaagcgcttgctaagcgagtcattattattaattcaggtgggattgtatatgatggaaaattatcacacttaattaaaaagcgctcaccaaagaaaattctaaaggctaccatctcaggcctgataaaaccagaattgagatctctaattaactcatcttccgatgatggtcaaagtattgagttgattgtagagcgagatttgcttccttctgtggtcgcaaagttgatggaagaaaaaatcatacttgatatttctattcatgatgagcctattgaaaaggttttgggaagatatttatcttcatatggtgaaactgatgttgaagcaagttag

SEQ ID NO: 3386 - DNA, 864 bp, Xenorhabdus bovienii
  Coding sequence Name=Xb4151_4152.C438.gene179.dna; Position on contig= 134425..135288bp; Strand=+
atgatgagcctattgaaaaggttttgggaagatatttatcttcatatggtgaaactgatgttgaagcaagttaggagaagcctgctgttatggtgggtacttattggtcaatctttttcaagagtcattgcgtatcgcgctcagtccattatttggctgttaggcggtattatgcctatagcagtgatgtttgtttggttagggttagcaaaagaaggtgaaattggtagttatactgcaagtgattttgcagtgtattttctttcaatttatctcgttcgtcagttaacggcaatttgggttatgcggcgtttagatcgtgatattagacgtggtgaattatcgatgttacttctgcggccagtttctcctctctataattatgtatctgatcatgtaggggaaatgatggtcagaggtcctatcatttcactggtttttatattaggtattttactgacaggtaatttacatcgtttggatattagaaatttattgatttttattccagcgcttgccttggcgtggattattatatttcatctttattattgccttgggttgttagcattctggatcagtaactcgatggcattcgatccattgctttgggcgctttataccattttaggcggagtactcattccacttgatttatatccggagaatgttgcttcatggttaaaattattaccttttgcgtcagcattagattttccggttcaaataatattaggaaaattggatggcttactcttgttgattggatttggagtgcaactattttgggtcattttactgacatgtatcagggtattgttatggaatgcagggctaaaaagatattcagcatctggagcttaa

SEQ ID NO: 3387 - DNA, 783 bp, Xenorhabdus bovienii
  Coding sequence Name=Xb4151_4152.C438.gene180.dna; Position on contig= 135293..136075bp; Strand=+
atgagatatatttcattatttttagtattactaagacattctttcttgctagaatttgaatttcgttttaatgctctggtaaatttaatcaattctagtctttcttgtttgttggcattattagtactgacaggatttttcggtcaggtatctcaggttggtggctggacttactatcagatggtagctttattgggggtaacactcattattgagtctttgattgatagttggttatttccaagcgttcattcgctctctgaatatattaggcgtggagatttggatcaaattattattcgtcctgttgatactcaattttttgttagtttccatcgttttaatatatgggatggtgctaattttattgttggttatgtggttgtgttattagcaatgtctcagcaggatgcgttaacgatttggaactttttacaatttaattttgctttgttactaggagcttgtgttttctattccctgtttatgtgttcaaatctgcttgccttttggtttactaaagtgtcagatgtttggattatttgctattcgttaatggatgttgggcgttttccggtcagtgcgtatccgggtgctttacggtttttgttgagttttttattacctgttttctttgttagtaatgtccctgctcaggctgcattgggaataatgagtatggaaacattattattggcttttgtatatgccataggtgctcttattttaactcgttttttctggttaaaagcaatttcaaaatatagtagttcaagtagttag

SEQ ID NO: 3388 - DNA, 111 bp, Xenorhabdus bovienii
  Coding sequence Name=Xb4151_4152.C438.gene181.dna; Position on contig= 136148..136258bp; Strand=-
gtgatccgttcaggctcagaaaggactctcttcgatttcattagtggaagcggtaagtcagtttattgtattatcgactataacaaaaatgcagataatttcattgattaa

SEQ ID NO: 3389 - DNA, 318 bp, Xenorhabdus bovienii
  Coding sequence Name=Xb4151_4152.C438.gene182.dna; Position on contig= 136218..136535bp; Strand=+
atgaaatcgaagagagtcctttctgagcctgaacggatcacgttgcaacaactcgccctgaatcatccgcatcgggacgtccgtacgagaggaaccggtttgctcatgcttaccagagggttaaagccgcgccagatcgccgttgagacaggatgcagtgtccgggttatctataactgggttcatacatggcatgacttcggtatcgcgggtctgttgggcggccatgccggaggccggtatcccgccatgacgtctgaaatgatcgcaacagcggttgaaatcgcctgttccgagtccctgactttgtcccgatag

SEQ ID NO: 3390 - DNA, 270 bp, Xenorhabdus bovienii
  Coding sequence Name=Xb4151_4152.C438.gene183.dna; Position on contig= 136696..136965bp; Strand=-
atgtcaggcaatggtctccctgctttgccacctgtgccaaaaaatctatcacgttcgcccgggttatgtgacctgataccgtctgataaaacagactgttgtccgtgtcattcaacgcaccaagcacggaacgtctgcaatagttttgaggctcggtttcatgggattttccccgtggactccacccatattgcaccggaggagacgcggcaagaccggattcatcaaaataaaccaaacggtagcggcctgattgtgcaccggccttaa

SEQ ID NO: 3391 - DNA, 492 bp, Xenorhabdus bovienii
  Coding sequence Name=Xb4151_4152.C438.gene184.dna; Position on contig= 136728..137219bp; Strand=+
ttggtttattttgatgaatccggtcttgccgcgtctcctccggtgcaatatgggtggagtccacggggaaaatcccatgaaaccgagcctcaaaactattgcagacgttccgtgcttggtgcgttgaatgacacggacaacagtctgttttatcagacggtatcaggtcacataacccgggcgaacgtgatagattttttggcacaggtggcaaagcagggagaccattgcctgacatttttagtgctggataatgcccgtatccatcttggtatcgagacaaaaataaaagtggagtggttacgtgagcataatatgtttttactttatctcccggcgtacagccctgagctgaatctgattgaaatcgtctggaaacaggccaaatatcactggcggcgatttattacctggactaaagagacgatggaagaagaacccaatactttactgggcggttatggtaacaaatttgcaattaatttttcttga

SEQ ID NO: 3392 - DNA, 129 bp, Xenorhabdus bovienii
  Coding sequence Name=Xb4151_4152.C438.gene185.dna; Position on contig= 137224..137352bp; Strand=-
gtggtagcgctcactcactccagtcacatagtagcctatgcttctggagatcctttcacttgctgtcgtgctacatcttgcaaactactggatatatacatgaataacattaagaaaatatataaataa

SEQ ID NO: 3393 - DNA, 1473 bp, Xenorhabdus bovienii
  Coding sequence Name=Xb4151_4152.C438.gene186.dna; Position on contig= 137414..138886bp; Strand=-
atgaggtgtaaaatgaaatattataaaaagttagagaaattaatggagaaatggaattcactatatggtgccagcatggtcctacattgggataaaagaacaatgatgcccatacgtagccatctattgagatcagaacaaatatcactactcagtactatgcaacatgaaatactagcaagccaggaaattactgaacttctaaattgcattgatattacccagttaaatgattggcaaaaagctaatatgagagaaatataccgattacatactatggcaacccaaatacctgaaaatttagtaaatcgacttacacaagcaaccatgaaatgcgagaaagtctggcaccttcaagccaatcaaactgatcagcaagctcttgaaaaatcttttgaagaattaattacactaacacgagaaatggcgtactcatttggagatagcctaaatataagcgcttatgatgcactattagaacaacaccagcctgggttaagagatcatttcattctccctatattcaatcaaatagaatcattcacagccaactttacatctataagaaacagattaccaaaagaaaaaaataactggccaataattcctaaatatcaacaacaaaaatttgcaaaaaaactaatgttagaaatgaaatttgattttaggacaggaagactcgatgagagtgtccatccttttactggtggaatatccggtgatatcagagtttgtagctatttcaaaccagataatattatcttaagtatttcagccattatgcatgaaatgggacatgcctcttatgaaagtcgattaccaagacaatttcgtgggcaacctgtcggtgattcaagaggaatgtgtattcatgaaggaattgccctgctttttgaaaaaaaaattggccactcaagtgagtatttagaatatctgtctaaaaaactcaataaacaatttggatacctaaattatttcagcaaagaaaaattacttcatcatttcaatacagtaagaagaagtggaatacgtgttagtgctgatgattttacctacccagcacacatacttattcgatataagatagaaaaagaattaatctcaggggagctatcggtaaaaaatttaaataatagatggcgtgatttatataatttataccttgggatagcgccttcccttcatgaaggcccttggcaagatattcactgggcagcgggatattttggatatttcccttgctacctgattggaaacgttatttcttctcaattatttaataaagcagaaaaagaattttcaattaaaaatgaaatcagtcaaggaaaattcgataaaatacaaaaatggctaagtgaaaaaatatataaaaaaagttcttattatgaatttgaagatcttatcctatcaagttgcggaaaatcactaagtgctgacgatttcattaacaatttaaaagaaagattacattaa

SEQ ID NO: 3394 - DNA, 1146 bp, Xenorhabdus bovienii
  Coding sequence Name=Xb4151_4152.C438.gene187.dna; Position on contig= 138876..140021bp; Strand=-
atgacatataacctaaatatattcaatttacatctaaaaaacacctggtataaaaacaagcaatcactaagaagtatcaaaaaaaaatggtctaccatccgatataattatacagaaccgcctaaaatatgtggtgagataaatcttaatgaacgtatatggagtattcctggctacattggaaataataaattcatcataagttgttatgatggatatatttattgttaccatctaaaaacatttcagaaaatttggcaattaaaaacaaatggccctatttatagttccccagcagtaacaagaaatggagatttcattatcggaggagaagacgctaccctaagaatgatctctgcccatggacattgcctatggcaattcaatgcttatgacgctttccattccacacctacaatagatgaaaaaaatggaattgtttatgctggtagttacgatcactctatgtacgcaatcaatataaataatggagaattaatatggaagcgagattttgaaaaaaatattatagatgatatttatagttcaccagctttaacatccgaaggaaatattatttttggaactaacaagatattaatttgtattgacaaattcggtactacaatttgggaagttgccaatgaaggaagatttgaaggtagcgctgccttagattacagtattaatacgggtatcataggtaccgaagagaatggtcaaattatcatttttgatataattacaggtagaatacgtacaatccatcaaacaggaggatttattgtttcttgcccatccattggataccaacatatagcaacaataggtagcgatgataaaaatatttatgggattgatcttataactactgatatattatggaaatattatgtaggaacccgttttgtgtatactccattttcttccctccccaatggcgatccaatatttgtgggtacaactgatgatcctaaccattttgctgaatcagtacattgtcataatcataaaaatggagagtttcgctggaaaattaccgctcccacaggaatacattcagcacctcttatcactgaagaaggctatttaattattggttcacattggaataaagtatatatttatcaatgggatgaggtgtaa

SEQ ID NO: 3395 - DNA, 672 bp, Xenorhabdus bovienii
  Coding sequence Name=Xb4151_4152.C438.gene188.dna; Position on contig= 140149..140820bp; Strand=-
atgacaaatattttaccaaatttggctcatgcgttaccagatatcatttccttagatctattggataaacagcaagatttttcacataaagcccgcattttacttttatatggttctaacagaacaccttcttttagtcgtttactcgttcaagaagcagctcttttactgaattctctgggagctgaaacaagaatctttgatcccttttacctccccttaccagatactactgctgactcccataataaagtcgttgaattacaacaattaatgcaatggtcagaggggcaagtctggtgctctccagaacatcatggttccattagcgcagtattcaaatcacaattagactgggtcacactagagacaaatctttcatgtcctacacaaggtaagacattagcagtactgcaagtcaatggaggggggcaatcttttaacgttgttaatcaattacgaacaataggcagatatatgcgtatgttcactatccctaaccatttatctgtatctcaagcttttcttgaatttgaagagacaggtcgtatgagaacatcatcttattacgatagacttatagatgttatggaagagttactaaaatttactctaacattacgcgacaaacgtcaatattttttagatagatattcagaacgccataaataa

SEQ ID NO: 3396 - DNA, 120 bp, Xenorhabdus bovienii
  Coding sequence Name=Xb4151_4152.C438.gene189.dna; Position on contig= 141015..141134bp; Strand=-
atggccgttgtaacgatagttgagttgaaaggttctttggcagcctttgcaatagtagcgagggaagccagccttacctgttcagtgtttgcgtacattaaacgagtatatttaatataa

SEQ ID NO: 3397 - DNA, 282 bp, Xenorhabdus bovienii
  Coding sequence Name=Xb4151_4152.C438.gene190.dna; Position on contig= 141122..141403bp; Strand=-
atgggcgatgacttgtttccttttcgtatcaaaagcataccaaagccaatgacgttgttttttattgcctataaaaaaccactgctcatccaattcacagataagtgtgacatcgtcataagcgatctgtcgcgatgttacttgttttggcgagagttttttaatgtccgcatcaccgtattgataccgagacctaatacacggcctgtgtctctcccgccagagccattcattgccatatccacaattttttctttcatacccggtttatggccgttgtaa

SEQ ID NO: 3398 - DNA, 171 bp, Xenorhabdus bovienii
  Coding sequence Name=Xb4151_4152.C438.gene191.dna; Position on contig= 141366..141536bp; Strand=+
atgcttttgatacgaaaaggaaacaagtcatcgcccatgtctttggcccccgaacggatgcaacctgccgaaaattgctcaacttattggtgccttttaatattcgtttcatcacgaccgataacgggggaagctatgccagagaagtggtgccggaaaaacatctggtag

SEQ ID NO: 3399 - DNA, 96 bp, Xenorhabdus bovienii
  Coding sequence Name=Xb4151_4152.C438.gene192.dna; Position on contig= 141632..141727bp; Strand=+
atggaaatccacgaaaaactcattggcacatatatattgaaaaacatcattacaaccctttgggtcatgaccaaatactccaactcctgtcgctaa

SEQ ID NO: 3400 - DNA, 249 bp, Xenorhabdus bovienii
  Coding sequence Name=Xb4151_4152.C438.gene193.dna; Position on contig= 141745..141993bp; Strand=+
atggatgtggcagggacacaaaccaagattaccgagatgattttagcgaaattagccgattacttattagcagtcaaagagaaccagccctcattatcagcggaagtcacgacgcaatttcagaccttttggcataatacgcctgaggacattgttgggttaggtttttatgaagaatttgatacccaatacggaagcaaagatcatcgcagtctaatcagagcgagttgcgaaaggaaaggaatatga

SEQ ID NO: 3401 - DNA, 228 bp, Xenorhabdus bovienii
  Coding sequence Name=Xb4151_4152.C438.gene194.dna; Position on contig= 142060..142287bp; Strand=+
atgcactggtttgtggagaatcaacttcattggatattagacattgcgttcagagaagatcaacttcaggctcggatggggtatgctgggaaaaatttagccctcataagaaaatggattttgaatatgctaaaacagaatacctcccgaaaattaagtttggagaacaaacgtagattatgttgtttgagtgatgattacttacttgaatcttttgggtgtttctaa

SEQ ID NO: 3402 - DNA, 342 bp, Xenorhabdus bovienii
  Coding sequence Name=Xb4151_4152.C438.gene195.dna; Position on contig= 142385..142726bp; Strand=+
atgaaagatcctattcgcaatgcctcattgtctgcggtaaaagtggcgagtgaaattgcgtataattatgtcagtgaggttcgaaaccaacgagtatttcccgattctgacgctttatcgggtctacagaatcttgatggggcattacctcaaaatggaacggattgccaacaagtgcttgtgcagctccataagtacggctcgcccgcgacggtagcgacaacaggaggccgatatttcggtttggttgttggtggttcaacgccggcagatattcaacgtagcttgaaagcgattgctgatgcaattgatgaggttaagcgtttaaacagaatgctatga

SEQ ID NO: 3403 - DNA, 1092 bp, Xenorhabdus bovienii
  Coding sequence Name=Xb4151_4152.C438.gene196.dna; Position on contig= 142834..143925bp; Strand=-
atgggattcaaatgcggtatcgttggcctgcctaacgttgggaaatctacattattcaatgcgctgaccaaagcaggtatcgaagcagcaaacttccctttctgcactatcgagccaaacaccggtgttgtaccgatgccagacccacgtctcgaccaattagctgaaatcgtcaaaccccagcgcatactgccaaccacgatggaattcgtagatattgcaggtctggtgaaaggtgcctcaaaaggcgaaggtctgggtaatcaattcctgaccaatattcgtgaaacagaagctatcggtcacgttgtgcgttgcttcgaaaacgacaatatcattcacgtttccggtcaggttgatccagcctcagacatcgagattatcaataccgaactggcactggcggatttggatacctgtgaacgtgctatccaccgcgttcagaaaaaagctaaaggtggcgataaagatgctaaaacagaattggatgcgctggaaaaatgtcttcctcaccttgagcaggccggtatgctacgcgccttagacctgagtgctgaagaaaaagcggcgattcgctacctcagcttcctgactttgaaaccaaccatgtacattgccaacgtcaatgaggatggttttgagaataatccacatcttgataccgttcgcgccattgcagaaacagaaggttctgtggttgttccggtttgcgctgctattgaatcagatatcgctgagctggaagatggcgaccgtgaagaattcatggctgaactgggtctggaagaaccgggtctgaaccgtgtcattcgcgctggttatcaattactgaacctgcaaacttacttcaccgctggcgtgaaagaagttcgcgcatggacgattccgattggtgccacagcgccacaggcagcgggtaaaatccacaccgacttcgaaaaaggctttatccgtgcccaaaccatcgcgtttgaagatttcatcaattacaaaggtgaacaaggcgcgaaagaagccggcaaaatgcgtgctgaaggtaaagactacatcgttaaagatggcgatgtgatgaacttcttgtttaacgtctga

SEQ ID NO: 3404 - DNA, 114 bp, Xenorhabdus bovienii
  Coding sequence Name=Xb4151_4152.C438.gene197.dna; Position on contig= 143947..144060bp; Strand=-
atgcctttagagcaggagcttaacaggcagtgcgtggcgcagctgattattgcgtgtataatagcgcccattttgtataactcaccgacaggcatcttgtctgttggtttataa

SEQ ID NO: 3405 - DNA, 663 bp, Xenorhabdus bovienii
  Coding sequence Name=Xb4151_4152.C438.gene198.dna; Position on contig= 144038..144700bp; Strand=-
ttgtactcaagccttgaggcaggtaaactaaacccctttttttattttattgccaataagcgaactaagactgtgagtaacataaaattaatcgttggtctggcaaaccctggggctgaatacgcacagaccagacataatgccggagcatggtttgtcgatttgttagcccaacgccacagacagcccctgaaagaagagagtaaatttttcggctataccgcccgtatcaatctgaatgggcaagatgttcgcctgctggtgccaacaactttcatgaacctcagcggtaaatcagttcttgctctcgccggattctaccgcatccagccggatgaaattctggtcgcacacgatgagcttgatctgccacccggcgtagcaaaaatgaaactggggggcagtaacggtggccataacggtttgaaagacattcagaacaagttcagtaataaccctaactttcaccgtctgcgcattggcatcggccatccgggtgacaaaaataaagtagtgggttttgtacttggcaagcctcctgccagtgagcagaagctaatcgatgaagccattgatgaagcactgagctgtactgatattctgatgaaagaaggcatgaacaaggccattaaccgtctgcatgcctttagagcaggagcttaa

SEQ ID NO: 3406 - DNA, 171 bp, Xenorhabdus bovienii
  Coding sequence Name=Xb4151_4152.C438.gene199.dna; Position on contig= 144825..144995bp; Strand=-
atgttaccgagaatgaaagcatttttacgtttcatcaccaacctccaatacttttctgaactcaatttgcaaacgaaacgaactcaaaagcacgaaagtagacacatccttggttatattatagccttattatctaaaaggttattgcggcggcgatcacaagttgtataa

SEQ ID NO: 3407 - DNA, 276 bp, Xenorhabdus bovienii
  Coding sequence Name=Xb4151_4152.C438.gene200.dna; Position on contig= 144961..145236bp; Strand=+
atgaaacgtaaaaatgctttcattctcggtaacatttttatggggttagggatggcggcaatgctgattagtctgtcttttgtactgctcagtcatgtgtttagtttagaccagtctggatttgccacaggtatctcactgatgggtttatttgttggtgcattggtttggttggcaggtgccagtatcggtgggcgtgagcaggttagtgataagtattggtggttgaagaattatgacgagcgttatcgccgtaaaaaacacagaacatcatga

SEQ ID NO: 3408 - DNA, 1953 bp, Xenorhabdus bovienii
  Coding sequence Name=Xb4151_4152.C438.gene201.dna; Position on contig= 145303..147255bp; Strand=-
atgaaaaaagcatttttattcacacctgctctattagcgctttcaatcagtaccatttccaatgcccatgcttatgacagcacctatgactttggcgatagcctgagtgatagcgggaataatgggcgatataccacagatggagaaaccagtcagctttatgctgagtatgttgctgaacatattactggtagtaaacccactgcttccaaagatggtggcaccaattacgcccaaggtggcgctactgctattgggtcattaaaccctaaatataataccactgagcaagtcaaaaaatatctggctgcacataataaccgtgcagatgctaatggtgtgtatattcactggatagggggcaatgatctcgcagccgctttgatcgctggccaaaagaatccatttgatgcttatgatattgtcaacaggagtgccactgccgccggagaacagattaatctgctggttaacgccggtgctggcttaattattgcaccaactgttcctgatgttggtattacacccagactgttggaaacagtgctcagcggtgcgttacaaacaaaaggcaaatcccaagatgatatcaacgcaattttacaacaagttcgcgcaggaattaacgaatatcctacccctaataatgaggttcgcgacctagttttagacggtgcgttgaaaaaaatcgctgcaaaaaccactgatccagccgagaccgaagcattgcttctggctgcctatggcgtagcgcgtaaaggtgccacaaatctagccgatgcctataataaactggtagatgagaaaatcagccagagcaacggtaatattatgcgtgtcgatgccaacggtctgctcaaggaagtcatcgcaaaccctctggtttatggtatttccaatactcttggctatgcctgctcagaatcattgtctgatgctgaatgttcttccaaagacccaaaatttgacagtaatcagtcatttttatttgctgatagcctccacccaaccccgctaggtcatctcatactgggtcaatatattgaatccatctacaatgcgccatcacaggtcatgaccctgaatcaagtcaaccgtatccccgtcaaaggtgttcgctcttcccttgatggtcacctgcaacaacttcgcaatggtggcaatgctcagggtaaaattggcatctttggcggctacaccggcagccacaacaacaccttcacactgggtggtgattatcagctcactgataacctgctgctgggcgctgtatattctaactataaggatgaacgcacctctgcctccaatttcacgcatgaaggacgtgctcacgtagtgacaagttacgcgttgtggaacttctatgacaaaggttggttaagtggcgatctccattactcaaacaacaaatacgatagtctgacacgtattattcagttaggtcaggcgacacgccgggaaaccggttctaccaccggtaaacaatggggtggacgcctcacagctggctgggatatcgctgttaccaatcaaatcaccaccagcccgattatccagtatgcatgggataaaggtgatatcaaaggctaccgtgaatccggtaacaacagtacttccatgcattttgctgatcagaactacacgtctaaagtcggaacactgggctggcgtgtagatacccaattaggccgtttcaatccttatgcctctgtccagtttaatcaccagttcggtgacacacgctataaactgagcagcgccatcaattccactgaagtttcctttgtacaggaaagtggcaaacagaacactgactggcgtcaatatactgtcggtgtgaatgctaacctgttcaataactggcgcggcttcgcttctgtaacccgtaacgagggtaactctcaggagcataactacaatttcagtctgggcatcaacgccagcttctga

SEQ ID NO: 3409 - DNA, 180 bp, Xenorhabdus bovienii
  Coding sequence Name=Xb4151_4152.C438.gene202.dna; Position on contig= 147513..147692bp; Strand=+
atgacgataaaaagtcacaatagccgctaccgattgtccggcaggttagcagcaacggtaataacacaccagaattgttcgggagttagggtactggacgtaccagatgatttattgttcgtatatgatgttgtctttttcttgaacgcatgctcagagtgcaaactctgttggggatga

SEQ ID NO: 3410 - DNA, 939 bp, Xenorhabdus bovienii
  Coding sequence Name=Xb4151_4152.C438.gene203.dna; Position on contig= 147907..148845bp; Strand=-
atgaagctttttgctggtaatgccacccctgaactagcacaacgtgttgccaaccgcctgtacactagccttggagacgctgccgtcggtcgttttagcgacggtgaagtcagtgttcaaatcaatgaaaatgtacgcggtggtgatgtattcatcatccagtccacctgtgcaccaaccaatgacaacctgatggaattggtcgttatggtcgatgcgcttcgtcgcgcttctgccggacgtattactgccgttattccttacttcggttatgcccgtcaggatcgccgtgtccgttcagcacgtgtgcctatcactgctaaagtcgttgcggactttttgtccagcgttggggtagatcgcgttcttacggttgacctacacgccgagcagatccaaggtttctttgatgttccggttgataatgtatttggtagcccaatccttctggaagatatgcttcagaaaggcctggaaaacccaattgttgtctctccagacattggtggtgttgttcgcgcccgtgcaatcgccaagctgttgaacgatacggatatggccatcattgataaacgtcgcccacgtgcaaacgtttctcaagtcatgcatatcattggtgacgtcgctggccgtgactgcgtcctggttgatgacatgatcgacacgggtggcacgctgtgtaaagctgctgaggcattgaaagagcgtggagcgaaacgggtgtttgcttatgcaacccaccctatcttttctggtaatgcagtagaaaacatcaagaactcagtgatagatgaatttatcgtttgtgacaccattcctctgtctgctgagatcaaagcgttgaataaagttcgcactctgacactgtctggcatgcttgctgaagctatccgtcgtatcagcaatgaagagtcaatctctgcgatgtttgagcactaa

SEQ ID NO: 3411 - DNA, 879 bp, Xenorhabdus bovienii
  Coding sequence Name=Xb4151_4152.C438.gene204.dna; Position on contig= 148913..149791bp; Strand=-
atgacgttgacttggccttccccggcaaaattgaatttattcttgtatattactggccaacggtctgatggctaccacgaactgcaaacgctgttccagtttcttgactatggcgacgagatcacgattaccccccgtcaggataatcaaatccacctgctgacgcccgttgaaggcgtagctcatgacaataatctgatcgtccgggctgcccgattattgcaggatcatttattacagaataataataagggaacccaacatctgggcgccgatatccacatcgacaaatgcctgccaatggggggaggtctgggtggtggttcttctaatgccgcgacagtactgattgccttgaattaccactggcaagccaacttgtccgatgatgaacttgcacagcttggtatcagccttggtgcggacgttcccgtatttattaaaggccatgccgcttttgccgaaggcattggggaaaaactccggccggcatcaccggaagaaaagtggtttctggttgctcatcccggaattgagatttcaacgccgacgatcttcacagatcctgaattaaaaagaaattctccgattcgttctctacccgcattattacaggcaccatttacaaatgattgtgaatcaatcgcaagaaaacgttttcgtaaggttgaacagcttctttcatggctgctagaatacgcaccgtcgcgcctgaccggaaccggtgcgtgtgttttcggcgagttcgaatcagaagcatcggcccgtaaggtgttaaatcaatccccagagtggatgcagggctttgttgcgcgtggagtcaacatttcaccattgcatacattccgctctgggatatacatgttattgaaccaatga

SEQ ID NO: 3412 - DNA, 618 bp, Xenorhabdus bovienii
  Coding sequence Name=Xb4151_4152.C438.gene205.dna; Position on contig= 149791..150408bp; Strand=-
atgaaaatatcatcactttttcgcttacttcccctctctgcggttttgctgacagcctgtaccgtcacacagcctcctacaggtacaggttccgccaattctccgcaatggcatatccgtgaacagcaactgcaaaaactgaaaaattaccagacccgaggttcttttgcttatctggcaaatgaaaagaaagtctatgcccgctttttctggcaacagtattcgcctgataactataaactgttgttgcttaatccactaggtacaacagaattggaattatttgtccagccgaatatgattcagcttactgataataatggtaaaaaatacctcagtgatactcctgagtcactaatttaccagcttaccaatatgaatattcctctggataatctgaaaaactggattattggcttacccggcgatgccaaagattttcagttagatgagaattacctgctcaaatcggtgagtagcaagaaaaatggtgagatctggaaagtcaattatcagggttatgatgcttcgaccatgccagtgttgcctaatcgattggaactcactcagggcaagaaccgcataaaattaaaaatggataactggacaacccaataa

SEQ ID NO: 3413 - DNA, 105 bp, Xenorhabdus bovienii
  Coding sequence Name=Xb4151_4152.C438.gene206.dna; Position on contig= 150454..150558bp; Strand=-
atgcatcaattcaataaaagtcaatcggacggctatgccgtaatttattcgagaaattttgacaaaatttcgctaaattatcaccttgattatagacttggatag

SEQ ID NO: 3414 - DNA, 1263 bp, Xenorhabdus bovienii
  Coding sequence Name=Xb4151_4152.C438.gene207.dna; Position on contig= 150669..151931bp; Strand=+
atgactttattagcactcggtatcaatcataaaaccgcgcctgtttccttacgtgagcgggtggcattttctcctgacacaatcgggcttgcgcttgataacttgctccagcagcggctggtgcgaggtggcgttgtgctgtcaacctgcaaccgcaccgaactttatctcagtgtcgagccgcaggataatttaaaagaccaattaatcagttggttgtgtgagtatcatcagctcaatcctgacgatctgaaagccagcctttattggcatttggataatgatgccgtcagccacttgatgcgagtggcgagtggtctcgattcgctggtacttggggagccacagattctggggcaggtaaagaaagcctttgccgaatcgcagaattatcaatccctgtcaggggagctggagcgcctgttccagaaatctttttcagttgccaagcgggtcagaacagaaacggaaattggcgcaaatgcagtttctgtggcttttgctgcctgtacgcttgcccgacagattttcgaatctctgtctaaattgaatattctgctggtgggggcgggggaaacgattgaattggttgcccgccatctcaaggaacaccgtgtgcgtcacatgatgattgccaaccgcacgaaagagcgggcgcagacactcgccagtcaagtgaatgcggaggttatttccttgtctgaaattgatacccggctggcagaagccgatattgtgatcagttctaccgccagcccactgccgattatcggtaaaggcatggtcgaacgggcattgaaagtccgccgcaaccagccgatgttgctgattgatatcgctgttcctcgcgatattgaaccggacgttgaaaaattgagcaatgcttatctatacagtgttgacgatttacaggccattattcagcaaaatctggctcaacgtaaggctgctgctgttgtcgcagaaggcattgtgcagcaggaaagccgctattttatggattggttgcgctctcagggggcggtcaatacaatccgggaatatcgggaacaggcagaaaaagtcagagctgaaatgacagcaaaagcattgatgtccatcaggcagggtgctgatgctgaacagatcattaaccaattgactcaccaattgacgaatcgtctgctccatacaccaactaaatcacttcaacaggcggccagtgatggcgatttggaacgcctgaatctcttacgggacagccttgggctggatcataactaa

SEQ ID NO: 3415 - DNA, 1083 bp, Xenorhabdus bovienii
  Coding sequence Name=Xb4151_4152.C438.gene208.dna; Position on contig= 151962..153044bp; Strand=+
atgaagccttctattgtcgctaaactggaagcattgcaagaacgccatgaagaaattttggttcacctcggtgatgccagtgttattgctgatcaagatcgtttccgtgcattgtcaaaggaatatgctcaacttaccgatgtgacccattgtttcaaatcctggaaaacggttcaggaggatttacagacagcggagatgatgcttgacgatctcgaaatgcgggaaatggcacaggaagaactcaaggacgcaaaaattcgtaatgaagagctggaacagcagctacagctactgttgttaccgaaagatccggatgatgagcgcaactgtttccttgaagtccgggcaggaaccggtggcgatgaagccgcgatatttgcgggagatttgttccgcatgtatagccgttatgcggaagcccgccgttggagagtggagattataagcgccaacgaaggcgagcatggtggctacaaagaagtgattgccaaagtttcgggtgatcaggtttatggtcatttgaaatttgaatcaggcggtcatcgtgtccagcgtgtaccggaaacagaatctcaggggcgcattcacacttctgcctgtacggtggctgtcatgccagaaattccagaagctgaattaccggacatcagccctggtgatttgaaaatagatacgtttcgctcttccggtgcgggtgggcagcacgtcaataccaccgattctgcgattcgaattacccatctcccaacggggatcgtagtggaatgtcaggatgagcgttcccagcacaaaaacaaagcaaaagcgatgtccgtattggcggctcgtatccgtgctgctgaaatgcataagcgtcaagaagcggaagcctctgaacgtcgcaatttactgggttccggcgaccgttcagatcgtaatcgcacctataatttcccacagggacgtgtgactgatcaccgaatcaatctgacgttataccgccttgatgaagtgatagaaggcaaactggatatgcttattcagccgatcattatcgaatatcaggcagatcaactgtctgcactgtcagagcaggattaa

SEQ ID NO: 3416 - DNA, 861 bp, Xenorhabdus bovienii
  Coding sequence Name=Xb4151_4152.C438.gene209.dna; Position on contig= 153044..153904bp; Strand=+
atgaattaccagtgctggctacaacatgcggctacacagttgtttgagagtgacagccctaagcgtgatgcggaaatcttattgggatacgtgacggggcgttcccgtacttatttgattgctttcgatgaaacgctaatctcatcggaagaattacatcagcttgatagcctgttggggcgccgcattcagggagagccggtcgcttatattattggtgaacgggaattctggtcactaccgtttgccgtatcaccagcgacgttgatcccgcgccctgatactgaatgtctggtggagaaggcattggaattattgcctgattctccagcccggattctggatctggggacgggaacgggagcgattgcactggcattggcaagtgagcggaatgattgttatgtgacgggagtcgatatcaactctgatgctgtgatgctggcgcaatacaatgctgaaaaaaacgccggaaaactggccattcacaatgtgaattttttgcaaagtgagtggtttgcagcagtgggtaaccaacaatttgatatgattgtcagcaatcctccgtatatagatgagtgtgaccctcatctacaagaaggggatatcaggtttgaaccagccactgcattgatcgctgcacaaaatggcatggcggatttgcaggcaattgtgggacaggcgcgccatttcctgtcaccaaatggatggctattgctggaacatggctggaaacagggaatcgttgtcagaaacctatttttagagaagggttatcaacagatagcgacttttcaggattatggcggtaatgaacgcatcacgataggtcgatggaataaaaatgaaacccatagttaa

SEQ ID NO: 3417 - DNA, 810 bp, Xenorhabdus bovienii
  Coding sequence Name=Xb4151_4152.C438.gene210.dna; Position on contig= 153888..154697bp; Strand=+
atgaaacccatagttaattatgaattcaataatactcccctgattgacggtattattctggtatcaaaaattatccgccctgattttcctcagactctggtgagtgagcagctgacagcattggttgaagaagcccggcagaggctttcctccattaccgattccaaagtgaaattggattcgctgctgacacttttttatcgggaatggaagtttggtggagctaatggggtgtattgtttgtcagataccctgtggctggatcgcttactccattcacgtcaaggttcacctgtatcattgggtacggtgtttacgcacattgctcaggcgctggggctgtcggtacagcctgtcatatttccaatccaactgatattgcggattgatttgcttgatcagcccacttggttcattaatcccttgaatggggatacgctgaatgaacatacgctggatgtctggttaaaaggtaatattggcccaactgttcgtctgaaaaaacaggatttgcaggaagccgataatgtcagcctcgtgcgcaaaatcactgacaccatcaaagtttctctgatggaagagaaaaagatggaactggcgcttaaggccagcgaagtggtgctgacgtttgatcccgatgacccctatgaaatccgcgatcggggacttatctatgcccagctcgactgcaatcatattgctgtttcggatttaagttattttgtcgaacattgccctgaggacccaatctcagaaatgataaaaatgcaaattaacaccatagaacagcggttgattgtcctgcattag

SEQ ID NO: 3418 - DNA, 855 bp, Xenorhabdus bovienii
  Coding sequence Name=Xb4151_4152.C438.gene211.dna; Position on contig= 154756..155610bp; Strand=+
atgcaacagaaagtggttaatattggtgatatcaaggtcgcaaatgatctgccatttgtattgtttggtggaatgaacgttcttgaatcacgggatttggccatgcggatttgtgagcactatgtcactgtgacacaaaaactgggcattccttatgtttttaaagcgtcttttgataaggctaaccgttcttctatccgctcttatcgtgggccagggctagaagaagggatgaaaatctttcaggaactgaaacaaactttcggcgtgaaaattatcactgacgtgcatgagcctgcacaggctcaaccagtcgcggatgtggtggatgtgattcagcttccagctttcctcgcccgccagaccgatctggttgaagcgatggcgaaaaccggtgctgtgatcaatattaaaaaaccacagtttgttagccctgggcaaatgggcaatattgttgaaaaattcaaagaaggcggcaatgaccaggtgatcctgtgtgaccgtggcagcaactttggctatgacaatctggtggttgacatgctgggcttcggtgttatgcaacaggctacccacggtgcaccggttattttcgatgtcactcatgcattacagtgtcgtgacccattaggtgcagcgtccggtggccgtcgtgcacaggttgctgaactggctcgtgcgggtatggccgtggggatcgccggtctgttccttgaagcgcatccagatccagaaaatgccaaatgtgatggcccgtctgctttgccattggcaaaactggagtcattcctgatgcaaattaaagcgattgatgatgttgtgaaaagttttccggaactggataccagcaaataa

SEQ ID NO: 3419 - DNA, 1683 bp, Xenorhabdus bovienii
  Coding sequence Name=Xb4151_4152.C438.gene212.dna; Position on contig= 155675..157357bp; Strand=-
atgaaggaatcttactctttcccccgttttatcagagatatcatcgctgggattaccgtgggtgttatcgctatcccactggcaatggctctggcgataggaagcggagtcgcgccacagtacggcctgtacactgccgctatcgccggcattgtcatcgccatgaccggaggctcacgctatagcgtttccggcccaactgctgcttttgtggtgatcctctatcctgtttcgcagcaatttggtttgagcggcctgctcattgcgacgctgatgtcaggtgtgattttgattgtgatgggattggcacgttttggccggtttatcgaatatattcctatgtctgttacccttggatttacttccggtattgccatcactatcgccaccatgcaggttcaaaatttctttggcctgaaactggtacacataccggaaaattatattgataaggtgattgcactttctcaagcactgccttcattacaattgagtgatacgcttatcgggttgactacgcttctggtactgattttctggccgaaactgggggtaaagttaccgggtcacttacccgctttaatcacgggtacggcggttatgggcgcgatgcacctgttaggctatgatgtcgccaccattggttcatcttttagttacacactgtcggacggcacacaaggccaaggcattccccccattcttccccaatttgtcctcccgtggaatttgcccgatacacattctctcaatattagctggaataccgtatcggcattgctgcccgctgctttttcgatggccatgctgggtgcgattgaatcattactgtgtgcagtaattctggatggcatgacagggaaaaagcaccattctaacggggaactgcttggtcaggggttgggcaatattgccgctcctttctttggtggcattaccgccacagcagctattgcccgttcagccgccaatgtgcgggcaggcgcgacttccccgatagccgctgtagtccattctctactggtattattaacattgctagttttggctccgatgctctcttatttaccactggcggcaatgtcagccattttgctgattgtggcgtggaatatgagcgaggcacataaggtggtggatttaatacgccatgcgcctaaagatgacattattgtcatgcttttatgtctgtcattaactgtcctattcgatatggtcgtcgcgatcactatcggcattgtgctggcatcgctcctgtttatgcgcaaaattgccaatatgacgcgtatcagcacttcgtctttaacgagcgcagataaagggttattggttgtacgaattaacggccctttattcttcgctgccgccgaacgtatttttgccgaactgagagaaaaaagtgctgattatcaaaccatcatcatgcagtgggatgccgtacccgttttggacgcaggcggattacacgcttttcagggttttgtgcgcgaacttggcaaagaaaaacatatcgttgtatgtgatattcccttccagccattaaaaacgctggcaagagccaaagttacaccgattgaaggagaactgagtttttatgcaactttgcccaaggcactaaaagagatggcagttaattacacgtctgaggtgtgtgcttcttcagaaaagattcaaggtcagtaa

SEQ ID NO: 3420 - DNA, 513 bp, Xenorhabdus bovienii
  Coding sequence Name=Xb4151_4152.C438.gene213.dna; Position on contig= 157575..158087bp; Strand=-
atgtcacgttcagacaaacacatctggatgccctgtctcaatgggcaaaaatctacctataacggggaacataacatgcagcaggaaaatctgatcagcaaagtgattatcgcaacgttaaaaagctggcgctttatatcggcactatctgttttttctatcctgagcgcaacagcaatactgattgctgtcttcaacactgccaccttaaacaacattgcactctatgccgtactattattcacaacgctgtactgccaatactattgttggcgcacttggcttgactgccactattttcagatcctcaattcatcccctgaaaaaagtgccgagttcgatcaaacgttattgctgatatttaataagttaccccaatcacggacccagaatgatcgctttaacggagcaatcaaactgttaaaaaaggctacgattggtctgatcctgcaatgggtaatgtttttcctgtttctgcttatgttgaaatattcagccttaattcagctttaa

SEQ ID NO: 3421 - DNA, 1320 bp, Xenorhabdus bovienii
  Coding sequence Name=Xb4151_4152.C438.gene214.dna; Position on contig= 158026..159345bp; Strand=-
atggaacactacatgcactcttctctcgatagtcgtcgacgcctatggctgacaggtgttatctggctattgtttctgactccgtttttctttcttacttatggtcaggtcaatcagttcacggcacaaagaggcgatgtcggcactgtgatgttcggttgggaacataacatccctttttggtcatggtcgattatcccttactggagtatcgacctgttctacggaatatcgttatttatctgtacccatcgccgtgaacagtggcttcacggctggcgattaatgaccgcatcactgattgcctgcattggattcctactgtttcccctgaaattttcgctctcccgccccaccacagaaggtctatttggctggttatttaatcaactggcgttatttgatctgccctataatcaagcgccttccctgcacattattctgctgtggttgctctggctgcgctattcagcctacgtgtgtggttactggcgcggattgctacatatttggtcagtgctggttgcactatcggttctgacaacctggcagcaccattttgtcgatatgctcacgggttttgccgttggtgtcatcatcagttacctactgccagtttcataccgctggcgctggcaatccaatcaagatcgctatgcacgaaagttgttcagctattatttgacaggcagtgcgttgttcgcgcttatggcatatctgctgggtggtagtttctggctgctgctgtggcctgccgtatcattactgatggtcgcactgggttatgcaggattaggcagctccgtgtttcaaaaacagccagatggccgtatgtcactgtctgcacgctggctactggcgccataccaactgggagcatggctctcttatctctggttccggcgtaaaagcacacctttcagccacataactgaaggaattattctcggtagcctgccttgtcaacccgtcacgacagccagtgtccttgatatgaccgctgaatggcacaggcgatctgattcccacacagtagactatgtttgccagccgcaaatcgacttactgccgctgacacctgaatctctgcaatcagcaatttgtgcgttggataaactacgccagcagggagatgttttcgttcattgtacgcttggcctgtcacgtagtgcgatggtgatagcagcatggctgctgaaacagcatcctgaatatgatatcaacactgtcgtagcaatcctgcgtaaagccagaccgcatgtcacgttcagacaaacacatctggatgccctgtctcaatgggcaaaaatctacctataa

SEQ ID NO: 3422 - DNA, 1770 bp, Xenorhabdus bovienii
  Coding sequence Name=Xb4151_4152.C438.gene215.dna; Position on contig= 159364..161133bp; Strand=-
atgacaccacaactcgatcaacgtattgctgaagaacattatttcaccacatcagataatgcttctctattttaccgttactggccacagcaacaggccaatccagacaaagcgatcattatttttcaccgtggtcatgagcactcaggacgcatccagcatgtcattgacggactcgatctgcctgatgttcctatgtttgcgtgggatgcccgtggacacggtaagacagaagggccacgcggttacagcccttccatgggaacgtcgattcgtgatgttgatgaatttgtcagatttattgccaatcagtacaacatcgccatgggaaatatcgtagttatcggccagagtgtcggagcggtattagtctctgcttgggtacacgactatgcgccgaaaatccgcgccatgatcctcgcagcacccgcatttgatattaaattgtatatcccttttgccacgcagggactgcaattgatgcaaaaagcacgaggtattttcttcgtgaattcctatgtgaaagccaggtatctgactcacgatgaaacccgaattgcctcttataatagcgatccgttgattacccgggaaatcgccgtcaatattctcttggatctttaccaaaccgccgagcgagtagttaaagatgccgccgccattacactacctaccctgttgtttatttcaggcagtgattatgtcgtgaacaaaaaaccacagcatcagttttatcagcagttaaatacccctatcaaagaaaaacacgtgatggatggcttctaccacgatacgttgggtgaaaaagatcgccatctggtttttgacaaaatccgggtctttattgaacgcgtttttgcacttccgcgttatcagcacgattacagccgagaagatacctggagtcactctgccgatgaatttcgaacactcagcacatcattaccgagtctgtgtccgaagaaactcagctatcagttgatgcgtaaggtaatgaatactcgctggggcagagcttccgagggtatctgcatcggtctcaaaacggggtttgattccggctccacattagattatgtctaccgcaaccaaccgcagggtaagggcattttggggcgaatgctcgataaaaattatttgaacagcattggctggcgcggtatccggcagcgcaagatccatattgaaatgttgatccgccatgctattcgcagtctacgtgaacagaatatgcctgtgcatatggttgatatcgctgccggacacggtcgctatattcttgacgcaatcaacgatttcagtaaagtcgactctattttgttaagagactatagcgaaatcaatgtcaatcaagggcaggcttatattgaggagcgcgatctgacggacaaaattcgttttgttatcggcgatgcctttaatgctgaaagtatcgcatccattacgccggcgccgacactgggtattgtgtccggtctctatgaattgttccctgataataatttactcagaaattctctacgcggctttgctgatgctatgacagaaaatggttatctggtgtacaccggccaaccgtggcatccacaaattgaggtcatcgcccgtgttctttccagccatcgtgacaatcaaccgtggatcatgcggcgccgtactcaaggggaaatggacgcattggtggaagccgccgggtttgaaaaactgtaccaactgacagataactggggcattttcactgtttcgattgccaagcgcgttcatcgctga

SEQ ID NO: 3423 - DNA, 624 bp, Xenorhabdus bovienii
  Coding sequence Name=Xb4151_4152.C438.gene216.dna; Position on contig= 161143..161766bp; Strand=-
atgaccatatacgatttaaaaccccgtttccaaaatctactgcgtcctatcgtaatttatctgtataaacaaggaattaacgcgaatcaggtcactttaaccgcgctgttcttgtcaatctttgccggttcactattgagcctatttccttcgccccacctctactggctgctacccatttttcttttcattcgcatggccctgaatgccattgatggcatgctggcacgggaacataaccagaagtcccatctgggcgctatttataatgaattgggggatgtcatttctgatgttgccctctatctccccttctgccttttacctgatgtgaacagcttcagcctgttgattattttattcctcactatcttgaccgaattcatcggcgtactggcacaaacgattggttcatcacggcgctatgacggcccgataggaaaaagtgaccgtgcttttatcttcggagcttatgggttgattattgcgattttcccttcggccttgggctggagtagctctttgtttgctttcatgatcattttactcttagtgacttgctatcagcgcgttgttaaagccttacgtgaaatccggctggctgaacagtcacactccaaatga

SEQ ID NO: 3424 - DNA, 795 bp, Xenorhabdus bovienii
  Coding sequence Name=Xb4151_4152.C438.gene217.dna; Position on contig= 161855..162649bp; Strand=+
atgatcttatttaagggatcaaaaaactatctttttaatcaattaaattatgatagttgcgtattattagagattgatgagtcggttaacttgaatggatgggacgaattgtctagagcacagcgtttgttatctctcatggaaatattgcgccgttatcactttccggttcagggaaaagtgttggcgcagaaattgaatatcagcttaagaacgctgtatagggatattgcatcgttgcaggctcaaggcgcgattatcgaaggtgagccgggaataggatacgttttgagacctggatttgtgttaccaccgctcatgtttacacaaaatgaaatagaggcgttggcattgggcgcgaattgggtggctaaacgtgcagactcccaactaaaagaatctgcaaataatgcaataagcaaaattgcggctgtgatcccggcagaattgaaacaaatgttggaggcaagctccttactgatcgggcctgctgcgacggctgttcagccggttgtcgagattcagcagatacgtcaggcgatcaatacccggcataaaatcactttcgcttatctggatataaaagatatcccatcagaaagaacaatatggccattcgccttaggttattttgaaaatatcagcattgtgattggatggtgtgaattacgcgaggaatttcgtcatttcagatcagataggatcatgcgtttgaaaattgaaaaacaatgttacccccgttcaaggcaagtattgctcaaagaatggagagcaatggaaaaaatttctcgttag

SEQ ID NO: 3425 - DNA, 252 bp, Xenorhabdus bovienii
  Coding sequence Name=Xb4151_4152.C438.gene218.dna; Position on contig= 162769..163020bp; Strand=+
atgttaacactcaaattttctacatcggtaaacgctaaaccatcccatatttgggcacattatgttgattttaatttgcggaaaaaatgggaaatcgatcttgaatatcttcaatttgaaggggagatcaaaacgggtcaatacggcaaaatgagattaagtggaatgccggaaattcgcttttatctttcaaatatcgaagtgaataaagaatttaccaatcaggttaccttccgcaaatgggaatattaa

SEQ ID NO: 3426 - DNA, 552 bp, Xenorhabdus bovienii
  Coding sequence Name=Xb4151_4152.C438.gene219.dna; Position on contig= 163008..163559bp; Strand=+
atgggaatattaacgttcagacatcaaattattacagatgaaaacaatatggcgtgccgtattcaggtgaccgtttcatttgaacctgatgctaatattcccgctgttcaggccgaaggcttctttaagcagggtacgcaagatctggttgaaaccgtattaaggctgaaaaatatcgttgagacagtatccccaaaacccaatctccagcttgtttacgtctctgatattgagcattcaactgctttttacaaaacaattttcaatgccgaaccgatatttgccagctctcgttatgtggcattttctgctggtggtgaagtattgtttgctatttggagtggaggagtaaagcctgatcgtgctattccgcgatttactgaaatcggtattatgctgccatccggtaaagatgttgatcgatgctttgatgaatggcgaaagaaccctgagatcaaaatagtacaggaaccccataccgaagtttttggccgtactttccttgctgaagatcccgatggccatattattcgggtatgtcctttggattag

SEQ ID NO: 3427 - DNA, 189 bp, Xenorhabdus bovienii
  Coding sequence Name=Xb4151_4152.C438.gene220.dna; Position on contig= 163668..163856bp; Strand=+
atgcgaaaaatcctgaacataagttcaggatttttcttgagatatggcggtgagagaggggttcgaaccctcgatacgttttcacgtatacacactttccaggcgtgctccttcagcctctcggacacctcaccgtgttttgtttctgcggttatcctgttaggaatttccgcaagggttactaaataa

SEQ ID NO: 3428 - DNA, 234 bp, Xenorhabdus bovienii
  Coding sequence Name=Xb4151_4152.C438.gene221.dna; Position on contig= 163900..164133bp; Strand=+
ttgtgttcaggctcttttttagaatatggcggtgagagaggggttcgaaccctcgatacgttttcacgtatacacactttccaggcgtgctccttcagcctctcggacacctcaccgcattttgttgttgtagcgatatcacttgagttcgtcgctgcaacggggcgtaactatagggaaaagcagggcaggcgtcaacaggcttatgacgattttttcaggctttttgactga

SEQ ID NO: 3429 - DNA, 162 bp, Xenorhabdus bovienii
  Coding sequence Name=Xb4151_4152.C438.gene222.dna; Position on contig= 164117..164278bp; Strand=-
atggttgcaagcctctgccaaaaagcgaggaatgaaaatattgataatgttacccagttaacatatttaccactacatattacaaaaagtgcatctgctttagtaaatgactatcaaacattcaaattgttttttatttgtgtaatcagtcaaaaagcctga

SEQ ID NO: 3430 - DNA, 942 bp, Xenorhabdus bovienii
  Coding sequence Name=Xb4151_4152.C438.gene223.dna; Position on contig= 164328..165269bp; Strand=+
atgaatattattttttttcactcttcctctaataccgatgagtggattcaaggaattcaggcacgtctgcctgatgccaaagtgaggcaatggtttagtggtgatcaagagcccgcagactatgcattagtttggcagccaccttatgaaatgttagccaatcgtcaggggctaaaaggcatattcgcactgggtgctggtgtcgatgcgattttcaaacaagaatcgaaaaatcccggtatgttaccggctgatgttccactgatccgcctcgaagatacaggaatgggcaggcagatgcaggaatataccattacctcagtgttgcattatttccgccgtatggatgaatataaacgataccaggaacagcgcctctgggctcctatgtctccacataaccggaaagaatttgttatcggggttttaggagccggagtattagggctaagtgtaattgggaaattaatggaatttgatttcaatgtgcgttgttggagcaggacgccaaaacaactcaatagtgtcgaaagtttttacggtaaagagcaattgggtgattttctttctggctgcaaggtgctgattaaccttctccctgatactcccgaaacgcgtggtatccttaatctgtcattattcagccaactaaaatcgggttcatatgtgattaatctggcgcgaggagcgcagcttgtcgaacaggatctgctcgttgctattgataaaggttatatcgcaggagcaacccttgatgtgtttgccgaagaaccattgtcaaatatgcacccattctggactcaccctcgtatccatgtgactccgcatattgctgctaacactgttcctgaggctgctatggatgtcatctgtgaaaatatccggcggatggcacggggtgaaatgccaactggtctcgtcgatagggaacgtggctattaa

SEQ ID NO: 3431 - DNA, 138 bp, Xenorhabdus bovienii
  Coding sequence Name=Xb4151_4152.C438.gene224.dna; Position on contig= 165345..165482bp; Strand=+
atgaacgaattttctattgtttgccgtatattgggtacattgtttaaccgcgcaccgcaagatcccgttctgcaacctttaatcactatgattgctgaggggaaactaaaacaaggcatggcctttggaacaggatga

SEQ ID NO: 3432 - DNA, 129 bp, Xenorhabdus bovienii
  unsure (1)..(129): unsure at all n locations
  Coding sequence Name=Xb4151_4152.C438.gene225.dna; Position on contig= 165450..165578bp; Strand=-
tttaggaataacanntttccgtttttaanngagctaacgggggttagtcgatccgtcacttctgtanagnatccacgctgtaaacgatccagccattcatcctgttccaaaggccatgccttgttttag

SEQ ID NO: 3433 - DNA, 372 bp, Xenorhabdus bovienii
  Coding sequence Name=Xb4151_4152.C439.gene1.dna; Position on contig =42..413bp; Strand=+
gtgggaatatttactcatagtagccataattctatacgtctttacaataaagaatatcataatattccttttcaagaacttcaaggaagaataaaaggtagtgttgagattgatgataatacttttattggcgcaaatgcaatcattatgcccaatacaaaaatagggaaaggatgtatagtaacagcattctcttatgtgcaaggaaattttagtgacttttcaataatcgctggaaatcctgcaaaaaaagtcggagatgtacgaaagattgattatagattattaaaaaaacatccagaattaattgaatcatatttaaaatattttaactataaatctattggggctcttattgatcatgaagaataa

SEQ ID NO: 3434 - DNA, 960 bp, Xenorhabdus bovienii
  Coding sequence Name=Xb4151_4152.C439.gene2.dna; Position on contig =403..1362bp; Strand=+
atgaagaataataaagaattatataaaaatctctgcgaaacagagaaaacaatccctatatttagtcaagcttggtggcttgacgcaactgcaggaatagaaaattgggatgtagctatcgttcaaaaggaaaatggagaaattattgcctccctaccttatatgataaagaaagttcaatttctaaaaaaaatcactcagcccaaattaacacagtttctaggtccctggttcaaggaaaataatagcaattacaccaagtcactaggtcaacaaaaagatctaatgttttcactcatagagcagctacctgaatttcattccttttctcaaaattggaatcattctcaacaaaattggttgccattctattggaaaaatttttcccaaagtacaagatatacatatagaattacagacataagtaatgaggagaaattatggaatggatttcaatcaaatataagaggttatattcgcaaagcaaaagaacgttatgagctagaaatacgtacagatttagatattcatgaattcttaaaattaaataacaaggtatttgaacgtcaaaataaaactcctccatacgaagataactttgttatcgatctggatagagtttgttcagaaaaaaaatctcggaaaatttttattgctcaagataaattaggcagaaaacatgctggagcttacctaatatgggataacaataacgcatactatattatggcaggagcagacccatcacttccaaatagtggggcaacaagtttatgtttatgggaagcaataaaatttgcatctacagtgacaaaaaattttgactttgaaggctctatgcttgaacctgttgaaagattttttagagcatttggcgctgaacaaacaccatattttcatatctctaaaacaaattcaaagatattaaaaacatattatttccttaaaaatttaaaataa

SEQ ID NO: 3435 - DNA, 1350 bp, Xenorhabdus bovienii
  Coding sequence Name=Xb4151_4152.C439.gene3.dna; Position on contig =1486..2835bp; Strand=+
atgaaatccattaattctaacatactgctttggttccaacttattataagagaacgatttggaattccaattaatgcttcatatacagagaaaggtataaaattatatcttcaaaaagaagaaaaatatattatacttgacgaattacaatcaagcttctattccatagatacaaaattgtcgtttactacttggaatggatgtgaagaaggctgggagacaatattagcctcccccttaccagcaccaacaattaaaaatttaccaaaacctttaattgaaaaaaagtcatatggacataatattcattatgatattattggtttaacttattggatattatctagaatagaagaaataaataaagagcaagtattagataatcactataggttccctgccattgagtctcatgcctataaaaataattatctaaatcgcccaattgttgatgaatggttacatattttaagacaaataattgaaaaaacttggccaaatgcagtgctaaaaaagcatcaatttagatttaatgctacacatgatgttgatagaccatatagatttaaatattgtaaattaactaaattaataaaaaatattgctggcgatgtaattcgtaagaaagtattttcatcaattatatatgctccttttataaaaatatcaaataataaacatgttcttaataaggatctatattttacttttgattggattatgaacctatcagaaaaaaataacataaagagtgagttctatttcatctgtgggcgaacagatagaactaaagacgctgattatgagattgaagacccactaatacgaggtttacttcgaaaaattcattctagaggacatgttataggattacatcctagctatagttccttccaagatccacaacaaataaaagaagaattttctcgcttacaaaatgtatgtgctgaggaaaatataaaacaaaaacagtatggtggacgaatgcattatttacgatggtcacacccagaaactctagttgcatggaataatgctggcttaaactatgatagcactctcggctatgctgataggcctggttttcgttgtggtacttgttttgaatatcccgcaataaaccctctaacaaatgaaattttaaacataagaataagacctttgattgtaatggaatcctctatattgaaatatatgaacattaaaaataccaacgatgcaaagaccttgtttttatattataaaaatatatgcaaaaagtttaatggtgagtttacattactatggcataatagtgaactttataataataaaatgagagaaatatatttagcattgttaactgaatag

SEQ ID NO: 3436 - DNA, 1074 bp, Xenorhabdus bovienii
  Coding sequence Name=Xb4151_4152.C439.gene4.dna; Position on contig =3044..4117bp; Strand=+
atgaataaaatatctgactactttcattcccaagccttgtttgctttattagctcctattattgtactatacggaatggattcaaatttacctcttactcctgttatttattcattagcctccattttatttataaggtggttgaccaatacttctataaaaacacctaaaatatcaatagtaccaataataaaaaatggcgacaaaattttctatctaatatcattaataatggttatatatcttgtttgttggtattttttttctggtgcagtaaataatataaattttaatataactaaagtttatgaatttagagaaaaaaatagtgcaataacaaatataggtattttagcttatgttaatgattgggtctacagtgttttttctttatcactccttggctattctttatggagaaaaaaatacatcacgtttttatttgttataatatgtcaaatctttttctatagtatatcagcccataaatcggtattatttgcacctttttttgtaattggaatttatttttattttagtcgtactaatgctctatcatctgtgccattagtttttagcactaccgttctttgtggtttattattatataacatagttaatgaaactatttttccttctatgtttattaggcgtgttttttttgtacctgctaatttaacttatgtctattttgaatttttccaacataacccttattctatgtggagcaattctatattaaaatttatacaacctaatatttatgaggcgggaatatctaaaaccattggaatatatataggcactgacatatatgctaataatggatatataagcagcggttttgctcaagcaggattactaggcatattcttatatagtataatacttggtatatatctaaaatggttaaatatattatctaataaaggccctacattatggcttggattaatattagttgtaacacctttgagaagcttattaatttcatcagatctattaactgtgatgcttacacatggtctatttgtagctactctaatgttgattttactcagaaagaataaataa

SEQ ID NO: 3437 - DNA, 1122 bp, Xenorhabdus bovienii
  Coding sequence Name=Xb4151_4152.C439.gene5.dna; Position on contig =4123..5244bp; Strand=+
atgaaaattgcacacttaacttcagttcatcatcgttatgacactcgtattttattaaaagaatgtacatctcttagtacatttggttatgatgtatatttaattgttgcagatggaaaagaagatgaacttattcaaaacataaatatactagatgtaggaaaaccatcagggaggctcaacaggatattaacatccactaataagatatataaaaaagccttagaagtagatgcaaatatatatcatctacacgatcctgaactcatacccattgggttaaaattaaaaaagaaaggtaaaatagttatttttgactcacacgaaaatgtttcacagcaaatacttggaaaaccatacttacaaaaaagtttaaaaaaaataatttctagattatattcatattatgaaaaatacagcttatccaaatttgatggtataatatctgcaaccacatcaatcaaagaaaaattaataaaaatcaataaaaacacaatcgctgtgaataatttccctatcataaatgatataaccaatacaaatatcatctgggataaaaaagaaaatagaatatgttatgttggtgcaatttctaatattaggggtataaaagaaatggttgaatctgtttctgatataaaaacaaacactaaaataaccataggaggaaatttcccaaataacaaatttgagaatgaagtaaaaaataacaaaaattcaaatgaaattgaattcttaggctttttaaatagaaagcaaataaatgaattattttccatatcaaaagcaggtctagtagtattacatccaactataaattacttagactctcttcctgtaaaaatgtttgaatacatggccgcaggaattcctataattgcctcaaatttccccttatggaaagaaattatatctagtaacaattgtggccttcttgtaaatccccttgaacctacagaaatagctaatgccatagattttataataaataactcagacatatcaaaagaaatggggaaaaacgcaagagtagcaatagaaaaaaaatataattggtctatagaatgcgaaaaacttttagatttctatactaaaatagatgaattatcgttatccaactaa

SEQ ID NO: 3438 - DNA, 276 bp, Xenorhabdus bovienii
  Coding sequence Name=Xb4151_4152.C439.gene6.dna; Position on contig =5260..5535bp; Strand=+
atgaatagtctagtttcaattataatgcccacttataactcatcaaagtatattgaagatagtattaactcaatcctaaagcaaacatataaacactgggagcttattattactgatgatcattcaaatgataatacttttgatataatatctaaatactctctaatatatcctcaaataaaaatttttaaacatgaaaaaaatcttggtgcaggggctgttagaaataacagtatagaacactctagtgggagatttactagcttttctagatag

SEQ ID NO: 3439 - DNA, 429 bp, Xenorhabdus bovienii
  Coding sequence Name=Xb4151_4152.C439.gene7.dna; Position on contig =5582..6010bp; Strand=+
atgcttaaaaaagaatgtgctctttcttatagttactatcaaaaaataaatgaagatggacaattaaaaggaattataaaggctcccaaatttactaacagcaaaaaattattattcacgaatgttattggatgcctaactgctatctatgacactcaaaaagttggaaagttatacatgccgctgataagaagaagacaagatatggctctttggttaaagataatgaatatttcaggcaatgcctatggcattccagaaattttagcttactatcgagtttcaaaaaatagcttatctggaaataagtataatgcagctaaatctcaatggcatttatatagaaatatattaactctaggttttgttaaatcatccatttatttcatttcatacgctttttttggtttaattaaaaaatttaaatag

SEQ ID NO: 3440 - DNA, 1167 bp, Xenorhabdus bovienii
  Coding sequence Name=Xb4151_4152.C439.gene8.dna; Position on contig =6024..7190bp; Strand=+
atggatataacaatagcaggtataggatacgtgggcttatctaacggaattcttttatcacaaaaacataaagttattgcgttagatattagcgaagaaaaagtcaatcttataaataaaaaaaaatctccagttgtcgataaagaaatagaattctatataaaagaaaaaaaattagacctcattgcaacacttgataaaaaacttgcatatgaaaacgctgactttgttatcattgcaacacctacagattacgaccctaaaactaactattttaatataaaatctgtcgaatctgtcatagaagatgttctgtattataatcccacagctataatgataattaaatcaacaattcctgttggttttacgaaacagatgagagaaaaatataatacggacaatattattttctctccagaatttctcagagaaggacgcgcattatacgacaatttatatccatctagaattgttattggcgaaaaatctgaaagggcacaattattttctgatcttctactcgaaggagctataaaaaaagacattcctattctttttactgaatcaactgaagcagaagcaataaaattattttcaaatacatatttagctatgcgagtagcatattttaacgaacttgatagttatgcagaaatcaatgaattaaacactcgccaaattatcgaaggtgtttctttagatcctagaattggtaatcactataataatccatcatttggatatggtggctattgcttacctaaagacactaaacaattacttgctaactatcaaaaagtaccaaataatattattaatgcaattgtggaagctaatcgtacacgcaaagattttatcgctgattcaatccttagcaaaaatcctaaaattgtcggtgtttatcgattaattatgaaatcaaactctgacaattttagagcatcttcaattcaggggatcatgaaaagaatcaaagctaaaggcattgaagttgttatatttgaaccagaaatgacagatgagtattttttcaactctaaacttattcgcgatttagaatattttaaatctatatcagatataattatctctaatcgcatgtctgaagaactcaaggatgtgaaagaaaaagtgtatacgcgagatttatttggtaacgattaa

SEQ ID NO: 3441 - DNA, 99 bp, Xenorhabdus bovienii
  Coding sequence Name=Xb4151_4152.C439.gene9.dna; Position on contig =7275..7373bp; Strand=+
atgccacacttactattaacaattacactctctacctcattctgttatcatatgtcccatgctaaacatcgtcctattcgaaccagaaatcccgcctaa

SEQ ID NO: 3442 - DNA, 504 bp, Xenorhabdus bovienii
  Coding sequence Name=Xb4151_4152.C439.gene10.dna; Position on contig =7333..7836bp; Strand=+
atgctaaacatcgtcctattcgaaccagaaatcccgcctaacacgggaaacattattcgcctttgtgccaacacaggctgccagcttcatttaatccaacccttgggcttcacatgggatgataaacgcctgcgtcgcgcagggttggattaccacgagttcgctaacattaaacagcatcacgatttccatgctttcttggtaagtgaaggtttaagtccggtgaattcacaatccccgtctggggcgcggttgtttgccttaaccacaaaaggcacgccagcgcacagtaatgtcagctatcaggatggtgattacctgatgtttggcccagaaacccgtgggttacccgcttatgtattagataatatgccaacagagcagaaaatcaggatccctatgctgtcagacagtcgcagtatgaatctttccaattctgtggctgtggtggtttttgaagcatggcggcagctgggatattcaggggcgttattacgggattaa

SEQ ID NO: 3443 - DNA, 837 bp, Xenorhabdus bovienii
  Coding sequence Name=Xb4151_4152.C439.gene11.dna; Position on contig =7906..8742bp; Strand=-
atgagaatgattgctatgtctcgagaagaactgaacgaagtctggaaaaatataaagaatgaagcaagggagctggctgattgtgaacccatgttagccagtttttttcacgcaacattactcaagcatgaaaaccttggtagtgctttgagctatatgctggcaaataaactggcaaccccgattatgcctgcgattgcggtcagagaagttgttgaagacgcttaccgcagcgatccagagatgattggctcggcagcccgtgatatcaaagccgttcgcctgcgtgaccccgccgtggacaaatattcaacaccgttactctatcttaaaggcttccatgcattacaggcataccgcatagcgcactggctctggaatcaagagcgcaaggcattggcgatttatatgcaaaatcagatatccgtctcttttagtgtcgatattcacccagccgcgaaaattggctgcggtatcatgctcgaccacgcaaccggtattgtgattggtgaaaccgcagtggttgagaatgatgtctccattctgcaatctgtcacacttggtggtacaggcaaagctggcggggatcgtcatccgaaagtgcgtgaaggggtgatgattggtgcaggctctaagatcctcggcaatattgaaattggccgtggcgcgaaaattggggcgggttccgttgtcttacgtgctgttccacctcataccaccgttgcgggcgtaccggcgcggattgtgggtaaacccgaaagtgacaaaccatcactggatatgaaccagcattttaatggtatcaataatgggtttgagtatggggatgggatttga

SEQ ID NO: 3444 - DNA, 1020 bp, Xenorhabdus bovienii
  Coding sequence Name=Xb4151_4152.C439.gene12.dna; Position on contig =8828..9847bp; Strand=-
atgaataccgcttctatgacagttatcggtgccggttcatacggcaccgctttagccatcacactggctcgcaacgggcatgaagttgtgctctgggggcataaccctcagcatatccacgccttgcagcaggcgcgttgcaatcaggcatttttgccggatatttctttccctgataacttattgctcgaagcagacctgaaaaatgcggtttcaaccagcagtaatattctgatcgtggttcccagccatgttttcggggatgtattacagcagataaaaccatatttacagccggattcccggattgtctgggcaacgaaaggccttgaagcagaaaccgggcgtttattgcaggatgtggcacgtgagatattgggtaacgaaatcccattggctgtggtatctggcccgacattcgccaaagaactggcagcaggtttgccgacagcaattgctgtatctgcgacgacccctgaatttggcgaagaactccagcagctttttcactgcggcaaaagttttcgtgtgtataagaacccggatttcactggcgtacagcttggcggcgcaataaaaaatgttattgcaattggtgccgggatatctgatggtatgggttttggggcaaatgctcgcacagcattaatcacccgaggcttggccgagatgagtcgccttggtatcgcattaggcgctgatccttcgacatttataggtatggccggattgggtgatttagttttgacctgtactgataaccaatctcgtaaccgtcgttttggcatgatgctgggtcaaggtatcagcgttgacgatgcacaacgtgagattggtcaagttgttgaaggctatcgtaacaccaaagaagctcgggcattggcagaacgagccggtgttgagatgccgattacagaacagatctatcagatactatattgtaataagaacgttatcgaagcagcccagacattattgggcagagcgacaagagatgagggagaaaaccttaactcttga

SEQ ID NO: 3445 - DNA, 474 bp, Xenorhabdus bovienii
  Coding sequence Name=Xb4151_4152.C439.gene13.dna; Position on contig =9847..10320bp; Strand=-
atgtcagaacaaaacaacaccgaaatggctttccagatccagcgtatctacacgaaagatgtttctttcgaagcaccgaaagcacctcagattttccagctggaatggcagccggaagtcaaattggatttggataccgcctccaatgaattagctcagggagtctatgaagttgttctgcgtgttactgtcacagcggcattaggggaagaaacggcgttcctgtgtgaagttcagcaggcgggtattttctctatcgacggtattgatggaacccaattggcacattgcttaggtgcctattgcccgaacattctgttcccatatgcccgtgagtgcatcaccagcctggtaggccgtggtactttcccacaactgaatctggcgccagtcaactttgatgcgctgttcatgaattacctgcaacagcaggctgaacagtctgagcctagtgagactactcaggaagcctga

SEQ ID NO: 3446 - DNA, 438 bp, Xenorhabdus bovienii
  Coding sequence Name=Xb4151_4152.C439.gene14.dna; Position on contig =10393..10830bp; Strand=-
atgctgcaagaaatcatgcaatttattagccggaatactatcctgagtcttgcctggattgcattgctggtggctgtcattgtcatgacggcaaaaagcgtgttctccaagagtaaagagatcacccgtgcacaggctatccatttcatcaataaggaagatgctgtcgtcgtggatttacgctcccgtgacgatttccgcagagggcatattattggttccgttaacctgacaccatctgagattaaagaaaataatctgggtgagtttgaaaagcataaaaaacagcttgtcattgtggtttcagcgaatggtctggaatccagaacgccggctgagcatctgatccgtgcaggctttgaacgggtttattccctgaaagagggaattacgggatggtcaggtgaaaatctgccattggcccgaggcaaaaaataa

SEQ ID NO: 3447 - DNA, 117 bp, Xenorhabdus bovienii
  Coding sequence Name=Xb4151_4152.C439.gene15.dna; Position on contig =10785..10901bp; Strand=-
ttgacgcaacacacaggtatactctgctaccttagatatttgttattaactaacgggagttgtttccccccatgctgcaagaaatcatgcaatttattagccggaatactatcctga

SEQ ID NO: 3448 - DNA, 171 bp, Xenorhabdus bovienii
  Coding sequence Name=Xb4151_4152.C439.gene16.dna; Position on contig =10888..11058bp; Strand=+
gtgtgttgcgtcaattacagccaattagcgccagcccagtgtagattttgcggagagtttcgagaaaaagcaaaaatcctccgagattcatttgattgtcatgtttcaccaaaatattttatatcacacggagccggtgcaggattttcaccaataaatgagctaaattaa

SEQ ID NO: 3449 - DNA, 1332 bp, Xenorhabdus bovienii
  Coding sequence Name=Xb4151_4152.C439.gene17.dna; Position on contig =11142..12473bp; Strand=+
atgatcggcaaggtactcaataagatggctgatagtaaggatctaaagagccgtaatcagcggcagaagcaggatcaatggcaaccccagaacagaagcttattgctctgtatattgctgtttgcctttttcagcacagatacctttgccaatcagatttcagagagtaaaaaccagctcaaggatattcagcaagatattgccgagaaagaggaaagtgtcaagcaacagcaaaaaaaacgcactaatctgctgagtcaattaaaggatcaagagagcacaatctcagaagtggggctttctctacatggcactcaaacccgcttgaataaactgggcaatgaaattacatcactgaatgcgaatatcaaacgcctgcaaattcaacaaaaagaacagcgtcgtctgcttgccaaacaattggattcagcattccggcagggaaatcaccaaggattagaactgctattcaatggtcaggaaactcaacgcaaagagcgcatactggcttactacagttatctgaatcaggcgcgtcaggaaacgatcaacaaactgcaaaaaacaaccgagcagcttaaccagcaaaaaaagctgcaactggaaaaacaaaatgagcagaaaacaatactgagcagccaaaagcaacaaaaacagaaaatggaagttgtccatattgcgcggcaaaaaacgttaacggagcttgagtcttcactgcaaaaagatcaacaaagtctgaccgagcttcggcagaatgaagcccagctaaggaataaaattgccaaagcagagcgggaagccaaagcccgtgctgaacgagaggctcgtgaagccgcacgagtccgtgcacaagtcgcagccaagcagaaacaggctcagcagaaaggttcccgctacaaaccgacggaagaagagcgctcgctgatggctcgaacggatgggcttgggcgcccggccgggcaggcaatctggccggtacgcggtcgggtcatccatagttttggtgaagcaatacaaggtgagctacgctggaaagggatcgttattgccgcagcagacaatacggaagtgaaagcgatttccgatggacgggtactgttggcagactggctgcaaggctatggtttggttgtggtagtgcaacacggcaaaggagatatgagcatttatggttataacaaaacgacgctggtcagtgttgggcaacaggtacgagccgggcaatctatagcgttggttggcagcagcggcggccagcagcagccttcactgtattttgagatccgccgtcagggtcgggcagttaatccattgccatggttagggaaatag

SEQ ID NO: 3450 - DNA, 1038 bp, Xenorhabdus bovienii
  Coding sequence Name=Xb4151_4152.C439.gene18.dna; Position on contig =12458..13495bp; Strand=+
atggttagggaaataggggaagagaaaataatggtgaagtctcggttaatcaggcgagttatcccgttcacactgttatcttggatactcctgttttgtctatcattactgtttaccctgaatgcacatgccgcacgtctggccattgtcattgatgactttggctatcgtgttcaccatgaaaacaaaatattacaaatgccaacggcggtttctatcgcaatattgccagattctccacacggccgggagatggcgcaaaaagcccataaacaaggccgggagattttgatccacctgccaatggctccactcagtaaacagccattggagaaaaatacgctgcatccttccatgagccgagaagaaattggccgtattattcacgatgccatacagaaagtgcctcatgccatgggcatgaataatcatatgggcagtgcaatgacatccagtctcaatggcatggagaacgtgatgcaagtgttatcttcttaccaccatctctactttctcgatagcgtgaccattggcaagacacaagtcaccaaagcagcgatgggaacaccggttcaggtgctccgccgtcatgtttttctggataatgtgcagacagaagcagaaacacggcatcagctcaatcgagccattgcgcttgcccgtaagcaaggttctgccattgctattgggcatccttacccaaccacggttcgggccttacagcaagccctcacagcgttacctgacgatattgaactggtaacacccagcaggctgttaaaccccacttcagcgagcaaaaacgatcaccagactgcacgtaaatgtgcaaaacctcatgaaccagcagccgtacctgcaaccaagctggattatctcaagaggataggcaacgcattaacgcacaatgctattgttgagacgttgagtcagcacattgataaacttttgggaaaaacagagtcggcgcaaaaagataaaacagtacaaggcaacacaggcgcccgtacaacgacagacacctgtgctgatttttaa

SEQ ID NO: 3451 - DNA, 1026 bp, Xenorhabdus bovienii
  Coding sequence Name=Xb4151_4152.C439.gene19.dna; Position on contig =13516..14541bp; Strand=-
atgaaatcactgtcaaaattaaagccagaagaaggtatttggatggcggatgtgcccacaccggaactggggcacaatgatgtgatgattaaaattcgcaagaccgccatctgtggtacggatgtacacatctataactgggatgactggtctcagaaaacgattcctgtgccgatggtggtagggcacgaatatgtcggtgaagtggtcgcgattggtcaggaagtcaaagggttcaacatcggcgaccgtgtgtctggtgaaggccacatcacttgtggtcattgccgtaactgccggggtgggcgtacccacttgtgccgtaatacgaccggcgttggcgtgaaccgtgcgggtgcatttgcggaatatctggttatcccggcatttaatgccttcaaaattccggacaatattccagatgaactcgccgctatttttgacccgtttggcaatgctgttcacactgcactgtcttttgatctggtcggggaagatgtactggtatctggtgctggcccgattggtattatggcggctgcggtgtgtaagcatgtcggagcacgtcatgtcgtgattacagatgtcaatgaatatcggcttgatttggcgcgtaaaatgggtgtcacccgtgccgtgaatgtcagtaaggaaaatctgaccgatgtcatgaaagaattaggcatgacagaaggttttgatatagggctggaaatgtcaggcgcgccacaggcattccgcactttattgagtaccatgaaccacggtgggcgcattgccctgttggggatcccaccttcagatatggcgatagattggaatcaggtcatctttaaggggctgtttatcaaagggatctatggccgtgaaatgtttgagacatggtacaaaatggcggcattgatccagtctggtttagatttgaccccgattattactcaccaattctcgattgatgatttccagaaaggttttgatatcatgcgttcagggcaatccggcaaagtgatcctgaattgggattaa

SEQ ID NO: 3452 - DNA, 1197 bp, Xenorhabdus bovienii
  Coding sequence Name=Xb4151_4152.C439.gene20.dna; Position on contig =14551..15747bp; Strand=-
atgtcagcgtctttttatcagaaaatgaatgagcagttggaacaaacccgtgcggaaggattattcaaaaatgaacgtatcatcacttctgcgcagaatgccgatattaccgttgccgatggtagccaagttattaatttttgtgccaataattatttagggttagctaatcacccggacctgatcgctgccgcaaaagcgggactggatagccatggttttggcatggcatctgttcgttttatctgtggtacgcaagactcccataaagaactggaaaataaaatagctgaatttctgggtatggaagatgccattctgtactcttcatgttttgatgcgaacggcggcctgttcgagacattattcgggccggaagatgccattatttcagattctctgaaccatgcttcgatcattgatggcattcgtttgtgcaaggcaaagcgttatcgctatgccaataatgatatgcaggaattaagagcacagttggaaaaagcaaaagcagacggtgcggagaatattctggttgcaaccgatggggtgttctcaatggacggtgtgattgctgacttgaaatcggtctgtgatctggccgatgaatttgatgcgctggtcatggttgatgattcccacgctgttgggtttgttggcaaaggcggacgtggtacacatgaatactgtgatgtcatgggtcgcgttgacattatcactggcacactcggtaaagcgctgggcggtgcatctggcggttatactgcggcacgcaaagaagttgttgaatggctgcgtcagcgttcacgcccttatctgttctccaattcactggcaccttccattgtagcagcctctatcaaagtgctggatatgctgaaacatggcgacgaattacgcgatcgcctgtggagaaatgccaacctgttccgtgcaaaaatgaccgccgcaggctttacactggctggtgcagatcacgcgatcatccctgttatgttaggagatgcgaaactggcgcaggaattcgctgccgagctgctgaaagaaggcatctatgtgattggattcttctatcccgttgttccgaaagatcaggcacgtatccgcacccaaatctctgctgcccataccgaagagcaaatcgaacatgcggtggctgcgtttatccgtatcggtaaacagttgaatgttattgcataa

SEQ ID NO: 3453 - DNA, 105 bp, Xenorhabdus bovienii
  Coding sequence Name=Xb4151_4152.C439.gene21.dna; Position on contig =15716..15820bp; Strand=-
gtgtcgtcactggcaggatctataagtaaaatacaccacgcttttcacttattcaggtactcaggagagaaaaatgtcagcgtctttttatcagaaaatgaatga

SEQ ID NO: 3454 - DNA, 939 bp, Xenorhabdus bovienii
  Coding sequence Name=Xb4151_4152.C439.gene22.dna; Position on contig =15985..16923bp; Strand=+
atgattattgtcactggcggcgcagggtttattggcagcaatatcgtcaaggcactgaatgacgaaggctataaggatattctggttgttgataatctgaaagacggcacaaaattcgtcaatctggttgatttggatatcaccgattacatagataaggaagatttcattgccagcatcgttgcgggtgatgattttggcgatattgatgccattttccatgaaggcgcgtgctcatccacaacggaatgggatggcaagtatatgatggacaataattatcagtactccaaagatatattgcattactgtcttgagcgccagatcccttttctgtatgcctcctcggctgcaacctacggtggccgcagtgataatttcattgaagagcgtcagtatgaaaaacctctcaatgtttatggctactccaagttcctgtttgaccagtatgtccgcgatattttgccacaggcggattctcaaatttgtggcttccgttatttcaatgtttatgggccacgcgaaggacataaaggcagcatggccagtgtcgcctaccatttaaacaatcagattcaccaaggccaaaatccgaagttattcgccggtagtgaacatttccgccgcgatttcatctctgtcagtgatgttgccgcagtgaacctgtggttctggaaaaacagcatttctggcatttttaattgtggtacgggccgcgccgaatctttccaagccgttgccgatgccgttaccgggttccatcaagaaaaatcccctgtcgtggaatatattgaattcccggaaaaattaaagggacgctatcagagttttactcaagctgacctgacaaaatttcgtgctgcgggttatgacaaaccattcaaaaccgttgccgaaggcgtcactgaatatatgcaatggctcaatcaggataattaa

SEQ ID NO: 3455 - DNA, 1053 bp, Xenorhabdus bovienii
  Coding sequence Name=Xb4151_4152.C439.gene23.dna; Position on contig =16933..17985bp; Strand=+
atgaagatattggtgataggcccatcatgggtgggtgacatgatgatgtcacaaagcctctaccgaaccttgaaggctttgtaccctaatgcagaaattgatgtcatggcacctgcatggtgccgcccattactggcaaaaatgccagaggttaatcaggctctggcaatgccgttagggcatggtactctcggtctgggtgaacgccgtcgtcttgggatcgcactgcgtgacagtacatatgaccgcgcttatgtgcttcccaactcgttcaaatctgccttagtgccttttttcgccaatatccccctgcgcacaggctggcgtggtgaaatgcgctatggcctgctgaatgatatccgtgttttgaataagagcgcctttcctctcatggttcagcgctatgtggctcttgcatataatgggaaaatgatgagtggtgctgaggatcttccccaaccgctgttatggcctcagttagacgtcagtgacgaagatattgcagaatcaacagcggcgtttaatatcgctgatcatcgtcccattattggtttttgcccgggcgcagaattcggcccggcaaaacgctggccacattatcattacgccgcccttgccgaacaattgatcacccaaaaaggctatcagatcttgctgtttggctccgccaaagatcacgaagccggtgaagatattcgagcacggttgagcgaaagtgcccgtgaagattgcctcaaccttgcggggcaaacgtctctcgaacaagccgttaatatcatcgcggcctgtgatgctattgtcaccaacgattcaggtttgatgcacgttgcagcggccttaaatcgtcctctcgtcgcgttatatggcccaagtagcccggattttacaccgcccttatcaaacaaagcagaagtgatccgcctgatcacgggttaccataaagtcagaaaaggtgacaatgcgggtggctatcatcaaagcctcattgatattcaaccagagcaggtcttagctttactggaaaaactgttacagtcggagaagcagaattaa

SEQ ID NO: 3456 - DNA, 966 bp, Xenorhabdus bovienii
  Coding sequence Name=Xb4151_4152.C439.gene24.dna; Position on contig =17985..18950bp; Strand=+
atgcgcgttttactggtaaaaacgtcttcaatgggtgatgtgctccataccctgcctgcattgacggatgcaaagcagcactttcccggtattcagtttgattggatagtggaagaaggatttgcccagatcccgacatggcacaacgccgttgaaaatgtaattcccgttgctattcgccgctggcggaaaaattggtttagaaaagatattcgtgaagaacgggcacgcttccgggaaacattacggcaaaaccaatatgacaccattattgatgcccaagggctgttaaaaagtgcctttttggtgacacgcttggcacatggctcaaaacacggctatgacagaaaaagtatccgcgaaccactggccagctttttctacgatcaccgtcataccgtcagtaaacagcaacacgcggtagagcgtatccgtacattgtttgctgatagtctgggttatcaaaaacccacagaacaaggtgattatgctatcgcccgccactttctgaactcacagattaaaggtcaaagtgactatctggttttcctgcacgcgaccacccgtgatgaaaaacattggccagaaaaccactggcggcaactgattgcagagatccagtcaacaggtatgcgaatcaaactgccttggggtgcagaacatgaacaccaacgggcattgcggttagcagaaggctttgcccatgttgatatattgccaaaattaacactggctgaagttgctcaggtattggccggcgcaaaagccgtggtttcggttgataccgggctgagtcacctcactgccgcccttgatcgcccgaatatcactctgtttggccccaccgatccgggtttaattggcggctatggaaaagaacagcttcccctgaaatcggtggataatacgatgcaaagcattgcaccaccgaaagtgatgcagctgttgcaaaacgtattaaaataa

SEQ ID NO: 3457 - DNA, 903 bp, Xenorhabdus bovienii
  Coding sequence Name=Xb4151_4152.C439.gene25.dna; Position on contig =18942..19844bp; Strand=-
atggggatattttttatggcagaaataaaagcacttttttcaggatggaaaaaatgcgattttgaacgatataaagaagcttatgctctctttgggggatgtgtatcaacagatcctaatattatatcttttttggatagacatcttgatggtaagttttccttttatataaaagaaacaggaaatttaattaaaggtgcttgtttttcatttaataacaataagttagtggaagagatgaaagataggtatctaatatcatatgatgaaatcacttttcctatcgcaatggatgcgaaactatttttaccagtgaaatcaaagagattgtcacctattcatgaaaataattttattaatacctgttacaagccttttttcaacaaacggaaaatctgcctgatcaaagacagcttttcttacaagacccgccgtaaccgcagcaacgagatcaacaaattcaagcgagcgggaggagaaattcgtccttcgagtgaatttagtgcagaagaattggtgaatatctatgttgatctgtaccaaaagcgctgggattacaatcactcggctgagcaacgtaagcatctgcttgagatgtacacagagcttcgtgagcatatctttggctatgtgctactgatcaatggcaacccttgcgcatacgattttgtcttgcgcgcagatagccctaaatggatttcatttgatgcgatcaatggtgggtatgatcccgaatatgctgatcttagcgttggcagcatcttgatgtgggttaatacccaagaagcaaaagcacagtgtcaggaagcagacaaaactatgcgttactcattgggtaatcctacttttgagtataaaaatcgctggtgcgttacacttccgctaggcaaagtattattttaa

SEQ ID NO: 3458 - DNA, 165 bp, Xenorhabdus bovienii
  Coding sequence Name=Xb4151_4152.C439.gene26.dna; Position on contig =20166..20330bp; Strand=+
atgggtagaatggcattgaataaagatcaattttatttgactggggaaattattacattgcacattataatctataacagtcgctattattggttggatcaatatttattttcattgctaaatgcattacagacatatgggaaaaaaatggaaatttttttataa

SEQ ID NO: 3459 - DNA, 231 bp, Xenorhabdus bovienii
  Coding sequence Name=Xb4151_4152.C439.gene27.dna; Position on contig =20264..20494bp; Strand=-
atgatcctgagtacgatttttagtaatcgctctttcattaaaggttgtcgtttaggtggtcacggtaatatttgcatttctgacgaggctaaaaatagaattcagatcaccaataacatatattattggatatactatctaattttatcttggcattttcatggttataaaaaaatttccatttttttcccatatgtctgtaatgcatttagcaatgaaaataaatattga

SEQ ID NO: 3460 - DNA, 960 bp, Xenorhabdus bovienii
  Coding sequence Name=Xb4151_4152.C439.gene28.dna; Position on contig =20491..21450bp; Strand=-
atgagtgtttatcctaaaatttctgtcctgatgtcagtctataatggtgaaaaatatttagaagaagctattgattctatattatcacagacatttgaagattatgaactcatcattattgatgatggctcaactgactcaagtccttcaattctatcttcatacgccgagaaagatatgcgtgttaaggttataaccaatgagaataatattggtttaatcctttctcttaataaaggattgtatatggcatctagtaatctagtcgcaagaatggatgctgatgacattgcgattcctgaacggcttaagattcaggtggattttatgcagaatcatccagatatagtcgtttgtggtggattcacaacatatttagaaaatcctactaagggtgatatacatgccacaagtcatgaaggcattgttgcagagtgttttttccattgtcctgttgctcatccgactgtgatcatgagaaaagataaaattttggagctaacggatggatatgatccaaatgatctatatgcggaggattatggattatggagtcggttaattatgtcaaaaagagctaaatttgcaaatattaataagtctcttttaaactatcgtacacatccaaataaccctaggtttgaatataaaaaaaagcagaaaaaaacagctgttactattcagcagaaaatgttttcatctttaggtatatatattccattaaaggacgtttctttgatgaatcactctgaaggtaaaatatctattgatgatgtcaaacaatgtgaattctggttgtataaaatagaacaatgtactaataatatgaataaaacagaaaggatttgttttttaagggaaataaaagataaaaagatgtatttgtggagaaaaatcagaaaaaattcaatgtcagctatattgagatatataagggcaagactatactataaaaaatga

SEQ ID NO: 3461 - DNA, 954 bp, Xenorhabdus bovienii
  Coding sequence Name=Xb4151_4152.C439.gene29.dna; Position on contig =21670..22623bp; Strand=-
atgacaattaaagcatgtgatatagatttagcttcttccaagatactatcaattgttgttgctgcccataatttggaaaaattaattctcaaatgtatcaatagtataaaggatgctttgtctgattgcgatcctagcctatatgaagttttgttgatagatgatagctcttctgactctacaccatcaattttaagaaagttttctgaggagaatgattctttcatctatataagaaaagaattcaaaagtttaggaaaagtgaaaaaatattcagtcgaagtaagtaatggagaatatattacttttgttgatggtgatgatttcttatcagaattttccatgaaagaaatcgttggttttcttatggataaaagaccagatatgttaattagtccattacaggaagtcagaaacgatgctgatataatacataagtcaagtttaatatcaccagttctttttgataaaaaaacagctataaaggaatatttaatacataagaagtatcaggctcattcttgtggtaagttttttagaaaaaaattattaagaggaaataattttccggaagtttcatgttatgaagatgctttgtcatttccagcggtattaataaaatgtaataaagtatactatacaaaaatgaaatattataattacattaaaagtgaaggcagcctttctggaaatataaacgaagagaaaattaatcttatggcagatgttgtattaaccgctgacagagtcttcggtaaggagtttagaatgttgactgtgtgtcatgcaatagatattatatataagtacaggaataatttatcaaggaaatctcactctttgttgatgggtttaattgacagtatatctgtgttgaattttatgttaaatacgaatgttagatttagctttaagaaaaaatattataaaataagaaatcactttaaaagttag

SEQ ID NO: 3462 - DNA, 972 bp, Xenorhabdus bovienii
  Coding sequence Name=Xb4151_4152.C439.gene30.dna; Position on contig =22681..23652bp; Strand=-
atgaccttaccaacatttattatcacgatcgacactgaaggtgatgatctttggcaaaacagtgataaaatttcgactaaaaatacgcaatatttgccaaggttccagaacctttgtgaacgctttggatttaaacccgtctggctgaccaattatgagatggcaatggatgatagctatatcgaatttgccaaggatgtgattgccagagacacgggtgaaatcggtatgcatttacatgcttggaacaatccacccattgtatctctaaccgctgatgatatgcgctataagccttatttgattgaatacgctaaagatcaaatcaaagcaaaaattgatttaatgactaatctgctggaggagaaactccagactaagatgttgagtcatcgtgctggtcgttgggcatttaatgaatattatgctcaattattggttgagtatggttatcaggtggattgttctgtcacgccaaaaatcaattggcattttaccaaaggcgatcctaacggaaatggcgggacagactatagccattttcctactcaggcttactttatggatttacaggatatcgctaaagaaggtgattcttcgctattgcaagtgccaatgagtattcagtataaacactctccaatcatgaattttattaagcaaaagtatgatcatttgcggggtaagcagcgctccccatctgttaactggctacgtccaaaaggtggaaatttggagcagatgaaaaaagttgtccaacaaaccttggctggtggtagtgattatgttgagtttatgttgcattcgtcagaatttatgccaggtggaagccctacttttaaagatgaagagcaaattgagcagctttatcgagatttggaagggttatttgatttcttgcggccattagtccggggaatgacattggctgaatactatcaatttaaatcgccgaaaaataacgcagactaa

SEQ ID NO: 3463 - DNA, 99 bp, Xenorhabdus bovienii
  Coding sequence Name=Xb4151_4152.C439.gene31.dna; Position on contig =23747..23845bp; Strand=+
atgattgacactacatatcgtgtgattgaaaagcttaaaatgtatactctgtggctacttgctgcattaaaatcatcatatcgtattgatattatatag

SEQ ID NO: 3464 - DNA, 1068 bp, Xenorhabdus bovienii
  Coding sequence Name=Xb4151_4152.C439.gene32.dna; Position on contig =23856..24923bp; Strand=+
atgataaaaaatcataatggaatcaaaaaaattctggtgataagactacaacatcatggcgatatgctactaatcacacctgtaatcagtacattaaagtaccactatccagatgcaaaaatcgatgtgctcctttaccaagaaaccttgcctatgctggaaaactcacctgaaatttcgagtattttttcaatagatcgcaaatggaaaaattttggagcaaaaaaacatttattacttgaatgggacttactcaaaacattaagccaacaacgctatgatttaactatcaatcttgccgatcaatggcgaagtgcctttattacccgctttatcggagctcctattcgcctcgctctggattaccccaaacgtcaaaattggaagtggcgtctttgccatactgaagtagtatccacaattggtcacgattctttgcatacagtagaacaaaacctttcgattctaaaaccattacaacttactcctctcatcaataaagtaacgatgagttatggtaaggatgatttgcagtgggtaaaagatacgctttccgggtacaaattcgccgaaaattacctcgtcatacaacctacttccaggtggttctttaaatgctgggatgaaattaaaatggcaaaagtgatcacagcgctacagaaggaacagcaaaatatcatcattacttctggacctgataggcgggaattagagatggttgatactatcttgtcatactgccctgataagaacaatatactctctctagcaggacaattaacgttacctaaactagcagcattgattgatcactcaaaattatttatcggtgttgactcagttcccatgcacatggccgcagccctgaaaacaccctgtattgcattatttgggtcatccaaactgacgttctggaaaccttggcaatctatcggtgaagtgatttgggctggagattatggcaacatcccacatccagatgatattaagacccatacagatacgcgttatttggatttgataccaacagatgcggtcatttcagcagcaaggaaatatatttcatga

SEQ ID NO: 3465 - DNA, 1131 bp, Xenorhabdus bovienii
  Coding sequence Name=Xb4151_4152.C439.gene33.dna; Position on contig =24920..26050bp; Strand=+
atgaaatctctacggttagccatcgtccgtcaaaagtatcgtccagatggcggggctgagcgttttgtcacacgggccctagaggctctcaatcaccaacaacttgaacttaatatcattacacgctcttggcagggagaaagtaatcctaattggaatattcacctatgcaatcctattaaatttgggcgaatcagccgtgagcgtggttttgcaaaagcagcgcgaaacttatggcaaaaagagcaatttgatttagttcaaagtcacgaaagaattgctggctgtgacatttacagagctggagatggtgttcatcagcgttggttacatcagcgcgcaaggattttgccaaagtggaaagctcactggctattaaataatccataccacagatatgtaatgaatgcagaagaggaaatgtattcctcaccatcattaaagcaggtgatctgtaatgctgaaatgataaaaaaagaaattatcgaagaatttagtctcgctgaagacaaaatatccgttatatataatgccattgatagcacaaaattctttcctgcccatgagcaaactcgcctgcaattgcgacaacaatataacattcccactaccgcaaagtgtctgatttatgtaggctctggttttgaacgaaaaggtttgtctgccgcgattaaaactattgctaaaacaggagactatctgttagttgtaggaaaagataaggaacaggtaaagtatgaagaacttgctaatactttaggatgccagcatcgtatccgtttcatgggattacaaaaaaatacattgttgctttatcaaatgtctgatgccttattgctaccgacattatatgatccatttcccaacgtcatccttgaagccatggcgtgtggtttgcctgtcattaccagtacgacctgcgggggagcagagtttatcaccgaaggtaaaaatggctttatctgtgacgcactcgatatcggaaaactagaagaggcggtttattgtcttcctaataatatattaggtacggatatgtcaatatcagcgcgaaatcaggtgataaattcaacacctgaaaatttatctcaacaattaattcagctttatcaacgagtttcagaacagtga

SEQ ID NO: 3466 - DNA, 1104 bp, Xenorhabdus bovienii
  Coding sequence Name=Xb4151_4152.C439.gene34.dna; Position on contig =26047..27150bp; Strand=+
gtgaaagaacacattctttttattattgatggattacctggtggaggagctgaaaatgtgacgcttcgtcttgctatcggcttgcatcagcttggttaccaaatttcgttactttcactcaatactcaactggtttacaacatacctgaaggtattcactacattgttagcgcagacagctaccaaggacctttcagaaaattaaatgaacttaagcgtcgtgctaaagccatggataaggtgttatcggaacttttccaacagaaaggtaagccgactttggttatttctaatcttcacaaaactgaccgtattgtcgtcaaatcaaccatactgagttattgtaatgtatggcattgtattcacggcattttttcccattcatatctcagcaataaaaaacctctttcttattggataaaaaaagagaaaataaaaaaagtttataaaaataaacaagttatttgtgtttctgacgcagttagagatgatttggtaaaaaatattggaatacacccaaaacagataacaacaatctataatccatttaatttcaatgaaataaaacacagagctttacaaccaaatccttatcacgggaaaaattatctactgcatattgggcgctttcatgaagttaaacgccatgataggttaatagcagcttttgcacaggctaaactcccatgcaagctgatcattgtgggtaacggagccaaagacatagaaaatcatattaaagcgaaaatccatgagctaaatttaggtgataaagtaattttggcaggctttcattctaaccctctccctattattcatggtgcaaaggccgtagtcatcagttctgacagtgaaggattacccacagtattaatcgaagcattaatttgtcatacgccgattgtcagtactgactgtccgggaggggtaagagagataatgacaggtaaactcaaagaatatctgagtgaaatcacagttgacgctttagcagaaaaaatgcagctcgtttacaatgaaccaccggtaatcacagacacgatgtatgaaaaatttgcgataaataatatattaagacaatacactgccttaatagagcaatag

SEQ ID NO: 3467 - DNA, 1278 bp, Xenorhabdus bovienii
  Coding sequence Name=Xb4151_4152.C439.gene35.dna; Position on contig =27252..28529bp; Strand=+
atgttgcttcgcttatatcaggtacttctctaccttatccaaccgcttatctggttacgcctgctgttgcgcagccgtaaatcccctgcgtaccgtaaacgctggggtgaacgttatggtttttgtgccaaaaaagtcgcaaaaggtggaatattactccattccgtttctgttggagaaacattggctgccattccattagtaagaatactacggcaccattatcctttcctgccgattaccgtgacaacaatgacaccaactggctctgaaagggtgctttctgctttaggtactgatgtcaaccacgtttacctcccctatgatttgcctggctccatgagccgtttccttgataacgtcaaccccaagctggtgattattatggaaacagaattatggcccaatttgattacccaactgaaccaacgcgaaatccctctggtcattgccaatgcaaggttatcaacccgttcagcagcgggatatcaaaaaatcagcaactttattaaaaccattttaaataaaataacactgattgccgcacaaaatcaggaagatggtgagcgcttcatcgaactcggcttaaaacgttcccaactcgccgtcactggcagcctgaaattcgacatttctgtcacgccagaactggcagcaaaagcggttacactgcgccgccaatgggcgccacatcgtcctgtctggattgccaccagcacccatgatggagaagaaaccatcatattggatgcgcactgcaaattaattcaacaatttcctgatctactgttaattctagtaccacgccatcctgaacgttttaccaaggccgcagagttaacccaaaaagcgggattaaattcgatattaaggagctctgacacaatacctgatcccaatgtgcaggtggttatcggagatactatgggcgaattgatgctcttgtatggtatcgctgatctggcttttgtcggagggagtctggtcgagcgtggcggtcataatccactggaagccgcagctcatgccatccctgtcattatggggccacatactttcaactttaaagatatttgtgccaagctggataaagccaatggccttatcgccgttacggatagtcactcgttgagtgccgctatcaatagcctgctgacagatgaggactatcgtctttattacggtcgccatgccgccgaagtcctgcacgaaaatcagggagcacttcagcgattgctaaaattactggaaccttatctcccgccacggggtcattga

SEQ ID NO: 3468 - DNA, 777 bp, Xenorhabdus bovienii
  Coding sequence Name=Xb4151_4152.C439.gene36.dna; Position on contig =28529..29305bp; Strand=+
atgagcaagagaaaacgcctgtccgttgtgatgattgctaaaaattccgccgatttgattgcagattgtctgctatccgtagattgggctgatgaaattatcgttctagacgccggcagtaccgatacaacttgtcaaatagccagcgaaatgggcgcgaaagtctacatcaatacgcaatggcccggcttcggtcgtcagcggcaactcgcacaatcctatgccagcggtgattacattttcatgattgataccgatgaacgtgtaacccctgaattaagaacatcaattgagcagattttggcagatcccgacgatgataaagtctatgactgcgcacgtctcaacctgtttatggatcgtttcatgaagcacagtggctggtatcctgataaagtcattcgtctctattgccgcgaacattatcaatataacgacaatcaggttcatgaatcacttaacactcagggtgtccgcatcgtgacattaaagggcgatttacgtcatctcacctgccgtaatctgatggaattccagcaaaaacaattgaattacgccagagattgggcaaaataccgccacgaacaaggtaacacagcccgttatttttctatcttcagccatacgttaggcgcattttttaagacatggctgttaagggccgggttcctcgatggcaaacaagggttggtattagcaatggtgaatgcccagtatacatttaataaatatgctgccctctgggaactcacccaaacagagagtaaaaaacgatga

SEQ ID NO: 3469 - DNA, 492 bp, Xenorhabdus bovienii
  Coding sequence Name=Xb4151_4152.C439.gene37.dna; Position on contig =29319..29810bp; Strand=-
atgatcgccccctttttcacgctatcttatttgccgaatttcttcagcattgcctgtgctacgggttctggcaggaatgtcgaaacatcaccatcatggcgtgcgacgtcttttatcaaggatgatgatacgaaggacaggttttgcgagggcaataaaaagacactttccagttctggcataaaatgtcggttcatgttggcaagctgccactcatattcaaaatctgaaacggaacgtactccacggattaaaatggtggcttgttgttttttggcaaaattggccatcagttcactaaacccaaccacttctacattcttcagatgggcggtgacttcttttgccagtgcggttcgttcttccagattgaacatggggttttttctgtcactattggcaatggcaagtaaaacatggtcgaacatgtttgccgcacgagtcacaatatcaaggtggccgtgggtgatagggtcaaaagtaccaggataa

SEQ ID NO: 3470 - DNA, 810 bp, Xenorhabdus bovienii
  Coding sequence Name=Xb4151_4152.C439.gene38.dna; Position on contig =29830..30639bp; Strand=-
atgccggagctaccagaggttgaaaccagtcgccggggaattgagccccatttgacgggtaatgtgatccaatattccgaggtcagaaattcgcgcttgcgctggccagtttccgaacaaatcatgaagcttgctgaccaaccggtactcagtgtccggcgtcgggcaaagtacttattgcttgaactgcctgagggctggattattattcaccttggtatgtctggtagtttacgtatcttgctgaatgaatctcctcctgaaaaacatgatcacgttgatttgattatggcagatggcaaaatcctccggtataccgatccccgacgttttggggcgtggctatggagtgacaatcttgatgagtgttctgtattggctcatttaggccctgagcctctttctgatgcgtttgatggtgaatatctttataccctttcccgccacaaaaaaacggtgatcaaaccttggttgatggataacaaggtggttgttggagttgggaatatctatgccaatgaagctctgtatgttgcgcatattctgcctgagcgccctgtgaattcattgacacaggaagaagcttatttactggccgatacgataaaacagatcttacatcgctctattgagcagggaggcactacactgaaagattttctacaatccgatggtaagccgggatattttgcgcaggaattatttgtttatggcaaaaaaggtgaactttgtccgacatgtggtgaaaaaattgagagtataaaactggggcaacgcagcacgtttttctgtcgtcagtgtcagcattaa

SEQ ID NO: 3471 - DNA, 1236 bp, Xenorhabdus bovienii
  Coding sequence Name=Xb4151_4152.C439.gene39.dna; Position on contig =30757..31992bp; Strand=+
atgcttgatataaaaaacagatttaacataggcaacaacaagaaatccttatggaatttatccattattggtctgtatatcattcttgtttatctgccggatattacaagatataaaaatcttgtcatgatcctcatctgtgcaaccgcactctgctatctcgtaaaagattttcgtcaggtagtcaattcactacgtagttcgctatttttatccattttgttattcgtcttggcaatattctattctatcggcatttcaattgattctgctctgagtttcaaggagatgaacaaacccatactcaatggattactgctgttcagcgtgactttcccaattgtgctctatcaggaaaagaaacagcacatcgcgaagatgattctgattgcgtttattattggcatgggtcttatctcgctaacagatattgcgaaatacctcatcaattattacgcaactggcgaaatgccgtttatgaattacaatcatcgggaattttcttacggatttctattctatttccctgtattgctatgtacctgggcattatggaaaaaacattctctactgagttggctactactgattattgcctcagctatcagcctgttcttattactcggtactctttctcgtggtgcttgggttgccattgttgtagccacagtatttattattgtgattaatagagagtggaaactcattctggctgcgacaatatgtctggggctactggccggatcaattcactggtcagcggtatctaaccccgccacgaaattgctgcttcacaaactcacccaaacagacagcagttatcgctatagcaacggcacccaaggttcagcatggtcattaatcatggagaatcccgtaaaaggttacggttttggtaataaagtctaccatcaggtctacaatagccgtgttgctgattatcctgattggacattcagaacttcgattggtccacataacgtatttttatcgctttggtttgctggcggtctcttcggtttgattaccacccttttgatgacgctttccacattatttacaggaagccagatcattcgccagcatagcgggatcatccgacaagctggcctcatccttctgacggcctttattggtctgtttatcgtcaggggagcttttgaaaatgcctatatcaatgaaataggtatcttattcggtttaatgattgcgctatacaagcaaaaagatgattag

SEQ ID NO: 3472 - DNA, 105 bp, Xenorhabdus bovienii
  Coding sequence Name=Xb4151_4152.C439.gene40.dna; Position on contig =32008..32112bp; Strand=+
ttgttaaatgccagcccacaatgggctggcctacaaacgatttcagtaatcgcttatttagacaggttttccgctatcacttgcatgataagctttgcacgctga

SEQ ID NO: 3473 - DNA, 1179 bp, Xenorhabdus bovienii
  Coding sequence Name=Xb4151_4152.C439.gene41.dna; Position on contig =32061..33239bp; Strand=-
atgaagattgcgtatattgacccttatcccgtacctgattatcgagttgcttcgttgcagattttgcagaatgtcgatgcttttgcccgtcaggggcacagcgtctgcctgattacgccagaaggtcaaaatcgtgttgaggagattataggcagagcattgccgccttccgctgaactgatagctctgcgcaatatgcgtagaaagtggtattttcccctcaatacacagaaattgttttattttcaggtttctcgctggctgaaagatcatcaagttgacgctatttttactcgcaatattaaaatggcgaattatctcctgcgtaagcatcctgatattccgcatttttttgaaagccacgaagtttttgcccaatcgtttaaagaatcccataaattagataaacgtaaaaatcgccgtaaatatcataagctcagaaacacggaacaacaggtttatcgccattccaaggccgtgtttgtgctgacttcactattgagtgaggatatttataaagaatatagcgttaagacaccgatgatagtagcacctgatggtgttgatatgctggcggttgaatctacaaaaaaagcgtcttctggcagaaggcacaaaccgggagaaacaactcaggtgctgtatttgggtagtttgcatcgctggaaaggtgttcctactgttatgaaagcgatgtattaccttgataatgctgtactgaacattgccggtggtgatagcgtgcagattgaacgattgaagtgtacagcccaacagattggcgtgagtgataaagtcaatttccttgggtttatccagccgaaaaagcgttttcaggttattgcagagaatgatatttgcgttttaccattaacgaaaaccagcattggcagccgttatacatcccccctcaaactttttgaatacatggcaatgggcaaacccgttgttatttctgattttccttctattcgcgatgctgtggatgagaaggcggtcaattttgctgatagcgaaaatgcagagagctttgcagagcagattcaatcattgattgataaccctgctgaaatgatggctaaagtgggttactcacagcgattggtagcagaacgttttaactgggatcagcgtgcaaagcttatcatgcaagtgatagcggaaaacctgtctaaataa

SEQ ID NO: 3474 - DNA, 1104 bp, Xenorhabdus bovienii
  Coding sequence Name=Xb4151_4152.C439.gene42.dna; Position on contig =33239..34342bp; Strand=-
atgaaaataggatttatcgatgtcaccgttactatgtcttatggcggtattcaaacagcggtttgggaattagcaaaggctttgacagatgcggggcacgagatccatattttcggcggaacaggtgacgttaggccagtattgggagagcgaaatattcatgttcacacatttccatttactcccagagaacgagtcatcaatattgggcgacgttttcaacgtattgttgagcgttattcttttgcccgtcatgcccgtgaaagggtcatcgctgaaaattttgactgggtgattttgacgaaaccctttgattttttctggcccagaatgatgccgaaaacttcctgcacaaagttttgttatatgagtggtggcaccagttttttcaaaggtgatcgggcattgggtaacaaaatatctgcgtgggttgcatgcagccactttaatgcttggcagatccagcaccattttaaacaatttccaaacgtgatttataatggtgtcgatattgataagtttaaacctgttaattctgatctccggcatcggctagatatcaatgaaaatacgtttttgctgactttcgctggcaggctggtgggttggaaaggcatgaaagtcgccattgatgcgatggctttactgcgtgacaaggatgtaaggttattgattattggcgcaggtgatgatcttaacttattgaaaaaaaaagtttctgaactgaatttagaaaaaacagtcattttccatcctcctgttggtcatgatcaattacctgaattttatgctgcgggagatgcgggtatttttcccagtattggtgatgaagcatttggtattactattgctgaagcgatggcatgcggacgtcctgtgatagccagttatattggtggcattcctgaggtggtcggcaatgaaaatcatgcgggtattctggtcgcacctggcaatgcagcggctatcgctgaggcagtcaatcatcttttgtccttgccggacagggggaaagcaatgggaaaactggctcgtcagcggattgaaacgatgtatacttgggaacattctgcaaatcgtttattgggcgcgataaaaaaataa

SEQ ID NO: 3475 - DNA, 411 bp, Xenorhabdus bovienii
  Coding sequence Name=Xb4151_4152.C439.gene43.dna; Position on contig =34357..34767bp; Strand=-
atgcagcctaaaaatattctggttattattattgcccgttttggtgacactttgcttataacgccagtgatccgggcgttgaaattacgatggcctgaagcgaatattgatgtattggcacataaaaaaacgaaagagatccttgagaatattagtgaaattcattcaataaccgctttttcaaagggacaggcaaaatggaggggatggttttcccgtcgacgttatgattttgccttagtataccatagttttcatcctggccgttttcttgctcctcagcaacatccaaaattggcggtgattgaacatccgatagattatcaacaggcgactcgccaagatgaaatgtcagcaatatcggttgaacaagtctgggtttccgttcagaacttgttggaaaatacatga

SEQ ID NO: 3476 - DNA, 1116 bp, Xenorhabdus bovienii
  Coding sequence Name=Xb4151_4152.C439.gene44.dna; Position on contig =34972..36087bp; Strand=-
atgactaaaaaaaccttgaatatcttacacactgaatcatcgtgtggttggggggggcaagagatccgcatcctgacggaatctcagggcatgatacaacgcggtcatcaggttgttattgtttgttgcccagcgtcaacgatttatcatgaagcccattcgtatggtgtacctgttgttgcactgccgattgaaaaaaaacgccttccctgcttgcgggcgatgcgccgctggctaaaagccgaaggccgtcaatttgatgtcatcaatactcatagctctactgattcttggttagtggctgcggcatgtgccacattgcaaggtatgccaccgatagtccgaacccgccatgtttccactaacgtatccacatctgtggcgactcgctggctgtatttgaaatcctgtcagcatattgtgacaacaggggagaagttacgccaatatctgcatacgaataatggttacccattacctcacatgacctctgtgccgacgggaatcgatctgacgcgttttcatcccgaaaataagcaactttgtcgtcagcgtattggtatagcggataaaccgaccctgggtattgtcgctacgatgagaacctggaaagggcaccgttacttgcttgatagttggaaaatattgcactcgtgttatcccgactggcaattactgtttgtgggggatggtcctcagcgaaaaaatctggaaccccaggctaaacaggaagggctgtcggagagtgtcatttttctcggtaaccgacaagatgtgcctgattgtctgaatgcgatggatgtctttgcactaccttcgtttggcaatgaaggtgtgccacaaggcattatgcaggcaatggcctgtggtttgcccgtagtatctacttcggtgggcgcaatcactgaggccgttattgatggtgatacgggttatattatcgagccaagatgtgttgaacagttaactgaaaggttagatgttttaatgaaaagtgctgagttgcgtttgcagatggggaacgcctcattggaacgggctgccgatttatttagcatggataatatgttagaaaaaatggagtttatcttttacggtagtatggagcgtaaatag

SEQ ID NO: 3477 - DNA, 153 bp, Xenorhabdus bovienii
  Coding sequence Name=Xb4151_4152.C439.gene45.dna; Position on contig =36150..36302bp; Strand=-
ttgatccagttattcgccagtatgtggtgtataaagaagctaaaattaaataattttagtggattgagaaaaaacccagcgtatgctgggtttttttatacctgccagaatgtttggatagcttggttaaaaacaggttatgcatggacgtaa

SEQ ID NO: 3478 - DNA, 168 bp, Xenorhabdus bovienii
  Coding sequence Name=Xb4151_4152.C439.gene46.dna; Position on contig =36250..36417bp; Strand=-
atggctaaaggtattcgcgataaaattaagctggtttcttctgctggtactggtcacttctataccactacgaagaacaagcgcaccatgcctgaaaaactggaactgagaaaatttgatccagttattcgccagtatgtggtgtataaagaagctaaaattaaataa

SEQ ID NO: 3479 - DNA, 237 bp, Xenorhabdus bovienii
  Coding sequence Name=Xb4151_4152.C439.gene47.dna; Position on contig =36429..36665bp; Strand=-
atgtcccgagtctgccaagttactggcaagcgcccggtgagtggtaacaaccgctcccatgcattaaatgcgactaagcgtcgttttctgcctaacctgcattctcaccgtttctgggttgagtctgagaaacgttttgtaactctgcgtgtaactgctaaaggtatgcgtgtgattgacaaaaagggtatcgatgtagttctggcagaactgcgtgcccgtggtgagaaatactaa

SEQ ID NO: 3480 - DNA, 228 bp, Xenorhabdus bovienii
  Coding sequence Name=Xb4151_4152.C439.gene48.dna; Position on contig =36664..36891bp; Strand=+
atgtctattctccaaaaatcaaatcagctcgagctttatattgggtatgaccgcctcgtcaggcttaggagcccatctcagcacattttcatcactgaaaagactcacattatctcaataaaaaaacttactgagataggctcttctcgccaaacccaagatcctcaaaggtggcgtagtatacgccctcattcgctgatgctcaagtcccgaacaactaagatctga

SEQ ID NO: 3481 - DNA, 693 bp, Xenorhabdus bovienii
  Coding sequence Name=Xb4151_4152.C439.gene49.dna; Position on contig =36913..37605bp; Strand=-
atggatgttacggtgatggaaataagcgatgaattgcattcaaatcttgctcctcgggagaaattgctggcttatggcgccgtttccctgacggatgccgagttgttggctatatttttgcgtacgggaacccgagggattcctgtcgtgcaaatggcggaacatctactgaaatcatttggttcactttatcacctgctctctgcggattatgccgatttttgttcacataaagggatggggctatgcaaatatgtccagttgcaggcggtatctgaactggcaaaacgttttttctccagtcaatttatccatgaagatgtgatgagtagcccagtcgcgacacaaaattatttgcaggatttattgtcctggcaggatcgtgaagtctttgtggtgctgtttttgacgaatcagaataaagtcatctgtcatgatgaaatgtttaagggaacgataaacaaagttgaagtgcatccgcgtgaaatcgtgaaacaggcggttaaagtgaatgctgcatcgattattcttgctcataaccacccctccggtaatccagaacccagtctggcagataaattggtgacagaaaaaattattgatgcttgtgagttggttggcgttaaggttttggatcatatcgtgattgggaagcaacattgcgtctcatttgtggaaagaggttggatttag

SEQ ID NO: 3482 - DNA, 162 bp, Xenorhabdus bovienii
  Coding sequence Name=Xb4151_4152.C439.gene50.dna; Position on contig =37590..37751bp; Strand=-
ttgagaacctgccttattcaggtgccaaaaaatgacaagtttgcgaagcgctacgcaagccatgaaaatggggctggcgatgcttttttcatcatgggatattggcggcgtgaagccactgggcgaaagggaatgagggggaatatatggatgttacggtga

SEQ ID NO: 3483 - DNA, 102 bp, Xenorhabdus bovienii
  Coding sequence Name=Xb4151_4152.C439.gene51.dna; Position on contig =37748..37849bp; Strand=-
atgtttaccagaaagctgtttgctggaaaatcctgccattctgattgtccacatgtaagttacaattacctaagattctaccataagaaaatattaagttga

SEQ ID NO: 3484 - DNA, 1230 bp, Xenorhabdus bovienii
  Coding sequence Name=Xb4151_4152.C439.gene52.dna; Position on contig =37811..39040bp; Strand=+
atggcaggattttccagcaaacagctttctggtaaacatatcgtgctcggtatcagcggggggatcgccgcttataagacagccgagctggtacgccgtttacgtgatcgcggtgccgaagtacgcgtcgccatgacgccagcagcagaagcttttattacgccactgaccttgcaggccgtatcgggtcatcctgtctccgatgaccttttggatcctgccgctgaagcggcaatggggcatattgaactggctaagtgggctgatttgattattctcgctccggccacagccgatctgctcgctcgtttaaccgcaggtatggcaaatgatttggttaccacgatttgtttggcatcagcagcccccattgctgttgctccagcgatgaatcagcagatgtatcgtgcgcaggcaacccaacataacctgaatgtactcaaagagcgtggcgtgctgatttgggggcctgatgagggaagccaggcatgcggtgacgtcggcccgggaagaatgcttgaacccatggcgatggtcgaactggcaacacaacatttcaacaccgatcaggatttctccggtctttgcatcaccattaccgcagggccaactcatgaagctttagatcctgtccgctttatcaccaatcacagttccggcaaaatgggattttccatcgcacaggcagcagcggaacgcggtgctgacgtcacattgattgcaggtcccgtcaatttaccgacaccaccgggtgtcaaacgtatcgacgtaaccagtgcgctggaaatgcatgagtacgttcaggtaaccgcagcttcacagcatattttcatcggctgtgccgccgtagcggactatcgtttcaaacaaatagcgacggagaaaatcaagaaacagggtgatgaggtcacatttacactggtgaaaaatcctgacattgtagcaagtgttgccacgatggaaataaatcgtccatttgtcgttggatttgcagccgaaacccagaatgtggaagaatacgcccgcagaaaactcaagcagaagtctctggacttgatttgcgcaaataatgtatctctggccgaacatggcttcaacagtgataccaacgcattacatctattctggcatgatggcagcgttaatttacctcacagtagtaaattacagctcggccactgtttattagacgagatactcaaacgctatgacgaaaaaaatcgacgttaa

SEQ ID NO: 3485 - DNA, 459 bp, Xenorhabdus bovienii
  Coding sequence Name=Xb4151_4152.C439.gene53.dna; Position on contig =39018..39476bp; Strand=+
atgacgaaaaaaatcgacgttaaaatccttgatccccgcattggacaagaatttcccttaccgacttatgctacacctggttctgcgggtttagatttacgtgcttgtctggataatgcagtagaactggctccaggccagactgaactcctgccaacagggatcgccatccatatcgcagacgaacaattggcagcggttattcttccccgctccgggctgggtcacaaacacggtgtggttctgggcaatctggtggggcttatcgactccgattatcagggacagctgatggtttcagtttggaaccgtggtgataagatgttcatcattgaacccggtgagcgcattgcccaaatggtttttgtgcccgttgtacaggccgaatttaacttggttgaagattttgaaaccagcaaacgcggcagtggtggttttggtcattccggtcgtcaataa

SEQ ID NO: 3486 - DNA, 183 bp, Xenorhabdus bovienii
  Coding sequence Name=Xb4151_4152.C439.gene54.dna; Position on contig =39470..39652bp; Strand=-
gtgccagtgtctgtaagatttcctcacgtctatttttcttttttgtacgttctttttctgccatgtctgataagacccctgctaaaacagcaaaacaaatccagctattttttgcccaccacgatcatgggcaaaaaatatgaaaatcggttgacggtatcaggctttatggaaagttattga

SEQ ID NO: 3487 - DNA, 600 bp, Xenorhabdus bovienii
  Coding sequence Name=Xb4151_4152.C439.gene55.dna; Position on contig =39589..40188bp; Strand=+
atggcagaaaaagaacgtacaaaaaagaaaaatagacgtgaggaaatcttacagacactggcacatatgcttgaatccagtgatggcagtcagcgcattaccacagcaaaactcgccgcaaatgttggggtttctgaagcagcactttatcgtcattttccaagcaaaacccggatgtttgatagcctgattgagtttattgaagacactttgatttcgcgtatcaatctgattctgcaagatgaaaaagacaccattacccgcattcggttaatcctcatcctgcttttgggatttgcggaaaagaaccccggattgacccgtatcatgacaggtcatgccctgatgttcgaacaagacagactacaaaaccgcattaaccaactatttgaacgtattgaagcgcagctccgccaaattttaaaagagaaaaaaatacgtgatggacagggattcaattatgacgaggccgtactggcatcgcagctactggcgttttgtgaaggaatgctttcccgttttgttcgttctgaattccgctatcgcccgacccaagagtttgaaatacgctggccattgatattaactcaactgcaataa

SEQ ID NO: 3488 - DNA, 141 bp, Xenorhabdus bovienii
  Coding sequence Name=Xb4151_4152.C439.gene56.dna; Position on contig =40171..40311bp; Strand=-
atgccattactgagttactttatagtaaactcaacgagaagatgcatattaacacaattcaacgaaaaaaccgcacgttatcattctcagcatgaaagagggaatttcacggtgcaggctcagttattgcagttgagttaa

SEQ ID NO: 3489 - DNA, 189 bp, Xenorhabdus bovienii
  Coding sequence Name=Xb4151_4152.C439.gene57.dna; Position on contig =40305..40493bp; Strand=+
atggcatcgttaccgtattacatgcggggtgtcatttctactactcaccccgcccggccattgggcgagggttttttttatctctcagccgtttttacccagcgggcaatcagataccgtattctctgcgataggcttccaccgccgccaaataaggctgcatatctggattttcacgtagatatctaa

SEQ ID NO: 3490 - DNA, 642 bp, Xenorhabdus bovienii
  Coding sequence Name=Xb4151_4152.C439.gene58.dna; Position on contig =40414..41055bp; Strand=-
atgaaagcctatcaacgcgaatttattgagctggcactgaaaaagcaggtgctgaaatttggcgaatttacgctgaaatccggccgcaagagtccctattttttcaatgcagggctgtttaatactgggcgtgatgtggcattgattggtcgtttctatgcagcagcactgttggatagcggtatttcgtgtgatctgctgtttgggcccgcttataaaggtattccgattgcaaccacaacggcagtcgcgttggcagaacgtcatgacatcgatatgccttattgctttaaccgtaaggaagctaaagatcatggtgaaggcggatcactggtcggtagcccactacaaggtaatgttgttgttgttgatgatgtgattacagcaggaacagctatccgcgagtcgatggaaattatcaaacaacacggtgcaacgttgtctggtgttattttgtgtttggatcgtcaagaacgcgggcaggagacgctttcagctattcaggaagttgagcgtgactatcactgcaaagttttttccatcattactttgaatgacttgattagatatctacgtgaaaatccagatatgcagccttatttggcggcggtggaagcctatcgcagagaatacggtatctga

SEQ ID NO: 3491 - DNA, 729 bp, Xenorhabdus bovienii
  Coding sequence Name=Xb4151_4152.C439.gene59.dna; Position on contig =41144..41872bp; Strand=-
atgagtccagtaggaaagcgtccagcaggaagaacggcagggcaggtgcgtcctattaaaatgacccgtcattacaccaaacacgcggaaggctcggttctggtggagttcggggataccaaagtgttatgtaatgcctccgttgaagaaggaattcctcgtttcctgaaaggtcaggggcaaggttggatcacggctgaatatggcatgttgccacgagcaaccaatagccggaatgcccgcgaagccgccagaggaaagcagactggccgcacaatggaaatccagcgtctgattgcacgttcactgcgtgccgcagtagatttgaaaaaattgggtgaatataccattacgctggattgcgatgtgattcaggccgatggcggtacgcggactgcggccatctctggcgcgtgtgtggcactggtggatgcactgaacaagttggttgctgatggcaagctgaaaaaaagcccgatgaaatcaatggtagcggcagtgtctgtcgggattgttgagggtgaaggtctttgtgatctggaatatgttgaagactcggcggctgaaactgatatgaatatcgtcatgatggatgacggccggatgattgaagtgcaaggcacggcagaaggtgaaccgttcagccatgatgaattgctctcattgctttccctcgctaaagaggggttagaaacgatttttgcagcgcagcgagatgcgttgaaataa

SEQ ID NO: 3492 - DNA, 135 bp, Xenorhabdus bovienii
  Coding sequence Name=Xb4151_4152.C439.gene60.dna; Position on contig =41874..42008bp; Strand=+
gtgttctctccgctgttaaaacattattgggggcgcattatacgacctaacacggcgaatgcctatcctgcatctacgcggagagttataatccgctcatcattctataaattggaaacgaattatgatccgtag

SEQ ID NO: 3493 - DNA, 864 bp, Xenorhabdus bovienii
  Coding sequence Name=Xb4151_4152.C439.gene61.dna; Position on contig =41998..42861bp; Strand=+
atgatccgtagcatgaccgcttttgcgcggcgagatatcaaggccgattggggaaacgcagcatgggaactgcgctccgtcaaccaacgttacctggaaacctacattcgcctgcctgagcaattcagaagccttgagccagtcatccgcgaacgtattcgttcccgcctgactcgcggcaaagtagagtgtaacttgcgttttgatctggatacccgtactcagggaaccttgatgctgaatgaaaatctggcaaaacagctggttgaggcagcaaactgggttaaacagcaaagcaatcaaggcgaaatcaatccagtagatatcctgcgctggccgggcgtgatgtccgccgaagaacaggatttagacaccatcagcatacaattgctggcagagcttgatctggctcttgatgcctttatccagagccgtgaaacagaaggtcaggcacttaagacgctgattgagcagcgtttggatgcagtgacggaagaagccagcaaaatccgccagcaaatgccagaaatcttacaatggcagcgtgagcgcttacagaccaaactggaagaagcacagattcagttggaaaataaccgtcttgagcaggagctgattctaatggcacagcgcattgatgtggcagaagaactggatcgtctggatgctcatgtaaaagagacacgtaatattctgaagaagaaagaagccgttggccgtcggctggattttatgatgcaggaatttaaccgcgagtcgaatacactggcgtcgaagtcaattaatgcggatgtgacaaattcagcgattgaattaaaagtgctgattgagcagatgcgcgagcaaattcaaaatatcgaatag

SEQ ID NO: 3494 - DNA, 114 bp, Xenorhabdus bovienii
  Coding sequence Name=Xb4151_4152.C439.gene62.dna; Position on contig =42886..42999bp; Strand=-
atgtgctttgggtacacctttgggtacaccctaatcatgcgctactgtgattcactctgcaatgctctgataacaaaaaagccagatacaacaaggtgtatgctggctttgtga

SEQ ID NO: 3495 - DNA, 150 bp, Xenorhabdus bovienii
  Coding sequence Name=Xb4151_4152.C439.gene63.dna; Position on contig =42950..43099bp; Strand=-
ttgcctgactttatccacgccctgatctctttattggtgagtttaggcattgtgcaatctccaatgaaaaatagggggtgtacccaaaatggttttctaaatgtgctttgggtacacctttgggtacaccctaatcatgcgctactgtga

SEQ ID NO: 3496 - DNA, 1272 bp, Xenorhabdus bovienii
  Coding sequence Name=Xb4151_4152.C439.gene64.dna; Position on contig =43050..44321bp; Strand=+
atgcctaaactcaccaataaagagatcagggcgtggataaagtcaggcaaaaggttcgaggggaaagcggacggtaacgggctatatttacgttttagagaggctgaccgaattccatcatggcgtttcagatataaattggctggaaagtctagaaccatgaatttaggaacgtatgctgacctatcgctagccaaagcgcgagagcttacccgtgagttatccgcacgtgtttcgctgggctatgacgttgctggcgaaaagcaagaacgtaaagccgaagcactggcaaaaattgaggctgaaaagaacgctatcaaagtatcagacttagcggctgagtattttgaacgtcagatactgccacgctggaagcaccccgacatactccgcagacgcatagacaaagacattaaccctcgcattggtcatatgaagttggaggatgtaagaccccgccacattgatgaaatgctcaagagcattgtagacaggggcgcacccactatggcgaccgatgttctacggtggctaaggcgcatgtttgattatgccattaagcggcagatgatagagattaacccgtgttcggcatttgaggttgcggacgctggcgggaaagaagtatcacgcgatagatggctaaccagagaagaactgatcattctactgagaacgttcagaacgtcttcaatcagccgccagaatgaaatcagttttaagatactgcttgctctatgcttgagaaaaatggagctatgcggcgcacgttgggaagaattcaactttaaaaaggcagtctggcactttccggcagaacgtagcaaaaacggtgatgcggtagatatcccactgtgcccacaggttatagagtggtttatggaattaaaggctatggcttgcggtagtcaatatgttctaccagccagaaaaatgcagcatcgcatgatcccacatattcaggaatctaccttacccgttgcgctcgccaaagtaagacgggaattacctgttgatatgcctaacttcactatccacgactttagacgaactgccagaacccacttagccgcgttaggtgtagatccctttgtagccgaacgttgcctaaatcaccgtataaaaggcgttgagggcatctataacaggcatgattactttgatgagcgtaaagccgcactagctcaatggtgtgatttgctggtagcgctggaaaaaggcgaagactacaacgttactccaataaaacaaattaaacggaaatttttatga

SEQ ID NO: 3497 - DNA, 738 bp, Xenorhabdus bovienii
  Coding sequence Name=Xb4151_4152.C439.gene65.dna; Position on contig =44318..45055bp; Strand=+
atgaagaagccacctgagattgatagatttaagttattttcattccaaggacgtgcaacacccaatgctgtagctctttcacttcttggtattaacccttatgcagcagttaaagatataccggaggaatattcagaaaatgttaatatgctaagaagtgctattgtgaataatgtaaacgctgtcaatccgttacaggacacaaaaacaaactcagcggttgattctgatatcgtatttggtgctgcatatccgtacgtgtgccttttagaagaatttataccagagatcattaaatcaagaatagaacaagctctaaacaatatatatacaaagtataaaaatgatgagtggaaaacatacattcacgcccttggtggacaagaattagttcaaaagatagcgatgcagaataaaaaaggtcagggacaatatcgcaaaaatgatgagcaaaaaggaacttacaaactgattgggctacttgtactactactgcaagaaaaaactataaatggctgtcaaccatcaaacaattacggctcaataggtaagcctaacaagaaaagaatttatgaagatatcaaagaattagttgatggaatgaacaaagacttgttagctgacggaattaacaaagactttttaggtggtgttggatcctccacattctatgacaaactaagagatgctgattactacttaaacgagagcgatgaacaattggttcataaccaatag

SEQ ID NO: 3498 - DNA, 93 bp, Xenorhabdus bovienii
  Coding sequence Name=Xb4151_4152.C439.gene66.dna; Position on contig =45411..45503bp; Strand=-
atgggcttgtatttttcatgcgtgggtttttctgcttcaccatgctgcttctggcctccctatgttatgcctatctctgttgtgacgtgttag

SEQ ID NO: 3499 - DNA, 243 bp, Xenorhabdus bovienii
  Coding sequence Name=Xb4151_4152.C439.gene67.dna; Position on contig =45461..45703bp; Strand=+
atggtgaagcagaaaaacccacgcatgaaaaatacaagcccataccctgaaatcggtaatgcacgtaaacgccataccgcagactttctgggtatatctgattcaacgttacaccgttggattaaagataaaaagataccgcagccttttgaattagaggatggtttttttgtctttgatgcagcagaaatacgtaaatgggtagaaaataaaaaatcacgaagagaatctatagttatataa

SEQ ID NO: 3500 - DNA, 840 bp, Xenorhabdus bovienii
  Coding sequence Name=Xb4151_4152.C439.gene68.dna; Position on contig =45838..46677bp; Strand=+
atgaatgaagtatcattctataaagatgaaaatctatcatatatctttaactacaagttcataccgtttgaagagaacggtaaagatactgggtttatgattcgaactattgaattatataaactggcaaagatgaaagattcaataaaaaaattcactgaactcacagggtttaactttgataatctgatcccctctgtagaggaaataaaacttcttattaagagaggacgaagtgttgtatcaaattattcaaagcttcctgaaaaagaggatgccgagctgaaaagtatggttgacatattaagcaatgctcaaagcggtaaaataaaaaatcctaacagctattctatcagtaaccgagcttggattacagatatgcaccacgcagtagaaaggaaagaagactctattaagcgtgagagaggtaaactggagaaagtgaatggtctctatggtttactatatccggttattgaatggttattttctgaaaaaataatggggtttaaaaaagaactattagaatctatccccagagaaacagtgaatttaaatgctttactatccggaatggattgggaacatagtcgcgcatgtaaactaattatatcagcgacggatgagttagaacgttgtattaataaaatcattagtcaatgtgttactccaaaagataaatatacgttaaatcatactcccgtttatcaaagtgattactataaattatattacagaaaagaaagtcatcatttaaagcatgtgttaaccgctgatgaatacgttaataccatggttaatgctaaaaatagaactaaagataaattgagctatatgtaa

SEQ ID NO: 3501 - DNA, 1020 bp, Xenorhabdus bovienii
  Coding sequence Name=Xb4151_4152.C439.gene69.dna; Position on contig =46698..47717bp; Strand=+
atgtatattaccgccattccagatgcggccagaacttttcatgccaattttacccgtggggctgaatacacctctagcaatagtaatacttttgctatttctcctccctctgaaaatttattacgcgttgctatttcagattcaagttggtttttaaataaattgacgctagcggatgtgagccaagaaaacggcgatacggttaatttaggagataataccctccatacgggaagagttattgacggccgattccataaacgtgtcaacatggaaggtgctccttatgctttagaagaaacagatacctgcgctgcaatttcttatgaacaaatgtcactcattgccaacagtggcagtggggatgatgaacactttactaaaattatgtctgacttgttttctaaaacggtttcgttagacatgatcagaatcggctttaatggtgaattctgtgcctatccgactcaacccgatatctataaacgcgggcaagatgttaataggggctggcacgcaatagcgaaagaatttaatcagggttcacaagtgatcaccgataaaatttccttaggcaagaatggggatttccctaatttagatgctattgcaaattatcttatcatcaagaaaatccctgaagagttccgcgaagatcctcgcttagtggtcttggtcggttcagaactggcggcactctatcgagagaaattatttagtgcttcggataaggcggcagatattcaagccagccaactggcactcagtaccattgcgggacgctttgcgctcattccaccgtttatgccaggtcgtcgattggttgtgactacattagataatttgcatatctatacgcaaaaaaatacccggcgtttccgcgcggaatttgtcgatgaaagacaggtgtatgaacacagttatttgcgtaacgaaggttacggcttaggggatggcaacctttatgccgcagttgatgaaaatgcgatccacattgaagaaggggtattttcgctatga

SEQ ID NO: 3502 - DNA, 522 bp, Xenorhabdus bovienii
  Coding sequence Name=Xb4151_4152.C439.gene70.dna; Position on contig =47714..48235bp; Strand=+
atgagtgaatcgcagttaatgaccacttggatttgtgttgcaacagagggacaaaccattgatagacgtgttatcgaagcgcaatggctgaatgaaatagcagaaacctacgatcccaattattacaccgcactgatctgggaagagcataaccgcaatctcgataatttaggggaggtactcgcagcccgaaccgatgtcattgatggaaaagcacggctctatttgcgattaagaccgaatctaaagctcatggaatataacagacaggggcaaaaattattttgctctatcgaggttcaagaggatttccaaggggagggtattttttatttgggtggtcttgccgttacagacagccctgcgagtgttggaacagacagattaaaattcagtattaaccgttctcacttttcccgaaagaaaagtaagttttcgattagttcaccggtagtatttaacctttcggatggactcaagaatacgaaaaatcgttggtttacagcaatctccgcaggttaa

SEQ ID NO: 3503 - DNA, 96 bp, Xenorhabdus bovienii
  Coding sequence Name=Xb4151_4152.C439.gene71.dna; Position on contig =48213..48308bp; Strand=-
atgattaaaatcggcttaaactacgaagttgatagggatgagaaaacagcccagcctaaactgggcaaaagagttaacctgcggagattgctgtaa

SEQ ID NO: 3504 - DNA, 513 bp, Xenorhabdus bovienii
  Coding sequence Name=Xb4151_4152.C439.gene72.dna; Position on contig =48307..48819bp; Strand=+
atgaaaataaaaaggttgcatccgtctgaacggttgggctatattggaaacacgttagcaaaatctaacgtcaggcgtggaaacctgagaatagtaaaggcgacagtagacgccacatgcgtctttttttgtgtcgtaaataatgcctatctaatggcggcctacgcctatctgaattcaatggtggcgttgtcggagcacccgaaagggtggctggtttcctttactaccagtatttccacctctgataacgtcaccgcccctattgagcgtggaaactctggcggtgatcacttttacaaagtaaaggagatcatctttatgatgacagtccctacccaaactcaatttaaatttatattcctgtgcgtaaaacgttctgatactaccgctaaaccattccgtatagaggctacagcgctagatgaacacaacgcaagaatactgcttgttcatgattttgttctcttgtttgcagggcgtttacctgtgcagccaaagagagagaattga

SEQ ID NO: 3505 - DNA, 219 bp, Xenorhabdus bovienii
  Coding sequence Name=Xb4151_4152.C439.gene73.dna; Position on contig =48822..49040bp; Strand=+
atgacaaatacaatccataaaaatgccgtcatttctgctacaggcgaaaagcagctattaagagtggcgcagatgacggcatttctcgccgaattattaaataacagcgaagggaagcctatttcaagcgaaggcatggcagtcgtcatggagtgtttatcagaacaagttgaactcattattgaggaaagcagcctaatgaacagggatattaaataa

SEQ ID NO: 3506 - DNA, 2715 bp, Xenorhabdus bovienii
  Coding sequence Name=Xb4151_4152.C439.gene74.dna; Position on contig =49040..51754bp; Strand=+
atgaataatcaaaactatccagacgcttcaacgataccaacaagcataccttccgtgacggatatcgttaaggcagccaacgggcgttggtattatattttaagcaatttaggggtatctgtacccgaaaataacaagcatggagcttgccctaaatgtggtggcaaagatcgctttcgatttgatgataaaaacggtaaaggaacgtggttttgtaatcactgtggcagcggtgacggactcgatttaattaaactggtgacaggtcaagatattaaaacgacgtgtttcgaaatcaataaaatactcctcttacctgagtttaaaaaaataacgccaaccagaataaaaaaggctagcgcacaaaaaggtatcgagctatttgaaaaactgaaagccttatgtctttcaggcgaaagccaatatctctcaaacaaaggcttaaccaatcatcaatatttaattacgcagcaacaatatacgcaaggtgggattatttttccaactggatcacttttattgccattagttgataaccaagtttcaattaaaggcgggcaattaatcagcccgaaaggggaaaagagcctgttatccggttctgtgctttcaggttcatttattgtcgtcgctgataagacggataaaaacattgaacaggtggtgattacagaaggttttgccacagggttaagcctgtcaaaagtgattgatgctttcattgtggcggcggttgctgccactaatctggttaaagtcgcacaacagttgagagaacgatggccacaggcaaaaattattattgccggtgataacgattttattgatggcaaggaaaacacgggcaagttatgggcagaaaaagcggctaaggcggtcgatggttgggtaactctgccacctactcactataaagcggattgggatgattaccgacaagaaaacagtgacaacaaggtaaaagaggctttctttgaagaaatgatctactgcggaaaagataaagcctatttacctcaaggttttcgactcactcaagaatatttatggtatgacaagcttgtcaataaatcggatggtgataccgaagtcaggaacatcaaaattagtagcccgataaaagtgactgcaattacctgtgatgctgacagcagtaattacggacgtttattagaatgggaagatacttacggtaattgccgtaagtgggctatgccgatggaaatgttaagcggaagcggtgaagaattacgccgagtgcttttggtgaacgggctatcctatatcaatacttcagggcaggcacgggcgcacttgatggaatacatatcactgtgtcgaccagagaaaaaggttacttgtgtcaataaaactgggtggcacggtaatgtgtatgttttacaagatgaagttgtcggttcaggtgcggattccgttattttgcaaacctccagtgtccaaggcaaagattttagagtgtcgggcacaagtgaagaatggagagaacacataggcaaatattgcacaggaaacgcaagactcgccttttccgtgagtttagcctttgcctcatcattactgaaattagttggtgtaggtggcggtggctatcacttaaaaggtgaatccacggatggtaagacaaccacaatgaaagtggctgcgtctgtctgtggtggaacagattactggtatacatggcgagccactggcaatgcgcttgaaggtacagcctgccgccgcaatgatgcaacattgatgctagacgaaatcagagaagttgacgggcgtgaggcgggtaatattgcctatatgctggcaaatggtcagggtaaggccagagcgaaaacagacggaagtgtcagagaaaccaaccgctggaatttacttttcttatcaacaggggaactctctttagttgaacatgcggcgaatgcgggcgaacgcacttatgcaggtgtggaagtgcgtatgatccaaattccgagtgattcaggtaaacacggtgtgtttgaagacttacaccagtttgccagcggtaaatcactggctgagtaccttgaacaggccgtgactaaatatcatggctcaccgttccgcgattggctgaaatacctcactcatgatctgacatctatctcaggaacggctaaagccttattgaaagaatataccgcaaacatgatgccagagaatgcaggtaatcaggttggtcgcgcaattacccgttttgcccttgttgctatggcgggggaaatcgcaacacgagcaggaattacaggttggcaacaaggggaagcgtatgcagcggctgaaaaatgtttagcggcatggatgaaagagcggggacacaccgcgaatcaggaagatattacggcattggagcaagtgaccgattttatttcacgtaaccaattcagccgctttgcggattggtacgatgagaatagtcgccctctcaatatgatgggctttcgtcgcgttgaaaaaggcactgcaaatcaagatccaactgttcaattttatgttttatcctccgcatggaaagagatatgcaagggctttgattcgcgcaaagtagcccgtttgtgtgttgaaaagggttggttagaagcaggcaaggacggcaggatacaaacgagtatacgcctaccagaaatagggcttaaacgggtttacttatttaatagtgacgtcttaggttctgccgaataa

SEQ ID NO: 3507 - DNA, 141 bp, Xenorhabdus bovienii
  Coding sequence Name=Xb4151_4152.C439.gene75.dna; Position on contig =51784..51924bp; Strand=+
atgtgtaacagtggtaacactggtaacaaccagttatatcaaggcttaccactgttaccagtcaattttggggagtggcaacaactggtaacaaaaataggctgttaccacttgttaccagttcgttttttggagtggtaa

SEQ ID NO: 3508 - DNA, 213 bp, Xenorhabdus bovienii
  Coding sequence Name=Xb4151_4152.C439.gene76.dna; Position on contig =52046..52258bp; Strand=+
atgaaagtattaaaagtatattgcccagagtgtgacggacaggcaacaatcaaaaaaatcaaaacgcaagaattgaataacataccggaaatttattgttgttgtaatgatgttgaatgtggtcatacatacgctttaaccctaagtttttcacattcgatacgtcctagtaagttggtacaagattcacgtaatcatgtattgaaattgtag

SEQ ID NO: 3509 - DNA, 147 bp, Xenorhabdus bovienii
  Coding sequence Name=Xb4151_4152.C439.gene77.dna; Position on contig =52212..52358bp; Strand=-
atgcagggtaggaggaaatgtaaactgaaattgtgtgaaatttcgcgttctgcatctgataattcttcccataaaattattgatgctatttctcagattgctacaatttcaatacatgattacgtgaatcttgtaccaacttactag

SEQ ID NO: 3510 - DNA, 117 bp, Xenorhabdus bovienii
  Coding sequence Name=Xb4151_4152.C439.gene78.dna; Position on contig =52561..52677bp; Strand=+
ttggtttgtagaattttaaaactgaaaaaactttttgatccaaaacgtgcaggcgggtgcggtgtagtgcgttttacgtcgggtttacgtttatttcgtggggattacgtggcgtag

SEQ ID NO: 3511 - DNA, 192 bp, Xenorhabdus bovienii
  Coding sequence Name=Xb4151_4152.C439.gene79.dna; Position on contig =52651..52842bp; Strand=-
ttgtacatttcttgggtgattattcaacaactcagatctcggcacggctcacctttaacggtgacttttacatcttcatataacgcaaccaatcgcacgctaagctacgcagataaaattttgcggtctagatggattcatttggttcacgtcactacatcacgcctacgccacgtaatccccacgaaataa

SEQ ID NO: 3512 - DNA, 225 bp, Xenorhabdus bovienii
  Coding sequence Name=Xb4151_4152.C439.gene80.dna; Position on contig =52848..53072bp; Strand=+
atgtacagatttggaggaatattatgcgtacatacacctcaactcaagcccgtgccaacatcgcggaagtgttggacacagcggctcacggtgaacctgttgaaatcactcgtcgagacggtagttcagcggtcgttatcagtagagctgaattcgatgcttggcaaaacgctaagctggatgcagagttcgattcgattatgcaacgtcatgggcatacgatag

SEQ ID NO: 3513 - DNA, 399 bp, Xenorhabdus bovienii
  Coding sequence Name=Xb4151_4152.C439.gene81.dna; Position on contig =53089..53487bp; Strand=+
atgatatgggtcagcgcacaggaagttatcgcttttcatgaccgaatattacaacggcttcccggcgttgccggaatgcccgattctggtagagctgaagcgctcatctatcgggtacaaaaccgtacacactatgaaggcataacagatatttttgaacttgcagcgacctattgggctgctatcgctcgtggtcatattttcaatgatggtaataagcgcacagcgtttttcgttaccatgacttttctctatcgtaatggtatcaagatccgtgataacgacaatacattggaaaacttaacagtagatgccgctacgggcgagaaaaccgttgaccagttggcgcagcacctgcgcgaattggtggactatactaacccgagctgtaatccatga

SEQ ID NO: 3514 - DNA, 126 bp, Xenorhabdus bovienii
  Coding sequence Name=Xb4151_4152.C439.gene82.dna; Position on contig =53611..53736bp; Strand=+
atgaataaattcaatcgaatagcatttcataacataccagaacatatcacaaagccagaatacaccttgttgtatctggcttttttactatcagagcattgcagaacgaatcacagtagcgcatga

SEQ ID NO: 3515 - DNA, 141 bp, Xenorhabdus bovienii
  Coding sequence Name=Xb4151_4152.C439.gene83.dna; Position on contig =53846..53986bp; Strand=-
atggctttcagggctttttcttcatcatcgaggaactcccatgacggatcgtgttattccatatacttaccggtgaattttgacagtgcttccggttcgttctgtaacttcgcctttcgccggattttatccatgccctga

SEQ ID NO: 3516 - DNA, 165 bp, Xenorhabdus bovienii
  Coding sequence Name=Xb4151_4152.C439.gene84.dna; Position on contig =53985..54149bp; Strand=+
atgacatttgctgttaataacaatgatgccaacggctaccgtgaagccaaagatcacgctatcaaggcactgaaaaaaatggttgagccgatgacggaagctgaaatacaggccttgatagagcgcacacggcagaccatgaacgaaagcaatctacacgattga

SEQ ID NO: 3517 - DNA, 123 bp, Xenorhabdus bovienii
  Coding sequence Name=Xb4151_4152.C439.gene85.dna; Position on contig =54197..54319bp; Strand=+
gtgaagggttcgttcctagcttatagttaccaataccatatcaatattgagcttggcaaaaggataaggagtttacggaaagggttattcttggatggcataacagtatttgaattacactaa

SEQ ID NO: 3518 - DNA, 825 bp, Xenorhabdus bovienii
  Coding sequence Name=Xb4151_4152.C439.gene86.dna; Position on contig =54377..55201bp; Strand=+
atggagcaacaccaccagccatttgaaaaaataaaaagaattgatgaatctggtatcgaattctggtcggctagagagctttctaagcttcttgaatattcagagtaccgtcacttcacgcctgttttagaacgagctaaagaagcctgctcccatagcggacacaatattgaaaaccatttcgaggatgtcctcgatatggtcaatattggctcaggtgcacaaagaaaattaaaggatataatactgtctcgctatgcctgctatctcgttgtacaaaatggagatcctagcaagccagtgatagcggcagggcagacatattttgcgattcaaactagacggcaagagctagcagatgatgcgacatttaaaagactacgagaagatgaaaaacggctattcctgcgcaatgagctaaaagagcataacaagcagctagttgaaacagcccagcgagcaggcgtagaaacaaatattgattttgccattttccaaaatcacggctaccaaggtttatacggcggactagaccaaaaagcaatccaccagcgaaaaggcttaaaaaaatcacaacgaatattagatcacatggggtcaacagagcttgctgctaacttgtttagagcaacccaagccgaggaaaaactgagacgagataacgtaaaaagcaaaacacaagcaaaccagactcattttgacgttggaagaaaagtaagagatacgatccaagagttgggcggaacaatgccagaggatttaccatcacccgagaaaagcatcaaacaattagaaacgatagcaaagaaaaaactcaaaaagtaa

SEQ ID NO: 3519 - DNA, 141 bp, Xenorhabdus bovienii
  Coding sequence Name=Xb4151_4152.C439.gene87.dna; Position on contig =55210..55350bp; Strand=-
ttgagtaggtggtatgaagccttgctattactgagtttgttctactcaatatttcctaggggacacccttgggtacacgctaaatcgaggtgtaccaatgggatgattgaaatgtattcaatcatgaaagtcacatattag

SEQ ID NO: 3520 - DNA, 135 bp, Xenorhabdus bovienii
  Coding sequence Name=Xb4151_4152.C439.gene88.dna; Position on contig =55471..55605bp; Strand=-
ttgcctgactttatccacgccctgatctctttatcggtgagtttaggcattgtgcaatctccaatgaaaaatagggggtgtacccaaaatggttttctaaatgtgctttgggtacaccctagtggtacacgatag

SEQ ID NO: 3521 - DNA, 423 bp, Xenorhabdus bovienii
  Coding sequence Name=Xb4151_4152.C439.gene89.dna; Position on contig =55556..55978bp; Strand=+
atgcctaaactcaccgataaagagatcagggcgtggataaagtcaggcaaaaggttcgaggggaaagcggacggtaacgggctatatttacgttttagagaggctgaccgaattccatcatggcgtttcagatataaattggctggaaagtctagaaccatgaacttaggaacgtatgctgacctatcactagccaaagcaagagaactgaccagagagctatcagctcgtgttgctttgggctatgacgttgccggagagaaacaggaacgcaaggccgaagcgctggcaaagattgacgctataaaggtatcagacttagcagctgaatattttgagcgccagatactcccacgctggaaaccccccgacatactccgaaggcgtatagcgtgcgattggttgcgttatatgaagatgtaa

SEQ ID NO: 3522 - DNA, 225 bp, Xenorhabdus bovienii
  Coding sequence Name=Xb4151_4152.C439.gene90.dna; Position on contig =56053..56277bp; Strand=+
atgtacagatttggaggaatattatgcgtacatacacctcaactcaagcccgtgccaacatcgcggaagtgttggacacagcggctcacggtgaacctgttgaaatcactcgtcgagacggtagttcagcggtcgttatcagtagaactgaattcgataattggcaaaacgctaagctggatgcagagttcgattcgattatgcaacgtcatgggcatacgatag

SEQ ID NO: 3523 - DNA, 1413 bp, Xenorhabdus bovienii
  Coding sequence Name=Xb4151_4152.C439.gene91.dna; Position on contig =56445..57857bp; Strand=-
atgatagtaactgaggaaaatagttggagtgatcttttttccagcaaaaatgcggcgaatgcaatggcgctttcactgggtgtagcattagttgctattaactctttaattgcgattaccattttgccttctgtcgtcaacgacattggaggtttgaatctctatgcttggaatacaactctgtttgttgtgacatcaattattggggcgatactttctgcccgattattgagagcttcgggagcgagaaaatcctatctgattgcggcactggtcttttttgtaggcagtttattctgtacgttggcaccgacgatggaagtgatgttgattgggagaactattcaaggatttggcggtgggttgctgtttgcactttcatattccatggtaaatctggtttttcctcaatcactctggcctcgtgctatggcgttgatttctggtatgtggggcgtagcgactttagccgggcctgccatcggcggcatttttgctgaaatggacacatggcgttatgcttttggcatcatgttgccaatcacgctgttgtatgccttatttacctacctgattttaccgaaaaaaaatgtacagaatgaaaccaaagcggcattgccgattgtacagctgtttctgctgtcggctgcggttatggcggtttccgcaggtagcttgtcacaagatctgaagaccaatattagtggtatcattgcggcggtggtattgatcgcgttattgattatccatgagcgccgtaccctagtgaaactattgccccagaatgcgttgagtttacgttcccctcatctggtattgttcacaaccatgttgttattagtgattggcctgtcgagtgacgtttttgttccttattttctgcaagttctgcatgggcaatctccactggcttccggatatatgattgcagcagcagcagtaggctggacgattgcagaaatactcagcgcgggttggcagggggcaaagatgcggttttccattgtgagtggccctatctttatgctgcttggcatggtgttgctgattgttatgctgccgcgctcatcgtcaggtcagtggcaaaccatattgccgcttattcttgggctggggctatttggttttggggtcggttttggctggccgcacattgtgacccgcatcttacaggtttctgccgattctgataaagatatcgggggggcatctattaccatcgttcagctatctgcgagcgcatttggttctgcattggcgggtatgaccgttaatgtgtttgggttttaccaacccggtggtgtcagtggtgcttcctcctcttcttattggctatttttactcttcgccattactccactattggcattatttactgcctggaaatcagcgaaaatccctgctgggaagtaa

SEQ ID NO: 3524 - DNA, 657 bp, Xenorhabdus bovienii
  Coding sequence Name=Xb4151_4152.C439.gene92.dna; Position on contig =57952..58608bp; Strand=+
atgtcaagcattgacttggaaaataacatcataactgcacagactgtgagcgaacggttattgatgctactgaaaacacgaggcgccatgcaagcctctgatgcaggcaaaatattgggaacctctggagaagcggctcgtcaacaatttgtgaaactggctaaagagggtctggttgaagcagaatcagaaacgagaggagtgggtcgccctattcagctctggcatttaacggacaaaggccacgcccgattcccgaatactcacgcagagttaacggttcaactgttgaccatcattcgcagtcaactcggcgaaactgccatagatttactcatcaacacgcgcgaacaaaaaacttctgccagctataaaatcgcgatggaaggcgctgcggagttgcaggaaaaaattgagcgtctggtcgcaatacgcaatcaggaaggttatatggcgcaatattcggttcaggaagatggcgcgattctgtttattgaaaaccactgtcctatctgtgcagccgccacaatatgccaaggattttgtcgggcagagctgaaactgtttcgggaaattctgcaagccgaagtggagagaacagaatatatcttgaacggtgcccgacgctgcgcctaccgcatcacgccattgaaatag

SEQ ID NO: 3525 - DNA, 924 bp, Xenorhabdus bovienii
  Coding sequence Name=Xb4151_4152.C439.gene93.dna; Position on contig =58671..59594bp; Strand=-
atgaaagtacctttactgcctgttgtggttatggggtcggctacaggagatattgttctcaggttatctgaattaccccacagcggtgaatattgggaagctgaagaagttgatcggcaagtaggcggctgtgctttcaacgttgtgcgggcattgtgccgtcttcaaattccggttatcaatggcatattcgtgggtaatggtgtttggggagaacgtgtcacagaagagatggaaatgctcggattaacagtgacattgcgtcatccaaaacgtgacaatagctggtgcattgccatgatgacgccagatgataagcgcatatacgtttctgtccccggttgtgacgatagttggaatgccgatattctggcgactattccgcttccggagcaggggcatatctattccagcggctatgaattggcaaacccaaaagcagacgttttgcgtgaatggttgctggcttctccctcagggctgacattggtattggattttggccctcgtctgcctgatatagatagggagtttattcaggcactgcctgctgaaagaacaatattgagtttaaatcttgatgaaacggcgatgctgtgtggcgccggcgatccagtggtacaggctggccgttatgttaatgagcgggggttcactgccattgttcgtcttggtgcagagggagcgtggatatgtcagccgggctgcgaaccggaatatattcctgcttatcaggtcaacgttgcagataccattggtgcgggtgatgcgcattgtggcggcatgctggctgggctgtctcagggaatgtcgctgcgtgatgcggtggagctgggcaaccgtgttgcggccgtgactgtcagccgttctggctctgatggcgcaccgaccaaggatgaactgatggattttgtatttggttga

SEQ ID NO: 3526 - DNA, 1416 bp, Xenorhabdus bovienii
  Coding sequence Name=Xb4151_4152.C439.gene94.dna; Position on contig =59591..61006bp; Strand=-
atgatggaaaacgtaatgggtacacagcagaataatcagggattctggaaggtagaacacacaggtattgatattgtccctccttcagaacgcacgggtacaccgatggatctgttctggatctggtcggccgccaacattggcattcttggcattatttatggtgccattattgtttcctttaaactctcttttctacaatctgcactggcggtattgatagggctatccagttttgccttagtgggttatctcagtttcagcggtaaactgggaagaacttcaactctgacgctttctcgtaacatttttggcatcaggggaaatattgcgccgaccatgattttctggggcatctccctcgggtgggagtccattaatatcgttactggaactttaacactctctgcgttatttcaggcttgcgggctcactgaaagtacacttttgaccgtgatcagcatgatattatttgcagggctgtcaattggcgtcactctgctgggaaaagagatgctcattgccatgcagcgctggattatccacgtttttggcgcgatgacactggttgtcgtgttttatattctgtttacgacagagtggaaagcggtgctagctatgccatccggcagttggttaacgggattcctgccagcggtttcggtggttgctgcggggacggggatagcgtgggcggctacgggagcggattacagccgctatcagagcgaaggttcttccaaattgggaatttttacagcagtcactgcgggaggaatgattcctttggtgctgttattgtttgcgggcattctgctctctgttcaattacccaatcttcccacatcagagaaccctatcgctcaaattggctcgattttgccggattggatggtgatcccttacttgatgacggcaacggcagggatagtaacaatggcagtattgagcctctattctgctagcttgaactttttgacattggggataaaagtcaaacagatccatgctgttaccattgattccattattgttctgactcttgcgatttatcttctttttgttactggcgacttcatggggccattcgtctcattcctgttattctgcggtgtgtttctggctccgtgggaggcgatattcttacttgactacattgtcgtccgccgtaagcagggttattgtcctgatagcttgtacaatggtgatggttcaaatagtggcattaaatggatccccgtattgtgttggttattgggtgcatttgtcggttttctggtgacgaaaaatgacttcatcagtggtccatgggcagttggcatttttgcgaattccagtcttggcctgctcctgtcattttttgtcagttttatttgttatggtctgtatttgatgccgggtaggtatacaagatga

SEQ ID NO: 3527 - DNA, 111 bp, Xenorhabdus bovienii
  Coding sequence Name=Xb4151_4152.C439.gene95.dna; Position on contig =61025..61135bp; Strand=-
atgaccagagccgttttcaggacgttattcaatataatcgtgtttcctgccaaggaaatgttacagattagtcaaatcaactcaggtagggctttattccttgtgtcttaa

SEQ ID NO: 3528 - DNA, 141 bp, Xenorhabdus bovienii
  Coding sequence Name=Xb4151_4152.C439.gene96.dna; Position on contig =61150..61290bp; Strand=-
atgaggcacttgaagaatcagaggctttgttggcttcgtcaagagttaatcgagtcggtacgtagtgctctggtcatggtgagattttttgatggtactccgataatgcgcgcgattgtttgtgccaacctaggggagtga

SEQ ID NO: 3529 - DNA, 117 bp, Xenorhabdus bovienii
  Coding sequence Name=Xb4151_4152.C439.gene97.dna; Position on contig =61379..61495bp; Strand=-
ttggcatcacaaaataacaatattggactttcattggccttaattattaatgtaaagtataaatcttgcttatataagaagtcgggagtttgtcagtatcactttgaaactacctga

SEQ ID NO: 3530 - DNA, 783 bp, Xenorhabdus bovienii
  Coding sequence Name=Xb4151_4152.C439.gene98.dna; Position on contig =61573..62355bp; Strand=+
atgccaaatcactttgttgactgggttcgcgaagaactgaaaaagaaaagtagtagtcctcgttacatacaattacaacaagccattgaaattgcgattaaaaaacaattaataaacgaggatgattttttaccgcctgagcgccggttagctgaattgcttaatatatcgcgagtgacagtcagtaaggctatgcagctcttggaagaaaaaggggtgatcatacgccagcaaggtgttggtacacaggttgccaaacccggtggaagctcactcaatcaggccgtgggtttcacttcccagatcgtgaaagaaggtggaacggtatccaattattggttatcgcggcgtatcattcctgcaccggaagatattgccagaaaattatccattcacatcggtgaaaaaattgctgaactgcgtcgtatccgccttgccaacggtacacctgtttcccttgaaaatacctatattccccgtgaatatttgcccaatcctgaattattggaagattccctgtatacgcattgggaagagcaaggtattcacctcaccaacgtgaatcacaaaataaaagctattgcctgctctatggaacttgccatattgctcaatatcgctgaaaaatcgccattgctgcaaattcatcaaataagccagaataatcagaacgagattattgagttcagtgaaatattatgccgtggtgatatttatgggttggatttcaatgcaccacagaatatcgacattaaatataataaaaaaagccgccatcaatag

SEQ ID NO: 3531 - DNA, 180 bp, Xenorhabdus bovienii
  Coding sequence Name=Xb4151_4152.C439.gene99.dna; Position on contig =62303..62482bp; Strand=+
atgcaccacagaatatcgacattaaatataataaaaaaagccgccatcaatagacaatcaattcaaaaaaacattctctctttctcatttacctatgatgatttatccctttctgccagacatctggcagaaagggatagagatagctactcttttcctgctgaattcaattgctggtaa

SEQ ID NO: 3532 - DNA, 1758 bp, Xenorhabdus bovienii
  Coding sequence Name=Xb4151_4152.C439.gene100.dna; Position on contig= 62449..64206bp; Strand=-
atggttttaacgaaaatggtgccttattttatgcacggtatatcgggcaaccatgttattttcatcggtcggtgcaaaactgaactcaattatggaactgaatggcgtatgaaaaaaaagataatctcggggatctatttgggggtgctgctgattgcgtcctggataatagtgtttgaaaaaagcagtgatatctacccagcattagtttctgtcggcgtattcggtgtcatctttggtctggcgtttttggtttcagcccgttggctattttcggcggcgtttaccggaaccgtattcattatcatcaaattcatcaaccagataaaagtccattactacaaagaacacctgatgttttccgatttgaatgtcatgctagacccgtcaaatcaggaaaccctgcgtcattactggctggcaggtgttgcgatggcagcgatgctgatctggttgatcttcaatatggtgttgagttggcgaaaagcaggccctgcatgtgggataaaatggcgcgttgccagtgtggcgctggttgccgccggtgtctgtgtcgtcaatctgaccaccaatgcttactacgcaacatggcagcgggaattgccgaaagggcgtggaaccatgactaacatgatgatgtcagctaaagatactgaataccagccgccccaatttggtgagtctgcggactattttctgcaacaggcaaaaagcgttaccttgcctgagcctcagtcagatgtgaaacctgatgtggttctgctattacaggaatccaccgttaatccccatatttaccaattgcctgccaatgttcagctgccagatctttatatgttccagcgtgatgccgatgtcagcgctcaaagcccactcagagtgcaaacctttggggggggaacatggctatctgaattctctgttttgacgggattgaacacggatgatttcggctcccgcaaaaatgcagtattttattttgtcgttgatcacctgcaaaacagcctgttccgcgccatgaaagataatggttattacaccgttgtactgacgccattcaataagtcagcctatcatgctggacatgcttacaagacaatgggtgttgatcgcattatccagccacaggaactgggttatccagccagtctggaggaaaatttatggacgatcccaacacaagatatgctgtcttatgtgaagacgattctggccaaggagacggacaagcctatctttattttctctctgacgatgtatgaacacggcccttatgatgaagggcatagcgatgattacggtttgacaggcaaactggagggttcatcagcagtaggtaagttcagccattatatggagaaaatcaaggcatctgatcctgctatcaaggatttcagtgaatttgttgccacacgcgataaaccaacgcttttcctctattttggtgatcatcagccaagtattcattttgggcaatatgattctccgttagctgatccggcacacataactcaatttactatgcgggataatctggcgcagggaactgccattacaacaggcaagctgacggatatctccttcctcggtggtatgattctggaacgcgctcgattgacggcaccgccattctatcaggccaatatgacgatgcgtcatttatgtgatggtgcgttgaatgactgtcaggacaaagctctggtcgatagttataaacactatatttaccagcaattgaattcagcaggaaaagagtag

SEQ ID NO: 3533 - DNA, 309 bp, Xenorhabdus bovienii
  Coding sequence Name=Xb4151_4152.C439.gene101.dna; Position on contig= 64292..64600bp; Strand=+
atgccaatcagattttctcggtcaggaacaatcgcggcaatcagggagtgctggatattgtgccaatgccgagttcgagaaagggttttgcaatccagcggaacactgtttattttatttgcgataagatatcgtccaattccatcttcaatggattgtcatacagcgctttttgctgcgtctgcgcgatttacgcagcaaaatggagataacttgaaaatgggtgattttctgtcgctaatgttttgggacgctcggcgcggcgttgatacaagtttttcaggttggcaaacaataacggaggaataa

SEQ ID NO: 3534 - DNA, 111 bp, Xenorhabdus bovienii
  Coding sequence Name=Xb4151_4152.C439.gene102.dna; Position on contig= 64654..64764bp; Strand=+
atgcgaatactcataacctttttaccttttatctttctggttcagtggcctattgtaattccatcattcgtaaggagtacccctttgcttaggacaaatttatattattag

SEQ ID NO: 3535 - DNA, 174 bp, Xenorhabdus bovienii
  Coding sequence Name=Xb4151_4152.C439.gene103.dna; Position on contig= 64771..64944bp; Strand=-
gtgataattggacggattttttattctgtatcatatatcccctatctgtttgttgatttttattatgttcaaagtagcctcttgctaattttaagtttaatagagcatgtattctattattttgtaattaaactattttatcttacattatttcccatcgttcagatggaatga

SEQ ID NO: 3536 - DNA, 792 bp, Xenorhabdus bovienii
  Coding sequence Name=Xb4151_4152.C439.gene104.dna; Position on contig= 64911..65702bp; Strand=+
atgatacagaataaaaaatccgtccaattatcacattctgttgttcattattactgtgtgggagaaggcgatggcattgtgtttttgcacggaactaacagtgatggagaaagcagttttggccatatcgtcaatgaattctcgaaaaacaatacggtgattattcctgattatgccggatgtgggaattctacccttccacaaggcgaaatcacggctgaacaattggcagagcaaattgccgcgattatcaaagacagcgcaaaataccctgttactttggttggcacatcattaggcgctgtcgttgccgccgttgtcgctgccaattatcctgagttaatcagcaaactggtattaaccgccccttgggcaagcagccaagatgccaggcaccagttgatgtttcaaacttggttggaattagaacaaaacgccccagacagcgccacggcttttggcctttctcacgtattaagcccggtgtttctgacctcattgggcaatgaaaaaatcaaacagatttgcagtaaagcatcggcaaaagatacggataaaagaattcagcttggactaaatatcgatattaatgaatcattaggcatgataaagcagcctactttagtgatagggttggagttcgatactctgatcccgatttatcaagtagtgaaggttcatcagaaaataacacagagccaatatagtagaatagccagtgggcatgctgtacaaatggagaatccacaggattggataagttgtattaaaaattttttacagagaacatga

SEQ ID NO: 3537 - DNA, 111 bp, Xenorhabdus bovienii
  Coding sequence Name=Xb4151_4152.C439.gene105.dna; Position on contig= 65677..65787bp; Strand=-
atgctgcgcttaataaccgatatgagattatcaccaccgcaaaatcggtgctcgggtttcgaagccgatcctgacagtgggaatgtcatgttctctgtaaaaaatttttaa

SEQ ID NO: 3538 - DNA, 603 bp, Xenorhabdus bovienii
  Coding sequence Name=Xb4151_4152.C439.gene106.dna; Position on contig= 66201..66803bp; Strand=-
atgaactcaccaaaaacattactagaaatatctggatcatcagaaaagaaacttgattggaataaagcagcactcatattaattgattttcagagagaatattctgatggtgctttacaattaggtgaacagggccgagaagctatcgccaacgctgctaagctattagcgtatgccagaaaaaataatgttcctgtctttcatgttgtacatcatgccaaacccggctctgctatatttgaccctaccactgataaagcaagtttgattaaggatgttgaagctaatactgaggaggaaattgtcaccaaatcattacctagttcgttttacaatacagaattaagtgacttgttatcactgactagccgaaagcagctcgtattggcaggttttatgagccatatgtgtgtcactgctacagctatcaaagcattagagttgggatatgaaaactttgtctgtgcagatgcttgcgctagccgtgacttgaaatatattgatggttcactggttaaagctgactcagtacataaagctgcaatggctgctttgaacgatcgatatgcaactttggtcaattgctctgatgtagtcagataa

SEQ ID NO: 3539 - DNA, 237 bp, Xenorhabdus bovienii
  Coding sequence Name=Xb4151_4152.C439.gene107.dna; Position on contig= 66856..67092bp; Strand=-
atggcctctatggactcaataaccctttttggggtatgggttgagccgcttttctcatatcggttacgctcacgctggatatcctctaataacgcgtatcgacgacctagagtgcaatttttcagaagagcggtcagttgctataatagtaggcatctttctcgccagttgatggcggttcaatgtataagaacttttttgcacatactatatgcaatatttcataattacttttga

SEQ ID NO: 3540 - DNA, 306 bp, Xenorhabdus bovienii
  Coding sequence Name=Xb4151_4152.C439.gene108.dna; Position on contig= 67103..67408bp; Strand=+
atgaaaaataagttagccgagcttgaggctcttattgccgaacatataaaccagcaccctaatttaaaaaaagattttgaacttttaacctcaataaaggggattggaactcagatgggtcttaacgtacggatacctttactcgtgcaacgtaagtcgctgcatatcttggtgttattcctattgcaaagcagtcaggtacatcggtgtatggtcgagtgcgcttatctaaaacggggcctgctaaaatcagggctaagttctttatgtctgcactcactgcagttcgttttaatccccacataa

SEQ ID NO: 3541 - DNA, 243 bp, Xenorhabdus bovienii
  Coding sequence Name=Xb4151_4152.C439.gene109.dna; Position on contig= 67309..67551bp; Strand=+
gtgtatggtcgagtgcgcttatctaaaacggggcctgctaaaatcagggctaagttctttatgtctgcactcactgcagttcgttttaatccccacataaatgatttatataatcgattggttaataaagggaaggcaaaaatgttggctttaggcgctgcgatgcgtaagttagttcatttgtgctacggagtattaaatacgcagcaatcatatgatgaaaactatgctattagaacttga

SEQ ID NO: 3542 - DNA, 120 bp, Xenorhabdus bovienii
  Coding sequence Name=Xb4151_4152.C439.gene110.dna; Position on contig= 67523..67642bp; Strand=+
atgatgaaaactatgctattagaacttgaccatcaagatggtagcttattagtcgaatccgccatttataaatgttacgatttatatcttattgattacacagagtacatatatggatag

SEQ ID NO: 3543 - DNA, 855 bp, Xenorhabdus bovienii
  Coding sequence Name=Xb4151_4152.C439.gene111.dna; Position on contig= 67635..68489bp; Strand=+
atggatagtgtaaattgggatgatttgaggttttttacagcgctagtagaatgtcgtacagtttctgctgcttcaaaaagattaaatgtgaactatgcaacagtatctagacgaatagagcgcttagaacatactttgaggcagcgtctttttgatcggacccaggatggttatattccaacagttgaaggtctaatcttatataaaaaaacatctctggtgagagaaaatgttgaaagtttagaggagtactttagtctgggggggaagtttaaaaaaagcgtagttatttcgatggtttcttcaatggcagaatatttcctcattcctaagctaagtgattttgtcaaaaaacatccagaaattaggctagaaattgatgtgtcaaatcggaatgttagtattccaagaaaagaagctgatatagcattccgtttagagcttccagaaaaaggagaatatttaagcaaaaaagtaggtgatattacttataaactctgtgccacacctgaaattatagaaaaaattaaaaatgaggtaaatgttagcattattacctttaacagtgattttagtcatttacccgaatctcagtatctaatcaggcgctttggaaataaatcaattcggttccaatcaaactcagttactactcaacgtattgcggccgaaaatgggtatggtgtagccttacttccatcactggcaattaaaaatagcccattagtttctttagaattggatgaacctataatacgttcaatatggatgctgacatccaaacacacaatgcaaatgacagcaagtcgattagtcgctgatgaactacaaagaatttttgatgggatgaaataa

SEQ ID NO: 3544 - DNA, 306 bp, Xenorhabdus bovienii
  Coding sequence Name=Xb4151_4152.C439.gene112.dna; Position on contig= 68706..69011bp; Strand=+
atggaaatatgtgctcatcaaatgttaaaaaatgatgatatgccttatgaatttagattggatttagcaaaacaagtttgggatgaaagtaggcatgaagaagcaaattccttcgtttatatcaataacgatgaagcctttcatgtccaaataggtaataaatggatatcgtatttagcagaaatcaatgaattaagtgaggagcagctattgaatgttatggtagttgcttcggaaaagataggtatcccattgtttggaaaaggagggtggaattcagaaatacggaaactcattggtttatag

SEQ ID NO: 3545 - DNA, 159 bp, Xenorhabdus bovienii
  Coding sequence Name=Xb4151_4152.C439.gene113.dna; Position on contig= 68962..69120bp; Strand=+
ttggaaaaggagggtggaattcagaaatacggaaactcattggtttatagaaaccagggaaaaactatcatcttgatagagataaagacagaaggtgtcaggcgcttctggatggaacatattgatagtgatagccgaatcgtagataccctgccctga

SEQ ID NO: 3546 - DNA, 1293 bp, Xenorhabdus bovienii
  Coding sequence Name=Xb4151_4152.C439.gene114.dna; Position on contig= 69300..70592bp; Strand=+
atggatttccctatttatgactttgatggcaatcgtctatatgatgagattggaaaccctgtgattactatcactggtggatttgaaatgctgaaagatttaggtacattgatcgacatacaacctgattggggagtagacttaattaatggaattgatgatagctttgatattcccttcaccaagtttgatgattttgaggtaaatgttgattcgatcaacttttccagcattattaatggtatttctggtttaaatcaggagcaaaaagataaattagaacgcatcattaatgaacaaaaaaaactagctgacgaagatcttcaagcagctaacagaaatttgatggatatgaatcatgaagaattttctttatatcaaagttatatttcagaacttcaaaaagcaaaatctaaaaaaataattgagttaattaataaagcaattgacattattaacaacacaccggaaggaagaacgctaagtgatgtcagtaaatatccttacgagaaaaagcatgagatagattttggtagagtctcatatgtcatatatatggtaattgacaatgtaaaaaagttaaatgaattgttaaataaaaaacatactgaatctgttaacattaatgagctttctcttgatgatttggctgattataaacttcgtgaatcacttagtaacttatttttatattatcaaggcctgaaaaataaattaaataaagcattggacagagagttagaaagaatagagtaccttgagaaattatttactaaagataatggaatgaatggatgggacatgctttctcattttagaggagactcaggtcggacactcaaccttcatgacatcggtgtgcataatcaagttcgtgaattgatgcataagcaaggtggatttgagaagccagaaggcagcattcaatctcgttttatttcacaaattcaacgtggtgaacgaattgattttaaaaatcaatatgatttcgctaaggaagcaagaataacaattatcgaccctctgtgggctattggtggtgcaacagtcagcggggttttgacagatattaaggccgaaaataccggtgataaatataatgtatctggtgtaataagttataaactcgatgataaattttccagcccttgggatatatacaactggagtcctgttgaacttaattttggtggaacaccatatgatatcactggtgagtggtcggaaatagttaatttcgatgtggacaaagatgtttatgagaataaaattaaacccatgattggtcaatag

SEQ ID NO: 3547 - DNA, 183 bp, Xenorhabdus bovienii
  Coding sequence Name=Xb4151_4152.C439.gene115.dna; Position on contig= 70657..70839bp; Strand=-
atgctattcatcgctattttatttatgatatttgtgtgtttttttactctaacgatgtttgttaattatttttttatatttaaaagaaattttaaaaaaactatattagtgtcaatattaatgactattatttcaataataagtcattttctacctatgattttttatcaaaccattttttaa

SEQ ID NO: 3548 - DNA, 156 bp, Xenorhabdus bovienii
  Coding sequence Name=Xb4151_4152.C439.gene116.dna; Position on contig= 70895..71050bp; Strand=-
gtgcgtgtcgatgcgccgtttagtctaccgggtttccacgcccgtgccacagattttgcggtgacgtatttacgtcaccgcaacctaaacaacacgtcaacaatatttatcgaaataattgtcaattgcgtcacaaaacgccatttttactactaa

SEQ ID NO: 3549 - DNA, 141 bp, Xenorhabdus bovienii
  Coding sequence Name=Xb4151_4152.C439.gene117.dna; Position on contig= 71093..71233bp; Strand=+
atggcggttcaggcagggcaacctttgggttggccgatacccgttcaggtcggtttatttgtcaaccttgatgcttcactgatagatacaagagccataaaaacctcagatccttccgtatttagccaaaatattctctag

SEQ ID NO: 3550 - DNA, 996 bp, Xenorhabdus bovienii
  Coding sequence Name=Xb4151_4152.C439.gene118.dna; Position on contig= 71198..72193bp; Strand=-
atgaacaatgtgagtgaggagatccccatgcaagtcagcagaaggcagttctttaagatctgcgctggcggtatggcgggtacgacggtaactgaacatgaaacaaaactaattttgtgttgcgtagcgttactaaatccatcattggaaaatccaactgaagaacaacgaacggtcacattcacttatcaggagtatgcgaagatgatgggactcactcttgataatgcctatcatcgtctaacgaatgcgacacgagagcttatgagtcgaactgtacagattctgtaccctacaggagatattgacagagaaatatttcaatgggtcaactacgcaaaattcaaccgtaagacacaatcagtaacgcttactttcagccctcacattcagccttttcttttccaattaaaaagatttatcaagtacaacctagaacacgtcaaagccttcgagaacaaatattccatgcgagtatatgaatggcttctcaaagaaataacacaacgaaaagtgtacaaggcaaatattgaaataagcatagataaatttaaattcatgctaatgcttgataagcagtatacagatctaaggaacttcactactagaatattaaataccgtcacaaaagacttaaacacctacagcaatatgaaattagagattaaaaaacgaggtcgtcctgctgacacattaatattccaagtcgagttagataggcagattgaccttattacagagctggataaaggctctgtagcgacatcaaaaaaggcaactaaaccaaccaatagcacaccagaagcccatctacatggaggactgagaaaaacactacacgatgcactaaccgcaaagatccaactcactggttttgaggcgaaatttcttggtgacatgcaaagtaagtacgacctcaatggttcattctcgtggctgacgcaaaaacagcgaaccacactagagaatattttggctaaatacggaaggatctga

SEQ ID NO: 3551 - DNA, 159 bp, Xenorhabdus bovienii
  Coding sequence Name=Xb4151_4152.C439.gene119.dna; Position on contig= 72193..72351bp; Strand=-
atgatactgtttgtgtggataaatcgtgagcgtagggagtttacacgatttaaacggatgatgttgatgacaggcagaatccataatgaaaagaaaaatattcataaatctaggcccaaaattacatacctacgggttttccgtcggggtatgtgttaa

SEQ ID NO: 3552 - DNA, 831 bp, Xenorhabdus bovienii
  Coding sequence Name=Xb4151_4152.C439.gene120.dna; Position on contig= 72379..73209bp; Strand=+
atggataatgcaaattcaggaaacaggttaatgatcgacgagatttgcggagccactcgtatcaatgtgcaacaaaaaaaccatctgaataacccaaaaccggactgggtggcagaagaaatcccgattgcattggtctacaacggtatttcccatgttgtgatgatggccagccccaaagatctcgaccatttcgcgatgggcttttcattatcagaaagcattatcacttccccacacgaaattcacggcatagataccgtaatcagttgccacggcggtattgagctgcatatcgaactttccagccgtcgttttacggaattaaaagaacgccgacgcaacatggcaggcagaaccggttgtggcatctgtggcaccgaacagattgccgaaattttccgcccgatcccccccttgcctttcacccagactttttcatgggattatcttgatcaggcgcttgcacaattaccccgtcttcaggaaatcggcgcagctacaggctgtacgcatgctgctggctggattgatgctaaaggagtattgcttggcggcagtgaggatgttggccgtcatgttgcactggataaattattgggaatacgagccaaaacgggctggcggcagggtgcggtattagtttccagtcgcgccagttatgaaatggtacaaaaatcggctatgtgcggtgtagaaattttgtttgctgtttctgccgccacctcgctggcaatcgaagtcgcagagaaatgcaatttgaccctcgtgggtttctgcaagccgggacgggcaacggtatatacccatccacaacggctggtggattaa

SEQ ID NO: 3553 - DNA, 765 bp, Xenorhabdus bovienii
  Coding sequence Name=Xb4151_4152.C439.gene121.dna; Position on contig= 73206..73970bp; Strand=-
atggacgctaaaataatcattcaatctgcggaagagaggactgatttagacgaacaaatatatgatctcgttcgtcatttatggcctttttttatgaatcaggatcctgttgctcaacaacattgggaaaaattatatgaacctgattttagccgcttccaaaaatttgccattctgcaacaagggcaggaagagcgtcttattgggctattgaatgccattcctttcccgtgggaacagcactctttggatcaattgccggatgaaggatgggatgccgtgtattgcgctgggatggcagcaaaaggaaaacagcaaccgactctgctgtcagcgctttcggtgactgttgcccctgaattccgtggacataatgtgcctgcattattaatcaacagcgtgaaacagactgcccgtgaagcgggattgcagggttttgtggttccggtcaggccgagcctgaaacgtagttatcccctgcaagacttcgttcagtactgtgaatggaaaaatgaaaaaggcgagccttttgacccttggatccgcactcattggcgtttgggggcaaaaatcattaaaccggcactacgctccatggatatttacggtactgtggcggaatggcaagaatggacaggcatgaaattcccacaaagtggggaatacatcattccgggtgggttggtaccgctgctggtggatattgaaaaacagatgggctactacattgaacccaatttgtggatgttccacagtcttgattaa

SEQ ID NO: 3554 - DNA, 738 bp, Xenorhabdus bovienii
  Coding sequence Name=Xb4151_4152.C439.gene122.dna; Position on contig= 74569..75306bp; Strand=+
atgaaaaagatcaatgtattagtcgccgcgttaggcgcattagggtttatggcacaagctcaggcaagtgttggatttggccagagtcaagaagacactacacctcacattaaggttggtgccaccaaagcgagttcaagtccacacggtggctcaggtaatgaaccaggcattggcgtcagttccgttcgtgacggtatgctcatcggcttttccggattaacccgtatggctcctgctgacagcaatggtattcataatatctcgatggcaggcgcacccggctctcacggtggtatgggtgtatttcatttcagcaaagtcgccaatgcggacgtttactttggcgaatggtcacagacaggtaatgcaacagacacaacccataccgtttattatgcgggcaaggacattaccaccaatatgccaaccgacggtacagctacctatgtggtgaacggtattaaccagtacagcggtgacaatgccctttccggcacattaacggcagattttggtgaaaaaacgctgatcggctccatagaaaataccgctatgacagtcagcattgatgccgatatccagtctgatgcccaattctcaggtcttgctacaacaggtgatcttgagggagaaacccaaggtcacttctttggtgatggtgcttccagtctggcgggatatgccaaatttgatgatcaatccaaggataccgctttcggtggttcgaaacagtaa

SEQ ID NO: 3555 - DNA, 117 bp, Xenorhabdus bovienii
  Coding sequence Name=Xb4151_4152.C439.gene123.dna; Position on contig= 75328..75444bp; Strand=+
atgccaaaaatggcattgttctctgttttgtttattgccgttttatttatcgctattgatttctggctatttatttctaataacgtgagccttgtgagctggtttttcgatgtctga

SEQ ID NO: 3556 - DNA, 1473 bp, Xenorhabdus bovienii
  Coding sequence Name=Xb4151_4152.C439.gene124.dna; Position on contig= 75437..76909bp; Strand=+
atgtctgacaatataacaaccccaatattattaacggcactgatggccttatgtctctccctgccggtttatgctgatgaagataccaaccgcaaaatctggcaggaggcgcagcacaatcaacaagaaaatgaagctgatctgataacgccagagcctatttttattgaggatggtgcttcatcgatagtcattaacggacagacatttcaggtagaaaacaacctcgataacatcggtcaggcactataccttgccactaaccatcgacagtggccggacgtcagacgttttctgacggcttatcaaaaactatccgggcatgatgtcatgctggcctcttttgcccagggcggcctggcgcgttttgaaggcgatttggatctcgccgcctatcattatcaaaagctcctgaaccaacaacccgacttcacacgcatcaagctggaactggcccgtgtttattttgaaaatcataaaaatcgggaagccgagcaactgtttgtaggattgagtgaacagaacctcttaccggaaacggtcttgaaaaatatcaacagctatttgaaagcgatagcattgagaagtgactggcgtggctctttttcggtaggttatgcctataacgataatgtcaatatgtctccggatcaggaatcaacctgccttgaatataaccctgatgggagttgccaggaggaacgccggataccaaaagccattaaaaagtgggggatgtcttatgacgccacattaagccgacgttaccaactttccggtcatcacggcatttttggacgtggcctgatttatggcgaaaactaccgtgattaccacgctgaaaatgaaaataccgtcctgctggtcagcggatacaactacaaaagcagaaatcacgatttctcttttggccccctgtttgaatataaacatcgggcgggtgatacctattaccgcgccacaggtgtcaaaacggaatggagacaaacattcagccctaaaacagctctcaatatcgaactggagcataaacaactgcggcatcagcagcgttaccactggaaaaatggcgacctctcctcatcctatctcactctttcccatgccatcagcaaagaatttgtcatatttggtggcggtgactgggtctatcggaacaatccgcaaccggcggatcgctatcaacaatggggaattcgggcaggcgtatccggacagatctaccccggtattaatggctcactgtctgccacactgcgagagcggcgctttggtgcttacagcccgatactgctcgccagacgtcaggatgatgaacagatctatactgccgtcattaaagtccctgccgctgaaatattgggtatgaccccctctatcactttccgccatcgacgcaatcacagcagtgtgaattggctgtacaactataacaaaaacgaagtactgctgaggctggaaaaatatttttaa

SEQ ID NO: 3557 - DNA, 2967 bp, Xenorhabdus bovienii
  Coding sequence Name=Xb4151_4152.C439.gene125.dna; Position on contig= 76939..79905bp; Strand=+
atgatgattgacaaattgaggcaaggaatatcaatggtataccgagttaaaatacagctaacccccattacaattgcactatcactggcattttcgctgacagcacctcccctgtttgccgaacccaaatctaccgtcacttctccaagcaagcagacggatttgggcaaaattagtgtcacggataacagtgataaagatgaagccggtcataatgcggtctatgacaaagatatctccaatatctatatcggcaaggaacagatagagcgctataaaggagcatctcccgccgatctgataaaaggtgcggtgggtgtctacagcggtgatgcccgtaatagcggcgctttggatatcaatatccgtggtattcaggggcaagggcgcattcccgtcactattgatggtacggagcaggctattacagtggggcgcggttataatggcgccaataaccgcaactatattgatcccaatttaatcagtagcatcgaaattgaaaaaggtccttccctgagccgcaacatcaaaggttcaatcggcggagccgtggttatcaaaacattaaccattgatgatgtcgtaccaaaaggggaaactttcggcatcaataccaaagtggaaaccagcagcaattcagttaaggaacgcaagccttctttggtactgggacaagactaccgcgatgttcccaactttatccaaaatggcgtcgaagctgatcctgagttgaaaatcacgccccattcgtcaaaagacaataaatttcccggatttaaagataatgccttccgggtcgcattaggaactcggcaggaatattttgatctgatgctggcttatagccaccgtcgtcaggggaattattttgccggcaaaggcggtgcacaccgctatgatgaacctattacggcagcagataccgaattaatgaatggctataaaacaacgttagatccttacctaccgtttgctgcccgtatctatcgccccggcaatgaagtacccaatacttccagtgagatgcgctccgtattaatcaaaaatacttggcgcctcaccaatgatcaggcattacagttaggttttcgcaatactcacatggaatttggcgatatcatgccttcgcgcttgggctgggtgaaggccgaagataatgctgttccacaatggccactggcgaatgtccaccagcaagccgtcaatctgacttataaatggcaagcggcggacaacccctatatcgattttgatatgaatctctgggcgacccgcacgacaagcaatactaataccgctgggggatatccccgaacacctgtagagagggactactcttgggataatggcagtggtgtcaaagcctctcacattgatggcacattgattgataccgccaaaaccaatgcccaaaacaatcgctggggcgtggatatctccaataaatttaccttggcctccagtttggatctgaccttaatggggaatttccaacgtgagcatctcgactccaatgatggctacaatcccttaaatatgtacttcttccagtcgccagcacggaaagggcagcgtcaggaaatcaatctcgcctttaactttgactggcgaccaacatcatggctggcactaagtgccggtgccaaacgtgtctcctattggtccaaagatgattttcttagtgaacgacgtgcagcaagagatgaccgttatagaaataactcggaaaccaccggacatcaaataagttactaccgaacgatgaccgaaagagaagcttatataaaacagaaaaaactgtctaaaatgagtaggaaagaacgaactgaatattttaaggtaaagacaggagatatcacctcccgcgatgggcagcagcgcaaaatggttcgtcaagaagtcgactggctctacaattccagcaatggccaacttaataaaagcgataacccctactttaatgggcagttggatatgcaggaaaagattatcgacccaatcacgggtaaagagggatataagtatgaatatggctcaggagttgatgcaaatggtataaggcgtgagattcctgatgctgatccctgggaacctgcttctaaacgcaaagatcacgcgtgggcgcccactttctctgctactgcctatgtaacggatgatttccgtatctatacccgctatgccgaagccgtcagaatgcccagtatttttgaagacactgtgggtttctccggtaacaaaagcaatcgcgtaggccaaaaattcaaacccgaacgagccaaaaccactgaagttgggttcgtctatgatttcagccaattggttgatgctgaacgccatgccgatatcaaagtttcttactacaacaccgtgattgaaaatgtatttgaccgggataacacctatgaattttctcaaatggacaaacagaaacttgccggtctggaactacaggcgcgttacgacaatggcagtttctttaccgatatgggattaacctacaacctgaaaaataaagtgtgcgacaacaattcttcattgagaatgaattcattgaatcgctacgatataccagaatgtattgatggcggttttgcgggaggctatctgcgtacttccattcagccccaatattcagcgaatctgactgtcggcgggcgcctgtttgatgagaagctggagctgggcagccggatgctttaccacagcaaagcagagaacaaagatgaaaaatggctgatggaagcattacctgatgtctataagggccaatcaaataacccaatgcgctggaatccggttttcaccgtcgatgcctatgttagctaccagatcacgccaaccctatcgatggaactgaccggaacgaacttaaccaatcgctactatctcgatcccctgacacgctccatgatacctgcgccggggagaacctttaaactcagtattaccagccagttttag

SEQ ID NO: 3558 - DNA, 819 bp, Xenorhabdus bovienii
  Coding sequence Name=Xb4151_4152.C439.gene126.dna; Position on contig= 79914..80732bp; Strand=+
atgaccaacacagccatattggagagtccaaccaaccattttccgctactgcccggaaagcaacttctggttggtatcctgattgccattttattgcatatcagtctgatatggctgttcaatcgacattcctcatatgatgacagcgctcatcatgtaaaccaaagttcgcccttaacagggctttccatcacgatggtagccgcttcgtcatggcaaaatgagccagagcctgtctctcctccgcccccgttgatcaccgcgcctgaatcgccgacaaagccagaaattgctctggataaagcggttcagcccgaaaacaggctggaaaaacccttggaatccgtcaaaccgcaaaaacgccaaaaacagcaaaaagaaaaaccacaggagaaggtagaaaaaaaatcagcaccatcaccacaagttcagaaagacaataatgaagaatttgaaaccagcggcactgatcaaatcaatgcacaaagcagcatgagccgagccgcaaccacacagcctctggtgggtcagggcaatagcgcgctggataattaccagtcaagactcaagcaagaagttgaaagccacaaacgttatccccgtaaagcaaagcgaatgaaacaacaaggcacagtgaccattggttttactctgcttaatgacggttcattcacggctgccagagtgatcaattcctctggcaacagcgtactggatgatgccgcgctggatgccatcgcccgcgccagttcggttggacccaaaccggtagatatggcacccgatgtaacgcttaaaattgattttgagctgaattaa

SEQ ID NO: 3559 - DNA, 150 bp, Xenorhabdus bovienii
  Coding sequence Name=Xb4151_4152.C439.gene127.dna; Position on contig= 80791..80940bp; Strand=-
gtgaaattaccggtgaatttacttcggatgatttgctgggacggattttttcgagcttttgtattgggaaatgaatgggtgaaaaaaatacctaatgttcttattttaacctcagcttcgtttaaaaatagcgatatcacaatcccgtaa

SEQ ID NO: 3560 - DNA, 1365 bp, Xenorhabdus bovienii
  Coding sequence Name=Xb4151_4152.C439.gene128.dna; Position on contig= 80867..82231bp; Strand=-
atgaataccaccgatacgatagtcgctcaggccactcctccgggacgaggcggtgtaggcatcctgcgtatttctggccctaaggcggcggaagttgctgaggtggtattgggcaagttgccgaagccccgttacgctgattatttacccttccgtgatgtggatggaactgtgctggatcaaggcatcgcactttacttccccggccccaactcttttaccggcgaagatgtgctggaacttcaggggcacggtgggccagtcattcttgatctgctgttaaaacgtattctgacaatttctgctgtgcgtattgctaatccgggtgaattttctgaacgtgcatttttgaatgacaagctcgacctggcgcaggctgaggcgattgcggatctgattgacgccagttctgagcaagctgcccgttcagcaatgaattctctgcaaggaacattttcccatcaagtccaccaaatggtggaagcgcttactaaccttcgtatctacgttgaagcggcgattgattttcctgatgaggaaattgattttctttccgatggcaagatagaagccaggctggatgaagtgattgaagaacttgatcacgtccgttcacaggcacgccaggggagtttgttgcgtgaagggatgaaagtagttatcgcggggcggccaaatgcgggaaaatccagcctgcttaacgcattggctggccgagaagcggcgattgtcaccgatatcgcaggtacaacacgcgatgttttgcgtgagcatattcatattgatggaatgccgctgcatattattgatacggcggggctgcgcgaagcgagcgatgaagtggaacgcattggtatcgaacgcgcatggcaggaaatcgagcaggcggatcgggtgctgtttatggtagatagcacgaccacggatgccgttgaacctgcgaaaatctggccggaatttatggcaaagctgcctgcatcactgcctgttaccgtgattcgcaataagaccgatatgaccggagaagaaaccggcgtattagaagtaagtggttactcattaatccgcctctccgcccgtgagggaaaaggtattgatttgctgcgggatcatctcaaagaggcgatgggtttcaacagcaataccgaagggggctttctcgcccgtcgccgccatttacaggcgttgaacacggcagcagaacatttgcaggaaggccatcaacaactggtttttgcccgttcaggggaattgctggcggaagaattgcgactggcgcaacaggtattgtgtgaaattaccggtgaatttacttcggatgatttgctgggacggattttttcgagcttttgtattgggaaatga

SEQ ID NO: 3561 - DNA, 1614 bp, Xenorhabdus bovienii
  Coding sequence Name=Xb4151_4152.C439.gene129.dna; Position on contig= 82309..83922bp; Strand=-
atggattcgcaacgcaatcttcttttcatcgctttgctgtttgtttcgttcttggtctggcaggcgtgggagaaagatcagaacccacaaccaacggcacagatcacgcaacaagcaaatacgccgagtagtgaagctagcagtgggcaaggtaaactgatcaccgtgaaaacggatgtgctttctttgcacatcaatacccgtggcggtgatatcgaagaggctgatctgctggcctatcctgataccctcggttcaaacaaaccattcaaactgctcgaaagcacccctgaattcatttatcaggctcaaagtggattaactggcaccaatggcccagataatcaagctgaccgcccgttttaccacaccactcaggatagctacgttttggctgatggtcagaatgaattgcgtattccgatgacttacactgcaccagatggtgttgtttatgtcaaaaccttcattttgaaacgcggtaattacgcggtttctgtcgattacaacatcgataatgtgactgacaagccgttgcagatggcgttctttggtcagttgaagcagagtgttgagctgccgaaaagtcgtgatactggcagcagcaactttgctctgcatacttatcgcggtgctgcttattcatccgctgaagcaaaatacgaaaaatacaaattcggcgatattgaagataaagcgttagccgtaacgaccaacggtggctgggtagcgatgttgcagcaatatttcgccaccgcttgggtgccgggcgcaaactctaccaacacgttttacactattgacctgaaaaaccagaaaatggcgataatcgggtacaaaggtgaaaccgtcaatattgcgcctaacagcaagcagaatatctcctctaccctgtgggtaggtcctgaaatccaggacaaaatggctgaagttgctccacatctggatctgactgttgattacggctggttgtggtttatttctcaacctctgttcaagttgctgaaattcctgcatgaattcatcggtaactggggcttctccatcatcgccattacctttatcgtgcgcggtatcatgtatccgctgactaaggcgcaatacacctccatggcgaaaatgcgtctgttgcagccgaaaattacggcgatgcgtgagcgtcatggtgatgatcgtcagcgcatgagtcaggaaatgatggcgctgtacaaaacagaaaaagtgaatccgctgggtggctgtctgcctctggtgattcagatgccaatcttccttgcgttgtattacatgctgatgggttctgttgagttgcgtcatgcgccattcattggttggattgaggacttgtccgcacaagacccttactacattctgccattgctgatgggtgcgaccatgtttgtgatccagaaactgtcaccaacgaccgtaaccgaccctatgcagcagaaaatcatgacttacatgcccgtcatgttcactgtcttcttcctgtggttcccgtctggtctggtgctgtactatatcgtcagtaacttggtcaccatcatccagcagcaggttattttccgcagtctggaaaaacgcggtttgcatacccgcgaaaaaaagtag

SEQ ID NO: 3562 - DNA, 261 bp, Xenorhabdus bovienii
  Coding sequence Name=Xb4151_4152.C439.gene130.dna; Position on contig= 83925..84185bp; Strand=-
atggcgtcgtcactgtcgcttggttcgcggctcttgattgcgataatcaggggctaccagttggtgatcagtccactgttggggcctcgctgtcgttttcatcctacctgttctcaatatggcattgaggcattgcgcaggtttggaatgataaaaggcagttggttaacagtgaaacgcatattaaaatgccaccccttacacgtaggtggtgatgatcctgtcccacctaaaaaaaacgaagataacagagaacattaa

SEQ ID NO: 3563 - DNA, 360 bp, Xenorhabdus bovienii
  Coding sequence Name=Xb4151_4152.C439.gene131.dna; Position on contig= 84149..84508bp; Strand=-
gtggttaagctcgcttttccgagggagttacgtttgttaactcccgagcatttcacttatgttttccagcagccacaacgggcaagctccgcagagataaccattcttgggcgccttaatgagctggggcatccccgcatcggtctaaccgtcgctaaaaaaaatgttaaacgcgctcatgaacgtaatcgtattaagcgattggctcgtgaaagttttcgtttaaaccagcataatttgccttccatggattttgtggttttggtgaggaaaggggttgctgagcttgataatcgtgagctaacggaggcgttgggcaaattatggcgtcgtcactgtcgcttggttcgcggctcttga

SEQ ID NO: 3564 - DNA, 141 bp, Xenorhabdus bovienii
  Coding sequence Name=Xb4151_4152.C439.gene132.dna; Position on contig= 84527..84667bp; Strand=-
atgaaacgcactttccaaccgtccgtactgaagcgtaaccgtactcatggtttccgctctcgtatggccactaaaaatggtcgtcaagttctggctcgccgtcgtgcgaaaggccgtactcgtctgactgtttctaagtaa

SEQ ID NO: 3565 - DNA, 120 bp, Xenorhabdus bovienii
  Coding sequence Name=Xb4151_4152.C439.gene133.dna; Position on contig= 84695..84814bp; Strand=-
ttgactaggggtagtacattttattacaatcctgcctctttctatatattgatgttgcgactgaggcatcggtgtctacttatttctcactggtcgccaacgaatttgctgaatcagtaa

SEQ ID NO: 3566 - DNA, 144 bp, Xenorhabdus bovienii
  Coding sequence Name=Xb4151_4152.C439.gene134.dna; Position on contig= 84929..85072bp; Strand=+
atggccggaaaaaatcgttggcgtaacacgcagggtggaggattatacggactgtgtaataaagcgcaaggatcatacaccgatccttacaccttaatcgtgatcatcacgttgttttcgcatcatattttaaacaatagctaa

SEQ ID NO: 3567 - DNA, 114 bp, Xenorhabdus bovienii
  Coding sequence Name=Xb4151_4152.C439.gene135.dna; Position on contig= 85073..85186bp; Strand=+
atggaatttgctatataccatgattacactacagtatcttctacgagccttatattctccgagtgccaaagcgtggcgatctccctgtggataaaaagcgtcaaagctgtgtaa

SEQ ID NO: 3568 - DNA, 1527 bp, Xenorhabdus bovienii
  Coding sequence Name=Xb4151_4152.C439.gene136.dna; Position on contig= 85252..86778bp; Strand=+
ttggggagcgatgatagtcaaaatcgccacaaggtacatgcgaccttcctcatcatcggaggagtgacgccttgtacccagtataacgtatctattattccgatttcttttattagtcttgttttaggggagttcgccgtgtcactttcgctttggcagcaatgtcttgcccgattgcaggatgagttacctgccacagaattcagtatgtggatacgaccccttcaggcagaactgagtgataacactttggctctctatgcccccaaccgtttcgtgctggattgggtaagagagaaatatataaacaatatcaatttgttattaaatgatttctgtggtcctgaagtaccgttactgcgttttgaagtcggtaataagcctgtttcaccgaaccagtctacatctcagaaaatcattgccaacatgccgatagctactgcgccgtccagtttatctgtacgcccaagctgggataatgcaaaagcccagccagagttatcctatcgttccaatgtgaacccaaaacatacgttcgataactttgttgaaggtaaatccaaccagctcgccagagctgcggcccggcaagttgccgataatccgggaggcgcatacaatccgctgttcctctatggcggcaccggcttgggtaaaactcaccttttgcatgccgtcggcaatagcatcatggcgcgcaaagccaatgcaaaagtggtatacatgcactctgaacggtttgttcaggacatggtaaaagctttacaaaacaatgcgatagaagaatttaaacgttattatcgctcagtggatgccctgctgatcgatgatattcaattttttgcgaataaagagcgatcccaagaagaattctttcacacgttcaatgccctgctggaaggtaatcaacagattattctgacctcagatcgctatccaaaagagatcaatggcgtcgaagatcggttaaaatcacgttttggctgggggctgaccgttgccatcgagccaccggaactggaaactcgcgttgccattctaatgaagaaagctgacgagaaccaaatccagttaccgggtgaagtggctttctttattgccaaacgcctgcgatccaacgttcgtgagctcgaaggcgctttgaacagggtcatcgccaacgccaattttaccgggcgggcgattaccattgattttgtacgcgaagcactacgtgacttattagctctacaagaaaagctggtaactattgataatattcagaaaacagtcgctgaatattacaaaatcaaggttgctgatctgctttccaaacgccgttcacgctccgttgcccgcccaagacagatggcaatggcgctggcaaaagagctgacgaatcacagtttgcctgaaatcggggatgcctttggtggacgtgaccatacaacagttcttcacgcatgtcgtaaaatcgaacagctgcgtgaggaaagtcatgatatcaaagaagatttttctaacttaatcagaacattgtcttcctag

SEQ ID NO: 3569 - DNA, 1101 bp, Xenorhabdus bovienii
  Coding sequence Name=Xb4151_4152.C439.gene137.dna; Position on contig= 86783..87883bp; Strand=+
atgaaatttatcattgaacgtgagcaattattaaaacccttacagcaggttagcagccccttgggtggccgccctaccctgccaatcttgggcaacttgttgttgcaggtgacggaaagttccctgttgctgacaggcacagatttagaaatggaaatgaaggcacgggttgctctgactcagccgcatgaacagggcgcaacaaccatccccgcacgtaaattttttgatatctggcgagggttgccggacggagcggaaatcagtgttgaactggatggcgatcgcattctggttcgctctggccgcagccgtttttcactgtctaccttgcctgcttcagattttcctaatcttgatgactggcagagcgaagtcgaattttctctgccacaggcaacactgaaacgtctgattgaatccacccagttttcaatggcacatcaggatgtccgctattacttaaacggcatgctgtttgaaaccgaagaggaagaactgcgtaccgttgcaacagacggccaccgtctggcagtttgctctatgaatatcggccagaacctgccttcccattcggtgatcgttccccgtaaaggcgtcattgaattgatgcggctgctcgatggcggcgatagcctgctgcaattgcagattggcagcaataacattcgcgcgcatgtcggtgatttcatcttcacatcaaagctcgtggacgggcgctttcctgattaccgccgcgtactgcccaaaaacccagataaaacgctggaagcaaactgtgacgtgcttaagcaggcattttcacgggcggcgattttatccaacgaaaaattccgtggtgttcgtatctatttaagcgaaaaccaactcagaattaccgcaaacaacccggaacaggaagaagcggaagagattgtcgatgtcagctaccaaggcactgaaatggaaattggcttcaatgtcagctatgtgctggatgtcctgaatgcattgaaatgcgagcaggtaagtctcttgctgacagatgccacctccagtgtgaaaatagagaattcagccagtcaggccgcgacttatgtcgtgatgcctatgcgcctgtaa

SEQ ID NO: 3570 - DNA, 1092 bp, Xenorhabdus bovienii
  Coding sequence Name=Xb4151_4152.C439.gene138.dna; Position on contig= 87902..88993bp; Strand=+
atgattctctcgcgtttgctgatccgcgattttcgtaatatcgcggatgccgatctgactttggcaaccggttttaattttctggttgggccaaatggcagtggtaaaacaagtatactggaagccatttatacattgggccatgggcgggcttttcgcagcattcaggcgggaagggtgatccgccacgattgtgaagaattcattcttcatgggcggctggaacagcaattccacgaacggatcttggcggtagggctgagtaaaaatcgtctgggtgacagcaaagtcaggatcgatggcagtgacgggcataaaattgccgaactggcgaaaatgctgccgatgcaacttatcacgccagaaggttttacgctgctaaacgggggtcctaaataccgccgcgcttttattgactggggctgctttcacaatgagccgcgtttttttactgcctgggtcaacctgaaaaggctgctcaaacagcgaaatgcggcgttgcggcaagtaacccgctatggccaaatccaacactgggatcgcgaacttgcaccgctagcgactgaaataagccaatggcgggctgaatacattgcaggtattgctgaagatatcgagaaaacctgcaaacaatttttacctgaattcaccctcagcatcagcttccagcagggctgggacaaagagagtgaatatgcagaactgctcgcgcggcaattcgagcgcgacagaacgttaacctacacagcttccggcccccataaagccgatctacggatcagggtggacggcacaccagtagaagatatgctctcccgtggtcagttgaaattactgatgtgcgcgttgaggttagcgcagggtgaatatttcacccgacagagcgggcaaaaatgcctgtatctgcttgatgattttgcttctgaactggatgccggccgtcgtcaactgttagccgagcgtctaaaatctacgcaagctcaggtatttgtcagtgcaatcacgcctgggcaagttacagacatgattgatgtaaatagcaggatgtttcgcgtagaacatggcaaaatcgaggttcaaccacaggattaa

SEQ ID NO: 3571 - DNA, 2415 bp, Xenorhabdus bovienii
  Coding sequence Name=Xb4151_4152.C439.gene139.dna; Position on contig= 89012..91426bp; Strand=+
atgtcgaatacatatgactcctcaagtatcaaggtattaaaagggctggatgccgtccgtaaacgtccaggcatgtatatcggtgataccgatgatggtacaggcctgcaccacatggtcttcgaggttgttgacaacgctatcgacgaagccctcgcaggtcattgtgacaaaatacttgtcaccatccatacagataactctgtttctgttcaggatgatggccgcggtattcctaccggcatacacgaagaagaaggtgtttcagcagcggaagtcatcatgaccgtgctgcatgcggggggtaaattcgatgacaactcctataaggtttccggtggtctgcatggtgtaggggtttctgttgttaacgccttatctgaaaaactggaactaattatccgtcgggacggcaaagtccacgaacaaacctaccagcatggggttccacaggcgccgttgaaaacggtcggagatactgagcagactgggacaactgtccgtttctggccaagtatggatacgttcaagctcaacaccgaattcgaatatgatattctggcgaaacgcctgcgtgagctgtcattcctgaactccggcgtttccatccgtttagtcgacaaacgcactaatgcagaagaccatttccattatgaaggtggtatcaaggcgtttgttgaattcctgagccgcaataaaacgcctattcaccccaatgtcttctatttttccacggaaaaagacggtatcggcgtggaaatttccatgcaatggaatgacggttttcaggaaaacatttactgtttcaccaacaacattcctcagcgcgatgggggagcccatttggttggtttccgtgccgcgatgactcgtaccctcaacagctacatggataaagagggttacaacaaaaaatccaaaattaatgccacaggtgatgatgcccgcgaaggcttgattgcggttatttctgtcaaagtccctgatccgaaattctcttcccagactaaagacaagctggtttcttctgaagtgaagactgcggttgaaacccagatgaatgagaagctggtagaatacctgctggaaaacccgaacgatgccaaaacggtcgtcggcaaaatcattgatgccgctcgtgcccgtgaagcagcgcgtaaagcccgtgaaatgacccgccgcaaaggcgcactggatctggcaggtctgccgggcaaactggctgactgtcaggagcgtgatcctgctctgtccgaactctatctggtggaaggtgattctgcgggagggtcagcaaaacaggggcgcaaccgtaaaaatcaggcgattctgcccctgaaaggtaagatcctgaacgttgaaaaagcgcgttttgacaagatgttgtcttcacaggaagtcgcaacgttaatcaccgcactgggctgcggtattggccgtgatgaatacaacccggacaaactgcgttatcacagcattatcatcatgaccgacgccgatgttgatggttcccatatccgtaccctgctgctgacgttcttttaccgccagatgcctgagatcattgaacgtggctatgtctatatcgcccagccacctctgtacaaagtgaaaaaaggcaaacaagagcaatacatcaaagatgacgatgccatggaagcataccagatgtcgattgcactggatggcgcatctctctacaccaatcagtacgcaccagcactgaaaggcgaagcgttggaaaaactggtcactgagttcaatgccagtaacaaaatcattaaacgcatggaacgcctgtatccgcaagctttactgaataatctgatttaccacccgacattgaccgaagatgccttgaacgatcaggcaaaagtggaagaatgggtgagtacgctggctattagtctaaatgataaagagcagaatggcagcacttacagttatcaaatccacgagaaccgtgagcgtcagatttatgagccggttctgtgtatccgtacacatggcgttgataccaactacaatctggatttcgatttcatccacgggggcgaataccgccgcatcaccaagctgggagaattgattggcaacctgattgaagaaggtgcatacattgaacgtggcgaacgccgtcagttagtcagtaattttgaacaggcattagaatggctgactaaagagtcccgccgtggcctttccatccagcgttataaaggtctgggagaaatgaaccctgatcaattgtgggaaaccaccatgaacccagaaacccgccgtatgatgcgtgtaacagtgaaggatgctattgctaccgacctactgtttacgactctgatgggagatgcggttgaacctcgccgtgcatttatcgaagagaatgcactgaaagcggcaaatattgatatctaa

SEQ ID NO: 3572 - DNA, 132 bp, Xenorhabdus bovienii
  Coding sequence Name=Xb4151_4152.C439.gene140.dna; Position on contig= 91454..91585bp; Strand=+
atgaccacattccaatcgggaatgtggtcattaaactcagataggcttcttcctgccaaagttatctccagctattaccatcgcccttcaaaaattatactggacaaaaaagatattccatttacactatag

SEQ ID NO: 3573 - DNA, 147 bp, Xenorhabdus bovienii
  Coding sequence Name=Xb4151_4152.C439.gene141.dna; Position on contig= 91528..91674bp; Strand=-
atgagtttatatgaagtgaatagtaatctgggttattattacttattattatgtatttatggaatggtttatcgtataaatagctatttctatagtgtaaatggaatatcttttttgtccagtataatttttgaagggcgatggtaa

SEQ ID NO: 3574 - DNA, 186 bp, Xenorhabdus bovienii
  Coding sequence Name=Xb4151_4152.C439.gene142.dna; Position on contig= 91702..91887bp; Strand=+
atgctaaaaataacaaattcttttgatggttatattcataaaacatcaacaagcagtctatcaagatcaaaatccttcaatactcttccacctgataacatattaagtataaatataaacagaaacaatccaagattaattaatgaatttatccctgtggtcagagaaaccaataaagaaaaatga

SEQ ID NO: 3575 - DNA, 261 bp, Xenorhabdus bovienii
  Coding sequence Name=Xb4151_4152.C439.gene143.dna; Position on contig= 91892..92152bp; Strand=+
atgaatgaaattaataatattcataatactattataaaagatagatggttttctcatattgaaaacattaataaccaaaacaagaccatacagaaaatcagagagagaaagtcattatgggatatgagatgccatacaacaaatagaatgcttttgaaaattaaatataaattatctgaacccaatatggaatatgacgaaacatgcacttactttattctttacattgacatagccccccatcggagctatgttatttaa

SEQ ID NO: 3576 - DNA, 777 bp, Xenorhabdus bovienii
  Coding sequence Name=Xb4151_4152.C439.gene144.dna; Position on contig= 92237..93013bp; Strand=+
atgctaaaacgaaacaactcctttaaggattatatatcaaagattcaatccgaatctttatctcgctcaaaatctttccattcattaccacctgataatattttgaaagcaaacgttaattacaacaatcccagattgattaatggatatattcctacagtcagagaaaccagcctagaagagataattaatgctgttaagcatatttacaaatcaattaaggaagacagatggactagtcatattaaaaatgtgactgaaagaaaaaatgaaatattccaaaaaaatcaaaaaacacgtgaagatgcatgggatatgagatgctgtatgacagataatcttttagaaaaactacagggaattttaaccattttattaaaaaatggttactttaaaactcatgcttattttgtgtgttacattaatacacaaccaatcggagtcatgttattaaaaaagtataactctttatatagcagaggaacagcatactatcctgaggttaattttattatcaatcatccaggcatccagaattgcgcctatttattgatggaaaaagcagtaaatacttcctataaaataggttatcaagggaaattaaaattgacacttgcaacaggtgaactctcttcaaaagtttatcaaaagatggggtttactcatattaaaggggatgagaatatgaaaatggaattaaacccaaatggaaacagtgtctggtatctaagccccagttatggcggttatttttttacagggatccgccgagattaa

SEQ ID NO: 3577 - DNA, 147 bp, Xenorhabdus bovienii
  Coding sequence Name=Xb4151_4152.C439.gene145.dna; Position on contig= 93033..93179bp; Strand=+
atgcaaactctaaccgccaatttattggttgaattggcggtttattttcacgaacctaataacaattccgttcttgctacaacaaaatacgcaacatccggcgcaacggctcagccgctccccatagaagctgatcacccacggtaa

SEQ ID NO: 3578 - DNA, 1155 bp, Xenorhabdus bovienii
  Coding sequence Name=Xb4151_4152.C439.gene146.dna; Position on contig= 93109..94263bp; Strand=-
atgatatcagtgtgtctgataaacatctttcaagatagggtaagcatgatgaaaaatgtaggttttatcggctggcgtggcatggtcggctcagtattggtacagcggatgttggaagagcgggattttgatgaaataaatccggtttttttcacgacttcccaacacgggctttctgccccggaatttgcaggaaaatcaggtgtattacaggatgcttttgatattggggcactaagtgcgttggatatcatcattagctgtcagggcggggattataccaatgaaatttatcccaagctgaaagcaaccggctggcagggatattggattgatgccgcatcttccctgcgtatgagtgatgatgctaccattattctcgatccgattaaccatcaacatattcaaaacagcctgaataaaggcatcaaaacctttgctggcgggaactgtaccgttagcttgatgttgatgtcattgggcggattatttgccaatgatctgatcgagtgggcatcggtatcaagctatcaggcagcttctggtagtggtgcccgccatatgcgtgaactgctggtgcaaatgggaatgctgcataatcaagttgcagatgagttgcaagatccggcttccgcaatcttggatattgaaaaacgtgtcacggattttacccgcagtggtgcattgccgacagatcaatttggcgtacctctggcgggaagcttgatcccgtggattgataagcaattggaaaatgggcagagtcgcgaagagtggaaaggtcaggcggaaactaacaagatcttaaacacgggcagcaatgtaataccaattgatggcttatgtgtccgcatcggggcattgcgttgccatagtcaggcattcaccctgaaattgaaaaaagatattccgatccatgaaattgagacgctgttggcttcccataatgattgggttcgtgtcattccgaatgatcgtgaactgacaatgcgagagctgacacccgctgcggtgactggcacattgaatacgccggtgggtcgtttgcgtaaactgaatatggggccggaatacctatccgcttttaccgtgggtgatcagcttctatggggagcggctgagccgttgcgccggatgttgcgtattttgttgtag

SEQ ID NO: 3579 - DNA, 114 bp, Xenorhabdus bovienii
  Coding sequence Name=Xb4151_4152.C439.gene147.dna; Position on contig= 94238..94351bp; Strand=+
atgtttatcagacacactgatatcattaaagctgacaaaatatggcgaaaggtgcaagtaaatttatgtcctacagtactatcatttgagcagcaatgcgtttgccgtttttaa

SEQ ID NO: 3580 - DNA, 273 bp, Xenorhabdus bovienii
  Coding sequence Name=Xb4151_4152.C439.gene148.dna; Position on contig= 94333..94605bp; Strand=+
atgcgtttgccgtttttaaaccatatcgcggtgggttcacaaatgtcagacactcattctccagcaggaattggtactccaagttttggggatcttaaaaaaggtaagggtgttaaaagactacagaaaaaatgtaggtttctgatcaccgtttctttttattcatacctgaactgctttaagacgcggattagttttacaaatgacatatacacggccacggagacgaacaatcttacaatcaggatgtcgttgctttgctgttttcaatga

SEQ ID NO: 3581 - DNA, 156 bp, Xenorhabdus bovienii
  Coding sequence Name=Xb4151_4152.C439.gene149.dna; Position on contig= 94535..94690bp; Strand=+
atgacatatacacggccacggagacgaacaatcttacaatcaggatgtcgttgctttgctgttttcaatgaactcaatacctgcaaaatcctttttatttgttgcccaaaaatgagtggctcagtgtggcgccagttgcttgcccacgggctttaa

SEQ ID NO: 3582 - DNA, 1452 bp, Xenorhabdus bovienii
  Coding sequence Name=Xb4151_4152.C439.gene150.dna; Position on contig= 94794..96245bp; Strand=-
atgagtaaccagtatgatgttttgatcatgggagccggggttgctggtattggtatggcatgtcatttaacaagagaatgtcccgataaaaaggtgattattttagagcgccgtcatgctatcggagggacttgggatttatttcgttatccgggcatccgttcagattcagatatgatgacttttggttataaattccggccttggtctgaaaccagtgtttttgccgatggcgagtcaattaaaaattatgtcaataaaacggcaaaagagtatggaattgataaaaaaattcagtttgggttaaaaattactaatgcggactggtctggcacgactaaccaatggagcattaccgctgttgaggaggcgagtggagaaactcgaacctttacctgtaattatctggtcgcggcgacgggttattacaactatgatgaagcgtatctacctgaattccccggtattgaggatttcaaagggcccgttattcatccccagcattggcctgaaggactagactataaagggaaacgggttgttgttattggtagtggagcgacagcagccacgttagttccaacaatggcaaatattgccgaacatgtcactatgctacagcgctcccccagttattatttgtctgtacccggaacagataaaatcgctgagtttttaagtaaatttatgccaaaacgctgggtttactcatttagccgaaatcgtaatatctttattcaccgtttactttataaaaccagccgatatttacctacgttgttgaaatcgtttttattgtcgtcagcccgcaaaagggttgggccaagttttaatatgaatcaccttacaccaaagtacatgccttgggatgaacggttgtgtgtgatccccaatggtaattttttaaagtcactgaaagaaggcaaatcctctattgtgaccgaccaggttaaacgctttactgaaaatggaattttactgcaatctggtaaggagctgccggcggatatcatcgtttctgctactggtctgaaattactccctcttggtggaattgaaatttctattgatgagcaaaaactacagggcaataatcgtatgctctacaagggaacgttgatacaggatattccgaattttgcctatctgtttggctatatcagcagttcttggacattgaaagtggatctatccgcagattatgtttgccgattattgaaagagatggatcgtcgaggtgctaaatctgtgacagcttatgctcagccggatgaaatgttgaaacacgaaaacatttttggcgagctacaatcgggttatgtgaggcgaggtgatgaaggtcttcctcgtcaggggcgcagcccgaattggtatgtttcacatgattataaaaaggataaagaggtattggaaaaacagccggtagaagattcagcacttagatggatgtag

SEQ ID NO: 3583 - DNA, 135 bp, Xenorhabdus bovienii
  Coding sequence Name=Xb4151_4152.C439.gene151.dna; Position on contig= 96316..96450bp; Strand=-
atgtatttcaaaaacagttctcattttactggtcatattcaggttgctttagccatgcgtctgatcggtagcaataattccctgtctctaaccatgatactcctatctcataaatacaaatggttgtcctattga

SEQ ID NO: 3584 - DNA, 1242 bp, Xenorhabdus bovienii
  Coding sequence Name=Xb4151_4152.C439.gene152.dna; Position on contig= 96520..97761bp; Strand=-
atgagtttgatgaaaaaatatagtgtcactaattttgttatataccaagtcagtgatgttttattcactatctccattaaaacaataggaatgttgtttacatgggttatgcttaatcaactcggattagtcgttgagttaggctattttctttttatatcgtgggcattgcaggtgcttactttgcttgctttcggtttatatggtgacaagttttcaactaaattctatttgatttcattctgtattttaagcttacttattatctccagcctgtactttattgaaagtaaaaactacttttactggggaatattttttatcatcacatctctgttctctatactgacccaaccgattggaaacagtatcatcagccgaatattgcataatacaaacaccgatcttgctttcagggctagagggttggtcagttcactgaacgttgtatcaggcccggctatctctggaatattaattagttatcttgcatatgggcatatactcgtcattgtattttgcagtgtcgtcatctctttcttaggttttctttgggtttctatgatgccatcagaaaaaaaagcggatacatcaaaggtaagtttaaagatcttaaagaacaaccctacagaattaaggttaggtgcaatttcgggtatttttaattttgtcatcgtcccattagtttcttactttattccttttttgatcatcgatacgatgaaactaggtgcatttgacttggggatagctgagtttttctttggtgcgggaatgttcttagggagtagcgttttagtaaaatttttcaatcagatactcggtaaaggttatgcatcattgactggaactattttagtttcactgggtattttcggcgtatccatatcgcagtcaaatattcatatcaatatatccatgttgattgcaggtattggcgttgttatttataacataaacacaacatctatcaggatgacggcaacgccttcttcacaaaggcactccatggaatctgtatttttatctctgtgcattattcccattccattgggaatgttattttctacttacagtatccagtttctaagtgttaacagcattctgcttggcatgtcattgatattgttattctgttctattttgattattaaaacgcctaattttatgcatctttgcaagatgagcagtgaatcgttggatggatattatgaaaaactatatccgcgttctgttagttaa

SEQ ID NO: 3585 - DNA, 129 bp, Xenorhabdus bovienii
  Coding sequence Name=Xb4151_4152.C439.gene153.dna; Position on contig= 98024..98152bp; Strand=-
atggtaattttagttttatttgttacgttatttattatttttacagatatattggtagtagttatttcttttgcagttatttttattttatgtatttttgtactttacctaatttacatcataatatga

SEQ ID NO: 3586 - DNA, 147 bp, Xenorhabdus bovienii
  Coding sequence Name=Xb4151_4152.C439.gene154.dna; Position on contig= 98416..98562bp; Strand=-
atgctcaatgtgctgtgtatagcgctttatagtggccaaaatattcaggtaatatttaaatcatcttccccttgcaacagtaaaaatgtggttaattactcatcagcattacaagagaatttcttttatgaatactcatattcttag

SEQ ID NO: 3587 - DNA, 744 bp, Xenorhabdus bovienii
  Coding sequence Name=Xb4151_4152.C439.gene155.dna; Position on contig= 98570..99313bp; Strand=-
atggcacagttgacgattggcaaaatagatatgcagctcaatcgcaaagcgataaagaacctgcatatcagcgtattgcctcctgatggacttgtacggatatcagcaccgatgcatatgagtgataccgccattcgaatggcggtgatcagccgcatcccctggattaaaaaacagcagcaggatttcgcacgccagccacgccagtcagaacgtgagatggttaatggcgaatgccactacctttggggaaggcggcatcgtttaaatattgttgagcatgtcggtaagcaacaagttaagaccagtggagaaaagatttatctttatgttccttatggtgctccatttgagaaaaaagcacaggtactttcagattattatcgagcagctttaaaagaacgaatagaaaagctgttaatgcactggcaacccattattggtgtgatgccttcgtcatggggcatcaaaaaaatgaaaaccaaatggggtagctgtaatactgtttctggcagtatctggctaaacttagaattggcaaaaaaaccactggagtgtctggaatttattttggttcatgaactagtgcatcttttagagcgcaaacataatgagcgatttatgacttatatggacggctatttacctgattggagagaaaggaaaaggttattaagtattttgccactgtctaatgatgagtgggtgactccctgtgtagccttactagatatctccgattaa

SEQ ID NO: 3588 - DNA, 3090 bp, Xenorhabdus bovienii
  Coding sequence Name=Xb4151_4152.C439.gene156.dna; Position on contig= 99313..102402bp; Strand=-
atgagcaccgtaggccagcgcgaacgcgtaactcaagatcgcattgtcaaatttttccagacggaattaggttaccgctatctgggaaatttacaggacagagacaataagaatattgacgtagatatactgactgcatggttaaaaaagcggggaatcagtggcacattgattggccgtgtgttgcgtcagttgattaataccgccgcgctgggcgatgggaataagctctatcatgccaacaaaaatgtctataatttgttgcgttatggcattaaagaaaaagaagatgtgggtgagcagcatcagactatttggttgattgactggcacaacccagaagccaatgattttgccattgctgaagaagtctccattaaaggagaaaataaaaaacgtccggatatcgtcctgtatgtaaatggcattgctttgggaattatcgaactgaagcgttcaagtgtctccgtttcagaaggtattcgtcagaatctggataaccagaaaaaagagttcatccgtgactttttcagcaccatgcaactggtgatggcagggaatgacacacaaggattgagctacggtactattggtacacctgaaaaatattatctggaatggaaagaaaggattgataacccttacccctatcgtttggattttcacctcagccgaatttgcagcaaaccacgttttctacaattaattcacgattttattgtgtttgatgcaggtgttaagaaagcttgtcgtcataatcaattctttggtgttgaggctgcaaaaaaacgtattctccaacgcgaaggtggcattatttggcatacacaaggttcaggaaaaagcctgactatggtttggctggcaaaatggatacgggaaaatgtgccaaatagccgcgtgttgattgtcaccgaccgcactgaattggatgcacagatcgaaaaagtttttactggggtagaagaaaatatttatcgcactaaaagtggtgcagatctgattttcaatcttaatcggccaaatccgtggctgatttgttctttagtacataaatttggtcatcggtctgaagcagaagacgatgcagcaacggatgaatacatcaaagaactcaaaaaatcattgccgagtgatttcagagcgaaaggtgatctgtttgtatttgttgatgaatgtcaccggactcaatccggtaaattgcatgatgcgatgaaatctatattagcggaagccgtgtttattggttttaccggtacacctttaatgaaaaaagacaagaaaaaatccattgaagtatttggtagttttattcatacatataagttcgatgaagctgtttctgatggtgtaatactggatttgcgttatgaagcccgtgatattgatcagtatctgacttcgcaaaaaagaatcgatgaatggtttgaagctaatacacaagggttgtcccgtttgggcaaaacccagttgaagcagaaatggggaacaatgcagaaggttctttccagtaaatctcgtttggaaatgatcgttatggacatcaggctggatatgatgaaacgtccacgcctgatggatggacgaggaaatgccatgttggtttgctccagcattcatcaagcttgtaccgtttacgatttgttcagccaaacagatcttgctgggaaagtagcaattatcaccagctataagccagactctgcaagtattaaaggagaagaaacgggagaaggcctgacagagcagctagctaaatataaaacttatcgtaaaatgctggctgattattttgaacaaccagaagataaagttgctaaccgggttgaagagtttgaaacgaaagtaaaacagcaatttattgatgagccaggacaaatgcgtttacttatcgtggtagataaattgctgacaggttttgatgcgccttccgcgacttatctttatattgataaacacatgtctgaccataatttattccaggccatttgccgagttaaccgtctggatggagatgacaaagaatatggctatattattgattataaagatttgttccgttccctgaataaagcgatatccgattataccaaagaggtatttgacggatacgacaagaaggatatcgatgggctgttgaaaaatcgtctggaacaagccagattaaatctggatgcggcattggagatggttagagcgttatgtgaacccgttaaagctccacgtaacacgatagattatattcactatttttgctgtgaatcgggagctgatcctgaattgctgtctgaaaaagaagcgttacgtttggcactatatcagtgtgtagcaaagctgttgcgtgctttcgcaaatattgccaatgaaatgaccattgctggatattctcctgcacagatggagaaaatccgtgcagaagtcgctcattatgaaaaagtacgtgacgagattaaactcgccagcaaagataaggttgaaatgaaacgttacgaaccggcgatgcgtagtcttatagatatgtatatccgggcggacgacagtgaagttctcatagattttgaagaaattggtcttttggaacttattattcagaaaggtgcggcagtgggagaggatttacctgagggaatacgtaaagatcccgaggcgatggcagaaacaatagaaaataacgtacgtaaaacgattgttgatgagaaccctgttaacccgagatattacgaacatatgtctgttttgctggatgagttgatcgctttacgtcgtcaaaatgcactaaactatcaggagtatctggaaaaaatccgtgatctcgctaaaaaagttgttcgcccgaatcagaacactgccgcttatccacctgatattgatacccctcctaaacgggcgttttatgataatttcgatcagaatacggatctggcaatctgcattgacaaaacaatacgtgatacgaaaaaagcagattgggtaaatgacagatttaaagaacgtgaaatcgcgaatgcacttcgtgacgaaactgccgaatataaagtggatattgataagataatggaacttgctaaagcgcagagagactaccgctga

SEQ ID NO: 3589 - DNA, 1359 bp, Xenorhabdus bovienii
  Coding sequence Name=Xb4151_4152.C439.gene157.dna; Position on contig= 102448..103806bp; Strand=-
atgaatcagatagcagagggcaattctaaatatttggctgaatcggtagggaatactttgcctattggatataagcaaacggaagctggagtgatacctgaggcttgggtggttaaaagcattggtgaacttgctaatgttataagaggagccagcccaagaccaaaaggtgacaaacgctattacgatggaaagattcctcgtcttatggttgaagatgttacacgagatggaaagtttgttactcctatcgtcgattcgcttaccgaagccggtgctaaattaagtaggccatgtctaaggggaactctgacattagtgtgttcaggtaatgtcggtataccttcaatattagctattgatgcatgtatacacgatggtttcttagctctaacaaaagtatcaaaaaatatatctatcgattatctttatcactttttttcgactcagcgtgagaaatttaataattcagctacacatgggggcgtatttacaaatttaacgactgaaggcgtaagagagtttttagttgctttacctttttgttatgaagaacaaactactattgccaacatcttatctgatgtcgatggcctaatcagtgagctggaaaaactgctagccaaaaaacaagccatcaaaattgcaaccatgcaacagttactaacaggccgtactcgcctgccgcagtttgcttttcgtgaagatggttcgaaaaaaggatacaagcgaagcgaattaagggaaataccagaggattggaatccaatttctattggtaaagatgctgtactaaaagcacgcatagggtggcaagcgttaacaactaaagagtatttagagactggtgagtattatctggttactggaacgaattttgatgcaggcacagttaaatgggaagattgctggtatgttagtgaatggcgttataaacaagactcaaacatacaattaaaagaagatgatgttcttattacgaaagatggaacaataggaaaggtgggttacgtagagtttcttaggcttccttcaacattaaatagtggagtatttgttatacgacctaaaaataatgccttccatcctaggtatctgttttatattcttacatcaaagatatttaatgaatttatgaaaggtattaccgctggttcgacaattacgcacttataccaaaaagattttgttaactttaacttcatagctccaaatattgaagaacaaaccaccatcgccacaatcctcttggatatggatacagaaattcaagcacttaaacagagactgggaaaaactcgtcaaattaaacaaggtatgatgcaagagctactcactggtaaaactcgtctgatataa

SEQ ID NO: 3590 - DNA, 2460 bp, Xenorhabdus bovienii
  Coding sequence Name=Xb4151_4152.C439.gene158.dna; Position on contig= 103809..106268bp; Strand=-
atggcaatcaaaaagaacgaactctattcctcattgtgggctagctgcgatgagctgcgtggcggtatggatgccagccagtacaaagactacgtgctgaccatgctgtttatgaagtatgtgtccgataagtacaagaatgatcgttacggcattattgttattcctgaaggtgctggttttgatgatatggttgccctgaagggcaaaaaagacattggcgatgaaatcaataagattatccgcaaattagctgatgaaaacgggttgggaaccatgtttgatgttgccaactttaacgatgaagaaaagcttggtaaaggcaaagagatgattgaccgcctttccaaattagtcggtatttttgaagggttggatctctccaataattatgctggtggcgatgatttgatgggtgatgcctacgaatatctgatgcgccacttcgcaactgaatctggcaaatcaaaaggacagttttatactcctgcggaagtttcgttagttctggcaaagattataggaataaacgataaaactccgcgtgatgcttctgtatacgacccgacctgtggttccggttctctgcttcttaaagcgagtgatgaagcaccgcgtgggttaagtatctttggtcaggagatggatgtgactacttcatcactggcaaaaatgaatatgattctgcatggtcatgaatctgatgttcatagtattcagcagggtaacaccattgcctctcctgtatttaaagatgataaaggacagcttaaaacttttgatttcgccgtagcaaatcctcctttttctaataaaaactggaccagtggtattaacccgagagaagatgaatttggtcgttttggttggggaattccaccagagaaaaacggtgattatgcctttttattgcacatcctcaagagcctgaaaagtacaggtaaaggggctgtaatcttgcctcacggtgtattgtttcgtggtaatgctgaatccctgattcgtgaaaacctgataaagcagggttacattagaggtattattggtcttccggcaaacctgttttatggcacaggtattccggcctgtattattgtgctagataagcaggatgccatttctgctgattttgatgcagaagggaaagtaacccgtgggcgtgatatttttatgattgacgcaagccgtgattttataaaagacggtaataaaaaccgcttgcgtagtcaggatatctataaaatcgttgaagtttttactcaacagaaaacattgccacgttttagccgaacagttgaattcaaagagattgtagcgaacgactacaacctcaatatccctcgttatatcgacagtagtgaaccggaagatttgcacgatctcagcgctcatctgcaaggggggattcctaaccgtgatattgatgtgctggataaatactggaatgttttccccggcattcgctctacattatttgcaacggagcgcgaaggatacagccacagcttggtggaagccaatcaggtcaaagatactattctcaaccatactgaatttaaaacttttgcggaacaaagcctaaaaccgtttgccgcatggtgtcaatccgctgcactaaaagaaattcatcgtagcgataatccaaaagagttacttaatgacattagtggatatttattgattaactatgagtcagtgcctctactgagtaagtacgatgtttaccagatcctgatggattattgggcagagacgatgcaggatgatgtttatgtgctggtacaagatgattgggcagcgggtaaaaaggtacgtgagctggtagtaaaacaagctgaaaaactgaaagaaacaccggattttgtgatcaagaaaactaagtataaagctgaaattattcctccggcattgattatccagaattactttgcagggcagcaggtaaaaatcgatcaattacaaattgatgcggataatgcaacacaagcgctagaaaactatatcgaagaaaacagcggcgatgatggcctgctgaatgatgccctgaatgacaaagataaagtgaccaaagcaagtattactgctcgcctgaaactggcaaccgacaatgaagaaaaaacagtactgaaacaggcaaaagagctatttgacgctgaaatagacgctaaaaaagagctgaaaaaatatcaggaagcgctggatttatcggtacttaagcaatactcaaaacttactgatgatgagatcaaaacgttggtggtggataagaaatggctagcaacattggaagctaatattcaggctgagattgagcgtgtaactcaacaattgacaaaccgtgtcagagaattggaagaacgctatgccgaatcgctgccaacaattagtaaatcggtggatagtttgagtagcaaagtggcagataatctgaaggctatgggtttggaatgggtattataa

SEQ ID NO: 3591 - DNA, 1257 bp, Xenorhabdus bovienii
  Coding sequence Name=Xb4151_4152.C439.gene159.dna; Position on contig= 106396..107652bp; Strand=-
atgggtataatcacattgaataacaaacgatatcctaggcttatagctcccaagcttaaagaggcgttaacagatacaccagtggtgtgtttattggggcctcgtcaggtaggaaaaaccacactggtaaaagagttagagtcggggagagcgtatattacttttgatgatagtacgctattgaatgctgcaaaaagcgatcccttagggtttgttcaaggattacctgagcgagtgacacttgatgaagtacagagagtaccggaaattttgcctgcattaaaagcagtagttgatactaatagaacatcagggcgtttcattcttacaggctctgccaacttgttattactgccgggagttcaggagtcattggctggacgtgttgaagtgacttatctacaacccttgtctgaacaagaaaaacagtattcatctgtgacgctacttgaaaaattgctatccaatcgtatttcaccatccattaagggagaacaagctcaactagagggaatagcggatgctgtagtacaaggtggttacccagaacccaacacccgaacagaggcgagagctcgtcagtggcataaacagtatcttaatgccattattcaacgagatgtcaaagatattgcagcaatccgcgacgaagaagaactgcttcgtcttatcaaaattctcgcgcttcgtacagggaacttactgaatattagtgggttatcgaaagatttaggactccagagagacactgttgataaatacatcactatattggagcgtttatttttagtccgtcgtttacctgcgtggcataaaaaccatgctaagagattgttgaaaacaccgaagatccacataatcgattccggtttagcgtgtgttttgactaaattacgtaccaatgattggtatgattttagtagtgatttcggcgcagtattagaaagtttcgtggtgcagcaactgatttgccaatcgggttggatcgaacatgaactatttttttctcactacagagataaagaccaagttgaagttgatttggtgattgaagatgggaaaaaagtttggggtgttgaagtgaaaaaagccgccagcattcaacctaaagacggggctggtttagctaagttggcctcactatctggcgatgattggcaaggcggaataatgctttatacagggaataactgcttaccgataagccaagtaccaaatacgtatgcggtgccgatgaatgcgttgtggaaggagtag

SEQ ID NO: 3592 - DNA, 186 bp, Xenorhabdus bovienii
  Coding sequence Name=Xb4151_4152.C439.gene160.dna; Position on contig= 107600..107785bp; Strand=+
ttgggagctataagcctaggatatcgtttgttattcaatgtgattatacccattaactattatattaaggatgatggcaaccgactatttgctggttattgtagcgactatttgatggttttgcatccgtctgtttgtatttttaatatccgactaattgctgttttaaaatgcaataattattaa

SEQ ID NO: 3593 - DNA, 1830 bp, Xenorhabdus bovienii
  Coding sequence Name=Xb4151_4152.C439.gene161.dna; Position on contig= 107985..109814bp; Strand=-
atgtgtggaattgttggtgcagtagcacaacgtgatattgcagaaatactgatcgaaggtcttcgtcgcctggaataccgtggttatgactcagccggtttggctgtggttgacagtgaaaacggtatgacccgtctgcgtgaagtcggcaaagtacagatgctggctgatgaagcaggtaaacagcctgtcactggtggtacggggatcgctcatactcgttgggcgacgcatggtgagccgaatgagctcaatgcccatcctcatgtttctgaacatattgcggttgtacataacggcattattgaaaactatgaagaactgcgtgaattattaaaagagcgcggttataccttcttttctgatacagataccgaaaccatcgcccatcttgttcactgggaacagaaacagggtggttcgttgttggaagtggttcagcgtgtgatcccacaattgcgtggcgcttatggcaccgtaattatggacagccgtcatcctgacgtgctggtggccgctcgttcaggcagcccgctggtgattggccttggcgttggtgaaaacttcctcgcatctgatcaactggcgctattaccggtgactcgccgctttatctatctggaagagggtgacatcgttgaaatcacccgtcgtaccgttcgcatctttgatgtcacaggtgcagccgttgagcgtgagcagattgaatccaacgttcagtatgatgcaggtgacaaaggtatttaccgtcactacatgcaaaaagagatctacgaacaaccgatggcaattaagagcacgctggaagggcgtttaagtcatggtcaggtagatctgtcagaactgggtgccaatgctgaagaattactgtctcaggttgaacacattcaaatcgttgcctgcggtacgtcttacaatgcgggcatggtttcacgctactggtttgaatctttggcaggtattccctgtgatgtggaaatcgcctctgaattccgttaccgcaagccagcacgtcgtaagggaagtttgctgatcaccttgtctcagtctggtgaaacggctgatactttggctgcactgcgtttatccaaagaactgggctatctgacttcgctggtcatctgtaacgttgccggttcctctctggtacgtgaatcagactttgccctgatgaccaaagcaggagcagaaatcggcgttgcatctaccaaagcatttaccacccagctgaccgtattattgatgctggtggcttacatggggcgcctgaaaggtgctgacgcagcattagaacaagatgttgtccacgcactgcaagcattgccaagccgcattgaaagcatgttgtcgaaagacaaagtcattgaagcactggcagaagatttctctgagaaacatcatgccctgttccttggacgtggcgatcaatacccgatcgcggttgaaggcgcactgaaactgaaagagatctcttacattcacgcggaagcctatgctgccggtgaattgaaacatggcccgttggcattgatcgatgcggatatgccagtgatcattgttgcaccaaacaatgaactgctggaaaaactgaaatctaacatcgaagaagtccgcgcccgtggcggccagctatatgtgttcgctgatcaggatgcaggttttaccaacagcgaaaacatgaagatcatctccctgccacacgtggaagatctgatcgcgccgatcttctataccgttccactgcaattgttgtcttaccacgttgccttgatcaagggaactgatgttgatcagccacgtaacttggcgaaatcggtgacggtggagtaa

SEQ ID NO: 3594 - DNA, 1380 bp, Xenorhabdus bovienii
  Coding sequence Name=Xb4151_4152.C439.gene162.dna; Position on contig= 109939..111318bp; Strand=-
atgtctattagtgcaaatagcgcaaaaagtgttgtgatccttgccgctggcaaaggcacgcgcatgtattctgctctccccaaggttctgcactcgctggccggtaaaccgatggttcagcatgttattgacaccgcaatggcgttgggtacccaaaatgttcatctggtctatgggcatggtggtgatctgatgaagcagactctctccaatcaaaaccttaattgggtactacaggcggaacagcttggaactggtcatgcaatgcagcaggcagcgccatattttgcagatgatgaagacattctgatgctctatggtgatgttcctttgatcgctcaagacacattagagcgtctggtggaaatcaaacctgaaggcggtattggcttattgactgctattttgaataatcctgccggatatggccgtatcattcgtgaaaatggcgaagtggccgggattatcgaacagaaagatgcaactgacgagcagcgtaaaatcaacgaaatcaacacgggtattttggtggcaaatggcggtgatttgaaacgttggttatcccagctggataacaacaatgctcagggtgaatactacattaccgatattattgctctggcccacaaagaagggcgtcaaatcaaagccgttcacccgagccgtttaagtgagatggaaggggttaacaatcgccttcagctttccgcactggaacgtatttaccaatcagagcaagcagaaaaattattgctggcaggtgtaatgctactggatcctgcacggttcgatcttcgcggtacattagaacatggccgtgatgtggttatcgataccaatgtcattatcgaaggtcatgttgcattgggaaataacgtacatattggatcgggctgcattttgaaaaattgcgccatcggtgatggcactgtcatcagcccttatactgtgatcgaagattctgaaattgctgccgaatgtacggttgggccttttgctcgtttacgtccggggtctaaactggcggaaaaagcacacgttggcaattttgtggaaatgaaaaaaacctcccttggtaaaggttccaaggcgggtcacctgacgtatctgggcgattctgaaatcggcaataatgtgaatattggtgcgggaacgatcacttgtaattacgatggtgccaataaatttaaaaccatcatcggtgatgatgtgtttgtgggttccgatacccagcttgttgcaccagtcacagtagctaaaggtgtgaccattggcgcaggcaccacagtaacaaaagacgtagctgaaaatgaactggtcatcagccgcgtgaaacaaactcatattcagggctggcaacgtcctgttaagaaaaaataa

SEQ ID NO: 3595 - DNA, 642 bp, Xenorhabdus bovienii
  Coding sequence Name=Xb4151_4152.C439.gene163.dna; Position on contig= 111392..112033bp; Strand=+
atgcaaaaaagccagttagctttcaccaactggctttttatcttactgcctatattacatccgttgttttgtcagttcgattacacgaagttttgcaatcgctttcgacaattcagcagatgcctgagcataatcaacatcgccgtgagaattacggacgtgttcttcagcctcacgcttcgcttcaagcgccttggcttcgtccaaatccttaccacggatcgctgtatcggccagtacgataacgccgtttggctgaacttcaagaactccaccggacaggtagataaattcttcttcaccaaactgcttaacaatacgtatcatgcccggttttatggcagtaagcagtggtgtgtgctgaggataaatacccagctcaccttcactgccagtcacctgaattttttgtaccagcccttcaaacaatcgtttttcagcgctgactacgttcaggaagaacgtcattgcagccatatcaacctcccgtcagccgtattacatcttcttcgctttttctacagcttcgtcgatggtaccaaccatgtagaacgcctgttctggcaggtggtcataatcaccctccaggatgcccttaaagccacgaatggtttctttcagagagacgaacttacctggtga

SEQ ID NO: 3596 - DNA, 1383 bp, Xenorhabdus bovienii
  Coding sequence Name=Xb4151_4152.C439.gene164.dna; Position on contig= 111890..113272bp; Strand=-
atggctactggaaagattatccaggtaatcggcgccgtggtggacgtcgaattccctcaggacagcgtaccaaaggtatacaatgctcttgaggttaaaaacagtgaagaaaaactggtgctggaagttcagcagcagctgggcggtggtatcgttcgctgtatcgcaatgggtacctctgatggtctgcgccgtggtttggacgcgattgatttagggcacccaattgaagttccggtgggtaaagcgacactgggccgtatcatgaacgtattgggtgatccaatcgacatgaaaggtgagattggcgaagaagagcgctggtcgattcaccgtacagcaccaagctatgaagaattgtccagctctcaggaactgctggaaaccggtatcaaggttatggacttgatctgcccatttgctaagggtggtaaagttggtctgttcggtggtgcgggtgtaggtaaaaccgttaacatgatggaactgatccgtaacatcgctatcgaacactccggttactctgtatttgccggtgtgggtgaacgtacccgtgaaggtaacgacttctatcatgaaatgaccgattcaaacgtactggataaagtatctctggtatatggtcagatgaacgagccaccaggaaaccgtctgcgtgtagcactgacgggtctgactatggctgagaaattccgtgatgaaggccgtgacgttctgttgttcgtcgataacatttaccgttataccctggcaggaacagaagtatctgcactgttgggtcgtatgccatctgcggtaggttatcagccgacactggcggaagagatgggcgttcttcaggaacgtatcacttcaaccaaaacgggctccatcacttccgtacaggcggtttacgtccctgcagatgacttgactgacccatcaccagcgaccacctttgctcacttggatgcaaccgtcgtattgagccgtcagattgcttcactgggtatttacccggcggttgacccactggattcaaccagtcgtcagcttgacccactggttgttggtcaggagcactatgatgtggcgcgtggtgtacagtctatcctgcagcgttatcaggaactgaaagacatcatcgcgattctgggtatggatgaactgtctgaagaagataaactggttgtggcacgtgcccgtaagatccagcgcttcttgtctcagccattcttcgttgcagaagtcttcactggctcaccaggtaagttcgtctctctgaaagaaaccattcgtggctttaagggcatcctggagggtgattatgaccacctgccagaacaggcgttctacatggttggtaccatcgacgaagctgtagaaaaagcgaagaagatgtaa

SEQ ID NO: 3597 - DNA, 864 bp, Xenorhabdus bovienii
  Coding sequence Name=Xb4151_4152.C439.gene165.dna; Position on contig= 113307..114170bp; Strand=-
atggccggcgcaaaagagatacgtaccaaaatcgccagtgtgcagaacacgcaaaaaatcactaaagcgatggagatggtcgccgcgtccaaaatgcgtaaaacgcaggatcgcatggcggccagtcgtccttatgcagaaaccattcgcagtgtgattggacaccttgcgttaggtaatctggaatacagacatccataccttgacgagcgcgaagttaagcgtgttgggtacttggttgtttcgacagatcgtggtttatgtggcggtttgaacattaacttgttcaaaaaattgctgatagaaatgaaagactggtctgataaaggcgttcaagttgatttagcacttgttgggtcgaaagcggtttctttcttttcttctgttggaggcaacattgttgcccaagtaacagggatgggagataacccatcattgtccgagctgatcgggccagtcaacgtcatgatgcaagcatatgacgcagggcgtctggataaattgtatatagtgacaaaccggttcatcaatacaatgtctcaggttccgacaattactcagttattgcctctgccagccggagacgatgaaacattgaagaagaagtcctgggattatctgtatgaacctgatcctaaggcgttgttggataccctgctgcgccgctatatagaatcacaagtttatcagggcgtcgttgaaaacctggctagtgaacaggccgcacgaatggtagcgatgaaagccgcgaccgataacggtggcaacctgatcaaagagttgcagttggtttacaacaaggctcgtcaggccagcatcactcaggaactcaccgaaatcgtttcgggtgcttctgcggtttaa

SEQ ID NO: 3598 - DNA, 1542 bp, Xenorhabdus bovienii
  Coding sequence Name=Xb4151_4152.C439.gene166.dna; Position on contig= 114230..115771bp; Strand=-
atgcaactgaattccaccgaaatcagcgaactgatcaaacagcgtattgctcagttcaatgtcgtgagcgaagctcacaacgaaggtacgattgtttccgttaacgacggtatcattcgtatccacggtttagccgatgtcatgcagggtgaaatgatttctctgcctggcaaccgttacgcaattgcactgaacctggagcgcgactctgtgggtgcggttgtgatgggtccgtatgctgacctggccgaaggcatgaaagtcaaatgtactggccgcattctggaagtacctgttggtcgtggtctgctcggtcgtgttgttaacacactgggtgagccaatcgatggcaaaggcgctcttgagaatgatggtttctctcctgttgaagttattgctccgggggttatcgaccgtcaatccgttgaccagcctgtccagacaggttacaaatccgttgatgccatgatcccaattggccgtggtcagcgtgagctggttatcggtgaccgtcagacgggtaaaaccgctctggctattgatgcgatcatcaaccaacgtgattctggtatcaaatgtatctatgttgcaattggtcagaaagcatctaccatttccaacgtagttcgtaaactggaagagcacaacgctctggctaatacgattgtcgttgttgcatccgcttctgaatctgcggccctgcaatatctggcaccttattctggctgtgcgatgggtgaatacttccgtgatcgcggcgaagatgctctgattgtttacgatgacctgtctaaacaggctgttgcttaccgtcaggtttctctgttgctgcgtcgtccacctggacgtgaagcattccctggtgacgttttctatctgcactcccgtctgctggagcgtgcagcgcgtgttaacgctgattatgtggaaaaattcaccaacggcgaagtgaaaggtaaaacgggttctctgactgcattaccaatcattgaaactcaggctggtgacgtttctgcgttcgtaccaacaaacgttatctccattaccgatggtcagatcttccttgaatctgctctgttcaacgcaggtatccgtccggcggttaacccagggatctccgtatcccgtgtaggtggtgctgctcagactaagataatcaagaaactgtctggtggtatccgtacagctctggctcagtaccgtgaattagctgcattctcacagtttgcttctgatctggatgatgcaactcgcaagcagttggatcatggtcagaaagtcactgagctgttgaaacagaaacagtatcagccaatgtccgttgcacagcaggctctgtctctgtttgcagctgaacgtggctatctggaagatgtcgaaatcgcgaaagtggtcagtttcgaatctgcgctgttagcttatgctaaccgtgaacattctgatcttctcaaagagattgaccagtctggtgactacaacggagagatcgaagcgaagctgacagctctgttggattccttcaaggcgactcagtcctggtaa

SEQ ID NO: 3599 - DNA, 534 bp, Xenorhabdus bovienii
  Coding sequence Name=Xb4151_4152.C439.gene167.dna; Position on contig= 115786..116319bp; Strand=-
atgtctgaatttgctacggtagctcgcccctacgccaaagcagcttttgactttgctgtagagcaccaatctctcgaacattggcagaacatgctggcgttcgttgctgaggttactcgcaatgagcaggttggtgagctgctttccggttcattggcaccggaaacgttagccaataccttcatcaccctttgtggtgagcaggtagatgagcatgctcagaactttattcgtgtaatggcagaaaatggtcgcttgctggtactgccagaagtcttccagcaatttacccaattgcgtgcgtcacttgaatcaaccatcaatgttgaagtgatttctgcgtctgaattgaatgagcagcagcaggctaaaatttctgcggcgatggaaaaacgtctgtcacgcaaagtgaagctgaattgcaaaattgacaagtctgttatcgccggtgtggttatccgcgcaggtgatatggtgatcgatggcagcattcgcggccgtctggatcgtttaacagacgtcttgcagtcttaa

SEQ ID NO: 3600 - DNA, 408 bp, Xenorhabdus bovienii
  Coding sequence Name=Xb4151_4152.C439.gene168.dna; Position on contig= 116332..116739bp; Strand=-
atgaagtatgtatggccaccaattatggcggccattgaaaagcgtcagaaagaaattactgacggtttggcttcagcagaacgtgctaaaaagaacctggacttagcgcaagccaatgcgaccgaccaactgaaaaaagcgaaagctgatgcgcaagctatcattgagcaggctaataaacaaaaagcccagattattgatgatgccaaaacagaagctgagctggaacgtaacaagattgtagcgcaggcccaggctgaaattgacgctgaacgcaaacgcgctcgtgaagagttacgtaaacaggttgcgatgctggctatcgcaggtgccgagaaaatcatcgaacgttccgtggatgaagctgctaacagcgacatcgttgataaactggtcgctgaactgtaa

SEQ ID NO: 3601 - DNA, 123 bp, Xenorhabdus bovienii
  Coding sequence Name=Xb4151_4152.C439.gene169.dna; Position on contig= 116705..116827bp; Strand=+
atggccgccataattggtggccatacatacttcatgcagaacaaaacaaacaggacaaacgcgatggcctggccgaggattgttgcgttaatattcaaagcacaatacctctatttcaattaa

SEQ ID NO: 3602 - DNA, 246 bp, Xenorhabdus bovienii
  Coding sequence Name=Xb4151_4152.C439.gene170.dna; Position on contig= 116857..117102bp; Strand=-
atggaaaacctgaatatggatctgctgtacatggctgccgctattctgatgggtctggctgctattggtgctgcgatcggtatcggcatcctcggaggtaaatttttggaaggcgctgctcgtcagcctgatctgattcctctgctgcgtacacagttctttatcgttatgggtctggttgacgccatccctatgatcgctgtgggcctgggcttatttatgatgttcgctgtcggcggtcagtaa

SEQ ID NO: 3603 - DNA, 828 bp, Xenorhabdus bovienii
  Coding sequence Name=Xb4151_4152.C439.gene171.dna; Position on contig= 117153..117980bp; Strand=-
atgtctgcatcaggagaagttttaacttcgcaggagtacataagtcatcacctgaagcaccttcagttagacttgcgtacctttgagttggtcaatccccacgctagtggttatgagacgacgttctggacgttgaacattgactcgctttttttctccgtcatattaggaatattgtttctgtttgtattccggagagttgcggttcgcgctaccgatggcgtaccgggtaagctccagactgcggtagaaatggttttcggtttcgttgataacactgttcgtgatatgtatcacggtaagagcaaagtgatagctcccctggctttgactgtgttcgtctgggtgttattaatgaacgcattggacttgctgccaatcgatttaattcctttgatcggtgaacgctatttcggcctgcctgctctgcgtattgttccaacagcagatgtcagtgtcactctgtcgatggcgctcggtgtctttgttctcatcctgttctatagcattaagatgaaaggaattcgtggttttgcgaaggagctgacattacagcctttcaatcacccactgtttattccaattaacttaattctggaaggggtcagcttactatctaaacctatatcactcgctctgcgactgtttggtaatatgtatgctggcgaattgatctttattcttattacggctcttttaccgttttggtcacagtggttactcagcctgccatgggcgattttccacatactgattatcacgttacaagcctttatcttcatggttctgacggttgtttatctatcgatggcatctgaagaacattaa

SEQ ID NO: 3604 - DNA, 378 bp, Xenorhabdus bovienii
  Coding sequence Name=Xb4151_4152.C439.gene172.dna; Position on contig= 118012..118389bp; Strand=-
atgtctgtatccctttacagcggtagaattgcactgaaactgttacttttgcagttaatgacttttattattctcagtgtggctttttgtaccagaagtatcgaatggggcgcttctgcttttgccggtgggctggcgtgctggctgccaaatgccatttttatgctgctaactcgcttccaaaaagcaaaagaagaagatgtaccagtacgcattgcatggttcttcgctattggcgaagtggctaaagttgtcattacgatagctgtgctgatagttgccttgggagtgtttaaggcggcatttgcaccacttggtgtagcctatttagcggtgctgattgtgcagatcatcgcacctgccgtaatgaacggttag

SEQ ID NO: 3605 - DNA, 621 bp, Xenorhabdus bovienii
  Coding sequence Name=Xb4151_4152.C439.gene173.dna; Position on contig= 119000..119620bp; Strand=-
ttgcttaacaaactggaatcgctgctggtgaaaacagacattgtgttatcgctagaacaaaaacaacagcttatcgcttacgttgatatgcttaacaaatggaacaaggcttataacctgacatctgttcgtgatcccgaacaaatgctggttcggcatatcatggacagcatagtcgttaatccttttcttcacggaacgcgatttattgatgtgggaacagggcctggtttgccgggcatcccgttggcaattgtacggccagattctcatttcactctgctggacagtttaggaaaacgagttcgcttcttacgtcaagttcagcatgaattgggtttgaaaaacattgatcctgtgcagagtcgggttgaagaatttatccctgaacccccttttgatggggtgatcagccgtgcattcgcttcgctgcaagacatgctgtcatggtgtcgtcatcttcctaaaccagcagaaggccgcttttatgccctgaaaggcgtgctgccggaaaatgagttgacccaactgccttcaggagtaacgcttgatacggtggtttctctgcaggttcctgagttgggtggggagcgtcatttggtcgtacttaagtcaaactaa

SEQ ID NO: 3606 - DNA, 1890 bp, Xenorhabdus bovienii
  Coding sequence Name=Xb4151_4152.C439.gene174.dna; Position on contig= 119633..121522bp; Strand=-
atgttttatccagaacactttgacgtcatcattatcggcggtggtcacgccggtaccgaagcagcaatggctgccgcacgtatgggacgtcaaaccttattactgactcacaatattgatactttgggccagatgtcatgtaatccagccattggtggaatcggtaaagggcatctggtaaaagagatcgatgcacttggtggcctaatggctcaagcaaccgatcaggccggtattcaattcagaacactgaatgccagcaaaggtccagcagttcgggcaacacgagcacaggcagatcgagtactgtaccgacaggctgtaagaaccgcattggaaaaccaatctaatttgatgatcttccaacagtcggttgaagatctcatcgttgaaaacaacaccataacaggcgttgttacacgtatggggttaaaatttaaagcaaaatcagttgtactaactgttggcacctttcttgatggaaaaattcacattgggctggaaaactacagtggtggacgtgccggagatcctcctgcgatcgcattatcccatcgcctgcgtgaattgcctttacgagtagctcgcctgaaaacgggaacacctccccgcattgatgcacgaaccattgatttcagccagcttgagcaacagttgggtgataacccgacacccgtattctcattcatgggcaacgtagatcaacacccacgacagatcccttgctatatcacacataccaatgaaaaaacccatgaagtgatccgtaataatttggatcgtagcccgatgtatgcggggatcatcgaagggatcggaccacgttactgcccttccatcgaagacaaagtcatgcgttttgcggatcgcaacgctcatcaaatcttccttgaaccagaaggcctcaccagtaacgaaatctatccgaacggtatttcaaccagcctgccatttgacgtgcagatgcagatcgttcactccatgaagggtatggaaaacgcccgtatcgttcgtcctggttatgcgatcgaatacgacttttttgatccacgtgatttaaaacagacactggaaagcaaatttatcaatggtctgttctttgctggtcaaatcaacggcactacaggatacgaagaagcagcagcacaaggattgctggcaggtttaaatgccgcacgttatgccgcagatgaaaacggctggttccctcgccgtgatcaagcctatatcggcgtattggttgatgacttatgcacattgggtacaaaagagccttaccgcatgtttacgtcgcgcgcagaatatcgcttgatgttacgtgaagacaatgctgatctccgtttaacagaaaaaggccgggaattgggcttggttgatgatcaacgttgggagcactattgccgcaaagttgagatgattgaacaggaacgccagcgcttacgaaatatctgggtacacccgcattccgatagcttggatgaaatcaaccaaatgctgaaagcaccactgtcaaaagaagccaatggtgaggatttactgcgtcgccctgaaatgaattatgaactgctgacatcactgccacgttttactccggggctgacagaacctcaagcagcagatcaagttgaaattcaagtgaagtacgaaggctatatcgcccgtcagcaagaagagatcgaaaaacaattacgtaatgaaaatgccgccttgccactcgatctggattacaaacaagtcaacggactttccaatgaagttattgcaaaactgaatgaccataaaccaagttcaattggtcaggcctcgcgtatttctggtattactccagcagccatttccattttgctggtatggttgaaaaaacaaggtttattacgtcgtagcgcctaa

SEQ ID NO: 3607 - DNA, 99 bp, Xenorhabdus bovienii
  Coding sequence Name=Xb4151_4152.C439.gene175.dna; Position on contig= 121635..121733bp; Strand=-
atgatcctttacagcatcatgatctttctatggaaaaatcacttatccacagatgatcgcgatcctaataacagatctaataaaaagatctttaaataa

SEQ ID NO: 3608 - DNA, 441 bp, Xenorhabdus bovienii
  Coding sequence Name=Xb4151_4152.C439.gene176.dna; Position on contig= 121897..122337bp; Strand=-
atgagcacaataaccttaatcagcggcagcacaatgggaagttctgaatatgttgccgaacatatggcggagatcttagaaaatcacgggttttcaactgaggtccttcatggtccttcattagatgatctgcgccttggtgggctatggcttgtggtcacatcaacgcatggagcaggggacttacccgaaaatcttcagcctctggcagacacgatcgcacaacaacagccagatctaagtaacgtgacatttggagcggtcggtattggcagttcagaatatgacatattctgtggtgcaatcaaatcatttgagcacctattgaaagatcgcggagcaaaaaggatcggggatcgattggaaatagacatccagaagtatgaaatccccgaggatcccgctgaagattgggttaaagaatgggcaaagttactctga

SEQ ID NO: 3609 - DNA, 462 bp, Xenorhabdus bovienii
  Coding sequence Name=Xb4151_4152.C439.gene177.dna; Position on contig= 122431..122892bp; Strand=-
atggcagaaatttatcagatcgataatttagaccgtgacattcttcacgctttaatggataacgcacggacaccttatgcagaattagccaaaaaattcgctgtcagcccgggtacaattcacgttcgtgtggaaaaaatgaagcaggcagggatcattacaggtactcgtgttgatatcagtgccaaacaactggggtttgatgtgtgttgctttatcggcatcattttaaaaagcgccaaagactatccggccgcattgaaaaaactcgacatgcttgatgaagtggttgaagtctattacaccacagggcattacagcattttcactaaagttatgtgccgctccatcgaatcgcttcaagatgtacttatcaacaagatccagacaatcgatgaaatacagtcaacagaaaccctgatctccctgcaaaacccaatcataagaacaatcaagccttga

SEQ ID NO: 3610 - DNA, 120 bp, Xenorhabdus bovienii
  Coding sequence Name=Xb4151_4152.C439.gene178.dna; Position on contig= 122942..123061bp; Strand=+
ttgtttataaatattactcgatatttttattatcagatattgaatttatacctcattctgttgcttaatctatatcaacaggacatagggtcactaaaaattttgagagcagcgccatga

SEQ ID NO: 3611 - DNA, 993 bp, Xenorhabdus bovienii
  Coding sequence Name=Xb4151_4152.C439.gene179.dna; Position on contig= 123058..124050bp; Strand=+
atgaaaacatcctttattgaaaaacagcagcagattagttttgtgaaatcatacttttcccgtctgctagagaagcaactcggtttaatcgaagttcagggacccattctgagccgtcttggtgatggtactcaggacaacttgtctggccatgaaaaagcggtacaggtaaaagttaaaacattgccagatgcaacgtttgaggtggttcattctctagctaaatggaagcgcaagacattaggtcgctttggttttcaagctgaacaaggattgtatacccacatgaaggctctgcgtcctgatgaggatcgcctgactcctatccactctgtctttgttgatcagtgggattgggaaaaagtgatgggtgaaggtcaccgctcactcggttatttaaaacagacagtaggtaaaatctacgaagcgataaaagaaacacaaaaagcagtaagtaaggaatttggtctggcaccgttcctgccagatcaaattcactttcttcacagtgaagagcttctgaaacgttaccctgatctggatgctaaaagtcgtgagcgtgaggccgccaaagagtttggtgcgattttcttgatgggaattggcggtaagttgtctgatggtcaggcacatgatgttcgtgcaccggattatgacgactggacaacgccaaacagcgatggcctcttcggcctgaacggtgacattattgtctggaaccccgtattgcaagatgcttttgaaatttcgtcaatgggtatccgtgttgatgcagaagcactgcaacgtcagctcgagctaacttgtgatgaagatcgactgcaatatgactggcatcaggccttggtcaaaggagatatgccacaatccatcggtggaggcattggtcaatcacgtttggtgatgctgctgctgcaaatggcgcatattggtcaggttcagtgtggtgtctggtcacccgaaattatcgaatctgttgaaggtgtactgtaa

SEQ ID NO: 3612 - DNA, 1458 bp, Xenorhabdus bovienii
  Coding sequence Name=Xb4151_4152.C439.gene180.dna; Position on contig= 124084..125541bp; Strand=-
atgttaactctgacaacgctcgatcttttactctcgatcaatgaaggtgaactgatcgaggagatcattttagcactgttaagtgcccctcaattgaccattttttttgaaaaataccctaggttcaagcgcgcattattgaaagatgtacctgcatggcagcaaacactacaacaaagaataaaagatacactcattcctgcctccctagctgaagaatttcagttataccagcaattactaacagcgaatacgacaaaattttatcaacaactccctgatctcgcagataagcttgaacagatcaaatctccttttacccatgacgcccacacattgcgagaagcgttatctgaacacactcacgcaggacaaatcctgtttattcaacactggcgtaccagcctgatcctacaagtaacaacctttcacaagcaattgctggaacaggaaaaagaacaattattggcagagatccaaaagcgattagatctcagtggcaatctcgatccgatattcgatgaaaatgatcgcgccgcagggcgattatgggacatgagcaaaggccgacttcacctgacgtcgcacaataccgcattattcacccaatatgctcaatttctcaaacagcagcctgaactggaaaaactggcacaattactcggccgcagccaagcggctaaatcaattcctgaagatagcaacacccttgaaccattcacccaaatagagcgaataccagataccgtgccagagcaagtcagcggtatccaacaaggtgacgatatccagagacttttacccacagaactggccatgctgggaattgaagagctggagtacgaattttatcggcggttggtagataaaaaattactgatctaccggctacaaggggacaactggcagccaagaaacatattgaagccgatgactcaccatgatcatgcagaacagccccgaggaccatttattgtgtgcgtggatacttccggatcaatgggcgggttcaatgagcattgtgcaaaggcattttgtctggcactgatgcgtattgctctggcagataatcgtcactgtcacatcatattattttccacagaactcattcactatgacttaacatcacaagatgggctaacacaggcggtacattttttggggcaaactttcaaaggaggaaccgatctggcattctgcctgaatgccatcattgagaaaatgcaagaaagtatctggaaagatgccgacgctgttgttatttcagatttcattgcccagcggttaccagacgttctaatccatcagatacaaaacctgcaacaacgccaacaacaccgcttccatgcagtttccctgtcccattatggaaagcccggtatcatgcagatattcgatcatatctggcactttgataccggagttacaagccgtttactgcgaagatggcgacactga

SEQ ID NO: 3613 - DNA, 1503 bp, Xenorhabdus bovienii
  Coding sequence Name=Xb4151_4152.C439.gene181.dna; Position on contig= 125546..127048bp; Strand=-
atgcaattggtcgagaaaatatcccagttaagtcagtacctagaaatcggattatatgaaagacggcaaaccatccgtctctgtcttctggccgccttatgtggagagagtgtttttctcctgggaccaccggggatcgcgaagagcctgatcgcacgccggttaaaattttcgtttcaaaatgctcacgcttttgagtacttgatgacacgcttttccacaccagaagagatcttcggcccactttccattcaagcactcaaagatgaaggccgttatcagcgcctgacagaaggctatttgccagaagcggaaattgtttttctggatgaaatctggaaagcaggccccgctattttgaatactctgctgaccgcaattaatgaaaagaaatttagaaatggcaaccaagaagaaaacctgccgatgcggttactggtcacggcatccaacgagctgcccgatgctgatagcagcctggaagccctctacgatcgtatgttgatccgaatctggctgaacaatattcaggaaaagaagaattttcgtgccttactgactgatcgaaacaatgaaaatgacaatcctgtacctacccatttccaaatcacagatgaggaatttcatcaatggcaatgtaagattaaacacgtctccctgccagactacattttcgagctgatttatcagctacgccagctactgaatgcctctgaaaatctccctcacgtttcagatcgccgctggaaaaaagccatccgcttattgcaggccagtgcattcttcagtgggaaaaatgccatatctccgttagatttggtgctattgaaagactgcctgtggcacgacctgaatgccttaaagcttctgccgcaattccttcatgatttgctgacagaacaagcctatcaacagagtttcctgctacagaaaatggatggagtataccaacaatggatacaaaccagccgagatgaaactcacctccatcccttacaattaaccacgaattcatcacttttcggccgcaagatccactactcacttcccaagactatcaatgatgaaaaactgattctatttctgtatcccgcattacatctgcatgatattgaagttaatttcattgaaatagatagtaaagtactggaaaacgtgctcaaaaatagcaatggagaattgcttgctcgcttaaatggcattggttttccactgaaaatttcggccgagatcaacgaaaaacatcaattggaagtgctggatatgagccgtaacagagccattctctgccaagcggaagcaaagcaactaacaacagaaaaaacaaataacgagtggaatgaaaagctgatatctattagtgatgccatccagcatcagcgccaattgttcggtcagcatcaaccttgtttatttattgaagaacattggattgccaacattgaacaaagttttctgcaattgatcgaaaagttgaaacaattgagatcaaaaatgaggtaa

SEQ ID NO: 3614 - DNA, 420 bp, Xenorhabdus bovienii
  Coding sequence Name=Xb4151_4152.C439.gene182.dna; Position on contig= 127331..127750bp; Strand=+
atgaaaaaaggcgttttattgcattctgatatttctgccgttatttctcgtttgggccacactgatcagatcacgatcagtgatgcggggctacctatcccgttgtccactcagcgaattgatttagcgttaacccagggaatacccgatttgatgtctgtgtttgatgtggttgtgcaggaagtgcaggttgaagcggccattttggctacggagatgattgatcacaaccctcagatacatgaacaaatcatcaagcgcattgctgaactcgaaacaaaacagggaaatgcaatcgcgatagagtatgtgaatcataacattctgaaagagaagacagaaaagagcaaagcgattatccgtactggggaatgttctccttatgccaatatcctcctttgttcaggcgtaactttctga

SEQ ID NO: 3615 - DNA, 1509 bp, Xenorhabdus bovienii
  Coding sequence Name=Xb4151_4152.C439.gene183.dna; Position on contig= 127755..129263bp; Strand=+
atgatggagccattgctggagttaaaagagattgataaggctttccctggggtaaaggcgttgtcgggtgcggcccttcgcgtttatcccggaaaagttatggcgctggttggcgaaaatggtgccggtaagtccacgatgatgaaagtcttgaccggcatctataccaaagatgccggttcaattcattatcttgggaaaaatgtggttttctccgaccctaaatcttcccaagaagctgggattggcattattcatcaagaattaaatcttatcccccaactgacgatcgcagaaaatatttttcttggacgtgagttcgtcaataaactgggtatcatcaattggcaaaaaatgtatgaagaggccgataatctgctgaagcgtttgaatattcgttatagcagccgtcgactggtttctgaattgtccattggcgatcagcaaatggtggaaattgccaaggtgctgagtttccaatccaaagtcattataatggatgagccaacggatgccttgaccgataccgaaactgaatcgctgtttcatgttatacgggagctgaaagctcaagattgcggcattgtctacatttcccatcgcctgaaagaaatctttgaaatttgtgatgacgtgacggtatttcgtgatgggcaatttattggtgaacagccggttgctgctctacaagaagatacgttgatcgaaatgatggtgggacgcaagctggaagatcaatacccgcgtctggatcttccgcgtgggggaaaacgactggagattgaaaatctgtctggatcagggatcaaaaatgtcagcttctctctgtttggtggcgagattctgggaatatccggtttaatgggagctggtcgtactgaattgatgaagatgatctacggagcattgccgaaaaccaaaggcaggatcttgctggatggaaaatctctgactattcgcaacccacaggatgggctggctaacggcattgtctatatttcggaagatcgtaaacgtgatggcttggtgttgggaatgtcggtcaaagaaaatatgtccctcacagcgttacgttatttcagtcaaaaaccctatcgtttgaatcattccgcagaacaaaaaaccgtaactgacttcatcaaattattcaatatcaaaactccctcaatggaacaatcgattggcttgctttctggcggtaaccagcaaaaagtggcgattgctcgtggtctgatgactcgcccgaaggtattgattctggttgagccaacccgaggagtggatgtcggtgcgaagaaagagatctatcagttgatcaatcagttcaaaaaagaaggtttgagcattattttggtctcgtctgagatgccggaagtcatgggaatgagtgatcgtattctggtgatgcatgaaggtggcataagtggtgagttcagtgcggataatgcctctcaggaagcgctgatggtcgctgctgtcggcaaacaatacggtgcagttgaaaggtaa

SEQ ID NO: 3616 - DNA, 972 bp, Xenorhabdus bovienii
  Coding sequence Name=Xb4151_4152.C439.gene184.dna; Position on contig= 129282..130253bp; Strand=+
atgaattttaacacagcagcaacctccagatattggctcacgaaagcctggttgatggagcagaagtcactgattgcactattgattctgattgttgtcgtttccttcttcagccccaattttttcacactgaataacctgtttaatatcctccagcaaacttctgttaacgctatcatggcggtgggaatgacgttggtgatcctgacttcgggcattgatttatccgtcggatctctattggcactgacgggagcggtggcggcatctatggtcggtacggatgtcaacgcactggtggcagttgctgcggcactggcattgggggcagcgattggcgcatgtactggtgttattgttgctaagggtaaagtccaggcgtttatcgctacattagtgatgatgctgttattgcgtggtgttacccgtgtttataccgatggcagtcccatcaataccggattcagtgataatgccgatctgtttggctggtttggtattggccgtccattaggagtgccagcaccagtctggatcatgctgctggtttttgctactgcctggtacattctccatcacactcgccttggccgttacatctacgctttaggcggaaatgaatctgcaacacgtttatcaggtattaacgttgataaaataaaaataatcgtttattccctatgtggtctattggcagcgctggccagtattatcgaagtagcccggctatcttctgcccaacctatggccggaagtggttatgagctggatgctattgcagccgtggtgctggggggaaccagtctggctggcgggaaagggcggattgtcggtacgctgattggtgcgctgattttaggctttttgaacaatggattgaacttattaggtatttcttccaactaccagatgatcgtcaaggcagttgtgattttactggcggtcttggttgataacaaaagtagtaaataa

SEQ ID NO: 3617 - DNA, 891 bp, Xenorhabdus bovienii
  Coding sequence Name=Xb4151_4152.C439.gene185.dna; Position on contig= 130278..131168bp; Strand=+
atgaaaatgaataagctggcaaccattctatccgccgtagttttgagtgcaaccatgagtgccaatgcattggcgaaggatagcattgcattggttatttcaacattgaacaaccccttctttgtcacgatgaaagacagcgcacagaaagaggctgataaactcggatataacctgatagtgcttgattctcaggataatccggcaaaagagttggctaacgtacaggatttgactgttcgtggtacgaaattgatgctgattaacccaacagattcagacgccgttggtaatgcggtcatcatggcaaacaaggcgaatattccggttatcacccttgaccgtgcggcgaataaaggaaacgttgtcagccatattgcttctgacaatcgtttgggaggcaaaatggccggtgattttatcgctgaaaaattgggtaacaatgccaaaatcattcaattggaaggtatctctggtacttctggtgcacgtgaacgtagtgaaggtttttctcaggccgccaaaagccatcaattcaatatgctagccagccagcctgctgactttgaccgcacaaaagggctgaatgtcatgcagaacctgctgacagcccatccatcagtacaagccgtttttgcccaaaatgatgaaatggcactcggtgcgctgcgcgcgttgcagacagccaataaaaaggatgtgctggttgtcggatttgacggaactgacgatggtgtcaaggcggtacggagcggtaaattaagtgcaacgattgcacagcgacctgatcagattggcatcattggcgtccagacagcggacaaggtgctgaaaggtgaaaaagttgacgctactatcccggttgaattggaattagttatcaaaaaataa

SEQ ID NO: 3618 - DNA, 930 bp, Xenorhabdus bovienii
  Coding sequence Name=Xb4151_4152.C439.gene186.dna; Position on contig= 131232..132161bp; Strand=+
atgagtatggcaaaacttgccgtgatgggcagcattaatgcagatcacatcttgaacctcgaatcttttcctcagcctggggaaaccgtgatgggaaaacagtatcaggttgcatttgggggaaagggagctaatcaggcggttgctgcaggtcgctgtggtgctgacattacatttattgcttgtgttggccaagatgatattggcgagcgtgtccgtcaacaattggtgaaagataatatcaatacctcggcaatcggagttattgaaggtgaaacaacgggtgtagcactgatttttgtgaatcagcaaggggaaaacgtcattggcattagcgcaggagcgaatggcgcactcacatctgaatatttccaccatcatgagcaggtggtcaaagaggctgatgtgttgttgttacagctcgaaacaccgttggaaactgtacagctggccgctgaaacggccagaaaacataacactaaagttatcttgaaccctgcgccagcacagaaactctctgaacaattgctttctttggtcgatattatcactcctaatgaaacagaagcggaatacttaactgggatcgctgtaaaagataatgtaggagcagaaaaagccgctcaggacttgcataaaaaaggtattgaaatcgttattatcacattgggcagccgtggcgtatggctgagtgaaaatggtaagcaaggtaaaattgttcctggatttaaagttaaggcaatcgatacgattgcggcgggcgatacatttaatggcgcactggtaacgggattattggaggggaaaggaatcgtatcggcaattcgttttgcccatgctgcggcagctattgctgtgacacgtcagggagcgcagccagctgttccgtggcgacgtgagattgatgcatttctggctgaacaggactaa

SEQ ID NO: 3619 - DNA, 993 bp, Xenorhabdus bovienii
  Coding sequence Name=Xb4151_4152.C439.gene187.dna; Position on contig= 132173..133165bp; Strand=+
atgaaggacgttgcccgtcttgcgggtgtatctacatcaacggtctcttatgtaattaacgataaccgttatgtcagtgagagagtgaaaaagaaagtcaatgcggctattgatgagttgaactatgcgccttccgctttggccagaagtctgaaaatcaagaaaaccaaaaccatcggtatgctggtcacaaccagtaataacccgttttatgctgaaattgtcaggggagttgaacggaattgttacgagcgtggatacagcttaattctgtgtaataccgaaggtgacgtgacgcggttgatccgcagtatggaaacactgttgcaaaaacgtgttgatggattgttaatcatgtgttctgaaaatgcgattctacccaatgactttctgctccgatatccacttataccgatggtaacaatggattggtcgcctttttatgtatccagtgatgtcatcaaagataactctctattggggggcgaattagccacaagttatctgattagccgaggttttcgtaaaatagcctgtatcgctggcccacaggataagacgccagcccgtcagcgtctggctggatatcgaaaagcaatgaaagatgcccagttagagatcccggaaggatatgaaatccacagtgattttgaatttgctggtggattgtcatcaatggaacagctactccaattatctaaacctcctgaggcggtatttgcaggaaatgacgccatggctattggggcttatcaagccttacatagagcgggtttttctgttcccgatgatatctccgtgattggatatgatgacatttcgatggcgccttacatgaccccaccactgaccaccattcatcaacccaaagatgaattgggtaagctggctattgatactctgctctatagaatgggcaatccggaaagtgagccaaaacaattaattttgaagccaaaactgattgagcggaattctgtagccagacgctga

SEQ ID NO: 3620 - DNA, 1383 bp, Xenorhabdus bovienii
  Coding sequence Name=Xb4151_4152.C439.gene188.dna; Position on contig= 133171..134553bp; Strand=-
atggtcaaatctgcacgcagtatgtcgggactgccctggattgctgcgatagctttttttatgcaatccctggatgcaaccatccttaataccgcattgccggcaattgctaaaagtcttaatcatcatcctctggcaatgcagccagccattgttagttataccttaacggtggcaatgttaatcccggtcagtggttggttggctgatagattcggcacacaacggatattcatttatgccgtttcccttttttctttaggttcactcgcctgtgcgttatccagcagtttctcttttttggtagctgcccgcgtcattcaagggatcggtggtgccatgatgatgcctgttgcccgtttggcattactgcgggcatatcctcgcagcgaattgttgcccgttttgaattttgtgactatgccaggtttgcttggcccaattttaggccccatgctcggcggactgttagtaacttatgcaacttggcattggatcttcatcatcaatattcctatcggcctactgggtattatttatgccaaaaagcacatgcccaactttaccatgcctaaatgcttctttgattttctgggattcatgctatttagtgtaggactggtgatgctttcggtcagctttgatttatttggtaataatactctacctaactatgttcccgttgcggttatggcgggtagtatcattatgctgtcaggatatatttttcatgcaaaaaggcacccaaatccactcatcgacctccagttgttccaaacacgtaccttttcagttggtatcaccagcaatattgccactcgcttaagtacaggatccctctcatttcttattccgttaatgctacaagtgggttttggttattcggcggttattgccgggataatgatggcaccaaacgccattggcgcaattctcgctaaatcttttgtcaccaaattactgactcaatttggatatcgaaacacgctcatttgggttacggtgatcattggtgtgatgattgcacagttttcactacagacaccggagatatcactcgtctttttgatcattcctctatttgttttaggaatggcaatgtccacgcaatttacatcaatgaataccattacccttggtgatttgaataataacaatgccagtgcgggcaatagcctattggcggttactcaacagttatctatcagtttaggagtaacagtcagtgctgcaatccttcggttttacgaatcagcggaatacggttcaacagtggatcacttccactatacctttattacgataggcgtgattactctagcctcttcttttgttttcctgttattgaagaaagaagatggccggaatttgatcaaaaagtaa

SEQ ID NO: 3621 - DNA, 99 bp, Xenorhabdus bovienii
  Coding sequence Name=Xb4151_4152.C439.gene189.dna; Position on contig= 134582..134680bp; Strand=+
atgattacttactgggtatttttttccatttgtttttgttctcttaactgcatggatgtcacatgctccttctatttaacacattatactactgtatag

SEQ ID NO: 3622 - DNA, 345 bp, Xenorhabdus bovienii
  Coding sequence Name=Xb4151_4152.C440.gene1.dna; Position on contig =85..429bp; Strand=+
gtgatcaatgcgctgaacggaccaggtgataacccggtttatgtgcgttttgatatcaccgtggtcggcaaggaagcgaccagtctggtcggccgttgccagaaggcggtagatgaggataaaaaagtgttgctgggctttaccttaagcaatccctcgactgatatctttaccctgaaacgcggagaccatgccggtgaacagcgcgtcagcctgaaagcccgtctgattaaggttgactggattaaaatcggtcaggagaaagtgtatcaggccgaacaatccgactcgatgccgcctcagaacggcatcacgcaaaaagaatatgcagagaactctttctga

SEQ ID NO: 3623 - DNA, 210 bp, Xenorhabdus bovienii
  Coding sequence Name=Xb4151_4152.C440.gene2.dna; Position on contig =500..709bp; Strand=+
atgaatgctgcaccgattgggtttctggccctgcaatattgccataaacaactgccgttaatcgttttgcgccgccgtgcggggttttatatcggcacgatggatgaaggcattccctgctctcgtgagtcagtggagtattttgcccgacgtgaacaggcggagtttgccctgaaacagggacaatggacacaacgtcagtcagtttaa

SEQ ID NO: 3624 - DNA, 510 bp, Xenorhabdus bovienii
  Coding sequence Name=Xb4151_4152.C440.gene3.dna; Position on contig =727..1236bp; Strand=+
atgtcttcacgtggaatcaacaaagtaattttagtgggttatctggggcaggatccggaaatccgttacctacccgccgggggtaccgtggcaatgctttcaatggccacctcagataactggcgggataaacaaaccggtgaaatacgggagaaaaccgaatggcaccgggtcgttatcttcggcaaattagccgacattgcggcggagtatttgcagaaaggggcacaggtctatattgaaggccagctgaaaacccgcaaatggcaggataaccagggccaggatcgctactcaacggaagtggtggtgaatgtgaatgggtcgatgcagatgctggggaaccgtaatgagccaaagcgtatggcacctcaacaggttgaaaataagccgatacagaagcaatcctctcaaccagttagcagagaaagaaaggagattcctgtagtacaaacctctgttttaccaaaaaaggaagaagtagattggaatgaggaaattcctttttga

SEQ ID NO: 3625 - DNA, 1017 bp, Xenorhabdus bovienii
  Coding sequence Name=Xb4151_4152.C440.gene4.dna; Position on contig =1331..2347bp; Strand=-
atgacagtttattttgttcatggagaaaatatgtcacataaaaccatatcaccttcaaaatatgtttatatttatcatatattatgcttttacatttcaatctcctgtctatttttttatataaaatcacctgcaatacccttcattatttggattggaatgatatttatcactgcaataatagtattccatagaaaaataggtccattaccaaagataaaactcaaaacaaaaatatcaagttatactataagcatcatcctttcgatgttatcatctttattttttttgacatcttgttttatttttacattcattgaaaattccagctcacaaacagatacaatagcaactttcatattatttcttctgtgcttatgtatatctatactaactttcacgtctaattccataaacagaaaaaatgataattttagctctgttttgttaaccacatttaaaataatatggattttattaagctatttattttattctcactcaagaaatactgttgcggaaatatttgatataagttatgaatcaacactttcaaagccaaccactatagggctaacaatcatttccataatgataatatattctatatttatagggttatctcctgtattattaatgttttttgaaaaagcaaaatcattcacaagaaaaaaaacaaaagaaatacattacagtagcgcaccaatagcaataccagtactcttatcttggtttatcatttacatccttttcaatataaacattcataaagcaattaacactataatagatgttactattccaatggagactagaagtacttttttttgccatgaaaaatatatgatactgccggaaggaaacacgactcgttacatgagccttgagaatgacgaatatagagcttttataaaaacagaaaattcatgggaagtttcaaagttaaaatgtcagaataaaaaaccttattataaactaatcccagtaaaaacaattgaaaatataaataaaaattaa

SEQ ID NO: 3626 - DNA, 468 bp, Xenorhabdus bovienii
  Coding sequence Name=Xb4151_4152.C440.gene5.dna; Position on contig =2812..3279bp; Strand=+
atgaaattaagaaaattagatcaagctttttatgatgataatactcatctcatacaagcgcttgataatgaagatggaaagtggatatcaggtaaaacccgcggacatggtattgttgtagtcaatatcaacaaattaactttcgctatcccacttagaacttcgattaaacataacgcagcatatattacgcaaaaatccaaccaaaaaggtgtaaaaggaaaaggactggattactcgaaagctttattaatcatcaatcaaaagtatatttctgatgaaatatttttgatcccagcagaacaacataaaaacatccaagggaaagaatttttcattacgagaaaatttgagaagtatgtagaaaaatatattaaggccgctaaaaacagggacagacatgttcttaatagtctggaatatcgttttactacgcttcaaaattaccataatcagttagatgtgtga

SEQ ID NO: 3627 - DNA, 285 bp, Xenorhabdus bovienii
  Coding sequence Name=Xb4151_4152.C440.gene6.dna; Position on contig =3620..3904bp; Strand=+
atgactatgactcacactcagaaagactggcacccagccgaaattatttgcgcattacgcaagcgtggtacaacactcgccgccgtctcccgcgaagccggattaagctcttcaactctcgccaacaccctgtcccgcgcctggccaaaaggggaatggatcattgcaaattatctcgatgttcatccctctgaaatctggccgagccgttattttgaccaatatggtcagttgattgagcgtaccgtgcgtaaaacggtttcagcagaatcttcagatcaataa

SEQ ID NO: 3628 - DNA, 537 bp, Xenorhabdus bovienii
  Coding sequence Name=Xb4151_4152.C440.gene7.dna; Position on contig =4010..4546bp; Strand=+
atgagaataaccgtattaatgggtgtattggtcactatcctgacgggttgcaatgcctcgtcaaagcaaccgtcatctcaatgtgctcccgaaaaagccatttcaacaacgcagctcacgcgcaatattcagcccgtctcacccgatatttatcaacaaacatcggaagtcgtccgccacggtcgttataccctggtaagtaccgatccaacagcagcacagcgtgatccactttcccaattgattgaggttcatatcccggcgtctcagcatctcacggtagccgatgccctgcgtgacgtattgcgccagtcgggttatcggttatgtacgcctgaaaaaaccaatgacattttatatcgccagccgttgccgtcggtacatacgcagtcaggttccgtccggctgcgcacggcgttgcagtttatggccggtccggcctggcaactggaggtggatgaggtccagcgtgtggtgtgtcaccatttacggccgggttatcagcttccacaacctcggcagggaaagcagccatga

SEQ ID NO: 3629 - DNA, 696 bp, Xenorhabdus bovienii
  Coding sequence Name=Xb4151_4152.C440.gene8.dna; Position on contig =4543..5238bp; Strand=+
atgagattgcatcaaatcggtctggtaacgtggatagtgctcatcagcccaacatgggcagccacaccgtcacccttaacgtcgcagcaggcacatacggtggaaagccaaaagcaaacattgagaatacaggccgggcaatggggattgaacgcggatgaatatcagcgctatcagcaattattgaatgggccaagggggatccagtcgccggggcttgacccgttgacaaccctggggattgaagcggaaagtgaggctgaccgccgccgttatgccgaacagtgggtcaaagcggaatttgtccgcactgaaaaagaactgcgttttcaacgggaagtggatgctgcatggcaacggttatttccggatgtgttgccggtcaatatggcgaaatccggtgaggcaaaggggcgtttggcgttgtttgtcaaaatcaacgattgcccgccgtgtgatgcccgtttagctgaagttctggcgttaatgcaaccggttgacatttatctggtcgacagcaagggcaatgacgacacattacggcaatgggccaaaaaacaccgaatccctgttgagcgagtgcgcaatcggcaagtcaccctgaatcatgatgcagggtactggttcaggtttgggcagggtgttatgccggtcttattgcggcaggaagagcagggatggcatatcacgttatga

SEQ ID NO: 3630 - DNA, 543 bp, Xenorhabdus bovienii
  Coding sequence Name=Xb4151_4152.C440.gene9.dna; Position on contig =5220..5762bp; Strand=+
atggcatatcacgttatgataatgaaagggttgcgcgtattccccattatcgggatgctctggttcaatacctgccatgcggagctgaatgtcattgccgatttaggcggcaaagatgcctcgcctttttatgaaagcattaatgctgagcaacgcgatgagcctgtgtcatcggtgcaaaattcctcacccgaaatggcaggtgaagcggcgatgttgcctgtcaaaacaccggaactgacgccgggaaaagtggcaagcagaccactgcaactgccgggaattggcgcactgtttctgattggggatgatccggactcgcgccagtggttaagccagaatgcggccaccttgacgaaactgcatgctgtgggtctggtcgtcaatgtcagtgaaatagcgggcttgcagtcactgcgtgcatcagcgccgggtttattgttgtcaccggctgccggcaccgagctggctcgtcgattgcaactgcaacattatccggtgttgatcacggaaactcaactttcccaacagttgtcaccatga

SEQ ID NO: 3631 - DNA, 2064 bp, Xenorhabdus bovienii
  Coding sequence Name=Xb4151_4152.C440.gene10.dna; Position on contig =5759..7822bp; Strand=+
atgagccgccgttatgtggttgaagccctgctgcgtcctgccgtcgagctgaatacggcgctggtctccgccgttgccgcgtttgtctgtatcagggcaccctgggccatcgcactggcaccttccgtcagctatgtgatggccggtggttttactgtattagcgatgatacgcacatggcagggtattcaggtcatccgttatcgcagaaacctgcgccgcctgccacgttatcagatgagcaccaggcacattcctgtcagtcaccggcagttgtttctgggcaggggatttcgctggcagcagaagcatacccagcgtttacaggatacccgccgaccggaggtcgagagattcgtacaaccgtcccggatatatcagtttgcccgcgcactggagcgtcgaactgaataccgctggccaacattatcggcgttgttacgtcaggattcgccatttaatcccgtacgcccgctgcctccggtgggcggtaatcctgctatccacggtattgagccacaggaggccgatgtttttatggatctgcgcgagcgggtcgggcatacgctggtgatgggtaccactcgggtggggaaaacccggctggctgaactgcttatcacgcaggatatccggcgcggtgaagtggtgattgtgtttgatcccaaaggggatgctgacctgttaagacgcatctgggcagaagcacaccgggccggtcgcggtaatgaattgctcctctttcatctgggctggccggagatttcggcgcgttataacgccgtcgggcggtttggccgggtatccgaagtggcttcccgtctggccggacagctcagcggcgaaggcaacagcgccgcgttccgtgaatttgcctggcggtttgtcaatattgtcgcccgtgctttggtggctctggggcaccggccggattaccagctcatcacccgctacgtcaataatatcagcgaactgtatcagcgctatgccacccgaatgatggaggaaagacaaccggatctgctggcgcaaatcaatcattccctcagcaaactgaaagaaaaagacattccgcgcaatatgcaggggcaacccgatgccctccggctctgggcgatggaaatgacgctgagttctgacgcaggcaagcaactctatgacccgattctggatggtctgcgttctgccgtgcgttatgaccgtacctattttgataaaattgtcgcgtccttattgccgctgctggaaaaactgaccacaggcaaaattgccgaactgttatcgccggattacctcaatatgacggatctacggcccatctttgactgggagcaggtgatccgcaaaaacgggattgtttatatcggtctggatgcactgtctgacagtgatgtggcctcagccgtgggcaacagtatgtttgcggatctggtcagtgtcgccgggcagatttacaaatatgggatgaatgccggattgccggttcgccatgacgggaaactggcgattaatctgcattgtgatgaattcaatgaactgatgggtgatgaatttattccgctgatcaacaaaggtggcggcgcggggatgcaggtcacggcgtatacccagacctcttctgatatcgaagcccgtatcggcagtccggccaaaaccgcgcaggtggtgggtaacttcaataccctgatgatgctgcgggtgcgggataaccggacggcagaactgctcaccagccagcttcctgaagtggaaatctacagcaagacgctggtatcgggacattcagatattgctgatgtggaacagggtcaggattttacctcttccacgcaggacagggtaggcaccgtcaaaacaccactgattactcccgccgaaatgattaacctgccaaaagggcaggcattcgcgttactggaaggcgggcaattgtggaaaatccgcatgcctttgccaacgggggatgaggatgatgccctgatgccggccagtttgcagcacattgccgaacagatgcgcaggcactaccgcaccagtgaaaactggtgggaagagaagggatag

SEQ ID NO: 3632 - DNA, 759 bp, Xenorhabdus bovienii
  Coding sequence Name=Xb4151_4152.C440.gene11.dna; Position on contig =7832..8590bp; Strand=+
atggctcagtcagaaaatcagtcccgcccatcttcccaaccgccccgcaagcatggcctgttgtatcgtctgttatgggaatgcccgtggcagctcattggctttgtggtgatgtcctggctattcagcctgttactggaatatctcggtatggcttttttctggccggaacagggtgccgctcacagtcagactatgatgaaggcagagcttaattatctctcctcggaatttacccgaagtctgttattgacagaaccttcacaaaccgttttggcatggctggcacaggtttatcagtggctgtttgtggacagtggttttatgaactgggttcaagggcagaggcaatatcagctccataacaacaatgattttatgcgtgaattcaatacggtattacatggcatatcggcgcatttgcaagaatattggctggccacggtatttatcacgatggtgacgctgatccggctggggatcctgctgttatccgtgcccctgtttgtaatggtggtgttagtggcactggttgacgggctgggacgacgggatttgcggcgctacggagccgggtatgaatccagttttgtctatcaccatgccaagcgagggataaaaccggcctgcacggttccctgtgtactgtatttatcgtggccggaggtggtgtatcccacggtaatcttgttgcctgcggcgatagtgctgggcatagcgattgtgataacaacatccatgtttaagaaatatatttag

SEQ ID NO: 3633 - DNA, 693 bp, Xenorhabdus bovienii
  Coding sequence Name=Xb4151_4152.C440.gene12.dna; Position on contig =8678..9370bp; Strand=-
atgctgcggattgatttaaacgtccccgatgatgaatacgagcaggcacggaagctgggtgcacactgggatgccgccgcccaaatctggtatatcgataacagtgttgacccgacgccgtttatgaactggttgccgttctacaatgtgcacgctgaatactggtatctcgcccagacccggacgacctgcccgcactgtcatgaacacaccacggtgaccgcgtttatgctgccagccgggcaccaactgctggaagcggataacggcgatgaacccggcacagaagttgattataccgagcaggacagcccggcatttttgttttatatcgctgatattccctctctcgtgcgtagcgtactgcccggctttcatcacactctgcgcaaagccgtcagccaacggctgcgccggcagcactggataaaccattgcgaacactgtggcgcacaacaggatgataccgaattgtttgccgaagtcggcggcgcgtttttccctgctgccaaagagcaggcggcggctattcagctgcatcgtatcgatcagccgtttgtggggtattgtgaagatatctcgcatcatcactaccattttgacccgaagcaggataaccgtatttgtaaagcgtgtgacgggtttgaatggatgacgcaggtggtgaatgtgccgtcaacgtatcggcattag

SEQ ID NO: 3634 - DNA, 348 bp, Xenorhabdus bovienii
  Coding sequence Name=Xb4151_4152.C440.gene13.dna; Position on contig =9502..9849bp; Strand=+
atgatgaggtgcgtgttgatgcgtggtgacttttctttgtcccgttctgtctgtctgctggggttgactgtgctgtgtatgccgcttgcgcaggcggccgagaaagacgaactggcgagtgcaaaaaatctgattgagcaggtgcagatggcgctggagcgtgcaaacctcgccgaaaagcaggctgacaccccaacccgccctcgctatgactttgattacctccgtatcaaagcggatctcaacaccatcaaagccggtatcgatcactatctgaccccttcccgcgcccggcagcaggcgtcaggcacgctatccggtcattaccgtcaggaacatccgcaatga

SEQ ID NO: 3635 - DNA, 237 bp, Xenorhabdus bovienii
  Coding sequence Name=Xb4151_4152.C440.gene14.dna; Position on contig =9846..10082bp; Strand=+
atgacggaggcacaacgcactgcctttaccgtggcctcggggcattttgatatcacttttctgtatctggtctgcgtcggatttttcctggccaccctgtttctctgggcggcctgggccgcagtggatgtctggcacggctgggcgaatgaaaaaatacgtaaccagaccatcagccagtttgccctgcgaaccgccctcttactggtggtcgcggtctggatgtttgccagctga

SEQ ID NO: 3636 - DNA, 354 bp, Xenorhabdus bovienii
  Coding sequence Name=Xb4151_4152.C440.gene15.dna; Position on contig =9994..10347bp; Strand=+
atgaaaaaatacgtaaccagaccatcagccagtttgccctgcgaaccgccctcttactggtggtcgcggtctggatgtttgccagctgatgcaacgaacataatgaacaaggaatggattgaacatgaagccaatttttaccgtttgccgtcgtatcagtatgcacctgataaccagaataagtacctttcttttgctgtcgggtctttcctgtcaatcagcccgggccgatttgccggctatcgaaccgccaaaaagtggcggcgggggcggattactgggacaggtgaaaggctatgcgcaggatggcattgtgattggcgggctgatcctttcggccgtcgcgttctttaa

SEQ ID NO: 3637 - DNA, 417 bp, Xenorhabdus bovienii
  Coding sequence Name=Xb4151_4152.C440.gene16.dna; Position on contig =10268..10684bp; Strand=-
atgaacagcatacccgtcggtatcatgacccagccggctaacgggataaaaggaaggctcaccatcagcccgaacaccagccccagcaaagcggccagccccatttccggtgtggtgaatccccggaatacgatcggttcggcatttaagcgatcaggcaggaaagggatcgtctgcataaattgcaccttaaaaaataatgccggccgatttcgccagcagccaaatcaccgcaaccaacagcaccacaccgactacgatgatagaaccgaattgtgtccaggtggctttgccgtcccgcacttcggagaaggtttcaaccgccgccgacgcgaccttaaagaacgcgacggccgaaaggatcagcccgccaatcacaatgccatcctgcgcatagcctttcacctgtcccagtaa

SEQ ID NO: 3638 - DNA, 375 bp, Xenorhabdus bovienii
  Coding sequence Name=Xb4151_4152.C440.gene17.dna; Position on contig =10506..10880bp; Strand=+
atgcagacgatccctttcctgcctgatcgcttaaatgccgaaccgatcgtattccggggattcaccacaccggaaatggggctggccgctttgctggggctggtgttcgggctgatggtgagccttccttttatcccgttagccggctgggtcatgataccgacgggtatgctgttcatgcccttgttattgattagttttggtgggcgctggctcgcgcagcttaagcgcggcaaaccggaaaattatctctggctgacgctggaagagaaaaaacgccggctgggtatcggtgatcaggcattgattattgcggctcagggctggtcgttgcgccgaagcaggctgactcatcgtaacgggagcctgcgatga

(The sequence listing continues in the following parts.)

What is claimed is:

1. An isolated polynucleotide encoding a *Xenorhabdus* strain Xs85831 protein, wherein said protein comprises the amino acid sequence as set forth in SEQ ID NO:7316.

2. The isolated polynucleotide of claim 1, comprising the nucleotide sequence as set forth in SEQ ID NO:2003.

3. An isolated polynucleotide of claim 2, wherein said *Xenorhabdus* strain Xs85831 has an Agriculture Research Culture Collection (NRRL) deposit number 30311.

4. An isolated polynucleotide encoding a *Xenorhabdus* strain Xs85831 protein, wherein said protein is at least 95% identical to the amino acid sequence set forth in SEQ ID NO:7316, and exhibits insecticidal activity.

5. The isolated polynucleotide encoding a *Xenorhabdus* strain Xs85831 protein of claim 4, wherein said protein is at least 99% identical to the amino acid sequence set forth in SEQ ID NO:7316, and exhibits insecticidal activity.

6. The isolated polynucleotide encoding a *Xenorhabdus* strain Xs85831 protein of claim 4, wherein said protein is at least 98% identical to the amino acid sequence set forth in SEQ ID NO:7316, and exhibits insecticidal activity.

* * * * *